United States Patent 10,706,955 (BIOINFORMATIC PROCESSES FOR DETERMINATION OF PEPTIDE BINDING) - sequence listing, part 68

SEQ ID NO: 2588910 - protein, 23 aa, Entamoeba histolytica
TMTEIRQGPNLYSFKTINGQFKI

SEQ ID NO: 2588911 - protein, 19 aa, Entamoeba histolytica
TNANTFKKCIVSISQQISS

SEQ ID NO: 2588912 - protein, 17 aa, Entamoeba histolytica
TNCIIHSLTGLLYIGNS

SEQ ID NO: 2588913 - protein, 18 aa, Entamoeba histolytica
TNCLKYINSGHCVECKEG

SEQ ID NO: 2588914 - protein, 22 aa, Entamoeba histolytica
TNCLLYKYGRCVACENHFSFDS

SEQ ID NO: 2588915 - protein, 26 aa, Entamoeba histolytica
TNESSKMVKCWIEFIESKAMNISETF

SEQ ID NO: 2588916 - protein, 22 aa, Entamoeba histolytica
TNFKELFKMIGEEESNILKGII

SEQ ID NO: 2588917 - protein, 19 aa, Entamoeba histolytica
TNFLFWGIGSIIYIIFYIL

SEQ ID NO: 2588918 - protein, 26 aa, Entamoeba histolytica
TNFVLRQRFGLGIALYFDFLYYVLVS

SEQ ID NO: 2588919 - protein, 25 aa, Entamoeba histolytica
TNGEWYCIYPPFAFVQALERMNSDL

SEQ ID NO: 2588920 - protein, 21 aa, Entamoeba histolytica
TNHRLNILKLYSLRNNELTGN

SEQ ID NO: 2588921 - protein, 21 aa, Entamoeba histolytica
TNIFDTRFENIVIKNHSKKKW

SEQ ID NO: 2588922 - protein, 28 aa, Entamoeba histolytica
TNIKSRLRVSLLYTWCVILILNNVRIQD

SEQ ID NO: 2588923 - protein, 18 aa, Entamoeba histolytica
TNITFGLLSSDYKIQSLP

SEQ ID NO: 2588924 - protein, 25 aa, Entamoeba histolytica
TNKVECPYWLAPECIINKKACLKSD

SEQ ID NO: 2588925 - protein, 18 aa, Entamoeba histolytica
TNLKTEIALLLNSIVFFY

SEQ ID NO: 2588926 - protein, 27 aa, Entamoeba histolytica
TNLLDPRTVSIIFTCLLVISFVVALLL

SEQ ID NO: 2588927 - protein, 22 aa, Entamoeba histolytica
TNLNGISCTFIILSIGITFILF

SEQ ID NO: 2588928 - protein, 23 aa, Entamoeba histolytica
TNLPEWTTWTLLIGMACYDLVAV

SEQ ID NO: 2588929 - protein, 22 aa, Entamoeba histolytica
TNLRRFECIGMKEAFNAIGGIE

SEQ ID NO: 2588930 - protein, 22 aa, Entamoeba histolytica
TNLSREALLVWLIAETIAVTFV

SEQ ID NO: 2588931 - protein, 21 aa, Entamoeba histolytica
TNLVCPIDFSGKFTAEVPDYQ

SEQ ID NO: 2588932 - protein, 18 aa, Entamoeba histolytica
TNNCARIGVLVLILHDIV

SEQ ID NO: 2588933 - protein, 18 aa, Entamoeba histolytica
TNNDGTCVECLFSESAEK

SEQ ID NO: 2588934 - protein, 26 aa, Entamoeba histolytica
TNNDYNVIFGMFKDFVEKVVTSTGTN

SEQ ID NO: 2588935 - protein, 18 aa, Entamoeba histolytica
TNNWKYPMHFTFHSGDYT

SEQ ID NO: 2588936 - protein, 24 aa, Entamoeba histolytica
TNQIKRLHVFGEILAENGYLVRSD

SEQ ID NO: 2588937 - protein, 18 aa, Entamoeba histolytica
TNQIPTFVSDWFNNAPLN

SEQ ID NO: 2588938 - protein, 18 aa, Entamoeba histolytica
TNSLLRRLPGGTCKSICN

SEQ ID NO: 2588939 - protein, 19 aa, Entamoeba histolytica
TNSTMGIWIKSCEQHIIHS

SEQ ID NO: 2588940 - protein, 17 aa, Entamoeba histolytica
TNTIKCYQNTFSTLSGA

SEQ ID NO: 2588941 - protein, 24 aa, Entamoeba histolytica
TNTIQNIYINIHLIAETLSESVPA

SEQ ID NO: 2588942 - protein, 19 aa, Entamoeba histolytica
TNTKCLECLFHSYINQEEC

SEQ ID NO: 2588943 - protein, 24 aa, Entamoeba histolytica
TNVFLEMFQNFGIVTEPNHMFWGQ

SEQ ID NO: 2588944 - protein, 24 aa, Entamoeba histolytica
TNVSLCSEFICYCSDLDIVELSVI

SEQ ID NO: 2588945 - protein, 25 aa, Entamoeba histolytica
TNYKCLKCGLGCLFCEDDSGDCLSC

SEQ ID NO: 2588946 - protein, 25 aa, Entamoeba histolytica
TPAPHLPPSFPLSVTVPDNYSNPIQ

SEQ ID NO: 2588947 - protein, 24 aa, Entamoeba histolytica
TPDPKECRSCYGAETPEKKCCFTC

SEQ ID NO: 2588948 - protein, 25 aa, Entamoeba histolytica
TPDPVLIPFWKIWFDALKDKTLIIL

SEQ ID NO: 2588949 - protein, 23 aa, Entamoeba histolytica
TPEAPASQHGPTPVEGGSVTTGG

SEQ ID NO: 2588950 - protein, 24 aa, Entamoeba histolytica
TPERDFNKYFILYLACVLMLIQTN

SEQ ID NO: 2588951 - protein, 21 aa, Entamoeba histolytica
TPESLSLVFQKERMIPQTKIE

SEQ ID NO: 2588952 - protein, 21 aa, Entamoeba histolytica
TPFIYKNFYVVQSRFLDFLLS

SEQ ID NO: 2588953 - protein, 20 aa, Entamoeba histolytica
TPFMLITVLFLGFFATKFTA

SEQ ID NO: 2588954 - protein, 24 aa, Entamoeba histolytica
TPFSGPWSRIEVTGAVFIISLLLF

SEQ ID NO: 2588955 - protein, 20 aa, Entamoeba histolytica
TPGSIYMRTRVLGSDHKGFV

SEQ ID NO: 2588956 - protein, 17 aa, Entamoeba histolytica
TPINMNIVFAFVAGNQV

SEQ ID NO: 2588957 - protein, 18 aa, Entamoeba histolytica
TPITIIWENGERLTVNYK

SEQ ID NO: 2588958 - protein, 18 aa, Entamoeba histolytica
TPITIIWENGERLTVNYN

SEQ ID NO: 2588959 - protein, 19 aa, Entamoeba histolytica
TPKLITWVDELMKYKNFII

SEQ ID NO: 2588960 - protein, 17 aa, Entamoeba histolytica
TPKVWLLGYDEDHKPLT

SEQ ID NO: 2588961 - protein, 20 aa, Entamoeba histolytica
TPLSNFEAGMAYRDVPDPAV

SEQ ID NO: 2588962 - protein, 19 aa, Entamoeba histolytica
TPMKSLCEKYMIQLVEKPN

SEQ ID NO: 2588963 - protein, 31 aa, Entamoeba histolytica
TPRMVKVCDITEPFVPLAPKNFFKPISEVIE

SEQ ID NO: 2588964 - protein, 22 aa, Entamoeba histolytica
TPSEIKQLIFINGSYTNSLDLT

SEQ ID NO: 2588965 - protein, 28 aa, Entamoeba histolytica
TPSFYGRRVRTCFVKIILQLSLPLTIII

SEQ ID NO: 2588966 - protein, 24 aa, Entamoeba histolytica
TPYNWKYFPTPAFYAYVASNFIAD

SEQ ID NO: 2588967 - protein, 25 aa, Entamoeba histolytica
TQCGHTFCWKCIKDKVPGYCPFCGN

SEQ ID NO: 2588968 - protein, 19 aa, Entamoeba histolytica
TQEIYYWSIILIKLLMFIL

SEQ ID NO: 2588969 - protein, 25 aa, Entamoeba histolytica
TQFKWMRREIGIGFNGEIKYGDWEI

SEQ ID NO: 2588970 - protein, 19 aa, Entamoeba histolytica
TQIGKELHSQPVVPTVQHE

SEQ ID NO: 2588971 - protein, 18 aa, Entamoeba histolytica
TQIPFSLKMKSNDKLLHS

SEQ ID NO: 2588972 - protein, 24 aa, Entamoeba histolytica
TQIPMYCAFSFLVIAGGKTVLLTN

SEQ ID NO: 2588973 - protein, 22 aa, Entamoeba histolytica
TQKFPFNAHFTFFVLAVIPFIN

SEQ ID NO: 2588974 - protein, 17 aa, Entamoeba histolytica
TQKSSAVSIPIKIQIPS

SEQ ID NO: 2588975 - protein, 18 aa, Entamoeba histolytica
TQLDFSWSQSDDIPLEIL

SEQ ID NO: 2588976 - protein, 32 aa, Entamoeba histolytica
TQLPFGRDPQQAFCPRCNMTVTTVVKYEAGGM

SEQ ID NO: 2588977 - protein, 25 aa, Entamoeba histolytica
TQQELKKGITLIGFRLSDFNNDITQ

SEQ ID NO: 2588978 - protein, 23 aa, Entamoeba histolytica
TQRMCSNPSKYSFQMKKVLLNSG

SEQ ID NO: 2588979 - protein, 20 aa, Entamoeba histolytica
TQRSCFYGKHILKLKNKSVI

SEQ ID NO: 2588980 - protein, 21 aa, Entamoeba histolytica
TQWCKARGFKDGILINTKVSK

SEQ ID NO: 2588981 - protein, 21 aa, Entamoeba histolytica
TQWGVCILLGLVSLPLGLLNG

SEQ ID NO: 2588982 - protein, 25 aa, Entamoeba histolytica
TQWTYRRSVILLGFIVTVILYLVMA

SEQ ID NO: 2588983 - protein, 18 aa, Entamoeba histolytica
TQYAICTKAKALGEEILN

SEQ ID NO: 2588984 - protein, 17 aa, Entamoeba histolytica
TQYSDAIDIFFKVIQTW

SEQ ID NO: 2588985 - protein, 17 aa, Entamoeba histolytica
TQYVYGIYFDVPVQNSS

SEQ ID NO: 2588986 - protein, 17 aa, Entamoeba histolytica
TRALLYFSSLCREKDEL

SEQ ID NO: 2588987 - protein, 21 aa, Entamoeba histolytica
TRATGIFPLKHCNIELQTYPI

SEQ ID NO: 2588988 - protein, 18 aa, Entamoeba histolytica
TRCILKIQISVHIFFLVA

SEQ ID NO: 2588989 - protein, 25 aa, Entamoeba histolytica
TRCTITNLYHCIKIISHFSGTEKSN

SEQ ID NO: 2588990 - protein, 20 aa, Entamoeba histolytica
TRDCTGCQPGYMWFGEGNCS

SEQ ID NO: 2588991 - protein, 20 aa, Entamoeba histolytica
TRECKTCSLTETKEKVEEID

SEQ ID NO: 2588992 - protein, 25 aa, Entamoeba histolytica
TRELAVQINEHFKKLIKYLPQFTSL

SEQ ID NO: 2588993 - protein, 25 aa, Entamoeba histolytica
TRELDASGIGIRWQQSLDPGLVDSL

SEQ ID NO: 2588994 - protein, 17 aa, Entamoeba histolytica
TRFAMTFTFGNILIFIG

SEQ ID NO: 2588995 - protein, 18 aa, Entamoeba histolytica
TRFNCYAHVWDIHLREYY

SEQ ID NO: 2588996 - protein, 24 aa, Entamoeba histolytica
TRFYCGAITFKTCSSRTTEDDCIR

SEQ ID NO: 2588997 - protein, 22 aa, Entamoeba histolytica
TRIKRIIVNIIIDNSMLDILKN

SEQ ID NO: 2588998 - protein, 17 aa, Entamoeba histolytica
TRIWKKDNSDYILIVNN

SEQ ID NO: 2588999 - protein, 21 aa, Entamoeba histolytica
TRKIWGFCILTISFILNNIGF

SEQ ID NO: 2589000 - protein, 24 aa, Entamoeba histolytica
TRKLAIPLMVDLCTKRCYCKSLII

SEQ ID NO: 2589001 - protein, 28 aa, Entamoeba histolytica
TRKVKCPASRGLDCKAIPLASQIYLTHP

SEQ ID NO: 2589002 - protein, 22 aa, Entamoeba histolytica
TRLCSKSKIKLHEIPQLPEYIK

SEQ ID NO: 2589003 - protein, 25 aa, Entamoeba histolytica
TRLVKAYFLMCEIIEFNETKENEEG

SEQ ID NO: 2589004 - protein, 26 aa, Entamoeba histolytica
TRNCKLCDVNSCFSCLENSYLSKGIC

SEQ ID NO: 2589005 - protein, 17 aa, Entamoeba histolytica
TRNICLCIFFDGVDLLC

SEQ ID NO: 2589006 - protein, 23 aa, Entamoeba histolytica
TRQETCPICKSKVTVDSVIPIYN

SEQ ID NO: 2589007 - protein, 22 aa, Entamoeba histolytica
TRSDGSASFVVRGMENVKGDIE

SEQ ID NO: 2589008 - protein, 18 aa, Entamoeba histolytica
TRSFICPFTRNFNFPQMY

SEQ ID NO: 2589009 - protein, 17 aa, Entamoeba histolytica
TRSGKYILYSFSDLIGL

SEQ ID NO: 2589010 - protein, 19 aa, Entamoeba histolytica
TRTAGFSIINVRDLSPPVI

SEQ ID NO: 2589011 - protein, 25 aa, Entamoeba histolytica
TRTFLYKQKMRIHRVELELEVFKGH

SEQ ID NO: 2589012 - protein, 17 aa, Entamoeba histolytica
TRVEPVVQFMLTPQQSV

SEQ ID NO: 2589013 - protein, 24 aa, Entamoeba histolytica
TRYEIFGILACSFFGIERSKICHT

SEQ ID NO: 2589014 - protein, 19 aa, Entamoeba histolytica
TSAFQKYPLFLLAVISLIG

SEQ ID NO: 2589015 - protein, 26 aa, Entamoeba histolytica
TSAYCSGCSYDSPDVCFYCIDQYILE

SEQ ID NO: 2589016 - protein, 37 aa, Entamoeba histolytica
TSCKVCPDGFFPYPDRSRCFTCQAGMELAASGCKDCQ

SEQ ID NO: 2589017 - protein, 21 aa, Entamoeba histolytica
TSCLFNLIIPKSFTSGTLKLY

SEQ ID NO: 2589018 - protein, 20 aa, Entamoeba histolytica
TSCLYCKWTDVTDDINEAFI

SEQ ID NO: 2589019 - protein, 18 aa, Entamoeba histolytica
TSCNLCGSGMTIDNGICQ

SEQ ID NO: 2589020 - protein, 22 aa, Entamoeba histolytica
TSCVLCSPGYWFNGNSCVKCNE

SEQ ID NO: 2589021 - protein, 25 aa, Entamoeba histolytica
TSCYFPIPLFYQFFQRREFPRCGTC

SEQ ID NO: 2589022 - protein, 23 aa, Entamoeba histolytica
TSDEEMKRVLKLVNSVNELDDVV

SEQ ID NO: 2589023 - protein, 23 aa, Entamoeba histolytica
TSDFHLALFVLRLLLSKRNELKD

SEQ ID NO: 2589024 - protein, 18 aa, Entamoeba histolytica
TSDNFFVYFSYIMMLFNN

SEQ ID NO: 2589025 - protein, 24 aa, Entamoeba histolytica
TSELKRLQIGFAKNNMYVLNNGNV

SEQ ID NO: 2589026 - protein, 25 aa, Entamoeba histolytica
TSERIESIISFDFVNKVFNYSEISV

SEQ ID NO: 2589027 - protein, 18 aa, Entamoeba histolytica
TSFELVRLFYDCQIPYIM

SEQ ID NO: 2589028 - protein, 24 aa, Entamoeba histolytica
TSFHPETWTPVWSISSMLEAIRAF

SEQ ID NO: 2589029 - protein, 18 aa, Entamoeba histolytica
TSFKRPNLFQQYIREDNE

SEQ ID NO: 2589030 - protein, 21 aa, Entamoeba histolytica
TSFYEYFEWNLDYNKESNPRE

SEQ ID NO: 2589031 - protein, 17 aa, Entamoeba histolytica
TSFYSLWVYVFEIEQQV

SEQ ID NO: 2589032 - protein, 18 aa, Entamoeba histolytica
TSGCGKDCLCKKGYTANG

SEQ ID NO: 2589033 - protein, 19 aa, Entamoeba histolytica
TSGCSRCSIGFYLNKGKCL

SEQ ID NO: 2589034 - protein, 26 aa, Entamoeba histolytica
TSGKPEVPEPSVASGKNSEKPPQPTS

SEQ ID NO: 2589035 - protein, 22 aa, Entamoeba histolytica
TSHIPQTFILNGKLTFSKTTSA

SEQ ID NO: 2589036 - protein, 22 aa, Entamoeba histolytica
TSIILCILNWVAMVMLSQRQHN

SEQ ID NO: 2589037 - protein, 22 aa, Entamoeba histolytica
TSIKANTPWPSKVNFLNTLSSL

SEQ ID NO: 2589038 - protein, 27 aa, Entamoeba histolytica
TSILHLWLMVSIPKFDITKSFKSQICY

SEQ ID NO: 2589039 - protein, 18 aa, Entamoeba histolytica
TSIMPPFISFIIKLIGSH

SEQ ID NO: 2589040 - protein, 25 aa, Entamoeba histolytica
TSKNCSSCSFGYYFNDEGICEYIGE

SEQ ID NO: 2589041 - protein, 18 aa, Entamoeba histolytica
TSKSYPLLLPDVINLITL

SEQ ID NO: 2589042 - protein, 18 aa, Entamoeba histolytica
TSLEVIKVLSAHEIAESM

SEQ ID NO: 2589043 - protein, 27 aa, Entamoeba histolytica
TSLHLEDACDFTWKIMQGELDSIKCLH

SEQ ID NO: 2589044 - protein, 21 aa, Entamoeba histolytica
TSLKNKTGFILLNRNLPFVVI

SEQ ID NO: 2589045 - protein, 17 aa, Entamoeba histolytica
TSLLVILDRCFDGYTPL

SEQ ID NO: 2589046 - protein, 17 aa, Entamoeba histolytica
TSLQVPIHFDRMDSSKS

SEQ ID NO: 2589047 - protein, 24 aa, Entamoeba histolytica
TSLSKKELQGFCDLLNGKENNFTL

SEQ ID NO: 2589048 - protein, 19 aa, Entamoeba histolytica
TSNEEFKYHLVITEENMQN

SEQ ID NO: 2589049 - protein, 17 aa, Entamoeba histolytica
TSPNLDGIFAYYEKTEL

SEQ ID NO: 2589050 - protein, 21 aa, Entamoeba histolytica
TSQWKELWVDLYYDEIVIRSD

SEQ ID NO: 2589051 - protein, 22 aa, Entamoeba histolytica
TSSNLGGLVAQWSSHHVTKLKK

SEQ ID NO: 2589052 - protein, 19 aa, Entamoeba histolytica
TSSTKCAVPTCGNGKIDVY

SEQ ID NO: 2589053 - protein, 19 aa, Entamoeba histolytica
TSTRYENYDALSFTTDAIQ

SEQ ID NO: 2589054 - protein, 19 aa, Entamoeba histolytica
TSVFNKGLILFLQYYIHQH

SEQ ID NO: 2589055 - protein, 26 aa, Entamoeba histolytica
TSVHLKLRFCQDISRGMLYLHENNII

SEQ ID NO: 2589056 - protein, 19 aa, Entamoeba histolytica
TSVIQRSFVYEIFLGSLPL

SEQ ID NO: 2589057 - protein, 18 aa, Entamoeba histolytica
TSVSGAAVAPVDWEIKEV

SEQ ID NO: 2589058 - protein, 21 aa, Entamoeba histolytica
TSYKYSFKYFSLQQRINFTIL

SEQ ID NO: 2589059 - protein, 17 aa, Entamoeba histolytica
TSYTCASHCLAGYEQDN

SEQ ID NO: 2589060 - protein, 18 aa, Entamoeba histolytica
TTCFSSATYCMGCSSDKY

SEQ ID NO: 2589061 - protein, 18 aa, Entamoeba histolytica
TTCGIPFCVYCPEYYNDK

SEQ ID NO: 2589062 - protein, 18 aa, Entamoeba histolytica
TTCPYDCLNGVCSVSKGG

SEQ ID NO: 2589063 - protein, 20 aa, Entamoeba histolytica
TTDSDSFCLFGISKNNQNIC

SEQ ID NO: 2589064 - protein, 19 aa, Entamoeba histolytica
TTFWQYRTPPVNSIHEVLT

SEQ ID NO: 2589065 - protein, 25 aa, Entamoeba histolytica
TTGCAFTYPFAWLAGAKIMTYTHYP

SEQ ID NO: 2589066 - protein, 17 aa, Entamoeba histolytica
TTILCWTAIPFLQSYCS

SEQ ID NO: 2589067 - protein, 17 aa, Entamoeba histolytica
TTIWDRWRPTTFTDDII

SEQ ID NO: 2589068 - protein, 19 aa, Entamoeba histolytica
TTKGSIGWQAPEMLDDSCP

SEQ ID NO: 2589069 - protein, 24 aa, Entamoeba histolytica
TTKQWLLSFCCKLLSNKLSENDTI

SEQ ID NO: 2589070 - protein, 23 aa, Entamoeba histolytica
TTKTPRFEQVLTLNATTNTFNGN

SEQ ID NO: 2589071 - protein, 23 aa, Entamoeba histolytica
TTLFLEEFIRIVFIGHPDRTTSF

SEQ ID NO: 2589072 - protein, 24 aa, Entamoeba histolytica
TTLIGYPFFIVYIIAAGLGIFIEG

SEQ ID NO: 2589073 - protein, 25 aa, Entamoeba histolytica
TTLILFFICVCIIIGILFIIQPDYA

SEQ ID NO: 2589074 - protein, 17 aa, Entamoeba histolytica
TTLLTQVMNPYGFYIGT

SEQ ID NO: 2589075 - protein, 17 aa, Entamoeba histolytica
TTLPNICINKKPYSPFE

SEQ ID NO: 2589076 - protein, 25 aa, Entamoeba histolytica
TTLQSILKNMCELYKLLYTIPQFQK

SEQ ID NO: 2589077 - protein, 17 aa, Entamoeba histolytica
TTLSFPAAYFTFKGTGT

SEQ ID NO: 2589078 - protein, 23 aa, Entamoeba histolytica
TTLYIPYLFLFGWNIVSIEDHYN

SEQ ID NO: 2589079 - protein, 18 aa, Entamoeba histolytica
TTMCGVYVNAGRENSVAS

SEQ ID NO: 2589080 - protein, 19 aa, Entamoeba histolytica
TTMIGWNCFLQVGSNMLIT

SEQ ID NO: 2589081 - protein, 25 aa, Entamoeba histolytica
TTMPEKKLNMFIKFCDIIKTLHTKL

SEQ ID NO: 2589082 - protein, 23 aa, Entamoeba histolytica
TTNLCGTLAWIAPEILQNKPFGI

SEQ ID NO: 2589083 - protein, 17 aa, Entamoeba histolytica
TTPLFKKTALYLVDALR

SEQ ID NO: 2589084 - protein, 18 aa, Entamoeba histolytica
TTPVLSFILSVTSLLIAN

SEQ ID NO: 2589085 - protein, 29 aa, Entamoeba histolytica
TTQLKLGAGVYRLSLLVHESLKISKEFFS

SEQ ID NO: 2589086 - protein, 25 aa, Entamoeba histolytica
TTQLKRLHVFGEIFAENGYLVRSDA

SEQ ID NO: 2589087 - protein, 24 aa, Entamoeba histolytica
TTQLKVRICQDIARGMNYLHQNNI

SEQ ID NO: 2589088 - protein, 21 aa, Entamoeba histolytica
TTSESFLCYLIPQNVDEMQEI

SEQ ID NO: 2589089 - protein, 17 aa, Entamoeba histolytica
TTSMFIILCATIILLFF

SEQ ID NO: 2589090 - protein, 30 aa, Entamoeba histolytica; identical to SEQ ID NO: 2391413

SEQ ID NO: 2589091 - protein, 25 aa, Entamoeba histolytica
TTTHLKRLFLLWGFSLSILLMIYGI

SEQ ID NO: 2589092 - protein, 26 aa, Entamoeba histolytica
TTTLWFKFIGVRVIFVGIIFITLCCF

SEQ ID NO: 2589093 - protein, 20 aa, Entamoeba histolytica
TTTRCSFIPLFNPKEYSDQK

SEQ ID NO: 2589094 - protein, 26 aa, Entamoeba histolytica
TTTSSLYFKFIDQFPDAPICEFGEVF

SEQ ID NO: 2589095 - protein, 19 aa, Entamoeba histolytica
TTVDPFIALLGRMIPSPHL

SEQ ID NO: 2589096 - protein, 19 aa, Entamoeba histolytica
TTVGMFLMHFCFFVLSERQ

SEQ ID NO: 2589097 - protein, 19 aa, Entamoeba histolytica
TTYLLKLLPLFIFTLFIQL

SEQ ID NO: 2589098 - protein, 35 aa, Entamoeba histolytica
TTYSNSLVDRWLCLRVDCIGAFVMFGSVIAASLGG

SEQ ID NO: 2589099 - protein, 19 aa, Entamoeba histolytica
TVCPYNCLNGVCSVSKGGC

SEQ ID NO: 2589100 - protein, 21 aa, Entamoeba histolytica
TVCVILPFVILFFIATPKLDL

SEQ ID NO: 2589101 - protein, 24 aa, Entamoeba histolytica
TVEIEYSIIMSILYIEDVLENIRV

SEQ ID NO: 2589102 - protein, 25 aa, Entamoeba histolytica
TVFPGLMFTSAFIFKFLAYFNLIID

SEQ ID NO: 2589103 - protein, 18 aa, Entamoeba histolytica
TVFTDVWLPNDIDTNTDF

SEQ ID NO: 2589104 - protein, 19 aa, Entamoeba histolytica
TVFTTRYAKYVLKSSNQTA

SEQ ID NO: 2589105 - protein, 17 aa, Entamoeba histolytica
TVGHAALALGLIFQGTM

SEQ ID NO: 2589106 - protein, 23 aa, Entamoeba histolytica
TVGNKGAYVLLSFDENTKPITKI

SEQ ID NO: 2589107 - protein, 29 aa, Entamoeba histolytica
TVHIPKYFVKDSFLGWKYVDFNNSKFNPD

SEQ ID NO: 2589108 - protein, 28 aa, Entamoeba histolytica
TVHRPECAIPFKYSLPIESLAKEMTLIN

SEQ ID NO: 2589109 - protein, 19 aa, Entamoeba histolytica
TVHSNLCLCKQAIRSLRII

SEQ ID NO: 2589110 - protein, 23 aa, Entamoeba histolytica
TVHTAFCLFSIIIYYAGKMYAHR

SEQ ID NO: 2589111 - protein, 23 aa, Entamoeba histolytica
TVIKRFIGCLIIYIPIPDNSINT

SEQ ID NO: 2589112 - protein, 19 aa, Entamoeba histolytica
TVIPGIIFLWKVIIKPLLF

SEQ ID NO: 2589113 - protein, 21 aa, Entamoeba histolytica
TVISVFCFILSLIAFIYQFVF

SEQ ID NO: 2589114 - protein, 19 aa, Entamoeba histolytica
TVKEHWKYGINITSTLPIT

SEQ ID NO: 2589115 - protein, 24 aa, Entamoeba histolytica
TVKQADCNFHYPPFLYTLKKNETS

SEQ ID NO: 2589116 - protein, 24 aa, Entamoeba histolytica
TVKQCRNSTCPACYQICKNGAIST

SEQ ID NO: 2589117 - protein, 25 aa, Entamoeba histolytica
TVLLTCPIFYYFRFCKELFVSDLTP

SEQ ID NO: 2589118 - protein, 21 aa, Entamoeba histolytica
TVLSLRLPILTVVSHDDNYAE

SEQ ID NO: 2589119 - protein, 17 aa, Entamoeba histolytica
TVMKACCDKLFEQTKID

SEQ ID NO: 2589120 - protein, 17 aa, Entamoeba histolytica
TVPESYLITGYETMGDG

SEQ ID NO: 2589121 - protein, 25 aa, Entamoeba histolytica
TVSFKEKYGRMALLKMTELKEPKRG

SEQ ID NO: 2589122 - protein, 20 aa, Entamoeba histolytica
TVSTIRLKYYGTWKLTESLG

SEQ ID NO: 2589123 - protein, 18 aa, Entamoeba histolytica
TVSWKRYVDDDCTVNNPV

SEQ ID NO: 2589124 - protein, 23 aa, Entamoeba histolytica
TVSYKIIRIHTGFNTVDLILCCC

SEQ ID NO: 2589125 - protein, 20 aa, Entamoeba histolytica
TVTCIKEWIEEYGRIKKEEE

SEQ ID NO: 2589126 - protein, 31 aa, Entamoeba histolytica
TVTLPSFMVICFYVCLSFIIDRHIVIVINNI

SEQ ID NO: 2589127 - protein, 23 aa, Entamoeba histolytica
TVTLRLILIIVFHLVSIKCSIFE

SEQ ID NO: 2589128 - protein, 25 aa, Entamoeba histolytica
TVVKALKRRGEVVAMTGDGVNDAPA

SEQ ID NO: 2589129 - protein, 20 aa, Entamoeba histolytica
TVVLKFKVILIVILQKQGYN

SEQ ID NO: 2589130 - protein, 22 aa, Entamoeba histolytica
TVVVDCLFVVWIYWNKSNIEEW

SEQ ID NO: 2589131 - protein, 17 aa, Entamoeba histolytica
TWACIIIGYIPPVLTIL

SEQ ID NO: 2589132 - protein, 17 aa, Entamoeba histolytica
TWARRISLILGITYGLG

SEQ ID NO: 2589133 - protein, 19 aa, Entamoeba histolytica
TWVKWETGWSLGYKAEQWE

SEQ ID NO: 2589134 - protein, 26 aa, Entamoeba histolytica
TYCGCAVGGSWNCAIMRELAKVYCSE

SEQ ID NO: 2589135 - protein, 22 aa, Entamoeba histolytica
TYCMSCKGNAILSNHTCFNDYK

SEQ ID NO: 2589136 - protein, 22 aa, Entamoeba histolytica
TYDIKSSIIAGKRPELKLPMPQ

SEQ ID NO: 2589137 - protein, 24 aa, Entamoeba histolytica
TYEKHVWPSLLFMVLITFLLSVVI

SEQ ID NO: 2589138 - protein, 25 aa, Entamoeba histolytica
TYFEFRGVNVLTEYSQEITIVNTGK

SEQ ID NO: 2589139 - protein, 20 aa, Entamoeba histolytica
TYGCLQCMRGYFFNSNLECE

SEQ ID NO: 2589140 - protein, 26 aa, Entamoeba histolytica
TYGFQRVEPLLGFINGFFLVLFSAFT

SEQ ID NO: 2589141 - protein, 31 aa, Entamoeba histolytica
TYHYQECREIMDFLYKRLCEDGKNWREIYKS

SEQ ID NO: 2589142 - protein, 18 aa, Entamoeba histolytica
TYIILSILLFIISFNQMR

SEQ ID NO: 2589143 - protein, 25 aa, Entamoeba histolytica
TYILYRPIYQWIFQRVTEVYMMYFP

SEQ ID NO: 2589144 - protein, 19 aa, Entamoeba histolytica
TYISWEMEDRPYLYLYQNV

SEQ ID NO: 2589145 - protein, 20 aa, Entamoeba histolytica
TYLPPLFIQRNYSIKCIVSE

SEQ ID NO: 2589146 - protein, 18 aa, Entamoeba histolytica
TYRMCGIECIDRFKDSTP

SEQ ID NO: 2589147 - protein, 18 aa, Entamoeba histolytica
TYRRCIKVTNDGKEIESE

SEQ ID NO: 2589148 - protein, 18 aa, Entamoeba histolytica
TYSCLKCENRRCLENILG

SEQ ID NO: 2589149 - protein, 23 aa, Entamoeba histolytica
TYSKLCWFDSIKIGSLSNTKLSV

SEQ ID NO: 2589150 - protein, 37 aa, Entamoeba histolytica
TYSLIKRLMLIGILFFPFHLVVCYLFRNSNDKRIQRI

SEQ ID NO: 2589151 - protein, 29 aa, Entamoeba histolytica
TYTPSWKSIVIPLLIGFIVPLISNIIPIK

SEQ ID NO: 2589152 - protein, 25 aa, Entamoeba histolytica
TYTRCGLCLEITGPSLLTTTCTVVG

SEQ ID NO: 2589153 - protein, 19 aa, Entamoeba histolytica
TYYTLPFVYEIRTILDWCL

SEQ ID NO: 2589154 - protein, 23 aa, Entamoeba histolytica
VADSKRIKYKWNQFQLKNKTYIY

SEQ ID NO: 2589155 - protein, 22 aa, Entamoeba histolytica
VAEALCSLSNIIVKMKVGVDDF

SEQ ID NO: 2589156 - protein, 24 aa, Entamoeba histolytica
VAFCSNCKCEYGYSYDKEKNACNP

SEQ ID NO: 2589157 - protein, 19 aa, Entamoeba histolytica
VAFITAIISKCCDFLNAPT

SEQ ID NO: 2589158 - protein, 19 aa, Entamoeba histolytica
VAFSGLFLAGVIVLDLFAF

SEQ ID NO: 2589159 - protein, 28 aa, Entamoeba histolytica
VAIKGTFPFIWIFLVFASICYWASNQFA

SEQ ID NO: 2589160 - protein, 17 aa, Entamoeba histolytica
VAKKKIIMCASGLSSVN

SEQ ID NO: 2589161 - protein, 22 aa, Entamoeba histolytica
VAKTDAGLWYLLKRSSDIVNEK

SEQ ID NO: 2589162 - protein, 19 aa, Entamoeba histolytica
VALDLGIKRIYIPTFLIYP

SEQ ID NO: 2589163 - protein, 22 aa, Entamoeba histolytica
VALFCLCFYWAGLFFVICFWIM

SEQ ID NO: 2589164 - protein, 20 aa, Entamoeba histolytica
VALFGVCVYAFGYIPFQYIK

SEQ ID NO: 2589165 - protein, 24 aa, Entamoeba histolytica
VALGMVYCVFGFLKHTSMVVSPPK

SEQ ID NO: 2589166 - protein, 18 aa, Entamoeba histolytica
VALMFRFFQAFWDCNKKT

SEQ ID NO: 2589167 - protein, 18 aa, Entamoeba histolytica
VAMSIPLIFAWTKTSTQP

SEQ ID NO: 2589168 - protein, 27 aa, Entamoeba histolytica
VAPCNIIPFRAKHCGAQVAFINCSKTP

SEQ ID NO: 2589169 - protein, 17 aa, Entamoeba histolytica
VAQVCWFIANSNLPYVV

SEQ ID NO: 2589170 - protein, 21 aa, Entamoeba histolytica
VARFHFKLAKRTTAVKTLKLK

SEQ ID NO: 2589171 - protein, 27 aa, Entamoeba histolytica
VARLTSCLLKTFPAVVISNIIKNSPTK

SEQ ID NO: 2589172 - protein, 28 aa, Entamoeba histolytica
VASIVPVCIMLGFSCIRELLDEFRKFRA

SEQ ID NO: 2589173 - protein, 25 aa, Entamoeba histolytica
VASTFGCPIGGLLFSVEVTATYYPV

SEQ ID NO: 2589174 - protein, 18 aa, Entamoeba histolytica
VASYCEPGYKFDRFNNKC

SEQ ID NO: 2589175 - protein, 24 aa, Entamoeba histolytica
VATSNFRKVLFGILFLLHYLCLKK

SEQ ID NO: 2589176 - protein, 23 aa, Entamoeba histolytica
VAVFAVSLIGAWNDYSKQSKFIE

SEQ ID NO: 2589177 - protein, 19 aa, Entamoeba histolytica
VAVKRLVKEFYSIAQHEVE

SEQ ID NO: 2589178 - protein, 24 aa, Entamoeba histolytica
VAVMFPVVWSAYWGKDPYGAERGK

SEQ ID NO: 2589179 - protein, 32 aa, Entamoeba histolytica
VAVSHILLCISLFKIQIQPAINHLKSAAYIFN

SEQ ID NO: 2589180 - protein, 25 aa, Entamoeba histolytica
VAYSEDFFAILFFPIEHKIACLLPL

SEQ ID NO: 2589181 - protein, 21 aa, Entamoeba histolytica
VAYSIQWIGVFALSKASYSVF

SEQ ID NO: 2589182 - protein, 17 aa, Entamoeba histolytica
VCAVFLSLSFNEAICSE

SEQ ID NO: 2589183 - protein, 18 aa, Entamoeba histolytica
VCGCKWSNEELVFISPVA

SEQ ID NO: 2589184 - protein, 19 aa, Entamoeba histolytica
VCGEFGKYLQLHVSSSESI

SEQ ID NO: 2589185 - protein, 23 aa, Entamoeba histolytica
VCIAYAGAMISMFIVVIFLILSI

SEQ ID NO: 2589186 - protein, 17 aa, Entamoeba histolytica
VCIFYSMYLFVHEEPTR

SEQ ID NO: 2589187 - protein, 23 aa, Entamoeba histolytica
VCIGYRYNCAIDMWSFGCMVAEM

SEQ ID NO: 2589188 - protein, 24 aa, Entamoeba histolytica
VCIGYRYNCAIDMWSFGCMVAEMF

SEQ ID NO: 2589189 - protein, 27 aa, Entamoeba histolytica
VCIINISLTLFFLWKVILMAIFFILQV

SEQ ID NO: 2589190 - protein, 29 aa, Entamoeba histolytica
VCLALNFIKNGWVCLIFAIPTGFISGLDL

SEQ ID NO: 2589191 - protein, 17 aa, Entamoeba histolytica
VCLIGLIAIVIEQDQSL

SEQ ID NO: 2589192 - protein, 18 aa, Entamoeba histolytica
VCNLKPSKLRGVASEAMI

SEQ ID NO: 2589193 - protein, 24 aa, Entamoeba histolytica
VCNSGMKCALKFVMNKPVNCSGIK

SEQ ID NO: 2589194 - protein, 18 aa, Entamoeba histolytica
VCPLCKQPILQSKTNYGK

SEQ ID NO: 2589195 - protein, 23 aa, Entamoeba histolytica
VCSEEGCELCQSPFILNDKKECI

SEQ ID NO: 2589196 - protein, 27 aa, Entamoeba histolytica
VCSFSKNNICLKCPQGKMIDSDHTGCS

SEQ ID NO: 2589197 - protein, 19 aa, Entamoeba histolytica
VCSIPYCEKCNKNGYCQEC

SEQ ID NO: 2589198 - protein, 20 aa, Entamoeba histolytica
VCSKAGGPILYYPDPNKISS

SEQ ID NO: 2589199 - protein, 22 aa, Entamoeba histolytica
VCSQCKGFCSLTHGGCLCNGVS

SEQ ID NO: 2589200 - protein, 21 aa, Entamoeba histolytica
VCSQFALGLVLRGSSISVTYG

SEQ ID NO: 2589201 - protein, 20 aa, Entamoeba histolytica
VCSSIYPILFINCIDSSSEN

SEQ ID NO: 2589202 - protein, 25 aa, Entamoeba histolytica
VCSVICSFLGALAWWYPKPWPESYW

SEQ ID NO: 2589203 - protein, 18 aa, Entamoeba histolytica
VCTTCSGLATAIGGIVVY

SEQ ID NO: 2589204 - protein, 30 aa, Entamoeba histolytica
VCVKKFFKSKAGIILGCVIGVVLLLIIIAI

SEQ ID NO: 2589205 - protein, 17 aa, Entamoeba histolytica
VCVSLTFIAFILSVIFL

SEQ ID NO: 2589206 - protein, 17 aa, Entamoeba histolytica
VCVVILFIICGTLSITL

SEQ ID NO: 2589207 - protein, 30 aa, Entamoeba histolytica
VCYFTYSYIYRKGEKWYLPDTDNVWKQTVL

SEQ ID NO: 2589208 - protein, 19 aa, Entamoeba histolytica
VCYFVCVIGGFIPFFIKLL

SEQ ID NO: 2589209 - protein, 22 aa, Entamoeba histolytica
VDAGAAVAYVGRWFTQNPSDWA

SEQ ID NO: 2589210 - protein, 24 aa, Entamoeba histolytica
VDALKELYCIKAIDENGHITQLGI

SEQ ID NO: 2589211 - protein, 21 aa, Entamoeba histolytica
VDALYKIIFELSKEMIKKYQT

SEQ ID NO: 2589212 - protein, 21 aa, Entamoeba histolytica
VDAYSLWKGHRLEYRHFTFHS

SEQ ID NO: 2589213 - protein, 28 aa, Entamoeba histolytica
VDCIWRFLETPFKFRMEKTVSVDNDLPM

SEQ ID NO: 2589214 - protein, 18 aa, Entamoeba histolytica
VDEPFKSALISSLAALEV

SEQ ID NO: 2589215 - protein, 17 aa, Entamoeba histolytica
VDFLNVFRDSSILFRAN

SEQ ID NO: 2589216 - protein, 17 aa, Entamoeba histolytica
VDFLYMIIILHFPLIIK

SEQ ID NO: 2589217 - protein, 17 aa, Entamoeba histolytica
VDFSRWYLNDHFVYQIV

SEQ ID NO: 2589218 - protein, 20 aa, Entamoeba histolytica
VDGTYWRVLGEFRLPNQKIL

SEQ ID NO: 2589219 - protein, 18 aa, Entamoeba histolytica
VDHLRFLAIKEKYPILQW

SEQ ID NO: 2589220 - protein, 18 aa, Entamoeba histolytica
VDIICFMLYLSLSLMNTE

SEQ ID NO: 2589221 - protein, 22 aa, Entamoeba histolytica
VDIKISSGLLKKSRSHFMTFPA

SEQ ID NO: 2589222 - protein, 21 aa, Entamoeba histolytica
VDIMFPMVWHLYYGDSDSAEH

SEQ ID NO: 2589223 - protein, 17 aa, Entamoeba histolytica
VDIQAVFPFDSNRKRMS

SEQ ID NO: 2589224 - protein, 17 aa, Entamoeba histolytica
VDISDSIVICFKYFPII

SEQ ID NO: 2589225 - protein, 17 aa, Entamoeba histolytica
VDITKYYLNLSLKQQLN

SEQ ID NO: 2589226 - protein, 18 aa, Entamoeba histolytica
VDKLSLFRKMVEKEFEIL

SEQ ID NO: 2589227 - protein, 19 aa, Entamoeba histolytica
VDLAAQMLVIDPLAFRSWD

SEQ ID NO: 2589228 - protein, 25 aa, Entamoeba histolytica
VDLMYSSLMARCWNEQPSNRPDFKE

SEQ ID NO: 2589229 - protein, 17 aa, Entamoeba histolytica
VDLSISFMAKCTALLNE

SEQ ID NO: 2589230 - protein, 17 aa, Entamoeba histolytica
VDLSISFMAKCTTILNE

SEQ ID NO: 2589231 - protein, 26 aa, Entamoeba histolytica
VDLYIKLGKYLPECETLPEITYKIQE

SEQ ID NO: 2589232 - protein, 23 aa, Entamoeba histolytica
VDNPRWVAPEVLINKPFTLAADV

SEQ ID NO: 2589233 - protein, 17 aa, Entamoeba histolytica
VDPRSPYAYTDERKTEV

SEQ ID NO: 2589234 - protein, 19 aa, Entamoeba histolytica
VDPYFSWKLYVHSQSNYKE

SEQ ID NO: 2589235 - protein, 17 aa, Entamoeba histolytica
VDQSCILSCEETESKEC

SEQ ID NO: 2589236 - protein, 25 aa, Entamoeba histolytica
VDRMKTCGYWEFLFKPSKKEDVHYD

SEQ ID NO: 2589237 - protein, 24 aa, Entamoeba histolytica
VDSKLDILHFFPSILQKCLEDATS

SEQ ID NO: 2589238 - protein, 17 aa, Entamoeba histolytica
VDSRTGFIYATECSDGF

SEQ ID NO: 2589239 - protein, 24 aa, Entamoeba histolytica
VDSRYRIAVDVSFDNRIRFIQEVD

SEQ ID NO: 2589240 - protein, 24 aa, Entamoeba histolytica
VDSSFIIPCITRLSTIDNELNVDL

SEQ ID NO: 2589241 - protein, 17 aa, Entamoeba histolytica
VDVLMVFMSVLFASQTL

SEQ ID NO: 2589242 - protein, 21 aa, Entamoeba histolytica
VDVSTCFPKTIIDTGVEITTG

SEQ ID NO: 2589243 - protein, 17 aa, Entamoeba histolytica
VDYAFRYFGQQNHINPY

SEQ ID NO: 2589244 - protein, 22 aa, Entamoeba histolytica
VECICKCGGISVLLSIIEKSTT

SEQ ID NO: 2589245 - protein, 24 aa, Entamoeba histolytica
VECVSELPQRILVANELMKQFTSI

SEQ ID NO: 2589246 - protein, 24 aa, Entamoeba histolytica
VEFIECVKELIPIMNTLYYYNELI

SEQ ID NO: 2589247 - protein, 19 aa, Entamoeba histolytica
VEGLQGIILTMEFANCKFT

SEQ ID NO: 2589248 - protein, 29 aa, Entamoeba histolytica
VEIIFALRFFLYFEHRWGIILFFVTYIIS

SEQ ID NO: 2589249 - protein, 19 aa, Entamoeba histolytica
VEIKKAPKHIGFKGEGDND

SEQ ID NO: 2589250 - protein, 17 aa, Entamoeba histolytica
VEIKRAPRHNGFQSIIL

SEQ ID NO: 2589251 - protein, 17 aa, Entamoeba histolytica
VEIRGYCDLNEIKKITI

SEQ ID NO: 2589252 - protein, 19 aa, Entamoeba histolytica
VEIRKGRKLTLIREELKCV

SEQ ID NO: 2589253 - protein, 19 aa, Entamoeba histolytica
VEITQRLVFNLNDPVPIEQ

SEQ ID NO: 2589254 - protein, 24 aa, Entamoeba histolytica
VELKEIPDYIGYFGLDEDDNKCSH

SEQ ID NO: 2589255 - protein, 21 aa, Entamoeba histolytica
VELKFKIKMICTAVVNDEIGI

SEQ ID NO: 2589256 - protein, 18 aa, Entamoeba histolytica
VELMPVFYAFIVIPLVTA

SEQ ID NO: 2589257 - protein, 17 aa, Entamoeba histolytica
VELQKKFIERKMNIKKW

SEQ ID NO: 2589258 - protein, 23 aa, Entamoeba histolytica
VELRNGWDKIIEEWRNFDEENTN

SEQ ID NO: 2589259 - protein, 20 aa, Entamoeba histolytica
VEMIDRMNLLMFDNITEDSF

SEQ ID NO: 2589260 - protein, 23 aa, Entamoeba histolytica
VEMYIGIIFFCYFIAQTLVMAIM

SEQ ID NO: 2589261 - protein, 23 aa, Entamoeba histolytica
VEMYIGILFFCYFIAQTLVMSVM

SEQ ID NO: 2589262 - protein, 22 aa, Entamoeba histolytica
VENKLTFLLLFVLILFNNPFFT

SEQ ID NO: 2589263 - protein, 17 aa, Entamoeba histolytica
VEPLTKLFVDKWKEEEK

SEQ ID NO: 2589264 - protein, 17 aa, Entamoeba histolytica
VEQCLSSVIPLIGLKAY

SEQ ID NO: 2589265 - protein, 17 aa, Entamoeba histolytica
VEQPFGFPEYVAKNKLK

SEQ ID NO: 2589266 - protein, 17 aa, Entamoeba histolytica
VEQVKSYALPLVISEKV

SEQ ID NO: 2589267 - protein, 20 aa, Entamoeba histolytica
VERRKLQLTLCSRFVDPTRP

SEQ ID NO: 2589268 - protein, 20 aa, Entamoeba histolytica
VESDIYSLGMLYIIIHMQFI

SEQ ID NO: 2589269 - protein, 24 aa, Entamoeba histolytica
VESLRPALFEGWGKKQGGSVKTWK

SEQ ID NO: 2589270 - protein, 19 aa, Entamoeba histolytica
VESSYYWYDKTHVCVYESA

SEQ ID NO: 2589271 - protein, 22 aa, Entamoeba histolytica
VETLFSPSYFEWNDVCLSASED

SEQ ID NO: 2589272 - protein, 23 aa, Entamoeba histolytica
VEVLHPIFLRIVFALDDLLTYQT

SEQ ID NO: 2589273 - protein, 20 aa, Entamoeba histolytica
VEVSGRMGINATLLVSEAKR

SEQ ID NO: 2589274 - protein, 23 aa, Entamoeba histolytica
VEYIKRGALHISYYDLNVYNSNE

SEQ ID NO: 2589275 - protein, 22 aa, Entamoeba histolytica
VEYLVKWGLTICVIILVVLISH

SEQ ID NO: 2589276 - protein, 24 aa, Entamoeba histolytica
VFALSIYWFFYVFNWYMTYAKQLL

SEQ ID NO: 2589277 - protein, 25 aa, Entamoeba histolytica
VFEMTMRVLFHLYKPITGHYMNDIL

SEQ ID NO: 2589278 - protein, 20 aa, Entamoeba histolytica
VFFEHTFKTISFATVLSEVK

SEQ ID NO: 2589279 - protein, 27 aa, Entamoeba histolytica
VFFKIKDIWKHVCIVWNKCYNYTPKEI

SEQ ID NO: 2589280 - protein, 22 aa, Entamoeba histolytica
VFFLRRGQTFWQTLVSIVAQFL

SEQ ID NO: 2589281 - protein, 24 aa, Entamoeba histolytica
VFFVVCFWIMFVIAILVIIVLVVL

SEQ ID NO: 2589282 - protein, 17 aa, Entamoeba histolytica
VFGCNALGIWLGSKTLQ

SEQ ID NO: 2589283 - protein, 19 aa, Entamoeba histolytica
VFGCQRCNLGYFLYDGQCI

SEQ ID NO: 2589284 - protein, 19 aa, Entamoeba histolytica
VFGNVKYKKVDIITNEFCP

SEQ ID NO: 2589285 - protein, 18 aa, Entamoeba histolytica
VFIACLDKDLSYQVIKDN

SEQ ID NO: 2589286 - protein, 26 aa, Entamoeba histolytica
VFIAPCVFHLLSIRLFQKCSLFSYHP

SEQ ID NO: 2589287 - protein, 17 aa, Entamoeba histolytica
VFICFSQTTCNNAIDIN

SEQ ID NO: 2589288 - protein, 25 aa, Entamoeba histolytica
VFIFICSIVIIFLLIRFTKGHKIDL

SEQ ID NO: 2589289 - protein, 20 aa, Entamoeba histolytica
VFILICLVIAYYLFISYQQF

SEQ ID NO: 2589290 - protein, 25 aa, Entamoeba histolytica
VFISPVAGVLIRFFYEMWVEHSNED

SEQ ID NO: 2589291 - protein, 25 aa, Entamoeba histolytica
VFKESLRVALPVLEMRCSRCDSVIG

SEQ ID NO: 2589292 - protein, 37 aa, Entamoeba histolytica
VFLCVYSAIMVILWGARKWLDVSFSSFFIASFILCCV

SEQ ID NO: 2589293 - protein, 26 aa, Entamoeba histolytica
VFLLFYVLITFEFYRYGKGTKKIKYW

SEQ ID NO: 2589294 - protein, 27 aa, Entamoeba histolytica
VFMICSFGYLCFLIIFKWCNPDKDPAP

SEQ ID NO: 2589295 - protein, 17 aa, Entamoeba histolytica
VFNECFKCGNHCKKCKN

SEQ ID NO: 2589296 - protein, 27 aa, Entamoeba histolytica
VFNEILKFLICLVMLKFVHKKENLLQH

SEQ ID NO: 2589297 - protein, 20 aa, Entamoeba histolytica
VFNTSIYPLFSIFNVSGMTT

SEQ ID NO: 2589298 - protein, 19 aa, Entamoeba histolytica
VFNWPVDWISFAFLLFNFG

SEQ ID NO: 2589299 - protein, 24 aa, Entamoeba histolytica
VFPSALRFLPFVMILSLFLNNTPV

SEQ ID NO: 2589300 - protein, 22 aa, Entamoeba histolytica
VFPTLKRLLPFIKEKELEKKYI

SEQ ID NO: 2589301 - protein, 23 aa, Entamoeba histolytica
VFSCANFTCLPVYKRAPCSFTKV

SEQ ID NO: 2589302 - protein, 27 aa, Entamoeba histolytica
VFSFGMVMAFVLLRKPLQTILGRDVEI

SEQ ID NO: 2589303 - protein, 22 aa, Entamoeba histolytica
VFSGIWPYTKLVMLLVVWMIPS

SEQ ID NO: 2589304 - protein, 22 aa, Entamoeba histolytica
VFSLSMPQWLYIVVDDKCNRVR

SEQ ID NO: 2589305 - protein, 17 aa, Entamoeba histolytica
VFTARLWIHRISYTNII

SEQ ID NO: 2589306 - protein, 24 aa, Entamoeba histolytica
VFTKCSIGGKIYGKKEYEESEEEE

SEQ ID NO: 2589307 - protein, 27 aa, Entamoeba histolytica
VFTTLFFLRYLFLPLISYPSLLKTLQK

SEQ ID NO: 2589308 - protein, 21 aa, Entamoeba histolytica
VFVLCFGWLLNSGFIAFCYMY

SEQ ID NO: 2589309 - protein, 22 aa, Entamoeba histolytica
VFVSLYGWPLILLIIGLYCDMV

SEQ ID NO: 2589310 - protein, 19 aa, Entamoeba histolytica
VFVTIILDVPLNFNIPVLS

SEQ ID NO: 2589311 - protein, 24 aa, Entamoeba histolytica
VFYKIFFRVLEPIGYYHLKSENIF

SEQ ID NO: 2589312 - protein, 25 aa, Entamoeba histolytica
VGAFLGRGTAFAMLSNFEKAIQDFT

SEQ ID NO: 2589313 - protein, 32 aa, Entamoeba histolytica
VGAHAICCFVLSLRFSLRLIVGIYPSSSLSID

SEQ ID NO: 2589314 - protein, 17 aa, Entamoeba histolytica
VGASDCKKTVDYLPADK

SEQ ID NO: 2589315 - protein, 18 aa, Entamoeba histolytica
VGCAICNDGYYRKGTSCP

SEQ ID NO: 2589316 - protein, 23 aa, Entamoeba histolytica
VGCDCKGDCVIDYSDVTNDIIYA

SEQ ID NO: 2589317 - protein, 26 aa, Entamoeba histolytica
VGELLKRKIIKGVIYIHIIRIIINQL

SEQ ID NO: 2589318 - protein, 17 aa, Entamoeba histolytica
VGFFRCSFFTLTVEIGS

SEQ ID NO: 2589319 - protein, 37 aa, Entamoeba histolytica
VGFGFGIGLYFSWKLSLCILAVFPIISFFMFINGQLN

SEQ ID NO: 2589320 - protein, 32 aa, Entamoeba histolytica
VGFGVGIAFYYDWKVALCVMAIAPVLIVIVFL

SEQ ID NO: 2589321 - protein, 22 aa, Entamoeba histolytica
VGFINFCIFGILFLVFHILEFS

SEQ ID NO: 2589322 - protein, 25 aa, Entamoeba histolytica
VGFLYCAFCSFLVPKTEIEEPPKNH

SEQ ID NO: 2589323 - protein, 18 aa, Entamoeba histolytica
VGGLCYYLTAPNSLFELV

SEQ ID NO: 2589324 - protein, 20 aa, Entamoeba histolytica
VGGYFFLQAFETIQCLFSIY

SEQ ID NO: 2589325 - protein, 18 aa, Entamoeba histolytica
VGILFGEVLQCVATPNID

SEQ ID NO: 2589326 - protein, 19 aa, Entamoeba histolytica
VGILIRRSSHNTGVDIVRI

SEQ ID NO: 2589327 - protein, 23 aa, Entamoeba histolytica
VGKQCAELMFSTGLNELNTTTSF

SEQ ID NO: 2589328 - protein, 23 aa, Entamoeba histolytica
VGLCISFSCGISLLILLLVQTIF

SEQ ID NO: 2589329 - protein, 18 aa, Entamoeba histolytica
VGLNSLWGKTKESLNQDK

SEQ ID NO: 2589330 - protein, 23 aa, Entamoeba histolytica
VGLTNKCGWNIHQNDVIEMKTIK

SEQ ID NO: 2589331 - protein, 19 aa, Entamoeba histolytica
VGMYDSAYWIAHFIQNMII

SEQ ID NO: 2589332 - protein, 28 aa, Entamoeba histolytica
VGPMCIMMLWPRIEKFGDPNFRKLSIID

SEQ ID NO: 2589333 - protein, 18 aa, Entamoeba histolytica
VGRVLTLMSLNFKILSCV

SEQ ID NO: 2589334 - protein, 23 aa, Entamoeba histolytica
VGSRPVRFFIHCYERMTIHYQSE

SEQ ID NO: 2589335 - protein, 23 aa, Entamoeba histolytica
VGTICGLLKSLLMEMNPRFINGE

SEQ ID NO: 2589336 - protein, 21 aa, Entamoeba histolytica
VGTTFSLKRAYLIRSKANSNQ

SEQ ID NO: 2589337 - protein, 24 aa, Entamoeba histolytica
VGVFTVFVSVCFLYILQNVVELVP

SEQ ID NO: 2589338 - protein, 19 aa, Entamoeba histolytica
VGVMKPEFIVRSVAPVVFA

SEQ ID NO: 2589339 - protein, 18 aa, Entamoeba histolytica
VGVSVLVVIAGMVMYVYQ

SEQ ID NO: 2589340 - protein, 17 aa, Entamoeba histolytica
VGYICIFSLILMFYFYK

SEQ ID NO: 2589341 - protein, 21 aa, Entamoeba histolytica
VGYYYFWWLDAVGGIVLSFYI

SEQ ID NO: 2589342 - protein, 22 aa, Entamoeba histolytica
VHDTCIIPAFIEKLNYSDALAS

SEQ ID NO: 2589343 - protein, 17 aa, Entamoeba histolytica
VHESLKISKEFFSRPIY

SEQ ID NO: 2589344 - protein, 28 aa, Entamoeba histolytica
VHIPKYFVKDSFLGWKYVDFNNSKFNPD

SEQ ID NO: 2589345 - protein, 18 aa, Entamoeba histolytica
VHLYYFFHYCYLSELQFF

SEQ ID NO: 2589346 - protein, 25 aa, Entamoeba histolytica
VHRIHAIELLPLYSSNGLSVGETMK

SEQ ID NO: 2589347 - protein, 21 aa, Entamoeba histolytica
VHSVPRLKSAPGTFLSKAISL

SEQ ID NO: 2589348 - protein, 27 aa, Entamoeba histolytica
VHWYSIYICSALCLFLLTVLVFASYKR

SEQ ID NO: 2589349 - protein, 25 aa, Entamoeba histolytica
VHYHASWILSNWFFGRTQDWIQTHS

SEQ ID NO: 2589350 - protein, 34 aa, Entamoeba histolytica
VHYPCPIPDLYIYLIIACCGLVIFILGLILIAII

SEQ ID NO: 2589351 - protein, 18 aa, Entamoeba histolytica
VIAGRGVKFFGFPLLGTW

SEQ ID NO: 2589352 - protein, 25 aa, Entamoeba histolytica
VIAIFPFDIVRYIGIGCTISVTITL

SEQ ID NO: 2589353 - protein, 25 aa, Entamoeba histolytica
VIAIVMCFFMTFLFSITVSRLVLLI

SEQ ID NO: 2589354 - protein, 18 aa, Entamoeba histolytica
VIAPAGLYYCFKKFDFNM

SEQ ID NO: 2589355 - protein, 20 aa, Entamoeba histolytica
VICRDWKLTWFNSILFEFME

SEQ ID NO: 2589356 - protein, 17 aa, Entamoeba histolytica
VICSYTFNGKVLTPVTL

SEQ ID NO: 2589357 - protein, 18 aa, Entamoeba histolytica
VIEFFSIETKHMFLDQFK

SEQ ID NO: 2589358 - protein, 18 aa, Entamoeba histolytica
VIEKVPFKTVKTMVQGKE

SEQ ID NO: 2589359 - protein, 17 aa, Entamoeba histolytica
VIETALLLSQKMGAKYI

SEQ ID NO: 2589360 - protein, 36 aa, Entamoeba histolytica
VIFEALRKPISWRKNINFWIGRILFFCAFILVILIT

SEQ ID NO: 2589361 - protein, 17 aa, Entamoeba histolytica
VIFKQAILSNGFTVSAP

SEQ ID NO: 2589362 - protein, 17 aa, Entamoeba histolytica
VIGASLFILYSLISFLN

SEQ ID NO: 2589363 - protein, 22 aa, Entamoeba histolytica
VIGFTKCWDLALVVLATVPFSS

SEQ ID NO: 2589364 - protein, 22 aa, Entamoeba histolytica
VIGFTKCWDLALVVLATVPLSS

SEQ ID NO: 2589365 - protein, 19 aa, Entamoeba histolytica
VIGGEGVISFLKKMNLIDT

SEQ ID NO: 2589366 - protein, 18 aa, Entamoeba histolytica
VIGGFIPFFIKLLPNRKL

SEQ ID NO: 2589367 - protein, 24 aa, Entamoeba histolytica
VIGIGAACGFRLMTKANLFCLFIV

SEQ ID NO: 2589368 - protein, 18 aa, Entamoeba histolytica
VIGTISIILFLISFIWWI

SEQ ID NO: 2589369 - protein, 18 aa, Entamoeba histolytica
VIHMLKYIRMNPRFKREV

SEQ ID NO: 2589370 - protein, 22 aa, Entamoeba histolytica
VIIGFACSFCFGDATRTPVTHN

SEQ ID NO: 2589371 - protein, 20 aa, Entamoeba histolytica
VIIQPHLKGIYKIQIYTKKY

SEQ ID NO: 2589372 - protein, 17 aa, Entamoeba histolytica
VIISLVICYFINKASYR

SEQ ID NO: 2589373 - protein, 18 aa, Entamoeba histolytica
VIITPFVGFIFKKVKFGN

SEQ ID NO: 2589374 - protein, 22 aa, Entamoeba histolytica
VIKLFKYSDWIDVILVLVGLIS

SEQ ID NO: 2589375 - protein, 19 aa, Entamoeba histolytica
VIKRNDIVGQFFCYIQLKE

SEQ ID NO: 2589376 - protein, 19 aa, Entamoeba histolytica
VILAKMYAKRGWCDDCLKT

SEQ ID NO: 2589377 - protein, 24 aa, Entamoeba histolytica
VILFPSTTMPLSFEDFEKYSTKPK

SEQ ID NO: 2589378 - protein, 17 aa, Entamoeba histolytica
VILGIPIKIETNVQYKL

SEQ ID NO: 2589379 - protein, 20 aa, Entamoeba histolytica
VILILKFLIEVIILVFNETI

SEQ ID NO: 2589380 - protein, 27 aa, Entamoeba histolytica
VILIVFGSWCLVNFFIGKRGIAVLPLY

SEQ ID NO: 2589381 - protein, 26 aa, Entamoeba histolytica
VILLSILCFIIYIPTYFVYGQSEPEV

SEQ ID NO: 2589382 - protein, 23 aa, Entamoeba histolytica
VILPGGVFYFMFVVMVHSLWYEW

SEQ ID NO: 2589383 - protein, 27 aa, Entamoeba histolytica
VILVCDIRFPPKLAFATMKNIYSFFYS

SEQ ID NO: 2589384 - protein, 18 aa, Entamoeba histolytica
VINALWLYIILKYKHSTD

SEQ ID NO: 2589385 - protein, 20 aa, Entamoeba histolytica
VINCPILSSFSLVNTQNPIT

SEQ ID NO: 2589386 - protein, 19 aa, Entamoeba histolytica
VINVCLKKPQIEIICEIAS

SEQ ID NO: 2589387 - protein, 21 aa, Entamoeba histolytica
VIPIKLRIKFMIDAANGIQYL

SEQ ID NO: 2589388 - protein, 28 aa, Entamoeba histolytica
VIPILPCELRKKVIFNFVLSHKLFNTLF

SEQ ID NO: 2589389 - protein, 25 aa, Entamoeba histolytica
VIPKLRRCALYSASIMIFTLNMIPF

SEQ ID NO: 2589390 - protein, 19 aa, Entamoeba histolytica
VIPSHYYLFSLIGWIANQL

SEQ ID NO: 2589391 - protein, 17 aa, Entamoeba histolytica
VIPTILLLKSALWKEEW

SEQ ID NO: 2589392 - protein, 19 aa, Entamoeba histolytica
VIQLIKMGMNFTITSHIKL

SEQ ID NO: 2589393 - protein, 18 aa, Entamoeba histolytica
VIQQLIFHLHINHVKFNK

SEQ ID NO: 2589394 - protein, 18 aa, Entamoeba histolytica
VIQRCCIKTMSLLEKGVE

SEQ ID NO: 2589395 - protein, 19 aa, Entamoeba histolytica
VIRMKVWKLLLGYYTPRKR

SEQ ID NO: 2589396 - protein, 19 aa, Entamoeba histolytica
VISAFTFRAVTNIYKGRDG

SEQ ID NO: 2589397 - protein, 22 aa, Entamoeba histolytica
VISELPWNCWSSSFEFSSQLPP

SEQ ID NO: 2589398 - protein, 18 aa, Entamoeba histolytica
VISLRYIIITTFPRCVLV

SEQ ID NO: 2589399 - protein, 23 aa, Entamoeba histolytica
VISNWKCMIFFVIFTICLCLLYF

SEQ ID NO: 2589400 - protein, 25 aa, Entamoeba histolytica
VISRFACSWSLGKAIGFCVSGPMKT

SEQ ID NO: 2589401 - protein, 25 aa, Entamoeba histolytica
VISSFPLHQCFELIQIVNEPILYFN

SEQ ID NO: 2589402 - protein, 23 aa, Entamoeba histolytica
VISYKEMIKFIIFFIKQKLGKID

SEQ ID NO: 2589403 - protein, 24 aa, Entamoeba histolytica
VISYRDMFRFVIFFIKQKLGKIDA

SEQ ID NO: 2589404 - protein, 20 aa, Entamoeba histolytica
VITFGCGKKNYYRECYANPT

SEQ ID NO: 2589405 - protein, 18 aa, Entamoeba histolytica
VIVGGTLNFTALARDTDG

SEQ ID NO: 2589406 - protein, 25 aa, Entamoeba histolytica
VIVGLMASNLFCFISGIRYVVYNFI

SEQ ID NO: 2589407 - protein, 24 aa, Entamoeba histolytica
VIVKICLIAEKFAKTPQWYVDIML

SEQ ID NO: 2589408 - protein, 23 aa, Entamoeba histolytica
VIVLTMSVLYLTWLCVLSNKLDE

SEQ ID NO: 2589409 - protein, 17 aa, Entamoeba histolytica
VIVRNIGCFELGIEEKK

SEQ ID NO: 2589410 - protein, 19 aa, Entamoeba histolytica
VIVTFCISISMTIPNPWFS

SEQ ID NO: 2589411 - protein, 17 aa, Entamoeba histolytica
VIVTLIVLVIGLVVFCV

SEQ ID NO: 2589412 - protein, 21 aa, Entamoeba histolytica
VIYKVCTKLNISIPINLPQEF

SEQ ID NO: 2589413 - protein, 25 aa, Entamoeba histolytica
VIYPYCFLHHYGLKKWSMIGLLFHV

SEQ ID NO: 2589414 - protein, 28 aa, Entamoeba histolytica
VIYWIEVVASLILSFSMLFKQDNRFINP

SEQ ID NO: 2589415 - protein, 19 aa, Entamoeba histolytica
VKASSDWLYYHSGIYSHSC

SEQ ID NO: 2589416 - protein, 18 aa, Entamoeba histolytica
VKAYLVIFYALLIYFPQL

SEQ ID NO: 2589417 - protein, 21 aa, Entamoeba histolytica
VKCILVIRLSFKLATKSIWVV

SEQ ID NO: 2589418 - protein, 23 aa, Entamoeba histolytica
VKCLSQSMPAKWYHMKGTGKYYL

SEQ ID NO: 2589419 - protein, 25 aa, Entamoeba histolytica
VKCTCVLRCKIPVTLRYGQAKDVIK

SEQ ID NO: 2589420 - protein, 25 aa, Entamoeba histolytica
VKDSIEWYFRVFICQTKIEGIINSI

SEQ ID NO: 2589421 - protein, 22 aa, Entamoeba histolytica
VKECYDLIELCLKDKLEETEEK

SEQ ID NO: 2589422 - protein, 25 aa, Entamoeba histolytica
VKEDFKVMVPFSMKSKTTKIDVIKT

SEQ ID NO: 2589423 - protein, 17 aa, Entamoeba histolytica
VKEKLLKFLIETNQPNE

SEQ ID NO: 2589424 - protein, 18 aa, Entamoeba histolytica
VKELPKLLRVFELGSEGK

SEQ ID NO: 2589425 - protein, 27 aa, Entamoeba histolytica
VKFFALAYFRFPSFRIKLTQYYTNLFQ

SEQ ID NO: 2589426 - protein, 23 aa, Entamoeba histolytica
VKFFDERPVFSFRNSVVGMKRVL

SEQ ID NO: 2589427 - protein, 19 aa, Entamoeba histolytica
VKFFGFPLLGTWILHQTQP

SEQ ID NO: 2589428 - protein, 18 aa, Entamoeba histolytica
VKFFGPKIQECIKSYCNE

SEQ ID NO: 2589429 - protein, 17 aa, Entamoeba histolytica
VKFGIQFISYLLTFIGS

SEQ ID NO: 2589430 - protein, 21 aa, Entamoeba histolytica
VKGEIIWPIVDTIITRYTIAP

SEQ ID NO: 2589431 - protein, 27 aa, Entamoeba histolytica
VKGFSIGCAIVLTTICSIFIFGTQVDT

SEQ ID NO: 2589432 - protein, 20 aa, Entamoeba histolytica
VKGKAGSIVTLIGDYFSHMK

SEQ ID NO: 2589433 - protein, 19 aa, Entamoeba histolytica
VKGTLNIRTGSTFEATNIK

SEQ ID NO: 2589434 - protein, 20 aa, Entamoeba histolytica
VKHYPQCIIINVDKLDYCSS

SEQ ID NO: 2589435 - protein, 20 aa, Entamoeba histolytica
VKIFYCKYNDPLYIKIEKLE

SEQ ID NO: 2589436 - protein, 21 aa, Entamoeba histolytica
VKIGRDLLKCVTRALVQNLNQ

SEQ ID NO: 2589437 - protein, 19 aa, Entamoeba histolytica
VKILDDMAVALSYLHQNSI

SEQ ID NO: 2589438 - protein, 18 aa, Entamoeba histolytica
VKILIPFTSNFKMPNKKI

SEQ ID NO: 2589439 - protein, 18 aa, Entamoeba histolytica
VKITLPMYTPDAEFDRHE

SEQ ID NO: 2589440 - protein, 23 aa, Entamoeba histolytica
VKKDSRYFIAFRWFMAQLLINAK

SEQ ID NO: 2589441 - protein, 30 aa, Entamoeba histolytica; identical to SEQ ID NO: 2391789

SEQ ID NO: 2589442 - protein, 24 aa, Entamoeba histolytica
VKKKEILPSLLCEKENKKKRIKST

SEQ ID NO: 2589443 - protein, 25 aa, Entamoeba histolytica
VKKSVRYLLKRAFEINSNETNKILS

SEQ ID NO: 2589444 - protein, 22 aa, Entamoeba histolytica
VKLICFIILYFVLRMMYNLFYF

SEQ ID NO: 2589445 - protein, 24 aa, Entamoeba histolytica
VKLKEGLKIAMAISSVGNKYLQDT

SEQ ID NO: 2589446 - protein, 27 aa, Entamoeba histolytica
VKLLIKLVLLISIIVSIMFGIIRVITL

SEQ ID NO: 2589447 - protein, 20 aa, Entamoeba histolytica
VKMTEYIHRFGLPYNESLIC

SEQ ID NO: 2589448 - protein, 17 aa, Entamoeba histolytica
VKNDILLSMGLEEAIVF

SEQ ID NO: 2589449 - protein, 23 aa, Entamoeba histolytica
VKPECYLSILLFDTMAYNECIII

SEQ ID NO: 2589450 - protein, 22 aa, Entamoeba histolytica
VKQYRVVIFSLEIPKESVCDSA

SEQ ID NO: 2589451 - protein, 20 aa, Entamoeba histolytica
VKRALDEKAIKEGKKPKFNT

SEQ ID NO: 2589452 - protein, 18 aa, Entamoeba histolytica
VKSILLIFTIADHHILQQ

SEQ ID NO: 2589453 - protein, 21 aa, Entamoeba histolytica
VKSKFLFVGPIYGNYIVHLFE

SEQ ID NO: 2589454 - protein, 19 aa, Entamoeba histolytica
VKSLFFSHIIWFYTATLIV

SEQ ID NO: 2589455 - protein, 18 aa, Entamoeba histolytica
VKTALAIAKECGIVGECQ

SEQ ID NO: 2589456 - protein, 21 aa, Entamoeba histolytica
VKTLECGFVTFSNYIQYWVLG

SEQ ID NO: 2589457 - protein, 24 aa, Entamoeba histolytica
VKTWNLWTLASFIISLVLFFIFML

SEQ ID NO: 2589458 - protein, 22 aa, Entamoeba histolytica
VKTWNWYLLFSYVLSFILIFSV

SEQ ID NO: 2589459 - protein, 26 aa, Entamoeba histolytica
VKVEPCKKSNCSISLDVEEYERQRLQ

SEQ ID NO: 2589460 - protein, 17 aa, Entamoeba histolytica
VKVIAFKGTNSFGDGLY

SEQ ID NO: 2589461 - protein, 23 aa, Entamoeba histolytica
VKVILELFSQWLLPNPSKIDHIL

SEQ ID NO: 2589462 - protein, 18 aa, Entamoeba histolytica
VKVPFALKSLAIIVDENT

SEQ ID NO: 2589463 - protein, 19 aa, Entamoeba histolytica
VKYVNCIFEYNGSLANCQI

SEQ ID NO: 2589464 - protein, 17 aa, Entamoeba histolytica
VLCDLLKRNWHFNFHIT

SEQ ID NO: 2589465 - protein, 19 aa, Entamoeba histolytica
VLCEAIHWFSQIITIPEYC

SEQ ID NO: 2589466 - protein, 20 aa, Entamoeba histolytica
VLCIYLTFAQCYKDGTVTIK

SEQ ID NO: 2589467 - protein, 23 aa, Entamoeba histolytica
VLCSPILRIIWDFSTIYNQFLTS

SEQ ID NO: 2589468 - protein, 24 aa, Entamoeba histolytica
VLDQELFLRQSIIYISKSLIIENA

SEQ ID NO: 2589469 - protein, 20 aa, Entamoeba histolytica
VLDRWKTFSFGGEEDPTQQS

SEQ ID NO: 2589470 - protein, 27 aa, Entamoeba histolytica
VLEGWRFSYKSGYYFGLLNIIFVSVSF

SEQ ID NO: 2589471 - protein, 32 aa, Entamoeba histolytica; identical to SEQ ID NO: 2391825

SEQ ID NO: 2589472 - protein, 21 aa, Entamoeba histolytica
VLEMRCSRCDSVIGIVQQKPM

SEQ ID NO: 2589473 - protein, 18 aa, Entamoeba histolytica
VLFAIRLVCVYLTILPDP

SEQ ID NO: 2589474 - protein, 31 aa, Entamoeba histolytica
VLFGIVLTCCMFLSTRLEGFTTKIIDNCEET

SEQ ID NO: 2589475 - protein, 22 aa, Entamoeba histolytica
VLFVCGFIGIYIVLVVSIFSTI

SEQ ID NO: 2589476 - protein, 23 aa, Entamoeba histolytica
VLGEKKYGLHLFENYLIGQTTVE

SEQ ID NO: 2589477 - protein, 36 aa, Entamoeba histolytica
VLGIFFEWHIPLKYLWPSVRVVLYRTIYGLIYGLTI

SEQ ID NO: 2589478 - protein, 21 aa, Entamoeba histolytica
VLGKPCYLMYMQLIGYLLLIG

SEQ ID NO: 2589479 - protein, 24 aa, Entamoeba histolytica
VLHDVCPLEIILLLREILQSQLTI

SEQ ID NO: 2589480 - protein, 23 aa, Entamoeba histolytica
VLICAMLSFELCYRKNETSTLCT

SEQ ID NO: 2589481 - protein, 17 aa, Entamoeba histolytica
VLICFLGTVVVICICCI

SEQ ID NO: 2589482 - protein, 19 aa, Entamoeba histolytica
VLIDPEIFTDFSLNSPKEN

SEQ ID NO: 2589483 - protein, 22 aa, Entamoeba histolytica
VLIGIIWWRRSRSVKAETAAIK

SEQ ID NO: 2589484 - protein, 19 aa, Entamoeba histolytica
VLIITSLFVAFLADCRHKK

SEQ ID NO: 2589485 - protein, 25 aa, Entamoeba histolytica
VLIMWMIWIPLHFISSIKFDIFPIT

SEQ ID NO: 2589486 - protein, 20 aa, Entamoeba histolytica
VLIVFSCICSAYTYDENDLL

SEQ ID NO: 2589487 - protein, 27 aa, Entamoeba histolytica
VLKKCITSLFKHHYIATLIFFLIMLTS

SEQ ID NO: 2589488 - protein, 17 aa, Entamoeba histolytica
VLKQFGVVLSFAVLLDT

SEQ ID NO: 2589489 - protein, 27 aa, Entamoeba histolytica
VLKTFYPEVEFDNFFEVFNKCIKTIDE

SEQ ID NO: 2589490 - protein, 25 aa, Entamoeba histolytica
VLLCCGGILLYFLLRTTKFDINIYL

SEQ ID NO: 2589491 - protein, 22 aa, Entamoeba histolytica
VLLEAPKKYLLILPGETSTSFC

SEQ ID NO: 2589492 - protein, 19 aa, Entamoeba histolytica
VLLEILKFIDIVNINPLID

SEQ ID NO: 2589493 - protein, 24 aa, Entamoeba histolytica
VLLIFRYILLFVILLSFIFNSFIK

SEQ ID NO: 2589494 - protein, 18 aa, Entamoeba histolytica
VLMACFVGSMKKIQVQEL

SEQ ID NO: 2589495 - protein, 17 aa, Entamoeba histolytica
VLMCCFLSCCFYGVTII

SEQ ID NO: 2589496 - protein, 31 aa, Entamoeba histolytica
VLMLQFGIMLYFRFAPFIKENEIVSTFEKSV

SEQ ID NO: 2589497 - protein, 25 aa, Entamoeba histolytica
VLMMDKMRCPYIINFVGAVDTLDHY

SEQ ID NO: 2589498 - protein, 20 aa, Entamoeba histolytica
VLMTFGSFIFFCINPSMCSL

SEQ ID NO: 2589499 - protein, 17 aa, Entamoeba histolytica
VLMYLPLSLVHSIHLPS

SEQ ID NO: 2589500 - protein, 20 aa, Entamoeba histolytica
VLNKFMLFIHQWKENNQTIK

SEQ ID NO: 2589501 - protein, 24 aa, Entamoeba histolytica
VLPFELPDIVYLCIGICSMILLII

SEQ ID NO: 2589502 - protein, 19 aa, Entamoeba histolytica
VLPNMYINIDMSFPKMNCD

SEQ ID NO: 2589503 - protein, 27 aa, Entamoeba histolytica
VLPYKLKMRMLLDCAKGMVFLHENKIV

SEQ ID NO: 2589504 - protein, 18 aa, Entamoeba histolytica
VLRNKFPSSVSLGIDINN

SEQ ID NO: 2589505 - protein, 18 aa, Entamoeba histolytica
VLSIACILFGPRLQMKYR

SEQ ID NO: 2589506 - protein, 25 aa, Entamoeba histolytica
VLSSCPHKIHLECYLKDYEDSGNEE

SEQ ID NO: 2589507 - protein, 19 aa, Entamoeba histolytica
VLSSLKANIVFNNENDNAI

SEQ ID NO: 2589508 - protein, 27 aa, Entamoeba histolytica
VLTGKSNEAFKCIKCKSGYSLNSNNKC

SEQ ID NO: 2589509 - protein, 26 aa, Entamoeba histolytica
VLTGKSNEAFKCINCKNGYYLNSKHE

SEQ ID NO: 2589510 - protein, 18 aa, Entamoeba histolytica
VLTGWLQLGPGFYKILEI

SEQ ID NO: 2589511 - protein, 19 aa, Entamoeba histolytica
VLTPEEFVNAGDFLVNKYR

SEQ ID NO: 2589512 - protein, 21 aa, Entamoeba histolytica
VLTPSCIHLLLLALKDKNVNE

SEQ ID NO: 2589513 - protein, 26 aa, Entamoeba histolytica
VLTYMGYCYLLIGLICIGVIFFIISI

SEQ ID NO: 2589514 - protein, 20 aa, Entamoeba histolytica
VLVVKWRFGKNHEESSVTTT

SEQ ID NO: 2589515 - protein, 19 aa, Entamoeba histolytica
VLYDGFKIVFDGIQNEPEK

SEQ ID NO: 2589516 - protein, 20 aa, Entamoeba histolytica
VLYIIPFCLIKPLFDNYSIL

SEQ ID NO: 2589517 - protein, 25 aa, Entamoeba histolytica
VLYKKWSRKHAKSFTIDGQSYPFTP

SEQ ID NO: 2589518 - protein, 18 aa, Entamoeba histolytica
VLYYLIYLQFPFKINSLN

SEQ ID NO: 2589519 - protein, 18 aa, Entamoeba histolytica
VLYYLRWKSSFPIPDHLT

SEQ ID NO: 2589520 - protein, 18 aa, Entamoeba histolytica
VMCIALLYSSYITTRIVL

SEQ ID NO: 2589521 - protein, 24 aa, Entamoeba histolytica
VMIHFKKRIIMIINICVQIIVVGM

SEQ ID NO: 2589522 - protein, 23 aa, Entamoeba histolytica
VMKEVMEEIRLLKKLKHKHIVRY

SEQ ID NO: 2589523 - protein, 24 aa, Entamoeba histolytica
VMKNGVCRVCPDGYYSNRITCDKC

SEQ ID NO: 2589524 - protein, 18 aa, Entamoeba histolytica
VMLSLCVYLSRCQKFVPY

SEQ ID NO: 2589525 - protein, 18 aa, Entamoeba histolytica
VMNCKNQIIGLILFTNTA

SEQ ID NO: 2589526 - protein, 19 aa, Entamoeba histolytica
VMPCKDMIDTVRIGYMNSK

SEQ ID NO: 2589527 - protein, 18 aa, Entamoeba histolytica
VMPILAFTLMTILYPDYS

SEQ ID NO: 2589528 - protein, 31 aa, Entamoeba histolytica
VMRYSEEWKKVVWRCGRWIDMDHPYKTMDID

SEQ ID NO: 2589529 - protein, 20 aa, Entamoeba histolytica
VMSFSTFWVYLRSLFLLFQF

SEQ ID NO: 2589530 - protein, 17 aa, Entamoeba histolytica
VMSRLVLILAPAICLLS

SEQ ID NO: 2589531 - protein, 17 aa, Entamoeba histolytica
VMVKILINYLKTQQTID

SEQ ID NO: 2589532 - protein, 19 aa, Entamoeba histolytica
VNASCSISFKINVINKFLL

SEQ ID NO: 2589533 - protein, 18 aa, Entamoeba histolytica
VNAWKVRMYAVIALLRSL

SEQ ID NO: 2589534 - protein, 21 aa, Entamoeba histolytica
VNCYLLISWMYECIVNLHIQR

SEQ ID NO: 2589535 - protein, 24 aa, Entamoeba histolytica
VNDLPDYGAFLFYASYGIETRGSS

SEQ ID NO: 2589536 - protein, 28 aa, Entamoeba histolytica
VNEGEGMYRISIDFYVRRFESSCEEPTN

SEQ ID NO: 2589537 - protein, 19 aa, Entamoeba histolytica
VNGGPGAICKTFLNKEGLD

SEQ ID NO: 2589538 - protein, 17 aa, Entamoeba histolytica
VNIALGRVVEVKTLQSF

SEQ ID NO: 2589539 - protein, 17 aa, Entamoeba histolytica
VNIKRKDFSHIYHSSEK

SEQ ID NO: 2589540 - protein, 25 aa, Entamoeba histolytica
VNILTRYPNMLSISMQRSFLTRDVR

SEQ ID NO: 2589541 - protein, 23 aa, Entamoeba histolytica
VNINTSCLYDFLVDIQKIIISTG

SEQ ID NO: 2589542 - protein, 19 aa, Entamoeba histolytica
VNIVMKLACDQLFAQTGID

SEQ ID NO: 2589543 - protein, 18 aa, Entamoeba histolytica
VNKFILPLEVNKYSNHEL

SEQ ID NO: 2589544 - protein, 21 aa, Entamoeba histolytica
VNLCLCIVKIVAAIVSGSLTV

SEQ ID NO: 2589545 - protein, 23 aa, Entamoeba histolytica
VNLDRVAPIIATFVNGRVDFILT

SEQ ID NO: 2589546 - protein, 19 aa, Entamoeba histolytica
VNLVMSIGITIEFCVHIAH

SEQ ID NO: 2589547 - protein, 17 aa, Entamoeba histolytica
VNMLQRRILALIITLDG

SEQ ID NO: 2589548 - protein, 23 aa, Entamoeba histolytica
VNNFTNDLDICFANTQKNYFYID

SEQ ID NO: 2589549 - protein, 22 aa, Entamoeba histolytica
VNNLLFKVIMIFDNLHNSCEDI

SEQ ID NO: 2589550 - protein, 18 aa, Entamoeba histolytica
VNPFLFRIGFTSVSSNAR

SEQ ID NO: 2589551 - protein, 18 aa, Entamoeba histolytica
VNQFCRIFNPPTCNCNLL

SEQ ID NO: 2589552 - protein, 24 aa, Entamoeba histolytica
VNQMKSSYCNLIIKGEIETSLIID

SEQ ID NO: 2589553 - protein, 22 aa, Entamoeba histolytica
VNRCVQCSFGYLNTSFKCQECN

SEQ ID NO: 2589554 - protein, 17 aa, Entamoeba histolytica
VNRMYAMMVDKNCDGIV

SEQ ID NO: 2589555 - protein, 18 aa, Entamoeba histolytica
VNTLKFIKKPSIDNLNNL

SEQ ID NO: 2589556 - protein, 23 aa, Entamoeba histolytica
VNTMLCQVCLIFFQATKEIQHKF

SEQ ID NO: 2589557 - protein, 22 aa, Entamoeba histolytica
VNVFSIIAMCYVNAEQYHRAMS

SEQ ID NO: 2589558 - protein, 22 aa, Entamoeba histolytica
VNYKTVICLISLGVMMTLILSE

SEQ ID NO: 2589559 - protein, 18 aa, Entamoeba histolytica
VNYTFEFSENVTFNNLYV

SEQ ID NO: 2589560 - protein, 23 aa, Entamoeba histolytica
VPAKLLLVICENGICKMNVNQRL

SEQ ID NO: 2589561 - protein, 22 aa, Entamoeba histolytica
VPDKLSVITCIGVLQQYLDTTP

SEQ ID NO: 2589562 - protein, 26 aa, Entamoeba histolytica
VPFELEIACGFFIFLFSNIFIWTYDR

SEQ ID NO: 2589563 - protein, 17 aa, Entamoeba histolytica
VPGCTAPAINMKSDGTL

SEQ ID NO: 2589564 - protein, 20 aa, Entamoeba histolytica
VPGENEPSCYQVFHDEIYMA

SEQ ID NO: 2589565 - protein, 19 aa, Entamoeba histolytica
VPGIPKYVFISMAFSDIFT

SEQ ID NO: 2589566 - protein, 26 aa, Entamoeba histolytica
VPGMSVRNISYWGWLFTLKQPLFYLM

SEQ ID NO: 2589567 - protein, 19 aa, Entamoeba histolytica
VPHCIKYNYEACIECETNY

SEQ ID NO: 2589568 - protein, 20 aa, Entamoeba histolytica
VPIAGCLAVIIIIVLVVIFL

SEQ ID NO: 2589569 - protein, 18 aa, Entamoeba histolytica
VPIAIGFVSYHPFYEIMR

SEQ ID NO: 2589570 - protein, 23 aa, Entamoeba histolytica
VPILPIRICCVLFGLIGLPIFSY

SEQ ID NO: 2589571 - protein, 17 aa, Entamoeba histolytica
VPISYRISYCAKPQYID

SEQ ID NO: 2589572 - protein, 20 aa, Entamoeba histolytica
VPITLRYGQLGNILKDIKRE

SEQ ID NO: 2589573 - protein, 20 aa, Entamoeba histolytica
VPLLILLGIICLLFAGFTTL

SEQ ID NO: 2589574 - protein, 17 aa, Entamoeba histolytica
VPLLLLLICESFTNNSI

SEQ ID NO: 2589575 - protein, 25 aa, Entamoeba histolytica
VPNCPVCKSRVLLNQIIRVNKNKNH

SEQ ID NO: 2589576 - protein, 20 aa, Entamoeba histolytica
VPNKEYYVFVGPENFAEEGF

SEQ ID NO: 2589577 - protein, 17 aa, Entamoeba histolytica
VPPEGIELFAVGRKKHL

SEQ ID NO: 2589578 - protein, 18 aa, Entamoeba histolytica
VPPELWKRIEDVAFEPNV

SEQ ID NO: 2589579 - protein, 20 aa, Entamoeba histolytica
VPQTISWLFIFRIVPMVVIF

SEQ ID NO: 2589580 - protein, 22 aa, Entamoeba histolytica
VPQVRFVDRGLLLKSKVPASKP

SEQ ID NO: 2589581 - protein, 38 aa, Entamoeba histolytica
VPRTNNCLLRAFFYWSGCYFLRLNLMKKAEFMFRQCCE

SEQ ID NO: 2589582 - protein, 24 aa, Entamoeba histolytica
VPSPWLQVRILRTLRYITPKKGAE

SEQ ID NO: 2589583 - protein, 18 aa, Entamoeba histolytica
VPSQHKIQIITLNVNGSY

SEQ ID NO: 2589584 - protein, 25 aa, Entamoeba histolytica
VPSTIEFKSSLTYIIVNSAYSSSDK

SEQ ID NO: 2589585 - protein, 18 aa, Entamoeba histolytica
VPTDFFTYEEKFWDEFAD

SEQ ID NO: 2589586 - protein, 18 aa, Entamoeba histolytica
VPTLSSFVVLPNELKLTC

SEQ ID NO: 2589587 - protein, 25 aa, Entamoeba histolytica
VPVMCTDVLVGLCLDYDIFLFSRVL

SEQ ID NO: 2589588 - protein, 19 aa, Entamoeba histolytica
VPVSFDWSILSTRIGELQL

SEQ ID NO: 2589589 - protein, 17 aa, Entamoeba histolytica
VPVSVVLHVDFSDVEYG

SEQ ID NO: 2589590 - protein, 19 aa, Entamoeba histolytica
VPVTIRYGKFKQIMQELLE

SEQ ID NO: 2589591 - protein, 23 aa, Entamoeba histolytica
VPVTLRYGKLKSILKEIEKNNPE

SEQ ID NO: 2589592 - protein, 17 aa, Entamoeba histolytica
VPYNLSDVYGCYKMLTD

SEQ ID NO: 2589593 - protein, 18 aa, Entamoeba histolytica
VQALKWFVDACDTGVGEK

SEQ ID NO: 2589594 - protein, 24 aa, Entamoeba histolytica
VQAVAVLPFRAGIVAKPGNLKIKT

SEQ ID NO: 2589595 - protein, 18 aa, Entamoeba histolytica
VQCKCYYDNLLPDCEINP

SEQ ID NO: 2589596 - protein, 25 aa, Entamoeba histolytica
VQEHMPVFYGLWIVYGIILLYLKIF

SEQ ID NO: 2589597 - protein, 31 aa, Entamoeba histolytica
VQFNPMVIVKYSWFFFELIIRSLVYYLNDEI

SEQ ID NO: 2589598 - protein, 23 aa, Entamoeba histolytica
VQFPRTYRTIAFSKLFENVYLCS

SEQ ID NO: 2589599 - protein, 21 aa, Entamoeba histolytica
VQGCGSAARLIFNDKRKTSFY

SEQ ID NO: 2589600 - protein, 24 aa, Entamoeba histolytica
VQIIKGRGGIFLPNNCAISMLRCF

SEQ ID NO: 2589601 - protein, 17 aa, Entamoeba histolytica
VQKARLSWDNTEECDTF

SEQ ID NO: 2589602 - protein, 22 aa, Entamoeba histolytica
VQKDWMCLLSYIVIGLGVMCAF

SEQ ID NO: 2589603 - protein, 26 aa, Entamoeba histolytica
VQKKRLDLVLLLLKFGARIYIANNAG

SEQ ID NO: 2589604 - protein, 26 aa, Entamoeba histolytica
VQLHSILRCGRLIMSSKTRIVGYNGS

SEQ ID NO: 2589605 - protein, 25 aa, Entamoeba histolytica
VQMPSRISPELAYVGFFQMFPTIIK

SEQ ID NO: 2589606 - protein, 19 aa, Entamoeba histolytica
VQQYFKLVVGTLYLNKDID

SEQ ID NO: 2589607 - protein, 20 aa, Entamoeba histolytica
VQQYFKLVVGTLYLNKDIDV

SEQ ID NO: 2589608 - protein, 23 aa, Entamoeba histolytica
VQRLIKKYFRVHKGTLATLKSSI

SEQ ID NO: 2589609 - protein, 17 aa, Entamoeba histolytica
VQSFSLYAGLAIFIDFI

SEQ ID NO: 2589610 - protein, 25 aa, Entamoeba histolytica
VQSRFLDFLLSWKIFGLLYVFSMAV

SEQ ID NO: 2589611 - protein, 25 aa, Entamoeba histolytica
VQYSVDLKLLIALTIHLCKNNQTNT

SEQ ID NO: 2589612 - protein, 19 aa, Entamoeba histolytica
VRALGRCAIKLENVANQCI

SEQ ID NO: 2589613 - protein, 19 aa, Entamoeba histolytica
VRENICFLSPYKKEHYDES

SEQ ID NO: 2589614 - protein, 17 aa, Entamoeba histolytica
VRFSISITPEVVILKRN

SEQ ID NO: 2589615 - protein, 26 aa, Entamoeba histolytica
VRGDGRRYAIHTCFTQSSGSDHTSLE

SEQ ID NO: 2589616 - protein, 21 aa, Entamoeba histolytica
VRGEFIPLTFPVHTYTTDNTV

SEQ ID NO: 2589617 - protein, 22 aa, Entamoeba histolytica
VRGPDQLCCTITILFVIFGVVS

SEQ ID NO: 2589618 - protein, 26 aa, Entamoeba histolytica
VRILKIPSSTLWFSFHELPKIGISYY

SEQ ID NO: 2589619 - protein, 17 aa, Entamoeba histolytica
VRLEAYVFKDILKNPPQ

SEQ ID NO: 2589620 - protein, 24 aa, Entamoeba histolytica
VRLSTCVRLSVHIIKNQKYNYVQG

SEQ ID NO: 2589621 - protein, 23 aa, Entamoeba histolytica
VRNKCIWILLFGLAVFVTTYMYL

SEQ ID NO: 2589622 - protein, 21 aa, Entamoeba histolytica
VRNQVLIFSNRIFKLYPNTQE

SEQ ID NO: 2589623 - protein, 25 aa, Entamoeba histolytica
VRNSVKRICKIFAIEHPDVGYQQGI

SEQ ID NO: 2589624 - protein, 36 aa, Entamoeba histolytica
VRQQSYRWFVCLFCREFHFHLTLALWDNFMLDNGFR

SEQ ID NO: 2589625 - protein, 23 aa, Entamoeba histolytica
VRQTLKAGFGIEVTFKIKMLCTA

SEQ ID NO: 2589626 - protein, 17 aa, Entamoeba histolytica
VRRCCGGNTKMMLLTQP

SEQ ID NO: 2589627 - protein, 17 aa, Entamoeba histolytica
VRSKCPTTNFIINSPTF

SEQ ID NO: 2589628 - protein, 18 aa, Entamoeba histolytica
VRSNLSLNSKRLYETSQI

SEQ ID NO: 2589629 - protein, 30 aa, Entamoeba histolytica
VRSRLVGSLKYWIESCLFDNKFLEDIKVFI

SEQ ID NO: 2589630 - protein, 19 aa, Entamoeba histolytica
VRTALNFGDILCSFGDRMK

SEQ ID NO: 2589631 - protein, 28 aa, Entamoeba histolytica
VRTSYCNYCIGCCSVSVVFVITCTLLSI

SEQ ID NO: 2589632 - protein, 20 aa, Entamoeba histolytica
VRVGEELDLIGYVKPSVTGM

SEQ ID NO: 2589633 - protein, 24 aa, Entamoeba histolytica
VRWRNYFRSWGMCFTCIGDEEELI

SEQ ID NO: 2589634 - protein, 26 aa, Entamoeba histolytica
VRYHRLYHAYFRFLSRYAAENPNLVG

SEQ ID NO: 2589635 - protein, 17 aa, Entamoeba histolytica
VRYKPLISYPTALMVEP

SEQ ID NO: 2589636 - protein, 21 aa, Entamoeba histolytica
VSAVVLCIIGSVFVGESPLNA

SEQ ID NO: 2589637 - protein, 20 aa, Entamoeba histolytica
VSCVYPKYWTAYRGGILRGL

SEQ ID NO: 2589638 - protein, 24 aa, Entamoeba histolytica
VSDAFECIESVKINNTFTQYVQKT

SEQ ID NO: 2589639 - protein, 17 aa, Entamoeba histolytica
VSDISFASIVFGDLQKV

SEQ ID NO: 2589640 - protein, 23 aa, Entamoeba histolytica
VSEFLLNYGFAFFSICIAEVGCF

SEQ ID NO: 2589641 - protein, 23 aa, Entamoeba histolytica
VSEIKHYFCTGMYSNSFTVSVIE

SEQ ID NO: 2589642 - protein, 22 aa, Entamoeba histolytica
VSELLEILFWKYLKEEPGTSAE

SEQ ID NO: 2589643 - protein, 17 aa, Entamoeba histolytica
VSEQFSHEFKCSLNSVF

SEQ ID NO: 2589644 - protein, 21 aa, Entamoeba histolytica
VSFEKGIEYYGTWRDEIIFNS

SEQ ID NO: 2589645 - protein, 17 aa, Entamoeba histolytica
VSFIPVIISLLLSYHAP

SEQ ID NO: 2589646 - protein, 23 aa, Entamoeba histolytica
VSFIRLTISFIINMYVLCSPILR

SEQ ID NO: 2589647 - protein, 25 aa, Entamoeba histolytica
VSFSCGHKFHYSCVIPWLQHNSVCP

SEQ ID NO: 2589648 - protein, 17 aa, Entamoeba histolytica
VSGKIWLYAITLEVAVT

SEQ ID NO: 2589649 - protein, 21 aa, Entamoeba histolytica
VSGKLKIGIGYTQSKELLTLL

SEQ ID NO: 2589650 - protein, 19 aa, Entamoeba histolytica
VSGNSFIDIIINFIVTIAL

SEQ ID NO: 2589651 - protein, 26 aa, Entamoeba histolytica
VSHYLKIKFCLDAAKAIEYLHSNGIL

SEQ ID NO: 2589652 - protein, 24 aa, Entamoeba histolytica
VSIGKKNVLEWWVPSTIANIRTYN

SEQ ID NO: 2589653 - protein, 18 aa, Entamoeba histolytica
VSIIKIGLSLAVSVIPEG

SEQ ID NO: 2589654 - protein, 25 aa, Entamoeba histolytica
VSIKWQAAEIISIIVTFGGIDIVRK

SEQ ID NO: 2589655 - protein, 17 aa, Entamoeba histolytica
VSISFASQECGKWEETQ

SEQ ID NO: 2589656 - protein, 17 aa, Entamoeba histolytica
VSISFASQECGKWGETQ

SEQ ID NO: 2589657 - protein, 17 aa, Entamoeba histolytica
VSISLPFTRAQNVPSAW

SEQ ID NO: 2589658 - protein, 17 aa, Entamoeba histolytica
VSISWAVSEEIILKSLS

SEQ ID NO: 2589659 - protein, 17 aa, Entamoeba histolytica
VSITTCIALIISLYIFF

SEQ ID NO: 2589660 - protein, 22 aa, Entamoeba histolytica
VSKEIDRFIGLKYDMPNKVEAI

SEQ ID NO: 2589661 - protein, 26 aa, Entamoeba histolytica
VSKKLKWYYHLVILIAGVVGVMLIII

SEQ ID NO: 2589662 - protein, 21 aa, Entamoeba histolytica
VSKSNCIYPIFDGNQYHIIYN

SEQ ID NO: 2589663 - protein, 19 aa, Entamoeba histolytica
VSLEVAKFIQTMLMECDTD

SEQ ID NO: 2589664 - protein, 19 aa, Entamoeba histolytica
VSLFIELLSSFMLPCAVVM

SEQ ID NO: 2589665 - protein, 17 aa, Entamoeba histolytica
VSLIGAWNDYSKQSKFI

SEQ ID NO: 2589666 - protein, 19 aa, Entamoeba histolytica
VSLLRCFLASLPEPLIPES

SEQ ID NO: 2589667 - protein, 23 aa, Entamoeba histolytica
VSLVCGLLFVFGYPQFHFTTLKI

SEQ ID NO: 2589668 - protein, 25 aa, Entamoeba histolytica
VSLYSCYLLPFLFFLGFVYSLGSLY

SEQ ID NO: 2589669 - protein, 19 aa, Entamoeba histolytica
VSNICFFVCYTFVEVRRCC

SEQ ID NO: 2589670 - protein, 19 aa, Entamoeba histolytica
VSNIQGFRRYVICKGQTEP

SEQ ID NO: 2589671 - protein, 26 aa, Entamoeba histolytica
VSNPSRLSKWLPIISLVYSQHLDQVW

SEQ ID NO: 2589672 - protein, 17 aa, Entamoeba histolytica
VSPKQEKPAVVQQTQNG

SEQ ID NO: 2589673 - protein, 26 aa, Entamoeba histolytica
VSPSLKQLHIFGAVFAENGFFQRSDS

SEQ ID NO: 2589674 - protein, 25 aa, Entamoeba histolytica
VSQHLNEWIDLIFGFKQTGEPAIKA

SEQ ID NO: 2589675 - protein, 25 aa, Entamoeba histolytica
VSQHLNEWIDLIFGYKQRGKNAEEA

SEQ ID NO: 2589676 - protein, 30 aa, Entamoeba histolytica
VSSETGKICRICFETGKCITFRSYGALSEH

SEQ ID NO: 2589677 - protein, 30 aa, Entamoeba histolytica
VSSLCAVLICLLLSIFKKSFILTFLLIIVT

SEQ ID NO: 2589678 - protein, 17 aa, Entamoeba histolytica
VSSLCIIQIESEETSAI

SEQ ID NO: 2589679 - protein, 24 aa, Entamoeba histolytica
VSSTLCSFVVYLLIGLFGYFSLTP

SEQ ID NO: 2589680 - protein, 22 aa, Entamoeba histolytica
VSSYDIPSGWGKYTNEYTYLVT

SEQ ID NO: 2589681 - protein, 18 aa, Entamoeba histolytica
VSTCFPKTLVNTAVEITK

SEQ ID NO: 2589682 - protein, 21 aa, Entamoeba histolytica
VSTPRRRLLSLVSPRKTESPQ

SEQ ID NO: 2589683 - protein, 26 aa, Entamoeba histolytica
VSVCIWPFCTGFFWPVTTGTIGLEAP

SEQ ID NO: 2589684 - protein, 17 aa, Entamoeba histolytica
VSVILRKDIPYYLFIHS

SEQ ID NO: 2589685 - protein, 22 aa, Entamoeba histolytica
VSVLCLLPLLIVILLIVLPSLI

SEQ ID NO: 2589686 - protein, 21 aa, Entamoeba histolytica
VSWWKGHKMDIAYIYNCFSGD

SEQ ID NO: 2589687 - protein, 17 aa, Entamoeba histolytica
VSYRLSGTESRDFNQDG

SEQ ID NO: 2589688 - protein, 22 aa, Entamoeba histolytica
VSYVSSMSWYILIFAGGRYIIR

SEQ ID NO: 2589689 - protein, 18 aa, Entamoeba histolytica
VTDQYGCLECYYDQINLE

SEQ ID NO: 2589690 - protein, 24 aa, Entamoeba histolytica
VTECIDLMPLKLISLYVRGTLVNV

SEQ ID NO: 2589691 - protein, 25 aa, Entamoeba histolytica
VTEEGRCRCNPGFGGDDCHKLCYYN

SEQ ID NO: 2589692 - protein, 18 aa, Entamoeba histolytica
VTELCPVYSPFFGSMGIT

SEQ ID NO: 2589693 - protein, 18 aa, Entamoeba histolytica
VTELLGCSLYELMKLNKK

SEQ ID NO: 2589694 - protein, 17 aa, Entamoeba histolytica
VTFHFKTTLPEIISLFP

SEQ ID NO: 2589695 - protein, 25 aa, Entamoeba histolytica
VTFKCLKSSILLGFISCLWYAQYIR

SEQ ID NO: 2589696 - protein, 34 aa, Entamoeba histolytica
VTFLNIWTRKLWRSACSLLDYIKGIMRKPTCNEI

SEQ ID NO: 2589697 - protein, 17 aa, Entamoeba histolytica
VTFTIYLIYAYRKTVHH

SEQ ID NO: 2589698 - protein, 17 aa, Entamoeba histolytica
VTGYPWVFVSSYDQNHP

SEQ ID NO: 2589699 - protein, 24 aa, Entamoeba histolytica
VTHPEILTTLVLDFDLLSSCPNGI

SEQ ID NO: 2589700 - protein, 17 aa, Entamoeba histolytica
VTIALYVGLICWVICVI

SEQ ID NO: 2589701 - protein, 17 aa, Entamoeba histolytica
VTICHSFSILSTLRGYI

SEQ ID NO: 2589702 - protein, 23 aa, Entamoeba histolytica
VTIIPGLILLWKLFVKPKLFKSS

SEQ ID NO: 2589703 - protein, 24 aa, Entamoeba histolytica
VTIPKFKIETSFSMNQQLKQLGLI

SEQ ID NO: 2589704 - protein, 25 aa, Entamoeba histolytica
VTIQPRYPLLGGWSTSFSINYHYKF

SEQ ID NO: 2589705 - protein, 26 aa, Entamoeba histolytica
VTKAGFKGGFILKNSWNDTIYGNYPG

SEQ ID NO: 2589706 - protein, 25 aa, Entamoeba histolytica
VTKGLKEWGGAIIVGFDGDPYGKDE

SEQ ID NO: 2589707 - protein, 25 aa, Entamoeba histolytica
VTKGLKEWGGAILVGFDVDPYGKDE

SEQ ID NO: 2589708 - protein, 22 aa, Entamoeba histolytica
VTLILIGLIMMWWSSDYDDESF

SEQ ID NO: 2589709 - protein, 26 aa, Entamoeba histolytica
VTLLGNRIPNLLTFKTLIAKVIGLVF

SEQ ID NO: 2589710 - protein, 32 aa, Entamoeba histolytica
VTLYYCRTCFFKKPPRAIHCRICNNCIEHFDH

SEQ ID NO: 2589711 - protein, 22 aa, Entamoeba histolytica
VTNDIIPIISFVFDDSSISTMI

SEQ ID NO: 2589712 - protein, 23 aa, Entamoeba histolytica
VTPPTRLPWHIRMLKKASESGED

SEQ ID NO: 2589713 - protein, 22 aa, Entamoeba histolytica
VTQVLKHLQSIMLIKVDDLTLD

SEQ ID NO: 2589714 - protein, 22 aa, Entamoeba histolytica
VTRNPTSFLFWFITLGVQGFTV

SEQ ID NO: 2589715 - protein, 23 aa, Entamoeba histolytica
VTSSFKYPYIVAVVKNKLYSTLL

SEQ ID NO: 2589716 - protein, 19 aa, Entamoeba histolytica
VTSWGCAVGEYYYNFFRGC

SEQ ID NO: 2589717 - protein, 18 aa, Entamoeba histolytica
VTYFNGGMQFLYPQPCAT

SEQ ID NO: 2589718 - protein, 24 aa, Entamoeba histolytica
VVAVCGLLLIFGMIIVKFAKRNNN

SEQ ID NO: 2589719 - protein, 25 aa, Entamoeba histolytica
VVCFIICCIVAYKFCDKTEKPTRVN

SEQ ID NO: 2589720 - protein, 18 aa, Entamoeba histolytica
VVCLVWFIVMSCLTFFMT

SEQ ID NO: 2589721 - protein, 24 aa, Entamoeba histolytica
VVEFLNEFLNIFIVPSQTVQIKEQ

SEQ ID NO: 2589722 - protein, 17 aa, Entamoeba histolytica
VVEFWKYWMDSTPQSDA

SEQ ID NO: 2589723 - protein, 24 aa, Entamoeba histolytica
VVFIPICVSFNIATRPHSYTCSAS

SEQ ID NO: 2589724 - protein, 19 aa, Entamoeba histolytica
VVGIFLWWRQRGEEVEGEV

SEQ ID NO: 2589725 - protein, 31 aa, Entamoeba histolytica
VVGIICGSLSFLFGCSVQFIGMYSIVVLIVW

SEQ ID NO: 2589726 - protein, 20 aa, Entamoeba histolytica
VVGILAFRTHPIFTLITEHK

SEQ ID NO: 2589727 - protein, 17 aa, Entamoeba histolytica
VVGKAQIDRSVKVPFAL

SEQ ID NO: 2589728 - protein, 19 aa, Entamoeba histolytica
VVGKSRILSISKPYTITKI

SEQ ID NO: 2589729 - protein, 30 aa, Entamoeba histolytica
VVGMFLISFSFDFLGLAGWALAILGQSPRR

SEQ ID NO: 2589730 - protein, 17 aa, Entamoeba histolytica
VVGTLYLNKDIDVGKYC

SEQ ID NO: 2589731 - protein, 17 aa, Entamoeba histolytica
VVIASLFPNDFKMQQRA

SEQ ID NO: 2589732 - protein, 23 aa, Entamoeba histolytica
VVIDLNKVSAFFCIENVQEPTSY

SEQ ID NO: 2589733 - protein, 29 aa, Entamoeba histolytica
VVIFPFVLCFYPDCIRIYNFFTGQLDDTI

SEQ ID NO: 2589734 - protein, 24 aa, Entamoeba histolytica
VVKELWKREFGVFQSRHTLPPNAL

SEQ ID NO: 2589735 - protein, 17 aa, Entamoeba histolytica
VVKGLIIESECYIHESL

SEQ ID NO: 2589736 - protein, 28 aa, Entamoeba histolytica
VVKQGHIIWNWYNRWLVLTKEQLYYYDE

SEQ ID NO: 2589737 - protein, 19 aa, Entamoeba histolytica
VVLCIPYLIGQMGVEIDNI

SEQ ID NO: 2589738 - protein, 19 aa, Entamoeba histolytica
VVLKFKVILIVILQKTVRI

SEQ ID NO: 2589739 - protein, 20 aa, Entamoeba histolytica
VVLLLWLLLWVFSGCFVCDH

SEQ ID NO: 2589740 - protein, 18 aa, Entamoeba histolytica
VVLSSLISLIGIFPAIVM

SEQ ID NO: 2589741 - protein, 26 aa, Entamoeba histolytica
VVLYLVCIMFNFNLVKEFNFIDKKDI

SEQ ID NO: 2589742 - protein, 21 aa, Entamoeba histolytica
VVMKERIECSAVFTEKYTSVS

SEQ ID NO: 2589743 - protein, 25 aa, Entamoeba histolytica
VVNLKPKKMCKIKVYIFPFCTLEEE

SEQ ID NO: 2589744 - protein, 22 aa, Entamoeba histolytica
VVNRIVPFLNNFGIEKESVITT

SEQ ID NO: 2589745 - protein, 22 aa, Entamoeba histolytica
VVPEDRFGAFIGLANCAVVFAQ

SEQ ID NO: 2589746 - protein, 19 aa, Entamoeba histolytica
VVPPELWKRIEDVAFEPNV

SEQ ID NO: 2589747 - protein, 18 aa, Entamoeba histolytica
VVRYYCQYQRAFEIVKKL

SEQ ID NO: 2589748 - protein, 18 aa, Entamoeba histolytica
VVSCRETYLLISQLLEKT

SEQ ID NO: 2589749 - protein, 19 aa, Entamoeba histolytica
VVSLSEGFIESIVASGGIK

SEQ ID NO: 2589750 - protein, 19 aa, Entamoeba histolytica
VVVFEWYHSYILTSCTRKN

SEQ ID NO: 2589751 - protein, 17 aa, Entamoeba histolytica
VVVGFVYFRRNKQESQY

SEQ ID NO: 2589752 - protein, 20 aa, Entamoeba histolytica
VVVISFLWYLARPCLGGVRG

SEQ ID NO: 2589753 - protein, 25 aa, Entamoeba histolytica
VVVYSGLKYLMWMIGIGGGIIGVVI

SEQ ID NO: 2589754 - protein, 21 aa, Entamoeba histolytica
VVYLIACCGILGIAVYKFSKM

SEQ ID NO: 2589755 - protein, 25 aa, Entamoeba histolytica
VVYSGWKYLMWMIGIGGGIIGVVIV

SEQ ID NO: 2589756 - protein, 31 aa, Entamoeba histolytica; identical to SEQ ID NO: 2392092

SEQ ID NO: 2589757 - protein, 25 aa, Entamoeba histolytica
VVYVGFRFALGFVFYPFEVSNTYMN

SEQ ID NO: 2589758 - protein, 17 aa, Entamoeba histolytica
VWCTLTYFNDSKQSKKL

SEQ ID NO: 2589759 - protein, 17 aa, Entamoeba histolytica
VWIITIIIAIIIYLVYH

SEQ ID NO: 2589760 - protein, 20 aa, Entamoeba histolytica
VWLFCVVQWSAFAGLVIMFL

SEQ ID NO: 2589761 - protein, 17 aa, Entamoeba histolytica
VWLVCILPHSLKVHQGM

SEQ ID NO: 2589762 - protein, 20 aa, Entamoeba histolytica
VWMLFCFFWAVWNGANFYFE

SEQ ID NO: 2589763 - protein, 23 aa, Entamoeba histolytica
VWSICFFTSIPIYTHSCALEFAI

SEQ ID NO: 2589764 - protein, 32 aa, Entamoeba histolytica
VWVVMSCIIVSFFVILLFNIVFFVIKNCFLNE

SEQ ID NO: 2589765 - protein, 18 aa, Entamoeba histolytica
VWYEFKFIERIHTLQKGD

SEQ ID NO: 2589766 - protein, 23 aa, Entamoeba histolytica
VYADLLWKNVFETFYLNDNIVID

SEQ ID NO: 2589767 - protein, 22 aa, Entamoeba histolytica
VYAFKTGVLFCFAPASVFLTSV

SEQ ID NO: 2589768 - protein, 23 aa, Entamoeba histolytica
VYCIPSMLLFIIKVWQIGITDMI

SEQ ID NO: 2589769 - protein, 18 aa, Entamoeba histolytica
VYCPCYSSNCVVQILPSI

SEQ ID NO: 2589770 - protein, 19 aa, Entamoeba histolytica
VYEGLYLVTFNRDYAKASE

SEQ ID NO: 2589771 - protein, 26 aa, Entamoeba histolytica
VYESASFRSEICKIFSSYENVNVQIN

SEQ ID NO: 2589772 - protein, 22 aa, Entamoeba histolytica
VYFSLLSGFLFDNFGPRGTLIF

SEQ ID NO: 2589773 - protein, 23 aa, Entamoeba histolytica
VYGSLFLLTFIYYFILFSIEYLS

SEQ ID NO: 2589774 - protein, 18 aa, Entamoeba histolytica
VYIGFVFSLFLFKLYHNY

SEQ ID NO: 2589775 - protein, 23 aa, Entamoeba histolytica
VYIKVILDKSCTAFSNVFSLKFK

SEQ ID NO: 2589776 - protein, 17 aa, Entamoeba histolytica
VYIPLIVFVVFNIINFG

SEQ ID NO: 2589777 - protein, 18 aa, Entamoeba histolytica
VYISLAVIVSVIIILFIA

SEQ ID NO: 2589778 - protein, 19 aa, Entamoeba histolytica
VYKEPKLSDLVTLNENTEE

SEQ ID NO: 2589779 - protein, 17 aa, Entamoeba histolytica
VYKGEFKGNSVAIKRMK

SEQ ID NO: 2589780 - protein, 18 aa, Entamoeba histolytica
VYKGIFRNNIVAIKNLKN

SEQ ID NO: 2589781 - protein, 21 aa, Entamoeba histolytica
VYKKNGFEVFGNVKYKKVDII

SEQ ID NO: 2589782 - protein, 21 aa, Entamoeba histolytica
VYKNLKMGKSILHDFDTIQWH

SEQ ID NO: 2589783 - protein, 18 aa, Entamoeba histolytica
VYKSIKYLAMITETEGLF

SEQ ID NO: 2589784 - protein, 20 aa, Entamoeba histolytica
VYLIACCGILGIAVYKFSKM

SEQ ID NO: 2589785 - protein, 17 aa, Entamoeba histolytica
VYLSFFIFLMIIVLFIR

SEQ ID NO: 2589786 - protein, 23 aa, Entamoeba histolytica
VYNLSMVVGWTFILVTYFLKALE

SEQ ID NO: 2589787 - protein, 18 aa, Entamoeba histolytica
VYNPLTLDKINEITIKID

SEQ ID NO: 2589788 - protein, 18 aa, Entamoeba histolytica
VYQNEFVMTLAILTRIDP

SEQ ID NO: 2589789 - protein, 19 aa, Entamoeba histolytica
VYSCGELLHVMLYGNHHYF

SEQ ID NO: 2589790 - protein, 17 aa, Entamoeba histolytica
VYSCGLTGGSFCAFATL

SEQ ID NO: 2589791 - protein, 24 aa, Entamoeba histolytica
VYSDRFSIWFLFELLFISQALSQI

SEQ ID NO: 2589792 - protein, 34 aa, Entamoeba histolytica
VYSLPKLPGMWVYCWTITIVMWTSCWRQRNELSE

SEQ ID NO: 2589793 - protein, 34 aa, Entamoeba histolytica
VYVDDCNVCYSGGYRKCGINSYIVMKLEKNHHYY

SEQ ID NO: 2589794 - protein, 23 aa, Entamoeba histolytica
VYVREKWYYYGLVDNNRTNNLKI

SEQ ID NO: 2589795 - protein, 17 aa, Entamoeba histolytica
VYYCWALGYHFHSLVFH

SEQ ID NO: 2589796 - protein, 17 aa, Entamoeba histolytica
VYYHSTLIADEKEISLQ

SEQ ID NO: 2589797 - protein, 17 aa, Entamoeba histolytica
VYYPSADHKIEKRKCTT

SEQ ID NO: 2589798 - protein, 24 aa, Entamoeba histolytica
WAIANLILGIGFVFIAVVVVVLYL

SEQ ID NO: 2589799 - protein, 26 aa, Entamoeba histolytica
WAKSNLKTSIVFSSQLLRSIECLESF

SEQ ID NO: 2589800 - protein, 18 aa, Entamoeba histolytica
WANKGCRTLALSYKDIAP

SEQ ID NO: 2589801 - protein, 22 aa, Entamoeba histolytica
WANRILPILLYFSLLTLTILAI

SEQ ID NO: 2589802 - protein, 30 aa, Entamoeba histolytica
WAWSPPKFECWWLTRIIPYIFLIFVSLFLC

SEQ ID NO: 2589803 - protein, 21 aa, Entamoeba histolytica
WCDDCLKTLEDVHLFEFELVN

SEQ ID NO: 2589804 - protein, 18 aa, Entamoeba histolytica
WCLPRVKREILACLVSCV

SEQ ID NO: 2589805 - protein, 22 aa, Entamoeba histolytica
WDCLLYSPYLCLIINSESIYEG

SEQ ID NO: 2589806 - protein, 24 aa, Entamoeba histolytica
WDDLKLLRPEMNEVENERILLEKE

SEQ ID NO: 2589807 - protein, 20 aa, Entamoeba histolytica
WDEKRKCVVRKSGDNVIRIS

SEQ ID NO: 2589808 - protein, 19 aa, Entamoeba histolytica
WDIADTITIGKRPNIIQEV

SEQ ID NO: 2589809 - protein, 17 aa, Entamoeba histolytica
WDKDVLVLLDCVRDINL

SEQ ID NO: 2589810 - protein, 17 aa, Entamoeba histolytica
WDLALVVLATVPLSSFS

SEQ ID NO: 2589811 - protein, 17 aa, Entamoeba histolytica
WDLFNFICVVPFFLLLI

SEQ ID NO: 2589812 - protein, 18 aa, Entamoeba histolytica
WDLHSFKIIRSFEHHACI

SEQ ID NO: 2589813 - protein, 19 aa, Entamoeba histolytica
WDLTLVIIIAIARALIRNP

SEQ ID NO: 2589814 - protein, 17 aa, Entamoeba histolytica
WDLWGPMLVCYILSLLL

SEQ ID NO: 2589815 - protein, 18 aa, Entamoeba histolytica
WDNNSFCRGYYCNGGESV

SEQ ID NO: 2589816 - protein, 28 aa, Entamoeba histolytica
WDVLISVLLCLFISFLIMKFTKMNFCKS

SEQ ID NO: 2589817 - protein, 17 aa, Entamoeba histolytica
WDYTGKHIFIFGGSAGV

SEQ ID NO: 2589818 - protein, 26 aa, Entamoeba histolytica
WEADRLEVRYGLFGRVFGQRAVAWAF

SEQ ID NO: 2589819 - protein, 21 aa, Entamoeba histolytica
WEESISYAISVVEWLAQLIEN

SEQ ID NO: 2589820 - protein, 17 aa, Entamoeba histolytica
WEGNGMGYMIMKEISNI

SEQ ID NO: 2589821 - protein, 26 aa, Entamoeba histolytica
WEIPLTVYMLFNWLWLLGTLIYLNCV

SEQ ID NO: 2589822 - protein, 22 aa, Entamoeba histolytica
WEIRHGAAICLREVLRAQSNAV

SEQ ID NO: 2589823 - protein, 21 aa, Entamoeba histolytica
WEIVPLTALVILFWNIPSNKS

SEQ ID NO: 2589824 - protein, 23 aa, Entamoeba histolytica
WEIWKKWDWDIDYSLRKYTLLMP

SEQ ID NO: 2589825 - protein, 22 aa, Entamoeba histolytica
WEKKEETGRCLIEKVDILYESN

SEQ ID NO: 2589826 - protein, 24 aa, Entamoeba histolytica
WEKMKLKLIMPKGIWEEDVEEYMI

SEQ ID NO: 2589827 - protein, 20 aa, Entamoeba histolytica
WERNKCFAMQSSLGISSIDR

SEQ ID NO: 2589828 - protein, 17 aa, Entamoeba histolytica
WESVLKKGLELSCIIEA

SEQ ID NO: 2589829 - protein, 20 aa, Entamoeba histolytica
WEVKHGALLVLKYTVAIVDK

SEQ ID NO: 2589830 - protein, 24 aa, Entamoeba histolytica
WFDPDSWYPLGRNIGTTVFPGLMF

SEQ ID NO: 2589831 - protein, 18 aa, Entamoeba histolytica
WFFLFLIRIYLIYYILFI

SEQ ID NO: 2589832 - protein, 19 aa, Entamoeba histolytica
WFFVLKLAKQITVSRDFKY

SEQ ID NO: 2589833 - protein, 19 aa, Entamoeba histolytica
WFGVLILSSLIVKFTPKKV

SEQ ID NO: 2589834 - protein, 17 aa, Entamoeba histolytica
WFHYIFYWVSVIGASLF

SEQ ID NO: 2589835 - protein, 19 aa, Entamoeba histolytica
WFIEKELRLNRFALSSSLR

SEQ ID NO: 2589836 - protein, 19 aa, Entamoeba histolytica
WFNLPDRLIWKQCQEEYSV

SEQ ID NO: 2589837 - protein, 19 aa, Entamoeba histolytica
WFNTTSICGFYRVLQNKNQ

SEQ ID NO: 2589838 - protein, 17 aa, Entamoeba histolytica
WFVVHGFVCLFMTGVFG

SEQ ID NO: 2589839 - protein, 20 aa, Entamoeba histolytica
WFYPHEFKLHENLIVHMKGT

SEQ ID NO: 2589840 - protein, 20 aa, Entamoeba histolytica
WGAPYPKETFPFPWNIAEFI

SEQ ID NO: 2589841 - protein, 25 aa, Entamoeba histolytica
WGECSKITYAVGFCFGVGSTVTTLI

SEQ ID NO: 2589842 - protein, 25 aa, Entamoeba histolytica
WGEGKELWFAYIIKYLILFFPVFNL

SEQ ID NO: 2589843 - protein, 22 aa, Entamoeba histolytica
WGFKFCYINILIIIVFVFPLWF

SEQ ID NO: 2589844 - protein, 18 aa, Entamoeba histolytica
WGIKFDDLNGLKWNNMRI

SEQ ID NO: 2589845 - protein, 20 aa, Entamoeba histolytica
WGKKVCEAFRGINGVLDSQF

SEQ ID NO: 2589846 - protein, 22 aa, Entamoeba histolytica
WGKRKHPFVGVAGVECIISGNY

SEQ ID NO: 2589847 - protein, 17 aa, Entamoeba histolytica
WGLLINGIGLCFFSDII

SEQ ID NO: 2589848 - protein, 17 aa, Entamoeba histolytica
WGNAGHSMAYWMQNISE

SEQ ID NO: 2589849 - protein, 17 aa, Entamoeba histolytica
WGPAYPKEQFKYPWQIA

SEQ ID NO: 2589850 - protein, 17 aa, Entamoeba histolytica
WGRSIRPKLGLPQGNRE

SEQ ID NO: 2589851 - protein, 24 aa, Entamoeba histolytica
WGRVPLESGVTFLANVSNCYEILL

SEQ ID NO: 2589852 - protein, 17 aa, Entamoeba histolytica
WGTFFFDLHIVCFFIPL

SEQ ID NO: 2589853 - protein, 19 aa, Entamoeba histolytica
WGTSIVFFAKQWRMRIELI

SEQ ID NO: 2589854 - protein, 23 aa, Entamoeba histolytica
WHQKIPILWTYKPFYEPRTIHLP

SEQ ID NO: 2589855 - protein, 22 aa, Entamoeba histolytica
WHYAKLSMLGSYVMVLIIVAFF

SEQ ID NO: 2589856 - protein, 18 aa, Entamoeba histolytica
WICERKLDKVILAERETV

SEQ ID NO: 2589857 - protein, 17 aa, Entamoeba histolytica
WIGVFALSKASYSVFNV

SEQ ID NO: 2589858 - protein, 19 aa, Entamoeba histolytica
WIICLRIGAVVLIRLHLFL

SEQ ID NO: 2589859 - protein, 17 aa, Entamoeba histolytica
WIIIIIFIIAVIVIGII

SEQ ID NO: 2589860 - protein, 23 aa, Entamoeba histolytica
WIKINTIALEWVKIAQYIQSKYL

SEQ ID NO: 2589861 - protein, 17 aa, Entamoeba histolytica
WILCPSGDSISVTGYGG

SEQ ID NO: 2589862 - protein, 18 aa, Entamoeba histolytica
WILLEKWYCVLFVLCFIA

SEQ ID NO: 2589863 - protein, 18 aa, Entamoeba histolytica
WIPLSGRCQILVNKRLAN

SEQ ID NO: 2589864 - protein, 21 aa, Entamoeba histolytica
WIRCHSFCPLCKVSFHLNPLK

SEQ ID NO: 2589865 - protein, 25 aa, Entamoeba histolytica
WIRCHSFCPLCKVSFHLNPLKKNKQ

SEQ ID NO: 2589866 - protein, 40 aa, Entamoeba histolytica
WISDCPKVFFDRCSWLLSLPEDWFEFGLILSKTPMFCQYL

SEQ ID NO: 2589867 - protein, 18 aa, Entamoeba histolytica
WISGELFSYVHYNILIVS

SEQ ID NO: 2589868 - protein, 18 aa, Entamoeba histolytica
WISKKLCSNGKWDNISIS

SEQ ID NO: 2589869 - protein, 19 aa, Entamoeba histolytica
WIVFGVLVYVLFAGILAGC

SEQ ID NO: 2589870 - protein, 17 aa, Entamoeba histolytica
WIVFIFQPTFKPTVSTL

SEQ ID NO: 2589871 - protein, 19 aa, Entamoeba histolytica
WIWYLRRPYPVYLVSFATS

SEQ ID NO: 2589872 - protein, 22 aa, Entamoeba histolytica
WKDAFIKISSYILGEYGSLVVK

SEQ ID NO: 2589873 - protein, 18 aa, Entamoeba histolytica
WKDVFLYLIDMVQHKLNM

SEQ ID NO: 2589874 - protein, 20 aa, Entamoeba histolytica
WKDVICKSVNRNGGNEYDES

SEQ ID NO: 2589875 - protein, 19 aa, Entamoeba histolytica
WKEIRCIGSESTLLLKSKS

SEQ ID NO: 2589876 - protein, 21 aa, Entamoeba histolytica
WKGHVETLVPLLARFVSISAK

SEQ ID NO: 2589877 - protein, 18 aa, Entamoeba histolytica
WKGVKFVLKDQMIDNSNE

SEQ ID NO: 2589878 - protein, 24 aa, Entamoeba histolytica
WKIIGELSAILSYELEYFECTCEG

SEQ ID NO: 2589879 - protein, 20 aa, Entamoeba histolytica
WKIIQLLKIDFIRDLHQFVY

SEQ ID NO: 2589880 - protein, 20 aa, Entamoeba histolytica
WKINIIVIILLLNFFHILSL

SEQ ID NO: 2589881 - protein, 19 aa, Entamoeba histolytica
WKIPGRAPPSVIAERGMTL

SEQ ID NO: 2589882 - protein, 17 aa, Entamoeba histolytica
WKIYQLWNGRVIIFIIR

SEQ ID NO: 2589883 - protein, 19 aa, Entamoeba histolytica
WKKALIVLFQGMTMAIISI

SEQ ID NO: 2589884 - protein, 22 aa, Entamoeba histolytica
WKKGGYIGLVFDKIMHLFEVII

SEQ ID NO: 2589885 - protein, 18 aa, Entamoeba histolytica
WKKPLLELSSFIATSLVA

SEQ ID NO: 2589886 - protein, 31 aa, Entamoeba histolytica
WKKQKKSMKWIYSIIVIPVIIAIGYILYVFI

SEQ ID NO: 2589887 - protein, 21 aa, Entamoeba histolytica
WKLILERRLKETKKEIYEEPN

SEQ ID NO: 2589888 - protein, 17 aa, Entamoeba histolytica
WKLTRVFTLNFKEKGSF

SEQ ID NO: 2589889 - protein, 19 aa, Entamoeba histolytica
WKLTWFNSILFEFMELSFQ

SEQ ID NO: 2589890 - protein, 18 aa, Entamoeba histolytica
WKMTEEIHKITAYPNHVH

SEQ ID NO: 2589891 - protein, 21 aa, Entamoeba histolytica
WKNLQTIFSKKKLCFPDNGRW

SEQ ID NO: 2589892 - protein, 22 aa, Entamoeba histolytica
WKNNKLLLAQGLRDLYIENPSL

SEQ ID NO: 2589893 - protein, 17 aa, Entamoeba histolytica
WKNPAFGEWCIQKIIGT

SEQ ID NO: 2589894 - protein, 21 aa, Entamoeba histolytica
WKPKCIKSDVNEFFLPSSYQR

SEQ ID NO: 2589895 - protein, 19 aa, Entamoeba histolytica
WKRLRCFHFSLKEMRINDF

SEQ ID NO: 2589896 - protein, 19 aa, Entamoeba histolytica
WKRSGFCSEHGNQFKGNVV

SEQ ID NO: 2589897 - protein, 18 aa, Entamoeba histolytica
WKSSKEVFDTTPALPQIN

SEQ ID NO: 2589898 - protein, 17 aa, Entamoeba histolytica
WKTLKLYGCGSSIDSQE

SEQ ID NO: 2589899 - protein, 19 aa, Entamoeba histolytica
WKTSVCMKCVDGYQFDVSS

SEQ ID NO: 2589900 - protein, 19 aa, Entamoeba histolytica
WKVSLAVMAVSPVLIVVVF

SEQ ID NO: 2589901 - protein, 17 aa, Entamoeba histolytica
WKYPMHFTFHSGDYTKY

SEQ ID NO: 2589902 - protein, 20 aa, Entamoeba histolytica
WKYPMHFTFHSGDYTKYEIM

SEQ ID NO: 2589903 - protein, 20 aa, Entamoeba histolytica
WKYYERFGYQNSEENFLHKM

SEQ ID NO: 2589904 - protein, 17 aa, Entamoeba histolytica
WKYYLQRVLPNDESIKM

SEQ ID NO: 2589905 - protein, 24 aa, Entamoeba histolytica
WLGFAICFGCVILISYFFVVYYSL

SEQ ID NO: 2589906 - protein, 17 aa, Entamoeba histolytica
WLIFSINGIMVVIMNIK

SEQ ID NO: 2589907 - protein, 18 aa, Entamoeba histolytica
WLIVIACFVGAHAICCFV

SEQ ID NO: 2589908 - protein, 19 aa, Entamoeba histolytica
WLMFIGGLISSLGYLLTLL

SEQ ID NO: 2589909 - protein, 20 aa, Entamoeba histolytica
WLNIFFNWIPEMVFMICSFG

SEQ ID NO: 2589910 - protein, 17 aa, Entamoeba histolytica
WLPDNRNSIHINEPIEL

SEQ ID NO: 2589911 - protein, 17 aa, Entamoeba histolytica
WLVLLAGILCFIVVGLL

SEQ ID NO: 2589912 - protein, 17 aa, Entamoeba histolytica
WMCELSHKLKIAELNIE

SEQ ID NO: 2589913 - protein, 17 aa, Entamoeba histolytica
WMGLIFAIIFWLSLLLI

SEQ ID NO: 2589914 - protein, 24 aa, Entamoeba histolytica
WMTICKCTKYLKEVEFIECVKELI

SEQ ID NO: 2589915 - protein, 19 aa, Entamoeba histolytica
WMYECIVNLHIQRFMLPIS

SEQ ID NO: 2589916 - protein, 20 aa, Entamoeba histolytica
WNCFLQVGSNMLITFINSFL

SEQ ID NO: 2589917 - protein, 24 aa, Entamoeba histolytica
WNDNICILVGGLTRILKYILPSVS

SEQ ID NO: 2589918 - protein, 26 aa, Entamoeba histolytica
WNDVRFELVSDIPWNCFNPHLDVKGK

SEQ ID NO: 2589919 - protein, 19 aa, Entamoeba histolytica
WNEYCEKYSFDWSSLTVLI

SEQ ID NO: 2589920 - protein, 17 aa, Entamoeba histolytica
WNFIPLAYLRQFKYTYN

SEQ ID NO: 2589921 - protein, 19 aa, Entamoeba histolytica
WNGNVSFERVITFETTPSL

SEQ ID NO: 2589922 - protein, 17 aa, Entamoeba histolytica
WNGYVSFERLIKFETTP

SEQ ID NO: 2589923 - protein, 17 aa, Entamoeba histolytica
WNKGVSFERLITFETTP

SEQ ID NO: 2589924 - protein, 24 aa, Entamoeba histolytica
WNKMKLKLIMPKGIWEEDVEEYMI

SEQ ID NO: 2589925 - protein, 17 aa, Entamoeba histolytica
WNKNAIKVSKKFSKLFQ

SEQ ID NO: 2589926 - protein, 17 aa, Entamoeba histolytica
WNQDPSARWTFQQIDEF

SEQ ID NO: 2589927 - protein, 18 aa, Entamoeba histolytica
WNQITDFIVMILIVGTIV

SEQ ID NO: 2589928 - protein, 19 aa, Entamoeba histolytica
WNTKMIFVWVKASFTNKNV

SEQ ID NO: 2589929 - protein, 28 aa, Entamoeba histolytica
WNVITQCWDHIPSKRPAFKDVAVMLQDE

SEQ ID NO: 2589930 - protein, 22 aa, Entamoeba histolytica
WNWILVIGHIISIIFIFIIYGL

SEQ ID NO: 2589931 - protein, 19 aa, Entamoeba histolytica
WPFELFCEKMMQNIFDPKW

SEQ ID NO: 2589932 - protein, 17 aa, Entamoeba histolytica
WQIFGYVVVAILIVLIL

SEQ ID NO: 2589933 - protein, 20 aa, Entamoeba histolytica
WQLAHVDLSWSLTQPQNNYQ

SEQ ID NO: 2589934 - protein, 24 aa, Entamoeba histolytica
WQPSLIRRAVICLIFTSFAGMLSA

SEQ ID NO: 2589935 - protein, 18 aa, Entamoeba histolytica
WQYPIKLFVHLINIQTDR

SEQ ID NO: 2589936 - protein, 17 aa, Entamoeba histolytica
WRCNGYDYILIVNVRAV

SEQ ID NO: 2589937 - protein, 20 aa, Entamoeba histolytica
WRGKCWKCNDGYYMNSESVP

SEQ ID NO: 2589938 - protein, 26 aa, Entamoeba histolytica
WRHQIMLWYAGLRGAIAVLLSLQMAS

SEQ ID NO: 2589939 - protein, 19 aa, Entamoeba histolytica
WRKKAKFELLTTVRIHHGK

SEQ ID NO: 2589940 - protein, 19 aa, Entamoeba histolytica
WRLVTPFLVYSDRFSIWFL

SEQ ID NO: 2589941 - protein, 18 aa, Entamoeba histolytica
WRMFNIIMLGVGFLIIYI

SEQ ID NO: 2589942 - protein, 23 aa, Entamoeba histolytica
WRTSSWKSNEWRDITYIMCEDAM

SEQ ID NO: 2589943 - protein, 17 aa, Entamoeba histolytica
WRVFIYKFLNTIVDDLF

SEQ ID NO: 2589944 - protein, 20 aa, Entamoeba histolytica
WRVKEIPNFLLCAPAAIISL

SEQ ID NO: 2589945 - protein, 17 aa, Entamoeba histolytica
WRYCACSLLYNYAAFLF

SEQ ID NO: 2589946 - protein, 17 aa, Entamoeba histolytica
WRYDKKSGKEEIKDIDE

SEQ ID NO: 2589947 - protein, 21 aa, Entamoeba histolytica
WRYYFNVNTSFVLKKILMIIM

SEQ ID NO: 2589948 - protein, 24 aa, Entamoeba histolytica
WSKSISFIPMKAFIYHRRSNFLEI

SEQ ID NO: 2589949 - protein, 17 aa, Entamoeba histolytica
WSMFRGFPIMTVAFCGH

SEQ ID NO: 2589950 - protein, 19 aa, Entamoeba histolytica
WSNEELVFISPVAGVLIRF

SEQ ID NO: 2589951 - protein, 23 aa, Entamoeba histolytica
WSSPTCPCTGNGCIIDTTKPSVA

SEQ ID NO: 2589952 - protein, 19 aa, Entamoeba histolytica
WSVGKAFGFLFGGMLKSAL

SEQ ID NO: 2589953 - protein, 27 aa, Entamoeba histolytica
WSWSSWLIGGSCGILLGLSDNMIYNLK

SEQ ID NO: 2589954 - protein, 18 aa, Entamoeba histolytica
WSYWQYKQRFNLLALCTM

SEQ ID NO: 2589955 - protein, 20 aa, Entamoeba histolytica
WTCFSPDTESTCGFGSTIQL

SEQ ID NO: 2589956 - protein, 26 aa, Entamoeba histolytica
WTFTFSLTCFAYFLATLMSKTRIAIT

SEQ ID NO: 2589957 - protein, 17 aa, Entamoeba histolytica
WTIMAFSSVCFLFVSLL

SEQ ID NO: 2589958 - protein, 20 aa, Entamoeba histolytica
WTKCMCFYPQAVLEESIHIK

SEQ ID NO: 2589959 - protein, 25 aa, Entamoeba histolytica
WTLHFAARLPFSYYYFVSFLEDLLL

SEQ ID NO: 2589960 - protein, 18 aa, Entamoeba histolytica
WTRILLKTGSKTPILNIY

SEQ ID NO: 2589961 - protein, 18 aa, Entamoeba histolytica
WTTPLFKKTALYLVDALR

SEQ ID NO: 2589962 - protein, 20 aa, Entamoeba histolytica
WVEMSMFLKSLKIDERSEYL

SEQ ID NO: 2589963 - protein, 19 aa, Entamoeba histolytica
WVFLLRKKISLNFLLLNIV

SEQ ID NO: 2589964 - protein, 17 aa, Entamoeba histolytica
WVFPRYVISAAYNAKNF

SEQ ID NO: 2589965 - protein, 17 aa, Entamoeba histolytica
WVGFGSMFTHVAFALAC

SEQ ID NO: 2589966 - protein, 19 aa, Entamoeba histolytica
WVGNCIGRRNYRIFYQFLI

SEQ ID NO: 2589967 - protein, 17 aa, Entamoeba histolytica
WVGVLVSIFIRKLSPDN

SEQ ID NO: 2589968 - protein, 23 aa, Entamoeba histolytica
WVLQSPKFAKFMFFLLAYILSCE

SEQ ID NO: 2589969 - protein, 17 aa, Entamoeba histolytica
WVRDRWSATQLNKKRQH

SEQ ID NO: 2589970 - protein, 18 aa, Entamoeba histolytica
WVVLRRYFFLQGIIYFIR

SEQ ID NO: 2589971 - protein, 24 aa, Entamoeba histolytica
WVVVGCIICAGLVMVIVIVVIIIR

SEQ ID NO: 2589972 - protein, 24 aa, Entamoeba histolytica
WWLSLCKIGYMLSVSFFSFINCNT

SEQ ID NO: 2589973 - protein, 18 aa, Entamoeba histolytica
WYEFMFLERCELLQKNDR

SEQ ID NO: 2589974 - protein, 17 aa, Entamoeba histolytica
WYFIPFFFFTQVILLSL

SEQ ID NO: 2589975 - protein, 18 aa, Entamoeba histolytica
WYGSLVIRGKGGSKGVFA

SEQ ID NO: 2589976 - protein, 18 aa, Entamoeba histolytica
WYIVFSLLMSMLMLSIII

SEQ ID NO: 2589977 - protein, 19 aa, Entamoeba histolytica
WYLARPCLGGVRGTQGCFC

SEQ ID NO: 2589978 - protein, 18 aa, Entamoeba histolytica
WYNSPKITYYGTVEHKRT

SEQ ID NO: 2589979 - protein, 17 aa, Entamoeba histolytica
WYNTIYMKQKELENYME

SEQ ID NO: 2589980 - protein, 17 aa, Entamoeba histolytica
WYPLGRNIGTTVFPGLM

SEQ ID NO: 2589981 - protein, 23 aa, Entamoeba histolytica
WYQLCGIVLFVFVHKHIKSQIKM

SEQ ID NO: 2589982 - protein, 18 aa, Entamoeba histolytica
WYVFYGFVGGFKFISMGE

SEQ ID NO: 2589983 - protein, 17 aa, Entamoeba histolytica
YACEFELFITIKCTTKI

SEQ ID NO: 2589984 - protein, 20 aa, Entamoeba histolytica
YADVIVKGFAVSVAIVCTTT

SEQ ID NO: 2589985 - protein, 23 aa, Entamoeba histolytica
YAGLGGAIGIFIGMIVDTLLVII

SEQ ID NO: 2589986 - protein, 17 aa, Entamoeba histolytica
YAGRPRPNMYALVAQGK

SEQ ID NO: 2589987 - protein, 24 aa, Entamoeba histolytica
YAIGTLIGLIPCNFVVVYFSASMT

SEQ ID NO: 2589988 - protein, 20 aa, Entamoeba histolytica
YAIKRTLAFLTTYQGNEEQM

SEQ ID NO: 2589989 - protein, 26 aa, Entamoeba histolytica
YAKEIKTLKLLSSKVLKNLKNEDEEQ

SEQ ID NO: 2589990 - protein, 17 aa, Entamoeba histolytica
YAKGKIWIEPTGETSLK

SEQ ID NO: 2589991 - protein, 20 aa, Entamoeba histolytica
YALESMSFVSLRSNLLSQEF

SEQ ID NO: 2589992 - protein, 18 aa, Entamoeba histolytica
YALIAVICSYTFNGKVLT

SEQ ID NO: 2589993 - protein, 25 aa, Entamoeba histolytica
YALPGKIQFTFVILLQFINNTIESV

SEQ ID NO: 2589994 - protein, 18 aa, Entamoeba histolytica
YALSPEIYEEIKPETMLN

SEQ ID NO: 2589995 - protein, 20 aa, Entamoeba histolytica
YALSRKELKQVYDYHDPTDE

SEQ ID NO: 2589996 - protein, 17 aa, Entamoeba histolytica
YALTYSGIRSFDIDYQL

SEQ ID NO: 2589997 - protein, 19 aa, Entamoeba histolytica
YANQLKRIYNLYKTHLKSE

SEQ ID NO: 2589998 - protein, 17 aa, Entamoeba histolytica
YANSSICYCSYDPYVDQ

SEQ ID NO: 2589999 - protein, 24 aa, Entamoeba histolytica
YAPECPTACRLFHYIAELVIKFSE

SEQ ID NO: 2590000 - protein, 17 aa, Entamoeba histolytica
YAQFKVYVFNVGQADSQ

SEQ ID NO: 2590001 - protein, 19 aa, Entamoeba histolytica
YAREFFKTTLFPPPFNKQN

SEQ ID NO: 2590002 - protein, 24 aa, Entamoeba histolytica
YASSILPDISIYFSQLVHICSSVY

SEQ ID NO: 2590003 - protein, 22 aa, Entamoeba histolytica
YASWKLIQQKGIYETIIYEVIV

SEQ ID NO: 2590004 - protein, 27 aa, Entamoeba histolytica
YAVTMYECFKWGNAFASNIKPWCICDM

SEQ ID NO: 2590005 - protein, 19 aa, Entamoeba histolytica
YCAVPTCGNGKINDYEECD

SEQ ID NO: 2590006 - protein, 19 aa, Entamoeba histolytica
YCCTEYKGITKYKLVGIVV

SEQ ID NO: 2590007 - protein, 17 aa, Entamoeba histolytica
YCEIWKIKKRQMMIDIN

SEQ ID NO: 2590008 - protein, 30 aa, Entamoeba histolytica; identical to SEQ ID NO: 2392345

SEQ ID NO: 2590009 - protein, 19 aa, Entamoeba histolytica
YCGLKTYSLKGAVSCIECD

SEQ ID NO: 2590010 - protein, 20 aa, Entamoeba histolytica
YCHSACSLVTKGLKEWGRAI

SEQ ID NO: 2590011 - protein, 19 aa, Entamoeba histolytica
YCILFIVVLYLHIGITKKI

SEQ ID NO: 2590012 - protein, 17 aa, Entamoeba histolytica
YCISERVISYFIQVYCE

SEQ ID NO: 2590013 - protein, 20 aa, Entamoeba histolytica
YCIYEPRGVYSIIDTTKDII

SEQ ID NO: 2590014 - protein, 18 aa, Entamoeba histolytica
YCLSCKEGYFIDDHQCRD

SEQ ID NO: 2590015 - protein, 22 aa, Entamoeba histolytica
YCLYLFLLVALMFRFFQAFWDC

SEQ ID NO: 2590016 - protein, 19 aa, Entamoeba histolytica
YCNDISFYHLFKILTTIFM

SEQ ID NO: 2590017 - protein, 18 aa, Entamoeba histolytica
YCNHLCIVTELLGCSLYE

SEQ ID NO: 2590018 - protein, 18 aa, Entamoeba histolytica
YCNHLCIVTELLGSSLYE

SEQ ID NO: 2590019 - protein, 18 aa, Entamoeba histolytica
YCPCSGSACSIKIPNTIS

SEQ ID NO: 2590020 - protein, 28 aa, Entamoeba histolytica
YCPNTRLERWWFIITDVRNQFVLNATHG

SEQ ID NO: 2590021 - protein, 19 aa, Entamoeba histolytica
YCQECIRNISFLSIVQLII

SEQ ID NO: 2590022 - protein, 18 aa, Entamoeba histolytica
YCRMSFYDKDYIKLTSNF

SEQ ID NO: 2590023 - protein, 18 aa, Entamoeba histolytica
YCRMSLYDKNYIKLTSDF

SEQ ID NO: 2590024 - protein, 20 aa, Entamoeba histolytica
YCRSSKSSFCGICDDYFTKQ

SEQ ID NO: 2590025 - protein, 17 aa, Entamoeba histolytica
YCSCLPAVALIFPDTKK

SEQ ID NO: 2590026 - protein, 21 aa, Entamoeba histolytica
YCSNADEGIVCYWKENNTFVH

SEQ ID NO: 2590027 - protein, 18 aa, Entamoeba histolytica
YCTCKVDDPILIVSSDVK

SEQ ID NO: 2590028 - protein, 19 aa, Entamoeba histolytica
YCTCKVDDPILIVSSDVKK

SEQ ID NO: 2590029 - protein, 19 aa, Entamoeba histolytica
YCTECACGYELSTTNHTCV

SEQ ID NO: 2590030 - protein, 22 aa, Entamoeba histolytica
YCVFPCLIPPFISNRRIEKYIR

SEQ ID NO: 2590031 - protein, 20 aa, Entamoeba histolytica
YCYLCIGCTIICGIYFVWVI

SEQ ID NO: 2590032 - protein, 19 aa, Entamoeba histolytica
YCYSACSCVTKGLKEWGGA

SEQ ID NO: 2590033 - protein, 21 aa, Entamoeba histolytica
YDDFNSFDWKMIVETYKENSA

SEQ ID NO: 2590034 - protein, 23 aa, Entamoeba histolytica
YDEVLHQIILLKPSEIFVAAAIG

SEQ ID NO: 2590035 - protein, 21 aa, Entamoeba histolytica
YDEVPQCMKLVEGQSNSVTFD

SEQ ID NO: 2590036 - protein, 23 aa, Entamoeba histolytica
YDFFLHLPLSISSFHFYDSSGNI

SEQ ID NO: 2590037 - protein, 24 aa, Entamoeba histolytica
YDFYSEIYKLLVLTRDSHLSFTID

SEQ ID NO: 2590038 - protein, 28 aa, Entamoeba histolytica
YDGCDSYGYCPSGWSYFNHKCYENEGKL

SEQ ID NO: 2590039 - protein, 22 aa, Entamoeba histolytica
YDHLYLLLQLYQVFIIPKNQSF

SEQ ID NO: 2590040 - protein, 20 aa, Entamoeba histolytica
YDICYELGVNFISKLSKQSN

SEQ ID NO: 2590041 - protein, 19 aa, Entamoeba histolytica
YDIEYKFTLNLEIGIEAID

SEQ ID NO: 2590042 - protein, 19 aa, Entamoeba histolytica
YDIFIGVFFCTIYFMYTVG

SEQ ID NO: 2590043 - protein, 21 aa, Entamoeba histolytica
YDILVDYCFPEGVLHTRKEAK

SEQ ID NO: 2590044 - protein, 27 aa, Entamoeba histolytica
YDLFLKTHFISFLFKILPFKSTPTDEK

SEQ ID NO: 2590045 - protein, 24 aa, Entamoeba histolytica
YDLLYRFVQTLGMLPFSLLSTGNK

SEQ ID NO: 2590046 - protein, 21 aa, Entamoeba histolytica
YDLTFALYVNDVFKTNNVILK

SEQ ID NO: 2590047 - protein, 24 aa, Entamoeba histolytica
YDMFLFLKLFKTFNIKRGNETKQI

SEQ ID NO: 2590048 - protein, 23 aa, Entamoeba histolytica
YDPKELLCIFQQYGDVKTIYYST

SEQ ID NO: 2590049 - protein, 27 aa, Entamoeba histolytica
YDRKGCVRYTSGWSVALIIIGITLFIG

SEQ ID NO: 2590050 - protein, 25 aa, Entamoeba histolytica
YDVFYYLAMQPWRHFVWTTCETTKG

SEQ ID NO: 2590051 - protein, 25 aa, Entamoeba histolytica
YDVFYYLAMQPWRHFVWTTCTTTDG

SEQ ID NO: 2590052 - protein, 23 aa, Entamoeba histolytica
YDYDLFFSFSELKKNICPPFICV

SEQ ID NO: 2590053 - protein, 19 aa, Entamoeba histolytica
YDYLLFVGITEEYEANVRV

SEQ ID NO: 2590054 - protein, 17 aa, Entamoeba histolytica
YDYNETIPREFLLDPIN

SEQ ID NO: 2590055 - protein, 22 aa, Entamoeba histolytica
YDYTPFFGIEENDTFVLNIDCV

SEQ ID NO: 2590056 - protein, 22 aa, Entamoeba histolytica
YEALDRIILLLFDRRIDSELES

SEQ ID NO: 2590057 - protein, 19 aa, Entamoeba histolytica
YECECQAGWFEAHSVGCQR

SEQ ID NO: 2590058 - protein, 25 aa, Entamoeba histolytica
YECSKYKPNCLVCSNSSPNCLVCKN

SEQ ID NO: 2590059 - protein, 24 aa, Entamoeba histolytica
YECVCSCCSILLSIILLLQQCLFG

SEQ ID NO: 2590060 - protein, 17 aa, Entamoeba histolytica
YEDLLMASFRVEMTDDP

SEQ ID NO: 2590061 - protein, 17 aa, Entamoeba histolytica
YEEICCLTTSNKVNTLI

SEQ ID NO: 2590062 - protein, 33 aa, Entamoeba histolytica
YEEYQRKFFPYRKAHKRVRGWVNNAPRSKYRPK

SEQ ID NO: 2590063 - protein, 19 aa, Entamoeba histolytica
YEFCMKATNLFLIQTNCVA

SEQ ID NO: 2590064 - protein, 25 aa, Entamoeba histolytica
YEFDRCYACGSTVIIGVSDGSLDIK

SEQ ID NO: 2590065 - protein, 22 aa, Entamoeba histolytica
YEFLSKRIGSLSSQTINIAIKT

SEQ ID NO: 2590066 - protein, 28 aa, Entamoeba histolytica
YEFRNQECFRRSFDIFINDQFVTQCGWG

SEQ ID NO: 2590067 - protein, 27 aa, Entamoeba histolytica
YEHQEKIFSAWGFIISYVVYKGGCVTI

SEQ ID NO: 2590068 - protein, 22 aa, Entamoeba histolytica
YEIESPILFFGDDTKQVWQYQF

SEQ ID NO: 2590069 - protein, 23 aa, Entamoeba histolytica
YEIFCGQFIRLLRCPKCGKVADK

SEQ ID NO: 2590070 - protein, 29 aa, Entamoeba histolytica
YEIFCGQFIRLLRCPKCGKVADKYIEYDN

SEQ ID NO: 2590071 - protein, 20 aa, Entamoeba histolytica
YEILNMFPFSSSTKRMGVIV

SEQ ID NO: 2590072 - protein, 25 aa, Entamoeba histolytica
YEINGTYWLGGEVQRFDTLKFNGYA

SEQ ID NO: 2590073 - protein, 18 aa, Entamoeba histolytica
YEINWSCFEKKVEEIEDI

SEQ ID NO: 2590074 - protein, 23 aa, Entamoeba histolytica
YEIPESYIGKDLYIDVILISNVV

SEQ ID NO: 2590075 - protein, 19 aa, Entamoeba histolytica
YEIPRKCYRNGLISETGEE

SEQ ID NO: 2590076 - protein, 19 aa, Entamoeba histolytica
YEKEEIGGICYSNKEQIIF

SEQ ID NO: 2590077 - protein, 20 aa, Entamoeba histolytica
YEKWKIMWEDAINNVKEREE

SEQ ID NO: 2590078 - protein, 25 aa, Entamoeba histolytica
YELIYKLVIFEGYQPYYLEEFPPER

SEQ ID NO: 2590079 - protein, 23 aa, Entamoeba histolytica
YELLLPLYFDYHFTVTKAMKEFL

SEQ ID NO: 2590080 - protein, 24 aa, Entamoeba histolytica
YELTQVCRIYVALVPKGYTITECP

SEQ ID NO: 2590081 - protein, 26 aa, Entamoeba histolytica
YENYLWCGIMFIGSLILYFIGFIFLK

SEQ ID NO: 2590082 - protein, 17 aa, Entamoeba histolytica
YEPCGLVAASFFNDSFE

SEQ ID NO: 2590083 - protein, 20 aa, Entamoeba histolytica
YEREFKKKFDLPDMLSSYKF

SEQ ID NO: 2590084 - protein, 18 aa, Entamoeba histolytica
YEVSIWRNPFPKEQFKYP

SEQ ID NO: 2590085 - protein, 21 aa, Entamoeba histolytica
YEVTVPYSGIFGIGTQLPVQC

SEQ ID NO: 2590086 - protein, 20 aa, Entamoeba histolytica
YEWATTIMLVYTALFCTILM

SEQ ID NO: 2590087 - protein, 26 aa, Entamoeba histolytica
YEYVFASSLFVFWKIIITSIFCVFVV

SEQ ID NO: 2590088 - protein, 19 aa, Entamoeba histolytica
YFALLSVGLWYSSRSSNVS

SEQ ID NO: 2590089 - protein, 19 aa, Entamoeba histolytica
YFATKGCDNVCNLMNIPRA

SEQ ID NO: 2590090 - protein, 17 aa, Entamoeba histolytica
YFCRPRVNKALDVGSTD

SEQ ID NO: 2590091 - protein, 19 aa, Entamoeba histolytica
YFDFQMFNLRMESIGTKIG

SEQ ID NO: 2590092 - protein, 18 aa, Entamoeba histolytica
YFEDCRFGILGISNDDKN

SEQ ID NO: 2590093 - protein, 24 aa, Entamoeba histolytica
YFFPLPDYVASYSFLIEPTQETTN

SEQ ID NO: 2590094 - protein, 18 aa, Entamoeba histolytica
YFGCLRMMKEIKILLDSN

SEQ ID NO: 2590095 - protein, 17 aa, Entamoeba histolytica
YFGMAGGALVFIALTIY

SEQ ID NO: 2590096 - protein, 25 aa, Entamoeba histolytica
YFGVAIPDILVYLGVTRETLSEIMG

SEQ ID NO: 2590097 - protein, 18 aa, Entamoeba histolytica
YFGYSGLVEFIWIELNNK

SEQ ID NO: 2590098 - protein, 31 aa, Entamoeba histolytica
YFIIPRFSPTCWVKLPYKRSFYMTYSQKSYE

SEQ ID NO: 2590099 - protein, 21 aa, Entamoeba histolytica
YFILSCLTFFITGVLGLVVGT

SEQ ID NO: 2590100 - protein, 25 aa, Entamoeba histolytica
YFINLLKAKWYCVVFVIVFIAFSMI

SEQ ID NO: 2590101 - protein, 35 aa, Entamoeba histolytica
YFINPIVILLCCFLIGTIILFFIKSRRKQNEVELE

SEQ ID NO: 2590102 - protein, 21 aa, Entamoeba histolytica
YFIRGLCVFTTILPDPSGRPS

SEQ ID NO: 2590103 - protein, 26 aa, Entamoeba histolytica
YFIRYFLVICIFFILACIGIICAVFT

SEQ ID NO: 2590104 - protein, 24 aa, Entamoeba histolytica
YFISACIFLVFSIILILTCLKLWG

SEQ ID NO: 2590105 - protein, 17 aa, Entamoeba histolytica
YFISFKLDCLLNKICGR

SEQ ID NO: 2590106 - protein, 21 aa, Entamoeba histolytica
YFIVFCLLLFIWIQPLQITIS

SEQ ID NO: 2590107 - protein, 22 aa, Entamoeba histolytica
YFIVFCLLLFIWIQPLQITISA

SEQ ID NO: 2590108 - protein, 17 aa, Entamoeba histolytica
YFIYKAIIEPSGIILKE

SEQ ID NO: 2590109 - protein, 21 aa, Entamoeba histolytica
YFKEELIDYIINCIAPGLDPI

SEQ ID NO: 2590110 - protein, 25 aa, Entamoeba histolytica
YFKLYGYSCCPCFIPPPCSPANSHR

SEQ ID NO: 2590111 - protein, 22 aa, Entamoeba histolytica
YFLCNACSQLIPIFKVGMTFTY

SEQ ID NO: 2590112 - protein, 25 aa, Entamoeba histolytica
YFLYKRKIWLCSLFFGLSIHMKIYP

SEQ ID NO: 2590113 - protein, 19 aa, Entamoeba histolytica
YFMLCKDVPYISYKSPIFF

SEQ ID NO: 2590114 - protein, 23 aa, Entamoeba histolytica
YFNCFGGSISFEITLLQIVVNLK

SEQ ID NO: 2590115 - protein, 17 aa, Entamoeba histolytica
YFNEIVFISLLYSIALL

SEQ ID NO: 2590116 - protein, 23 aa, Entamoeba histolytica
YFNSLWMIMCLLPPPQSFIDQFK

SEQ ID NO: 2590117 - protein, 23 aa, Entamoeba histolytica
YFNVSGLDTWYGLQFFEPLRDTP

SEQ ID NO: 2590118 - protein, 19 aa, Entamoeba histolytica
YFRFCKELFVSDLTPNLGL

SEQ ID NO: 2590119 - protein, 25 aa, Entamoeba histolytica
YFRKWKYRSHFTILEVVFLLGCIIF

SEQ ID NO: 2590120 - protein, 17 aa, Entamoeba histolytica
YFRYFFMHWCDSVQFAF

SEQ ID NO: 2590121 - protein, 19 aa, Entamoeba histolytica
YFSAFIFNKMKGINVSSTF

SEQ ID NO: 2590122 - protein, 23 aa, Entamoeba histolytica
YFSCFGKILICGETVVREDQSIT

SEQ ID NO: 2590123 - protein, 24 aa, Entamoeba histolytica
YFSIITCSLFYLLIAVCGDLSFDK

SEQ ID NO: 2590124 - protein, 18 aa, Entamoeba histolytica
YFSSFTSLFVFTSSLLNH

SEQ ID NO: 2590125 - protein, 22 aa, Entamoeba histolytica
YFTELINALGLKEVKTPEQICT

SEQ ID NO: 2590126 - protein, 17 aa, Entamoeba histolytica
YFTRRFVELQILNEQSI

SEQ ID NO: 2590127 - protein, 18 aa, Entamoeba histolytica
YFVITMIGIIVFIINYTI

SEQ ID NO: 2590128 - protein, 18 aa, Entamoeba histolytica
YFVIVMCFCFYQIKNDLA

SEQ ID NO: 2590129 - protein, 24 aa, Entamoeba histolytica
YFYNSLKMKMSILIGVTHMTIGIW

SEQ ID NO: 2590130 - protein, 20 aa, Entamoeba histolytica
YGADALRLSLINSPAVRAET

SEQ ID NO: 2590131 - protein, 19 aa, Entamoeba histolytica
YGCAICKNGYFVSNLTCFH

SEQ ID NO: 2590132 - protein, 19 aa, Entamoeba histolytica
YGCKRCLDGYYLTTNMKCS

SEQ ID NO: 2590133 - protein, 17 aa, Entamoeba histolytica
YGCQRCVDGYFLNSDLM

SEQ ID NO: 2590134 - protein, 17 aa, Entamoeba histolytica
YGDACSSGCILPDICER

SEQ ID NO: 2590135 - protein, 26 aa, Entamoeba histolytica
YGDCLKIFNMFIVISIIFSGIMFILS

SEQ ID NO: 2590136 - protein, 23 aa, Entamoeba histolytica
YGEPSVKRYVPFALALTSIGKPK

SEQ ID NO: 2590137 - protein, 17 aa, Entamoeba histolytica
YGFEMIKKRGGIKSIQK

SEQ ID NO: 2590138 - protein, 21 aa, Entamoeba histolytica
YGFHCYQCSSTHYLENGICKE

SEQ ID NO: 2590139 - protein, 17 aa, Entamoeba histolytica
YGGESCILKCWHNNTWQ

SEQ ID NO: 2590140 - protein, 17 aa, Entamoeba histolytica
YGGFILYFYIIFQCGYD

SEQ ID NO: 2590141 - protein, 25 aa, Entamoeba histolytica
YGGIMSVYCIYKLMNCIIHVIGLTH

SEQ ID NO: 2590142 - protein, 18 aa, Entamoeba histolytica
YGGPCFNLLIGLGGGVLA

SEQ ID NO: 2590143 - protein, 23 aa, Entamoeba histolytica
YGIRSEPQLAFIKPGNAVEFNLF

SEQ ID NO: 2590144 - protein, 18 aa, Entamoeba histolytica
YGKHILKLKNKSVIYSDT

SEQ ID NO: 2590145 - protein, 26 aa, Entamoeba histolytica
YGKIHFLKHYIHIHRILQIQSQQVND

SEQ ID NO: 2590146 - protein, 18 aa, Entamoeba histolytica
YGLIGAVCSVTFGETVQT

SEQ ID NO: 2590147 - protein, 17 aa, Entamoeba histolytica
YGLNGLIVISSNTRECS

SEQ ID NO: 2590148 - protein, 21 aa, Entamoeba histolytica
YGMTYSLLWINYLVDQFFFRV

SEQ ID NO: 2590149 - protein, 24 aa, Entamoeba histolytica
YGNEGFLLMILYYLGCYITLSKLQ

SEQ ID NO: 2590150 - protein, 25 aa, Entamoeba histolytica
YGNLISGDFFILWKLVDVSHSSNFE

SEQ ID NO: 2590151 - protein, 19 aa, Entamoeba histolytica
YGSCLRCKDGYYASNGICK

SEQ ID NO: 2590152 - protein, 17 aa, Entamoeba histolytica
YGSFSCIDIEIYKKVIT

SEQ ID NO: 2590153 - protein, 19 aa, Entamoeba histolytica
YGVSLSFFETFRFNYNYTE

SEQ ID NO: 2590154 - protein, 19 aa, Entamoeba histolytica
YGYDLGISILESYRYNYNY

SEQ ID NO: 2590155 - protein, 19 aa, Entamoeba histolytica
YGYSLSLSFLESFRYNYNY

SEQ ID NO: 2590156 - protein, 17 aa, Entamoeba histolytica
YHCKKCGYCIEKRDHHC

SEQ ID NO: 2590157 - protein, 25 aa, Entamoeba histolytica
YHCYSKRFIEFLPFQVYGLASVYSY

SEQ ID NO: 2590158 - protein, 19 aa, Entamoeba histolytica
YHFLTLSLFTFFFIISLSL

SEQ ID NO: 2590159 - protein, 26 aa, Entamoeba histolytica
YHFNYKTVFVKSRILLGILGIVIVLF

SEQ ID NO: 2590160 - protein, 18 aa, Entamoeba histolytica
YHFQCGYSVFNIILTFLF

SEQ ID NO: 2590161 - protein, 25 aa, Entamoeba histolytica
YHNELVCRVVLLLLSYVIKEEYNEI

SEQ ID NO: 2590162 - protein, 25 aa, Entamoeba histolytica
YHPFYEIMRRMLLSIYELCPTLSNQ

SEQ ID NO: 2590163 - protein, 17 aa, Entamoeba histolytica
YHPGNDIFLSFYSHLVD

SEQ ID NO: 2590164 - protein, 22 aa, Entamoeba histolytica
YHSIILKNHFKSIDQYTSQFII

SEQ ID NO: 2590165 - protein, 24 aa, Entamoeba histolytica
YHVPSARTSWEFSNQAMKILETAG

SEQ ID NO: 2590166 - protein, 17 aa, Entamoeba histolytica
YIALTGNASLIPAIDTF

SEQ ID NO: 2590167 - protein, 24 aa, Entamoeba histolytica
YIANCKRFIGSVCIKCNDGYFIQS

SEQ ID NO: 2590168 - protein, 17 aa, Entamoeba histolytica
YIDLCVLRNKFPSSVSL

SEQ ID NO: 2590169 - protein, 22 aa, Entamoeba histolytica
YIDLKRMDLVFNKDPSITSGLE

SEQ ID NO: 2590170 - protein, 24 aa, Entamoeba histolytica
YIEARSILTYNILQYLNVALNNYF

SEQ ID NO: 2590171 - protein, 20 aa, Entamoeba histolytica
YIEDIIIDVVYSFKLFNTIR

SEQ ID NO: 2590172 - protein, 24 aa, Entamoeba histolytica
YIEMKRDFVAMLRKNESVNMIKEW

SEQ ID NO: 2590173 - protein, 24 aa, Entamoeba histolytica
YIFGGCGFLLFYFICSVIVDLVIE

SEQ ID NO: 2590174 - protein, 17 aa, Entamoeba histolytica
YIFTFSLLIFIVLSMIY

SEQ ID NO: 2590175 - protein, 18 aa, Entamoeba histolytica
YIFYLLFNCCLLNILSVF

SEQ ID NO: 2590176 - protein, 22 aa, Entamoeba histolytica
YIFYYFALVFAFFFPSFTVHYI

SEQ ID NO: 2590177 - protein, 17 aa, Entamoeba histolytica
YIGIAIVLFCTILCELV

SEQ ID NO: 2590178 - protein, 22 aa, Entamoeba histolytica
YIHIICLLLVFLLSISILCNVQ

SEQ ID NO: 2590179 - protein, 24 aa, Entamoeba histolytica
YIHKYSYCCGNVLVSNCHEIELLN

SEQ ID NO: 2590180 - protein, 20 aa, Entamoeba histolytica
YIHNNIHLIAETTTSSQGAK

SEQ ID NO: 2590181 - protein, 17 aa, Entamoeba histolytica
YIHQVLDGLAFIHDQGI

SEQ ID NO: 2590182 - protein, 24 aa, Entamoeba histolytica
YIHSCVYIGFSQCFPVLVSWTQIM

SEQ ID NO: 2590183 - protein, 18 aa, Entamoeba histolytica
YIIASKLPVSLCNHKEIM

SEQ ID NO: 2590184 - protein, 17 aa, Entamoeba histolytica
YIICVPLVKPTFLRCLE

SEQ ID NO: 2590185 - protein, 27 aa, Entamoeba histolytica
YIIKKGRYGIIGIWIIIALCCSYFALN

SEQ ID NO: 2590186 - protein, 22 aa, Entamoeba histolytica
YIITFPFLFGVMFGDIGHGIIV

SEQ ID NO: 2590187 - protein, 18 aa, Entamoeba histolytica
YIIYSIYLMIAFRPKKII

SEQ ID NO: 2590188 - protein, 19 aa, Entamoeba histolytica
YIKHFFTKMHFDFITIGCL

SEQ ID NO: 2590189 - protein, 18 aa, Entamoeba histolytica
YIKSLKLSVKESVLDYAK

SEQ ID NO: 2590190 - protein, 25 aa, Entamoeba histolytica
YIKYGGWVYFTLVMLFFFISSFLLI

SEQ ID NO: 2590191 - protein, 19 aa, Entamoeba histolytica
YIKYISIVFNNVFSLFVKV

SEQ ID NO: 2590192 - protein, 22 aa, Entamoeba histolytica
YILCTFGIIFGFIAGFDLEENM

SEQ ID NO: 2590193 - protein, 18 aa, Entamoeba histolytica
YILPYSICPYQHQRGINE

SEQ ID NO: 2590194 - protein, 25 aa, Entamoeba histolytica
YILQFGLCYLIFPIVQTYSIVGDFT

SEQ ID NO: 2590195 - protein, 19 aa, Entamoeba histolytica
YILSISWSSVLYLIQDLGL

SEQ ID NO: 2590196 - protein, 23 aa, Entamoeba histolytica
YILSMIACGFSIPKVSLASLAKE

SEQ ID NO: 2590197 - protein, 19 aa, Entamoeba histolytica
YILSPRITSVIYPKTPYYL

SEQ ID NO: 2590198 - protein, 43 aa, Entamoeba histolytica
YILSTICFAFGFALYYDWKLALCVIAVFPIHTLILFFDFKLNS

SEQ ID NO: 2590199 - protein, 19 aa, Entamoeba histolytica
YINGFKAKMGDEFKKILKE

SEQ ID NO: 2590200 - protein, 28 aa, Entamoeba histolytica
YINLLFMPYCSFNIQIPFQIIIVEDNIK

SEQ ID NO: 2590201 - protein, 25 aa, Entamoeba histolytica
YINMVRLNLFSGFYEYYVLVFLFSF

SEQ ID NO: 2590202 - protein, 18 aa, Entamoeba histolytica
YINSGHCVECKEGYYLVI

SEQ ID NO: 2590203 - protein, 19 aa, Entamoeba histolytica
YINSVECPQAIMTTNTIIE

SEQ ID NO: 2590204 - protein, 19 aa, Entamoeba histolytica
YIPESKAGITVHSFSMKTS

SEQ ID NO: 2590205 - protein, 20 aa, Entamoeba histolytica
YIPICVIAIISIYQKNIEKG

SEQ ID NO: 2590206 - protein, 20 aa, Entamoeba histolytica
YIPKKWKIYQLWNGRVIIFI

SEQ ID NO: 2590207 - protein, 17 aa, Entamoeba histolytica
YIQEYFVSVITFIICGI

SEQ ID NO: 2590208 - protein, 22 aa, Entamoeba histolytica
YIREDNEIFLLMIELLSMNLHN

SEQ ID NO: 2590209 - protein, 18 aa, Entamoeba histolytica
YIRYETVPPSSLPDSTEI

SEQ ID NO: 2590210 - protein, 28 aa, Entamoeba histolytica
YISCWRYPRIEMFFKFLCCTETRDHPLR

SEQ ID NO: 2590211 - protein, 17 aa, Entamoeba histolytica
YISETKIPLWKDEKDKR

SEQ ID NO: 2590212 - protein, 18 aa, Entamoeba histolytica
YITGTTMPLMYIIFLTCN

SEQ ID NO: 2590213 - protein, 32 aa, Entamoeba histolytica
YITLAPMQVKFLWLCLCNIPSSSSLLEIIPLI

SEQ ID NO: 2590214 - protein, 24 aa, Entamoeba histolytica
YITSDIFYVIGFVVWTIGINMIQL

SEQ ID NO: 2590215 - protein, 17 aa, Entamoeba histolytica
YIVCSGLIKVSYGKVTL

SEQ ID NO: 2590216 - protein, 26 aa, Entamoeba histolytica
YIVGFIICLLLFFRLTKKIKQEIEDE

SEQ ID NO: 2590217 - protein, 19 aa, Entamoeba histolytica
YIVGMMLFSFIVLINIVYM

SEQ ID NO: 2590218 - protein, 32 aa, Entamoeba histolytica
YIVRLCPFTMSFIRSRIQSVKVILTVGLIMTL

SEQ ID NO: 2590219 - protein, 21 aa, Entamoeba histolytica
YIVSCFRRLACHHIHVSGKIW

SEQ ID NO: 2590220 - protein, 17 aa, Entamoeba histolytica
YIVYGIAMLICIGLCIL

SEQ ID NO: 2590221 - protein, 33 aa, Entamoeba histolytica
YIYFFKGRLWFTLEFISFIGMFYSFITLHFILV

SEQ ID NO: 2590222 - protein, 25 aa, Entamoeba histolytica
YIYGKWFKLNMNFSGYISIETVFHY

SEQ ID NO: 2590223 - protein, 25 aa, Entamoeba histolytica
YKCDEVFKTPKKCTFKTGETDIDFN

SEQ ID NO: 2590224 - protein, 20 aa, Entamoeba histolytica
YKDQFPISGIFEVHQHVEIN

SEQ ID NO: 2590225 - protein, 19 aa, Entamoeba histolytica
YKERKEFGEHVLIQVICEN

SEQ ID NO: 2590226 - protein, 29 aa, Entamoeba histolytica
YKEVIMPNFLFLIKICLRIKDIYKVLDYE

SEQ ID NO: 2590227 - protein, 19 aa, Entamoeba histolytica
YKFPLNFEDSYSCGSENYK

SEQ ID NO: 2590228 - protein, 17 aa, Entamoeba histolytica
YKFTLNLEIGIEAIDYE

SEQ ID NO: 2590229 - protein, 17 aa, Entamoeba histolytica
YKIEKEYAYVVTVLITL

SEQ ID NO: 2590230 - protein, 24 aa, Entamoeba histolytica
YKIIPDSVFIEWMIKYDNAKSLIV

SEQ ID NO: 2590231 - protein, 17 aa, Entamoeba histolytica
YKIKDFIIFGIPLMILS

SEQ ID NO: 2590232 - protein, 19 aa, Entamoeba histolytica
YKILKKLDVDYVLVIFGGV

SEQ ID NO: 2590233 - protein, 19 aa, Entamoeba histolytica
YKITLNGGIKIISNEPGYT

SEQ ID NO: 2590234 - protein, 25 aa, Entamoeba histolytica
YKKETSSCLFEWRGKCWKCNDGYYM

SEQ ID NO: 2590235 - protein, 27 aa, Entamoeba histolytica
YKKLPETLVFHLKRFGYNEQFQIVKYN

SEQ ID NO: 2590236 - protein, 27 aa, Entamoeba histolytica
YKLDLRIIRALYDLGFINPTEIQQLSI

SEQ ID NO: 2590237 - protein, 25 aa, Entamoeba histolytica
YKLGLTVRETCRFNYNYNETIPREF

SEQ ID NO: 2590238 - protein, 18 aa, Entamoeba histolytica
YKLGRIPYLYLVIVALFT

SEQ ID NO: 2590239 - protein, 22 aa, Entamoeba histolytica
YKLKIKMLFDTARGMEFLHENN

SEQ ID NO: 2590240 - protein, 25 aa, Entamoeba histolytica
YKLKKLRAKRNIKEFPSSFNPINLP

SEQ ID NO: 2590241 - protein, 17 aa, Entamoeba histolytica
YKLLFLLIVNLLFFLCE

SEQ ID NO: 2590242 - protein, 19 aa, Entamoeba histolytica
YKLLHIIPFDSDRKRMSVI

SEQ ID NO: 2590243 - protein, 21 aa, Entamoeba histolytica
YKLMNCIIHVIGLTHSDGSSW

SEQ ID NO: 2590244 - protein, 22 aa, Entamoeba histolytica
YKLRMLKALHLYETIFLGKNNN

SEQ ID NO: 2590245 - protein, 20 aa, Entamoeba histolytica
YKMVLLVRKDLKMQKGKIAA

SEQ ID NO: 2590246 - protein, 27 aa, Entamoeba histolytica
YKNASFFLILLWYSFISNFTCQVVFDD

SEQ ID NO: 2590247 - protein, 25 aa, Entamoeba histolytica
YKNCDANPTALAFDMCTLRSDITSI

SEQ ID NO: 2590248 - protein, 21 aa, Entamoeba histolytica
YKNEVIGLLLLGFIYTVHCFF

SEQ ID NO: 2590249 - protein, 28 aa, Entamoeba histolytica
YKNKDYISSISFCWWLLNGILSSITIFF

SEQ ID NO: 2590250 - protein, 23 aa, Entamoeba histolytica
YKNVAFILMQFWFGIQNAFSGQS

SEQ ID NO: 2590251 - protein, 25 aa, Entamoeba histolytica
YKPTELGDYCEFHLNVLIVILPIIG

SEQ ID NO: 2590252 - protein, 23 aa, Entamoeba histolytica
YKQYQMYIGITGFIIITTILLLI

SEQ ID NO: 2590253 - protein, 17 aa, Entamoeba histolytica
YKSIKLISCDPLEDTTI

SEQ ID NO: 2590254 - protein, 19 aa, Entamoeba histolytica
YKSLEEWYIHNDIPNNKQQ

SEQ ID NO: 2590255 - protein, 20 aa, Entamoeba histolytica
YKSLNAIILLIRIFQQIGDF

SEQ ID NO: 2590256 - protein, 18 aa, Entamoeba histolytica
YKSMKCSVIVIPKTSKEV

SEQ ID NO: 2590257 - protein, 19 aa, Entamoeba histolytica
YKTLLLWVIEALIVSTMVF

SEQ ID NO: 2590258 - protein, 23 aa, Entamoeba histolytica
YKTTFSIHGSFIFYHELLPQIFI

SEQ ID NO: 2590259 - protein, 21 aa, Entamoeba histolytica
YKVVNDYKYAFPLFIQANVLL

SEQ ID NO: 2590260 - protein, 18 aa, Entamoeba histolytica
YKYAFPLFIQANVLLASS

SEQ ID NO: 2590261 - protein, 19 aa, Entamoeba histolytica
YKYAFPLFIQTNVLLASST

SEQ ID NO: 2590262 - protein, 17 aa, Entamoeba histolytica
YKYIKNWWIHRKDEKQP

SEQ ID NO: 2590263 - protein, 24 aa, Entamoeba histolytica
YKYKSRLYMLLWGIWFYCSEQTEV

SEQ ID NO: 2590264 - protein, 17 aa, Entamoeba histolytica
YKYRSLLPMIGNTKIGA

SEQ ID NO: 2590265 - protein, 17 aa, Entamoeba histolytica
YKYTYVLHYTASSSSGN

SEQ ID NO: 2590266 - protein, 23 aa, Entamoeba histolytica
YLCECLFNLSLILKEHIGNPVVY

SEQ ID NO: 2590267 - protein, 18 aa, Entamoeba histolytica
YLCSSGICVLDYSKSNQT

SEQ ID NO: 2590268 - protein, 17 aa, Entamoeba histolytica
YLDDSMKCVNCPDNCTS

SEQ ID NO: 2590269 - protein, 26 aa, Entamoeba histolytica
YLDGFGYRYTEHWVLDNSKPTFSYSI

SEQ ID NO: 2590270 - protein, 20 aa, Entamoeba histolytica
YLDKAIESFSQFNTLNKTTL

SEQ ID NO: 2590271 - protein, 24 aa, Entamoeba histolytica
YLDLFRMLITFIGNSIGFVRMIRT

SEQ ID NO: 2590272 - protein, 18 aa, Entamoeba histolytica
YLDNALRPYVVKCGESNY

SEQ ID NO: 2590273 - protein, 17 aa, Entamoeba histolytica
YLDQSIVARDWMDIYSP

SEQ ID NO: 2590274 - protein, 32 aa, Entamoeba histolytica; identical to SEQ ID NO: 2392628

SEQ ID NO: 2590275 - protein, 18 aa, Entamoeba histolytica
YLEKQAQNGFGFIENIKE

SEQ ID NO: 2590276 - protein, 20 aa, Entamoeba histolytica
YLELLYCYNSYWIVLVCMVI

SEQ ID NO: 2590277 - protein, 25 aa, Entamoeba histolytica
YLFDILLRFLHFVFPAKIISKEVTK

SEQ ID NO: 2590278 - protein, 38 aa, Entamoeba histolytica
YLGFLVVVMVFRFFLCKGRLIVLRRFVTLMGVMFLMRI

SEQ ID NO: 2590279 - protein, 17 aa, Entamoeba histolytica
YLGRKGHELRQKNINLY

SEQ ID NO: 2590280 - protein, 23 aa, Entamoeba histolytica
YLHCEWAYPIKFTVIPRPVRKNN

SEQ ID NO: 2590281 - protein, 17 aa, Entamoeba histolytica
YLHCPMVDYWIPENRAL

SEQ ID NO: 2590282 - protein, 18 aa, Entamoeba histolytica
YLHILFKMVHHSLLSEIQ

SEQ ID NO: 2590283 - protein, 25 aa, Entamoeba histolytica
YLIFLVKPYVNWSRMYLEINELIDG

SEQ ID NO: 2590284 - protein, 23 aa, Entamoeba histolytica
YLILCLIIKLVMIASAIIFSKSE

SEQ ID NO: 2590285 - protein, 26 aa, Entamoeba histolytica
YLINKRFSYFFFHWSDLIRTAFFHII

SEQ ID NO: 2590286 - protein, 18 aa, Entamoeba histolytica
YLIVISIEDINHVFNTTD

SEQ ID NO: 2590287 - protein, 21 aa, Entamoeba histolytica
YLIVSCCFVLFALGLVGSLYI

SEQ ID NO: 2590288 - protein, 29 aa, Entamoeba histolytica
YLKECTKIKWKQCISFDNCHRILPTLSLR

SEQ ID NO: 2590289 - protein, 20 aa, Entamoeba histolytica
YLKHFSVIVKFILINKKCWD

SEQ ID NO: 2590290 - protein, 19 aa, Entamoeba histolytica
YLLAKYCWEKVYASKNNQL

SEQ ID NO: 2590291 - protein, 28 aa, Entamoeba histolytica
YLLCCIKLHPMIRFIFFIISFLIGLTAL

SEQ ID NO: 2590292 - protein, 21 aa, Entamoeba histolytica
YLLESLGFAFVLPMESSQTIG

SEQ ID NO: 2590293 - protein, 23 aa, Entamoeba histolytica
YLLFALQVSFRFSSVTILSYLFL

SEQ ID NO: 2590294 - protein, 18 aa, Entamoeba histolytica
YLLFTIAMACCVVLCILS

SEQ ID NO: 2590295 - protein, 20 aa, Entamoeba histolytica
YLLMEMNIFITIFVGFAVWA

SEQ ID NO: 2590296 - protein, 26 aa, Entamoeba histolytica
YLLPSCTFFLGFSFIFGNYMKRVWES

SEQ ID NO: 2590297 - protein, 23 aa, Entamoeba histolytica
YLLSKWLLKYLKVRDIEKQLNIF

SEQ ID NO: 2590298 - protein, 18 aa, Entamoeba histolytica
YLLVPLILMFGLCFLYVS

SEQ ID NO: 2590299 - protein, 18 aa, Entamoeba histolytica
YLMIAFRPKKIISSSDEP

SEQ ID NO: 2590300 - protein, 28 aa, Entamoeba histolytica
YLMNKKIVWRDIINRMILDKESLLAKNQ

SEQ ID NO: 2590301 - protein, 17 aa, Entamoeba histolytica
YLMTCIFVAFNKVYTMQ

SEQ ID NO: 2590302 - protein, 18 aa, Entamoeba histolytica
YLMTCIFVAFNKVYTMQY

SEQ ID NO: 2590303 - protein, 25 aa, Entamoeba histolytica
YLNGFKMKFEIKVHVFFGTITLNAE

SEQ ID NO: 2590304 - protein, 23 aa, Entamoeba histolytica
YLNNCGRCGCLILILHDIVDAIM

SEQ ID NO: 2590305 - protein, 29 aa, Entamoeba histolytica
YLNTLPSWRWYYKFHYAPFALDFALYLNE

SEQ ID NO: 2590306 - protein, 25 aa, Entamoeba histolytica
YLPHISIICAIVFAAYPTIYTTPEI

SEQ ID NO: 2590307 - protein, 25 aa, Entamoeba histolytica
YLPKDFDKGLSMRFGKAYLLSNKKL

SEQ ID NO: 2590308 - protein, 18 aa, Entamoeba histolytica
YLPKDFDKGLSMTDGTAY

SEQ ID NO: 2590309 - protein, 17 aa, Entamoeba histolytica
YLPLAHIFELCLEFCIL

SEQ ID NO: 2590310 - protein, 20 aa, Entamoeba histolytica
YLPLRKHYTLGYTVLAIILP

SEQ ID NO: 2590311 - protein, 24 aa, Entamoeba histolytica
YLPRPFHEYPFKTTMALSREECAI

SEQ ID NO: 2590312 - protein, 24 aa, Entamoeba histolytica
  misc_feature (22)..(24): Xaa can be any naturally occurring amino acid
YLPRPFHEYPFKTTMALSREEXXX

SEQ ID NO: 2590313 - protein, 23 aa, Entamoeba histolytica
YLPRRISNQLLLKEGDELYVSIS

SEQ ID NO: 2590314 - protein, 18 aa, Entamoeba histolytica
YLQISLLSLYCKLGQAIG

SEQ ID NO: 2590315 - protein, 24 aa, Entamoeba histolytica
YLQLPRTFGELGVNEIRQRIDPQY

SEQ ID NO: 2590316 - protein, 22 aa, Entamoeba histolytica
YLRHPSYFGWFWWSVTTQIVML

SEQ ID NO: 2590317 - protein, 23 aa, Entamoeba histolytica
YLRIKFVLDCAKGIQYLHTNGIM

SEQ ID NO: 2590318 - protein, 20 aa, Entamoeba histolytica
YLRQLMKLKNGFERIKANLF

SEQ ID NO: 2590319 - protein, 19 aa, Entamoeba histolytica
YLSAPRCILFFTGNPSLLA

SEQ ID NO: 2590320 - protein, 25 aa, Entamoeba histolytica
YLSDECKYCKTPCGSGCCTKISSSM

SEQ ID NO: 2590321 - protein, 24 aa, Entamoeba histolytica
YLSDLRLGMHYPLGSVVMLTNTAD

SEQ ID NO: 2590322 - protein, 18 aa, Entamoeba histolytica
YLSLPALLLTYIDFIIAA

SEQ ID NO: 2590323 - protein, 17 aa, Entamoeba histolytica
YLSMVVFVILNLIGLII

SEQ ID NO: 2590324 - protein, 18 aa, Entamoeba histolytica
YLSSPSLVCRSLVRLQPY

SEQ ID NO: 2590325 - protein, 19 aa, Entamoeba histolytica
YLSSTAFKFEAVRMYGNSF

SEQ ID NO: 2590326 - protein, 17 aa, Entamoeba histolytica
YLTFMLQLFVTHPLTED

SEQ ID NO: 2590327 - protein, 18 aa, Entamoeba histolytica
YLTLEYKGIQNFLMTNIA

SEQ ID NO: 2590328 - protein, 26 aa, Entamoeba histolytica
YLTNKLTIWYKIRCINIDIDKATTIM

SEQ ID NO: 2590329 - protein, 21 aa, Entamoeba histolytica
YLVIAVLCFIQSLRIVKNHHK

SEQ ID NO: 2590330 - protein, 26 aa, Entamoeba histolytica
YLVICWSCTFSLIFLINIIVPGKSPR

SEQ ID NO: 2590331 - protein, 19 aa, Entamoeba histolytica
YLVKWKLFRSLALEDLKKT

SEQ ID NO: 2590332 - protein, 18 aa, Entamoeba histolytica
YLVWCMFLVLLVSLYGLH

SEQ ID NO: 2590333 - protein, 22 aa, Entamoeba histolytica
YLVYKNPLLLNAINHFIPTKTS

SEQ ID NO: 2590334 - protein, 24 aa, Entamoeba histolytica
YLYYFCKAGNMGICENEKELIKKV

SEQ ID NO: 2590335 - protein, 18 aa, Entamoeba histolytica
YMAMGTCVYYCTIPTKLN

SEQ ID NO: 2590336 - protein, 17 aa, Entamoeba histolytica
YMDKLGLMNYLSLKTIK

SEQ ID NO: 2590337 - protein, 21 aa, Entamoeba histolytica
YMFIVCPAFLLSGISSLLFIF

SEQ ID NO: 2590338 - protein, 23 aa, Entamoeba histolytica
YMIPIPWNRWVILACSIARCVFY

SEQ ID NO: 2590339 - protein, 19 aa, Entamoeba histolytica
YMLHYHFQIDLGEIPLTSD

SEQ ID NO: 2590340 - protein, 20 aa, Entamoeba histolytica
YMRLKCPHAQFTLAKDEFVE

SEQ ID NO: 2590341 - protein, 21 aa, Entamoeba histolytica
YMRLKCPHAQFTLAKDEFVEG

SEQ ID NO: 2590342 - protein, 20 aa, Entamoeba histolytica
YMRLKCPHAQFTLAKDYLVG

SEQ ID NO: 2590343 - protein, 17 aa, Entamoeba histolytica
YMSVNSLCVPKCDIEGC

SEQ ID NO: 2590344 - protein, 18 aa, Entamoeba histolytica
YMVWGKKVCEAFRGINGV

SEQ ID NO: 2590345 - protein, 20 aa, Entamoeba histolytica
YMYMYFCIPLTKELYSQSNQ

SEQ ID NO: 2590346 - protein, 24 aa, Entamoeba histolytica
YNCSKFCKYCFDDLMKLISKTPKG

SEQ ID NO: 2590347 - protein, 21 aa, Entamoeba histolytica
YNDPFDLILHFNKVEFDQADV

SEQ ID NO: 2590348 - protein, 31 aa, Entamoeba histolytica; identical to SEQ ID NO: 2392693

SEQ ID NO: 2590349 - protein, 19 aa, Entamoeba histolytica
YNFMNYRVDGVLVITLFSL

SEQ ID NO: 2590350 - protein, 17 aa, Entamoeba histolytica
YNFRFLYVMLCGICVFI

SEQ ID NO: 2590351 - protein, 23 aa, Entamoeba histolytica
YNKDGECLSCNSIKPNCAVCNIT

SEQ ID NO: 2590352 - protein, 24 aa, Entamoeba histolytica
YNKKLIIFFLWFTFFFFLFIFYYK

SEQ ID NO: 2590353 - protein, 27 aa, Entamoeba histolytica
YNKYNWIKQNWLVLILVTGVFLLILMA

SEQ ID NO: 2590354 - protein, 19 aa, Entamoeba histolytica
YNLFPMIFFGLILFVLNSF

SEQ ID NO: 2590355 - protein, 17 aa, Entamoeba histolytica
YNLGISVGETYRYNYNY

SEQ ID NO: 2590356 - protein, 25 aa, Entamoeba histolytica
YNLIGRYPLLGNWKESFSISYEQLI

SEQ ID NO: 2590357 - protein, 17 aa, Entamoeba histolytica
YNLIPLQTFLGGTIIGK

SEQ ID NO: 2590358 - protein, 25 aa, Entamoeba histolytica
YNLKLRMLYDTARGMSFLHENNILH

SEQ ID NO: 2590359 - protein, 17 aa, Entamoeba histolytica
YNLRIGLNQTIKGFFNS

SEQ ID NO: 2590360 - protein, 24 aa, Entamoeba histolytica
YNLTSRCPGCFITFSSYFIDPFWE

SEQ ID NO: 2590361 - protein, 22 aa, Entamoeba histolytica
YNNRVKIPITFYSKNKEKMMYI

SEQ ID NO: 2590362 - protein, 21 aa, Entamoeba histolytica
YNPKLSEIDLLYSANLTNAKC

SEQ ID NO: 2590363 - protein, 19 aa, Entamoeba histolytica
YNQIPVCGDSVWNQYYEQC

SEQ ID NO: 2590364 - protein, 19 aa, Entamoeba histolytica
YNSEFFYPNEVCPYTVRRG

SEQ ID NO: 2590365 - protein, 17 aa, Entamoeba histolytica
YNSLPFVPKKILGICCT

SEQ ID NO: 2590366 - protein, 18 aa, Entamoeba histolytica
YNVLKGLTVGLGLGAVMF

SEQ ID NO: 2590367 - protein, 23 aa, Entamoeba histolytica
YNVRKTFYTNWPYKSKNDIHAVR

SEQ ID NO: 2590368 - protein, 25 aa, Entamoeba histolytica
YNYRRLSYVILYSFYKNIVMYLTQF

SEQ ID NO: 2590369 - protein, 19 aa, Entamoeba histolytica
YNYTRMSAIFFGKGGKMTS

SEQ ID NO: 2590370 - protein, 20 aa, Entamoeba histolytica
YPAIFGKITIFKRFPALLPQ

SEQ ID NO: 2590371 - protein, 27 aa, Entamoeba histolytica
YPARYCIYCSHFLPPRAYHCVICNKCT

SEQ ID NO: 2590372 - protein, 17 aa, Entamoeba histolytica
YPDCHYLSYLFDLSLNI

SEQ ID NO: 2590373 - protein, 20 aa, Entamoeba histolytica
YPDFDRLGGTISYIQKTFPL

SEQ ID NO: 2590374 - protein, 20 aa, Entamoeba histolytica
YPECKSYTTSIIIISVIGGI

SEQ ID NO: 2590375 - protein, 24 aa, Entamoeba histolytica
YPEKEFPYIWNIASFIADGKRRPK

SEQ ID NO: 2590376 - protein, 26 aa, Entamoeba histolytica
YPEMKSLCPHTPFFLIATQSEKRNKC

SEQ ID NO: 2590377 - protein, 25 aa, Entamoeba histolytica
YPFKENRPLDFIYFTDVGVYKFYCM

SEQ ID NO: 2590378 - protein, 17 aa, Entamoeba histolytica
YPFYRKLNKLLFDLHDL

SEQ ID NO: 2590379 - protein, 19 aa, Entamoeba histolytica
YPHPWDIADTITIGKRPNI

SEQ ID NO: 2590380 - protein, 17 aa, Entamoeba histolytica
YPIECTKDLDGYYKYIQ

SEQ ID NO: 2590381 - protein, 25 aa, Entamoeba histolytica
YPIFLNWYNFFIAFGLVLMATFMKR

SEQ ID NO: 2590382 - protein, 20 aa, Entamoeba histolytica
YPIQLIWRGLYFINTYSYFR

SEQ ID NO: 2590383 - protein, 20 aa, Entamoeba histolytica
YPIREYQLDWSRIPSDTSKL

SEQ ID NO: 2590384 - protein, 27 aa, Entamoeba histolytica
YPKGVKSCSAILFWCYMFAILNIIFGV

SEQ ID NO: 2590385 - protein, 28 aa, Entamoeba histolytica
YPKSWELLKEYIIILFIIILSRTSYFWG

SEQ ID NO: 2590386 - protein, 20 aa, Entamoeba histolytica
YPLCLQCSWTTTSTSCVLCS

SEQ ID NO: 2590387 - protein, 17 aa, Entamoeba histolytica
YPLLSGISGSIGGLFSK

SEQ ID NO: 2590388 - protein, 18 aa, Entamoeba histolytica
YPLLSLFIAFILAIICIV

SEQ ID NO: 2590389 - protein, 17 aa, Entamoeba histolytica
YPLLYKLVSSLLKSRFS

SEQ ID NO: 2590390 - protein, 26 aa, Entamoeba histolytica
YPLNSCIDFSDYAAYFFYNNNTHMNF

SEQ ID NO: 2590391 - protein, 23 aa, Entamoeba histolytica
YPLRFTITKAIGWIVCIGGILLF

SEQ ID NO: 2590392 - protein, 21 aa, Entamoeba histolytica
YPSIIEFYGFIFFYPGLFSGP

SEQ ID NO: 2590393 - protein, 25 aa, Entamoeba histolytica
YPTFSGKLWPTGAMDFFTMAPFITA

SEQ ID NO: 2590394 - protein, 22 aa, Entamoeba histolytica
YPTRLSHRVLKGFNLEIKKGET

SEQ ID NO: 2590395 - protein, 26 aa, Entamoeba histolytica
YPVCIPNIIMKVILFEVEFDGDYSIL

SEQ ID NO: 2590396 - protein, 26 aa, Entamoeba histolytica
YPVEEFKFPWKIADFVCDGKRLLQPE

SEQ ID NO: 2590397 - protein, 17 aa, Entamoeba histolytica
YPVGDGFYFTFMMGLGI

SEQ ID NO: 2590398 - protein, 21 aa, Entamoeba histolytica
YPVHRYIASRFIWDIFCLFAI

SEQ ID NO: 2590399 - protein, 18 aa, Entamoeba histolytica
YPVILGMVYIISKLLLYN

SEQ ID NO: 2590400 - protein, 19 aa, Entamoeba histolytica
YPWEIADFISEGKRPRKED

SEQ ID NO: 2590401 - protein, 17 aa, Entamoeba histolytica
YQCFTVQDGINFKMKND

SEQ ID NO: 2590402 - protein, 26 aa, Entamoeba histolytica
YQELMKTIGISPVFICYMESMKKVKL

SEQ ID NO: 2590403 - protein, 17 aa, Entamoeba histolytica
YQFPFVIFNHLLEVPQT

SEQ ID NO: 2590404 - protein, 21 aa, Entamoeba histolytica
YQGHTLFIKWWRGSKSKSGVL

SEQ ID NO: 2590405 - protein, 23 aa, Entamoeba histolytica
YQGSFPSAHWVLYAILELIISNY

SEQ ID NO: 2590406 - protein, 17 aa, Entamoeba histolytica
YQGYIPLQFETELSTRL

SEQ ID NO: 2590407 - protein, 17 aa, Entamoeba histolytica
YQILRMKLSYYTKDLYR

SEQ ID NO: 2590408 - protein, 26 aa, Entamoeba histolytica
YQKKEFRIPISIFIDQQFLALMKLYH

SEQ ID NO: 2590409 - protein, 19 aa, Entamoeba histolytica
YQKNEFSDLLAYKMLNDVA

SEQ ID NO: 2590410 - protein, 21 aa, Entamoeba histolytica
YQKYPFCGRIIAGLELDVESS

SEQ ID NO: 2590411 - protein, 17 aa, Entamoeba histolytica
YQLIADMFICKGKVHVD

SEQ ID NO: 2590412 - protein, 20 aa, Entamoeba histolytica
YQLIGRVNWKVEVSVDGKLE

SEQ ID NO: 2590413 - protein, 25 aa, Entamoeba histolytica
YQLLKGLFLIYAFIIHYYRFSVIFI

SEQ ID NO: 2590414 - protein, 26 aa, Entamoeba histolytica
YQLNLWKNYLMYFPANMEIDLGLNKE

SEQ ID NO: 2590415 - protein, 26 aa, Entamoeba histolytica
YQLRPRYLFIPFIKLFDSLVFKKIKE

SEQ ID NO: 2590416 - protein, 17 aa, Entamoeba histolytica
YQLWNGRVIIFIIRCSI

SEQ ID NO: 2590417 - protein, 24 aa, Entamoeba histolytica
YQMASGLSIFGWLLAAVFIIAAAV

SEQ ID NO: 2590418 - protein, 17 aa, Entamoeba histolytica
YQPNGLGECIIQCLYGD

SEQ ID NO: 2590419 - protein, 22 aa, Entamoeba histolytica
YQRFSRCYSILLTIAYVKILLA

SEQ ID NO: 2590420 - protein, 23 aa, Entamoeba histolytica
YQRYVLKIFMLFSSQRSACSRML

SEQ ID NO: 2590421 - protein, 24 aa, Entamoeba histolytica
YQYMTICKLFESFSDILLTLLITF

SEQ ID NO: 2590422 - protein, 17 aa, Entamoeba histolytica
YRALYIINWIYRYATEQ

SEQ ID NO: 2590423 - protein, 17 aa, Entamoeba histolytica
YRCPGCTQGSYCPGNDI

SEQ ID NO: 2590424 - protein, 22 aa, Entamoeba histolytica
YREKMKLFGIFVAINVIFIVFV

SEQ ID NO: 2590425 - protein, 21 aa, Entamoeba histolytica
YRFKLDVIIVIIAFIGYIAYE

SEQ ID NO: 2590426 - protein, 25 aa, Entamoeba histolytica
YRFTEGFKKKEIVKLNSFDYYKGIT

SEQ ID NO: 2590427 - protein, 24 aa, Entamoeba histolytica
YRIKSQLSMKVARCYAQINNIVVH

SEQ ID NO: 2590428 - protein, 26 aa, Entamoeba histolytica
YRIPLYLEFYSMFSAGHFIIGLGDII

SEQ ID NO: 2590429 - protein, 27 aa, Entamoeba histolytica
YRKAPCGNGGYVQGFWVKFDSKAMEND

SEQ ID NO: 2590430 - protein, 19 aa, Entamoeba histolytica
YRKEIRLFWVSGQPIPQFI

SEQ ID NO: 2590431 - protein, 25 aa, Entamoeba histolytica
YRKKEPYQRIEFILTIGKSNEGTVT

SEQ ID NO: 2590432 - protein, 24 aa, Entamoeba histolytica
YRKKEPYQRIEFTLTIGKSNEGTV

SEQ ID NO: 2590433 - protein, 19 aa, Entamoeba histolytica
YRLPFPDFISPKMKNVIMK

SEQ ID NO: 2590434 - protein, 18 aa, Entamoeba histolytica
YRLSQGLCIGCPTERGEG

SEQ ID NO: 2590435 - protein, 21 aa, Entamoeba histolytica
YRNVLRLGFGILEFTLAISIG

SEQ ID NO: 2590436 - protein, 18 aa, Entamoeba histolytica
YRPMGIQVQQEFEGFSYS

SEQ ID NO: 2590437 - protein, 19 aa, Entamoeba histolytica
YRQKVLRSKGFGTVSPTTT

SEQ ID NO: 2590438 - protein, 24 aa, Entamoeba histolytica
YRQRLTRIWVFFIFPVVVNAYRCN

SEQ ID NO: 2590439 - protein, 19 aa, Entamoeba histolytica
YRRATYRYTPLLAEILIPD

SEQ ID NO: 2590440 - protein, 20 aa, Entamoeba histolytica
YRSDCLGCAEGYIPQGYLKC

SEQ ID NO: 2590441 - protein, 26 aa, Entamoeba histolytica
YRSWLHCLWVIFIGCSGILVLSFTFH

SEQ ID NO: 2590442 - protein, 22 aa, Entamoeba histolytica
YRTLGTILFNCRLSLYLPLFLK

SEQ ID NO: 2590443 - protein, 26 aa, Entamoeba histolytica
YRVGRKMIKQKGKWYRIHTNGLGNNI

SEQ ID NO: 2590444 - protein, 18 aa, Entamoeba histolytica
YRVIAIFDYILYILAEPT

SEQ ID NO: 2590445 - protein, 17 aa, Entamoeba histolytica
YSACALLTKGMWERGSA

SEQ ID NO: 2590446 - protein, 21 aa, Entamoeba histolytica
YSACDYVFHFLVRVEPFTTMF

SEQ ID NO: 2590447 - protein, 17 aa, Entamoeba histolytica
YSALKCPHAQFTEAKGY

SEQ ID NO: 2590448 - protein, 18 aa, Entamoeba histolytica
YSDFTIDLDVDFTPSFNW

SEQ ID NO: 2590449 - protein, 24 aa, Entamoeba histolytica
YSDRGCGINSRLIHQLSSDYDYFI

SEQ ID NO: 2590450 - protein, 25 aa, Entamoeba histolytica
YSEKARFDKLLLYASSCAAYYPEPQ

SEQ ID NO: 2590451 - protein, 27 aa, Entamoeba histolytica
YSFAILMYECINWCYAYPISMKTWNIA

SEQ ID NO: 2590452 - protein, 26 aa, Entamoeba histolytica
YSFFLKIPFIYRSVVNFILYTSCYFI

SEQ ID NO: 2590453 - protein, 17 aa, Entamoeba histolytica
YSFGISAWEVFYQDEPY

SEQ ID NO: 2590454 - protein, 25 aa, Entamoeba histolytica
YSFHTICIFILFVALVYRHTITLNW

SEQ ID NO: 2590455 - protein, 23 aa, Entamoeba histolytica
YSFPDNCRKVLSITKSWKETQSL

SEQ ID NO: 2590456 - protein, 18 aa, Entamoeba histolytica
YSFPFKFMLEQLMRFSNI

SEQ ID NO: 2590457 - protein, 28 aa, Entamoeba histolytica
YSGIKFVLRLSFIQSCLKSNQIIKKICD

SEQ ID NO: 2590458 - protein, 17 aa, Entamoeba histolytica
YSGSLIIEKGIGDYFNM

SEQ ID NO: 2590459 - protein, 18 aa, Entamoeba histolytica
YSHDPSFKYTASTCGTES

SEQ ID NO: 2590460 - protein, 20 aa, Entamoeba histolytica
YSHSQLRICVINNCKISIYQ

SEQ ID NO: 2590461 - protein, 27 aa, Entamoeba histolytica
YSIEYPHLYLLMEFMPKHSLFNVLHSN

SEQ ID NO: 2590462 - protein, 17 aa, Entamoeba histolytica
YSIKLSDICLGFNLSLN

SEQ ID NO: 2590463 - protein, 25 aa, Entamoeba histolytica
YSIPEFRFLVKLILVHGRYCYRQIG

SEQ ID NO: 2590464 - protein, 17 aa, Entamoeba histolytica
YSISIAIIFLVYLMLQI

SEQ ID NO: 2590465 - protein, 34 aa, Entamoeba histolytica
YSIVFRYFATWKMAECMGILFGFGYSGVKENKPT

SEQ ID NO: 2590466 - protein, 18 aa, Entamoeba histolytica
YSIYCFKQYINYNKKEMY

SEQ ID NO: 2590467 - protein, 20 aa, Entamoeba histolytica
YSKRECSKLILIDESEKGGR

SEQ ID NO: 2590468 - protein, 18 aa, Entamoeba histolytica
YSLAYLIPANLMFYIFRS

SEQ ID NO: 2590469 - protein, 17 aa, Entamoeba histolytica
YSLGIVLYYLIYLQFPF

SEQ ID NO: 2590470 - protein, 17 aa, Entamoeba histolytica
YSLMWKQKQIFIKTFTK

SEQ ID NO: 2590471 - protein, 26 aa, Entamoeba histolytica
YSMLLMFCIGIFWIIVGTLILISSES

SEQ ID NO: 2590472 - protein, 19 aa, Entamoeba histolytica
YSMMYKMCYHNFYKASNGY

SEQ ID NO: 2590473 - protein, 19 aa, Entamoeba histolytica
YSNAMIRNILEPMRMISVW

SEQ ID NO: 2590474 - protein, 22 aa, Entamoeba histolytica
YSNETKKVFNIFGTNQLVFDNN

SEQ ID NO: 2590475 - protein, 18 aa, Entamoeba histolytica
YSNHELKGVLTIYKNAEA

SEQ ID NO: 2590476 - protein, 26 aa, Entamoeba histolytica
YSNKHKRLYNVYNVHLKGEAIHEVSD

SEQ ID NO: 2590477 - protein, 22 aa, Entamoeba histolytica
YSQFKNCFTVPVLCNDKSQCTQ

SEQ ID NO: 2590478 - protein, 26 aa, Entamoeba histolytica
YSQMLDLFNYFGLRTGLMYIHCFMRR

SEQ ID NO: 2590479 - protein, 21 aa, Entamoeba histolytica
YSTETRLLLNLSKNNESILTI

SEQ ID NO: 2590480 - protein, 24 aa, Entamoeba histolytica
YSTLKRWVNESSFIGINAMSNDIA

SEQ ID NO: 2590481 - protein, 24 aa, Entamoeba histolytica
YSTTCLNGKCVVQAVGDVSNVGCG

SEQ ID NO: 2590482 - protein, 24 aa, Entamoeba histolytica
YSTTCLNGQCVVQAVGDVSNVGCG

SEQ ID NO: 2590483 - protein, 25 aa, Entamoeba histolytica
YSVFYYLTMQPWRNLEWTTIDSNFP

SEQ ID NO: 2590484 - protein, 30 aa, Entamoeba histolytica; identical to SEQ ID NO: 2392859

SEQ ID NO: 2590485 - protein, 20 aa, Entamoeba histolytica
YSVNCGIQLISGGTTLATKY

SEQ ID NO: 2590486 - protein, 26 aa, Entamoeba histolytica
YSYAIVMWEFLARADPYPDIPRFHLI

SEQ ID NO: 2590487 - protein, 17 aa, Entamoeba histolytica
YSYAVTMYECFKWGNAF

SEQ ID NO: 2590488 - protein, 19 aa, Entamoeba histolytica
YSYFFKTLIKFSLTNEKAV

SEQ ID NO: 2590489 - protein, 19 aa, Entamoeba histolytica
YTAGICYKTSTISSVQITK

SEQ ID NO: 2590490 - protein, 43 aa, Entamoeba histolytica
YTCFLIAGIFYYHFWLLCILFCIARTSFELVRLFYDCQIPYIM

SEQ ID NO: 2590491 - protein, 28 aa, Entamoeba histolytica
YTCKMAKYWYLQRMDWIGAAISIITVIV

SEQ ID NO: 2590492 - protein, 20 aa, Entamoeba histolytica
YTCPICGANHQELKKVFMLE

SEQ ID NO: 2590493 - protein, 30 aa, Entamoeba histolytica
YTEHEINDLLKIRICDNIAQAMDYLHNKQI

SEQ ID NO: 2590494 - protein, 20 aa, Entamoeba histolytica
YTGKHIFIFGGSAGVGQAIA

SEQ ID NO: 2590495 - protein, 21 aa, Entamoeba histolytica
YTHLKEIIHSLLLSNHSIQTM

SEQ ID NO: 2590496 - protein, 18 aa, Entamoeba histolytica
YTHNCFYDGLDVTSYIFG

SEQ ID NO: 2590497 - protein, 19 aa, Entamoeba histolytica
YTHYAKWIGPFIKDEYFST

SEQ ID NO: 2590498 - protein, 23 aa, Entamoeba histolytica
YTIFELFWRLIFILFSCLCTCIY

SEQ ID NO: 2590499 - protein, 23 aa, Entamoeba histolytica
YTISFKLIGFIVILITCYTSNET

SEQ ID NO: 2590500 - protein, 24 aa, Entamoeba histolytica
YTKESLQIIWLWEIINEMENSLKG

SEQ ID NO: 2590501 - protein, 19 aa, Entamoeba histolytica
YTKLSSIIYQQFAFSSARK

SEQ ID NO: 2590502 - protein, 17 aa, Entamoeba histolytica
YTKLVMLLVVWMIPSSI

SEQ ID NO: 2590503 - protein, 24 aa, Entamoeba histolytica
YTLACIFLSFFFVLFFGLFPLSLL

SEQ ID NO: 2590504 - protein, 18 aa, Entamoeba histolytica
YTLEQEVENLLDLVSLTK

SEQ ID NO: 2590505 - protein, 18 aa, Entamoeba histolytica
YTLFHWVKDFTEREVRVI

SEQ ID NO: 2590506 - protein, 20 aa, Entamoeba histolytica
YTLGESLSFKSLTESSSNIA

SEQ ID NO: 2590507 - protein, 19 aa, Entamoeba histolytica
YTLKSGEAMELKFKIKMLC

SEQ ID NO: 2590508 - protein, 18 aa, Entamoeba histolytica
YTLLKNKLLILFGNTMEN

SEQ ID NO: 2590509 - protein, 22 aa, Entamoeba histolytica
YTLQMAKSWYSQRLDWLGVGLA

SEQ ID NO: 2590510 - protein, 20 aa, Entamoeba histolytica
YTMHTCFSFLNFTRYQTAGL

SEQ ID NO: 2590511 - protein, 19 aa, Entamoeba histolytica
YTPDECGYCDEKGYRSDCL

SEQ ID NO: 2590512 - protein, 23 aa, Entamoeba histolytica
YTPLKLDYVWRTALALGAVPCIL

SEQ ID NO: 2590513 - protein, 18 aa, Entamoeba histolytica
YTQINILYSLIVFSISVI

SEQ ID NO: 2590514 - protein, 20 aa, Entamoeba histolytica
YTRGNKMYCGKRDNEGNAGY

SEQ ID NO: 2590515 - protein, 19 aa, Entamoeba histolytica
YTRIVEHFIVLKNICEDHL

SEQ ID NO: 2590516 - protein, 19 aa, Entamoeba histolytica
YTRLIELFIIYMFGVTDPL

SEQ ID NO: 2590517 - protein, 21 aa, Entamoeba histolytica
YTRLKCPHAQFTLAKDYLVGG

SEQ ID NO: 2590518 - protein, 20 aa, Entamoeba histolytica
YTSQFPFNAFMHIKTSSSHV

SEQ ID NO: 2590519 - protein, 25 aa, Entamoeba histolytica
YTTIRFFNDYGLEWNGIYFEKRTNP

SEQ ID NO: 2590520 - protein, 21 aa, Entamoeba histolytica
YTTLFPLCVVLIFSGIKEIYE

SEQ ID NO: 2590521 - protein, 17 aa, Entamoeba histolytica
YTTLKLILLNPNKKVFS

SEQ ID NO: 2590522 - protein, 17 aa, Entamoeba histolytica
YTVCNWLVLLFGWMSFV

SEQ ID NO: 2590523 - protein, 17 aa, Entamoeba histolytica
YTVGDVLDISELRYSNN

SEQ ID NO: 2590524 - protein, 21 aa, Entamoeba histolytica
YTVHCFFTIYCFFISIISTKS

SEQ ID NO: 2590525 - protein, 26 aa, Entamoeba histolytica
YTVQIPNDWKNFFEDITFVQQLFNVY

SEQ ID NO: 2590526 - protein, 22 aa, Entamoeba histolytica
YVACVCCGFVNASMNVTIRRFI

SEQ ID NO: 2590527 - protein, 33 aa, Entamoeba histolytica
YVASIIARACCPRYHLTIGKEYYERVEFTNKTE

SEQ ID NO: 2590528 - protein, 30 aa, Entamoeba histolytica
YVEMSFIITCCLICISLYYLKKPKLYFRGC

SEQ ID NO: 2590529 - protein, 19 aa, Entamoeba histolytica
YVFHFMPQVHILRSHSIKV

SEQ ID NO: 2590530 - protein, 17 aa, Entamoeba histolytica
YVFPLLFRLINFIEHSV

SEQ ID NO: 2590531 - protein, 30 aa, Entamoeba histolytica
YVFYISLSFTTAIFLRWVNRVDELMVNNKF

SEQ ID NO: 2590532 - protein, 21 aa, Entamoeba histolytica
YVGTHHLCFSYLKIIKKKHVI

SEQ ID NO: 2590533 - protein, 26 aa, Entamoeba histolytica
YVHHRRPEDSWGYFEMFVKSPETGEM

SEQ ID NO: 2590534 - protein, 24 aa, Entamoeba histolytica
YVIDFLITFLVDYQRYVLKIFMLF

SEQ ID NO: 2590535 - protein, 22 aa, Entamoeba histolytica
YVIKKKIDYINGFKAKMGDEFK

SEQ ID NO: 2590536 - protein, 24 aa, Entamoeba histolytica
YVILLCFISRAFNIFPITFIMNLR

SEQ ID NO: 2590537 - protein, 26 aa, Entamoeba histolytica
YVKLPYKLKVRMLFDTARGMQFLHEN

SEQ ID NO: 2590538 - protein, 20 aa, Entamoeba histolytica
YVKVMKRIIERGADYVEKEK

SEQ ID NO: 2590539 - protein, 17 aa, Entamoeba histolytica
YVLKFKVLWSTNSGEIE

SEQ ID NO: 2590540 - protein, 20 aa, Entamoeba histolytica
YVLSPRVSVILRKDIPYYLF

SEQ ID NO: 2590541 - protein, 19 aa, Entamoeba histolytica
YVLYKRIIFSASLFISMSL

SEQ ID NO: 2590542 - protein, 23 aa, Entamoeba histolytica
YVNEDRTRFGFIAQELKEVIPEA

SEQ ID NO: 2590543 - protein, 22 aa, Entamoeba histolytica
YVNPCGRLLYNYTVNSTIPSPD

SEQ ID NO: 2590544 - protein, 17 aa, Entamoeba histolytica
YVRRTIQEFSEKRNVTI

SEQ ID NO: 2590545 - protein, 24 aa, Entamoeba histolytica
YVSIYYKMIVVWKRGIICSERVDS

SEQ ID NO: 2590546 - protein, 19 aa, Entamoeba histolytica
YVVGTCLKTGESSSKKVFK

SEQ ID NO: 2590547 - protein, 18 aa, Entamoeba histolytica
YVVIPWFVVHGFVCLFMT

SEQ ID NO: 2590548 - protein, 22 aa, Entamoeba histolytica
YVYCFKCSPGCINSCIADYTCD

SEQ ID NO: 2590549 - protein, 24 aa, Entamoeba histolytica
YVYLERRRNLKVFSEGEEVEESKE

SEQ ID NO: 2590550 - protein, 23 aa, Entamoeba histolytica
YVYRSTLRIKEFQELLIKMHPQG

SEQ ID NO: 2590551 - protein, 20 aa, Entamoeba histolytica
YWHYFRAGGFIGLILCLIPF

SEQ ID NO: 2590552 - protein, 19 aa, Entamoeba histolytica
YWILPETKIEFIGERRAWA

SEQ ID NO: 2590553 - protein, 17 aa, Entamoeba histolytica
YWINVWYVYIFYYFALV

SEQ ID NO: 2590554 - protein, 19 aa, Entamoeba histolytica
YWNKLKLLLRSIQLFDYMS

SEQ ID NO: 2590555 - protein, 18 aa, Entamoeba histolytica
YWTAYRGGILRGLKCEKG

SEQ ID NO: 2590556 - protein, 17 aa, Entamoeba histolytica
YWVENTWQMSIDKSMPI

SEQ ID NO: 2590557 - protein, 27 aa, Entamoeba histolytica
YYANSLKMKLSILIGVFHMTFGVILSL

SEQ ID NO: 2590558 - protein, 20 aa, Entamoeba histolytica
YYERYCDTLCPCEGDDCEMD

SEQ ID NO: 2590559 - protein, 19 aa, Entamoeba histolytica
YYFAYCFVASVFLQITVLL

SEQ ID NO: 2590560 - protein, 20 aa, Entamoeba histolytica
YYFFHYCYLSELQFFHSRSL

SEQ ID NO: 2590561 - protein, 17 aa, Entamoeba histolytica
YYICVAVFMVLTVPLAY

SEQ ID NO: 2590562 - protein, 17 aa, Entamoeba histolytica
YYIGKECGKIFLNIFSG

SEQ ID NO: 2590563 - protein, 24 aa, Entamoeba histolytica
YYIRATCAISDCAITLKVDKTDAS

SEQ ID NO: 2590564 - protein, 17 aa, Entamoeba histolytica
YYISNFFSVFGPLIVLI

SEQ ID NO: 2590565 - protein, 21 aa, Entamoeba histolytica
YYKLLSELFLRYKKNGGNSEL

SEQ ID NO: 2590566 - protein, 19 aa, Entamoeba histolytica
YYKTLKFTTRYDLDDLDDI

SEQ ID NO: 2590567 - protein, 25 aa, Entamoeba histolytica
YYLSYLRYAFELVMLNQFDNIPLFC

SEQ ID NO: 2590568 - protein, 26 aa, Entamoeba histolytica
YYLTTEECILCLDIICKKKLGFNSTF

SEQ ID NO: 2590569 - protein, 18 aa, Entamoeba histolytica
YYLVTKGWSFLISKEQRR

SEQ ID NO: 2590570 - protein, 20 aa, Entamoeba histolytica
YYNFFRGCWDCSDESFCPGD

SEQ ID NO: 2590571 - protein, 17 aa, Entamoeba histolytica
YYNGVTWIGRVISISEL

SEQ ID NO: 2590572 - protein, 23 aa, Entamoeba histolytica
YYNKKSTCKFTRFSEKGKNSEMF

SEQ ID NO: 2590573 - protein, 19 aa, Entamoeba histolytica
YYPLFLSYIRFIIREKTEF

SEQ ID NO: 2590574 - protein, 19 aa, Entamoeba histolytica
YYPYWTCFSPDTESTCGFG

SEQ ID NO: 2590575 - protein, 18 aa, Entamoeba histolytica
YYQDASCQHCLWIDPYKN

SEQ ID NO: 2590576 - protein, 24 aa, Entamoeba histolytica
YYSHSSLFFKPSTEELLTPLNSLK

SEQ ID NO: 2590577 - protein, 24 aa, Entamoeba histolytica
YYSKKMWPLVIVFIILQIITEIIV

SEQ ID NO: 2590578 - protein, 25 aa, Entamoeba histolytica
YYSTTCLNGKCVVQAVGDVSNVGCG

SEQ ID NO: 2590579 - protein, 25 aa, Entamoeba histolytica
YYTKKECGKIILQICSGLISLKSAI

SEQ ID NO: 2590580 - protein, 29 aa, Entamoeba histolytica
YYTLQMAKIWYSQRLEWMGFTISTLTVLI

SEQ ID NO: 2590581 - protein, 27 aa, Entamoeba histolytica
YYTYCLLHFFLYIGMMFCNYNYFNECF

SEQ ID NO: 2590582 - protein, 18 aa, Entamoeba histolytica
YYVPYLFCCVLFGLFSLF

SEQ ID NO: 2590583 - protein, 22 aa, Entamoeba histolytica
YYYDIELWYSLLARSKVPFLTF

SEQ ID NO: 2590584 - protein, 23 aa, Entamoeba histolytica
VKNNKCWKCSFWYGTNEEGNECN

SEQ ID NO: 2590585 - protein, 24 aa, Entamoeba histolytica
DNGEWSSKCVLAYCDEGYKFDYIN

SEQ ID NO: 2590586 - protein, 24 aa, Entamoeba histolytica
DNGEWSSKCVLAYCDSGYKFDYIN

SEQ ID NO: 2590587 - protein, 25 aa, Entamoeba histolytica
VYSFAICMLEIWLGRDPYDPMKFPD

SEQ ID NO: 2590588 - protein, 25 aa, Entamoeba histolytica
DNGEWSTKCVLAYCDSGYKFDYINN

SEQ ID NO: 2590589 - protein, 24 aa, Entamoeba histolytica
DNGEWSTKCVLSYCDSGYKFDYIN

SEQ ID NO: 2590590 - protein, 22 aa, Entamoeba histolytica
GIKGQCLGLGFSVITFFMIASY

SEQ ID NO: 2590591 - protein, 19 aa, Entamoeba histolytica
QRRAEKLHHFFPIQKIWNE

SEQ ID NO: 2590592 - protein, 17 aa, Entamoeba histolytica
AASSPFIVLFAIIVVIL

SEQ ID NO: 2590593 - protein, 25 aa, Entamoeba histolytica
ALYYDWKLALCVIAVFPIHTLILFF

SEQ ID NO: 2590594 - protein, 19 aa, Entamoeba histolytica
CYECTIIGCEWCNNQCSLT

SEQ ID NO: 2590595 - protein, 24 aa, Entamoeba histolytica
DNGEWSTKCVLAYCDEGYKFDYIN

SEQ ID NO: 2590596 - protein, 24 aa, Entamoeba histolytica
DNGEWSTKCVLAYCDSGYKFDYIN

SEQ ID NO: 2590597 - protein, 17 aa, Entamoeba histolytica
FAFGFALYYDWKLALCV

SEQ ID NO: 2590598 - protein, 20 aa, Entamoeba histolytica
FGIVYRAEWRGVDVAVKVMK

SEQ ID NO: 2590599 - protein, 19 aa, Entamoeba histolytica
GEFFSYFGMCITGYVIGFV

SEQ ID NO: 2590600 - protein, 17 aa, Entamoeba histolytica
GFTKCWDLALVVLATVP

SEQ ID NO: 2590601 - protein, 18 aa, Entamoeba histolytica
GKKWKQQYIYSISKDGEL

SEQ ID NO: 2590602 - protein, 19 aa, Entamoeba histolytica
HPPELCWTTPLFKKTALYL

SEQ ID NO: 2590603 - protein, 17 aa, Entamoeba histolytica
IAVFPIHTLILFFDFKL

SEQ ID NO: 2590604 - protein, 18 aa, Entamoeba histolytica
IFNSFSILWFWIADSCDG

SEQ ID NO: 2590605 - protein, 21 aa, Entamoeba histolytica
KNNKCWKCSFWYGTNEEGNEC

SEQ ID NO: 2590606 - protein, 20 aa, Entamoeba histolytica
KSRDCIFMFISWCCTLSALS

SEQ ID NO: 2590607 - protein, 19 aa, Entamoeba histolytica
LIECGGIVLQECKTDTTTY

SEQ ID NO: 2590608 - protein, 20 aa, Entamoeba histolytica
LLKVRFCQDIARGMEYLHQN

SEQ ID NO: 2590609 - protein, 17 aa, Entamoeba histolytica
LNSCISFTDYAAYFFYN

SEQ ID NO: 2590610 - protein, 23 aa, Entamoeba histolytica
LPTGCYCTYSLISKQECIFDCEN

SEQ ID NO: 2590611 - protein, 17 aa, Entamoeba histolytica
LVVSFLSVGFFAEYLTK

SEQ ID NO: 2590612 - protein, 19 aa, Entamoeba histolytica
LYLPPRYPLLGGWKTSFEV

SEQ ID NO: 2590613 - protein, 19 aa, Entamoeba histolytica
MITFVLFIVLATSTETFLS

SEQ ID NO: 2590614 - protein, 19 aa, Entamoeba histolytica
NSFTRRIEVTGGQIEVNNK

SEQ ID NO: 2590615 - protein, 20 aa, Entamoeba histolytica
QRIAEKLHHFFPIQKIWNEN

SEQ ID NO: 2590616 - protein, 20 aa, Entamoeba histolytica
RLRYNLPIIMCLISTIIEFA

SEQ ID NO: 2590617 - protein, 23 aa, Entamoeba histolytica
SDLLKIRFCQDIARGMEYLHQND

SEQ ID NO: 2590618 - protein, 18 aa, Entamoeba histolytica
SIFFDWSVVLVTFIIMII

SEQ ID NO: 2590619 - protein, 23 aa, Entamoeba histolytica
TCPCSGDKCIIDFSATTSVIYKL

SEQ ID NO: 2590620 - protein, 21 aa, Entamoeba histolytica
TDKEILPFLLINKIQIYGEDP

SEQ ID NO: 2590621 - protein, 21 aa, Entamoeba histolytica
TEFPKWTIGVMVIFVIALIVI

SEQ ID NO: 2590622 - protein, 21 aa, Entamoeba histolytica
TFPMCIFCIMVLSALFIGIDY

SEQ ID NO: 2590623 - protein, 22 aa, Entamoeba histolytica
VLPHLSALVAIVFPRLNDIEAN

SEQ ID NO: 2590624 - protein, 24 aa, Entamoeba histolytica
VSWIWRIIVIIAFEFLEMSVFLIP

SEQ ID NO: 2590625 - protein, 18 aa, Entamoeba histolytica
YFVKDSFLGWKYVDFNNS

SEQ ID NO: 2590626 - protein, 18 aa, Entamoeba histolytica
YSDFSFLFGLILIVTSLL

SEQ ID NO: 2590627 - protein, 19 aa, Entamoeba histolytica
AAIDLCRLVFPLSRDKNPR

SEQ ID NO: 2590628 - protein, 20 aa, Entamoeba histolytica
AAYLCRLCAPLALNILHMIK

SEQ ID NO: 2590629 - protein, 17 aa, Entamoeba histolytica
ACIPLCIGYAIYSLYNN

SEQ ID NO: 2590630 - protein, 19 aa, Entamoeba histolytica
ADGLKGKWFVYTPKETEKV

SEQ ID NO: 2590631 - protein, 20 aa, Entamoeba histolytica
ADILELFELFSFVILLSLSN

SEQ ID NO: 2590632 - protein, 25 aa, Entamoeba histolytica
AEKHFPRLFSWRSFHNYIKELSIDE

SEQ ID NO: 2590633 - protein, 19 aa, Entamoeba histolytica
AFDFCFKWINKLKWIIVVF

SEQ ID NO: 2590634 - protein, 18 aa, Entamoeba histolytica
AFFAFRVATGLLKWVSLG

SEQ ID NO: 2590635 - protein, 18 aa, Entamoeba histolytica
AFTKRYDYGLTWSDMLEK

SEQ ID NO: 2590636 - protein, 22 aa, Entamoeba histolytica
AFTLPCLFIFMSLYRFNGFTLF

SEQ ID NO: 2590637 - protein, 19 aa, Entamoeba histolytica
AFYYDWKVALCVMAIAPVL

SEQ ID NO: 2590638 - protein, 17 aa, Entamoeba histolytica
AFYYDWKVSLAVMAVSP

SEQ ID NO: 2590639 - protein, 18 aa, Entamoeba histolytica
AGDGFFLQWMMSIGILII

SEQ ID NO: 2590640 - protein, 17 aa, Entamoeba histolytica
AGFLTERIEVIINTLSQ

SEQ ID NO: 2590641 - protein, 20 aa, Entamoeba histolytica
AGICAVHFVSYIYKYLKDKI

SEQ ID NO: 2590642 - protein, 21 aa, Entamoeba histolytica
AGVFCKWHYIILYLVAVCLNF

SEQ ID NO: 2590643 - protein, 20 aa, Entamoeba histolytica
AICILEIWICESVYPEDEFH

SEQ ID NO: 2590644 - protein, 17 aa, Entamoeba histolytica
AICLFVFVSGLIPYTID

SEQ ID NO: 2590645 - protein, 19 aa, Entamoeba histolytica
AICLLEIWLGRSPYNPVKF

SEQ ID NO: 2590646 - protein, 19 aa, Entamoeba histolytica
AICMLEIWNNGSLYDEQHF

SEQ ID NO: 2590647 - protein, 19 aa, Entamoeba histolytica
AIESRLLITVPRYLKEVEE

SEQ ID NO: 2590648 - protein, 18 aa, Entamoeba histolytica
AIFVCIGMVLKIRPEVLL

SEQ ID NO: 2590649 - protein, 18 aa, Entamoeba histolytica
AIIFCIIIPFSSVVLNDK

SEQ ID NO: 2590650 - protein, 22 aa, Entamoeba histolytica
AILPICISIVFSKCCRQSLAQL

SEQ ID NO: 2590651 - protein, 18 aa, Entamoeba histolytica
AISLRIPLILKDIFESVG

SEQ ID NO: 2590652 - protein, 17 aa, Entamoeba histolytica
AIWPFCTAFFWPVTTGT

SEQ ID NO: 2590653 - protein, 21 aa, Entamoeba histolytica
ALCILLRFCMCFTHVVQYFNE

SEQ ID NO: 2590654 - protein, 24 aa, Entamoeba histolytica
ALGGQEQWKGLAIFVDTFQNSYAS

SEQ ID NO: 2590655 - protein, 18 aa, Entamoeba histolytica
ALLLCFFVMLLSFTSNVY

SEQ ID NO: 2590656 - protein, 19 aa, Entamoeba histolytica
ALSHCYKIIFAFWKELNKA

SEQ ID NO: 2590657 - protein, 19 aa, Entamoeba histolytica
AMFAFPWYITWFLHSVENI

SEQ ID NO: 2590658 - protein, 19 aa, Entamoeba histolytica
AMFDFTFYWYNFMPLSRGT

SEQ ID NO: 2590659 - protein, 26 aa, Entamoeba histolytica
ANLFFAEFIRDLAIMWRHDEMAKLVD

SEQ ID NO: 2590660 - protein, 20 aa, Entamoeba histolytica
ANLFFAEFIRDLSLLWRHDE

SEQ ID NO: 2590661 - protein, 29 aa, Entamoeba histolytica
ANLFLANFIRDLMRFWKLAYVVGLIDMVM

SEQ ID NO: 2590662 - protein, 23 aa, Entamoeba histolytica
AQCCLKVHLIIALVICILAMIYK

SEQ ID NO: 2590663 - protein, 18 aa, Entamoeba histolytica
AQKGIKMQLERRWDNNSF

SEQ ID NO: 2590664 - protein, 20 aa, Entamoeba histolytica
ARLLWFRNYFIGVLISIITN

SEQ ID NO: 2590665 - protein, 23 aa, Entamoeba histolytica
ARNSGLFAVCWSFGKAIGYAAGG

SEQ ID NO: 2590666 - protein, 20 aa, Entamoeba histolytica
ARSGFAVEYIRCWGEYIRKE

SEQ ID NO: 2590667 - protein, 17 aa, Entamoeba histolytica
ASIKHLFVRPAWGKGKY

SEQ ID NO: 2590668 - protein, 23 aa, Entamoeba histolytica
ASKKLWIILCVAGGIVIVLGAIV

SEQ ID NO: 2590669 - protein, 24 aa, Entamoeba histolytica
ASLFLHPRVNIVIRVIMPFLILLN

SEQ ID NO: 2590670 - protein, 23 aa, Entamoeba histolytica
ASSRISIYILFGIILIVSLFSIF

SEQ ID NO: 2590671 - protein, 21 aa, Entamoeba histolytica
ASTLVPSVCRWYRLKQIIKQQ

SEQ ID NO: 2590672 - protein, 24 aa, Entamoeba histolytica
ATIKKPLLCFTRFFIVKLLMILLL

SEQ ID NO: 2590673 - protein, 21 aa, Entamoeba histolytica
ATLDDGCWCLFAGVIVYTVTT

SEQ ID NO: 2590674 - protein, 20 aa, Entamoeba histolytica
AVECFLRLVLMLLLSILLKT

SEQ ID NO: 2590675 - protein, 19 aa, Entamoeba histolytica
AVGKEWRIDLTLKLLSVIS

SEQ ID NO: 2590676 - protein, 20 aa, Entamoeba histolytica
AVIKREWWPFLLSFIAITIS

SEQ ID NO: 2590677 - protein, 18 aa, Entamoeba histolytica
AVSLCIIFGFSLLAIKRF

SEQ ID NO: 2590678 - protein, 19 aa, Entamoeba histolytica
AYLCRLCAPLALNILHMIK

SEQ ID NO: 2590679 - protein, 19 aa, Entamoeba histolytica
AYSTMGWLCWLIVSIAVFA

SEQ ID NO: 2590680 - protein, 23 aa, Entamoeba histolytica
CAICMTCGCLLCYKDKKHQDIIH

SEQ ID NO: 2590681 - protein, 18 aa, Entamoeba histolytica
CALSSFKNGIKMYLSDHE

SEQ ID NO: 2590682 - protein, 19 aa, Entamoeba histolytica
CASRKWLIIGIVVGILVVV

SEQ ID NO: 2590683 - protein, 20 aa, Entamoeba histolytica
CATIIGCLKLKSQDRREKLW

SEQ ID NO: 2590684 - protein, 20 aa, Entamoeba histolytica
CAVGGSWNCAIMRELAKVYC

SEQ ID NO: 2590685 - protein, 20 aa, Entamoeba histolytica
CCAARHGICFPKDEKAYSTM

SEQ ID NO: 2590686 - protein, 17 aa, Entamoeba histolytica
CCCGGLLLLIFIAYIAL

SEQ ID NO: 2590687 - protein, 17 aa, Entamoeba histolytica
CDFQDLFSIKSHVLAGY

SEQ ID NO: 2590688 - protein, 17 aa, Entamoeba histolytica
CDFTWKIMQGELDSIKC

SEQ ID NO: 2590689 - protein, 17 aa, Entamoeba histolytica
CDVSNRWHFDWKCNVTY

SEQ ID NO: 2590690 - protein, 18 aa, Entamoeba histolytica
CECKPGFVFKDEGCTECG

SEQ ID NO: 2590691 - protein, 26 aa, Entamoeba histolytica
CEMIQCALCGLPICSTSCLKIHSQQP

SEQ ID NO: 2590692 - protein, 17 aa, Entamoeba histolytica
CFFPLDVIITLGMGAAI

SEQ ID NO: 2590693 - protein, 20 aa, Entamoeba histolytica
CFISIFSLFMKYHFPIYFSI

SEQ ID NO: 2590694 - protein, 18 aa, Entamoeba histolytica
CFSNWRLVLLFPLALLFG

SEQ ID NO: 2590695 - protein, 20 aa, Entamoeba histolytica
CGEPMKFIFLIDVSKDSLTR

SEQ ID NO: 2590696 - protein, 18 aa, Entamoeba histolytica
CGHCKALAPKYIEVSKMY

SEQ ID NO: 2590697 - protein, 19 aa, Entamoeba histolytica
CGLKSRLAYNVVVGNKYFV

SEQ ID NO: 2590698 - protein, 18 aa, Entamoeba histolytica
CGTFFKRLLPIVFTENSL

SEQ ID NO: 2590699 - protein, 17 aa, Entamoeba histolytica
CHKKCSIKYLFNVPIYA

SEQ ID NO: 2590700 - protein, 18 aa, Entamoeba histolytica
CIAGELFSEAGFFQRSDQ

SEQ ID NO: 2590701 - protein, 20 aa, Entamoeba histolytica
CIMMLWPRIEKFGDPNFRKL

SEQ ID NO: 2590702 - protein, 23 aa, Entamoeba histolytica
CISCSVKHCIICTAEVCYNCQEG

SEQ ID NO: 2590703 - protein, 20 aa, Entamoeba histolytica
CKAMAILAFCNFFSVCEQDQ

SEQ ID NO: 2590704 - protein, 24 aa, Entamoeba histolytica
CKECYKEKCALCFGNDIVISGVCY

SEQ ID NO: 2590705 - protein, 22 aa, Entamoeba histolytica
CKERLKYSWVIYSLLIKSIIGY

SEQ ID NO: 2590706 - protein, 24 aa, Entamoeba histolytica
CKHYHIFKLLGIQSIQFFIIFKFI

SEQ ID NO: 2590707 - protein, 29 aa, Entamoeba histolytica
CKKICCCKNCKRILECIVHHIGITVLFFD

SEQ ID NO: 2590708 - protein, 20 aa, Entamoeba histolytica
CKRILECIVHHIGIIVLVVG

SEQ ID NO: 2590709 - protein, 17 aa, Entamoeba histolytica
CLDCFPRSFFLFCDVSK

SEQ ID NO: 2590710 - protein, 18 aa, Entamoeba histolytica
CLICPIGTYSKGEKNTYC

SEQ ID NO: 2590711 - protein, 20 aa, Entamoeba histolytica
CLKPTLPVSDLFKLRVFYQS

SEQ ID NO: 2590712 - protein, 19 aa, Entamoeba histolytica
CLKYLVALLYELSKNAKSK

SEQ ID NO: 2590713 - protein, 18 aa, Entamoeba histolytica
CNVCYSGGYRKCGINSYI

SEQ ID NO: 2590714 - protein, 21 aa, Entamoeba histolytica
CPCQSLTGYECELEFTGSTNP

SEQ ID NO: 2590715 - protein, 19 aa, Entamoeba histolytica
CPICYSLFYLRTTTIPNVA

SEQ ID NO: 2590716 - protein, 18 aa, Entamoeba histolytica
CPIDRTALIFSYTRRPFS

SEQ ID NO: 2590717 - protein, 17 aa, Entamoeba histolytica
CPIFYYFRFCKELFVSD

SEQ ID NO: 2590718 - protein, 26 aa, Entamoeba histolytica
CPMPFFIFEWHYLWYVHAFNFEISLR

SEQ ID NO: 2590719 - protein, 19 aa, Entamoeba histolytica
CPSYEAILFPQILNSKQLP

SEQ ID NO: 2590720 - protein, 20 aa, Entamoeba histolytica
CQSHLRFGGYFVQLILNVIT

SEQ ID NO: 2590721 - protein, 17 aa, Entamoeba histolytica
CSKCSESNCIVCKDNDG

SEQ ID NO: 2590722 - protein, 20 aa, Entamoeba histolytica
CSRNKIWFGKLIEIERNLCN

SEQ ID NO: 2590723 - protein, 23 aa, Entamoeba histolytica
CSTCSSQECYSCFNSSEIVTTSK

SEQ ID NO: 2590724 - protein, 18 aa, Entamoeba histolytica
CSYKSWSLILLWSSLILF

SEQ ID NO: 2590725 - protein, 19 aa, Entamoeba histolytica
CTFKFGRRRIFLVVGAIID

SEQ ID NO: 2590726 - protein, 18 aa, Entamoeba histolytica
CTLWMILSMITFVLFGIV

SEQ ID NO: 2590727 - protein, 19 aa, Entamoeba histolytica
CVHVHPGLVWSKFWRYMTP

SEQ ID NO: 2590728 - protein, 17 aa, Entamoeba histolytica
CVIEFKKMLGFCISCVS

SEQ ID NO: 2590729 - protein, 18 aa, Entamoeba histolytica
CVILCCLCPAPSVNIIYC

SEQ ID NO: 2590730 - protein, 19 aa, Entamoeba histolytica
CVPFCGTCKFGFSCNKAAK

SEQ ID NO: 2590731 - protein, 18 aa, Entamoeba histolytica
CVTSFILFLGVLIMVVPE

SEQ ID NO: 2590732 - protein, 24 aa, Entamoeba histolytica
CWCLFRISDLMIRFFLILFTHQPD

SEQ ID NO: 2590733 - protein, 19 aa, Entamoeba histolytica
CWGLKLYFAYGFLMSIFIQ

SEQ ID NO: 2590734 - protein, 24 aa, Entamoeba histolytica
CYDECPYCLWGLCHACTKGCNYGS

SEQ ID NO: 2590735 - protein, 23 aa, Entamoeba histolytica
CYDECPYCLWGLCHACTKGCSYG

SEQ ID NO: 2590736 - protein, 23 aa, Entamoeba histolytica
CYGCFLCGLIPIFISPKVSIIEI

SEQ ID NO: 2590737 - protein, 19 aa, Entamoeba histolytica
CYKQRLSVIHYLYSLIPLA

SEQ ID NO: 2590738 - protein, 18 aa, Entamoeba histolytica
DAASSPFIVLFAIIVVIL

SEQ ID NO: 2590739 - protein, 24 aa, Entamoeba histolytica
DAICSKELYLFWLFNVGNRKTKEE

SEQ ID NO: 2590740 - protein, 22 aa, Entamoeba histolytica
DALKELYCIKAIDENGHITQLG

SEQ ID NO: 2590741 - protein, 22 aa, Entamoeba histolytica
DCLGCGLAACMCCDWCTDCCYV

SEQ ID NO: 2590742 - protein, 18 aa, Entamoeba histolytica
DDIIFLIYLYQRWIYPVD

SEQ ID NO: 2590743 - protein, 23 aa, Entamoeba histolytica
DEEVRPSLKWYFMIFFGPNVETM

SEQ ID NO: 2590744 - protein, 24 aa, Entamoeba histolytica
DELRYRFNHVWKEFLETYFVPYKV

SEQ ID NO: 2590745 - protein, 17 aa, Entamoeba histolytica
DEMKLVGLLLVYGIVHN

SEQ ID NO: 2590746 - protein, 20 aa, Entamoeba histolytica
DEMKSLLVIYPFPRTLINTP

SEQ ID NO: 2590747 - protein, 20 aa, Entamoeba histolytica
DFLKVRFCQDIARGMEYLHE

SEQ ID NO: 2590748 - protein, 19 aa, Entamoeba histolytica
DFYSEIYKLLVLTRDSHLS

SEQ ID NO: 2590749 - protein, 27 aa, Entamoeba histolytica
DGFYLYFYKRFPGLLILVYNVVKKHYP

SEQ ID NO: 2590750 - protein, 23 aa, Entamoeba histolytica
DGKPSDCIIYFSMKDIARVEWLK

SEQ ID NO: 2590751 - protein, 19 aa, Entamoeba histolytica
DGNIGWYWLIFIFSFISGF

SEQ ID NO: 2590752 - protein, 21 aa, Entamoeba histolytica
DIELTMSFGCYFIVTSQTTFK

SEQ ID NO: 2590753 - protein, 18 aa, Entamoeba histolytica
DIFHCIYNIYSIPFQFKC

SEQ ID NO: 2590754 - protein, 23 aa, Entamoeba histolytica
DIIPRFKQGYSFCFIGKEDQTES

SEQ ID NO: 2590755 - protein, 17 aa, Entamoeba histolytica
DILPFNWISELPLNMKN

SEQ ID NO: 2590756 - protein, 17 aa, Entamoeba histolytica
DKACGKYVSVGYDYLAV

SEQ ID NO: 2590757 - protein, 19 aa, Entamoeba histolytica
DKAIWRIIFIISPIALILL

SEQ ID NO: 2590758 - protein, 24 aa, Entamoeba histolytica
DLFFKSGLLFYVLVILYIIVSRTI

SEQ ID NO: 2590759 - protein, 20 aa, Entamoeba histolytica
DLFKRYGIHVTFFIIGERVK

SEQ ID NO: 2590760 - protein, 17 aa, Entamoeba histolytica
DLFWGFSVDYEFKYKEL

SEQ ID NO: 2590761 - protein, 22 aa, Entamoeba histolytica
DLLKIRFCQDISRGMEYLHQND

SEQ ID NO: 2590762 - protein, 18 aa, Entamoeba histolytica
DLNLMFWIAISMTIALII

SEQ ID NO: 2590763 - protein, 23 aa, Entamoeba histolytica
DNGEWSSKCVLAYCDEGYMFDYI

SEQ ID NO: 2590764 - protein, 25 aa, Entamoeba histolytica
DNGEWSSKCVLAYCDSGYKFDYINN

SEQ ID NO: 2590765 - protein, 24 aa, Entamoeba histolytica
DNGEWSTKCVLAYCDSGYKFDYIK

SEQ ID NO: 2590766 - protein, 23 aa, Entamoeba histolytica
DNGEWSTKCVLSYCDSGYKFDYI

SEQ ID NO: 2590767 - protein, 21 aa, Entamoeba histolytica
DPIPFRCLLKFSKKENNSHCI

SEQ ID NO: 2590768 - protein, 18 aa, Entamoeba histolytica
DQFFFEWSLKLIIDRSSK

SEQ ID NO: 2590769 - protein, 23 aa, Entamoeba histolytica
DRMKTCGYWEFLFKPSKKEDVHY

SEQ ID NO: 2590770 - protein, 21 aa, Entamoeba histolytica
DRRMIDCLKKIDGEKKLVEYI

SEQ ID NO: 2590771 - protein, 17 aa, Entamoeba histolytica
DRSRCFTCQAGMELAAS

SEQ ID NO: 2590772 - protein, 18 aa, Entamoeba histolytica
DRTRFGFIAQELKEVIPE

SEQ ID NO: 2590773 - protein, 23 aa, Entamoeba histolytica
DSFRIWCIWCIVVFFSPFIIIQL

SEQ ID NO: 2590774 - protein, 20 aa, Entamoeba histolytica
DSIYRKTFCFSFQHESDIIE

SEQ ID NO: 2590775 - protein, 24 aa, Entamoeba histolytica
DSLTILRWCFEYHKKIKKDFLNQI

SEQ ID NO: 2590776 - protein, 25 aa, Entamoeba histolytica
DSWKKRIDMEWKRKISQKFQTNEHE

SEQ ID NO: 2590777 - protein, 17 aa, Entamoeba histolytica
DTFKYVIEKGVVTKYTF

SEQ ID NO: 2590778 - protein, 17 aa, Entamoeba histolytica
DTLKFFCYYVLRQIKEL

SEQ ID NO: 2590779 - protein, 26 aa, Entamoeba histolytica
DVFSFAICCTEIWLGRDPYDPEKFPD

SEQ ID NO: 2590780 - protein, 25 aa, Entamoeba histolytica
DVFSFAVCMLEIWLGKPPYSSDEFP

SEQ ID NO: 2590781 - protein, 18 aa, Entamoeba histolytica
DVFSFSICLLEIWLTHQP

SEQ ID NO: 2590782 - protein, 23 aa, Entamoeba histolytica
DVNYASAMALVFMGKYEDALKVV

SEQ ID NO: 2590783 - protein, 18 aa, Entamoeba histolytica
DWRYSRSAGMLFGVLVTI

SEQ ID NO: 2590784 - protein, 18 aa, Entamoeba histolytica
DYCYRSSQIIGFIINSHK

SEQ ID NO: 2590785 - protein, 19 aa, Entamoeba histolytica
DYLICPSLPTLQWTMIITY

SEQ ID NO: 2590786 - protein, 21 aa, Entamoeba histolytica
DYRLLGSLFFKRGNVLRKILS

SEQ ID NO: 2590787 - protein, 24 aa, Entamoeba histolytica
EADRLEVRYGLFGRVFGQRAVAWA

SEQ ID NO: 2590788 - protein, 37 aa, Entamoeba histolytica
EAGGMACLMCCIFTLLGFCCCGLIFCCMRNFKNAVHF

SEQ ID NO: 2590789 - protein, 21 aa, Entamoeba histolytica
EANNSKCLKCFGWNKPNKQGN

SEQ ID NO: 2590790 - protein, 24 aa, Entamoeba histolytica
EAVRLARRIAMEWEAYIKHTNALR

SEQ ID NO: 2590791 - protein, 18 aa, Entamoeba histolytica
ECAIPFKYSLPIESLAKE

SEQ ID NO: 2590792 - protein, 18 aa, Entamoeba histolytica
ECEFPCYAAASGEYIRDD

SEQ ID NO: 2590793 - protein, 30 aa, Entamoeba histolytica
ECHDILRPSLQWYFSILFWRDIKTLKSTFK

SEQ ID NO: 2590794 - protein, 19 aa, Entamoeba histolytica
ECKSGVESVCFAKNESDAE

SEQ ID NO: 2590795 - protein, 17 aa, Entamoeba histolytica
ECKYCKTPCGSGCCTKI

SEQ ID NO: 2590796 - protein, 18 aa, Entamoeba histolytica
ECQIDSYGIKKCLTCISD

SEQ ID NO: 2590797 - protein, 20 aa, Entamoeba histolytica
ECTCLLCKMKLVILQNRYVP

SEQ ID NO: 2590798 - protein, 22 aa, Entamoeba histolytica
ECTKIKWKQCISFDNCHRILPT

SEQ ID NO: 2590799 - protein, 17 aa, Entamoeba histolytica
EDFKEVFVWKVFYTSLI

SEQ ID NO: 2590800 - protein, 18 aa, Entamoeba histolytica
EENAKCVLYGDGKTIKVY

SEQ ID NO: 2590801 - protein, 22 aa, Entamoeba histolytica
EEVDLKFSFCFTESETERVRYY

SEQ ID NO: 2590802 - protein, 19 aa, Entamoeba histolytica
EEWHFWRLLLINIYTLWTV

SEQ ID NO: 2590803 - protein, 22 aa, Entamoeba histolytica
EEWYKHPWCIITSLFCHSSISQ

SEQ ID NO: 2590804 - protein, 17 aa, Entamoeba histolytica
EFIRLVFHLSLEHCMLI

SEQ ID NO: 2590805 - protein, 19 aa, Entamoeba histolytica
EFISQIIVICWNHDPRIKA

SEQ ID NO: 2590806 - protein, 20 aa, Entamoeba histolytica
EFISSLLFLWCICIFPKFYF

SEQ ID NO: 2590807 - protein, 20 aa, Entamoeba histolytica
EFKFPWKIAEFISTGKRPNI

SEQ ID NO: 2590808 - protein, 20 aa, Entamoeba histolytica
EFKFPWKIAEFISTGKRPVI

SEQ ID NO: 2590809 - protein, 21 aa, Entamoeba histolytica
EFLRLPVWMLFLGIDVNLAYK

SEQ ID NO: 2590810 - protein, 22 aa, Entamoeba histolytica
EGEGSLCFKAKVTKFGLYGYRK

SEQ ID NO: 2590811 - protein, 24 aa, Entamoeba histolytica
EGFKSFKNALSWEFKSVSFEKGIE

SEQ ID NO: 2590812 - protein, 22 aa, Entamoeba histolytica
EGGRKCLWISILIDSITVVLLL

SEQ ID NO: 2590813 - protein, 17 aa, Entamoeba histolytica
EGKCYRCEDSFDGILEN

SEQ ID NO: 2590814 - protein, 21 aa, Entamoeba histolytica
EGMYRISIDFYVRRFESSCEE

SEQ ID NO: 2590815 - protein, 21 aa, Entamoeba histolytica
EGTSGVVFKGRFREHIVAIKD

SEQ ID NO: 2590816 - protein, 19 aa, Entamoeba histolytica
EGYPWCDIDKKMSWCDIND

SEQ ID NO: 2590817 - protein, 22 aa, Entamoeba histolytica
EHKIACLLPLFGPVLLLLIKSL

SEQ ID NO: 2590818 - protein, 17 aa, Entamoeba histolytica
EHMPVFYGLWIVYGIIL

SEQ ID NO: 2590819 - protein, 19 aa, Entamoeba histolytica
EIFSKWGIQNIIGFNDNDN

SEQ ID NO: 2590820 - protein, 19 aa, Entamoeba histolytica
EILGSFVLPSMKSFEIPDI

SEQ ID NO: 2590821 - protein, 21 aa, Entamoeba histolytica
EILRYSCKIIKSINSGEIKEN

SEQ ID NO: 2590822 - protein, 25 aa, Entamoeba histolytica
EINDLLKIRICDNIAQAMDYLHNKQ

SEQ ID NO: 2590823 - protein, 21 aa, Entamoeba histolytica
EIYDVLIKWGYFIQMPSVSPF

SEQ ID NO: 2590824 - protein, 29 aa, Entamoeba histolytica
EKDFHKMGGWFKVCIAILISILVLTVGVI

SEQ ID NO: 2590825 - protein, 17 aa, Entamoeba histolytica
EKHIWNAIFGRFVDDIQ

SEQ ID NO: 2590826 - protein, 20 aa, Entamoeba histolytica
EKIKGGLVFFHLFRSFMKHT

SEQ ID NO: 2590827 - protein, 23 aa, Entamoeba histolytica
EKKKRIINMIGIIMYQMRRSLYE

SEQ ID NO: 2590828 - protein, 17 aa, Entamoeba histolytica
ELDASGIGIRWQQSLDP

SEQ ID NO: 2590829 - protein, 24 aa, Entamoeba histolytica
ELKRKDWYGVLAFSGIEPINEINE

SEQ ID NO: 2590830 - protein, 18 aa, Entamoeba histolytica
ELKSLIIYREYYLEESRK

SEQ ID NO: 2590831 - protein, 19 aa, Entamoeba histolytica
ELLLSCWKINTERLISIDE

SEQ ID NO: 2590832 - protein, 19 aa, Entamoeba histolytica
ELMKRFAIITTLFTPLTFL

SEQ ID NO: 2590833 - protein, 20 aa, Entamoeba histolytica
ELMKTIGISPVFICYMESMK

SEQ ID NO: 2590834 - protein, 17 aa, Entamoeba histolytica
ELMKYKVLMKFLLFTLL

SEQ ID NO: 2590835 - protein, 22 aa, Entamoeba histolytica
ELVPELFKFFSLSITTIQNHSI

SEQ ID NO: 2590836 - protein, 19 aa, Entamoeba histolytica
ELYTVDGLDEMKLVGLLLV

SEQ ID NO: 2590837 - protein, 21 aa, Entamoeba histolytica
EMKSLCPHTPFFLIATQSEKR

SEQ ID NO: 2590838 - protein, 18 aa, Entamoeba histolytica
EMTSCIGCGLALNQCYWN

SEQ ID NO: 2590839 - protein, 23 aa, Entamoeba histolytica
ENEIKRLIEWGRGLELIDEEEIK

SEQ ID NO: 2590840 - protein, 18 aa, Entamoeba histolytica
ENILFRFYLKFIGSPIAT

SEQ ID NO: 2590841 - protein, 17 aa, Entamoeba histolytica
EPLRWRKQYHSWDLFFL

SEQ ID NO: 2590842 - protein, 22 aa, Entamoeba histolytica
EPSFPWFYKLWRVQGYYNLLIL

SEQ ID NO: 2590843 - protein, 23 aa, Entamoeba histolytica
EQFKMPWDIAKFVIAGKRLERKD

SEQ ID NO: 2590844 - protein, 17 aa, Entamoeba histolytica
EQFKSLLLVYGPFVSSI

SEQ ID NO: 2590845 - protein, 21 aa, Entamoeba histolytica
EQWFAHQMCCFLLPYYDCSSN

SEQ ID NO: 2590846 - protein, 18 aa, Entamoeba histolytica
ERIMTFYIALLFRFHIFI

SEQ ID NO: 2590847 - protein, 16 aa, Entamoeba histolytica
ERKCTRFLMTFMIQLH

SEQ ID NO: 2590848 - protein, 20 aa, Entamoeba histolytica
ERLFVGSCCDLLRRDLTKRY

SEQ ID NO: 2590849 - protein, 19 aa, Entamoeba histolytica
ERNIRLVGLSVILSTIFTY

SEQ ID NO: 2590850 - protein, 19 aa, Entamoeba histolytica
ESDMKLYLLVGGKVKDKVV

SEQ ID NO: 2590851 - protein, 17 aa, Entamoeba histolytica
ESIISFDFVNKVFNYSE

SEQ ID NO: 2590852 - protein, 19 aa, Entamoeba histolytica
ESIKSNAIWNICRLEDYHV

SEQ ID NO: 2590853 - protein, 17 aa, Entamoeba histolytica
ESLSITFLVMWLGGDIT

SEQ ID NO: 2590854 - protein, 17 aa, Entamoeba histolytica
ESMTWKGFLLMLIPAFC

SEQ ID NO: 2590855 - protein, 21 aa, Entamoeba histolytica
ETGKICRICFETGKCITFRSY

SEQ ID NO: 2590856 - protein, 19 aa, Entamoeba histolytica
ETWKGVVYLLVIAFMQILT

SEQ ID NO: 2590857 - protein, 19 aa, Entamoeba histolytica
EVFELSSFDEIEWRNKVKQ

SEQ ID NO: 2590858 - protein, 20 aa, Entamoeba histolytica
EVLYSCGFLLLRVMLLKCSF

SEQ ID NO: 2590859 - protein, 18 aa, Entamoeba histolytica
EVVKAIGYFIGIHRNELP

SEQ ID NO: 2590860 - protein, 18 aa, Entamoeba histolytica
EWEMWMWFGIITAVIVIF

SEQ ID NO: 2590861 - protein, 19 aa, Entamoeba histolytica
EWKIPLKYIKVVLQVAIFK

SEQ ID NO: 2590862 - protein, 17 aa, Entamoeba histolytica
EYLRASITFNEIMKTKD

SEQ ID NO: 2590863 - protein, 17 aa, Entamoeba histolytica
EYVWKCWSNFHFYFYVI

SEQ ID NO: 2590864 - protein, 20 aa, Entamoeba histolytica
FAGRPRPHFYARLSEHPEQV

SEQ ID NO: 2590865 - protein, 20 aa, Entamoeba histolytica
FAICMLEVWISKDPYDSIKF

SEQ ID NO: 2590866 - protein, 23 aa, Entamoeba histolytica
FATWKMAECMGILFGFGYSGVKE

SEQ ID NO: 2590867 - protein, 22 aa, Entamoeba histolytica
FCAKQLRSLICERIKLNDESVS

SEQ ID NO: 2590868 - protein, 18 aa, Entamoeba histolytica
FCCMRNFKNAVHFCPNCK

SEQ ID NO: 2590869 - protein, 17 aa, Entamoeba histolytica
FCCYCVIRPIYAVLQNT

SEQ ID NO: 2590870 - protein, 24 aa, Entamoeba histolytica
FCPCKSNECLLNFNDENITELNDI

SEQ ID NO: 2590871 - protein, 17 aa, Entamoeba histolytica
FCSNCKCEYGYSYDKEK

SEQ ID NO: 2590872 - protein, 19 aa, Entamoeba histolytica
FDRCYACGSTVIIGVSDGS

SEQ ID NO: 2590873 - protein, 18 aa, Entamoeba histolytica
FDSFKAILPFKFIIDQST

SEQ ID NO: 2590874 - protein, 25 aa, Entamoeba histolytica
FDVGCSPLKIILCPKKFLNNYACEG

SEQ ID NO: 2590875 - protein, 24 aa, Entamoeba histolytica
FEECIKMGIEIIGIIYNITRSTKD

SEQ ID NO: 2590876 - protein, 22 aa, Entamoeba histolytica
FELEIACGFFIFLFSNIFIWTY

SEQ ID NO: 2590877 - protein, 20 aa, Entamoeba histolytica
FELFTSFILKWRYNKINEDY

SEQ ID NO: 2590878 - protein, 19 aa, Entamoeba histolytica
FELLWKIFIVLKYGLLNKL

SEQ ID NO: 2590879 - protein, 17 aa, Entamoeba histolytica
FEQGVCCAMETLLKIFI

SEQ ID NO: 2590880 - protein, 17 aa, Entamoeba histolytica
FERSNFLFVLGIFFPLL

SEQ ID NO: 2590881 - protein, 17 aa, Entamoeba histolytica
FETEFKGDFSLLLDSTK

SEQ ID NO: 2590882 - protein, 24 aa, Entamoeba histolytica
FEVFWRITLLTSMCCCTLFFMYVL

SEQ ID NO: 2590883 - protein, 20 aa, Entamoeba histolytica
FEVLKRLLVNYIQQSEINDN

SEQ ID NO: 2590884 - protein, 17 aa, Entamoeba histolytica
FFAILFFPIEHKIACLL

SEQ ID NO: 2590885 - protein, 17 aa, Entamoeba histolytica
FFCYRIVALVLMFTTLI

SEQ ID NO: 2590886 - protein, 22 aa, Entamoeba histolytica
FFFCFLKFIPCYSILGCICSII

SEQ ID NO: 2590887 - protein, 18 aa, Entamoeba histolytica
FFIPLIIGYILRISTLDN

SEQ ID NO: 2590888 - protein, 23 aa, Entamoeba histolytica
FFYFPRFLIVLLIGSFLVNLYLY

SEQ ID NO: 2590889 - protein, 18 aa, Entamoeba histolytica
FGELLSILMGFGYSGMKD

SEQ ID NO: 2590890 - protein, 19 aa, Entamoeba histolytica
FGILCLIPYLFLQEHSTKP

SEQ ID NO: 2590891 - protein, 20 aa, Entamoeba histolytica
FGIVYRAEWRGVDVAVKLMK

SEQ ID NO: 2590892 - protein, 22 aa, Entamoeba histolytica
FGMEILPLLKFIGSSQTYAEFL

SEQ ID NO: 2590893 - protein, 20 aa, Entamoeba histolytica
FGSWCLVNFFIGKRGIAVLP

SEQ ID NO: 2590894 - protein, 20 aa, Entamoeba histolytica
FGTKFVMKRLFLNWELRENK

SEQ ID NO: 2590895 - protein, 17 aa, Entamoeba histolytica
FGYLCFLIIFKWCNPDK

SEQ ID NO: 2590896 - protein, 18 aa, Entamoeba histolytica
FHATFCIASLFMLQNMTD

SEQ ID NO: 2590897 - protein, 17 aa, Entamoeba histolytica
FHFHLTLALWDNFMLDN

SEQ ID NO: 2590898 - protein, 18 aa, Entamoeba histolytica
FHTICIFILFVALVYRHT

SEQ ID NO: 2590899 - protein, 17 aa, Entamoeba histolytica
FHYFMLFVRLLISLTNS

SEQ ID NO: 2590900 - protein, 21 aa, Entamoeba histolytica
FIDKRLAEIISRGMNCEETAQ

SEQ ID NO: 2590901 - protein, 17 aa, Entamoeba histolytica
FIFEYIVAISICLSLFG

SEQ ID NO: 2590902 - protein, 18 aa, Entamoeba histolytica
FIFPRYLSIFSIAVYLST

SEQ ID NO: 2590903 - protein, 17 aa, Entamoeba histolytica
FIIFKFIEFFLLDEALY

SEQ ID NO: 2590904 - protein, 21 aa, Entamoeba histolytica
FIIFRFIFKSEVPWIQRLGGC

SEQ ID NO: 2590905 - protein, 22 aa, Entamoeba histolytica
FIKCPECMVALLIAPVLNANES

SEQ ID NO: 2590906 - protein, 18 aa, Entamoeba histolytica
FILCCVACFGVFIFQPTF

SEQ ID NO: 2590907 - protein, 21 aa, Entamoeba histolytica
FILKRRFNLIQVFSAIIALSG

SEQ ID NO: 2590908 - protein, 22 aa, Entamoeba histolytica
FILPYCYFSFIIVLVETIILWS

SEQ ID NO: 2590909 - protein, 17 aa, Entamoeba histolytica
FIMYRVGGSIGFMSSTH

SEQ ID NO: 2590910 - protein, 18 aa, Entamoeba histolytica
FINAFFIIKQYFSVLSIH

SEQ ID NO: 2590911 - protein, 17 aa, Entamoeba histolytica
FINFCIFGILFLVFHIL

SEQ ID NO: 2590912 - protein, 23 aa, Entamoeba histolytica
FIQWKIRMMHIFGPISFLIFSCL

SEQ ID NO: 2590913 - protein, 17 aa, Entamoeba histolytica
FISRFGVKFTITSNNHL

SEQ ID NO: 2590914 - protein, 17 aa, Entamoeba histolytica
FITALTLAARVEERRQK

SEQ ID NO: 2590915 - protein, 20 aa, Entamoeba histolytica
FKEVFVWKVFYTSLIWVLKN

SEQ ID NO: 2590916 - protein, 18 aa, Entamoeba histolytica
FKFPWKIAEFISTGKRPN

SEQ ID NO: 2590917 - protein, 20 aa, Entamoeba histolytica
FKGDICYKCPLGYYSINGNC

SEQ ID NO: 2590918 - protein, 21 aa, Entamoeba histolytica
FKHLTKLILFYGRNGKYQITT

SEQ ID NO: 2590919 - protein, 23 aa, Entamoeba histolytica
FKIKDIWKHVCIVWNKCYNSLFQ

SEQ ID NO: 2590920 - protein, 23 aa, Entamoeba histolytica
FKIKDIWKHVCIVWNKCYNYTPK

SEQ ID NO: 2590921 - protein, 25 aa, Entamoeba histolytica
FKIKDIWKHVCIVWTMCYNYIPPKK

SEQ ID NO: 2590922 - protein, 18 aa, Entamoeba histolytica
FKNEINEIIKFFKTNSVM

SEQ ID NO: 2590923 - protein, 18 aa, Entamoeba histolytica
FKNQLAFQHCLLIGVLNQ

SEQ ID NO: 2590924 - protein, 22 aa, Entamoeba histolytica
FKSEHVFLILQLCGSIIFYHSS

SEQ ID NO: 2590925 - protein, 17 aa, Entamoeba histolytica
FKSHTIFSLSLTIILVF

SEQ ID NO: 2590926 - protein, 21 aa, Entamoeba histolytica
FLCFPRFFKLQSCIPCYKKCV

SEQ ID NO: 2590927 - protein, 17 aa, Entamoeba histolytica
FLCKGRLIVLRRFVTLM

SEQ ID NO: 2590928 - protein, 24 aa, Entamoeba histolytica
FLFGFCFIFFWLASFVISRKSSQP

SEQ ID NO: 2590929 - protein, 17 aa, Entamoeba histolytica
FLFSAICLFVFVSGLIP

SEQ ID NO: 2590930 - protein, 21 aa, Entamoeba histolytica
FLMILLLRLSPLFPFPISNYV

SEQ ID NO: 2590931 - protein, 23 aa, Entamoeba histolytica
FLMYYQRLSFINAFNKVQGLYPL

SEQ ID NO: 2590932 - protein, 19 aa, Entamoeba histolytica
FLNQEIWSSICGRNNIMII

SEQ ID NO: 2590933 - protein, 21 aa, Entamoeba histolytica
FLRIYFPTVLNWMIGGVVGQN

SEQ ID NO: 2590934 - protein, 17 aa, Entamoeba histolytica
FLSFKFFFIESVINIIL

SEQ ID NO: 2590935 - protein, 21 aa, Entamoeba histolytica
FLSNHMCKSCYGYCQLNGNDT

SEQ ID NO: 2590936 - protein, 19 aa, Entamoeba histolytica
FLWCICIFPKFYFILEYIS

SEQ ID NO: 2590937 - protein, 23 aa, Entamoeba histolytica
FMFIVWFIPQWIKSLKMIGVVKE

SEQ ID NO: 2590938 - protein, 25 aa, Entamoeba histolytica
FNEILKFLICLVMLKFVHKKENLLQ

SEQ ID NO: 2590939 - protein, 18 aa, Entamoeba histolytica
FNQPEIWTTMELTNGCPC

SEQ ID NO: 2590940 - protein, 22 aa, Entamoeba histolytica
FNYEIVNEIAFWYYQQLFEEKC

SEQ ID NO: 2590941 - protein, 20 aa, Entamoeba histolytica
FPDKHSFIFRSFKQEFIVKM

SEQ ID NO: 2590942 - protein, 18 aa, Entamoeba histolytica
FPFFRRLLSLLLLSQVFI

SEQ ID NO: 2590943 - protein, 23 aa, Entamoeba histolytica
FPFIPLKISHDFTVEGFLSIQYS

SEQ ID NO: 2590944 - protein, 20 aa, Entamoeba histolytica
FPIIGFWKHVCVVWTKCMCF

SEQ ID NO: 2590945 - protein, 19 aa, Entamoeba histolytica
FPLHQCFELIQIVNEPILY

SEQ ID NO: 2590946 - protein, 18 aa, Entamoeba histolytica
FPMYMIAVIVVFVLVLVV

SEQ ID NO: 2590947 - protein, 19 aa, Entamoeba histolytica
FPNLHSFPAIILKYEQPED

SEQ ID NO: 2590948 - protein, 17 aa, Entamoeba histolytica
FPSLFTVLYSFVKEFYS

SEQ ID NO: 2590949 - protein, 19 aa, Entamoeba histolytica
FPSSLFIKIMHSVCLFETS

SEQ ID NO: 2590950 - protein, 23 aa, Entamoeba histolytica
FPSTYKWACLDSILILSTQTFNE

SEQ ID NO: 2590951 - protein, 17 aa, Entamoeba histolytica
FPSWGIALIIILSIIVM

SEQ ID NO: 2590952 - protein, 24 aa, Entamoeba histolytica
FPTFKGKWWPSGVMDFFTMAPFIT

SEQ ID NO: 2590953 - protein, 22 aa, Entamoeba histolytica
FPTHLKMVFKYIFSLEITSELE

SEQ ID NO: 2590954 - protein, 17 aa, Entamoeba histolytica
FPVKYFFVFYKQRKLFV

SEQ ID NO: 2590955 - protein, 22 aa, Entamoeba histolytica
FPYRKAHKRVRGWVNNAPRSKY

SEQ ID NO: 2590956 - protein, 18 aa, Entamoeba histolytica
FQLILGLISLCWFGWNQL

SEQ ID NO: 2590957 - protein, 19 aa, Entamoeba histolytica
FQLPMGFPLFQPVTYGYAH

SEQ ID NO: 2590958 - protein, 17 aa, Entamoeba histolytica
FQNKFYLGDGIKFVPFK

SEQ ID NO: 2590959 - protein, 24 aa, Entamoeba histolytica
FQSFLYHCCEVLYAWSCIDVFVVS

SEQ ID NO: 2590960 - protein, 19 aa, Entamoeba histolytica
FREYICLVDKFSLNLLYPS

SEQ ID NO: 2590961 - protein, 19 aa, Entamoeba histolytica
FRFSTEFEYGGSKSDKKVL

SEQ ID NO: 2590962 - protein, 17 aa, Entamoeba histolytica
FRFVMCIIISMQIIRNI

SEQ ID NO: 2590963 - protein, 18 aa, Entamoeba histolytica
FRIGEWMIINGLKTKSEI

SEQ ID NO: 2590964 - protein, 24 aa, Entamoeba histolytica
FRNQECFRRSFDIFINDQFVTQCG

SEQ ID NO: 2590965 - protein, 18 aa, Entamoeba histolytica
FRPASFFPLGYMYEILDK

SEQ ID NO: 2590966 - protein, 21 aa, Entamoeba histolytica
FRPREFFNITVLLRLSKALDI

SEQ ID NO: 2590967 - protein, 24 aa, Entamoeba histolytica
FRVLDRIYLIIGIIIFALILKYFI

SEQ ID NO: 2590968 - protein, 19 aa, Entamoeba histolytica
FRYIHKLRFVIVIFWILAV

SEQ ID NO: 2590969 - protein, 21 aa, Entamoeba histolytica
FRYSHELEIWYAFSQKSMKIP

SEQ ID NO: 2590970 - protein, 18 aa, Entamoeba histolytica
FSAWGFIISYVVYKGGCV

SEQ ID NO: 2590971 - protein, 19 aa, Entamoeba histolytica
FSCFGKILICGETVVREDQ

SEQ ID NO: 2590972 - protein, 17 aa, Entamoeba histolytica
FSFSSRFSFKFLSYKMS

SEQ ID NO: 2590973 - protein, 18 aa, Entamoeba histolytica
FSILLSFLYFMIFSVYDV

SEQ ID NO: 2590974 - protein, 19 aa, Entamoeba histolytica
FSKEWCFYHNTTIKSNTSE

SEQ ID NO: 2590975 - protein, 20 aa, Entamoeba histolytica
FSLLCFTGLYIPASDGLVSW

SEQ ID NO: 2590976 - protein, 17 aa, Entamoeba histolytica
FSLLPSFSQMRFSQVEQ

SEQ ID NO: 2590977 - protein, 17 aa, Entamoeba histolytica
FSPEIIYQLSIDSISGS

SEQ ID NO: 2590978 - protein, 27 aa, Entamoeba histolytica
FSRPIYAVICMFLRIVVSEVQLQISSH

SEQ ID NO: 2590979 - protein, 24 aa, Entamoeba histolytica
FSSRLSEWPTYCVLLKDNKNIETH

SEQ ID NO: 2590980 - protein, 18 aa, Entamoeba histolytica
FSVCFFKMLYFFITAPLG

SEQ ID NO: 2590981 - protein, 17 aa, Entamoeba histolytica
FSYITFIFLFLCFIAYT

SEQ ID NO: 2590982 - protein, 21 aa, Entamoeba histolytica
FTCLTWVLNIIMFRDSTNDNT

SEQ ID NO: 2590983 - protein, 22 aa, Entamoeba histolytica
FTFSLTCFAYFLATLMSKTRIA

SEQ ID NO: 2590984 - protein, 17 aa, Entamoeba histolytica
FTIPRWFVLGIICVVSI

SEQ ID NO: 2590985 - protein, 20 aa, Entamoeba histolytica
FTTAIFLRWVNRVDELMVNN

SEQ ID NO: 2590986 - protein, 23 aa, Entamoeba histolytica
FTVTELFWRIAFVCVGSIQLMTF

SEQ ID NO: 2590987 - protein, 17 aa, Entamoeba histolytica
FVFPIAIFFTIISGILS

SEQ ID NO: 2590988 - protein, 18 aa, Entamoeba histolytica
FVLCCITAFWMLESLART

SEQ ID NO: 2590989 - protein, 24 aa, Entamoeba histolytica
FVLCFSLPCIFHYLSRRKVIAKFN

SEQ ID NO: 2590990 - protein, 18 aa, Entamoeba histolytica
FVYFLKFGIAIGIHLSIL

SEQ ID NO: 2590991 - protein, 18 aa, Entamoeba histolytica
FWKHVCVVWTKCMCFYPQ

SEQ ID NO: 2590992 - protein, 17 aa, Entamoeba histolytica
FWLIIPILMRDIGASPF

SEQ ID NO: 2590993 - protein, 20 aa, Entamoeba histolytica
FWSKRCVPTYCDYGYLFDFD

SEQ ID NO: 2590994 - protein, 18 aa, Entamoeba histolytica
FWTFCVFAGIFLGIPYDE

SEQ ID NO: 2590995 - protein, 22 aa, Entamoeba histolytica
FYCKEVLLGIGFTCLKSLSKEQ

SEQ ID NO: 2590996 - protein, 23 aa, Entamoeba histolytica
FYHFLKRYLKVISPLIVSSYVID

SEQ ID NO: 2590997 - protein, 17 aa, Entamoeba histolytica
FYIMINWFFTLMEYLSI

SEQ ID NO: 2590998 - protein, 18 aa, Entamoeba histolytica
FYYHWKIHYGLVDPITFE

SEQ ID NO: 2590999 - protein, 18 aa, Entamoeba histolytica
GASNKWKGISVIFDTFQN

SEQ ID NO: 2591000 - protein, 24 aa, Entamoeba histolytica
GCCEMCLNELFAPFSTINLLRKQE

SEQ ID NO: 2591001 - protein, 23 aa, Entamoeba histolytica
GCELNCSCAFGWKRDNKGGCVPS

SEQ ID NO: 2591002 - protein, 21 aa, Entamoeba histolytica
GDKIFNFLFRYIHKLRFVIVI

SEQ ID NO: 2591003 - protein, 18 aa, Entamoeba histolytica
GECSKCPVLVNNSVIKSN

SEQ ID NO: 2591004 - protein, 18 aa, Entamoeba histolytica
GESLFVFATTILREGSGN

SEQ ID NO: 2591005 - protein, 21 aa, Entamoeba histolytica
GETAIKCSWSISNENIVSDFV

SEQ ID NO: 2591006 - protein, 18 aa, Entamoeba histolytica
GEVTRMFRLVIGCVQDVC

SEQ ID NO: 2591007 - protein, 19 aa, Entamoeba histolytica
GEVVFPAFFVKFIPIYNEE

SEQ ID NO: 2591008 - protein, 17 aa, Entamoeba histolytica
GFAKDWDLTLVIIIAIA

SEQ ID NO: 2591009 - protein, 24 aa, Entamoeba histolytica
GFFCCGCSFLFIFFFDRVVVTHGG

SEQ ID NO: 2591010 - protein, 20 aa, Entamoeba histolytica
GFFLPCIWIYNIVKYRNSGD

SEQ ID NO: 2591011 - protein, 24 aa, Entamoeba histolytica
GFIFCCLWPINACLYRHSTNKQIQ

SEQ ID NO: 2591012 - protein, 19 aa, Entamoeba histolytica
GFLLLRVMLLKCSFNKLKK

SEQ ID NO: 2591013 - protein, 22 aa, Entamoeba histolytica
GFLYCAFCSFLVPKTEIEEPPK

SEQ ID NO: 2591014 - protein, 17 aa, Entamoeba histolytica
GFSKCWDLTLVIMAVTP

SEQ ID NO: 2591015 - protein, 17 aa, Entamoeba histolytica
GGMLGFFAMDNLNAITS

SEQ ID NO: 2591016 - protein, 18 aa, Entamoeba histolytica
GHCKKLAPEYIKLADAYK

SEQ ID NO: 2591017 - protein, 19 aa, Entamoeba histolytica
GHIIWNWYNRWLVLTKEQL

SEQ ID NO: 2591018 - protein, 18 aa, Entamoeba histolytica
GHNGMFCAIDNSFGICSS

SEQ ID NO: 2591019 - protein, 25 aa, Entamoeba histolytica
GIARILLSLSLCFIGLFIGLSQLFI

SEQ ID NO: 2591020 - protein, 17 aa, Entamoeba histolytica
GIFCFKIVIVIVATIAG

SEQ ID NO: 2591021 - protein, 22 aa, Entamoeba histolytica
GIKGQCLGLGFSIITFFMIASY

SEQ ID NO: 2591022 - protein, 25 aa, Entamoeba histolytica
GILSLTIYVCFSWRGYNDVIESNMA

SEQ ID NO: 2591023 - protein, 19 aa, Entamoeba histolytica
GINYEFVKNLFIKNGNDLK

SEQ ID NO: 2591024 - protein, 24 aa, Entamoeba histolytica
GIPPEVWRYYLLINRPEQSDTVFL

SEQ ID NO: 2591025 - protein, 19 aa, Entamoeba histolytica
GIVYRAEWRKVDVAVKVMK

SEQ ID NO: 2591026 - protein, 17 aa, Entamoeba histolytica
GIYFCLGSFLVIGLEFF

SEQ ID NO: 2591027 - protein, 18 aa, Entamoeba histolytica
GKIFWNFPRACLTGFLFN

SEQ ID NO: 2591028 - protein, 19 aa, Entamoeba histolytica
GKKRLWELFFVFLVGFFRC

SEQ ID NO: 2591029 - protein, 23 aa, Entamoeba histolytica
GKNWREIYKSLLVLDNILKNGSE

SEQ ID NO: 2591030 - protein, 26 aa, Entamoeba histolytica
GKQIYSIFCSLRILLLDVLTQILKSI

SEQ ID NO: 2591031 - protein, 22 aa, Entamoeba histolytica
GLICITCLFLIGSFVAFSFGVP

SEQ ID NO: 2591032 - protein, 21 aa, Entamoeba histolytica
GLILCRLCFPLLFNRGSNIII

SEQ ID NO: 2591033 - protein, 23 aa, Entamoeba histolytica
GLKEWGGAILLGFDGDPYGKDEE

SEQ ID NO: 2591034 - protein, 19 aa, Entamoeba histolytica
GLMKGCARGVYYLHKLGIV

SEQ ID NO: 2591035 - protein, 17 aa, Entamoeba histolytica
GLVKGWLKPSCSVTIWT

SEQ ID NO: 2591036 - protein, 17 aa, Entamoeba histolytica
GLVSWIYYHHKLHNPYF

SEQ ID NO: 2591037 - protein, 28 aa, Entamoeba histolytica
GLYFSWKLSLCILAVFPIISFFMFINGQ

SEQ ID NO: 2591038 - protein, 21 aa, Entamoeba histolytica
GNFPFIWGFFMLCSLSYWVSF

SEQ ID NO: 2591039 - protein, 18 aa, Entamoeba histolytica
GRPRPHFYARIDAKPNEI

SEQ ID NO: 2591040 - protein, 23 aa, Entamoeba histolytica
GSIQRGGAVSVYFDNYLVSTKDR

SEQ ID NO: 2591041 - protein, 22 aa, Entamoeba histolytica
GTFGIVYRAEWRGVDVAIKLMK

SEQ ID NO: 2591042 - protein, 19 aa, Entamoeba histolytica
GTFGVVFKGEWRKIDVAVK

SEQ ID NO: 2591043 - protein, 17 aa, Entamoeba histolytica
GTLIFSFIFGTIGYLLF

SEQ ID NO: 2591044 - protein, 17 aa, Entamoeba histolytica
GTVLTVFMSVLLATQSL

SEQ ID NO: 2591045 - protein, 25 aa, Entamoeba histolytica
GVACPFKICIIPKCSCFIEEDLIII

SEQ ID NO: 2591046 - protein, 17 aa, Entamoeba histolytica
GVIKLNFFGTENIEQNE

SEQ ID NO: 2591047 - protein, 18 aa, Entamoeba histolytica
GVLAEIYISIGLYDSAFQ

SEQ ID NO: 2591048 - protein, 19 aa, Entamoeba histolytica
GVYSFCFDNTMSLYTSKLV

SEQ ID NO: 2591049 - protein, 18 aa, Entamoeba histolytica
GWVLCVLAIPIGIISGYD

SEQ ID NO: 2591050 - protein, 24 aa, Entamoeba histolytica
GYFGYPVCMPHIFGKMIDLEYEFN

SEQ ID NO: 2591051 - protein, 17 aa, Entamoeba histolytica
HAFCYQCIKEWLSRVPN

SEQ ID NO: 2591052 - protein, 24 aa, Entamoeba histolytica
HCATTCKCYFGFIPITINGTTKCS

SEQ ID NO: 2591053 - protein, 17 aa, Entamoeba histolytica
HCKYCTSSDCLLCNDNY

SEQ ID NO: 2591054 - protein, 18 aa, Entamoeba histolytica
HCSYCSFGGVTNGQCSKC

SEQ ID NO: 2591055 - protein, 22 aa, Entamoeba histolytica
HDFVQYWVCFSIQLYLMYINTI

SEQ ID NO: 2591056 - protein, 17 aa, Entamoeba histolytica
HEVYKVYSLVLVHQQSL

SEQ ID NO: 2591057 - protein, 17 aa, Entamoeba histolytica
HFFERFLLCNNLYLTTC

SEQ ID NO: 2591058 - protein, 19 aa, Entamoeba histolytica
HFIRKRLNKVINWDQDTHQ

SEQ ID NO: 2591059 - protein, 22 aa, Entamoeba histolytica
HFKCWRVMTLIAGFMLMLVGGS

SEQ ID NO: 2591060 - protein, 22 aa, Entamoeba histolytica
HFKLSGLLPICYFLEKNDCTQE

SEQ ID NO: 2591061 - protein, 20 aa, Entamoeba histolytica
HGVIIGCLFFDYFKSKKALR

SEQ ID NO: 2591062 - protein, 17 aa, Entamoeba histolytica
HHCPWLGTCVGFKNHKF

SEQ ID NO: 2591063 - protein, 17 aa, Entamoeba histolytica
HKIHLECYLKDYEDSGN

SEQ ID NO: 2591064 - protein, 17 aa, Entamoeba histolytica
HLFVRPAWGKGKYTQFN

SEQ ID NO: 2591065 - protein, 19 aa, Entamoeba histolytica
HLMFWSIFEGIVFLLWIIS

SEQ ID NO: 2591066 - protein, 19 aa, Entamoeba histolytica
HPMFWKFIQGVGLCYLMLI

SEQ ID NO: 2591067 - protein, 21 aa, Entamoeba histolytica
HPYSRIVLINVIILGGFYTIS

SEQ ID NO: 2591068 - protein, 17 aa, Entamoeba histolytica
HQEKIFSAWGFIISYVV

SEQ ID NO: 2591069 - protein, 28 aa, Entamoeba histolytica
HQMKKAMCWRKWKLWIIIGVIAAIIIAV

SEQ ID NO: 2591070 - protein, 23 aa, Entamoeba histolytica
HSEDIPIGWGFKGNIYNEIMNKD

SEQ ID NO: 2591071 - protein, 18 aa, Entamoeba histolytica
HVFICLLAPLAPRFISYF

SEQ ID NO: 2591072 - protein, 19 aa, Entamoeba histolytica
HVSCLKGWLARASDCPICR

SEQ ID NO: 2591073 - protein, 17 aa, Entamoeba histolytica
HVVPICFNWPVGKHSLH

SEQ ID NO: 2591074 - protein, 19 aa, Entamoeba histolytica
HWLELSVMLSWVFIIVFAA

SEQ ID NO: 2591075 - protein, 17 aa, Entamoeba histolytica
HWSLSQFFLWIIVFLLL

SEQ ID NO: 2591076 - protein, 17 aa, Entamoeba histolytica
HYLNRFDVILQHYCEVA

SEQ ID NO: 2591077 - protein, 23 aa, Entamoeba histolytica
IAESCLRLPLPADKLVSFMFISL

SEQ ID NO: 2591078 - protein, 21 aa, Entamoeba histolytica
IAFIIKIIWYRGVIRENSGLL

SEQ ID NO: 2591079 - protein, 33 aa, Entamoeba histolytica
IALPRYPLLTGWKTEFMIGYSLPNKVVISKGKA

SEQ ID NO: 2591080 - protein, 22 aa, Entamoeba histolytica
IAPALVCCRLFFRLTKQSKIYL

SEQ ID NO: 2591081 - protein, 21 aa, Entamoeba histolytica
ICGSLSFLFGCSVQFIGMYSI

SEQ ID NO: 2591082 - protein, 17 aa, Entamoeba histolytica
ICIFPKFYFILEYISYK

SEQ ID NO: 2591083 - protein, 23 aa, Entamoeba histolytica
ICIGEGYGALILYHFLTSHKYDG

SEQ ID NO: 2591084 - protein, 18 aa, Entamoeba histolytica
ICLKTLIEECWKQKPDER

SEQ ID NO: 2591085 - protein, 18 aa, Entamoeba histolytica
ICSMILLIICSRIKRTGI

SEQ ID NO: 2591086 - protein, 20 aa, Entamoeba histolytica
IDITLRFGWTINIILLYFNW

SEQ ID NO: 2591087 - protein, 24 aa, Entamoeba histolytica
IDMPCLYPMAVALTFSREVFQKIS

SEQ ID NO: 2591088 - protein, 18 aa, Entamoeba histolytica
IDRLEVWTPTLPVSVPTS

SEQ ID NO: 2591089 - protein, 19 aa, Entamoeba histolytica
IDVLWCFFIGISVFYSFTI

SEQ ID NO: 2591090 - protein, 23 aa, Entamoeba histolytica
IEDECYKCPPGTYSDKYNCIPCS

SEQ ID NO: 2591091 - protein, 20 aa, Entamoeba histolytica
IEDILPFGLYIKIDDQQIEL

SEQ ID NO: 2591092 - protein, 18 aa, Entamoeba histolytica
IEGFFGYYPVDEPLTTFI

SEQ ID NO: 2591093 - protein, 27 aa, Entamoeba histolytica
IEGFKEWKIIFVDGFIRSTKFEYGINY

SEQ ID NO: 2591094 - protein, 17 aa, Entamoeba histolytica
IEGTFTFKKPVKLKNIH

SEQ ID NO: 2591095 - protein, 18 aa, Entamoeba histolytica
IEIIKLPPFNELKLPRLD

SEQ ID NO: 2591096 - protein, 17 aa, Entamoeba histolytica
IEVITWIIPWFVGGILG

SEQ ID NO: 2591097 - protein, 17 aa, Entamoeba histolytica
IEVLRLVLGRKITMLMF

SEQ ID NO: 2591098 - protein, 23 aa, Entamoeba histolytica
IFILRFLWILIVHRRARGITTND

SEQ ID NO: 2591099 - protein, 17 aa, Entamoeba histolytica
IFISFLFDGIRSQSISQ

SEQ ID NO: 2591100 - protein, 17 aa, Entamoeba histolytica
IFLICWCLFRISDLMIR

SEQ ID NO: 2591101 - protein, 20 aa, Entamoeba histolytica
IFPWKKRSKLVFCVPGAFII

SEQ ID NO: 2591102 - protein, 17 aa, Entamoeba histolytica
IFYKGCSGLLIPKIEQC

SEQ ID NO: 2591103 - protein, 17 aa, Entamoeba histolytica
IGCGLALNQCYWNVKTH

SEQ ID NO: 2591104 - protein, 26 aa, Entamoeba histolytica
IGFIKCWDLTLVVLCMFPFIMVSMMG

SEQ ID NO: 2591105 - protein, 18 aa, Entamoeba histolytica
IGIIIGVCFQFIPRSNNS

SEQ ID NO: 2591106 - protein, 17 aa, Entamoeba histolytica
IGIIQWITCLVLSSLSL

SEQ ID NO: 2591107 - protein, 17 aa, Entamoeba histolytica
IGIYKWAPLLSIFMCLT

SEQ ID NO: 2591108 - protein, 18 aa, Entamoeba histolytica
IGNLLLHYVNWMTNLCYL

SEQ ID NO: 2591109 - protein, 18 aa, Entamoeba histolytica
IGRAFSFPVIVRVYSIAG

SEQ ID NO: 2591110 - protein, 22 aa, Entamoeba histolytica
IGSLCLMIFCYCYIKPFRKVIK

SEQ ID NO: 2591111 - protein, 17 aa, Entamoeba histolytica
IGVLNWVGCTIIIHKRK

SEQ ID NO: 2591112 - protein, 19 aa, Entamoeba histolytica
IHSSRRWKIDISTCETSTN

SEQ ID NO: 2591113 - protein, 18 aa, Entamoeba histolytica
IIDCPMPFFIFEWHYLWY

SEQ ID NO: 2591114 - protein, 18 aa, Entamoeba histolytica
IIFEPRFGITIIQIASST

SEQ ID NO: 2591115 - protein, 18 aa, Entamoeba histolytica
IIGGIGMFALVVVALVEL

SEQ ID NO: 2591116 - protein, 22 aa, Entamoeba histolytica
IIITRTSFFWGRIYKKKERLTL

SEQ ID NO: 2591117 - protein, 20 aa, Entamoeba histolytica
IIIVFCIWFFKKPVEDKPQT

SEQ ID NO: 2591118 - protein, 20 aa, Entamoeba histolytica
IIKTLCYWRNEKIIHQHHLL

SEQ ID NO: 2591119 - protein, 18 aa, Entamoeba histolytica
IILDVCGFYKIIQFSFLS

SEQ ID NO: 2591120 - protein, 20 aa, Entamoeba histolytica
IIPDSVFIEWMIKYDNAKSL

SEQ ID NO: 2591121 - protein, 18 aa, Entamoeba histolytica
IIPFYSLWATIFGGFSDI

SEQ ID NO: 2591122 - protein, 17 aa, Entamoeba histolytica
IIQHFPKLILLFCVYSW

SEQ ID NO: 2591123 - protein, 18 aa, Entamoeba histolytica
IITLCIGIAFFLFSLHVT

SEQ ID NO: 2591124 - protein, 17 aa, Entamoeba histolytica
IIVFSVFYPSLKYPLDS

SEQ ID NO: 2591125 - protein, 18 aa, Entamoeba histolytica
IKCGVCSPILVPLDKDKQ

SEQ ID NO: 2591126 - protein, 20 aa, Entamoeba histolytica
IKCSFIPIILYLMVALLSIN

SEQ ID NO: 2591127 - protein, 17 aa, Entamoeba histolytica
IKDEFTQLLAIKVLSDC

SEQ ID NO: 2591128 - protein, 21 aa, Entamoeba histolytica
IKDFWTHVCIVWTKCLYSLSR

SEQ ID NO: 2591129 - protein, 17 aa, Entamoeba histolytica
IKELECVKGDFFDSTIM

SEQ ID NO: 2591130 - protein, 25 aa, Entamoeba histolytica
IKERRTLWILWAFWWFVYALVCVMA

SEQ ID NO: 2591131 - protein, 21 aa, Entamoeba histolytica
IKGQCLGLGFSIIIFFIIVSY

SEQ ID NO: 2591132 - protein, 20 aa, Entamoeba histolytica
IKGQCLGLGFSVITFFMIAS

SEQ ID NO: 2591133 - protein, 17 aa, Entamoeba histolytica
IKHLFKYVATFLSYYPV

SEQ ID NO: 2591134 - protein, 25 aa, Entamoeba histolytica
IKIQILLIFHMIKLMLVLMIFLIII

SEQ ID NO: 2591135 - protein, 17 aa, Entamoeba histolytica
IKLCMGMKLISKQIAVL

SEQ ID NO: 2591136 - protein, 19 aa, Entamoeba histolytica
IKLLATISVLCFAVYFFAL

SEQ ID NO: 2591137 - protein, 22 aa, Entamoeba histolytica
IKMCNRINPTLAMYEAYATHAL

SEQ ID NO: 2591138 - protein, 21 aa, Entamoeba histolytica
IKMEFANLILLNSDYEVETFV

SEQ ID NO: 2591139 - protein, 21 aa, Entamoeba histolytica
IKMKRMNGIFALRHCTVTMMN

SEQ ID NO: 2591140 - protein, 17 aa, Entamoeba histolytica
IKNHIYISIGFTFVALF

SEQ ID NO: 2591141 - protein, 18 aa, Entamoeba histolytica
IKPPIPKAEESPSEPGKV

SEQ ID NO: 2591142 - protein, 18 aa, Entamoeba histolytica
IKQIRAFKKHIRKLTARK

SEQ ID NO: 2591143 - protein, 19 aa, Entamoeba histolytica
IKSSSSWHPLRFSYDLIGL

SEQ ID NO: 2591144 - protein, 19 aa, Entamoeba histolytica
IKSWNIFLVLGFFVSFILS

SEQ ID NO: 2591145 - protein, 20 aa, Entamoeba histolytica
IKVITFRGSQSFSDFVYDIQ

SEQ ID NO: 2591146 - protein, 20 aa, Entamoeba histolytica
ILCHTLRLRFSLNSVNISTI

SEQ ID NO: 2591147 - protein, 24 aa, Entamoeba histolytica
ILDSLKILIGFVIILLCCVLIWKS

SEQ ID NO: 2591148 - protein, 17 aa, Entamoeba histolytica
ILFEIIELAPFVEFPEN

SEQ ID NO: 2591149 - protein, 18 aa, Entamoeba histolytica
ILFFLLLVYYKFEPNQLV

SEQ ID NO: 2591150 - protein, 23 aa, Entamoeba histolytica
ILFFPFHLVVCYLFRNSNDKRIQ

SEQ ID NO: 2591151 - protein, 19 aa, Entamoeba histolytica
ILFGFSFNYYFVVAMRLLN

SEQ ID NO: 2591152 - protein, 17 aa, Entamoeba histolytica
ILFNFAFESLTSDEEER

SEQ ID NO: 2591153 - protein, 17 aa, Entamoeba histolytica
ILLGELLYLAGLLLPQR

SEQ ID NO: 2591154 - protein, 17 aa, Entamoeba histolytica
ILLYCWLCYNSKNEKEW

SEQ ID NO: 2591155 - protein, 32 aa, Entamoeba histolytica
ILPKLPGVWFYCWGITCALWFSTFQNKNELKY

SEQ ID NO: 2591156 - protein, 21 aa, Entamoeba histolytica
ILQNRYVPWISLARIFYLSLM

SEQ ID NO: 2591157 - protein, 18 aa, Entamoeba histolytica
ILRLYAMIHLARFDPKRK

SEQ ID NO: 2591158 - protein, 19 aa, Entamoeba histolytica
ILSFDRWRSVLSHWKYYLQ

SEQ ID NO: 2591159 - protein, 17 aa, Entamoeba histolytica
ILVIGHIISIIFIFIIY

SEQ ID NO: 2591160 - protein, 17 aa, Entamoeba histolytica
IMLRYMFNLNVLPKEFN

SEQ ID NO: 2591161 - protein, 19 aa, Entamoeba histolytica
IMLYFRFAPFIKENEIVST

SEQ ID NO: 2591162 - protein, 18 aa, Entamoeba histolytica
IMPNFLFLIKICLRIKDI

SEQ ID NO: 2591163 - protein, 18 aa, Entamoeba histolytica
IMQLCVFNFINGTLFYYF

SEQ ID NO: 2591164 - protein, 17 aa, Entamoeba histolytica
IMRRMLLSIYELCPTLS

SEQ ID NO: 2591165 - protein, 19 aa, Entamoeba histolytica
INIITRWYIIISIGLIAFS

SEQ ID NO: 2591166 - protein, 23 aa, Entamoeba histolytica
INILLLCWKKMIRLIESEVQINQ

SEQ ID NO: 2591167 - protein, 21 aa, Entamoeba histolytica
INNCWRFGKGLKMKGFENKSC

SEQ ID NO: 2591168 - protein, 23 aa, Entamoeba histolytica
INPPFKMSWRIAATFLVSLFDAI

SEQ ID NO: 2591169 - protein, 26 aa, Entamoeba histolytica
INTLFKYPHLKSHWSLSQFFLWIIVF

SEQ ID NO: 2591170 - protein, 21 aa, Entamoeba histolytica
IPMILEFVLFLSFVLNPIIGC

SEQ ID NO: 2591171 - protein, 18 aa, Entamoeba histolytica
IPQFFKMFLAFKKVGLDG

SEQ ID NO: 2591172 - protein, 24 aa, Entamoeba histolytica
IPSLCLWTFIFLCVIGFIIVLLYQ

SEQ ID NO: 2591173 - protein, 18 aa, Entamoeba histolytica
IPSSTLWFSFHELPKIGI

SEQ ID NO: 2591174 - protein, 17 aa, Entamoeba histolytica
IQHEVYKVYSLVLVHQQ

SEQ ID NO: 2591175 - protein, 17 aa, Entamoeba histolytica
IQKEILGSFVLPSMKSF

SEQ ID NO: 2591176 - protein, 17 aa, Entamoeba histolytica
IRDANLFFAEFIRDLSL

SEQ ID NO: 2591177 - protein, 18 aa, Entamoeba histolytica
IRKSFRFILPRALLLLTL

SEQ ID NO: 2591178 - protein, 17 aa, Entamoeba histolytica
IRLNAMITQACGENDDF

SEQ ID NO: 2591179 - protein, 19 aa, Entamoeba histolytica
IRLRFSYCETYKLNYQFNE

SEQ ID NO: 2591180 - protein, 17 aa, Entamoeba histolytica
IRVALLLWKHFFLSLPN

SEQ ID NO: 2591181 - protein, 18 aa, Entamoeba histolytica
IRYCPPELLNELDLDETT

SEQ ID NO: 2591182 - protein, 18 aa, Entamoeba histolytica
ISFCCCWILFNIKVFEEL

SEQ ID NO: 2591183 - protein, 18 aa, Entamoeba histolytica
ISFFLCWFVIGIGAACGF

SEQ ID NO: 2591184 - protein, 19 aa, Entamoeba histolytica
ISFIETFAWDYSFNQTIPR

SEQ ID NO: 2591185 - protein, 17 aa, Entamoeba histolytica
ISFKELIIKSALIKGFT

SEQ ID NO: 2591186 - protein, 18 aa, Entamoeba histolytica
ISFSFDFLGLAGWALAIL

SEQ ID NO: 2591187 - protein, 19 aa, Entamoeba histolytica
ISLELKIITGMDVSKNAKL

SEQ ID NO: 2591188 - protein, 17 aa, Entamoeba histolytica
ISLLLPLLLEFIKQNKL

SEQ ID NO: 2591189 - protein, 19 aa, Entamoeba histolytica
ISLLLSVFVFRFTHKFYSL

SEQ ID NO: 2591190 - protein, 17 aa, Entamoeba histolytica
ISLVFSILYVLFVCGFI

SEQ ID NO: 2591191 - protein, 17 aa, Entamoeba histolytica
ISPELAYVGFFQMFPTI

SEQ ID NO: 2591192 - protein, 20 aa, Entamoeba histolytica
ISPIRWALYQGISLKYNHSL

SEQ ID NO: 2591193 - protein, 20 aa, Entamoeba histolytica
ISRRLLLMIFERINFDELFF

SEQ ID NO: 2591194 - protein, 17 aa, Entamoeba histolytica
ISSFSFFFSNEFSSHLG

SEQ ID NO: 2591195 - protein, 17 aa, Entamoeba histolytica
ISSMWLFFRFFKKYKEE

SEQ ID NO: 2591196 - protein, 17 aa, Entamoeba histolytica
ISTIFLPWFNTLRYLKQ

SEQ ID NO: 2591197 - protein, 20 aa, Entamoeba histolytica
ISTSCVVVWNESELALDTSL

SEQ ID NO: 2591198 - protein, 19 aa, Entamoeba histolytica
ISYGLSFFGTKAFEKDEPT

SEQ ID NO: 2591199 - protein, 18 aa, Entamoeba histolytica
ITDCFFLFITLVAGTGIY

SEQ ID NO: 2591200 - protein, 22 aa, Entamoeba histolytica
ITLCCVCPAPLLSIIYSVEYNV

SEQ ID NO: 2591201 - protein, 17 aa, Entamoeba histolytica
ITLEINIYRRCIKIKNN

SEQ ID NO: 2591202 - protein, 18 aa, Entamoeba histolytica
ITVVYSWKTPDNSEIFLT

SEQ ID NO: 2591203 - protein, 17 aa, Entamoeba histolytica
ITYRFIHQYGFDLNSGM

SEQ ID NO: 2591204 - protein, 18 aa, Entamoeba histolytica
IVAVLLKYWLKTRNLNCP

SEQ ID NO: 2591205 - protein, 20 aa, Entamoeba histolytica
IVCGCALGFIGYGYGGPVYA

SEQ ID NO: 2591206 - protein, 19 aa, Entamoeba histolytica
IVEVMYRFFACSIESTKCK

SEQ ID NO: 2591207 - protein, 22 aa, Entamoeba histolytica
IVIYRYLLNAVFVYPTEQNIES

SEQ ID NO: 2591208 - protein, 17 aa, Entamoeba histolytica
IVLTCCMFLSTRLEGFT

SEQ ID NO: 2591209 - protein, 22 aa, Entamoeba histolytica
IVPVCIMLGFSCIRELLDEFRK

SEQ ID NO: 2591210 - protein, 19 aa, Entamoeba histolytica
IVQCLYRFVTHSTSLDIKQ

SEQ ID NO: 2591211 - protein, 24 aa, Entamoeba histolytica
IVSFSFCCLACWVVFMFQPTFSCS

SEQ ID NO: 2591212 - protein, 19 aa, Entamoeba histolytica
IVYRAKWRKIEIAVKVLKT

SEQ ID NO: 2591213 - protein, 18 aa, Entamoeba histolytica
IWLLICTAIFGALIIITA

SEQ ID NO: 2591214 - protein, 20 aa, Entamoeba histolytica
IWTRKLWRSACSLLDYIKGI

SEQ ID NO: 2591215 - protein, 20 aa, Entamoeba histolytica
IYGSCLIRFFGFYLATLLLF

SEQ ID NO: 2591216 - protein, 22 aa, Entamoeba histolytica
IYHEMVRLLGIIAVRQPSLSHN

SEQ ID NO: 2591217 - protein, 19 aa, Entamoeba histolytica
IYLQHPICQIIHSIATQFH

SEQ ID NO: 2591218 - protein, 20 aa, Entamoeba histolytica
KAAVFKMDIGQYFGISASNG

SEQ ID NO: 2591219 - protein, 21 aa, Entamoeba histolytica
KAEEVFKIIFRLAPNHCFAHY

SEQ ID NO: 2591220 - protein, 21 aa, Entamoeba histolytica
KAIEIFFRFCELDLFKESKEI

SEQ ID NO: 2591221 - protein, 26 aa, Entamoeba histolytica
KAKCIEYKKGKSLKIYNKEIDNNKRY

SEQ ID NO: 2591222 - protein, 19 aa, Entamoeba histolytica
KCKIEYGLKIGRHGCMKCF

SEQ ID NO: 2591223 - protein, 19 aa, Entamoeba histolytica
KCLKCGLGCLFCEDDSGDC

SEQ ID NO: 2591224 - protein, 21 aa, Entamoeba histolytica
KCLLYGSMCDLMIRKIPKTSS

SEQ ID NO: 2591225 - protein, 17 aa, Entamoeba histolytica
KDFIKSFILETILNLII

SEQ ID NO: 2591226 - protein, 17 aa, Entamoeba histolytica
KDNLGFEMPIFYNDSIG

SEQ ID NO: 2591227 - protein, 19 aa, Entamoeba histolytica
KDNSLWAILFVYRNADAKQ

SEQ ID NO: 2591228 - protein, 18 aa, Entamoeba histolytica
KDTKCKFVEFDCTNSKLV

SEQ ID NO: 2591229 - protein, 23 aa, Entamoeba histolytica
KEDFKVMVPFSMKSKTTKIDVIK

SEQ ID NO: 2591230 - protein, 18 aa, Entamoeba histolytica
KEEYCIFINKLLQLLQIK

SEQ ID NO: 2591231 - protein, 20 aa, Entamoeba histolytica
KEFMVRTGISMGVTVIVTFT

SEQ ID NO: 2591232 - protein, 21 aa, Entamoeba histolytica
KEFRIPISIFIDQQFLALMKL

SEQ ID NO: 2591233 - protein, 17 aa, Entamoeba histolytica
KEICFNFGLTLDFIGKN

SEQ ID NO: 2591234 - protein, 20 aa, Entamoeba histolytica
KEIFKLLILKFPTLPPIEIP

SEQ ID NO: 2591235 - protein, 19 aa, Entamoeba histolytica
KEIYKEGCWYAFNTNGQQK

SEQ ID NO: 2591236 - protein, 19 aa, Entamoeba histolytica
KEIYQMFGFSSLKKRMNTL

SEQ ID NO: 2591237 - protein, 19 aa, Entamoeba histolytica
KELIIKSALIKGFTMTSGI

SEQ ID NO: 2591238 - protein, 18 aa, Entamoeba histolytica
KENCWKYLIEFISDVFPV

SEQ ID NO: 2591239 - protein, 17 aa, Entamoeba histolytica
KEQFKAFSQLCEWREKT

SEQ ID NO: 2591240 - protein, 20 aa, Entamoeba histolytica
KERIFGCGKITTIVVFLIMA

SEQ ID NO: 2591241 - protein, 17 aa, Entamoeba histolytica
KESRASTLLTFDIFGPP

SEQ ID NO: 2591242 - protein, 19 aa, Entamoeba histolytica
KETLAFDVIEKFVQLLSPE

SEQ ID NO: 2591243 - protein, 17 aa, Entamoeba histolytica
KEVPTWAIAVIVIVGVI

SEQ ID NO: 2591244 - protein, 19 aa, Entamoeba histolytica
KEYFIAIGIFLQIYEIKKR

SEQ ID NO: 2591245 - protein, 18 aa, Entamoeba histolytica
KEYISLFSSMNWIIHDSI

SEQ ID NO: 2591246 - protein, 23 aa, Entamoeba histolytica
KFFKSKAGIILGCVIGVVLLLII

SEQ ID NO: 2591247 - protein, 17 aa, Entamoeba histolytica
KFFPLGCYMNWYDDFDI

SEQ ID NO: 2591248 - protein, 17 aa, Entamoeba histolytica
KGLSFNFIETLYYTHGI

SEQ ID NO: 2591249 - protein, 18 aa, Entamoeba histolytica
KGTFPFIWIFLVFASICY

SEQ ID NO: 2591250 - protein, 17 aa, Entamoeba histolytica
KHFRIVAVLLKYWLKTR

SEQ ID NO: 2591251 - protein, 18 aa, Entamoeba histolytica
KHVWPSLLFMVLITFLLS

SEQ ID NO: 2591252 - protein, 17 aa, Entamoeba histolytica
KICFGSAIYCMSCSSDK

SEQ ID NO: 2591253 - protein, 17 aa, Entamoeba histolytica
KIEKEFREQLIIEQERL

SEQ ID NO: 2591254 - protein, 17 aa, Entamoeba histolytica
KIHSCDFLFPMNFPQSL

SEQ ID NO: 2591255 - protein, 21 aa, Entamoeba histolytica
KIVDFWGIFICCFVIAFAAFF

SEQ ID NO: 2591256 - protein, 20 aa, Entamoeba histolytica
KKDGYKWFAIQKVMNKKQIS

SEQ ID NO: 2591257 - protein, 23 aa, Entamoeba histolytica
KKGELKAVIILGLIHNEEIIIPK

SEQ ID NO: 2591258 - protein, 18 aa, Entamoeba histolytica
KKLNMFIKFCDIIKTLHT

SEQ ID NO: 2591259 - protein, 18 aa, Entamoeba histolytica
KKMNCCISNVNNFLQSFG

SEQ ID NO: 2591260 - protein, 20 aa, Entamoeba histolytica
KKNKCSKCSFWYGTNEEGNE

SEQ ID NO: 2591261 - protein, 19 aa, Entamoeba histolytica
KKRIWWLRIIEEIWLILVG

SEQ ID NO: 2591262 - protein, 19 aa, Entamoeba histolytica
KKRLPGIEVLYPNLMVTME

SEQ ID NO: 2591263 - protein, 23 aa, Entamoeba histolytica
KKVMKIFIHFIIKYMEENIKNKE

SEQ ID NO: 2591264 - protein, 24 aa, Entamoeba histolytica
KKYARLTITFAILGIFMSPLFILS

SEQ ID NO: 2591265 - protein, 17 aa, Entamoeba histolytica
KLCYYRFGELMTDRNKP

SEQ ID NO: 2591266 - protein, 17 aa, Entamoeba histolytica
KLDYVWRTALALGAVPC

SEQ ID NO: 2591267 - protein, 17 aa, Entamoeba histolytica
KLFAGRPRPHFYARLSE

SEQ ID NO: 2591268 - protein, 17 aa, Entamoeba histolytica
KLFECIKALALCHNVTP

SEQ ID NO: 2591269 - protein, 19 aa, Entamoeba histolytica
KLKIKILFDTARGMQFLHE

SEQ ID NO: 2591270 - protein, 20 aa, Entamoeba histolytica
KLKKMIIEWSINIKVFDKKN

SEQ ID NO: 2591271 - protein, 20 aa, Entamoeba histolytica
KLLCTCYGYFFADIFMLIPE

SEQ ID NO: 2591272 - protein, 20 aa, Entamoeba histolytica
KLLVCPRLTLYALQSIQFIL

SEQ ID NO: 2591273 - protein, 24 aa, Entamoeba histolytica
KLNWEIICGIAIDIAEGLVCLKEN

SEQ ID NO: 2591274 - protein, 18 aa, Entamoeba histolytica
KLRRCALYSASIMIFTLN

SEQ ID NO: 2591275 - protein, 24 aa, Entamoeba histolytica
KLTKLKMLLLFIAIMAFASIFIIF

SEQ ID NO: 2591276 - protein, 18 aa, Entamoeba histolytica
KLWGYFCGVLEHPQADVL

SEQ ID NO: 2591277 - protein, 18 aa, Entamoeba histolytica
KMKCNLCEYLSDVDDNYF

SEQ ID NO: 2591278 - protein, 21 aa, Entamoeba histolytica
KMKRVCVIPIWLSHEDYPYLL

SEQ ID NO: 2591279 - protein, 22 aa, Entamoeba histolytica
KMMDILYKIHLKSEGIKEERTD

SEQ ID NO: 2591280 - protein, 19 aa, Entamoeba histolytica
KMPFPLSYRFKLITQQGLG

SEQ ID NO: 2591281 - protein, 17 aa, Entamoeba histolytica
KNAVHFCPNCKKRLGSK

SEQ ID NO: 2591282 - protein, 17 aa, Entamoeba histolytica
KNCSSCSFGYYFNDEGI

SEQ ID NO: 2591283 - protein, 24 aa, Entamoeba histolytica
KNEHCLKCPKGTFSQDLQHCKEEC

SEQ ID NO: 2591284 - protein, 18 aa, Entamoeba histolytica
KNGKCFKCQDGCNVCYED

SEQ ID NO: 2591285 - protein, 18 aa, Entamoeba histolytica
KNIFKWGLILALVNAITN

SEQ ID NO: 2591286 - protein, 27 aa, Entamoeba histolytica
KNMLAWDVVCFYSFYFLICCCEQDALR

SEQ ID NO: 2591287 - protein, 19 aa, Entamoeba histolytica
KNNIFGMMGVIFYWIITQK

SEQ ID NO: 2591288 - protein, 19 aa, Entamoeba histolytica
KNNKCSKCSFWYGTNEEGN

SEQ ID NO: 2591289 - protein, 20 aa, Entamoeba histolytica
KNNKCSKCSFWYGTNEEGNE

SEQ ID NO: 2591290 - protein, 17 aa, Entamoeba histolytica
KNVLEWWVPSTIANIRT

SEQ ID NO: 2591291 - protein, 17 aa, Entamoeba histolytica
KNYIIKKSMKFLIFMII

SEQ ID NO: 2591292 - protein, 17 aa, Entamoeba histolytica
KPISWRKNINFWIGRIL

SEQ ID NO: 2591293 - protein, 17 aa, Entamoeba histolytica
KPNHIIVLFGSQHKGHL

SEQ ID NO: 2591294 - protein, 17 aa, Entamoeba histolytica
KPSEIFVAAAIGIQCVN

SEQ ID NO: 2591295 - protein, 18 aa, Entamoeba histolytica
KQKYRFGKWFKINLNQVT

SEQ ID NO: 2591296 - protein, 32 aa, Entamoeba histolytica
KQLKDFFVFRIMKLRWLKSQFFVWFSILTLIH

SEQ ID NO: 2591297 - protein, 18 aa, Entamoeba histolytica
KRAMWWKNIKLYLIAGAI

SEQ ID NO: 2591298 - protein, 19 aa, Entamoeba histolytica
KRGIIKWGPLLSITNAITN

SEQ ID NO: 2591299 - protein, 19 aa, Entamoeba histolytica
KRIAPIIFHNTFWLIKDYY

SEQ ID NO: 2591300 - protein, 19 aa, Entamoeba histolytica
KRIISYNCLPSFLTTLLHT

SEQ ID NO: 2591301 - protein, 22 aa, Entamoeba histolytica
KRISQPMFREFLLRVHPQLYTH

SEQ ID NO: 2591302 - protein, 21 aa, Entamoeba histolytica
KRKKLPLGFKFLQVIQEKDFE

SEQ ID NO: 2591303 - protein, 20 aa, Entamoeba histolytica
KRLDLVLLLLKFGARIYIAN

SEQ ID NO: 2591304 - protein, 18 aa, Entamoeba histolytica
KRLNFPRMRGILGTTELK

SEQ ID NO: 2591305 - protein, 19 aa, Entamoeba histolytica
KRLPHFFQILSLTPIGRGI

SEQ ID NO: 2591306 - protein, 20 aa, Entamoeba histolytica
KRPKILVSYIDYYFEKPNKG

SEQ ID NO: 2591307 - protein, 21 aa, Entamoeba histolytica
KRRIVELLYGFSLIGRPTPIS

SEQ ID NO: 2591308 - protein, 23 aa, Entamoeba histolytica
KRRTSLPNALPFKINATPFIPKR

SEQ ID NO: 2591309 - protein, 21 aa, Entamoeba histolytica
KRSKLVFCVPGAFIISNPQGV

SEQ ID NO: 2591310 - protein, 24 aa, Entamoeba histolytica
KRTMWWKNMKLWLIIGGVVAVIVI

SEQ ID NO: 2591311 - protein, 17 aa, Entamoeba histolytica
KRYFFFFTFHDDNLLIN

SEQ ID NO: 2591312 - protein, 17 aa, Entamoeba histolytica
KSGGMLGFFAMDNLNAI

SEQ ID NO: 2591313 - protein, 19 aa, Entamoeba histolytica
KSGNCSLSYFLTISSSPYE

SEQ ID NO: 2591314 - protein, 24 aa, Entamoeba histolytica
KSHKDLECLYNFFDGCHDLRSVEI

SEQ ID NO: 2591315 - protein, 20 aa, Entamoeba histolytica
KSIVIPLLIGFIVPLISNII

SEQ ID NO: 2591316 - protein, 17 aa, Entamoeba histolytica
KSKGCLEYESYENLLQL

SEQ ID NO: 2591317 - protein, 29 aa, Entamoeba histolytica
KSLCKRIIQFPGWFFKQFFRTDPKGASMF

SEQ ID NO: 2591318 - protein, 18 aa, Entamoeba histolytica
KSQLSMKVARCYAQINNI

SEQ ID NO: 2591319 - protein, 18 aa, Entamoeba histolytica
KSSLKMKVIRKMKIYNPS

SEQ ID NO: 2591320 - protein, 24 aa, Entamoeba histolytica
KSSNWKIGLVIGVLVVVLIIIIIL

SEQ ID NO: 2591321 - protein, 21 aa, Entamoeba histolytica
KSVKWYYCLGITFCDISATFC

SEQ ID NO: 2591322 - protein, 23 aa, Entamoeba histolytica
KTFKPSIVSFKFTYGKNETDPFI

SEQ ID NO: 2591323 - protein, 17 aa, Entamoeba histolytica
KTKCPINKLTIIESKEV

SEQ ID NO: 2591324 - protein, 22 aa, Entamoeba histolytica
KTLYYKWIYPIAIAIDITLRFG

SEQ ID NO: 2591325 - protein, 20 aa, Entamoeba histolytica
KTPCKKSRWILYDKELEACW

SEQ ID NO: 2591326 - protein, 24 aa, Entamoeba histolytica
KTQKRISLIYAFVISIIFSGFIPL

SEQ ID NO: 2591327 - protein, 18 aa, Entamoeba histolytica
KTSFEVIYNYPLDVSVQQ

SEQ ID NO: 2591328 - protein, 19 aa, Entamoeba histolytica
KTVGGLAWYFVKLIEINHS

SEQ ID NO: 2591329 - protein, 17 aa, Entamoeba histolytica
KVFPSWGIALIIILSII

SEQ ID NO: 2591330 - protein, 21 aa, Entamoeba histolytica
KVGGLKPSWEIAYCSWEESIS

SEQ ID NO: 2591331 - protein, 25 aa, Entamoeba histolytica
KVNIKELFRYAGVFEIILLIIGIIG

SEQ ID NO: 2591332 - protein, 26 aa, Entamoeba histolytica
KVRLVWKEIRGVWQWIEGKTYEVKPE

SEQ ID NO: 2591333 - protein, 18 aa, Entamoeba histolytica
KVVFCAAHSLPITYRILD

SEQ ID NO: 2591334 - protein, 18 aa, Entamoeba histolytica
KWEAFKWALISGVCEPFG

SEQ ID NO: 2591335 - protein, 18 aa, Entamoeba histolytica
KWMYIGLAIGCFFVTDIV

SEQ ID NO: 2591336 - protein, 21 aa, Entamoeba histolytica
KYFNLICGIIIMLLAVNRKDI

SEQ ID NO: 2591337 - protein, 18 aa, Entamoeba histolytica
KYGRMALLKMTELKEPKR

SEQ ID NO: 2591338 - protein, 21 aa, Entamoeba histolytica
LAFPLMLQYVIKWINNPQGTL

SEQ ID NO: 2591339 - protein, 18 aa, Entamoeba histolytica
LAIFWRKQKQYVFHFTGV

SEQ ID NO: 2591340 - protein, 17 aa, Entamoeba histolytica
LAIGCFFVTDIVLYLLV

SEQ ID NO: 2591341 - protein, 17 aa, Entamoeba histolytica
LAIVFQLIVCFSQEFGK

SEQ ID NO: 2591342 - protein, 17 aa, Entamoeba histolytica
LALDAMCSMCAVGCDKE

SEQ ID NO: 2591343 - protein, 17 aa, Entamoeba histolytica
LALIYLRNGWVLCVLAI

SEQ ID NO: 2591344 - protein, 18 aa, Entamoeba histolytica
LAVIRFILGLGIGGEYPL

SEQ ID NO: 2591345 - protein, 26 aa, Entamoeba histolytica
LCDHFKFTVPFLKYWTFDNIIFHYKN

SEQ ID NO: 2591346 - protein, 17 aa, Entamoeba histolytica
LCFCPFCQFGIKSMGLD

SEQ ID NO: 2591347 - protein, 17 aa, Entamoeba histolytica
LCICWSTIPILSWLVPC

SEQ ID NO: 2591348 - protein, 17 aa, Entamoeba histolytica
LCMMLKYMIEHFKENGN

SEQ ID NO: 2591349 - protein, 17 aa, Entamoeba histolytica
LCMWGALVLTTFTSQGM

SEQ ID NO: 2591350 - protein, 17 aa, Entamoeba histolytica
LCPCFGTNCIIHSLTGL

SEQ ID NO: 2591351 - protein, 17 aa, Entamoeba histolytica
LCPKKFLNNYACEGRID

SEQ ID NO: 2591352 - protein, 18 aa, Entamoeba histolytica
LCVYFWKAKVLTFIVPIL

SEQ ID NO: 2591353 - protein, 17 aa, Entamoeba histolytica
LDFIGEYLLMFNSFPDK

SEQ ID NO: 2591354 - protein, 20 aa, Entamoeba histolytica
LDGFGYRYTEHWVLDNSKPT

SEQ ID NO: 2591355 - protein, 24 aa, Entamoeba histolytica
LDIRWRYKLILSFCSSALIVIIYP

SEQ ID NO: 2591356 - protein, 29 aa, Entamoeba histolytica
LDKSKCIEYRKGRALKIYNKEIDNNNKYY

SEQ ID NO: 2591357 - protein, 18 aa, Entamoeba histolytica
LDWLIVMVDFYFERQRSV

SEQ ID NO: 2591358 - protein, 17 aa, Entamoeba histolytica
LEACWKKLALLILTRKG

SEQ ID NO: 2591359 - protein, 20 aa, Entamoeba histolytica
LEAPCGFARTMNRSAGDDFS

SEQ ID NO: 2591360 - protein, 24 aa, Entamoeba histolytica
LEGWRFSYKSGYYFGLLNIIFVSV

SEQ ID NO: 2591361 - protein, 22 aa, Entamoeba histolytica
LEKSSRVFGFFPLEFFGPPIVV

SEQ ID NO: 2591362 - protein, 18 aa, Entamoeba histolytica
LELLIAIVRSCWKLNVFE

SEQ ID NO: 2591363 - protein, 22 aa, Entamoeba histolytica
LEMKFCYEREEFGKTIIDDLIP

SEQ ID NO: 2591364 - protein, 25 aa, Entamoeba histolytica
LEQTWKSGVVMLIIFIVLFTALSIW

SEQ ID NO: 2591365 - protein, 17 aa, Entamoeba histolytica
LETFGFVSFLFVFNEKT

SEQ ID NO: 2591366 - protein, 18 aa, Entamoeba histolytica
LETPFKFRMEKTVSVDND

SEQ ID NO: 2591367 - protein, 21 aa, Entamoeba histolytica
LEYRRLLPILLNYGTGATPSI

SEQ ID NO: 2591368 - protein, 22 aa, Entamoeba histolytica
LFAGRPRPNFYAMIDAGNMKDA

SEQ ID NO: 2591369 - protein, 27 aa, Entamoeba histolytica
LFALGFLCCCVWCYGWCQYRHSTNSQA

SEQ ID NO: 2591370 - protein, 24 aa, Entamoeba histolytica
LFCGCFILKIAIYFVQPFLKSYLF

SEQ ID NO: 2591371 - protein, 17 aa, Entamoeba histolytica
LFELFSFVILLSLSNFG

SEQ ID NO: 2591372 - protein, 18 aa, Entamoeba histolytica
LFFCLSNFYPSKSFFTKE

SEQ ID NO: 2591373 - protein, 17 aa, Entamoeba histolytica
LFFLRYLFLPLISYPSL

SEQ ID NO: 2591374 - protein, 18 aa, Entamoeba histolytica
LFIICWFFLFLIRIYLIY

SEQ ID NO: 2591375 - protein, 18 aa, Entamoeba histolytica
LFILGFFICLTWIACYCI

SEQ ID NO: 2591376 - protein, 17 aa, Entamoeba histolytica
LFIPFLIAYIIGKKSES

SEQ ID NO: 2591377 - protein, 20 aa, Entamoeba histolytica
LFKKNCANIRKWNAERTNER

SEQ ID NO: 2591378 - protein, 17 aa, Entamoeba histolytica
LFKKRLPGIEVLYPNLM

SEQ ID NO: 2591379 - protein, 17 aa, Entamoeba histolytica
LFLEYAWMKGIDGFNNE

SEQ ID NO: 2591380 - protein, 17 aa, Entamoeba histolytica
LFLIYAFIIHYYRFSVI

SEQ ID NO: 2591381 - protein, 18 aa, Entamoeba histolytica
LFLLFTIFCDAFCLQEAM

SEQ ID NO: 2591382 - protein, 20 aa, Entamoeba histolytica
LFMKYHFPIYFSIEPSSISL

SEQ ID NO: 2591383 - protein, 17 aa, Entamoeba histolytica
LFVIAFRSCMNFIVWAI

SEQ ID NO: 2591384 - protein, 19 aa, Entamoeba histolytica
LFVSFLIVCAVILIIAVVI

SEQ ID NO: 2591385 - protein, 17 aa, Entamoeba histolytica
LFWNFPRACLAGFMFNF

SEQ ID NO: 2591386 - protein, 22 aa, Entamoeba histolytica
LGEMWGGQFLRWFNFACLVLYL

SEQ ID NO: 2591387 - protein, 17 aa, Entamoeba histolytica
LGFLVVVMVFRFFLCKG

SEQ ID NO: 2591388 - protein, 19 aa, Entamoeba histolytica
LGMRVELIGCVGLGAVVIF

SEQ ID NO: 2591389 - protein, 18 aa, Entamoeba histolytica
LGRWSWDVEPIWVESSLK

SEQ ID NO: 2591390 - protein, 21 aa, Entamoeba histolytica
LHGGWKYLFIVLSRFEQMNLI

SEQ ID NO: 2591391 - protein, 23 aa, Entamoeba histolytica
LHIVCFFIPLGIYFMLKNITDEN

SEQ ID NO: 2591392 - protein, 22 aa, Entamoeba histolytica
LHLPKHLPIILGFIPYDFKNKE

SEQ ID NO: 2591393 - protein, 18 aa, Entamoeba histolytica
LHRIACFRDDIIFLIYLY

SEQ ID NO: 2591394 - protein, 20 aa, Entamoeba histolytica
LHSILRCGRLIMSSKTRIVG

SEQ ID NO: 2591395 - protein, 21 aa, Entamoeba histolytica
LHWRDVMKIAVKWRQISEPND

SEQ ID NO: 2591396 - protein, 25 aa, Entamoeba histolytica
LHYVFSSSCSLCFESLENEESLSLI

SEQ ID NO: 2591397 - protein, 20 aa, Entamoeba histolytica
LIFLQCVSNLLGIPREVPVI

SEQ ID NO: 2591398 - protein, 17 aa, Entamoeba histolytica
LIIACIFFLFIIYWSLM

SEQ ID NO: 2591399 - protein, 17 aa, Entamoeba histolytica
LIIFIGIWSYCGIRFQR

SEQ ID NO: 2591400 - protein, 19 aa, Entamoeba histolytica
LIIHLQPSIPIYVFIHSPY

SEQ ID NO: 2591401 - protein, 17 aa, Entamoeba histolytica
LIKVFRGNGKWLKEFRV

SEQ ID NO: 2591402 - protein, 17 aa, Entamoeba histolytica
LILCFVGWYFLTKTQSI

SEQ ID NO: 2591403 - protein, 22 aa, Entamoeba histolytica
LILCPTCLILGVDKCSAIPLKE

SEQ ID NO: 2591404 - protein, 18 aa, Entamoeba histolytica
LILMNSLLFIFKFTLTFV

SEQ ID NO: 2591405 - protein, 20 aa, Entamoeba histolytica
LIRKSWPYLPLIFKESYCTR

SEQ ID NO: 2591406 - protein, 24 aa, Entamoeba histolytica
LITWKDGKKFFPLGLYFDEIVDSD

SEQ ID NO: 2591407 - protein, 17 aa, Entamoeba histolytica
LKCISYFLPFISDKNIL

SEQ ID NO: 2591408 - protein, 20 aa, Entamoeba histolytica
LKELFGNVVDVCFAYEAITE

SEQ ID NO: 2591409 - protein, 17 aa, Entamoeba histolytica
LKGETGVDEKLTTDKGA

SEQ ID NO: 2591410 - protein, 23 aa, Entamoeba histolytica
LKGMLRRAICNKIFLIILAIVFL

SEQ ID NO: 2591411 - protein, 17 aa, Entamoeba histolytica
LKGWLARASDCPICRNP

SEQ ID NO: 2591412 - protein, 27 aa, Entamoeba histolytica
LKIKDFWKHVCIVWTMCYNSLPPKKIE

SEQ ID NO: 2591413 - protein, 19 aa, Entamoeba histolytica
LKKGITLIGFRLSDFNNDI

SEQ ID NO: 2591414 - protein, 20 aa, Entamoeba histolytica
LKLGAGVYRLSLLVHESLKI

SEQ ID NO: 2591415 - protein, 20 aa, Entamoeba histolytica
LKLPRLDAFSSDAQTCLNQN

SEQ ID NO: 2591416 - protein, 25 aa, Entamoeba histolytica
LKLTWSQRILFCLGFCGFGMLCIFM

SEQ ID NO: 2591417 - protein, 17 aa, Entamoeba histolytica
LKPFLKEEMVIAEIERK

SEQ ID NO: 2591418 - protein, 17 aa, Entamoeba histolytica
LKPRLKIKFMIDTAKGI

SEQ ID NO: 2591419 - protein, 19 aa, Entamoeba histolytica
LKSIWVYKFFVQLIQKLNT

SEQ ID NO: 2591420 - protein, 17 aa, Entamoeba histolytica
LKVRFCQDIARGMEYLH

SEQ ID NO: 2591421 - protein, 17 aa, Entamoeba histolytica
LKWYFSIFTKILEKVSE

SEQ ID NO: 2591422 - protein, 18 aa, Entamoeba histolytica
LLCCISFTFSKSAIHRLK

SEQ ID NO: 2591423 - protein, 18 aa, Entamoeba histolytica
LLDFCYYTNFLLLVTIIL

SEQ ID NO: 2591424 - protein, 19 aa, Entamoeba histolytica
LLEIAYCYLNFCIAAKPNL

SEQ ID NO: 2591425 - protein, 19 aa, Entamoeba histolytica
LLFIWRFIIRRIIHPNPIQ

SEQ ID NO: 2591426 - protein, 19 aa, Entamoeba histolytica
LLHRALCNFVDNFRELKLI

SEQ ID NO: 2591427 - protein, 21 aa, Entamoeba histolytica
LLIDILLEFGFFFDSKMARHS

SEQ ID NO: 2591428 - protein, 22 aa, Entamoeba histolytica
LLLCISCGLVIVGMFLQSFSFD

SEQ ID NO: 2591429 - protein, 27 aa, Entamoeba histolytica
LLLFKAWMLRWWKIMYLRLLDLQKWKV

SEQ ID NO: 2591430 - protein, 23 aa, Entamoeba histolytica
LLLLCFLSDLFLCEAQKQEWPLF

SEQ ID NO: 2591431 - protein, 21 aa, Entamoeba histolytica
LLMFCIGIFWIIVGTLILISS

SEQ ID NO: 2591432 - protein, 17 aa, Entamoeba histolytica
LLMTVPYFIIMIGTETI

SEQ ID NO: 2591433 - protein, 21 aa, Entamoeba histolytica
LLNGTVCIANFFATERQVDCL

SEQ ID NO: 2591434 - protein, 18 aa, Entamoeba histolytica
LLNRIICWVLMISHNFTT

SEQ ID NO: 2591435 - protein, 17 aa, Entamoeba histolytica
LLNRLAVCIGKKEEIPN

SEQ ID NO: 2591436 - protein, 17 aa, Entamoeba histolytica
LLRCIVEVLGIQMNSTQ

SEQ ID NO: 2591437 - protein, 24 aa, Entamoeba histolytica
LLRSIECLESFLIHHDILNIFKAA

SEQ ID NO: 2591438 - protein, 18 aa, Entamoeba histolytica
LLRWNRLIVEVCLNNCSI

SEQ ID NO: 2591439 - protein, 24 aa, Entamoeba histolytica
LLSRFAVYIPIPWNKWPILGLSVV

SEQ ID NO: 2591440 - protein, 23 aa, Entamoeba histolytica
LLSYGVWCLIGFFVYSIYKFLTS

SEQ ID NO: 2591441 - protein, 25 aa, Entamoeba histolytica
LLTGKFRFGYVFGFTIIGSLAEYFI

SEQ ID NO: 2591442 - protein, 24 aa, Entamoeba histolytica
LLWVGVCFLCFLGIRINYLGLAII

SEQ ID NO: 2591443 - protein, 17 aa, Entamoeba histolytica
LLYRFVQTLGMLPFSLL

SEQ ID NO: 2591444 - protein, 17 aa, Entamoeba histolytica
LMYCLLIVFGLTIILSF

SEQ ID NO: 2591445 - protein, 18 aa, Entamoeba histolytica
LMYIHCFMRRDFLCKREV

SEQ ID NO: 2591446 - protein, 18 aa, Entamoeba histolytica
LNCGCLVCNNCFTEHRII

SEQ ID NO: 2591447 - protein, 23 aa, Entamoeba histolytica
LNEDFWMRHSLIALFSWYVIILL

SEQ ID NO: 2591448 - protein, 25 aa, Entamoeba histolytica
LNGKLRFGNIYGFSIIASFVEYLVM

SEQ ID NO: 2591449 - protein, 17 aa, Entamoeba histolytica
LNQLLSLVSDWPLQESI

SEQ ID NO: 2591450 - protein, 19 aa, Entamoeba histolytica
LNRYTKLCVYTFSIVLPII

SEQ ID NO: 2591451 - protein, 18 aa, Entamoeba histolytica
LNSCISFTDYAAYFFYNN

SEQ ID NO: 2591452 - protein, 18 aa, Entamoeba histolytica
LNSIALKIINLFSTQTEL

SEQ ID NO: 2591453 - protein, 18 aa, Entamoeba histolytica
LPETLVFHLKRFGYNEQF

SEQ ID NO: 2591454 - protein, 19 aa, Entamoeba histolytica
LPFTFPVKYFFVFYKQRKL

SEQ ID NO: 2591455 - protein, 20 aa, Entamoeba histolytica
LPLCCLKKGLISPIDITNKY

SEQ ID NO: 2591456 - protein, 17 aa, Entamoeba histolytica
LPLCLQKWINWGFNVSE

SEQ ID NO: 2591457 - protein, 20 aa, Entamoeba histolytica
LPLFFCLSNFYPSKSFFTKE

SEQ ID NO: 2591458 - protein, 20 aa, Entamoeba histolytica
LPMTMVLRFAKNINNALDVL

SEQ ID NO: 2591459 - protein, 21 aa, Entamoeba histolytica
LPNLRRLEIRAGRNGLTENLP

SEQ ID NO: 2591460 - protein, 17 aa, Entamoeba histolytica
LPRMIGIGLFTDVSTSQ

SEQ ID NO: 2591461 - protein, 18 aa, Entamoeba histolytica
LPVKVVFCLIGICYLAVN

SEQ ID NO: 2591462 - protein, 20 aa, Entamoeba histolytica
LPYTFSFPWLNAIIIYVISI

SEQ ID NO: 2591463 - protein, 17 aa, Entamoeba histolytica
LQLFSLDSFDTWIMVII

SEQ ID NO: 2591464 - protein, 17 aa, Entamoeba histolytica
LQLPYTFSFPWLNAIII

SEQ ID NO: 2591465 - protein, 17 aa, Entamoeba histolytica
LQRRLFIVILMNVALIG

SEQ ID NO: 2591466 - protein, 18 aa, Entamoeba histolytica
LQTSRVFCKYAFPDNLAR

SEQ ID NO: 2591467 - protein, 27 aa, Entamoeba histolytica
LQWILRSCVLIAYFFCFILYFFMNILH

SEQ ID NO: 2591468 - protein, 21 aa, Entamoeba histolytica
LRAMFSFTFFWYNFMPLTRGT

SEQ ID NO: 2591469 - protein, 17 aa, Entamoeba histolytica
LRCLALFLEYAWMKGID

SEQ ID NO: 2591470 - protein, 21 aa, Entamoeba histolytica
LRFIAPMPFYLVTGSSLQLAI

SEQ ID NO: 2591471 - protein, 18 aa, Entamoeba histolytica
LRIITPFISKWNEAEIKS

SEQ ID NO: 2591472 - protein, 21 aa, Entamoeba histolytica
LRIPLILKDIFESVGSKQVPI

SEQ ID NO: 2591473 - protein, 19 aa, Entamoeba histolytica
LRIVISVIFFFISCFFDIP

SEQ ID NO: 2591474 - protein, 17 aa, Entamoeba histolytica
LRLDAEWLLNNIASHQM

SEQ ID NO: 2591475 - protein, 17 aa, Entamoeba histolytica
LRLFGVLTMISMMLFFM

SEQ ID NO: 2591476 - protein, 20 aa, Entamoeba histolytica
LRLLVPSTWYSKDFINDALI

SEQ ID NO: 2591477 - protein, 17 aa, Entamoeba histolytica
LRLSTLQVLLKGILSAE

SEQ ID NO: 2591478 - protein, 21 aa, Entamoeba histolytica
LRRKANFIFGNAFYYKSYSSQ

SEQ ID NO: 2591479 - protein, 17 aa, Entamoeba histolytica
LRWFSLFTTDVFMKTTL

SEQ ID NO: 2591480 - protein, 19 aa, Entamoeba histolytica
LSEDPCFFVFILTALFLLK

SEQ ID NO: 2591481 - protein, 24 aa, Entamoeba histolytica
LSFDGRFPFIWTYSTLVASCYWIS

SEQ ID NO: 2591482 - protein, 17 aa, Entamoeba histolytica
LSFYIMINWFFTLMEYL

SEQ ID NO: 2591483 - protein, 19 aa, Entamoeba histolytica
LSIAFFERFHRYFLTHYPS

SEQ ID NO: 2591484 - protein, 26 aa, Entamoeba histolytica
LSIKIPHLFPYLSMVFNYLFEFIPTS

SEQ ID NO: 2591485 - protein, 20 aa, Entamoeba histolytica
LSILCFIIYIPTYFVYGQSE

SEQ ID NO: 2591486 - protein, 20 aa, Entamoeba histolytica
LSISCSIGYTCLDVMNNFKD

SEQ ID NO: 2591487 - protein, 19 aa, Entamoeba histolytica
LSLCNRFSLQITFLESLLD

SEQ ID NO: 2591488 - protein, 25 aa, Entamoeba histolytica
LSLFFLHFWRSCLIFIVLPSFYIFK

SEQ ID NO: 2591489 - protein, 20 aa, Entamoeba histolytica
LSLPEDWFEFGLILSKTPMF

SEQ ID NO: 2591490 - protein, 18 aa, Entamoeba histolytica
LSPLFPFPISNYVLGPFC

SEQ ID NO: 2591491 - protein, 17 aa, Entamoeba histolytica
LSQFKRSLCSSKYSYSV

SEQ ID NO: 2591492 - protein, 17 aa, Entamoeba histolytica
LSQLVIDSCNIIDCIAK

SEQ ID NO: 2591493 - protein, 18 aa, Entamoeba histolytica
LSRYDFYDALSISLNGFI

SEQ ID NO: 2591494 - protein, 20 aa, Entamoeba histolytica
LSTICFAFGFALYYDWKLAL

SEQ ID NO: 2591495 - protein, 17 aa, Entamoeba histolytica
LTGSISLLNYVPKTIGS

SEQ ID NO: 2591496 - protein, 18 aa, Entamoeba histolytica
LTKIIGLIIGCCFVYYTN

SEQ ID NO: 2591497 - protein, 20 aa, Entamoeba histolytica
LTLLVLIQWSGLFQIRHSLH

SEQ ID NO: 2591498 - protein, 19 aa, Entamoeba histolytica
LTNKCGWCSITKKCGYCED

SEQ ID NO: 2591499 - protein, 25 aa, Entamoeba histolytica
LTPILPCFICDGGLLILSRIPLKDR

SEQ ID NO: 2591500 - protein, 17 aa, Entamoeba histolytica
LTSCLLKTFPAVVISNI

SEQ ID NO: 2591501 - protein, 23 aa, Entamoeba histolytica
LTSPEFFEFFSFIDNLLMNEAVA

SEQ ID NO: 2591502 - protein, 19 aa, Entamoeba histolytica
LTVTIVCVILLFSYIFTYV

SEQ ID NO: 2591503 - protein, 23 aa, Entamoeba histolytica
LVCDIRFPPKLAFATMKNIYSFF

SEQ ID NO: 2591504 - protein, 33 aa, Entamoeba histolytica
LVFILCCVLCCFGLLCFSCIPCCLDGLKDAHHK

SEQ ID NO: 2591505 - protein, 17 aa, Entamoeba histolytica
LVGLLLVYGIVHNKKAI

SEQ ID NO: 2591506 - protein, 19 aa, Entamoeba histolytica
LVKAYFLMCEIIEFNETKE

SEQ ID NO: 2591507 - protein, 19 aa, Entamoeba histolytica
LVLLISIIVSIMFGIIRVI

SEQ ID NO: 2591508 - protein, 17 aa, Entamoeba histolytica
LVLLWFVMHFMLAVQSI

SEQ ID NO: 2591509 - protein, 17 aa, Entamoeba histolytica
LVMCYKQRLSVIHYLYS

SEQ ID NO: 2591510 - protein, 19 aa, Entamoeba histolytica
LVNSICLYSPFPYGYESET

SEQ ID NO: 2591511 - protein, 19 aa, Entamoeba histolytica
LVPVWWNFVVVIIIIDIII

SEQ ID NO: 2591512 - protein, 18 aa, Entamoeba histolytica
LVRSVRTGMRYVQEYDLI

SEQ ID NO: 2591513 - protein, 18 aa, Entamoeba histolytica
LVTYSIYWLPYVNLAQDY

SEQ ID NO: 2591514 - protein, 17 aa, Entamoeba histolytica
LWFKFIGVRVIFVGIIF

SEQ ID NO: 2591515 - protein, 19 aa, Entamoeba histolytica
LWFTLEFISFIGMFYSFIT

SEQ ID NO: 2591516 - protein, 19 aa, Entamoeba histolytica
LWLCLCNIPSSSSLLEIIP

SEQ ID NO: 2591517 - protein, 17 aa, Entamoeba histolytica
LYFAYGFLMSIFIQITI

SEQ ID NO: 2591518 - protein, 20 aa, Entamoeba histolytica
LYKHIERYLSLRLLSTSSKE

SEQ ID NO: 2591519 - protein, 17 aa, Entamoeba histolytica
LYLKYCIIITIIRFLFT

SEQ ID NO: 2591520 - protein, 23 aa, Entamoeba histolytica
LYLVCIMFNFNLVKEFNFIDKKD

SEQ ID NO: 2591521 - protein, 17 aa, Entamoeba histolytica
LYPRIILNEGNGTSEDG

SEQ ID NO: 2591522 - protein, 19 aa, Entamoeba histolytica
MADALSWGRGLGCSFLEDC

SEQ ID NO: 2591523 - protein, 21 aa, Entamoeba histolytica
MAKIWYSQRLEWMGFTISTLT

SEQ ID NO: 2591524 - protein, 24 aa, Entamoeba histolytica
MAKLWYLQRMDWIGAFIIVITTTV

SEQ ID NO: 2591525 - protein, 19 aa, Entamoeba histolytica
MALACARQGITLVTVYATL

SEQ ID NO: 2591526 - protein, 22 aa, Entamoeba histolytica
MAPEIYRYFKVILITMQIILLS

SEQ ID NO: 2591527 - protein, 18 aa, Entamoeba histolytica
MCCSELKEFCAIINEHEE

SEQ ID NO: 2591528 - protein, 19 aa, Entamoeba histolytica
MCLTMRFFIMLRIYLSKHI

SEQ ID NO: 2591529 - protein, 17 aa, Entamoeba histolytica
MFLLIDLMRNWFLSSND

SEQ ID NO: 2591530 - protein, 17 aa, Entamoeba histolytica
MFNCFLLTLGLAFNFIS

SEQ ID NO: 2591531 - protein, 18 aa, Entamoeba histolytica
MFYKRIGLGITFYMLVWA

SEQ ID NO: 2591532 - protein, 24 aa, Entamoeba histolytica
MGFITLPNCVVCIGIKGIKCVEIN

SEQ ID NO: 2591533 - protein, 20 aa, Entamoeba histolytica
MGGLKPSWEVAYCSWEESIN

SEQ ID NO: 2591534 - protein, 19 aa, Entamoeba histolytica
MILLIICSRIKRTGIIQTM

SEQ ID NO: 2591535 - protein, 17 aa, Entamoeba histolytica
MIMIHSLGHSFSIHQHM

SEQ ID NO: 2591536 - protein, 17 aa, Entamoeba histolytica
MKLFGMMHPINGAITSA

SEQ ID NO: 2591537 - protein, 17 aa, Entamoeba histolytica
MKLKLIMPKGIWEEDVE

SEQ ID NO: 2591538 - protein, 22 aa, Entamoeba histolytica
MKLTEIFKVFVLYFKFNSKENI

SEQ ID NO: 2591539 - protein, 17 aa, Entamoeba histolytica
MKLVGLLLVYGIVHNKK

SEQ ID NO: 2591540 - protein, 25 aa, Entamoeba histolytica
MKNAMWWKNFKLWLIIGTVVAIIIL

SEQ ID NO: 2591541 - protein, 21 aa, Entamoeba histolytica
MKPSFKRLLIKGSVVKTAMAQ

SEQ ID NO: 2591542 - protein, 23 aa, Entamoeba histolytica
MKRVLKYLVYWLLNGTVCIANFF

SEQ ID NO: 2591543 - protein, 17 aa, Entamoeba histolytica
MKSYQCMISGFFKINNA

SEQ ID NO: 2591544 - protein, 19 aa, Entamoeba histolytica
MKVLCKIHRGLTCCIDGRI

SEQ ID NO: 2591545 - protein, 17 aa, Entamoeba histolytica
MKYKVLMKFLLFTLLTF

SEQ ID NO: 2591546 - protein, 24 aa, Entamoeba histolytica
MLIATVITICFSRFFTVCVYDKIA

SEQ ID NO: 2591547 - protein, 17 aa, Entamoeba histolytica
MLLKCSFTRLKKRMPTI

SEQ ID NO: 2591548 - protein, 18 aa, Entamoeba histolytica
MLNLRSGFVNFLCMWGAL

SEQ ID NO: 2591549 - protein, 18 aa, Entamoeba histolytica
MLPKQFAAFMFFDCHNKF

SEQ ID NO: 2591550 - protein, 18 aa, Entamoeba histolytica
MLYLWRLGKIAEVIEKYL

SEQ ID NO: 2591551 - protein, 19 aa, Entamoeba histolytica
MNFLKYCRFNGFFNKEDKL

SEQ ID NO: 2591552 - protein, 22 aa, Entamoeba histolytica
MNIKNYWFNPAFNNIFSFKENH

SEQ ID NO: 2591553 - protein, 17 aa, Entamoeba histolytica
MRILKDVAKGMSFLHEN

SEQ ID NO: 2591554 - protein, 17 aa, Entamoeba histolytica
MRRRLSIAIAMTGNPKV

SEQ ID NO: 2591555 - protein, 17 aa, Entamoeba histolytica
MRSMLYLWRLGKIAEVI

SEQ ID NO: 2591556 - protein, 19 aa, Entamoeba histolytica
MTFLTWFFVSRCWKNKYTE

SEQ ID NO: 2591557 - protein, 19 aa, Entamoeba histolytica
MTKFMGWKRFVFREYPVAL

SEQ ID NO: 2591558 - protein, 23 aa, Entamoeba histolytica
MTYKEFYSLAAIERCRIKDSLHN

SEQ ID NO: 2591559 - protein, 17 aa, Entamoeba histolytica
MVAYCIRWYSDLDIPKE

SEQ ID NO: 2591560 - protein, 18 aa, Entamoeba histolytica
MYIPEIIYLLNLIGSVFT

SEQ ID NO: 2591561 - protein, 24 aa, Entamoeba histolytica
MYLLKEIFNFIVIVFAFMGGLLIY

SEQ ID NO: 2591562 - protein, 22 aa, Entamoeba histolytica
MYNLYKAELKGEVTTQITDEVP

SEQ ID NO: 2591563 - protein, 24 aa, Entamoeba histolytica
MYSNKHKIMYNKYNIHLKSEQHQV

SEQ ID NO: 2591564 - protein, 23 aa, Entamoeba histolytica
NCHKDSNCAFIFEDQEQITLHIP

SEQ ID NO: 2591565 - protein, 19 aa, Entamoeba histolytica
NCIYSKFEYLINCEEKGIT

SEQ ID NO: 2591566 - protein, 20 aa, Entamoeba histolytica
NCKRIAEKMLFGIKDLTENV

SEQ ID NO: 2591567 - protein, 17 aa, Entamoeba histolytica
NCLYRFNLLLSSNITHL

SEQ ID NO: 2591568 - protein, 19 aa, Entamoeba histolytica
NCMLEHLSLIFTQRSCSTN

SEQ ID NO: 2591569 - protein, 21 aa, Entamoeba histolytica
NCRRWKGSIIEYIPKGNKPIN

SEQ ID NO: 2591570 - protein, 22 aa, Entamoeba histolytica
NELLKRILKIVALYPKSNQVLI

SEQ ID NO: 2591571 - protein, 18 aa, Entamoeba histolytica
NFGCCFLLSWVCGFINNF

SEQ ID NO: 2591572 - protein, 18 aa, Entamoeba histolytica
NFGPRGTLIFSFIFGTIG

SEQ ID NO: 2591573 - protein, 19 aa, Entamoeba histolytica
NFISRFGVKFTITSNNHLK

SEQ ID NO: 2591574 - protein, 17 aa, Entamoeba histolytica
NFPPRINVINEYAFSGC

SEQ ID NO: 2591575 - protein, 20 aa, Entamoeba histolytica
NFWICCLHFIGTPLISNNAS

SEQ ID NO: 2591576 - protein, 17 aa, Entamoeba histolytica
NFYEIGWRFVFIILSCI

SEQ ID NO: 2591577 - protein, 19 aa, Entamoeba histolytica
NGCKDCLCSPQYLPYSIPR

SEQ ID NO: 2591578 - protein, 21 aa, Entamoeba histolytica
NGEWSTKCIVSYCDDGYKFDY

SEQ ID NO: 2591579 - protein, 22 aa, Entamoeba histolytica
NGWKTSRVRIARSLDKEELNNT

SEQ ID NO: 2591580 - protein, 20 aa, Entamoeba histolytica
NGWVLCVLAIPIGIISGYDL

SEQ ID NO: 2591581 - protein, 17 aa, Entamoeba histolytica
NIGSAVLHCIGYFSLFI

SEQ ID NO: 2591582 - protein, 25 aa, Entamoeba histolytica
NIKSRLRVSLLYTWCVILILNNVRI

SEQ ID NO: 2591583 - protein, 18 aa, Entamoeba histolytica
NIMYKRIIYIQALGQCTL

SEQ ID NO: 2591584 - protein, 26 aa, Entamoeba histolytica
NINFKWRLSQYITWYIVFSLLMSMLM

SEQ ID NO: 2591585 - protein, 17 aa, Entamoeba histolytica
NINFWIGRILFFCAFIL

SEQ ID NO: 2591586 - protein, 23 aa, Entamoeba histolytica
NIYRLSFVMVMNFCYFLFELIIG

SEQ ID NO: 2591587 - protein, 18 aa, Entamoeba histolytica
NKDFRFSTEFEYGGSKSD

SEQ ID NO: 2591588 - protein, 24 aa, Entamoeba histolytica
NKDYISSISFCWWLLNGILSSITI

SEQ ID NO: 2591589 - protein, 20 aa, Entamoeba histolytica
NKLICLSGECSLVVAADTVI

SEQ ID NO: 2591590 - protein, 18 aa, Entamoeba histolytica
NKRFAISKCCGVIQINSE

SEQ ID NO: 2591591 - protein, 21 aa, Entamoeba histolytica
NKRFSYFFFHWSDLIRTAFFH

SEQ ID NO: 2591592 - protein, 17 aa, Entamoeba histolytica
NKRLLCRSLIYNPEPYY

SEQ ID NO: 2591593 - protein, 22 aa, Entamoeba histolytica
NKVECPYWLAPECIINKKACLK

SEQ ID NO: 2591594 - protein, 18 aa, Entamoeba histolytica
NKVGYFGVFYYKDENCTE

SEQ ID NO: 2591595 - protein, 18 aa, Entamoeba histolytica
NLDCSFNRIFSFPPILSL

SEQ ID NO: 2591596 - protein, 19 aa, Entamoeba histolytica
NLNGTSCIFVILSVVVTFL

SEQ ID NO: 2591597 - protein, 19 aa, Entamoeba histolytica
NMALLCFDILLLVFVFWIF

SEQ ID NO: 2591598 - protein, 19 aa, Entamoeba histolytica
NMLFDICLELGYFFTLKKS

SEQ ID NO: 2591599 - protein, 17 aa, Entamoeba histolytica
NNIIKTLCYWRNEKIIH

SEQ ID NO: 2591600 - protein, 18 aa, Entamoeba histolytica
NNKCSKCSFWYGTNEEGN

SEQ ID NO: 2591601 - protein, 17 aa, Entamoeba histolytica
NNNFCFINHLGIYIRET

SEQ ID NO: 2591602 - protein, 18 aa, Entamoeba histolytica
NNRINCKIKECYNSLECL

SEQ ID NO: 2591603 - protein, 20 aa, Entamoeba histolytica
NPMRYWRIGVLFGGTIYVII

SEQ ID NO: 2591604 - protein, 18 aa, Entamoeba histolytica
NPRLFCGIFEEFLGNGIE

SEQ ID NO: 2591605 - protein, 21 aa, Entamoeba histolytica
NPRVALVLGIIFNFFEDSKTS

SEQ ID NO: 2591606 - protein, 22 aa, Entamoeba histolytica
NPSRLSKWLPIISLVYSQHLDQ

SEQ ID NO: 2591607 - protein, 18 aa, Entamoeba histolytica
NQQCVACPAGYFQSQNEC

SEQ ID NO: 2591608 - protein, 17 aa, Entamoeba histolytica
NRKEICFNFGLTLDFIG

SEQ ID NO: 2591609 - protein, 22 aa, Entamoeba histolytica
NRKRVGECLIHLSKDQKHQAQQ

SEQ ID NO: 2591610 - protein, 18 aa, Entamoeba histolytica
NRMKDIFETIGFTITTLN

SEQ ID NO: 2591611 - protein, 17 aa, Entamoeba histolytica
NRRINLLVLQTFYPSPL

SEQ ID NO: 2591612 - protein, 18 aa, Entamoeba histolytica
NRVVELFSNFILSAKNLK

SEQ ID NO: 2591613 - protein, 17 aa, Entamoeba histolytica
NSISTSCVVVWNESELA

SEQ ID NO: 2591614 - protein, 17 aa, Entamoeba histolytica
NSNPLQITFKWSDTFKK

SEQ ID NO: 2591615 - protein, 19 aa, Entamoeba histolytica
NSRDICKIYSLFAETIIST

SEQ ID NO: 2591616 - protein, 20 aa, Entamoeba histolytica
NSSIYSVCWSFGKSLGYLFG

SEQ ID NO: 2591617 - protein, 19 aa, Entamoeba histolytica
NTCKLCFDGFVLNGLKCVS

SEQ ID NO: 2591618 - protein, 24 aa, Entamoeba histolytica
NTIKRLTFGYVFVLCFDYLYISNS

SEQ ID NO: 2591619 - protein, 19 aa, Entamoeba histolytica
NVCQRWLGMRVELIGCVGL

SEQ ID NO: 2591620 - protein, 19 aa, Entamoeba histolytica
NVIPRLVLNVGVTKSPLKS

SEQ ID NO: 2591621 - protein, 22 aa, Entamoeba histolytica
NVLRIGFYIGEPFEISLLIQSI

SEQ ID NO: 2591622 - protein, 19 aa, Entamoeba histolytica
NYFKAIVCGIIIFFVKLWT

SEQ ID NO: 2591623 - protein, 19 aa, Entamoeba histolytica
NYMKRVWESLVLVIFIRPF

SEQ ID NO: 2591624 - protein, 17 aa, Entamoeba histolytica
NYPRWLMWGSVVNGNQT

SEQ ID NO: 2591625 - protein, 17 aa, Entamoeba histolytica
PALFEGWGKKQGGSVKT

SEQ ID NO: 2591626 - protein, 20 aa, Entamoeba histolytica
PALFLRRIYDIGMSKIDQYV

SEQ ID NO: 2591627 - protein, 17 aa, Entamoeba histolytica
PCELRKKVIFNFVLSHK

SEQ ID NO: 2591628 - protein, 18 aa, Entamoeba histolytica
PCGEWSFKYRGTRPEIVH

SEQ ID NO: 2591629 - protein, 21 aa, Entamoeba histolytica
PCGNFSSYGYSYLMVRGGGDV

SEQ ID NO: 2591630 - protein, 17 aa, Entamoeba histolytica
PDVWKGISILINTNENN

SEQ ID NO: 2591631 - protein, 21 aa, Entamoeba histolytica
PEALKLVPIFVLGAMKTSAFM

SEQ ID NO: 2591632 - protein, 23 aa, Entamoeba histolytica
PEFPFMWGYCWFTTILSYLSLWN

SEQ ID NO: 2591633 - protein, 20 aa, Entamoeba histolytica
PEGWCSCIPQTILLLQRYGY

SEQ ID NO: 2591634 - protein, 19 aa, Entamoeba histolytica
PEHCLDCLNSEYCFKCENG

SEQ ID NO: 2591635 - protein, 20 aa, Entamoeba histolytica
PEILTTLALDFKIARSCPNG

SEQ ID NO: 2591636 - protein, 20 aa, Entamoeba histolytica
PEMMRLPIIQGFIGRSECAV

SEQ ID NO: 2591637 - protein, 21 aa, Entamoeba histolytica
PETWKGVVYLLVIAFMQILTS

SEQ ID NO: 2591638 - protein, 18 aa, Entamoeba histolytica
PEYRRAYATVAFHGTYLP

SEQ ID NO: 2591639 - protein, 17 aa, Entamoeba histolytica
PEYRYLCCFDEECNPML

SEQ ID NO: 2591640 - protein, 17 aa, Entamoeba histolytica
PFCDFQDLFSIKSHVLA

SEQ ID NO: 2591641 - protein, 18 aa, Entamoeba histolytica
PFFPLILKLILQESFALV

SEQ ID NO: 2591642 - protein, 25 aa, Entamoeba histolytica
PFGPKWKKGDVVSICVDFDQRRIKI

SEQ ID NO: 2591643 - protein, 17 aa, Entamoeba histolytica
PFLKRIKIISSIDASSQ

SEQ ID NO: 2591644 - protein, 17 aa, Entamoeba histolytica
PFPKTQFKFAWDIADLV

SEQ ID NO: 2591645 - protein, 20 aa, Entamoeba histolytica
PFTMSFIRSRIQSVKVILTV

SEQ ID NO: 2591646 - protein, 20 aa, Entamoeba histolytica
PGKRECKRCEIEYGKYVNEN

SEQ ID NO: 2591647 - protein, 18 aa, Entamoeba histolytica
PHKYCWREGDDLYINIKG

SEQ ID NO: 2591648 - protein, 18 aa, Entamoeba histolytica
PIECKTCFYEHCLTCADD

SEQ ID NO: 2591649 - protein, 18 aa, Entamoeba histolytica
PIFCCISILLYLITSIAA

SEQ ID NO: 2591650 - protein, 21 aa, Entamoeba histolytica
PIILLRPLFRIPLKQNDLVIG

SEQ ID NO: 2591651 - protein, 17 aa, Entamoeba histolytica
PIIPMFILCSIFITHRN

SEQ ID NO: 2591652 - protein, 20 aa, Entamoeba histolytica
PIIRRMVCIFDKLLEALNKS

SEQ ID NO: 2591653 - protein, 17 aa, Entamoeba histolytica
PIYVAGCGLLFGTLAII

SEQ ID NO: 2591654 - protein, 18 aa, Entamoeba histolytica
PKGRYILRQVFDKKKNLV

SEQ ID NO: 2591655 - protein, 20 aa, Entamoeba histolytica
PKHIIPFVFSWPSCSNPFLY

SEQ ID NO: 2591656 - protein, 22 aa, Entamoeba histolytica
PKKNILRWGPTLAFVSAANTFV

SEQ ID NO: 2591657 - protein, 18 aa, Entamoeba histolytica
PKPIYYRKYKRVVKQVKP

SEQ ID NO: 2591658 - protein, 21 aa, Entamoeba histolytica
PKTQFKFAWDIADLVANGKRT

SEQ ID NO: 2591659 - protein, 19 aa, Entamoeba histolytica
PKVFFDRCSWLLSLPEDWF

SEQ ID NO: 2591660 - protein, 18 aa, Entamoeba histolytica
PLFHSVLPFSLPKLRRRE

SEQ ID NO: 2591661 - protein, 18 aa, Entamoeba histolytica
PLFWDFNKKLNFIKSASD

SEQ ID NO: 2591662 - protein, 21 aa, Entamoeba histolytica
PLFYRLIKVILMPKTTVPQTI

SEQ ID NO: 2591663 - protein, 17 aa, Entamoeba histolytica
PLIYLTRFVPFTFIRKY

SEQ ID NO: 2591664 - protein, 20 aa, Entamoeba histolytica
PLKYLWPSVRVVLYRTIYGL

SEQ ID NO: 2591665 - protein, 18 aa, Entamoeba histolytica
PLQITFKWSDTFKKDNSS

SEQ ID NO: 2591666 - protein, 19 aa, Entamoeba histolytica
PLVHSYCCRHVWGNDSKAF

SEQ ID NO: 2591667 - protein, 17 aa, Entamoeba histolytica
PLYLEFYSMFSAGHFII

SEQ ID NO: 2591668 - protein, 17 aa, Entamoeba histolytica
PMLPTMIPIILKRVNLN

SEQ ID NO: 2591669 - protein, 19 aa, Entamoeba histolytica
PMYCAFSFLVIAGGKTVLL

SEQ ID NO: 2591670 - protein, 18 aa, Entamoeba histolytica
PNQCGIVFCLSKKDCESL

SEQ ID NO: 2591671 - protein, 18 aa, Entamoeba histolytica
PNVICKYIEWGRIEIIKE

SEQ ID NO: 2591672 - protein, 21 aa, Entamoeba histolytica
PPKFECWWLTRIIPYIFLIFV

SEQ ID NO: 2591673 - protein, 19 aa, Entamoeba histolytica
PPSSLRLDAEWLLNNIASH

SEQ ID NO: 2591674 - protein, 23 aa, Entamoeba histolytica
PQLLFVIRWFFSFLLDPVNSVTL

SEQ ID NO: 2591675 - protein, 19 aa, Entamoeba histolytica
PRKGLWYKVVNNYKYAFPL

SEQ ID NO: 2591676 - protein, 20 aa, Entamoeba histolytica
PRVDLYLMIFLKFLATVIPT

SEQ ID NO: 2591677 - protein, 21 aa, Entamoeba histolytica
PRWFVLGIICVVSIFILLLWM

SEQ ID NO: 2591678 - protein, 22 aa, Entamoeba histolytica
PSGHSKCTFAFLRINQPVDNVD

SEQ ID NO: 2591679 - protein, 18 aa, Entamoeba histolytica
PSGIKWILSFSICGSSVA

SEQ ID NO: 2591680 - protein, 24 aa, Entamoeba histolytica
PSHDFWRHVCIVWNKCYYSISDRQ

SEQ ID NO: 2591681 - protein, 21 aa, Entamoeba histolytica
PSLKQLHIFGAVFAENGFFQR

SEQ ID NO: 2591682 - protein, 24 aa, Entamoeba histolytica
PSLMPYKCMISGWFTYNGSDTNDN

SEQ ID NO: 2591683 - protein, 21 aa, Entamoeba histolytica
PSPIIPFCFLDFIKQQENCKL

SEQ ID NO: 2591684 - protein, 20 aa, Entamoeba histolytica
PSSHAQFWCCFIVLFYYYIN

SEQ ID NO: 2591685 - protein, 21 aa, Entamoeba histolytica
PSSHAQFWCCFIVLFYYYINQ

SEQ ID NO: 2591686 - protein, 25 aa, Entamoeba histolytica
PSSLLIKRKLVLIAFQCLQSKVIKP

SEQ ID NO: 2591687 - protein, 20 aa, Entamoeba histolytica
PTFEPSFVFSLGFWWRVAVI

SEQ ID NO: 2591688 - protein, 21 aa, Entamoeba histolytica
PTIPRRSSIQFSYHNLIEKTR

SEQ ID NO: 2591689 - protein, 20 aa, Entamoeba histolytica
PTSMPFHYFMLFVRLLISLT

SEQ ID NO: 2591690 - protein, 18 aa, Entamoeba histolytica
PVCICCWFLNLFQSKKTR

SEQ ID NO: 2591691 - protein, 20 aa, Entamoeba histolytica
PYDCCGWKLTNITTLNNSTC

SEQ ID NO: 2591692 - protein, 17 aa, Entamoeba histolytica
QAAEIISIIVTFGGIDI

SEQ ID NO: 2591693 - protein, 17 aa, Entamoeba histolytica
QCISCSNILFLEANSRK

SEQ ID NO: 2591694 - protein, 20 aa, Entamoeba histolytica
QCTKCRCSVCDKKEGCYIGC

SEQ ID NO: 2591695 - protein, 17 aa, Entamoeba histolytica
QCVICLILAILSGHSHS

SEQ ID NO: 2591696 - protein, 24 aa, Entamoeba histolytica
QECAKRVQLEWEELLGLLEEFAAF

SEQ ID NO: 2591697 - protein, 21 aa, Entamoeba histolytica
QECREIMDFLYKRLCEDGKNW

SEQ ID NO: 2591698 - protein, 17 aa, Entamoeba histolytica
QELKKGITLIGFRLSDF

SEQ ID NO: 2591699 - protein, 17 aa, Entamoeba histolytica
QEYILSHCVDWLQVINS

SEQ ID NO: 2591700 - protein, 24 aa, Entamoeba histolytica
QFNPMVIVKYSWFFFELIIRSLVY

SEQ ID NO: 2591701 - protein, 24 aa, Entamoeba histolytica
QFVFSLPIDVCFGIASNNDGYMIV

SEQ ID NO: 2591702 - protein, 17 aa, Entamoeba histolytica
QHKIMYNLYKAELKGEV

SEQ ID NO: 2591703 - protein, 22 aa, Entamoeba histolytica
QHLNEWIDLIFGFKQTGEPAIK

SEQ ID NO: 2591704 - protein, 21 aa, Entamoeba histolytica
QHLNEWIDLIFGYKQRGKNAE

SEQ ID NO: 2591705 - protein, 17 aa, Entamoeba histolytica
QINEHFKKLIKYLPQFT

SEQ ID NO: 2591706 - protein, 19 aa, Entamoeba histolytica
QKHVFYRGFTLPTFLKECM

SEQ ID NO: 2591707 - protein, 18 aa, Entamoeba histolytica
QKIPVVWARAIVEASEAI

SEQ ID NO: 2591708 - protein, 17 aa, Entamoeba histolytica
QKKFCIFPSVSKEITTF

SEQ ID NO: 2591709 - protein, 20 aa, Entamoeba histolytica
QKKSMKWIYSIIVIPVIIAI

SEQ ID NO: 2591710 - protein, 19 aa, Entamoeba histolytica
QLCLCPLCINGIPNYNDTK

SEQ ID NO: 2591711 - protein, 19 aa, Entamoeba histolytica
QNMIISFFLCWFVIGIGAA

SEQ ID NO: 2591712 - protein, 19 aa, Entamoeba histolytica
QQSSWKIVWIVLLISLILA

SEQ ID NO: 2591713 - protein, 22 aa, Entamoeba histolytica
QRPLCPRYMLLLNEIVRLSLLI

SEQ ID NO: 2591714 - protein, 20 aa, Entamoeba histolytica
QRVEPLLGFINGFFLVLFSA

SEQ ID NO: 2591715 - protein, 23 aa, Entamoeba histolytica
QTLTDFYLFFSIVAEQQPIDLSK

SEQ ID NO: 2591716 - protein, 18 aa, Entamoeba histolytica
QVFIKFYIIIAVNQKKNF

SEQ ID NO: 2591717 - protein, 19 aa, Entamoeba histolytica
QVKFLWLCLCNIPSSSSLL

SEQ ID NO: 2591718 - protein, 18 aa, Entamoeba histolytica
QWCYRKARRIACGIDSDI

SEQ ID NO: 2591719 - protein, 17 aa, Entamoeba histolytica
RAEKLHHFFPIQKIWNE

SEQ ID NO: 2591720 - protein, 21 aa, Entamoeba histolytica
RAFCYKFGWYLAALQLFDTFI

SEQ ID NO: 2591721 - protein, 19 aa, Entamoeba histolytica
RAPCSFTKVLYCTIPSCSI

SEQ ID NO: 2591722 - protein, 19 aa, Entamoeba histolytica
RATGLLAYFVFFLLYFILY

SEQ ID NO: 2591723 - protein, 17 aa, Entamoeba histolytica
RCNLHLSSGPFIINSLS

SEQ ID NO: 2591724 - protein, 19 aa, Entamoeba histolytica
RCPKCGGLLKLDVVLFGEK

SEQ ID NO: 2591725 - protein, 21 aa, Entamoeba histolytica
RCPRCGGYVNPFCTFEEGGKK

SEQ ID NO: 2591726 - protein, 20 aa, Entamoeba histolytica
REGLKGIVIILNFTNPRLSD

SEQ ID NO: 2591727 - protein, 25 aa, Entamoeba histolytica
REGRFRFGGFWGKKWAKLTINKNES

SEQ ID NO: 2591728 - protein, 20 aa, Entamoeba histolytica
REIFQAIGIFIGFVICVSII

SEQ ID NO: 2591729 - protein, 17 aa, Entamoeba histolytica
REKARMEVMKEIKAKEA

SEQ ID NO: 2591730 - protein, 17 aa, Entamoeba histolytica
REMICSFILIFSFFCRC

SEQ ID NO: 2591731 - protein, 18 aa, Entamoeba histolytica
RFRIGNFHFFKTILSEEM

SEQ ID NO: 2591732 - protein, 24 aa, Entamoeba histolytica
RFSPTCWVKLPYKRSFYMTYSQKS

SEQ ID NO: 2591733 - protein, 22 aa, Entamoeba histolytica
RHAYRLLSVFLLKAVSIMNKQP

SEQ ID NO: 2591734 - protein, 17 aa, Entamoeba histolytica
RHHFVIIGITVFFLLII

SEQ ID NO: 2591735 - protein, 17 aa, Entamoeba histolytica
RHIPARFIVGIIVLVIV

SEQ ID NO: 2591736 - protein, 18 aa, Entamoeba histolytica
RIAMCFFVVAVALILIFP

SEQ ID NO: 2591737 - protein, 19 aa, Entamoeba histolytica
RIFGLRLTYVMTIICTSMF

SEQ ID NO: 2591738 - protein, 18 aa, Entamoeba histolytica
RIGLGITFYMLVWAISIF

SEQ ID NO: 2591739 - protein, 18 aa, Entamoeba histolytica
RIGMPIPFYVLKKNIAAY

SEQ ID NO: 2591740 - protein, 21 aa, Entamoeba histolytica
RIKALCGFSPFVISSYTQRGG

SEQ ID NO: 2591741 - protein, 21 aa, Entamoeba histolytica
RIKRSIVITGIFNLKTDRIEF

SEQ ID NO: 2591742 - protein, 18 aa, Entamoeba histolytica
RILKSGGMLGFFAMDNLN

SEQ ID NO: 2591743 - protein, 18 aa, Entamoeba histolytica
RIPFDWLEEKSMGLSDSI

SEQ ID NO: 2591744 - protein, 20 aa, Entamoeba histolytica
RIYNEYKVHLKGEGEVIEPL

SEQ ID NO: 2591745 - protein, 21 aa, Entamoeba histolytica
RKCWMCVFPGCTEPPKTRYNC

SEQ ID NO: 2591746 - protein, 18 aa, Entamoeba histolytica
RKEKEIYQMFGFSSLKKR

SEQ ID NO: 2591747 - protein, 23 aa, Entamoeba histolytica
RKKEPYQRIEFILTIGKSNEGTV

SEQ ID NO: 2591748 - protein, 24 aa, Entamoeba histolytica
RKSKRKSIRVIGNMALLCFDILLL

SEQ ID NO: 2591749 - protein, 23 aa, Entamoeba histolytica
RKWCCIGCGITIILAMAIHPTTV

SEQ ID NO: 2591750 - protein, 20 aa, Entamoeba histolytica
RKYRYCFEIKTAAASSTHID

SEQ ID NO: 2591751 - protein, 19 aa, Entamoeba histolytica
RLCFIISLIIVIGYIALII

SEQ ID NO: 2591752 - protein, 17 aa, Entamoeba histolytica
RLFLNWELRENKNIYYG

SEQ ID NO: 2591753 - protein, 20 aa, Entamoeba histolytica
RLGGCLGCNIGLFLFPILEI

SEQ ID NO: 2591754 - protein, 18 aa, Entamoeba histolytica
RLIKLFLSFFLINSTRFA

SEQ ID NO: 2591755 - protein, 20 aa, Entamoeba histolytica
RLKSFPLWFCKQWLRTDEKG

SEQ ID NO: 2591756 - protein, 17 aa, Entamoeba histolytica
RLMKIRLSPYIVITSIV

SEQ ID NO: 2591757 - protein, 17 aa, Entamoeba histolytica
RMIGIGLFTDVSTSQAM

SEQ ID NO: 2591758 - protein, 18 aa, Entamoeba histolytica
RNISYWGWLFTLKQPLFY

SEQ ID NO: 2591759 - protein, 22 aa, Entamoeba histolytica
RNLRAVFMLVFVVFFTLNIRSE

SEQ ID NO: 2591760 - protein, 19 aa, Entamoeba histolytica
RRCGSCLGLSGPSMKSYQC

SEQ ID NO: 2591761 - protein, 22 aa, Entamoeba histolytica
RRFSWSDGHSFNFSFFKKKKKC

SEQ ID NO: 2591762 - protein, 21 aa, Entamoeba histolytica
RRPEDSWGYFEMFVKSPETGE

SEQ ID NO: 2591763 - protein, 22 aa, Entamoeba histolytica
RRTLWYVWALWWFIYAVVCVAT

SEQ ID NO: 2591764 - protein, 25 aa, Entamoeba histolytica
RRVNGLKILICWSFLEVRICHILTN

SEQ ID NO: 2591765 - protein, 19 aa, Entamoeba histolytica
RRVRTCFVKIILQLSLPLT

SEQ ID NO: 2591766 - protein, 17 aa, Entamoeba histolytica
RSACSLLDYIKGIMRKP

SEQ ID NO: 2591767 - protein, 21 aa, Entamoeba histolytica
RSEIDWVILICRALMTVVVCI

SEQ ID NO: 2591768 - protein, 25 aa, Entamoeba histolytica
RSFFKRYYLLFLVSFYLLAFIIPNY

SEQ ID NO: 2591769 - protein, 17 aa, Entamoeba histolytica
RSSMVYQCCKLFVHLLE

SEQ ID NO: 2591770 - protein, 19 aa, Entamoeba histolytica
RTAISFSWLLQYAEQNGVS

SEQ ID NO: 2591771 - protein, 22 aa, Entamoeba histolytica
RTKGCSVVEKYGYIFVFVLFFI

SEQ ID NO: 2591772 - protein, 20 aa, Entamoeba histolytica
RTNKYLKSEIVSTLEDIKPP

SEQ ID NO: 2591773 - protein, 19 aa, Entamoeba histolytica
RTSTFYGYYMKYRLLCHNK

SEQ ID NO: 2591774 - protein, 18 aa, Entamoeba histolytica
RTTISLPFYFYSVRFLGK

SEQ ID NO: 2591775 - protein, 19 aa, Entamoeba histolytica
RTTLGFGYPTVIKMYELFS

SEQ ID NO: 2591776 - protein, 20 aa, Entamoeba histolytica
RVDRELQHGFVLFECTSELM

SEQ ID NO: 2591777 - protein, 21 aa, Entamoeba histolytica
RVRTSDLPQCFPLNKNIINKQ

SEQ ID NO: 2591778 - protein, 19 aa, Entamoeba histolytica
RYCFWKFHATFCIASLFML

SEQ ID NO: 2591779 - protein, 19 aa, Entamoeba histolytica
RYDYGLTWSDMLEKVPNSN

SEQ ID NO: 2591780 - protein, 19 aa, Entamoeba histolytica
RYFKVARDWFLFLMSHDAT

SEQ ID NO: 2591781 - protein, 20 aa, Entamoeba histolytica
RYLIRNCGDRELFIWYCETN

SEQ ID NO: 2591782 - protein, 23 aa, Entamoeba histolytica
SAAEEFMFRFSFFKPTKEVLSLA

SEQ ID NO: 2591783 - protein, 23 aa, Entamoeba histolytica
SAKFFSGDCSFGFEENDNDWIYY

SEQ ID NO: 2591784 - protein, 17 aa, Entamoeba histolytica
SALRLLVPSTWYSKDFI

SEQ ID NO: 2591785 - protein, 25 aa, Entamoeba histolytica
SALWCSLSFCYLCISKIVKSFDILE

SEQ ID NO: 2591786 - protein, 19 aa, Entamoeba histolytica
SAWVSGLLYFFGRIPQIIH

SEQ ID NO: 2591787 - protein, 17 aa, Entamoeba histolytica
SCFFYWIVVPLLFNEQG

SEQ ID NO: 2591788 - protein, 20 aa, Entamoeba histolytica
SCIIVSFFVILLFNIVFFVI

SEQ ID NO: 2591789 - protein, 17 aa, Entamoeba histolytica
SCLLGMIRLEGFNETTK

SEQ ID NO: 2591790 - protein, 17 aa, Entamoeba histolytica
SCVLYIFICLMFLISTV

SEQ ID NO: 2591791 - protein, 17 aa, Entamoeba histolytica
SCVRGVFRFSNENFYST

SEQ ID NO: 2591792 - protein, 18 aa, Entamoeba histolytica
SDIFLEFHSGSTMQFWLD

SEQ ID NO: 2591793 - protein, 24 aa, Entamoeba histolytica
SDIHRSWCAFRCTQLLTLLDQIVS

SEQ ID NO: 2591794 - protein, 23 aa, Entamoeba histolytica
SDLLKIRFCQDIARGMEYLHEND

SEQ ID NO: 2591795 - protein, 22 aa, Entamoeba histolytica
SDLLKVRFCQDIARGMEYLHQN

SEQ ID NO: 2591796 - protein, 17 aa, Entamoeba histolytica
SDLRLGMHYPLGSVVML

SEQ ID NO: 2591797 - protein, 17 aa, Entamoeba histolytica
SDLSIKVFYQWLTTSIY

SEQ ID NO: 2591798 - protein, 24 aa, Entamoeba histolytica
SDPLRFSFNYSFFETFRHNYNYNE

SEQ ID NO: 2591799 - protein, 19 aa, Entamoeba histolytica
SDPSIQCISRFCSSSLVFC

SEQ ID NO: 2591800 - protein, 17 aa, Entamoeba histolytica
SDPYFQWTVHVHNPKNF

SEQ ID NO: 2591801 - protein, 22 aa, Entamoeba histolytica
SEELCKSAPVIILWTTLFLVQI

SEQ ID NO: 2591802 - protein, 25 aa, Entamoeba histolytica
SEEWKKVVWRCGRWIDMDHPYKTMD

SEQ ID NO: 2591803 - protein, 18 aa, Entamoeba histolytica
SEFWIQIYYLIITFGVII

SEQ ID NO: 2591804 - protein, 19 aa, Entamoeba histolytica
SEIIPWWLLCCHDSVKEIS

SEQ ID NO: 2591805 - protein, 21 aa, Entamoeba histolytica
SEIKFGYNPWFCFFIPGLVVI

SEQ ID NO: 2591806 - protein, 17 aa, Entamoeba histolytica
SFIFKTWIFEVKWTFVL

SEQ ID NO: 2591807 - protein, 19 aa, Entamoeba histolytica
SFMVICFYVCLSFIIDRHI

SEQ ID NO: 2591808 - protein, 20 aa, Entamoeba histolytica
SFNCSKCPVGSASAVRNAAQ

SEQ ID NO: 2591809 - protein, 21 aa, Entamoeba histolytica
SFSACCFWLIIPILMRDIGAS

SEQ ID NO: 2591810 - protein, 23 aa, Entamoeba histolytica
SFVFSLGFWWRVAVITLINSFPF

SEQ ID NO: 2591811 - protein, 22 aa, Entamoeba histolytica
SFVKRMRWFPSFFFGYDQALMN

SEQ ID NO: 2591812 - protein, 19 aa, Entamoeba histolytica
SGCKSFLKEAGFETEDNVA

SEQ ID NO: 2591813 - protein, 20 aa, Entamoeba histolytica
SGCLQLRLTSLQIINTILAK

SEQ ID NO: 2591814 - protein, 19 aa, Entamoeba histolytica
SGLLTGKWKNLVISTFNDK

SEQ ID NO: 2591815 - protein, 18 aa, Entamoeba histolytica
SGSTFTHFCLVSDPHASS

SEQ ID NO: 2591816 - protein, 29 aa, Entamoeba histolytica
SHEMKKAMCWRKWKLWIIIGVIAAIIIIV

SEQ ID NO: 2591817 - protein, 23 aa, Entamoeba histolytica
SHHKRIIRELCRYVSPSLDNQKR

SEQ ID NO: 2591818 - protein, 24 aa, Entamoeba histolytica
SICSHCNKLLPACEMIQCALCGLP

SEQ ID NO: 2591819 - protein, 19 aa, Entamoeba histolytica
SIECLSCSNNLFLKDNKCQ

SEQ ID NO: 2591820 - protein, 19 aa, Entamoeba histolytica
SIKDICWIIMKIEKLAQLE

SEQ ID NO: 2591821 - protein, 17 aa, Entamoeba histolytica
SILTYNILQYLNVALNN

SEQ ID NO: 2591822 - protein, 20 aa, Entamoeba histolytica
SIPFRFIMEFTTPHISDNRK

SEQ ID NO: 2591823 - protein, 20 aa, Entamoeba histolytica
SIPRLSCLDNRCGNGIIDET

SEQ ID NO: 2591824 - protein, 19 aa, Entamoeba histolytica
SITSRIEGTFTFKKPVKLK

SEQ ID NO: 2591825 - protein, 20 aa, Entamoeba histolytica
SIVNSVMWGRCVFDNIRKFL

SEQ ID NO: 2591826 - protein, 17 aa, Entamoeba histolytica
SKFRVVVFTTLQGMFSV

SEQ ID NO: 2591827 - protein, 17 aa, Entamoeba histolytica
SKLGFGWLLKAAQQGNV

SEQ ID NO: 2591828 - protein, 19 aa, Entamoeba histolytica
SKMPKWSIYPLAFIPGVVL

SEQ ID NO: 2591829 - protein, 24 aa, Entamoeba histolytica
SKQHKRLFNLHNIHLKGETGVDEK

SEQ ID NO: 2591830 - protein, 17 aa, Entamoeba histolytica
SKRISFDSVKSCSLLKD

SEQ ID NO: 2591831 - protein, 23 aa, Entamoeba histolytica
SKRPSLFLVIFKLEWKMFLLCYI

SEQ ID NO: 2591832 - protein, 23 aa, Entamoeba histolytica
SKSDIKGHIAWRRSIGKNGKKVT

SEQ ID NO: 2591833 - protein, 17 aa, Entamoeba histolytica
SLFKLGRIPADSLFDSI

SEQ ID NO: 2591834 - protein, 18 aa, Entamoeba histolytica
SLICCLCCVLIIVIFLAI

SEQ ID NO: 2591835 - protein, 17 aa, Entamoeba histolytica
SLIEWAKELELIDEKEI

SEQ ID NO: 2591836 - protein, 21 aa, Entamoeba histolytica
SLKKRITSLIQWYPKEMQCVE

SEQ ID NO: 2591837 - protein, 17 aa, Entamoeba histolytica
SLKRLYCQREQLPHCLN

SEQ ID NO: 2591838 - protein, 20 aa, Entamoeba histolytica
SLLKMWLHFIHFCGNVANIT

SEQ ID NO: 2591839 - protein, 23 aa, Entamoeba histolytica
SLNHCFPCTSLANQLCQKDNGTS

SEQ ID NO: 2591840 - protein, 23 aa, Entamoeba histolytica
SLPKLPGMWVYCWTITIVMWTSC

SEQ ID NO: 2591841 - protein, 17 aa, Entamoeba histolytica
SLPRFWIVLLYIICVPL

SEQ ID NO: 2591842 - protein, 22 aa, Entamoeba histolytica
SLSENWIRFTVYTSIIIQILIS

SEQ ID NO: 2591843 - protein, 17 aa, Entamoeba histolytica
SMFNVLPAFSFSGEKVK

SEQ ID NO: 2591844 - protein, 17 aa, Entamoeba histolytica
SMICCFDALIKCNAEYF

SEQ ID NO: 2591845 - protein, 17 aa, Entamoeba histolytica
SMLRCFYTLYVNCDIGE

SEQ ID NO: 2591846 - protein, 19 aa, Entamoeba histolytica
SMMIVCMFVTVSLSKNRVY

SEQ ID NO: 2591847 - protein, 18 aa, Entamoeba histolytica
SMVFRFISALVCFFTDIF

SEQ ID NO: 2591848 - protein, 20 aa, Entamoeba histolytica
SNCFSCILAAVTINMIIRIS

SEQ ID NO: 2591849 - protein, 18 aa, Entamoeba histolytica
SNCKCEYGYSYDKEKNAC

SEQ ID NO: 2591850 - protein, 18 aa, Entamoeba histolytica
SNCQWIFVVVITLISIIL

SEQ ID NO: 2591851 - protein, 22 aa, Entamoeba histolytica
SNDWKQRLAFLTALNAAINSKK

SEQ ID NO: 2591852 - protein, 20 aa, Entamoeba histolytica
SNIFCGWSCTYERGIDNFYN

SEQ ID NO: 2591853 - protein, 24 aa, Entamoeba histolytica
SNLWRYWCPWLMWFVSPFFKIFWK

SEQ ID NO: 2591854 - protein, 17 aa, Entamoeba histolytica
SNNELYFYNSLKMKMSI

SEQ ID NO: 2591855 - protein, 19 aa, Entamoeba histolytica
SPCIISFIGYCITKESICL

SEQ ID NO: 2591856 - protein, 19 aa, Entamoeba histolytica
SPHGIKYIIEFFKSNIGHP

SEQ ID NO: 2591857 - protein, 23 aa, Entamoeba histolytica
SPIKAALCALAYYYMALSWGAYV

SEQ ID NO: 2591858 - protein, 23 aa, Entamoeba histolytica
SPTRLCYWLSTILRLYAMIHLAR

SEQ ID NO: 2591859 - protein, 17 aa, Entamoeba histolytica
SPVFPFPIINYILPPVV

SEQ ID NO: 2591860 - protein, 21 aa, Entamoeba histolytica
SPYGICWCSQMSMANNCIIGS

SEQ ID NO: 2591861 - protein, 19 aa, Entamoeba histolytica
SQLGGIFSFDAWRYYFNVN

SEQ ID NO: 2591862 - protein, 23 aa, Entamoeba histolytica
SQVEPRLAVAVVLLFLYLGIFAG

SEQ ID NO: 2591863 - protein, 18 aa, Entamoeba histolytica
SRASTLLTFDIFGPPIVV

SEQ ID NO: 2591864 - protein, 23 aa, Entamoeba histolytica
SRDLLKHKWFITNGIKIEESKKP

SEQ ID NO: 2591865 - protein, 24 aa, Entamoeba histolytica
SRFIWDIFCLFAILIHLSCMRSRG

SEQ ID NO: 2591866 - protein, 17 aa, Entamoeba histolytica
SRIPLIIRKVLYLIIGF

SEQ ID NO: 2591867 - protein, 17 aa, Entamoeba histolytica
SRTGLRFSSRGGDINGN

SEQ ID NO: 2591868 - protein, 20 aa, Entamoeba histolytica
SRVFCKYAFPDNLARVLSRI

SEQ ID NO: 2591869 - protein, 21 aa, Entamoeba histolytica
SSAICAISFLVTRVQKLFTRY

SEQ ID NO: 2591870 - protein, 22 aa, Entamoeba histolytica
SSCDRNGWKWGTWNELEPTYES

SEQ ID NO: 2591871 - protein, 22 aa, Entamoeba histolytica
SSCGEAPCLTRCVSHLIPRVNR

SEQ ID NO: 2591872 - protein, 26 aa, Entamoeba histolytica
SSCIVRFLFNIAFQFKKKFYVDYQLR

SEQ ID NO: 2591873 - protein, 19 aa, Entamoeba histolytica
SSECILCYNGYQLQNKKCV

SEQ ID NO: 2591874 - protein, 20 aa, Entamoeba histolytica
SSFYSLVSWCMGTTEHLDYF

SEQ ID NO: 2591875 - protein, 20 aa, Entamoeba histolytica
SSICALVYHLIRPYPTSFLG

SEQ ID NO: 2591876 - protein, 23 aa, Entamoeba histolytica
SSICLVCGNGMWSYISSSGCYSC

SEQ ID NO: 2591877 - protein, 24 aa, Entamoeba histolytica
SSKKLKIILLVSVIIVLALILIIG

SEQ ID NO: 2591878 - protein, 22 aa, Entamoeba histolytica
SSKMVKCWIEFIESKAMNISET

SEQ ID NO: 2591879 - protein, 21 aa, Entamoeba histolytica
SSLAFRFSILLSFLYFMIFSV

SEQ ID NO: 2591880 - protein, 18 aa, Entamoeba histolytica
SSLLCFISIFSLFMKYHF

SEQ ID NO: 2591881 - protein, 17 aa, Entamoeba histolytica
SSMKLFKLDGIELQEIE

SEQ ID NO: 2591882 - protein, 17 aa, Entamoeba histolytica
SSTKLSFLIPSFMRKRS

SEQ ID NO: 2591883 - protein, 23 aa, Entamoeba histolytica
SSTSCSFCSFIINGQIKYDFYYI

SEQ ID NO: 2591884 - protein, 19 aa, Entamoeba histolytica
STICFAFGFALYYDWKLAL

SEQ ID NO: 2591885 - protein, 17 aa, Entamoeba histolytica
STIEFKSSLTYIIVNSA

SEQ ID NO: 2591886 - protein, 17 aa, Entamoeba histolytica
STKECIICQPGFVLLNG

SEQ ID NO: 2591887 - protein, 21 aa, Entamoeba histolytica
SVFEMFWRMAFILFSSFCCML

SEQ ID NO: 2591888 - protein, 19 aa, Entamoeba histolytica
SVFNWFWNRQSYIPNEPYS

SEQ ID NO: 2591889 - protein, 21 aa, Entamoeba histolytica
SVHLKLRFCQDISRGMLYLHE

SEQ ID NO: 2591890 - protein, 19 aa, Entamoeba histolytica
SVKTWKKRWFVLKDNRLWY

SEQ ID NO: 2591891 - protein, 24 aa, Entamoeba histolytica
SVSIKELYRYAGFIDYILLIGGII

SEQ ID NO: 2591892 - protein, 17 aa, Entamoeba histolytica
SWHPLRFSYDLIGLTDQ

SEQ ID NO: 2591893 - protein, 21 aa, Entamoeba histolytica
SWLHCLWVIFIGCSGILVLSF

SEQ ID NO: 2591894 - protein, 18 aa, Entamoeba histolytica
SYCERIKLSPVFFNVSYP

SEQ ID NO: 2591895 - protein, 17 aa, Entamoeba histolytica
SYCTSCFYGFCSSCEDG

SEQ ID NO: 2591896 - protein, 20 aa, Entamoeba histolytica
SYGYCPSGWSYFNHKCYENE

SEQ ID NO: 2591897 - protein, 18 aa, Entamoeba histolytica
SYNIWLLICTAIFGALII

SEQ ID NO: 2591898 - protein, 20 aa, Entamoeba histolytica
SYSVCCLILLLIFKKKTRTN

SEQ ID NO: 2591899 - protein, 24 aa, Entamoeba histolytica
TASFIIKIIWFRGIVRESSGLLMK

SEQ ID NO: 2591900 - protein, 23 aa, Entamoeba histolytica
TATSCIFGFLALFYPFTWPGIFI

SEQ ID NO: 2591901 - protein, 21 aa, Entamoeba histolytica
TCCLCPLFAGLIATQTDDRKW

SEQ ID NO: 2591902 - protein, 17 aa, Entamoeba histolytica
TCFFKKPPRAIHCRICN

SEQ ID NO: 2591903 - protein, 21 aa, Entamoeba histolytica
TCNTCKDGSCLNCIKNEVNFK

SEQ ID NO: 2591904 - protein, 17 aa, Entamoeba histolytica
TCPLLKFIVVGGLGTII

SEQ ID NO: 2591905 - protein, 19 aa, Entamoeba histolytica
TCRLSIILLWSILFVLSLL

SEQ ID NO: 2591906 - protein, 23 aa, Entamoeba histolytica
TCSEGKVKYCCRCFDFSYHRNHV

SEQ ID NO: 2591907 - protein, 18 aa, Entamoeba histolytica
TCTACAYGSYSKGETSVC

SEQ ID NO: 2591908 - protein, 17 aa, Entamoeba histolytica
TDYPSVFSIPSFFNNKQ

SEQ ID NO: 2591909 - protein, 19 aa, Entamoeba histolytica
TEECILCLDIICKKKLGFN

SEQ ID NO: 2591910 - protein, 17 aa, Entamoeba histolytica
TEFVFPIAIFFTIISGI

SEQ ID NO: 2591911 - protein, 21 aa, Entamoeba histolytica
TEVIRFTTLIGIHYFTKKFDE

SEQ ID NO: 2591912 - protein, 17 aa, Entamoeba histolytica
TEYYDWFLINIILHPQN

SEQ ID NO: 2591913 - protein, 17 aa, Entamoeba histolytica
TFGFVSFLFVFNEKTHE

SEQ ID NO: 2591914 - protein, 23 aa, Entamoeba histolytica
TFIFCIICVFIFGICFSIYHYFK

SEQ ID NO: 2591915 - protein, 19 aa, Entamoeba histolytica
TGDGFFFQWVMSIGILIVG

SEQ ID NO: 2591916 - protein, 19 aa, Entamoeba histolytica
TGDGFFYQWVMAIGVLLAG

SEQ ID NO: 2591917 - protein, 17 aa, Entamoeba histolytica
TGLLKWVSLGVMIIGFI

SEQ ID NO: 2591918 - protein, 17 aa, Entamoeba histolytica
THPEILTTLALDFKIAR

SEQ ID NO: 2591919 - protein, 26 aa, Entamoeba histolytica
THTFFWICFFLMQFCTVVLVLNLLKK

SEQ ID NO: 2591920 - protein, 20 aa, Entamoeba histolytica
TIEGIPLFVEHSFRFFELSS

SEQ ID NO: 2591921 - protein, 21 aa, Entamoeba histolytica
TIICLVSFIFCIKIFNTPLTP

SEQ ID NO: 2591922 - protein, 17 aa, Entamoeba histolytica
TIILGLICFITITFFLL

SEQ ID NO: 2591923 - protein, 19 aa, Entamoeba histolytica
TILSWRGSILYFKSIVVPD

SEQ ID NO: 2591924 - protein, 22 aa, Entamoeba histolytica
TIQRVIPILLHFGSLFKENLLV

SEQ ID NO: 2591925 - protein, 21 aa, Entamoeba histolytica
TKFLWKFKWIILTVVILCCIV

SEQ ID NO: 2591926 - protein, 21 aa, Entamoeba histolytica
TKKEGCIICRSCEDSENDPLG

SEQ ID NO: 2591927 - protein, 24 aa, Entamoeba histolytica
TKQKDCIRKGFKPITYHIINTENC

SEQ ID NO: 2591928 - protein, 20 aa, Entamoeba histolytica
TLILIGLIMMWWSSDYDDES

SEQ ID NO: 2591929 - protein, 20 aa, Entamoeba histolytica
TLISCLVCGGILIGLSVMSY

SEQ ID NO: 2591930 - protein, 17 aa, Entamoeba histolytica
TLLRLLISMGYNIVLKK

SEQ ID NO: 2591931 - protein, 17 aa, Entamoeba histolytica
TLSCVPSYCDYGYKFDR

SEQ ID NO: 2591932 - protein, 20 aa, Entamoeba histolytica
TLTGLSYKAGQYFFDTILMN

SEQ ID NO: 2591933 - protein, 17 aa, Entamoeba histolytica
TMCEWCVYYDFNSCKSC

SEQ ID NO: 2591934 - protein, 19 aa, Entamoeba histolytica
TMICFFCFGLNFLIYYNAV

SEQ ID NO: 2591935 - protein, 19 aa, Entamoeba histolytica
TMYECFKWGNAFASNIKPW

SEQ ID NO: 2591936 - protein, 24 aa, Entamoeba histolytica
TNFLKLRFCQDIARGMLYLHENDI

SEQ ID NO: 2591937 - protein, 24 aa, Entamoeba histolytica
TNIVKECLKHLGMAPEIYRYFKVI

SEQ ID NO: 2591938 - protein, 32 aa, Entamoeba histolytica
TNNCLLRAFFYWSGCYFLRLNLMKKAEFMFRQ

SEQ ID NO: 2591939 - protein, 21 aa, Entamoeba histolytica
TPCYWRSVLGFGYILLNFTME

SEQ ID NO: 2591940 - protein, 19 aa, Entamoeba histolytica
TPCYWRSVVGFGFVFMNYV

SEQ ID NO: 2591941 - protein, 19 aa, Entamoeba histolytica
TPHRVSVFNWFWNRQSYIP

SEQ ID NO: 2591942 - protein, 22 aa, Entamoeba histolytica
TQLRWSEMTSILGLSKTVMDLI

SEQ ID NO: 2591943 - protein, 18 aa, Entamoeba histolytica
TRFSWNHIETVDSAFECI

SEQ ID NO: 2591944 - protein, 17 aa, Entamoeba histolytica
TRIVPLYLAVHIFAESP

SEQ ID NO: 2591945 - protein, 17 aa, Entamoeba histolytica
TRREIFQAIGIFIGFVI

SEQ ID NO: 2591946 - protein, 17 aa, Entamoeba histolytica
TRSLPLYLSIFIFGESS

SEQ ID NO: 2591947 - protein, 18 aa, Entamoeba histolytica
TSCYFYWIVVPLLFNEQG

SEQ ID NO: 2591948 - protein, 17 aa, Entamoeba histolytica
TSLPLIFFFTLVFLSFT

SEQ ID NO: 2591949 - protein, 19 aa, Entamoeba histolytica
TSRCPGCFITFSSYFIDPF

SEQ ID NO: 2591950 - protein, 24 aa, Entamoeba histolytica
TSWKDGKAFCALVHHFKPELINFE

SEQ ID NO: 2591951 - protein, 17 aa, Entamoeba histolytica
TSWTHKFIRKWSNATTH

SEQ ID NO: 2591952 - protein, 23 aa, Entamoeba histolytica
TTHLKRLFLLWGFSLSILLMIYG

SEQ ID NO: 2591953 - protein, 17 aa, Entamoeba histolytica
TTIKMACFLFCFCFYSL

SEQ ID NO: 2591954 - protein, 19 aa, Entamoeba histolytica
TVCCFLLFFIIIAIIGVLL

SEQ ID NO: 2591955 - protein, 25 aa, Entamoeba histolytica
TVFEIYWRICLAFGNCVLLCLFFWF

SEQ ID NO: 2591956 - protein, 19 aa, Entamoeba histolytica
TVIGWKLCLPPLLSYFQIC

SEQ ID NO: 2591957 - protein, 23 aa, Entamoeba histolytica
TVPMCLYDFLIVHIFPLITPLIS

SEQ ID NO: 2591958 - protein, 21 aa, Entamoeba histolytica
TVVKRKKFEFILSKPKVQEMK

SEQ ID NO: 2591959 - protein, 21 aa, Entamoeba histolytica
TYCLLHFFLYIGMMFCNYNYF

SEQ ID NO: 2591960 - protein, 18 aa, Entamoeba histolytica
VACGQTPPFSAMMILWAN

SEQ ID NO: 2591961 - protein, 18 aa, Entamoeba histolytica
VAIPDILVYLGVTRETLS

SEQ ID NO: 2591962 - protein, 18 aa, Entamoeba histolytica
VARDWFLFLMSHDATLFI

SEQ ID NO: 2591963 - protein, 20 aa, Entamoeba histolytica
VCDITEPFVPLAPKNFFKPI

SEQ ID NO: 2591964 - protein, 18 aa, Entamoeba histolytica
VCIWPFCTGFFWPVTTGT

SEQ ID NO: 2591965 - protein, 20 aa, Entamoeba histolytica
VCLFCREFHFHLTLALWDNF

SEQ ID NO: 2591966 - protein, 20 aa, Entamoeba histolytica
VCLNFPFIIPKSVKFLNRIS

SEQ ID NO: 2591967 - protein, 23 aa, Entamoeba histolytica
VCPCQSLTGYECELEFTGSTNPI

SEQ ID NO: 2591968 - protein, 18 aa, Entamoeba histolytica
VCQMLNWTSFSFDEYMEG

SEQ ID NO: 2591969 - protein, 17 aa, Entamoeba histolytica
VCRVVLLLLSYVIKEEY

SEQ ID NO: 2591970 - protein, 21 aa, Entamoeba histolytica
VCYFPRLLMTVPYFIIMIGTE

SEQ ID NO: 2591971 - protein, 22 aa, Entamoeba histolytica
VDALKLKGYRIIENSNIIAQYL

SEQ ID NO: 2591972 - protein, 23 aa, Entamoeba histolytica
VEELKIHIGFRFKFLRNKDTLNI

SEQ ID NO: 2591973 - protein, 19 aa, Entamoeba histolytica
VELKLRFCHDIASGMDYLH

SEQ ID NO: 2591974 - protein, 22 aa, Entamoeba histolytica
VELRLLKIVLNWLIPEVFNECL

SEQ ID NO: 2591975 - protein, 17 aa, Entamoeba histolytica
VEPCKKSNCSISLDVEE

SEQ ID NO: 2591976 - protein, 18 aa, Entamoeba histolytica
VFCGYRLSEVITCPPDVL

SEQ ID NO: 2591977 - protein, 17 aa, Entamoeba histolytica
VFFKIGFLIVFFITFYY

SEQ ID NO: 2591978 - protein, 23 aa, Entamoeba histolytica
VFGFRGSYEFSDWVYDFKLFTES

SEQ ID NO: 2591979 - protein, 19 aa, Entamoeba histolytica
VFLPCVWAFVVGLTRFYDH

SEQ ID NO: 2591980 - protein, 18 aa, Entamoeba histolytica
VFLQLKLLWPSFNIINTT

SEQ ID NO: 2591981 - protein, 18 aa, Entamoeba histolytica
VFPFCYFIYYLFSITNDA

SEQ ID NO: 2591982 - protein, 24 aa, Entamoeba histolytica
VFSFAICMLEIWLGKEPYDPMKFP

SEQ ID NO: 2591983 - protein, 24 aa, Entamoeba histolytica
VFSFAICMLEIWLTHDPYPIIEFH

SEQ ID NO: 2591984 - protein, 17 aa, Entamoeba histolytica
VFVSVCFLYILQNVVEL

SEQ ID NO: 2591985 - protein, 17 aa, Entamoeba histolytica
VFYKFGTKFVMKRLFLN

SEQ ID NO: 2591986 - protein, 17 aa, Entamoeba histolytica
VGCCLPLLFGCIVAISR

SEQ ID NO: 2591987 - protein, 22 aa, Entamoeba histolytica
VGELTCCLCPLFAGLIATQTDD

SEQ ID NO: 2591988 - protein, 25 aa, Entamoeba histolytica
VGELTCCLCPLFAGLIATQTDDRKW

SEQ ID NO: 2591989 - protein, 18 aa, Entamoeba histolytica
VGGVKIFFDKYLTSTGSG

SEQ ID NO: 2591990 - protein, 17 aa, Entamoeba histolytica
VGSLKYWIESCLFDNKF

SEQ ID NO: 2591991 - protein, 25 aa, Entamoeba histolytica
VHCKWCNNKMCFVCADDYLLSTDGI

SEQ ID NO: 2591992 - protein, 19 aa, Entamoeba histolytica
VICTCSYYLIIVVVLVLIA

SEQ ID NO: 2591993 - protein, 18 aa, Entamoeba histolytica
VIFKLEWKMFLLCYITMV

SEQ ID NO: 2591994 - protein, 21 aa, Entamoeba histolytica
VILWKALCIFFFTEAPIVVIL

SEQ ID NO: 2591995 - protein, 18 aa, Entamoeba histolytica
VIQRKCRLWNGNIIEYLP

SEQ ID NO: 2591996 - protein, 21 aa, Entamoeba histolytica
VIRGDVFFQFGFEEFNKTLAF

SEQ ID NO: 2591997 - protein, 17 aa, Entamoeba histolytica
VITQCWDHIPSKRPAFK

SEQ ID NO: 2591998 - protein, 21 aa, Entamoeba histolytica
VKGWLKPSCSVTIWTINVDLQ

SEQ ID NO: 2591999 - protein, 23 aa, Entamoeba histolytica
VKKNKCWKCSFWYGTNEEGNECN

SEQ ID NO: 2592000 - protein, 22 aa, Entamoeba histolytica
VKNNKCWKCSFWYGTNEEGNEC

SEQ ID NO: 2592001 - protein, 18 aa, Entamoeba histolytica
VKVWRYIRETNKVVVQYI

SEQ ID NO: 2592002 - protein, 19 aa, Entamoeba histolytica
VLAKICLGETFSIFETFIN

SEQ ID NO: 2592003 - protein, 24 aa, Entamoeba histolytica
VLKPHRRLAIALAIEYLKKMNCCI

SEQ ID NO: 2592004 - protein, 23 aa, Entamoeba histolytica
VLLCLFFWFLRLYSVFNWALEQH

SEQ ID NO: 2592005 - protein, 17 aa, Entamoeba histolytica
VLLCLFISFLIMKFTKM

SEQ ID NO: 2592006 - protein, 19 aa, Entamoeba histolytica
VLLLLSISCSIGYTCLDVM

SEQ ID NO: 2592007 - protein, 17 aa, Entamoeba histolytica
VLPAFSFSGEKVKVVMT

SEQ ID NO: 2592008 - protein, 18 aa, Entamoeba histolytica
VLPMFRWRMYYIDDKNTA

SEQ ID NO: 2592009 - protein, 24 aa, Entamoeba histolytica
VLREENRWFIPIAIVGVILIVSIV

SEQ ID NO: 2592010 - protein, 24 aa, Entamoeba histolytica
VLSRICFLCGLFGGIKSNQLDNIK

SEQ ID NO: 2592011 - protein, 18 aa, Entamoeba histolytica
VLYEIWKWDKAYPVEEFK

SEQ ID NO: 2592012 - protein, 18 aa, Entamoeba histolytica
VMVAIGLLFHLHFLSLQR

SEQ ID NO: 2592013 - protein, 26 aa, Entamoeba histolytica
VMWYDCYYCFSKYRFIWDSISLKNLF

SEQ ID NO: 2592014 - protein, 23 aa, Entamoeba histolytica
VNNCSILLLKVCKLLDSSINPTI

SEQ ID NO: 2592015 - protein, 17 aa, Entamoeba histolytica
VPLESGVTFLANVSNCY

SEQ ID NO: 2592016 - protein, 23 aa, Entamoeba histolytica
VPLYRPLTVILFFLITGIIFIPI

SEQ ID NO: 2592017 - protein, 19 aa, Entamoeba histolytica
VPSYCDYGYKFDRTSQTCI

SEQ ID NO: 2592018 - protein, 22 aa, Entamoeba histolytica
VPYPLLWCRYSFFIVLYPMGVS

SEQ ID NO: 2592019 - protein, 24 aa, Entamoeba histolytica
VQIRFRYAYELEYWDKLLDELCEL

SEQ ID NO: 2592020 - protein, 22 aa, Entamoeba histolytica
VRLSKCPFCLIMGLFLFVSLEE

SEQ ID NO: 2592021 - protein, 19 aa, Entamoeba histolytica
VRSCWKLNVFEGYEGIVSL

SEQ ID NO: 2592022 - protein, 19 aa, Entamoeba histolytica
VRYLLKRAFEINSNETNKI

SEQ ID NO: 2592023 - protein, 23 aa, Entamoeba histolytica
VSFALSCIACWIVFIFQPTFKPT

SEQ ID NO: 2592024 - protein, 20 aa, Entamoeba histolytica
VSIRQPIEWEIEKSDSRWKV

SEQ ID NO: 2592025 - protein, 17 aa, Entamoeba histolytica
VSLKELWVSSKVEKILL

SEQ ID NO: 2592026 - protein, 18 aa, Entamoeba histolytica
VTIDYFWTFCVFAGIFLG

SEQ ID NO: 2592027 - protein, 17 aa, Entamoeba histolytica
VTLKIKQIRAFKKHIRK

SEQ ID NO: 2592028 - protein, 18 aa, Entamoeba histolytica
VVASLILSFSMLFKQDNR

SEQ ID NO: 2592029 - protein, 25 aa, Entamoeba histolytica
VVCCIIAGLLFRFKPLIYLTRFVPF

SEQ ID NO: 2592030 - protein, 18 aa, Entamoeba histolytica
VVCCSIILCLKKVLINKD

SEQ ID NO: 2592031 - protein, 17 aa, Entamoeba histolytica
VVKRIALISEEWNSENG

SEQ ID NO: 2592032 - protein, 17 aa, Entamoeba histolytica
VVLARFIVRQMRKLMII

SEQ ID NO: 2592033 - protein, 18 aa, Entamoeba histolytica
VVMVFRFFLCKGRLIVLR

SEQ ID NO: 2592034 - protein, 24 aa, Entamoeba histolytica
VVSLPEIVRYLGLNMEDILPDLIG

SEQ ID NO: 2592035 - protein, 18 aa, Entamoeba histolytica
VYCPFKYITTHEMKDDSF

SEQ ID NO: 2592036 - protein, 18 aa, Entamoeba histolytica
VYEIRTILDWTFAKTSMF

SEQ ID NO: 2592037 - protein, 18 aa, Entamoeba histolytica
VYMLFNWLWLLGTLIYLN

SEQ ID NO: 2592038 - protein, 24 aa, Entamoeba histolytica
VYSFAICMLEIWLGQDPYDSTEFP

SEQ ID NO: 2592039 - protein, 25 aa, Entamoeba histolytica
VYSFAICMLEIWLGRDPYDPAKFPD

SEQ ID NO: 2592040 - protein, 25 aa, Entamoeba histolytica
VYSFAICMLEIWLGRDPYNPMKFPD

SEQ ID NO: 2592041 - protein, 17 aa, Entamoeba histolytica
VYSFAICMLEIWNNGSL

SEQ ID NO: 2592042 - protein, 20 aa, Entamoeba histolytica
VYYCFWRYFRFEIVRIINFY

SEQ ID NO: 2592043 - protein, 19 aa, Entamoeba histolytica
WAKECYHISFGMVMGMSTR

SEQ ID NO: 2592044 - protein, 21 aa, Entamoeba histolytica
WECDKCSVGFMYQCGAVSTFI

SEQ ID NO: 2592045 - protein, 20 aa, Entamoeba histolytica
WFFKSVICRFKLYPWYLKPK

SEQ ID NO: 2592046 - protein, 22 aa, Entamoeba histolytica
WFYPCGKFGILLGIFLPTLILA

SEQ ID NO: 2592047 - protein, 17 aa, Entamoeba histolytica
WGPTLAFVSAANTFVTS

SEQ ID NO: 2592048 - protein, 18 aa, Entamoeba histolytica
WGVVKVLGFISLGVGVGV

SEQ ID NO: 2592049 - protein, 17 aa, Entamoeba histolytica
WIFEVKWTFVLLIILVI

SEQ ID NO: 2592050 - protein, 17 aa, Entamoeba histolytica
WILRATGLLAYFVFFLL

SEQ ID NO: 2592051 - protein, 19 aa, Entamoeba histolytica
WKLNVFEGYEGIVSLQVLK

SEQ ID NO: 2592052 - protein, 17 aa, Entamoeba histolytica
WKYLCPFVSFSMKQKNI

SEQ ID NO: 2592053 - protein, 19 aa, Entamoeba histolytica
WLEILPFQFCVFIFTLGDY

SEQ ID NO: 2592054 - protein, 20 aa, Entamoeba histolytica
WLRIIEEIWLILVGFVRSSF

SEQ ID NO: 2592055 - protein, 24 aa, Entamoeba histolytica
WMIRPYSKYVICWFGLDTLQLLNF

SEQ ID NO: 2592056 - protein, 17 aa, Entamoeba histolytica
WNKYCGKLDTKFESDGD

SEQ ID NO: 2592057 - protein, 19 aa, Entamoeba histolytica
WNLFKCSFILLKFSLFAIP

SEQ ID NO: 2592058 - protein, 23 aa, Entamoeba histolytica
WPSCSNPFLYCCAANVSSDNAVH

SEQ ID NO: 2592059 - protein, 24 aa, Entamoeba histolytica
WPTAIRFVPLFACASVFLNNTPIV

SEQ ID NO: 2592060 - protein, 19 aa, Entamoeba histolytica
WQFWWKLVVIILLTSIPFI

SEQ ID NO: 2592061 - protein, 19 aa, Entamoeba histolytica
WQYACCLTIVFAGRYIPFL

SEQ ID NO: 2592062 - protein, 17 aa, Entamoeba histolytica
WRGSILYFKSIVVPDSF

SEQ ID NO: 2592063 - protein, 17 aa, Entamoeba histolytica
WRIDLTLKLLSVISLDR

SEQ ID NO: 2592064 - protein, 18 aa, Entamoeba histolytica
WRLQIMLWYAGLRGAIAV

SEQ ID NO: 2592065 - protein, 20 aa, Entamoeba histolytica
WRLVLLFPLALLFGFSRSFY

SEQ ID NO: 2592066 - protein, 17 aa, Entamoeba histolytica
WRMIPVIIPMFLAGIIV

SEQ ID NO: 2592067 - protein, 17 aa, Entamoeba histolytica
WRSSMIIGTIFKQGNTY

SEQ ID NO: 2592068 - protein, 17 aa, Entamoeba histolytica
WRYPRIEMFFKFLCCTE

SEQ ID NO: 2592069 - protein, 19 aa, Entamoeba histolytica
WSDRCTFKYGRRRIFIGIG

SEQ ID NO: 2592070 - protein, 18 aa, Entamoeba histolytica
WSIFEGIVFLLWIISLLL

SEQ ID NO: 2592071 - protein, 21 aa, Entamoeba histolytica
WTYRRSVILLGFIVTVILYLV

SEQ ID NO: 2592072 - protein, 24 aa, Entamoeba histolytica
WVMISEFFLVLSIVFLVIVVIVII

SEQ ID NO: 2592073 - protein, 18 aa, Entamoeba histolytica
WVVFSCVTQVLKHLQSIM

SEQ ID NO: 2592074 - protein, 24 aa, Entamoeba histolytica
WWFIYAVVCVATFTVLKLFIKTDD

SEQ ID NO: 2592075 - protein, 25 aa, Entamoeba histolytica
WWFVYALVCVMAFGALKYFGSNDDF

SEQ ID NO: 2592076 - protein, 20 aa, Entamoeba histolytica
WWIVDHWYCFGSLQQCLLKT

SEQ ID NO: 2592077 - protein, 19 aa, Entamoeba histolytica
WYVVLCSFVGWYLAFLSPL

SEQ ID NO: 2592078 - protein, 18 aa, Entamoeba histolytica
WYYHLVILIAGVVGVMLI

SEQ ID NO: 2592079 - protein, 17 aa, Entamoeba histolytica
YANLFLRFIRRLLTSRG

SEQ ID NO: 2592080 - protein, 23 aa, Entamoeba histolytica
YEEAARLFVLISIRIPDLYESIL

SEQ ID NO: 2592081 - protein, 23 aa, Entamoeba histolytica
YEFSESITTFFLFIGIHFFFLSG

SEQ ID NO: 2592082 - protein, 18 aa, Entamoeba histolytica
YEIAWRFGGNSLRTFTKV

SEQ ID NO: 2592083 - protein, 17 aa, Entamoeba histolytica
YEIRTILDWCLSKTSMF

SEQ ID NO: 2592084 - protein, 17 aa, Entamoeba histolytica
YETFGWREAYPVNTFKF

SEQ ID NO: 2592085 - protein, 19 aa, Entamoeba histolytica
YFFKGRLWFTLEFISFIGM

SEQ ID NO: 2592086 - protein, 24 aa, Entamoeba histolytica
YFIKEGYKLISNVLLDIALYNEGT

SEQ ID NO: 2592087 - protein, 18 aa, Entamoeba histolytica
YFILRPLFHSVLPFSLPK

SEQ ID NO: 2592088 - protein, 21 aa, Entamoeba histolytica
YFIRLCQLLSFHGPKVAPTMS

SEQ ID NO: 2592089 - protein, 19 aa, Entamoeba histolytica
YFRRLCVHPMLVLDDQHPM

SEQ ID NO: 2592090 - protein, 19 aa, Entamoeba histolytica
YFYCSFCTSLLKKRKCESD

SEQ ID NO: 2592091 - protein, 21 aa, Entamoeba histolytica
YFYLFPAFCLPWFVKQKKNIP

SEQ ID NO: 2592092 - protein, 18 aa, Entamoeba histolytica
YGFQRVEPLLGFINGFFL

SEQ ID NO: 2592093 - protein, 17 aa, Entamoeba histolytica
YGQCLELTGSTKIPVRC

SEQ ID NO: 2592094 - protein, 18 aa, Entamoeba histolytica
YHAYFRFLSRYAAENPNL

SEQ ID NO: 2592095 - protein, 26 aa, Entamoeba histolytica
YIIKKSMKFLIFMIIFVVSKGLEPIE

SEQ ID NO: 2592096 - protein, 17 aa, Entamoeba histolytica
YILRFIAPMPFYLVTGS

SEQ ID NO: 2592097 - protein, 17 aa, Entamoeba histolytica
YIYRKGEKWYLPDTDNV

SEQ ID NO: 2592098 - protein, 17 aa, Entamoeba histolytica
YKFGTKFVMKRLFLNWE

SEQ ID NO: 2592099 - protein, 17 aa, Entamoeba histolytica
YKFIGRVVAKTVYDGEF

SEQ ID NO: 2592100 - protein, 18 aa, Entamoeba histolytica
YKILRIAAQYHREIVSHY

SEQ ID NO: 2592101 - protein, 21 aa, Entamoeba histolytica
YKINNCWFCLSNSKSELKLII

SEQ ID NO: 2592102 - protein, 17 aa, Entamoeba histolytica
YKKWSRKHAKSFTIDGQ

SEQ ID NO: 2592103 - protein, 23 aa, Entamoeba histolytica
YKLKLKIMRDVECGLHYLHESKL

SEQ ID NO: 2592104 - protein, 21 aa, Entamoeba histolytica
YKQHFEVIKTIVLLPHQLSEM

SEQ ID NO: 2592105 - protein, 20 aa, Entamoeba histolytica
YKSIFKWGLILALVNAITNL

SEQ ID NO: 2592106 - protein, 17 aa, Entamoeba histolytica
YLAVVICGFVFVDQECA

SEQ ID NO: 2592107 - protein, 17 aa, Entamoeba histolytica
YLCAASFNALIQKVEKS

SEQ ID NO: 2592108 - protein, 22 aa, Entamoeba histolytica
YLECFKPICLCLRAMSECFKCN

SEQ ID NO: 2592109 - protein, 20 aa, Entamoeba histolytica
YLFKRLNQFFGQKLNFENIG

SEQ ID NO: 2592110 - protein, 19 aa, Entamoeba histolytica
YLISGCYLGCEYCMKKTIK

SEQ ID NO: 2592111 - protein, 21 aa, Entamoeba histolytica
YLKIKFCLDAAKAIEYLHSNG

SEQ ID NO: 2592112 - protein, 27 aa, Entamoeba histolytica
YLKQYWPEILWRWYVKKGMYEEAIKCI

SEQ ID NO: 2592113 - protein, 19 aa, Entamoeba histolytica
YLMDEFKSVLYYKGETSQR

SEQ ID NO: 2592114 - protein, 17 aa, Entamoeba histolytica
YLNCMLEHLSLIFTQRS

SEQ ID NO: 2592115 - protein, 17 aa, Entamoeba histolytica
YLSIFSIAVYLSTIIIR

SEQ ID NO: 2592116 - protein, 23 aa, Entamoeba histolytica
YMFRWLTLLCCMEFTLFETFMYW

SEQ ID NO: 2592117 - protein, 17 aa, Entamoeba histolytica
YNICIINSIPFPQFLPS

SEQ ID NO: 2592118 - protein, 19 aa, Entamoeba histolytica
YNLFSITVVYSWKTPDNSE

SEQ ID NO: 2592119 - protein, 18 aa, Entamoeba histolytica
YNLGCLFFFIARKEHPFG

SEQ ID NO: 2592120 - protein, 17 aa, Entamoeba histolytica
YNPSIIISYYIKQSIGG

SEQ ID NO: 2592121 - protein, 17 aa, Entamoeba histolytica
YNPWFCFFIPGLVVIVV

SEQ ID NO: 2592122 - protein, 19 aa, Entamoeba histolytica
YNVIFGMFKDFVEKVVTST

SEQ ID NO: 2592123 - protein, 23 aa, Entamoeba histolytica
YPFCWRSDTPLIYRAIPSWFVNV

SEQ ID NO: 2592124 - protein, 17 aa, Entamoeba histolytica
YPILQWILRSCVLIAYF

SEQ ID NO: 2592125 - protein, 17 aa, Entamoeba histolytica
YPSPFRIAYELPIKLPY

SEQ ID NO: 2592126 - protein, 19 aa, Entamoeba histolytica
YPWSISKFVCIGRRLPQHP

SEQ ID NO: 2592127 - protein, 17 aa, Entamoeba histolytica
YPYCFLHHYGLKKWSMI

SEQ ID NO: 2592128 - protein, 20 aa, Entamoeba histolytica
YPYWRCGLTFTNEEKQNIVN

SEQ ID NO: 2592129 - protein, 24 aa, Entamoeba histolytica
YQITTLIKFCFYKNAAFFLMDIWF

SEQ ID NO: 2592130 - protein, 19 aa, Entamoeba histolytica
YRCQSCFKVIVGDRESIDH

SEQ ID NO: 2592131 - protein, 19 aa, Entamoeba histolytica
YRFGKWFKINLNQVTNAVF

SEQ ID NO: 2592132 - protein, 22 aa, Entamoeba histolytica
YRKNRMRFGALYIDSLEQINDQ

SEQ ID NO: 2592133 - protein, 28 aa, Entamoeba histolytica
YRKRAHLYNEKWRKTNVNGHWSGKQFDN

SEQ ID NO: 2592134 - protein, 20 aa, Entamoeba histolytica
YRLKIRMLFDTARGMQFLHE

SEQ ID NO: 2592135 - protein, 17 aa, Entamoeba histolytica
YRYTEHWVLDNSKPTFS

SEQ ID NO: 2592136 - protein, 20 aa, Entamoeba histolytica
YSAAEPLTWGKGMKKDFFKC

SEQ ID NO: 2592137 - protein, 23 aa, Entamoeba histolytica
YSDCGWRCGFIPQRTGKILPIEY

SEQ ID NO: 2592138 - protein, 19 aa, Entamoeba histolytica
YSMEILHVVSWMYCNICRM

SEQ ID NO: 2592139 - protein, 25 aa, Entamoeba histolytica
YSNSLVDRWLCLRVDCIGAFVMFGS

SEQ ID NO: 2592140 - protein, 20 aa, Entamoeba histolytica
YSSYCIYFFNNFAYGMPGIE

SEQ ID NO: 2592141 - protein, 19 aa, Entamoeba histolytica
YSVLLKWFNTTSICGFYRV

SEQ ID NO: 2592142 - protein, 18 aa, Entamoeba histolytica
YTPFIIPMILEFVLFLSF

SEQ ID NO: 2592143 - protein, 19 aa, Entamoeba histolytica
YTQELLRWNRLIVEVCLNN

SEQ ID NO: 2592144 - protein, 20 aa, Entamoeba histolytica
YTSDLKLRWKQQIYSSLAQP

SEQ ID NO: 2592145 - protein, 20 aa, Entamoeba histolytica
YTSNLAFDFVYLLPFTINID

SEQ ID NO: 2592146 - protein, 17 aa, Entamoeba histolytica
YVFASSLFVFWKIIITS

SEQ ID NO: 2592147 - protein, 18 aa, Entamoeba histolytica
YVIEKGVVTKYTFKSNSD

SEQ ID NO: 2592148 - protein, 18 aa, Entamoeba histolytica
YVKLPYRLKIRMLFDTAR

SEQ ID NO: 2592149 - protein, 17 aa, Entamoeba histolytica
YWLAPEVILNNHFTEAS

SEQ ID NO: 2592150 - protein, 17 aa, Entamoeba histolytica
YWLPRIIFFVFFFAAVE

SEQ ID NO: 2592151 - protein, 17 aa, Entamoeba histolytica
YYAPEKMKLVCEQTFVF

SEQ ID NO: 2592152 - protein, 20 aa, Entamoeba histolytica
YYFVWEFGELLSILMGFGYS

SEQ ID NO: 2592153 - protein, 17 aa, Entamoeba histolytica
YYIKYYIDSNCDKEEEP

SEQ ID NO: 2592154 - protein, 23 aa, Entamoeba histolytica
YYLEKDANCSFGLIQEDKTKENN

SEQ ID NO: 2592155 - protein, 18 aa, Entamoeba histolytica
YYRCMKLIVGWLLFSVIL

SEQ ID NO: 2592156 - protein, 25 aa, Entamoeba histolytica
ATKTEAYDVCRMDFIGGRSITFRSF

SEQ ID NO: 2592157 - protein, 32 aa, Entamoeba histolytica; identical to SEQ ID NO: 2397240

SEQ ID NO: 2592158 - protein, 22 aa, Entamoeba histolytica
GTTYLCKFVQLTDDPSLDSEHF

SEQ ID NO: 2592159 - protein, 17 aa, Entamoeba histolytica
LLLCCLADKLNEFSADI

SEQ ID NO: 2592160 - protein, 24 aa, Entamoeba histolytica
AAVDNPLFFYSNTRMFLSDCKKGF

SEQ ID NO: 2592161 - protein, 29 aa, Entamoeba histolytica
DGYGECDGHKFLWVRSSWGNDWGVENGHF

SEQ ID NO: 2592162 - protein, 26 aa, Entamoeba histolytica
DKFRDEYIIHFYGAVFIPNKICMVTE

SEQ ID NO: 2592163 - protein, 19 aa, Entamoeba histolytica
EMMNPLFSMIVVLVTIFLC

SEQ ID NO: 2592164 - protein, 31 aa, Entamoeba histolytica; identical to SEQ ID NO: 2395155

SEQ ID NO: 2592165 - protein, 26 aa, Entamoeba histolytica
ESVPLLPHIWMEVYGYNLGISVGETY

SEQ ID NO: 2592166 - protein, 18 aa, Entamoeba histolytica
EVLNTTGIQVYDFLCQYL

SEQ ID NO: 2592167 - protein, 18 aa, Entamoeba histolytica
IFNKIEVLNTTGIQVYDF

SEQ ID NO: 2592168 - protein, 18 aa, Entamoeba histolytica
IIGGNFRHVLNAGLVIFG

SEQ ID NO: 2592169 - protein, 18 aa, Entamoeba histolytica
KITQSNIKFIPLGDGILT

SEQ ID NO: 2592170 - protein, 26 aa, Entamoeba histolytica
KSENKVGYFGVFYYKDENCTEELGFG

SEQ ID NO: 2592171 - protein, 27 aa, Entamoeba histolytica
LDKFRDEYIIQFYGAVFIPNKICMVTE

SEQ ID NO: 2592172 - protein, 21 aa, Entamoeba histolytica
NDDGTTSMFIILCATIILLFF

SEQ ID NO: 2592173 - protein, 26 aa, Entamoeba histolytica
QRRAEKLHHFFPIQKIWNENKVIILD

SEQ ID NO: 2592174 - protein, 18 aa, Entamoeba histolytica
SFAICMLEIWLGRDPYDP

SEQ ID NO: 2592175 - protein, 23 aa, Entamoeba histolytica
SLEIDYPLKFATSNKFTHFANKN

SEQ ID NO: 2592176 - protein, 23 aa, Entamoeba histolytica
YSIYSQWIEKILSPYDDVNYIVS

SEQ ID NO: 2592177 - protein, 17 aa, Entamoeba histolytica
ACLVCEYGYYPNGSGCS

SEQ ID NO: 2592178 - protein, 28 aa, Entamoeba histolytica
ACPNGIDAVWLWVNGSDPVFRKALEENG

SEQ ID NO: 2592179 - protein, 20 aa, Entamoeba histolytica
AFLTSSIIIIFLLYAKVINN

SEQ ID NO: 2592180 - protein, 22 aa, Entamoeba histolytica
AGKSYLQPFLELNPPKHEEEID

SEQ ID NO: 2592181 - protein, 26 aa, Entamoeba histolytica
AGNIKLLGINVFNELILEGSIIKSDN

SEQ ID NO: 2592182 - protein, 24 aa, Entamoeba histolytica
ALPQIHYLLHRPAIPSYRYPDVDP

SEQ ID NO: 2592183 - protein, 19 aa, Entamoeba histolytica
AMFMSYEFDKCYYTDEFES

SEQ ID NO: 2592184 - protein, 20 aa, Entamoeba histolytica
CFNLIRNNDIERITLIGSSG

SEQ ID NO: 2592185 - protein, 21 aa, Entamoeba histolytica
CGQYFIYRLITLANSLLLVAV

SEQ ID NO: 2592186 - protein, 18 aa, Entamoeba histolytica
CGTVSTMILFVVFAIFAL

SEQ ID NO: 2592187 - protein, 27 aa, Entamoeba histolytica
CQQRRSKWTSIIPIINSFPLGDWYSKP

SEQ ID NO: 2592188 - protein, 18 aa, Entamoeba histolytica
CSKKSLFCLQCAENFYFV

SEQ ID NO: 2592189 - protein, 20 aa, Entamoeba histolytica
DAEYALFRQLLPETDIVITT

SEQ ID NO: 2592190 - protein, 18 aa, Entamoeba histolytica
DGSIATIVAFIAIALFFV

SEQ ID NO: 2592191 - protein, 42 aa, Entamoeba histolytica
DGTSGGVYVFLLLLFICSSSNYCVSFFFFSFHILLYLLFICL

SEQ ID NO: 2592192 - protein, 29 aa, Entamoeba histolytica
DNFKSIYNFYLPCQAYVTATYHYSSLFNL

SEQ ID NO: 2592193 - protein, 22 aa, Entamoeba histolytica
DNLDAASSPFIVLFAIIVVILF

SEQ ID NO: 2592194 - protein, 23 aa, Entamoeba histolytica
DQRYSLDVSKLEKLGWRATTSFE

SEQ ID NO: 2592195 - protein, 27 aa, Entamoeba histolytica
DSEIMKYFYIFLGISGAMFISTYLHKA

SEQ ID NO: 2592196 - protein, 43 aa, Entamoeba histolytica
ECNKEVVWWMIMIIVIIIVIIIIITIVMIIMMVNYIMKRKEKK

SEQ ID NO: 2592197 - protein, 22 aa, Entamoeba histolytica
ESKDIIKILLEKELNKLRVRVA

SEQ ID NO: 2592198 - protein, 26 aa, Entamoeba histolytica
ESTYRKNFRNNWKKSIKGEEPVTITY

SEQ ID NO: 2592199 - protein, 24 aa, Entamoeba histolytica
ETIPLRTFRLTQVDRFLTGAYPFY

SEQ ID NO: 2592200 - protein, 24 aa, Entamoeba histolytica
ETVRLPCFCVFHKDCLISLFDQSI

SEQ ID NO: 2592201 - protein, 24 aa, Entamoeba histolytica
EYIVGGVCINKKIYVQTQFGVGEH

SEQ ID NO: 2592202 - protein, 30 aa, Entamoeba histolytica
FFDTCESNMKYLIAGSLFQQFEYNENTCDN

SEQ ID NO: 2592203 - protein, 17 aa, Entamoeba histolytica
FFDWSVVLVTFIIMIIV

SEQ ID NO: 2592204 - protein, 18 aa, Entamoeba histolytica
FIVFVDIMLLLTVVMAAI

SEQ ID NO: 2592205 - protein, 17 aa, Entamoeba histolytica
FNIIREFGKKYSTLKYP

SEQ ID NO: 2592206 - protein, 19 aa, Entamoeba histolytica
FNQPWMIPQFVIEGNRLEK

SEQ ID NO: 2592207 - protein, 32 aa, Entamoeba histolytica
FSLVSLITTTVLLLIGIIVYVISKRNKNNKNK

SEQ ID NO: 2592208 - protein, 27 aa, Entamoeba histolytica
FTIGSETYLLTFNPIESTETIYTKTSD

SEQ ID NO: 2592209 - protein, 25 aa, Entamoeba histolytica
FTVNITLDQLKYDTLVKYTAGTGQV

SEQ ID NO: 2592210 - protein, 25 aa, Entamoeba histolytica
FVKEWKLCFVMISVAPFMVGAAGIF

SEQ ID NO: 2592211 - protein, 35 aa, Entamoeba histolytica
FYAFIHLPIVWIMPIPLTLFILMSVSYYKAVTTKP

SEQ ID NO: 2592212 - protein, 18 aa, Entamoeba histolytica
GIAFADNVILCMDETSDK

SEQ ID NO: 2592213 - protein, 23 aa, Entamoeba histolytica
GIGLAFCLLAFGLPMPYLRANYI

SEQ ID NO: 2592214 - protein, 33 aa, Entamoeba histolytica
GKIIGFGCIILLVIFMLFMPEMFVTAFMSFVLA

SEQ ID NO: 2592215 - protein, 26 aa, Entamoeba histolytica
GKKTDKEILPFLLINKIQIYGEDPIY

SEQ ID NO: 2592216 - protein, 31 aa, Entamoeba histolytica
GLVIFGCLLCIPYIIFEYLTLNDSTLISNLE

SEQ ID NO: 2592217 - protein, 23 aa, Entamoeba histolytica
GMCYQCPIGCSLCSGPDSCITCE

SEQ ID NO: 2592218 - protein, 17 aa, Entamoeba histolytica
HLSTIYAYLTKQVDNNK

SEQ ID NO: 2592219 - protein, 17 aa, Entamoeba histolytica
IAILVAVFAVSLIGAWN

SEQ ID NO: 2592220 - protein, 24 aa, Entamoeba histolytica
IENDKKMYLIPRYSFKFSVVNPPD

SEQ ID NO: 2592221 - protein, 18 aa, Entamoeba histolytica
IGNLIYHSIIDNLKFHQS

SEQ ID NO: 2592222 - protein, 26 aa, Entamoeba histolytica
IIESLHFLMDILFLLGINFNTYITNG

SEQ ID NO: 2592223 - protein, 18 aa, Entamoeba histolytica
IIFGINAYFFVMFYGFVP

SEQ ID NO: 2592224 - protein, 19 aa, Entamoeba histolytica
IIVSLCFILALRGLSTQIS

SEQ ID NO: 2592225 - protein, 21 aa, Entamoeba histolytica
IKFDPLLFYDYLLNFSKSNNY

SEQ ID NO: 2592226 - protein, 25 aa, Entamoeba histolytica
IKNLSSCFLYLNDDMLLGKKLDIRH

SEQ ID NO: 2592227 - protein, 28 aa, Entamoeba histolytica
ILDNFRHEWFLSTFGFIGGIGGGAIFPF

SEQ ID NO: 2592228 - protein, 20 aa, Entamoeba histolytica
ILNCIDLFDSNNYPIQVIFP

SEQ ID NO: 2592229 - protein, 25 aa, Entamoeba histolytica
ILSQWIIIPTIIFIGPAFSVVYTAS

SEQ ID NO: 2592230 - protein, 18 aa, Entamoeba histolytica
INDLKYYLESYVFKDILK

SEQ ID NO: 2592231 - protein, 29 aa, Entamoeba histolytica
INENSELTLFYYFLPFSINIENDKKMYLI

SEQ ID NO: 2592232 - protein, 24 aa, Entamoeba histolytica
IPVTPYFVMILSIGLIAVVIVGHI

SEQ ID NO: 2592233 - protein, 17 aa, Entamoeba histolytica
IRCPYIVNFIGSVVTAD

SEQ ID NO: 2592234 - protein, 18 aa, Entamoeba histolytica
ITKLQIFAIFIVFGTLFI

SEQ ID NO: 2592235 - protein, 20 aa, Entamoeba histolytica
IYHITLFIVFVDIMLLLTVV

SEQ ID NO: 2592236 - protein, 29 aa, Entamoeba histolytica
KATRVKIIVLILLILILGAIIVLVLKVAL

SEQ ID NO: 2592237 - protein, 19 aa, Entamoeba histolytica
KIRDMKIPYTVWFSKSKST

SEQ ID NO: 2592238 - protein, 20 aa, Entamoeba histolytica
KLPTGCYCTYSLISKQECIF

SEQ ID NO: 2592239 - protein, 21 aa, Entamoeba histolytica
KYCNYEVDNGWMYLNKYPNDK

SEQ ID NO: 2592240 - protein, 19 aa, Entamoeba histolytica
LCKGLIVILTIILCLPSLQ

SEQ ID NO: 2592241 - protein, 27 aa, Entamoeba histolytica
LDKFRNEYIIQFYGAVFIPNKICMVTE

SEQ ID NO: 2592242 - protein, 24 aa, Entamoeba histolytica
LFGIFYAIFIFKMFRRYAKKHNLN

SEQ ID NO: 2592243 - protein, 19 aa, Entamoeba histolytica
LGDSTSIMFIGIALIITIF

SEQ ID NO: 2592244 - protein, 18 aa, Entamoeba histolytica
LKTDKWELTFNLAKSKAI

SEQ ID NO: 2592245 - protein, 18 aa, Entamoeba histolytica
LKTVKGVTLYYLKDDTYF

SEQ ID NO: 2592246 - protein, 27 aa, Entamoeba histolytica
LLMPTKSLLIFIIFSVLVVVSVCMVCT

SEQ ID NO: 2592247 - protein, 25 aa, Entamoeba histolytica
LLNHFIPIPLIFNSILKFFGVRDHN

SEQ ID NO: 2592248 - protein, 26 aa, Entamoeba histolytica
LNNHRYFMQFLYYLPINGFTGMIIQI

SEQ ID NO: 2592249 - protein, 17 aa, Entamoeba histolytica
LSICIHAKAYDCIPSGD

SEQ ID NO: 2592250 - protein, 17 aa, Entamoeba histolytica
LSYIMCKAMNRSFMSVI

SEQ ID NO: 2592251 - protein, 27 aa, Entamoeba histolytica
LTIIFTLVIVIILGYSIFICFKIRHPT

SEQ ID NO: 2592252 - protein, 25 aa, Entamoeba histolytica
MRQGQTLISFFYPAKNSKLLDLSVQ

SEQ ID NO: 2592253 - protein, 26 aa, Entamoeba histolytica
MVAEMFFGIPLFVANSELGLLRKQIK

SEQ ID NO: 2592254 - protein, 17 aa, Entamoeba histolytica
NCIDLFDSNNYPIQVIF

SEQ ID NO: 2592255 - protein, 17 aa, Entamoeba histolytica
NDLKYYLESYVFKDILK

SEQ ID NO: 2592256 - protein, 42 aa, Entamoeba histolytica
NEQNTISILFLEHPFVSIILLTVTLILIGLIMMWWSSDYDDE

SEQ ID NO: 2592257 - protein, 28 aa, Entamoeba histolytica
NETDCALLLFLKKIAMSPSLIRSTNTIS

SEQ ID NO: 2592258 - protein, 26 aa, Entamoeba histolytica
NIEHMLNELLGLYNHITFLVSTQEEM

SEQ ID NO: 2592259 - protein, 33 aa, Entamoeba histolytica
NKTSLKFMYIGIGLFFTSLIRTIIFDITGGNQI

SEQ ID NO: 2592260 - protein, 22 aa, Entamoeba histolytica
NNLDGASPVFMLLAFVIQLIFF

SEQ ID NO: 2592261 - protein, 33 aa, Entamoeba histolytica
NVIPDIEQELKDVGLYDLFSKKESIHENDIENE

SEQ ID NO: 2592262 - protein, 25 aa, Entamoeba histolytica
PKRALQLMLILLFFGMGCLVLTGMK

SEQ ID NO: 2592263 - protein, 25 aa, Entamoeba histolytica
PKSPSLLRTLFRMEWGHFLICFIAI

SEQ ID NO: 2592264 - protein, 24 aa, Entamoeba histolytica
PSFGTYYKKPVVQLILKEVDMSDN

SEQ ID NO: 2592265 - protein, 21 aa, Entamoeba histolytica
PSIQVFPKMKLMKHPRKPTEI

SEQ ID NO: 2592266 - protein, 26 aa, Entamoeba histolytica
PSLNQPQLIIWNSNWIHLYKPTTTST

SEQ ID NO: 2592267 - protein, 25 aa, Entamoeba histolytica
PTGSILIILNFILKVLYALPQIHYL

SEQ ID NO: 2592268 - protein, 19 aa, Entamoeba histolytica
PVDVYAYGIVLYETYVEHN

SEQ ID NO: 2592269 - protein, 18 aa, Entamoeba histolytica
QFEKACSTFVFAILEEIP

SEQ ID NO: 2592270 - protein, 20 aa, Entamoeba histolytica
QILECLVVCKQACIIHCDIK

SEQ ID NO: 2592271 - protein, 25 aa, Entamoeba histolytica
QNNCKYVKMILGHISLLFSPENRCC

SEQ ID NO: 2592272 - protein, 22 aa, Entamoeba histolytica
QPSIQVFPKMKLMKHPRKPTEI

SEQ ID NO: 2592273 - protein, 26 aa, Entamoeba histolytica
QQRRSKWTSIIPIINSFPLGDWYSNP

SEQ ID NO: 2592274 - protein, 17 aa, Entamoeba histolytica
QWIEKILSPYDDVNYIV

SEQ ID NO: 2592275 - protein, 18 aa, Entamoeba histolytica
QWIEKILSPYDDVNYIVS

SEQ ID NO: 2592276 - protein, 29 aa, Entamoeba histolytica
REGIRVRRLYFKSLLRQDATWYDFQESGE

SEQ ID NO: 2592277 - protein, 27 aa, Entamoeba histolytica
RIAQIPVFILLIIAFFFMCLVKNHHKE

SEQ ID NO: 2592278 - protein, 25 aa, Entamoeba histolytica
RISNNIKIMIQIMSKIFPSHDFLKH

SEQ ID NO: 2592279 - protein, 33 aa, Entamoeba histolytica
RNIQMYSNKHKRLYNVYNVHLKGEAIHEVSDIR

SEQ ID NO: 2592280 - protein, 25 aa, Entamoeba histolytica
SCDDKMKYVILNNTVIKYEYSSGEE

SEQ ID NO: 2592281 - protein, 25 aa, Entamoeba histolytica
SENKVGYFGTFYYKDENCTEELGFG

SEQ ID NO: 2592282 - protein, 27 aa, Entamoeba histolytica
SFNDLSQYPIFPWILNDYTSKTIDLND

SEQ ID NO: 2592283 - protein, 17 aa, Entamoeba histolytica
SFVFSESTSNTHTILCM

SEQ ID NO: 2592284 - protein, 31 aa, Entamoeba histolytica
SGKRMVITEIDADLYRLVEPTQVIISAVPIT

SEQ ID NO: 2592285 - protein, 19 aa, Entamoeba histolytica
SIRSVYNFAPYIKNYYIVT

SEQ ID NO: 2592286 - protein, 22 aa, Entamoeba histolytica
SIYSQWIEKILSPYDDVNYIVS

SEQ ID NO: 2592287 - protein, 17 aa, Entamoeba histolytica
SNKRLMRFCPNGIDLDK

SEQ ID NO: 2592288 - protein, 18 aa, Entamoeba histolytica
SNKRLMRFCPNGIKLNKT

SEQ ID NO: 2592289 - protein, 25 aa, Entamoeba histolytica
SNRGLIIKSLLIILFFALVFLVFFL

SEQ ID NO: 2592290 - protein, 21 aa, Entamoeba histolytica
SNVGLLWIPASIWQMLRGSMT

SEQ ID NO: 2592291 - protein, 25 aa, Entamoeba histolytica
SSLSQDIPALLLDGLNNHITFTGNN

SEQ ID NO: 2592292 - protein, 25 aa, Entamoeba histolytica
STNVWNVILWYFFEISYHFYNCIVN

SEQ ID NO: 2592293 - protein, 36 aa, Entamoeba histolytica
SWYHSYTHQYDVFYYLAMQPWRHFVWTTCDKNDNTE

SEQ ID NO: 2592294 - protein, 18 aa, Entamoeba histolytica
SYLPLTKEYLNTPISITW

SEQ ID NO: 2592295 - protein, 20 aa, Entamoeba histolytica
TDAIITIKPINNNSANLNIG

SEQ ID NO: 2592296 - protein, 20 aa, Entamoeba histolytica
TDSLLRYVGGIYKSESCTGK

SEQ ID NO: 2592297 - protein, 18 aa, Entamoeba histolytica
TEELGFGAQMYKCGMCVP

SEQ ID NO: 2592298 - protein, 18 aa, Entamoeba histolytica
TEELGFGSQMYKCGMCVP

SEQ ID NO: 2592299 - protein, 22 aa, Entamoeba histolytica
TFDSFLDLLMPTKSLLIFIIFS

SEQ ID NO: 2592300 - protein, 18 aa, Entamoeba histolytica
TICYKCENGLTLNGTHCY

SEQ ID NO: 2592301 - protein, 37 aa, Entamoeba histolytica
TNKKKVCMIIFLVLGICFPPFLVFSLVYMRKYRTSQK

SEQ ID NO: 2592302 - protein, 30 aa, Entamoeba histolytica; identical to SEQ ID NO: 2395266

SEQ ID NO: 2592303 - protein, 23 aa, Entamoeba histolytica
TVPSYIQLLYSTLTPRLLLSPVM

SEQ ID NO: 2592304 - protein, 21 aa, Entamoeba histolytica
TYIDILTDDVDFTDAIITIKP

SEQ ID NO: 2592305 - protein, 34 aa, Entamoeba histolytica; identical to SEQ ID NO: 2402639

SEQ ID NO: 2592306 - protein, 30 aa, Entamoeba histolytica
VIGVASFLSFFMYIGLFLSAGFKMIGRVRK

SEQ ID NO: 2592307 - protein, 32 aa, Entamoeba histolytica
VIPDIEQELKDVGLYDLFSKKESIHENDIENE

SEQ ID NO: 2592308 - protein, 24 aa, Entamoeba histolytica
VPVLPHIWMEVYGYNLGISVGETY

SEQ ID NO: 2592309 - protein, 25 aa, Entamoeba histolytica
VTATYHYSSLFNLTSYKLHLPQSEE

SEQ ID NO: 2592310 - protein, 19 aa, Entamoeba histolytica
VVLVTFIIMIIVLAYFIVR

SEQ ID NO: 2592311 - protein, 26 aa, Entamoeba histolytica
VVVALIVVSIGLFKTYQLVSSAMKNA

SEQ ID NO: 2592312 - protein, 28 aa, Entamoeba histolytica
VVVALIVVSIGLFKTYQLVSSAMKNAIT

SEQ ID NO: 2592313 - protein, 26 aa, Entamoeba histolytica
VYFGVISMVLSFLRTFSLFVVSQREG

SEQ ID NO: 2592314 - protein, 27 aa, Entamoeba histolytica
VYFGVISMVLSFLRTFSLFVVSQREGI

SEQ ID NO: 2592315 - protein, 17 aa, Entamoeba histolytica
YCYSGCSLVTKGLKEWG

SEQ ID NO: 2592316 - protein, 23 aa, Entamoeba histolytica
YDNLDAASSPFIVLFAIIVVILF

SEQ ID NO: 2592317 - protein, 24 aa, Entamoeba histolytica
YEETILNCIDLFDSNNYPIQVIFP

SEQ ID NO: 2592318 - protein, 17 aa, Entamoeba histolytica
YHSIIDNLKFHQSVSLN

SEQ ID NO: 2592319 - protein, 26 aa, Entamoeba histolytica
YSFSITMLQIITWQDPFPKSEFKFPW

SEQ ID NO: 2592320 - protein, 31 aa, Entamoeba histolytica
YTCFLIAGIFYYHFWLLCILFCIARTSFELV

SEQ ID NO: 2592321 - protein, 18 aa, Entamoeba histolytica
YYNERYYEYLFNESTLVL

SEQ ID NO: 2592322 - protein, 24 aa, Entamoeba histolytica
IWMKIFCIIVLSIGLDLFVKQKLL

SEQ ID NO: 2592323 - protein, 26 aa, Entamoeba histolytica
EEVFIIQVLILYVLKIQKCLISVQVS

SEQ ID NO: 2592324 - protein, 16 aa, Entamoeba histolytica
IKGIFIVDVLMVFMSV

SEQ ID NO: 2592325 - protein, 22 aa, Entamoeba histolytica
KVIWNILLVQKLVRKDEVVVMK

SEQ ID NO: 2592326 - protein, 22 aa, Entamoeba histolytica
AAAVYVLIGFFLIVASIVFTKD

SEQ ID NO: 2592327 - protein, 26 aa, Entamoeba histolytica
AACTALFLLVLIFLLFFSGIISEETT

SEQ ID NO: 2592328 - protein, 30 aa, Entamoeba histolytica; identical to SEQ ID NO: 2395287

SEQ ID NO: 2592329 - protein, 17 aa, Entamoeba histolytica
AAGMLIIVIVSNVVIGF

SEQ ID NO: 2592330 - protein, 31 aa, Entamoeba histolytica
AAHFEQYIIPFPYSLFIPKSYKEIAAFCSKY

SEQ ID NO: 2592331 - protein, 30 aa, Entamoeba histolytica; identical to SEQ ID NO: 2395289

SEQ ID NO: 2592332 - protein, 23 aa, Entamoeba histolytica
AAIDLCRLVFPLSRDKNPRVRNQ

SEQ ID NO: 2592333 - protein, 21 aa, Entamoeba histolytica
AAIFVAFYIFTVKPVIEMQRL

SEQ ID NO: 2592334 - protein, 21 aa, Entamoeba histolytica
AALISFCVFISFLNNTLYSSQ

SEQ ID NO: 2592335 - protein, 17 aa, Entamoeba histolytica
AAQMLVIDPLAFRSWDD

SEQ ID NO: 2592336 - protein, 28 aa, Entamoeba histolytica
AARLPFSYYYFVSFLEDLLLIFEYNSDQ

SEQ ID NO: 2592337 - protein, 22 aa, Entamoeba histolytica
AASGMFYLHSLTPPIIHLDLKS

SEQ ID NO: 2592338 - protein, 25 aa, Entamoeba histolytica
AASSKKLFFLNNKNLEIFDITKATP

SEQ ID NO: 2592339 - protein, 17 aa, Entamoeba histolytica
AAVFIIAAAVTYPMDIA

SEQ ID NO: 2592340 - protein, 17 aa, Entamoeba histolytica
AAWYFFYKRIPYEEKYL

SEQ ID NO: 2592341 - protein, 17 aa, Entamoeba histolytica
ACDIYVKAGLHPHHILA

SEQ ID NO: 2592342 - protein, 24 aa, Entamoeba histolytica
ACEFELFIIIKCTTKINDKIMIIS

SEQ ID NO: 2592343 - protein, 19 aa, Entamoeba histolytica
ACEFELFITIKCTTKIKDK

SEQ ID NO: 2592344 - protein, 27 aa, Entamoeba histolytica
ACFRDDIIFLIYLYQRWIYPVDKNRMD

SEQ ID NO: 2592345 - protein, 35 aa, Entamoeba histolytica
ACLITKFIFKLVFQILFLFSAICLFVFVSGLIPYT

SEQ ID NO: 2592346 - protein, 53 aa, Entamoeba histolytica
ACLRHIPARFIVGIIVLVIVLLISVLLGVYLLSKWLLKYLKVRDIEKQLNIFS

SEQ ID NO: 2592347 - protein, 20 aa, Entamoeba histolytica
ACPAFYWGLLWLTEQKQFGI

SEQ ID NO: 2592348 - protein, 33 aa, Entamoeba histolytica
ACQFQLLFFINVILIGIFILFIISTGHLILDST

SEQ ID NO: 2592349 - protein, 33 aa, Entamoeba histolytica
ACQFQLLFFINVILIGIFILFIISTGHLVCTST

SEQ ID NO: 2592350 - protein, 25 aa, Entamoeba histolytica
ACSQLPILRFILSSNIYTMNVGYVR

SEQ ID NO: 2592351 - protein, 20 aa, Entamoeba histolytica
ACVDGFYFDEIKGTCIPCTS

SEQ ID NO: 2592352 - protein, 25 aa, Entamoeba histolytica
ADCNFHYPPFLYTLKKNETSVELQI

SEQ ID NO: 2592353 - protein, 22 aa, Entamoeba histolytica
ADEIILICNAGLLTALVAVVPL

SEQ ID NO: 2592354 - protein, 21 aa, Entamoeba histolytica
ADFINICIRLFESDRIGIEQT

SEQ ID NO: 2592355 - protein, 35 aa, Entamoeba histolytica
ADGTHYFVITMIGIIVFIINYTILRVLVTLDNKYY

SEQ ID NO: 2592356 - protein, 25 aa, Entamoeba histolytica
ADILNEFNLLILKSGSKQTAHYYSH

SEQ ID NO: 2592357 - protein, 18 aa, Entamoeba histolytica
ADIWCFTPGIFPLIRSGA

SEQ ID NO: 2592358 - protein, 31 aa, Entamoeba histolytica
ADKLYEEYQRKFFPYRKAHKRVRGWVNNAPR

SEQ ID NO: 2592359 - protein, 20 aa, Entamoeba histolytica
ADNVYFYKDGALEQGFGIVN

SEQ ID NO: 2592360 - protein, 24 aa, Entamoeba histolytica
ADSQLLIFPSGYTVLIDLGENRDD

SEQ ID NO: 2592361 - protein, 21 aa, Entamoeba histolytica
ADYALPRLFVGVQIPVILSAL

SEQ ID NO: 2592362 - protein, 22 aa, Entamoeba histolytica
ADYLQYLLTLYFMFIGAVGINE

SEQ ID NO: 2592363 - protein, 24 aa, Entamoeba histolytica
ADYSIPEFRFLVKLILVHGRYCYR

SEQ ID NO: 2592364 - protein, 32 aa, Entamoeba histolytica
AEFVPFSVKFFALAYFRFPSFRIKLTQYYTNL

SEQ ID NO: 2592365 - protein, 24 aa, Entamoeba histolytica
AELIPILYLMLLIPLVIARFLVYR

SEQ ID NO: 2592366 - protein, 24 aa, Entamoeba histolytica
AELKQLDFGYWFTDGKRYPYRGKG

SEQ ID NO: 2592367 - protein, 24 aa, Entamoeba histolytica
AELKYDMAVFTYKTIFDLEDVSQF

SEQ ID NO: 2592368 - protein, 30 aa, Entamoeba histolytica
AENILTPRLIIHLQPSIPIYVFIHSPYGKT

SEQ ID NO: 2592369 - protein, 25 aa, Entamoeba histolytica
AEYIDSIYCINLPGLSKSVGLNHIN

SEQ ID NO: 2592370 - protein, 18 aa, Entamoeba histolytica
AFCPIDRTALIFSYTRRP

SEQ ID NO: 2592371 - protein, 21 aa, Entamoeba histolytica
AFCSFLKIILHLSLLILVFGP

SEQ ID NO: 2592372 - protein, 17 aa, Entamoeba histolytica
AFFFVFFDFVISIKQFF

SEQ ID NO: 2592373 - protein, 19 aa, Entamoeba histolytica
AFFIANFCAFLLIVITVFV

SEQ ID NO: 2592374 - protein, 17 aa, Entamoeba histolytica
AFFIIIEAIQRFIDIEE

SEQ ID NO: 2592375 - protein, 31 aa, Entamoeba histolytica
AFGNCVLLCLFFWFLRLYSVFNWALEQHLTA

SEQ ID NO: 2592376 - protein, 23 aa, Entamoeba histolytica
AFIKMMINEYINISIFTCSFNTY

SEQ ID NO: 2592377 - protein, 28 aa, Entamoeba histolytica
AFITLGLFNIMRLPLIRFPKLLNDTMQG

SEQ ID NO: 2592378 - protein, 37 aa, Entamoeba histolytica
AFKASDNTYYCPLKDLYLPYYFSVTKGSDNKITIGCV

SEQ ID NO: 2592379 - protein, 36 aa, Entamoeba histolytica
AFKASDNTYYCPLKDLYLPYYFSVTKGTSDNTITIG

SEQ ID NO: 2592380 - protein, 26 aa, Entamoeba histolytica
AFLHTLRLHWIEFQNKFYIGDGIPFI

SEQ ID NO: 2592381 - protein, 19 aa, Entamoeba histolytica
AFMNWFDPDSWYPLGRNIG

SEQ ID NO: 2592382 - protein, 25 aa, Entamoeba histolytica
AFMSMSLLHFMHLKGKYYYKDNDKT

SEQ ID NO: 2592383 - protein, 33 aa, Entamoeba histolytica
AFNILCLLFGVFFFVLVSIYELIKYFIFNIKNV

SEQ ID NO: 2592384 - protein, 36 aa, Entamoeba histolytica
AFNLCSLPRFWIVLLYIICVPLVKPTFLRCLEDIKK

SEQ ID NO: 2592385 - protein, 39 aa, Entamoeba histolytica
AFSGIIFCILSIVLALFPLNPIIQKWYLPIPQAINSIVT

SEQ ID NO: 2592386 - protein, 21 aa, Entamoeba histolytica
AFTLISTILMTIQKIPVVWAR

SEQ ID NO: 2592387 - protein, 23 aa, Entamoeba histolytica
AFVFLSIFFFVFYRFLKGTLTGT

SEQ ID NO: 2592388 - protein, 23 aa, Entamoeba histolytica
AFVYQHLMIPKPIFGSQLLNCQV

SEQ ID NO: 2592389 - protein, 29 aa, Entamoeba histolytica
AGAAFPFYSLNFVDLIRVLMKLHPGINLT

SEQ ID NO: 2592390 - protein, 30 aa, Entamoeba histolytica; identical to SEQ ID NO: 2395353

SEQ ID NO: 2592391 - protein, 25 aa, Entamoeba histolytica
AGCILSYCFILLLNRYTKLCVYTFS

SEQ ID NO: 2592392 - protein, 23 aa, Entamoeba histolytica
AGEWTEFKILLTDLGITNNEFWG

SEQ ID NO: 2592393 - protein, 20 aa, Entamoeba histolytica
AGFGIEVTFKIKMLCTAIVN

SEQ ID NO: 2592394 - protein, 20 aa, Entamoeba histolytica
AGGFVFMMSVLASIGKQIGK

SEQ ID NO: 2592395 - protein, 43 aa, Entamoeba histolytica
AGIILGCVIGVVLLLIIIAIIIVFCIWFFKKPVEDKPQTYRLD

SEQ ID NO: 2592396 - protein, 27 aa, Entamoeba histolytica
AGLLFLSLFLYFYFKKSNIHLNSLSSV

SEQ ID NO: 2592397 - protein, 51 aa, Entamoeba histolytica
AGLLFRFKPLIYLTRFVPFTFIRKYRKMPLSYLLLFIGILLYIHCGYIVIG

SEQ ID NO: 2592398 - protein, 22 aa, Entamoeba histolytica
AGVVDDLIYVNRSPWNCLDPEL

SEQ ID NO: 2592399 - protein, 28 aa, Entamoeba histolytica
AGVVGVMLIIICIVLLFIFTRKRKNDFE

SEQ ID NO: 2592400 - protein, 25 aa, Entamoeba histolytica
AHAVKSILLIFTIADHHILQQYDDW

SEQ ID NO: 2592401 - protein, 27 aa, Entamoeba histolytica
AHDGRPKFDIILLNNLGLMTSVSNNGA

SEQ ID NO: 2592402 - protein, 18 aa, Entamoeba histolytica
AHFYYFLRHVIPVHYPTL

SEQ ID NO: 2592403 - protein, 25 aa, Entamoeba histolytica
AHIASFFEIIKHCLIILTKDTIASR

SEQ ID NO: 2592404 - protein, 18 aa, Entamoeba histolytica
AHIFELTIEFCNLVYGGC

SEQ ID NO: 2592405 - protein, 24 aa, Entamoeba histolytica
AHTSFILHILLFVITPFALVFIEG

SEQ ID NO: 2592406 - protein, 18 aa, Entamoeba histolytica
AHYYSHSSLFFKPSTEEL

SEQ ID NO: 2592407 - protein, 18 aa, Entamoeba histolytica
AIALAKDSVIMSADRDSN

SEQ ID NO: 2592408 - protein, 18 aa, Entamoeba histolytica
AIALFDYELPWETIKLYP

SEQ ID NO: 2592409 - protein, 24 aa, Entamoeba histolytica
AIDIFFKVIQTWPGLLTLTSNKGI

SEQ ID NO: 2592410 - protein, 20 aa, Entamoeba histolytica
AIFIDFILQITVYAVLLCYD

SEQ ID NO: 2592411 - protein, 25 aa, Entamoeba histolytica
AIGGFIIFRFIFKSEVPWIQRLGGC

SEQ ID NO: 2592412 - protein, 30 aa, Entamoeba histolytica
AIGTTVGMFLMHFCFFVLSERQGIKIRMLY

SEQ ID NO: 2592413 - protein, 18 aa, Entamoeba histolytica
AIHEIPTEVFQKLIKPIC

SEQ ID NO: 2592414 - protein, 18 aa, Entamoeba histolytica
AIHFIGSFKFGSFTLGSS

SEQ ID NO: 2592415 - protein, 20 aa, Entamoeba histolytica
AIHPKLFPTPLILPTTPNSI

SEQ ID NO: 2592416 - protein, 21 aa, Entamoeba histolytica
AIIVLLVLSILLVHSLLTINI

SEQ ID NO: 2592417 - protein, 32 aa, Entamoeba histolytica
AIKMIRLDIIFILLALMFGWFAFQPFNTNFTN

SEQ ID NO: 2592418 - protein, 29 aa, Entamoeba histolytica
AIKNMNYPTYYPFFNLYAMSYNGNYYGRP

SEQ ID NO: 2592419 - protein, 22 aa, Entamoeba histolytica
AILFTLLAIVLFIQSVLLMNHS

SEQ ID NO: 2592420 - protein, 20 aa, Entamoeba histolytica
AILIPMFFSSIVYPLVIILT

SEQ ID NO: 2592421 - protein, 19 aa, Entamoeba histolytica
AILLATPKKVFLFIESEHI

SEQ ID NO: 2592422 - protein, 26 aa, Entamoeba histolytica
AILSIIILLLMFQFIDPLKTKWYVTF

SEQ ID NO: 2592423 - protein, 25 aa, Entamoeba histolytica
AILVYVLFFIFMDGYFVISFSICLL

SEQ ID NO: 2592424 - protein, 21 aa, Entamoeba histolytica
AINILTLFRNITANVAIETDY

SEQ ID NO: 2592425 - protein, 21 aa, Entamoeba histolytica
AINLLRIYIPEDYVILIISML

SEQ ID NO: 2592426 - protein, 17 aa, Entamoeba histolytica
AIQLSYLIGLVNQFCTI

SEQ ID NO: 2592427 - protein, 25 aa, Entamoeba histolytica
AIQPKWYIIGLLSPLFFSLPHPKKL

SEQ ID NO: 2592428 - protein, 25 aa, Entamoeba histolytica
AIQVSIIYIILIMKVVDKKDKKEDI

SEQ ID NO: 2592429 - protein, 25 aa, Entamoeba histolytica
AIRLCSLMFYHYFSCSQECSLEYPV

SEQ ID NO: 2592430 - protein, 25 aa, Entamoeba histolytica
AIRRFKHLTKLILFYGRNGKYQITT

SEQ ID NO: 2592431 - protein, 21 aa, Entamoeba histolytica
AISIKPILVSNYTLLSSAKDQ

SEQ ID NO: 2592432 - protein, 26 aa, Entamoeba histolytica
AISLESMFFARLLGIRVFLTEHSLFG

SEQ ID NO: 2592433 - protein, 18 aa, Entamoeba histolytica
AISWRRIVKKYTTHNAIF

SEQ ID NO: 2592434 - protein, 19 aa, Entamoeba histolytica
AITNLLTFSINAYGYYLGI

SEQ ID NO: 2592435 - protein, 19 aa, Entamoeba histolytica
AIVIPWMIYYYAKIVHNDN

SEQ ID NO: 2592436 - protein, 17 aa, Entamoeba histolytica
AIVLLFIVYIIGQIFQL

SEQ ID NO: 2592437 - protein, 24 aa, Entamoeba histolytica
AIVMEFIMYRVGGSIGFMSSTHLK

SEQ ID NO: 2592438 - protein, 17 aa, Entamoeba histolytica
AIYGSFIVNLCLCIVKI

SEQ ID NO: 2592439 - protein, 23 aa, Entamoeba histolytica
AIYLFLFILVIIQFVHTLYMSHK

SEQ ID NO: 2592440 - protein, 27 aa, Entamoeba histolytica
AKERLKYVWIIFALIIKSMVGYYEDKK

SEQ ID NO: 2592441 - protein, 25 aa, Entamoeba histolytica
AKKALVTMQFLPIESLIFSNEDSIS

SEQ ID NO: 2592442 - protein, 26 aa, Entamoeba histolytica
AKLYFPYNGFIIMTLILGALASVMCV

SEQ ID NO: 2592443 - protein, 24 aa, Entamoeba histolytica
AKNYKYLTFALNWEDQFCNLRITI

SEQ ID NO: 2592444 - protein, 25 aa, Entamoeba histolytica
AKTDAGLWYLLKRSSDIVNEKYTIL

SEQ ID NO: 2592445 - protein, 19 aa, Entamoeba histolytica
ALAFFWSICEYLLSNEIYQ

SEQ ID NO: 2592446 - protein, 20 aa, Entamoeba histolytica
ALCNNFFLNSLWTFPQNVDV

SEQ ID NO: 2592447 - protein, 41 aa, Entamoeba histolytica
ALDLGIKRIYIPTFLIYPIQRLPRYLLLLETLSKNVPENYE

SEQ ID NO: 2592448 - protein, 26 aa, Entamoeba histolytica
ALDNPLPWKFFPTPSFMIFPFATVIS

SEQ ID NO: 2592449 - protein, 22 aa, Entamoeba histolytica
ALESPMCKFALFFGNRITEEVE

SEQ ID NO: 2592450 - protein, 32 aa, Entamoeba histolytica
ALFCLCFYWAGLFFVICFWIMFVITIAVIIVL

SEQ ID NO: 2592451 - protein, 21 aa, Entamoeba histolytica
ALFLIITNKYYRTFNGFLELI

SEQ ID NO: 2592452 - protein, 21 aa, Entamoeba histolytica
ALFLTDLLRIYRRCVILEAID

SEQ ID NO: 2592453 - protein, 18 aa, Entamoeba histolytica
ALFPVFVDSFHDFVQYWV

SEQ ID NO: 2592454 - protein, 19 aa, Entamoeba histolytica
ALGEVCQMLNWTSFSFDEY

SEQ ID NO: 2592455 - protein, 18 aa, Entamoeba histolytica
ALGFLCCCVWCYGWCQYR

SEQ ID NO: 2592456 - protein, 20 aa, Entamoeba histolytica
ALICMAYILLFVNWDLFNFI

SEQ ID NO: 2592457 - protein, 29 aa, Entamoeba histolytica
ALIDGLLLFFFYLGILIFTIINNCWRFGK

SEQ ID NO: 2592458 - protein, 24 aa, Entamoeba histolytica
ALIIAHFNSGFPLPTHLIPKDGTQ

SEQ ID NO: 2592459 - protein, 26 aa, Entamoeba histolytica
ALILLISILFYYIFAKSLNSQDDLKI

SEQ ID NO: 2592460 - protein, 20 aa, Entamoeba histolytica
ALINAPYIYGKWFKLNMNFS

SEQ ID NO: 2592461 - protein, 18 aa, Entamoeba histolytica
ALINGVFLLSVAFFIIIE

SEQ ID NO: 2592462 - protein, 32 aa, Entamoeba histolytica
ALITLVDYYRYNPLLWYRLACSCIQYHYNYIK

SEQ ID NO: 2592463 - protein, 17 aa, Entamoeba histolytica
ALIYIIFANGILSRHKE

SEQ ID NO: 2592464 - protein, 26 aa, Entamoeba histolytica
ALKFNVPIDTSFKLGYYLPYSITSKR

SEQ ID NO: 2592465 - protein, 22 aa, Entamoeba histolytica
ALKYHVIIQWKSGILVYLEVSN

SEQ ID NO: 2592466 - protein, 24 aa, Entamoeba histolytica
ALLPLCVIVYFLPVKVVNGYIPQI

SEQ ID NO: 2592467 - protein, 24 aa, Entamoeba histolytica
ALLQTVCFLIYASLAPFGGKLADK

SEQ ID NO: 2592468 - protein, 18 aa, Entamoeba histolytica
ALLVIYFLLRIALIVLAC

SEQ ID NO: 2592469 - protein, 33 aa, Entamoeba histolytica
ALNGNFPFIWGFFMLCSLSYWVSFQMAPNGQWD

SEQ ID NO: 2592470 - protein, 27 aa, Entamoeba histolytica
ALQIFLGIYICVMLFVWGGSQNIKASF

SEQ ID NO: 2592471 - protein, 28 aa, Entamoeba histolytica
ALQLYLGVYVSLMLLLWGCSQTLNTSFL

SEQ ID NO: 2592472 - protein, 24 aa, Entamoeba histolytica
ALSCIVLSRTLFITNSIKSAVHQL

SEQ ID NO: 2592473 - protein, 17 aa, Entamoeba histolytica
ALSFCLFSIRIIGGLLT

SEQ ID NO: 2592474 - protein, 20 aa, Entamoeba histolytica
ALSFVVLILFIVSLGFMTKD

SEQ ID NO: 2592475 - protein, 22 aa, Entamoeba histolytica
ALSYLVYLTLFLSLGVVISIVV

SEQ ID NO: 2592476 - protein, 31 aa, Entamoeba histolytica
ALTTSAIINLFNISWRIITSHRLGIHNMIHA

SEQ ID NO: 2592477 - protein, 25 aa, Entamoeba histolytica
ALVCCRLFFRLTKQSKIYLSSSQEV

SEQ ID NO: 2592478 - protein, 27 aa, Entamoeba histolytica
AMDNSPINRYFTWTPTLLYSNETKKVF

SEQ ID NO: 2592479 - protein, 18 aa, Entamoeba histolytica
AMFILNQLFLKEDQPLFY

SEQ ID NO: 2592480 - protein, 23 aa, Entamoeba histolytica
AMIKEFELFITVSKLLQKILESF

SEQ ID NO: 2592481 - protein, 35 aa, Entamoeba histolytica
AMISCIILIVYLVFKSLFSLFLDYPAKPTVGLARA

SEQ ID NO: 2592482 - protein, 26 aa, Entamoeba histolytica
AMPTDPNWFKIVRLPNATYDKCTAPT

SEQ ID NO: 2592483 - protein, 21 aa, Entamoeba histolytica
AMSIPLIFAWTKTSTQPASKL

SEQ ID NO: 2592484 - protein, 36 aa, Entamoeba histolytica
ANALGPIVIAILSIILASLVFFLCQRRTDNGPAQYN

SEQ ID NO: 2592485 - protein, 36 aa, Entamoeba histolytica
ANASTLWFSIIIIVVVILLTLWQVRSLKAFFLRRKL

SEQ ID NO: 2592486 - protein, 18 aa, Entamoeba histolytica
ANGLFILMKKVCPTIMLG

SEQ ID NO: 2592487 - protein, 23 aa, Entamoeba histolytica
ANIYYPMLPVLYDLQTDVISWLQ

SEQ ID NO: 2592488 - protein, 30 aa, Entamoeba histolytica; identical to SEQ ID NO: 2395456

SEQ ID NO: 2592489 - protein, 26 aa, Entamoeba histolytica
ANQTGLWYFIEKSGFKVKKYVGRNIG

SEQ ID NO: 2592490 - protein, 22 aa, Entamoeba histolytica
ANSNELCLCLYNDPINKYLNCG

SEQ ID NO: 2592491 - protein, 23 aa, Entamoeba histolytica
ANTAFNYMLHYHFQIDLGEIPLT

SEQ ID NO: 2592492 - protein, 20 aa, Entamoeba histolytica
ANVCVNNKIFVNTQFGVAQH

SEQ ID NO: 2592493 - protein, 19 aa, Entamoeba histolytica
ANYAYQLYSFFKEGNGKGL

SEQ ID NO: 2592494 - protein, 17 aa, Entamoeba histolytica
ANYYTVYLKPVEVPIFI

SEQ ID NO: 2592495 - protein, 36 aa, Entamoeba histolytica; identical to SEQ ID NO: 2395460

SEQ ID NO: 2592496 - protein, 27 aa, Entamoeba histolytica
APATVKPIQVLPLYAALPPEQQLLIFS

SEQ ID NO: 2592497 - protein, 20 aa, Entamoeba histolytica
APAYVLIYQNLIIHLTTLII

SEQ ID NO: 2592498 - protein, 22 aa, Entamoeba histolytica
APEYVPIVYTPRVGPKRIKERR

SEQ ID NO: 2592499 - protein, 30 aa, Entamoeba histolytica
APHQISLSFFVWYIYSIYSFFTNAPPSIQS

SEQ ID NO: 2592500 - protein, 26 aa, Entamoeba histolytica
APKITWRLQIMLWYAGLRGAIAVILA

SEQ ID NO: 2592501 - protein, 25 aa, Entamoeba histolytica
APKLQLHLLSLVKLLVRLSDITQPE

SEQ ID NO: 2592502 - protein, 21 aa, Entamoeba histolytica
APLRQEAIATLYLFTKKDYER

SEQ ID NO: 2592503 - protein, 24 aa, Entamoeba histolytica
APNENFLCFLNSLKTVIMTEINTL

SEQ ID NO: 2592504 - protein, 27 aa, Entamoeba histolytica
APRSKYRPKPIYYRKYKRVVKQVKPVQ

SEQ ID NO: 2592505 - protein, 24 aa, Entamoeba histolytica
APTCLSFFSSILRSFYSILSQKLL

SEQ ID NO: 2592506 - protein, 17 aa, Entamoeba histolytica
APTNLFKIIIPLLCLLI

SEQ ID NO: 2592507 - protein, 18 aa, Entamoeba histolytica
APYTTLLKNWKKVGKINV

SEQ ID NO: 2592508 - protein, 17 aa, Entamoeba histolytica
AQCFSVVLRYLPLHVTP

SEQ ID NO: 2592509 - protein, 24 aa, Entamoeba histolytica
AQPYVNWFLAFLGGLAGGFAYQTS

SEQ ID NO: 2592510 - protein, 22 aa, Entamoeba histolytica
AQQIFYPPMSIVPPSKLHFVSM

SEQ ID NO: 2592511 - protein, 18 aa, Entamoeba histolytica
AQQYIISLILNSFKLSPS

SEQ ID NO: 2592512 - protein, 25 aa, Entamoeba histolytica
AQRLIMVYKVPLWMTFDECTIRPLI

SEQ ID NO: 2592513 - protein, 17 aa, Entamoeba histolytica
AQSGLAPAENPASTSPK

SEQ ID NO: 2592514 - protein, 41 aa, Entamoeba histolytica
AQVYQKKASKKLWIILCVAGGIVIVLGAIVTLVCILKFSGK

SEQ ID NO: 2592515 - protein, 23 aa, Entamoeba histolytica
ARDKKILPLKQPLRKITIIHGSQ

SEQ ID NO: 2592516 - protein, 33 aa, Entamoeba histolytica
ARIWGSMCCILYLFVFLIFGMGWIKGPIADFLI

SEQ ID NO: 2592517 - protein, 21 aa, Entamoeba histolytica
ASANKWYFAPRKCSKEKYDDS

SEQ ID NO: 2592518 - protein, 17 aa, Entamoeba histolytica
ASDGLVSWIYYHHKLHN

SEQ ID NO: 2592519 - protein, 31 aa, Entamoeba histolytica; identical to SEQ ID NO: 2395483

SEQ ID NO: 2592520 - protein, 21 aa, Entamoeba histolytica
ASFEFFILFKSLLPNVFVGLL

SEQ ID NO: 2592521 - protein, 18 aa, Entamoeba histolytica
ASFLDWLGQGIWQSLLLT

SEQ ID NO: 2592522 - protein, 17 aa, Entamoeba histolytica
ASFLFAIIIFKFNKINE

SEQ ID NO: 2592523 - protein, 39 aa, Entamoeba histolytica
ASHYLPIQTLRFIFFYFDVVYLRLPRQPLTSKWNILLHE

SEQ ID NO: 2592524 - protein, 24 aa, Entamoeba histolytica
ASIFGIPRFYFMSKEAIQLSYDFS

SEQ ID NO: 2592525 - protein, 28 aa, Entamoeba histolytica
ASIPDLQLFDYLFQPLLNNSDSLWKKEQ

SEQ ID NO: 2592526 - protein, 17 aa, Entamoeba histolytica
ASISFPNLFNSIPFIYL

SEQ ID NO: 2592527 - protein, 20 aa, Entamoeba histolytica
ASLLQFLVSPKKSFLRFILK

SEQ ID NO: 2592528 - protein, 37 aa, Entamoeba histolytica
ASLVNLQFILFLQLPYTFSFPWLNAIIIYVISIVVSI

SEQ ID NO: 2592529 - protein, 40 aa, Entamoeba histolytica
ASQVKTWNWYLLFSYVLSFILIFSVFYILPDDVQNLSYIR

SEQ ID NO: 2592530 - protein, 33 aa, Entamoeba histolytica
ASRSTLLLCLIVSIIFYFIPIIIGYNSFEVSDT

SEQ ID NO: 2592531 - protein, 17 aa, Entamoeba histolytica
ASSRKYCLAATEALLKA

SEQ ID NO: 2592532 - protein, 25 aa, Entamoeba histolytica
ASSTVWLLLVLSFLGGLVAGFAYQT

SEQ ID NO: 2592533 - protein, 17 aa, Entamoeba histolytica
ASTLLTFDIFGPPIVVL

SEQ ID NO: 2592534 - protein, 40 aa, Entamoeba histolytica
ASYAFDFCFKWINKLKWIIVVFWIIVALGMVYCVFGFLKH

SEQ ID NO: 2592535 - protein, 25 aa, Entamoeba histolytica
ATCGYLVWCMFLVLLVSLYGLHIYW

SEQ ID NO: 2592536 - protein, 28 aa, Entamoeba histolytica
ATCTRSLPIKLLPFTRTIDIPDAWPTQA

SEQ ID NO: 2592537 - protein, 20 aa, Entamoeba histolytica
ATLATWAIIVICIGGILLVI

SEQ ID NO: 2592538 - protein, 25 aa, Entamoeba histolytica
ATLLGIILILMYPVRDLLFNDGKLA

SEQ ID NO: 2592539 - protein, 20 aa, Entamoeba histolytica
ATLRLTLFDFLSKCLTYKPE

SEQ ID NO: 2592540 - protein, 25 aa, Entamoeba histolytica
ATNMESPLLTFMYSGSEDISLTTEK

SEQ ID NO: 2592541 - protein, 29 aa, Entamoeba histolytica
ATPIELIPEFFFLPQFLINFNTIDFGKRK

SEQ ID NO: 2592542 - protein, 28 aa, Entamoeba histolytica
ATPLLITLFIIVLIVSILTVMVKILINY

SEQ ID NO: 2592543 - protein, 24 aa, Entamoeba histolytica
ATQETNIFYKGCSGSLIPKIEQCE

SEQ ID NO: 2592544 - protein, 37 aa, Entamoeba histolytica
ATSCIFGFLALFYPFTWPGIFIPYIPDELFEFYETPV

SEQ ID NO: 2592545 - protein, 24 aa, Entamoeba histolytica
ATYKYLQEVAWKDAFIKISSYILG

SEQ ID NO: 2592546 - protein, 23 aa, Entamoeba histolytica
AVAIYLLLALLVDIAGFSFFVLI

SEQ ID NO: 2592547 - protein, 36 aa, Entamoeba histolytica
AVANGLFFIIYLKPNLWICLLITVYVFIVAVSRIYM

SEQ ID NO: 2592548 - protein, 23 aa, Entamoeba histolytica
AVCGIFSLAPLSLGEKFFIKPKR

SEQ ID NO: 2592549 - protein, 23 aa, Entamoeba histolytica
AVCLNLPLIIPKSVKFLSKISVL

SEQ ID NO: 2592550 - protein, 31 aa, Entamoeba histolytica; identical to SEQ ID NO: 2395518

SEQ ID NO: 2592551 - protein, 17 aa, Entamoeba histolytica
AVDHYALTYSGIRSFDI

SEQ ID NO: 2592552 - protein, 25 aa, Entamoeba histolytica
AVDIFTLGCLFYYIATRKHPYGNSL

SEQ ID NO: 2592553 - protein, 25 aa, Entamoeba histolytica
AVFEKWGCLQLGLLNPARADQYSAI

SEQ ID NO: 2592554 - protein, 25 aa, Entamoeba histolytica
AVFTARLWIHRISYTNIIEGKDDPV

SEQ ID NO: 2592555 - protein, 21 aa, Entamoeba histolytica
AVGCFFIVVLFVSAVMIVILQ

SEQ ID NO: 2592556 - protein, 30 aa, Entamoeba histolytica
AVHIPYIPYTIFSIPFAQYPLFINPCLSTR

SEQ ID NO: 2592557 - protein, 26 aa, Entamoeba histolytica
AVIIMFLCMVLFKDTFLNIVSISFTA

SEQ ID NO: 2592558 - protein, 29 aa, Entamoeba histolytica
AVIVSVIIILFIAIFVFQCYHRNCFITLK

SEQ ID NO: 2592559 - protein, 25 aa, Entamoeba histolytica
AVLRAIGVGRFLLLRTYLAESFVVI

SEQ ID NO: 2592560 - protein, 23 aa, Entamoeba histolytica
AVLYTFFYFCLSICGILFACSFK

SEQ ID NO: 2592561 - protein, 25 aa, Entamoeba histolytica
AVMEAIFIMVFQDPTYRTLIVWDLM

SEQ ID NO: 2592562 - protein, 17 aa, Entamoeba histolytica
AVMKTFTQALFAAAVEY

SEQ ID NO: 2592563 - protein, 23 aa, Entamoeba histolytica
AVQAVAVLPFRAGIVAKPGNLKI

SEQ ID NO: 2592564 - protein, 24 aa, Entamoeba histolytica
AVSLCIIFGFSLLAIKRFNKKNYS

SEQ ID NO: 2592565 - protein, 26 aa, Entamoeba histolytica
AVSWVCTFFMWKYDILPSNKVFYFVL

SEQ ID NO: 2592566 - protein, 23 aa, Entamoeba histolytica
AVTFFYFHHLFNLWGNWQTLFKK

SEQ ID NO: 2592567 - protein, 24 aa, Entamoeba histolytica
AVTNYRMMWIPYNTTIFQDKMNCS

SEQ ID NO: 2592568 - protein, 18 aa, Entamoeba histolytica
AVTYILHISPKLHWKFTF

SEQ ID NO: 2592569 - protein, 17 aa, Entamoeba histolytica
AVVFTIFIKPLICCCIT

SEQ ID NO: 2592570 - protein, 23 aa, Entamoeba histolytica
AVYQSVMLYLLSSSVIITNDVFD

SEQ ID NO: 2592571 - protein, 17 aa, Entamoeba histolytica
AWDQLFFNHGIWHLIVW

SEQ ID NO: 2592572 - protein, 26 aa, Entamoeba histolytica
AWTLERLIFAIIVIYPDIYQKTQFRI

SEQ ID NO: 2592573 - protein, 21 aa, Entamoeba histolytica
AYCYLNFCIAAKPNLLKTFKS

SEQ ID NO: 2592574 - protein, 24 aa, Entamoeba histolytica
AYEIQYVALRNIRLILQKCKDLLV

SEQ ID NO: 2592575 - protein, 19 aa, Entamoeba histolytica
AYFAQNFATLLYYFCKNIK

SEQ ID NO: 2592576 - protein, 17 aa, Entamoeba histolytica
AYFFVMFYGFVPTFANT

SEQ ID NO: 2592577 - protein, 21 aa, Entamoeba histolytica
AYFSVIWYLVLLIVIVFEVYW

SEQ ID NO: 2592578 - protein, 21 aa, Entamoeba histolytica
AYGIVLYETFIEKNAYDGDER

SEQ ID NO: 2592579 - protein, 20 aa, Entamoeba histolytica
AYIIVILFFNFAGTAVIRYS

SEQ ID NO: 2592580 - protein, 20 aa, Entamoeba histolytica
AYLFIWIPGMIFVYALPGKI

SEQ ID NO: 2592581 - protein, 39 aa, Entamoeba histolytica
AYSTMGWLCWLIVSIAVFAIFLIPFLAIGFVGNSNMTVA

SEQ ID NO: 2592582 - protein, 31 aa, Entamoeba histolytica
AYTPLKHIPSLMKGYFFHAVINGKNFFYPAQ

SEQ ID NO: 2592583 - protein, 23 aa, Entamoeba histolytica
AYVNLYCFFVAILNLPSLQKQGS

SEQ ID NO: 2592584 - protein, 34 aa, Entamoeba histolytica
AYWIAHFIQNMIISFFLCWFVIGIGAACGFRLMT

SEQ ID NO: 2592585 - protein, 21 aa, Entamoeba histolytica
AYYLSLLYTEYLHLNARLGHN

SEQ ID NO: 2592586 - protein, 23 aa, Entamoeba histolytica
CAAPMPFVIGCLRTLYPEIQNEC

SEQ ID NO: 2592587 - protein, 18 aa, Entamoeba histolytica
CAEGYIPQGYLKCVKFNE

SEQ ID NO: 2592588 - protein, 18 aa, Entamoeba histolytica
CAFKMKYSNLHFSSINEK

SEQ ID NO: 2592589 - protein, 20 aa, Entamoeba histolytica
CAFTYPFAWLAGAKIMTYTH

SEQ ID NO: 2592590 - protein, 24 aa, Entamoeba histolytica
CAICKNGYFVSNLTCFHCYKGCKI

SEQ ID NO: 2592591 - protein, 29 aa, Entamoeba histolytica
CAPLLWVCTISMIILIVPNFRTFNQLIDQ

SEQ ID NO: 2592592 - protein, 18 aa, Entamoeba histolytica
CASSMSFIVAVLMVIFIL

SEQ ID NO: 2592593 - protein, 27 aa, Entamoeba histolytica
CAVHFVSYIYKYLKDKIPLLNENYLTE

SEQ ID NO: 2592594 - protein, 24 aa, Entamoeba histolytica
CCCTLFFMYVLRGIPFKQWSLEQK

SEQ ID NO: 2592595 - protein, 38 aa, Entamoeba histolytica
CCGLVIFILGLILIAIIMKFAIIPQLQRKLKNAHDIME

SEQ ID NO: 2592596 - protein, 25 aa, Entamoeba histolytica
CCILYAIVFLIFGMGWIKGVIADFL

SEQ ID NO: 2592597 - protein, 19 aa, Entamoeba histolytica
CCLCPLFAGLIATQTDDRK

SEQ ID NO: 2592598 - protein, 17 aa, Entamoeba histolytica
CCSASFDYYFFTGSTYV

SEQ ID NO: 2592599 - protein, 18 aa, Entamoeba histolytica
CDIIAIFVVICTCSYYLI

SEQ ID NO: 2592600 - protein, 29 aa, Entamoeba histolytica
CDMWSIGVLAFVLLTVSFPFDGTVEEVKQ

SEQ ID NO: 2592601 - protein, 27 aa, Entamoeba histolytica
CDNEKDLLLFLPLYTTVLARGSTQPLP

SEQ ID NO: 2592602 - protein, 25 aa, Entamoeba histolytica
CDVFSFSICLLEIWLTHQPYDPEQF

SEQ ID NO: 2592603 - protein, 19 aa, Entamoeba histolytica
CDYLCECLFNLSLILKEHI

SEQ ID NO: 2592604 - protein, 24 aa, Entamoeba histolytica
CECYYLNEIFLFGEKERYFHFLSN

SEQ ID NO: 2592605 - protein, 20 aa, Entamoeba histolytica
CEFELFIIIKCTTKIKDKIM

SEQ ID NO: 2592606 - protein, 19 aa, Entamoeba histolytica
CEFELFITIKCTAKIKDKI

SEQ ID NO: 2592607 - protein, 40 aa, Entamoeba histolytica
CEFHLNVLIVILPIIGFIIILIVILCMAIILINSITRYTA

SEQ ID NO: 2592608 - protein, 24 aa, Entamoeba histolytica
CEFQIFITPYCTCSINNSIKLVYL

SEQ ID NO: 2592609 - protein, 26 aa, Entamoeba histolytica
CEIMTWIFFNVMTGFSFFGIAFSCCG

SEQ ID NO: 2592610 - protein, 25 aa, Entamoeba histolytica
CEKYHRLYHCLAYDLSCDYFNETIG

SEQ ID NO: 2592611 - protein, 44 aa, Entamoeba histolytica
CELSLPFISVLIVSVTFICAFIVIFIVFVITKLVVQKKAIDFSQ

SEQ ID NO: 2592612 - protein, 31 aa, Entamoeba histolytica
CENIHPVLSVYALFFSKCYPNLPSNVLIASL

SEQ ID NO: 2592613 - protein, 19 aa, Entamoeba histolytica
CENNYILNSLTLSCVSMSF

SEQ ID NO: 2592614 - protein, 28 aa, Entamoeba histolytica
CETTVNNLILICVPIAGCLAVIIIIVLV

SEQ ID NO: 2592615 - protein, 52 aa, Entamoeba histolytica
CETVPMCLYDFLIVHIFPLITPLISVLQRTPILLIPLLRLLGDIASSKNFQE

SEQ ID NO: 2592616 - protein, 21 aa, Entamoeba histolytica
CEYGYYINLNTRLCTKPKNIC

SEQ ID NO: 2592617 - protein, 24 aa, Entamoeba histolytica
CEYLVKFIFHCLPQNISPLLNQSN

SEQ ID NO: 2592618 - protein, 46 aa, Entamoeba histolytica
CFAFGFALYYDWKLALCVIAVFPIHTLILFFDFKLNSMQSSPAEKA

SEQ ID NO: 2592619 - protein, 18 aa, Entamoeba histolytica
CFFFTLSNGNIGVAQFVF

SEQ ID NO: 2592620 - protein, 18 aa, Entamoeba histolytica
CFFVVAVAIILIWPNTFF

SEQ ID NO: 2592621 - protein, 27 aa, Entamoeba histolytica
CFGCVILISYFFVVYYSLDELDPEVTI

SEQ ID NO: 2592622 - protein, 26 aa, Entamoeba histolytica
CFGSFILIFVLMLITYRKQSAALLIP

SEQ ID NO: 2592623 - protein, 23 aa, Entamoeba histolytica
CFHCSVYYLYNLPSVVYFSEGDI

SEQ ID NO: 2592624 - protein, 19 aa, Entamoeba histolytica
CFIMFYSLTNATECSCESS

SEQ ID NO: 2592625 - protein, 19 aa, Entamoeba histolytica
CFIWYEPFYSTTLITFLTI

SEQ ID NO: 2592626 - protein, 18 aa, Entamoeba histolytica
CFNGYVKDEIGRCQKCAP

SEQ ID NO: 2592627 - protein, 26 aa, Entamoeba histolytica
CFRDDIIFLIYLYQRWIYPVDKNRMD

SEQ ID NO: 2592628 - protein, 23 aa, Entamoeba histolytica
CFSLLACYYLLSKNNILLSCVFF

SEQ ID NO: 2592629 - protein, 22 aa, Entamoeba histolytica
CFSVVLRYLPLHVTPPPDLPDK

SEQ ID NO: 2592630 - protein, 21 aa, Entamoeba histolytica
CGALVFIVLTIYYIVSQFTHK

SEQ ID NO: 2592631 - protein, 25 aa, Entamoeba histolytica
CGCALGFIGYGYGGPVYAGLGGAIG

SEQ ID NO: 2592632 - protein, 35 aa, Entamoeba histolytica
CGCCAVLFIIILIIIIFIIYKFSHSIQLLLNDDIW

SEQ ID NO: 2592633 - protein, 36 aa, Entamoeba histolytica
CGDKYKWKEMFLNFDLIQKLWKITGIIMKEHYPQMF

SEQ ID NO: 2592634 - protein, 21 aa, Entamoeba histolytica
CGELLHVMLYGNHHYFFDGIQ

SEQ ID NO: 2592635 - protein, 23 aa, Entamoeba histolytica
CGFHIWPYSYIERNQKYRGFFDV

SEQ ID NO: 2592636 - protein, 26 aa, Entamoeba histolytica
CGKASRLIYYFTKPSYIFITGATQLD

SEQ ID NO: 2592637 - protein, 24 aa, Entamoeba histolytica
CGKITTIVVFLIMACFISLILSVD

SEQ ID NO: 2592638 - protein, 23 aa, Entamoeba histolytica
CGKSTIIGLLQRLYEPVDGKIMI

SEQ ID NO: 2592639 - protein, 18 aa, Entamoeba histolytica
CGLLCPIIGLFLNKKWFP

SEQ ID NO: 2592640 - protein, 21 aa, Entamoeba histolytica
CGLNKFPIDLTLLSNLTSLNL

SEQ ID NO: 2592641 - protein, 22 aa, Entamoeba histolytica
CGMILVLLSFFLPMVATRDIDE

SEQ ID NO: 2592642 - protein, 20 aa, Entamoeba histolytica
CGRIMTPIDFIWAYHSEAKE

SEQ ID NO: 2592643 - protein, 26 aa, Entamoeba histolytica
CGTFFKRLLPIVFTENSLCLAVMKTF

SEQ ID NO: 2592644 - protein, 20 aa, Entamoeba histolytica
CGVTYLILGLGSVLLFILAF

SEQ ID NO: 2592645 - protein, 20 aa, Entamoeba histolytica
CGVYFFINFLRQLSLLLLSE

SEQ ID NO: 2592646 - protein, 25 aa, Entamoeba histolytica
CHQNQLLLLFKPLINSIEKIILQNK

SEQ ID NO: 2592647 - protein, 24 aa, Entamoeba histolytica
CHVKVSLLPYCTCLINDTISLYEV

SEQ ID NO: 2592648 - protein, 26 aa, Entamoeba histolytica
CHWNHYVRMFFQELLLYRCTVSPSRN

SEQ ID NO: 2592649 - protein, 23 aa, Entamoeba histolytica
CIASLIILISYNIYIVAINYYKK

SEQ ID NO: 2592650 - protein, 26 aa, Entamoeba histolytica
CIAYPVIMFPTCAGILRYIPKQWKFM

SEQ ID NO: 2592651 - protein, 18 aa, Entamoeba histolytica
CICQIIIVQFLGILFDGV

SEQ ID NO: 2592652 - protein, 18 aa, Entamoeba histolytica
CIEGYKYDPLTYSCKDCQ

SEQ ID NO: 2592653 - protein, 21 aa, Entamoeba histolytica
CIENCTNVCLPLCEIQGCISG

SEQ ID NO: 2592654 - protein, 30 aa, Entamoeba histolytica
CIFISICFYILIMLIVIYVVGNKQPALIKL

SEQ ID NO: 2592655 - protein, 25 aa, Entamoeba histolytica
CIFSLILMFYFYKHDILLSLAMLLS

SEQ ID NO: 2592656 - protein, 25 aa, Entamoeba histolytica
CIGLILIQFYSLPSSFFISFITANY

SEQ ID NO: 2592657 - protein, 25 aa, Entamoeba histolytica
CIGNKKSKLLKIQFSTKDQLDKYEI

SEQ ID NO: 2592658 - protein, 38 aa, Entamoeba histolytica
CIINISLTLFFLWKVILMAIFFILQVSYGYIKGGFKEE

SEQ ID NO: 2592659 - protein, 28 aa, Entamoeba histolytica
CIMIIIMLSILWFPLLLMSSAAPNFIQP

SEQ ID NO: 2592660 - protein, 18 aa, Entamoeba histolytica
CIMMLWPRIEKFGDPNFR

SEQ ID NO: 2592661 - protein, 20 aa, Entamoeba histolytica
CIPLDLPPMPLYPDQMKEKI

SEQ ID NO: 2592662 - protein, 18 aa, Entamoeba histolytica
CIPLLWVCTLSSLILIIP

SEQ ID NO: 2592663 - protein, 18 aa, Entamoeba histolytica
CIPQTILLLQRYGYDIYI

SEQ ID NO: 2592664 - protein, 17 aa, Entamoeba histolytica
CIPYFEISFMKQIVDPH

SEQ ID NO: 2592665 - protein, 23 aa, Entamoeba histolytica
CITPPMLLLNQFKLIVEGFIEKN

SEQ ID NO: 2592666 - protein, 18 aa, Entamoeba histolytica
CITSLFKHHYIATLIFFL

SEQ ID NO: 2592667 - protein, 22 aa, Entamoeba histolytica
CIVAEMFLGIPLFPANSEYDLL

SEQ ID NO: 2592668 - protein, 24 aa, Entamoeba histolytica
CIVRFLFNIAFQFKKKFYVDYQLR

SEQ ID NO: 2592669 - protein, 19 aa, Entamoeba histolytica
CKDGYFLNEFDCIKCPIEC

SEQ ID NO: 2592670 - protein, 19 aa, Entamoeba histolytica
CKDGYYLNRNKCDKCDVLG

SEQ ID NO: 2592671 - protein, 17 aa, Entamoeba histolytica
CKIKVYIFPFCTLEEES

SEQ ID NO: 2592672 - protein, 28 aa, Entamoeba histolytica
CKKDKAFMEFIYSELDLLDDEKLYPLDE

SEQ ID NO: 2592673 - protein, 21 aa, Entamoeba histolytica
CKSNYYLLDNTCIKCPEGCQE

SEQ ID NO: 2592674 - protein, 23 aa, Entamoeba histolytica
CKYTPFIIPMILEFVLFLSFVLN

SEQ ID NO: 2592675 - protein, 17 aa, Entamoeba histolytica
CLFARADDIPTNLQCTT

SEQ ID NO: 2592676 - protein, 23 aa, Entamoeba histolytica
CLFIPFMIFPIFIAFIPYILVNT

SEQ ID NO: 2592677 - protein, 26 aa, Entamoeba histolytica
CLFISVAFFITKLWYFHTQAICKNYT

SEQ ID NO: 2592678 - protein, 24 aa, Entamoeba histolytica
CLGSLYVFPTLKRLLPFIKEKELE

SEQ ID NO: 2592679 - protein, 18 aa, Entamoeba histolytica
CLHNSTLLHCLIMNKYGC

SEQ ID NO: 2592680 - protein, 22 aa, Entamoeba histolytica
CLILYFIQFHILPLFKKDLKSE

SEQ ID NO: 2592681 - protein, 18 aa, Entamoeba histolytica
CLLAPLAPRFISYFFNLL

SEQ ID NO: 2592682 - protein, 25 aa, Entamoeba histolytica
CLNEKPYGNILLLSKEKFLDQAIDE

SEQ ID NO: 2592683 - protein, 20 aa, Entamoeba histolytica
CLNFPFIIPKSVKFLNRISV

SEQ ID NO: 2592684 - protein, 21 aa, Entamoeba histolytica
CLPPLLSYFQICELMILCYPM

SEQ ID NO: 2592685 - protein, 19 aa, Entamoeba histolytica
CLTAVLCYVLKFKVLWSTN

SEQ ID NO: 2592686 - protein, 26 aa, Entamoeba histolytica
CLTEGIFSFIKKLFVKRIYSKIYVDT

SEQ ID NO: 2592687 - protein, 36 aa, Entamoeba histolytica
CLTIILGLICFITITFFLLFKYSPKVPPPIPITTPL

SEQ ID NO: 2592688 - protein, 22 aa, Entamoeba histolytica
CLTPLQYNVLIRTLRFMLVIMN

SEQ ID NO: 2592689 - protein, 21 aa, Entamoeba histolytica
CMAIFNCIKLPFQSFGYLIAC

SEQ ID NO: 2592690 - protein, 32 aa, Entamoeba histolytica
CMEFTLFETFMYWDFFFIDLHEFVLLKVVCCS

SEQ ID NO: 2592691 - protein, 28 aa, Entamoeba histolytica
CMKCATHFITPIPFFKIMAKDEYNPRIV

SEQ ID NO: 2592692 - protein, 18 aa, Entamoeba histolytica
CMLEIWLTHDPYPIIEFH

SEQ ID NO: 2592693 - protein, 23 aa, Entamoeba histolytica
CMSGGEIFIIYAAKVFAAKRDEY

SEQ ID NO: 2592694 - protein, 23 aa, Entamoeba histolytica
CNDKWYLLEIVGNSGFIQSAHTF

SEQ ID NO: 2592695 - protein, 25 aa, Entamoeba histolytica
CNIELIPEFFYLPDFLINENSFEFG

SEQ ID NO: 2592696 - protein, 38 aa, Entamoeba histolytica
CNKEVVWWMIMIIIIIIIIIIIITIVMIIMMVNYIMKR

SEQ ID NO: 2592697 - protein, 39 aa, Entamoeba histolytica
CNKEVVWWMIMIIVIIIIIIIIITIVMIIMMVNYIMKRR

SEQ ID NO: 2592698 - protein, 42 aa, Entamoeba histolytica
CNKEVVWWMIMIIVIIIIIIIIITIVMIIMMVNYIMKRREKK

SEQ ID NO: 2592699 - protein, 39 aa, Entamoeba histolytica
CNKEVVWWMIMIIVIIIVIIIIITIVMIIMMVNYIMKRK

SEQ ID NO: 2592700 - protein, 39 aa, Entamoeba histolytica
CNKEVVWWMIMIIVIIIVIIIIITIVMIIMMVNYIMKRR

SEQ ID NO: 2592701 - protein, 39 aa, Entamoeba histolytica
CNKEVVWWMIMIIVIIIVIIIMITIVMIIMMVNYIMKRK

SEQ ID NO: 2592702 - protein, 41 aa, Entamoeba histolytica
CNKEVVWWMIMIIVIIIVIIIMITIVMIIMMVNYIMKRREK

SEQ ID NO: 2592703 - protein, 21 aa, Entamoeba histolytica
CNKKTCLWMTPFLIILAYIHL

SEQ ID NO: 2592704 - protein, 19 aa, Entamoeba histolytica
CNKLKSIYYTGTDLFTNCI

SEQ ID NO: 2592705 - protein, 18 aa, Entamoeba histolytica
CNSFVSDCIYYFTSSSIS

SEQ ID NO: 2592706 - protein, 18 aa, Entamoeba histolytica
CPDPFTECLTSQTPVPGK

SEQ ID NO: 2592707 - protein, 19 aa, Entamoeba histolytica
CPLGSLRKFMKTNPLTDLL

SEQ ID NO: 2592708 - protein, 17 aa, Entamoeba histolytica
CPNDVFAYAITAWELFY

SEQ ID NO: 2592709 - protein, 29 aa, Entamoeba histolytica
CQDSNVKVYFFSKCQEKKKFTIAGSYFQE

SEQ ID NO: 2592710 - protein, 28 aa, Entamoeba histolytica
CQDSNVKVYFFSKCQEKKKFTIAGSYIQ

SEQ ID NO: 2592711 - protein, 19 aa, Entamoeba histolytica
CQEGYMLRKGKCYKFESDN

SEQ ID NO: 2592712 - protein, 24 aa, Entamoeba histolytica
CQEYLFGKWFKIPKSSLPNSRVFF

SEQ ID NO: 2592713 - protein, 17 aa, Entamoeba histolytica
CQKGYYLEKDGDKKRCS

SEQ ID NO: 2592714 - protein, 29 aa, Entamoeba histolytica
CQQRRSKWISKIPIINSFPLGDWYSNPNI

SEQ ID NO: 2592715 - protein, 33 aa, Entamoeba histolytica
CQQRRSKWTSIIPIINSFPLGGWYSNPNIIKYG

SEQ ID NO: 2592716 - protein, 22 aa, Entamoeba histolytica
CQRWLGMRVELIGCVGLGAVVI

SEQ ID NO: 2592717 - protein, 17 aa, Entamoeba histolytica
CQYGYIDPYGGCEKCNG

SEQ ID NO: 2592718 - protein, 24 aa, Entamoeba histolytica
CRYERFFQRFIPKTDFVYDGELSS

SEQ ID NO: 2592719 - protein, 25 aa, Entamoeba histolytica
CSCSFNGLLPFARLNMKTGEMTFFN

SEQ ID NO: 2592720 - protein, 32 aa, Entamoeba histolytica
CSDASPVYLTFYYLVNILINGKIYKKTSNQFI

SEQ ID NO: 2592721 - protein, 22 aa, Entamoeba histolytica
CSDWTDMILILVGLISSLGNGV

SEQ ID NO: 2592722 - protein, 19 aa, Entamoeba histolytica
CSEDFFITSDFKCLRCNDV

SEQ ID NO: 2592723 - protein, 17 aa, Entamoeba histolytica
CSFLGALAWWYPKPWPE

SEQ ID NO: 2592724 - protein, 17 aa, Entamoeba histolytica
CSFMLYDLVGTAALYGI

SEQ ID NO: 2592725 - protein, 17 aa, Entamoeba histolytica
CSFNKLKKKMPTILNEL

SEQ ID NO: 2592726 - protein, 22 aa, Entamoeba histolytica
CSFRYKLYFIKYLQQLIESQIL

SEQ ID NO: 2592727 - protein, 25 aa, Entamoeba histolytica
CSGYIIYYFIYLIIKRIYPRDLDKQ

SEQ ID NO: 2592728 - protein, 22 aa, Entamoeba histolytica
CSHNTFIRYLQNSISSFYKNAF

SEQ ID NO: 2592729 - protein, 27 aa, Entamoeba histolytica
CSIDLHSWIFLPLFIPDESFDNSKYQP

SEQ ID NO: 2592730 - protein, 23 aa, Entamoeba histolytica
CSIKYLFNVPIYAKGIEFNFYQV

SEQ ID NO: 2592731 - protein, 18 aa, Entamoeba histolytica
CSILWMMDDMPIFAFMML

SEQ ID NO: 2592732 - protein, 24 aa, Entamoeba histolytica
CSKPQPLLYILKAPTRMSLSFFSS

SEQ ID NO: 2592733 - protein, 26 aa, Entamoeba histolytica
CSKYKPNWLGWSNSSPNWLGWKNGYG

SEQ ID NO: 2592734 - protein, 23 aa, Entamoeba histolytica
CSKYLFEGLMILQNRGYDSAGIA

SEQ ID NO: 2592735 - protein, 24 aa, Entamoeba histolytica
CSLCLPQYILIEAECIYFKNLYSN

SEQ ID NO: 2592736 - protein, 48 aa, Entamoeba histolytica
CSLLATFIIIFMASYILIPIVVIVIVVFLIFHTFFIKASIEMQRLEGL

SEQ ID NO: 2592737 - protein, 31 aa, Entamoeba histolytica; identical to SEQ ID NO: 2395708

SEQ ID NO: 2592738 - protein, 24 aa, Entamoeba histolytica
CSPNSIFKILLFTMQFSGNYSIRI

SEQ ID NO: 2592739 - protein, 32 aa, Entamoeba histolytica; identical to SEQ ID NO: 2395710

SEQ ID NO: 2592740 - protein, 25 aa, Entamoeba histolytica
CSRALPIQELPFSRSFDIPDVWPTG

SEQ ID NO: 2592741 - protein, 23 aa, Entamoeba histolytica
CSRCSIGFYLNKGKCLQCSSNCK

SEQ ID NO: 2592742 - protein, 45 aa, Entamoeba histolytica
CSRIPLIIRKVLYLIIGFITYIILYCILFIVVLYLHIGITKKIQQ

SEQ ID NO: 2592743 - protein, 29 aa, Entamoeba histolytica
CSRNITTMIFIQYKLIDGLLEFICQTFSL

SEQ ID NO: 2592744 - protein, 28 aa, Entamoeba histolytica
CSSSFLNFIIKTLPMIKFLSINSITKQE

SEQ ID NO: 2592745 - protein, 27 aa, Entamoeba histolytica
CSVDIYSWIFFLPYSPDDLIKSKFKPL

SEQ ID NO: 2592746 - protein, 24 aa, Entamoeba histolytica
CSVGFMYQCGAVSTFIVSALFIFA

SEQ ID NO: 2592747 - protein, 40 aa, Entamoeba histolytica
CSYKSWSLILLWSSLILFEFLLIVLSIISFFSLVGGVVDF

SEQ ID NO: 2592748 - protein, 19 aa, Entamoeba histolytica
CSYLRDFIVRFRVSLFTRS

SEQ ID NO: 2592749 - protein, 31 aa, Entamoeba histolytica
CSYTLLPYETLLRMNLLIRPTKVNKLGNSYM

SEQ ID NO: 2592750 - protein, 28 aa, Entamoeba histolytica
CSYVQIRGSIPLLWSQIPNIKYKPKIAI

SEQ ID NO: 2592751 - protein, 39 aa, Entamoeba histolytica
CTIQNAFVLLKLFFLFLPSPIIPFCFLDFIKQQENCKLN

SEQ ID NO: 2592752 - protein, 25 aa, Entamoeba histolytica
CTIYSSVRGLWYTFVGDGRAIVADT

SEQ ID NO: 2592753 - protein, 24 aa, Entamoeba histolytica
CTNGKLIILSPETLTKIIRSDFDC

SEQ ID NO: 2592754 - protein, 22 aa, Entamoeba histolytica
CTSFQLWCSIFPLLSNLSNISE

SEQ ID NO: 2592755 - protein, 26 aa, Entamoeba histolytica
CTTSAPTLWYKFKGDGKYIVINTCNY

SEQ ID NO: 2592756 - protein, 19 aa, Entamoeba histolytica
CVDGFYFDEIKGTCIPCTS

SEQ ID NO: 2592757 - protein, 18 aa, Entamoeba histolytica
CVDGYFMSWIGECKLTTE

SEQ ID NO: 2592758 - protein, 33 aa, Entamoeba histolytica
CVEGYLRNAFVLLQSRINVLLLLKSINGENRDV

SEQ ID NO: 2592759 - protein, 17 aa, Entamoeba histolytica
CVGVFKIVFITDSLGLW

SEQ ID NO: 2592760 - protein, 17 aa, Entamoeba histolytica
CVHLLTILLFILSSFNI

SEQ ID NO: 2592761 - protein, 24 aa, Entamoeba histolytica
CVIGPVYHLMIAYYQLRAVLGKIL

SEQ ID NO: 2592762 - protein, 17 aa, Entamoeba histolytica
CVIILVVLISHYNCYEN

SEQ ID NO: 2592763 - protein, 21 aa, Entamoeba histolytica
CVILAIIIILIESWCHKAVKK

SEQ ID NO: 2592764 - protein, 18 aa, Entamoeba histolytica
CVISPWNFPANLSLIPCA

SEQ ID NO: 2592765 - protein, 20 aa, Entamoeba histolytica
CVKCFGPYKPVNGTCTEAVA

SEQ ID NO: 2592766 - protein, 27 aa, Entamoeba histolytica
CVKLGYIDDFLFQYYLLNNQNYKEASS

SEQ ID NO: 2592767 - protein, 25 aa, Entamoeba histolytica
CVLCHLLYIWTLLAPALFPNRNFSK

SEQ ID NO: 2592768 - protein, 17 aa, Entamoeba histolytica
CVLMLVFMLLSKLLCKN

SEQ ID NO: 2592769 - protein, 46 aa, Entamoeba histolytica
CVLSKTNIILIFSISCIVIVFSLLIIIFIISYVISLKREKLSKRIK

SEQ ID NO: 2592770 - protein, 26 aa, Entamoeba histolytica
CVPTVYDTLPLYRTLFHPKDNEFVVN

SEQ ID NO: 2592771 - protein, 26 aa, Entamoeba histolytica
CVPTYCDYGYLFDFDTKRCILQSCPI

SEQ ID NO: 2592772 - protein, 33 aa, Entamoeba histolytica
CVTLKIWDMFLLEGFVWLVKVSSALLLIHGDLF

SEQ ID NO: 2592773 - protein, 24 aa, Entamoeba histolytica
CVYSWTTFVLSYFTTFSPLFTSDN

SEQ ID NO: 2592774 - protein, 17 aa, Entamoeba histolytica
CYIGCDPGYGYDSNKKQ

SEQ ID NO: 2592775 - protein, 18 aa, Entamoeba histolytica
CYILLFLSIEIVGEYCDW

SEQ ID NO: 2592776 - protein, 19 aa, Entamoeba histolytica
CYVQAGWLFLYHPPHYYLG

SEQ ID NO: 2592777 - protein, 27 aa, Entamoeba histolytica
DAILALCSQFLLFGIKNENIRITISKI

SEQ ID NO: 2592778 - protein, 18 aa, Entamoeba histolytica
DALLMVSFLGLLVNIIGV

SEQ ID NO: 2592779 - protein, 37 aa, Entamoeba histolytica
DALREPKIGIYKWAPLLSIFMCLTTLLTQVMNPYGFY

SEQ ID NO: 2592780 - protein, 28 aa, Entamoeba histolytica
DAVDLIRYMMIILLFSFSSRFSFKFLSY

SEQ ID NO: 2592781 - protein, 23 aa, Entamoeba histolytica
DAVIVINKNILSTKNNQYKNGVV

SEQ ID NO: 2592782 - protein, 18 aa, Entamoeba histolytica
DCGFLWQYYCVLTIFYCI

SEQ ID NO: 2592783 - protein, 24 aa, Entamoeba histolytica
DCHLLCFYNFTWQVSDYSQLCYYG

SEQ ID NO: 2592784 - protein, 47 aa, Entamoeba histolytica
DCKKKSYWYIYMIIGICILFIILIFVVIIAYYYFKKSMKIKQNDIMK

SEQ ID NO: 2592785 - protein, 18 aa, Entamoeba histolytica
DCLFPILSNAPNLFFQIK

SEQ ID NO: 2592786 - protein, 20 aa, Entamoeba histolytica
DCLQYIHLLCNKLTPERADR

SEQ ID NO: 2592787 - protein, 24 aa, Entamoeba histolytica
DCTSIVIIATVSPFLRVLHQKEKA

SEQ ID NO: 2592788 - protein, 22 aa, Entamoeba histolytica
DDALQRMFWMFCAPREVQLVDN

SEQ ID NO: 2592789 - protein, 23 aa, Entamoeba histolytica
DDFNSFVITVYVSLLSLPNDNYL

SEQ ID NO: 2592790 - protein, 25 aa, Entamoeba histolytica
DDFNSFVITVYVSLLSLPNDNYLIS

SEQ ID NO: 2592791 - protein, 27 aa, Entamoeba histolytica
DDFQIGKFIIKMNKGLISSIPLIHSEN

SEQ ID NO: 2592792 - protein, 21 aa, Entamoeba histolytica
DDFVIYNPWKEFDLSNIIAMI

SEQ ID NO: 2592793 - protein, 20 aa, Entamoeba histolytica
DDIGNCLLCLAKSSSLLYQL

SEQ ID NO: 2592794 - protein, 39 aa, Entamoeba histolytica
DDITYSLIKRLMLIGILFFPFHLVVCYLFRNSNDKRIQR

SEQ ID NO: 2592795 - protein, 26 aa, Entamoeba histolytica
DDKIKQIIYIIISILYQPLGNIVKKS

SEQ ID NO: 2592796 - protein, 27 aa, Entamoeba histolytica
DDMKMMYLSYVPLLYSPSMIALAIHYH

SEQ ID NO: 2592797 - protein, 19 aa, Entamoeba histolytica
DDMLYLINISSLSLYFSNL

SEQ ID NO: 2592798 - protein, 25 aa, Entamoeba histolytica
DDNFVYLAITFCPYTLDDYLIKIEE

SEQ ID NO: 2592799 - protein, 33 aa, Entamoeba histolytica
DDNNFPIVGIIFLLILFSGICLYLVIGVIINIL

SEQ ID NO: 2592800 - protein, 38 aa, Entamoeba histolytica
DDQMFLIFITGFIGIIILIWALYYLRKQRTIPTTFPCQ

SEQ ID NO: 2592801 - protein, 22 aa, Entamoeba histolytica
DDRFNQPWMIPQFVIEGNRLER

SEQ ID NO: 2592802 - protein, 22 aa, Entamoeba histolytica
DDSFPVIFSINATMYKLTCAIE

SEQ ID NO: 2592803 - protein, 20 aa, Entamoeba histolytica
DDSLPRWLHDLFSTVVQSNS

SEQ ID NO: 2592804 - protein, 24 aa, Entamoeba histolytica
DDVSLVILDVIELAFNGLFGRENW

SEQ ID NO: 2592805 - protein, 22 aa, Entamoeba histolytica
DDWKKPLIDCLIANGFTTEPQK

SEQ ID NO: 2592806 - protein, 24 aa, Entamoeba histolytica
DDWVMTCFNTFFTSLPPAAIALFD

SEQ ID NO: 2592807 - protein, 25 aa, Entamoeba histolytica
DDYIMTFFNILFTQIQPILIGIFDR

SEQ ID NO: 2592808 - protein, 17 aa, Entamoeba histolytica
DDYLLPIIVSAVSSFLA

SEQ ID NO: 2592809 - protein, 25 aa, Entamoeba histolytica
DDYTMTFFNIFITSLPPVFIACLDK

SEQ ID NO: 2592810 - protein, 17 aa, Entamoeba histolytica
DEFLTKTILPKKEYHRL

SEQ ID NO: 2592811 - protein, 18 aa, Entamoeba histolytica
DEFPYIQMLLFVVIGTVT

SEQ ID NO: 2592812 - protein, 17 aa, Entamoeba histolytica
DEHLITWKDGKKFFPLG

SEQ ID NO: 2592813 - protein, 38 aa, Entamoeba histolytica
DEICRYQKCYLYYLNIGLLILLSYAGNTFLPCDFISAK

SEQ ID NO: 2592814 - protein, 19 aa, Entamoeba histolytica
DEITKSFFRVFDDKNTQKT

SEQ ID NO: 2592815 - protein, 27 aa, Entamoeba histolytica
DEKKRLPHFFQILSLTPIGRGILKDNN

SEQ ID NO: 2592816 - protein, 35 aa, Entamoeba histolytica
DEKTVILFDMLIDILFEYGFIIFTSKMRNKGNKSK

SEQ ID NO: 2592817 - protein, 27 aa, Entamoeba histolytica
DELMKYKNFIIIYTTSIFGLVILAAFF

SEQ ID NO: 2592818 - protein, 26 aa, Entamoeba histolytica
DEMKSLLVIYPFPRTLINTPIHIILM

SEQ ID NO: 2592819 - protein, 23 aa, Entamoeba histolytica
DEPKKWLGFVYCGIILITQMIDS

SEQ ID NO: 2592820 - protein, 30 aa, Entamoeba histolytica
DEQDSFVHFYYLENVLSYIKYTAGICYKTS

SEQ ID NO: 2592821 - protein, 30 aa, Entamoeba histolytica
DERDSRYFFLVMVICLIVLVLQQIIFKKLK

SEQ ID NO: 2592822 - protein, 18 aa, Entamoeba histolytica
DERFNQPWMIPQFVIEGN

SEQ ID NO: 2592823 - protein, 22 aa, Entamoeba histolytica
DERFNQPWMIPQFVIEGNRLEK

SEQ ID NO: 2592824 - protein, 24 aa, Entamoeba histolytica
DETIHFITDKWGTKLYLWKDEFYH

SEQ ID NO: 2592825 - protein, 18 aa, Entamoeba histolytica
DETMPLLLKIMIESCWKQ

SEQ ID NO: 2592826 - protein, 18 aa, Entamoeba histolytica
DEVLHQIILLKPSEIFVA

SEQ ID NO: 2592827 - protein, 19 aa, Entamoeba histolytica
DEYLLTQLEYLFKELGKKF

SEQ ID NO: 2592828 - protein, 17 aa, Entamoeba histolytica
DEYQIPSFLNKSKLIYY

SEQ ID NO: 2592829 - protein, 23 aa, Entamoeba histolytica
DEYRKRAHLYNEKWRKTNVNGHW

SEQ ID NO: 2592830 - protein, 37 aa, Entamoeba histolytica
DFAGIIAFFLAFTLPCLFIFMSLYRFNGFTLFTIKPK

SEQ ID NO: 2592831 - protein, 25 aa, Entamoeba histolytica
DFCTSCFSGYFKTPDMLWCESTTSL

SEQ ID NO: 2592832 - protein, 24 aa, Entamoeba histolytica
DFDGTFRLNIYDNLPLINSRIDQA

SEQ ID NO: 2592833 - protein, 24 aa, Entamoeba histolytica
DFGVYFYWLVIPVLLKNDGKSPLV

SEQ ID NO: 2592834 - protein, 28 aa, Entamoeba histolytica
DFINEFPFLIILYFTLPYMNNVDKTLFI

SEQ ID NO: 2592835 - protein, 20 aa, Entamoeba histolytica
DFIPLIMIAVVIIIIVSVIV

SEQ ID NO: 2592836 - protein, 20 aa, Entamoeba histolytica
DFIRIYYINQNIRRLHVFGE

SEQ ID NO: 2592837 - protein, 19 aa, Entamoeba histolytica
DFKLLNIKIQLSFSITSLL

SEQ ID NO: 2592838 - protein, 21 aa, Entamoeba histolytica
DFKLYFNLINKFNSSQIPLLN

SEQ ID NO: 2592839 - protein, 17 aa, Entamoeba histolytica
DFLLVIGTSLQVAPCNI

SEQ ID NO: 2592840 - protein, 19 aa, Entamoeba histolytica
DFPTLLIQPVQRTMRYPLL

SEQ ID NO: 2592841 - protein, 26 aa, Entamoeba histolytica
DFSFSLGPRYITLPSAIIITILSVIL

SEQ ID NO: 2592842 - protein, 18 aa, Entamoeba histolytica
DFSLPYYVEPLLSNISTI

SEQ ID NO: 2592843 - protein, 23 aa, Entamoeba histolytica
DFTFNENFPFKFGSEELRFGSEK

SEQ ID NO: 2592844 - protein, 24 aa, Entamoeba histolytica
DFVFKSKWFRIINLYSSTIDLCIF

SEQ ID NO: 2592845 - protein, 19 aa, Entamoeba histolytica
DFVLPPREFPYKVYGHVVT

SEQ ID NO: 2592846 - protein, 23 aa, Entamoeba histolytica
DFVSQGHRLDFPKSFSPGICELI

SEQ ID NO: 2592847 - protein, 29 aa, Entamoeba histolytica
DFWKEYYNIPLSTLLFKCSGIIPLFVCQH

SEQ ID NO: 2592848 - protein, 17 aa, Entamoeba histolytica
DFYIYIIAIALVSGPSL

SEQ ID NO: 2592849 - protein, 17 aa, Entamoeba histolytica
DFYLPFNLEKLNSFELL

SEQ ID NO: 2592850 - protein, 27 aa, Entamoeba histolytica
DGDSVIPTILLLKSALWKEEWNSKKLT

SEQ ID NO: 2592851 - protein, 23 aa, Entamoeba histolytica
DGEEYLIMRNSWGKWGEYDDGYM

SEQ ID NO: 2592852 - protein, 25 aa, Entamoeba histolytica
DGEIEWVYYFRKYNSEFFYPNEVCP

SEQ ID NO: 2592853 - protein, 31 aa, Entamoeba histolytica
DGFESYVCCFILLYLKQLLINEKIGIFLLWY

SEQ ID NO: 2592854 - protein, 20 aa, Entamoeba histolytica
DGFFLQWMMSIGILIIGTFT

SEQ ID NO: 2592855 - protein, 23 aa, Entamoeba histolytica
DGFNLDKWLIEQRKLRGNIFGKE

SEQ ID NO: 2592856 - protein, 26 aa, Entamoeba histolytica
DGFTSDFHLALFVLRLLLSKRNELKD

SEQ ID NO: 2592857 - protein, 45 aa, Entamoeba histolytica
DGHKWRPLFFYCRFLVTKIIVPIFLFISFVLLVVGMFLISFSFDF

SEQ ID NO: 2592858 - protein, 22 aa, Entamoeba histolytica
DGIALWFTQTPLKTGKAFGASN

SEQ ID NO: 2592859 - protein, 39 aa, Entamoeba histolytica
DGICRYQKCYLFYTTIGLFLLFAYTGNILIPCDFISSKR

SEQ ID NO: 2592860 - protein, 25 aa, Entamoeba histolytica
DGKLDIFYGIWYFAIGFIGAAFGQF

SEQ ID NO: 2592861 - protein, 32 aa, Entamoeba histolytica; identical to SEQ ID NO: 2395835

SEQ ID NO: 2592862 - protein, 17 aa, Entamoeba histolytica
DGLIKLFSSINTSCVSI

SEQ ID NO: 2592863 - protein, 18 aa, Entamoeba histolytica
DGLLRKLGWLTFLDVLPL

SEQ ID NO: 2592864 - protein, 31 aa, Entamoeba histolytica
DGLVSWIYYHHKLHNPYFPIPKPSESTSLSG

SEQ ID NO: 2592865 - protein, 22 aa, Entamoeba histolytica
DGLYKIYKAIAPMKNALDKVAQ

SEQ ID NO: 2592866 - protein, 25 aa, Entamoeba histolytica
DGNLLGMILLYIGFGVYVIGYSVYD

SEQ ID NO: 2592867 - protein, 17 aa, Entamoeba histolytica
DGRYILYTQMATSSFLN

SEQ ID NO: 2592868 - protein, 23 aa, Entamoeba histolytica
DGSVEFIYYLGDYAKNIILPTSV

SEQ ID NO: 2592869 - protein, 24 aa, Entamoeba histolytica
DGVILFFIELLKETPKIYTTFNYS

SEQ ID NO: 2592870 - protein, 23 aa, Entamoeba histolytica
DGYSLPPISLIIEDVIDISQCWI

SEQ ID NO: 2592871 - protein, 23 aa, Entamoeba histolytica
DGYYMEGFMKCILLNRSELYTCD

SEQ ID NO: 2592872 - protein, 20 aa, Entamoeba histolytica
DHCLSCSTNYYFVKGKTTCV

SEQ ID NO: 2592873 - protein, 29 aa, Entamoeba histolytica
DHFGYYGISGLWHLFEVGNFTAGKFIERN

SEQ ID NO: 2592874 - protein, 18 aa, Entamoeba histolytica
DHPKCLWDCLPEKKLNIC

SEQ ID NO: 2592875 - protein, 25 aa, Entamoeba histolytica
DHRKFAIALCNFIIPYFANNHEYNA

SEQ ID NO: 2592876 - protein, 24 aa, Entamoeba histolytica
DHTEPTYHFFKELDLQKQYERIVQ

SEQ ID NO: 2592877 - protein, 23 aa, Entamoeba histolytica
DHTLRLRCLFNRSIKTYANIISF

SEQ ID NO: 2592878 - protein, 17 aa, Entamoeba histolytica
DHYALTYSGIRSFDIDY

SEQ ID NO: 2592879 - protein, 21 aa, Entamoeba histolytica
DIAFFLTCKWAWTLNLYLDSF

SEQ ID NO: 2592880 - protein, 18 aa, Entamoeba histolytica
DICDDIMTLPFNKIFLKE

SEQ ID NO: 2592881 - protein, 21 aa, Entamoeba histolytica
DICHLPMLQYLSLDSLNISYN

SEQ ID NO: 2592882 - protein, 25 aa, Entamoeba histolytica
DICIKAIFYVLPNSLINRFIDYCIS

SEQ ID NO: 2592883 - protein, 19 aa, Entamoeba histolytica
DICLELGYFFTLKKSRKMS

SEQ ID NO: 2592884 - protein, 18 aa, Entamoeba histolytica
DIDLALQKMYLVLGKVQQ

SEQ ID NO: 2592885 - protein, 28 aa, Entamoeba histolytica
DIDYRMTGINYEFVKNLFIKNGNDLKTY

SEQ ID NO: 2592886 - protein, 24 aa, Entamoeba histolytica
DIFHCIYNIYSIPFQFKCITPNCF

SEQ ID NO: 2592887 - protein, 20 aa, Entamoeba histolytica
DIFMYFVFSQSRQKLSLRLR

SEQ ID NO: 2592888 - protein, 18 aa, Entamoeba histolytica
DIFNQYIYLTLKGKSMEI

SEQ ID NO: 2592889 - protein, 21 aa, Entamoeba histolytica
DIGCVYGILFTFFFTITTVKN

SEQ ID NO: 2592890 - protein, 31 aa, Entamoeba histolytica
DIGHGIIVFLFALLMIIFQKKIELTKRNEIF

SEQ ID NO: 2592891 - protein, 32 aa, Entamoeba histolytica; identical to SEQ ID NO: 2395865

SEQ ID NO: 2592892 - protein, 25 aa, Entamoeba histolytica
DIGYETYTKIGCARSLLLNKCENIE

SEQ ID NO: 2592893 - protein, 23 aa, Entamoeba histolytica
DIIIDVVYSFKLFNTIRYNSDSS

SEQ ID NO: 2592894 - protein, 23 aa, Entamoeba histolytica
DIKQLPPVRIASFVKRILIMMLN

SEQ ID NO: 2592895 - protein, 32 aa, Entamoeba histolytica
DILEGLWYCLYTFLIIALMLRFFQVFWECSVT

SEQ ID NO: 2592896 - protein, 20 aa, Entamoeba histolytica
DILFYQLCQESFITKRTKGM

SEQ ID NO: 2592897 - protein, 27 aa, Entamoeba histolytica
DILKQMLFLFIWIICLRIGAVVLIRLH

SEQ ID NO: 2592898 - protein, 18 aa, Entamoeba histolytica
DIMEYWPQSIVLLQPNLF

SEQ ID NO: 2592899 - protein, 19 aa, Entamoeba histolytica
DIMFNITNQVLFLSSIKQP

SEQ ID NO: 2592900 - protein, 21 aa, Entamoeba histolytica
DIMIVCFCIIIPISLFKNLSA

SEQ ID NO: 2592901 - protein, 25 aa, Entamoeba histolytica
DIMTLPFNKIFLKESIDKLKGLNQV

SEQ ID NO: 2592902 - protein, 17 aa, Entamoeba histolytica
DIPTKESQKPEETTSAE

SEQ ID NO: 2592903 - protein, 19 aa, Entamoeba histolytica
DIQDITFHILDFKATFVNN

SEQ ID NO: 2592904 - protein, 19 aa, Entamoeba histolytica
DIQLYRPMIELCNKDILKE

SEQ ID NO: 2592905 - protein, 24 aa, Entamoeba histolytica
DISFYHLFKILTTIFMIAVVLCFS

SEQ ID NO: 2592906 - protein, 20 aa, Entamoeba histolytica
DISIIYSHFDRTPKVWLLGY

SEQ ID NO: 2592907 - protein, 18 aa, Entamoeba histolytica
DISLLHISQFPLTSQYCI

SEQ ID NO: 2592908 - protein, 27 aa, Entamoeba histolytica
DISNLNNIFFTIKTKVSGSAGIILPTQ

SEQ ID NO: 2592909 - protein, 37 aa, Entamoeba histolytica
DISWNGFTYVFQSFNFYLITIFTIIISVAPLILKRFI

SEQ ID NO: 2592910 - protein, 22 aa, Entamoeba histolytica
DIVIEMKWFIEKELRLNRFALS

SEQ ID NO: 2592911 - protein, 20 aa, Entamoeba histolytica
DIVQIRFRYAYELEYWDKLL

SEQ ID NO: 2592912 - protein, 17 aa, Entamoeba histolytica
DIYLCGNTYAFDSWISY

SEQ ID NO: 2592913 - protein, 24 aa, Entamoeba histolytica
DIYSFALTMYAIDTLTNPYPINEF

SEQ ID NO: 2592914 - protein, 24 aa, Entamoeba histolytica
DKAKYHLIFIELQNCIFGNLIEVG

SEQ ID NO: 2592915 - protein, 18 aa, Entamoeba histolytica
DKANSQAHQKHHNQKIQT

SEQ ID NO: 2592916 - protein, 25 aa, Entamoeba histolytica
DKARPITVLVLYSLAIFIVPLTSTI

SEQ ID NO: 2592917 - protein, 25 aa, Entamoeba histolytica
DKCIEPLIVLLTFSSSLDLTLLQLL

SEQ ID NO: 2592918 - protein, 19 aa, Entamoeba histolytica
DKCNGCMEGYYLNGTECKV

SEQ ID NO: 2592919 - protein, 17 aa, Entamoeba histolytica
DKCREGCNYCNSTHCYQ

SEQ ID NO: 2592920 - protein, 26 aa, Entamoeba histolytica
DKDEGSRFKYPWKIAEFVTSGKRLER

SEQ ID NO: 2592921 - protein, 24 aa, Entamoeba histolytica
DKDNSLWAILFVYRNADAKQNTMR

SEQ ID NO: 2592922 - protein, 30 aa, Entamoeba histolytica
DKDSVFPDSLLLLFYYSLCYVFAKEIKKST

SEQ ID NO: 2592923 - protein, 20 aa, Entamoeba histolytica
DKDYYLLVHGYYGSPLDTFT

SEQ ID NO: 2592924 - protein, 21 aa, Entamoeba histolytica
DKEIIRYLIRNCGDRELFIWY

SEQ ID NO: 2592925 - protein, 17 aa, Entamoeba histolytica
DKEKFVYIWNIAEFVIS

SEQ ID NO: 2592926 - protein, 25 aa, Entamoeba histolytica
DKFRDEYIIQFYGAVFIPNKICMVT

SEQ ID NO: 2592927 - protein, 26 aa, Entamoeba histolytica
DKFRNEYIIHFYGAVFIPNKISIVTE

SEQ ID NO: 2592928 - protein, 25 aa, Entamoeba histolytica
DKFRNEYIIQFYGAVFIPNKICMVT

SEQ ID NO: 2592929 - protein, 29 aa, Entamoeba histolytica
DKFRNEYVIHFYGAVFIPNKICMVTEFAK

SEQ ID NO: 2592930 - protein, 25 aa, Entamoeba histolytica
DKFRSDYIIHFYGAVFIPNKYCMVT

SEQ ID NO: 2592931 - protein, 25 aa, Entamoeba histolytica
DKFRSEYIVHFYGAVFIPNKICMVT

SEQ ID NO: 2592932 - protein, 26 aa, Entamoeba histolytica
DKFRSEYIVHFYGAVFIPTKICMVTE

SEQ ID NO: 2592933 - protein, 28 aa, Entamoeba histolytica
DKGKAVEFSIFIKPLCTTTIVDSLVLLG

SEQ ID NO: 2592934 - protein, 25 aa, Entamoeba histolytica
DKIEKMIISTIPQDAYIKGTVNAIE

SEQ ID NO: 2592935 - protein, 25 aa, Entamoeba histolytica
DKILKFHSFLYFPRELKLSIIGNKT

SEQ ID NO: 2592936 - protein, 21 aa, Entamoeba histolytica
DKINKLFAELSEKIQILEDVQ

SEQ ID NO: 2592937 - protein, 28 aa, Entamoeba histolytica
DKKIISKVFVLGKRLILEGSSIKLSEIH

SEQ ID NO: 2592938 - protein, 19 aa, Entamoeba histolytica
DKKKIFIAMLPFITSDNSE

SEQ ID NO: 2592939 - protein, 23 aa, Entamoeba histolytica
DKKKYRLLDPSGFDLKIGNSKSI

SEQ ID NO: 2592940 - protein, 28 aa, Entamoeba histolytica
DKKTLIHHFPFIMQSLFNIFKNVKDSAN

SEQ ID NO: 2592941 - protein, 22 aa, Entamoeba histolytica
DKKWNEVLIPLTDIPPVLPNNP

SEQ ID NO: 2592942 - protein, 18 aa, Entamoeba histolytica
DKLNWRKMLQECFKTLWE

SEQ ID NO: 2592943 - protein, 22 aa, Entamoeba histolytica
DKMQTVILSPPFQQLVESPCHE

SEQ ID NO: 2592944 - protein, 17 aa, Entamoeba histolytica
DKMVITKFEVTGTALSI

SEQ ID NO: 2592945 - protein, 42 aa, Entamoeba histolytica
DKNEVVLFGLWGIFLFLIIPSIIVFSVFYPSLKYPLDSLSDT

SEQ ID NO: 2592946 - protein, 20 aa, Entamoeba histolytica
DKNFVKVWRYIRETNKVVVQ

SEQ ID NO: 2592947 - protein, 24 aa, Entamoeba histolytica
DKNIYFAMKGKVIPTLFYTTNLTE

SEQ ID NO: 2592948 - protein, 24 aa, Entamoeba histolytica
DKQKISYQLKIKFLDDMAVALSYL

SEQ ID NO: 2592949 - protein, 51 aa, Entamoeba histolytica
DKTMPLKRKLANLGKWLVLLAGILCFIVVGLLVLWLFIKNGSMTWEDTVSI

SEQ ID NO: 2592950 - protein, 25 aa, Entamoeba histolytica
DKVSYIKNYIWLDNIPLLITGWFRL

SEQ ID NO: 2592951 - protein, 33 aa, Entamoeba histolytica; identical to SEQ ID NO: 2395928

SEQ ID NO: 2592952 - protein, 20 aa, Entamoeba histolytica
DLEKSYSFQFTLRNTYKKVL

SEQ ID NO: 2592953 - protein, 17 aa, Entamoeba histolytica
DLFGYLSCKELHLKSTT

SEQ ID NO: 2592954 - protein, 26 aa, Entamoeba histolytica
DLFPSLFILIFLSLFRYFLTKDVLNQ

SEQ ID NO: 2592955 - protein, 23 aa, Entamoeba histolytica
DLGMCLPFIENLAHQLKCNVVGY

SEQ ID NO: 2592956 - protein, 24 aa, Entamoeba histolytica
DLIILLSALVLQRKLLIKSKNRCI

SEQ ID NO: 2592957 - protein, 23 aa, Entamoeba histolytica
DLIKHIVRFITPLNGQCQLIQLS

SEQ ID NO: 2592958 - protein, 27 aa, Entamoeba histolytica
DLIRTAFFHIILYRSLFIKSTHLLSSK

SEQ ID NO: 2592959 - protein, 21 aa, Entamoeba histolytica
DLITFIMLLISIGQEALFAII

SEQ ID NO: 2592960 - protein, 22 aa, Entamoeba histolytica
DLKIKIMEDIVVGLAFLHENNI

SEQ ID NO: 2592961 - protein, 17 aa, Entamoeba histolytica
DLLIFKTVNYRSIYWPV

SEQ ID NO: 2592962 - protein, 17 aa, Entamoeba histolytica
DLLIILFTRYEHSEILH

SEQ ID NO: 2592963 - protein, 34 aa, Entamoeba histolytica
DLLKILGVIVFCVVMYFINGFNKNLARKLANKIQ

SEQ ID NO: 2592964 - protein, 18 aa, Entamoeba histolytica
DLMIRKIPKTSSKVYGYF

SEQ ID NO: 2592965 - protein, 39 aa, Entamoeba histolytica
DLNSLAFLVFPLFFILLAILILTLFPFLKTYFIPSHSHS

SEQ ID NO: 2592966 - protein, 25 aa, Entamoeba histolytica
DLQIREFYMFYSNKAYMKNIYYDTD

SEQ ID NO: 2592967 - protein, 27 aa, Entamoeba histolytica
DLQQKLKTPLLLLPKEKRPTANMFMST

SEQ ID NO: 2592968 - protein, 18 aa, Entamoeba histolytica
DLQVLYKQATRKNILGFD

SEQ ID NO: 2592969 - protein, 25 aa, Entamoeba histolytica
DLSNYYLTSLPHYLWQKIQKEQIQV

SEQ ID NO: 2592970 - protein, 34 aa, Entamoeba histolytica
DLSYDVFSIVFRQPYFYLVTLFTVIVGIIPNMLR

SEQ ID NO: 2592971 - protein, 21 aa, Entamoeba histolytica
DLTEYTLTLTPGQKYTLGESL

SEQ ID NO: 2592972 - protein, 27 aa, Entamoeba histolytica
DLTGLISFILVFIAPCVFHLLSIRLFQ

SEQ ID NO: 2592973 - protein, 23 aa, Entamoeba histolytica
DLTHGSILIEKRAKISFNGGSLN

SEQ ID NO: 2592974 - protein, 23 aa, Entamoeba histolytica
DLTNIPYFHIQSLPFYHENEINS

SEQ ID NO: 2592975 - protein, 24 aa, Entamoeba histolytica
DLTRVFLVVAALISFCVFISFLNN

SEQ ID NO: 2592976 - protein, 24 aa, Entamoeba histolytica
DLTSYFGLIEFYEKYLETHRNLIN

SEQ ID NO: 2592977 - protein, 19 aa, Entamoeba histolytica
DLVLINVLYFKNYFQYFPI

SEQ ID NO: 2592978 - protein, 17 aa, Entamoeba histolytica
DLVLPIEGFFSVSSLRV

SEQ ID NO: 2592979 - protein, 24 aa, Entamoeba histolytica
DLYINIKGCEFFTHPSGRKFSVLM

SEQ ID NO: 2592980 - protein, 17 aa, Entamoeba histolytica
DLYIPMFICELLCLLFL

SEQ ID NO: 2592981 - protein, 30 aa, Entamoeba histolytica
DMISKIIYDMFLFLKLFKTFNIKRGNETKQ

SEQ ID NO: 2592982 - protein, 34 aa, Entamoeba histolytica; identical to SEQ ID NO: 2395969

SEQ ID NO: 2592983 - protein, 26 aa, Entamoeba histolytica
DMPVDQFVFTLLKLKNALVNTDETQL

SEQ ID NO: 2592984 - protein, 18 aa, Entamoeba histolytica
DMQFSFLDFILPGKQSLN

SEQ ID NO: 2592985 - protein, 19 aa, Entamoeba histolytica
DMRETIWLLHDQELYLYSL

SEQ ID NO: 2592986 - protein, 24 aa, Entamoeba histolytica
DMVLIDFSFFKRFLNIADSTLSIN

SEQ ID NO: 2592987 - protein, 20 aa, Entamoeba histolytica
DNAVITCLFILFDCIIQYTE

SEQ ID NO: 2592988 - protein, 22 aa, Entamoeba histolytica
DNDFRYVAPNNLFFPKSNNKEE

SEQ ID NO: 2592989 - protein, 23 aa, Entamoeba histolytica
DNDKKMYLNPLNEFPYSISVDVP

SEQ ID NO: 2592990 - protein, 24 aa, Entamoeba histolytica
DNDQLIIFNPIEWKCDNGISGMLV

SEQ ID NO: 2592991 - protein, 22 aa, Entamoeba histolytica
DNEYTLLVLDRIVRVCPKDNLD

SEQ ID NO: 2592992 - protein, 31 aa, Entamoeba histolytica
DNFDLSVDLLFQKRNFSLLPNDVVFASWPKV

SEQ ID NO: 2592993 - protein, 35 aa, Entamoeba histolytica
DNFEHFFVHWYYQARIFFFKLIHLKMTLAPSFRIN

SEQ ID NO: 2592994 - protein, 17 aa, Entamoeba histolytica
DNFFGNDMPKFDDFSFG

SEQ ID NO: 2592995 - protein, 30 aa, Entamoeba histolytica
DNFGEIYKFYLPCQAYVTATYHYSSLFNLT

SEQ ID NO: 2592996 - protein, 41 aa, Entamoeba histolytica
DNFKSIYNFYLPCQAYVTATYHFQGRQRSIFTYEITTRECK

SEQ ID NO: 2592997 - protein, 25 aa, Entamoeba histolytica
DNFQLYPPQILTKGKIGYFLNSDLK

SEQ ID NO: 2592998 - protein, 17 aa, Entamoeba histolytica
DNGTSLVFLGLCLLLLL

SEQ ID NO: 2592999 - protein, 19 aa, Entamoeba histolytica
DNIPLLITGWFRLCGGIYN

SEQ ID NO: 2593000 - protein, 22 aa, Entamoeba histolytica
DNIRKFIQFQVTVNIVALALCV

SEQ ID NO: 2593001 - protein, 20 aa, Entamoeba histolytica
DNLSYWKQKILLLLTQMETP

SEQ ID NO: 2593002 - protein, 21 aa, Entamoeba histolytica
DNMYKYYLYYFCKAGNMGICE

SEQ ID NO: 2593003 - protein, 25 aa, Entamoeba histolytica
DNNENLLIQFFFYDKSTETKITETC

SEQ ID NO: 2593004 - protein, 23 aa, Entamoeba histolytica
DNNEYPITIILPMNGGGSGDLVS

SEQ ID NO: 2593005 - protein, 41 aa, Entamoeba histolytica
DNNKKEWIIIIIFIIAVIVIGIIIIGIVFVGVYLSKRKEKG

SEQ ID NO: 2593006 - protein, 26 aa, Entamoeba histolytica
DNNLKNALFTFTYPSVMKLTEIFKVF

SEQ ID NO: 2593007 - protein, 24 aa, Entamoeba histolytica
DNNNLNGTSHILFILPFFIGILFF

SEQ ID NO: 2593008 - protein, 30 aa, Entamoeba histolytica; identical to SEQ ID NO: 2395993

SEQ ID NO: 2593009 - protein, 17 aa, Entamoeba histolytica
DNRLWYFASKTAEEAKG

SEQ ID NO: 2593010 - protein, 24 aa, Entamoeba histolytica
DNSKMVGILIRRSSHNTGVDIVRI

SEQ ID NO: 2593011 - protein, 23 aa, Entamoeba histolytica
DNVNRFFTLQGMRVLAFGYKAIK

SEQ ID NO: 2593012 - protein, 25 aa, Entamoeba histolytica
DNYDNLDAASSPFIVLFAIIVVILF

SEQ ID NO: 2593013 - protein, 19 aa, Entamoeba histolytica
DNYYKTFNFNKINSFIPMC

SEQ ID NO: 2593014 - protein, 37 aa, Entamoeba histolytica
DPEEGIAYYLIIPNFLLCLDWLIVMVDFYFERQRSVF

SEQ ID NO: 2593015 - protein, 24 aa, Entamoeba histolytica
DPEYGFVTLLLGTLISLLLSHVMV

SEQ ID NO: 2593016 - protein, 20 aa, Entamoeba histolytica
DPFNIIREFGKKYLGLKCPH

SEQ ID NO: 2593017 - protein, 18 aa, Entamoeba histolytica
DPFNIWALEMYPESFIHD

SEQ ID NO: 2593018 - protein, 24 aa, Entamoeba histolytica
DPFPKSEFKFPWKIAEFISTGKRP

SEQ ID NO: 2593019 - protein, 25 aa, Entamoeba histolytica
DPFPKSEFKFPWKIAEFISTGKRPV

SEQ ID NO: 2593020 - protein, 20 aa, Entamoeba histolytica
DPIHMTIFDTLFVAVTDLNS

SEQ ID NO: 2593021 - protein, 21 aa, Entamoeba histolytica
DPISLNTWRYYGQAKIALVVD

SEQ ID NO: 2593022 - protein, 22 aa, Entamoeba histolytica
DPKELLCIFQQYGDVKTIYYST

SEQ ID NO: 2593023 - protein, 20 aa, Entamoeba histolytica
DPLRFSFNYSFFETFRHNYN

SEQ ID NO: 2593024 - protein, 27 aa, Entamoeba histolytica
DPNEIPIFMLSKIYRDIFNLYIVKLQE

SEQ ID NO: 2593025 - protein, 39 aa, Entamoeba histolytica
DPNQVNYPLHKYLGFSLLKLHLPANKILLQKIQNLDNTF

SEQ ID NO: 2593026 - protein, 19 aa, Entamoeba histolytica
DPSKLIALSILFAKQPNES

SEQ ID NO: 2593027 - protein, 20 aa, Entamoeba histolytica
DPSLIKIYGKSVKYLRDNFI

SEQ ID NO: 2593028 - protein, 18 aa, Entamoeba histolytica
DPSRPYTYGVWIELIHEK

SEQ ID NO: 2593029 - protein, 24 aa, Entamoeba histolytica
DPTKNVFVKFFAPWCGHCKALAPK

SEQ ID NO: 2593030 - protein, 26 aa, Entamoeba histolytica
DPTTSLYYPLSISVLPFLPTCPLHVD

SEQ ID NO: 2593031 - protein, 17 aa, Entamoeba histolytica
DPVYWIDLLTPEQFEEG

SEQ ID NO: 2593032 - protein, 23 aa, Entamoeba histolytica
DQALILFNIILGECALAEKSKNR

SEQ ID NO: 2593033 - protein, 19 aa, Entamoeba histolytica
DQCFQCSPGYFLTENYLCS

SEQ ID NO: 2593034 - protein, 21 aa, Entamoeba histolytica
DQFFNPIIQQPMDIFNYEIVN

SEQ ID NO: 2593035 - protein, 17 aa, Entamoeba histolytica
DQIDMFHRCFSLILSAL

SEQ ID NO: 2593036 - protein, 19 aa, Entamoeba histolytica
DQLPDYNITISLFSQTEEC

SEQ ID NO: 2593037 - protein, 23 aa, Entamoeba histolytica
DQNDRGIILRRKANFIFGNAFYY

SEQ ID NO: 2593038 - protein, 22 aa, Entamoeba histolytica
DQRYYIFVTSYYQEAGTFQLTI

SEQ ID NO: 2593039 - protein, 25 aa, Entamoeba histolytica
DQTKGIYWVVPIISVPIICGLSLDY

SEQ ID NO: 2593040 - protein, 20 aa, Entamoeba histolytica
DRESVFEHLLTSISFIQPFT

SEQ ID NO: 2593041 - protein, 30 aa, Entamoeba histolytica
DRFKDSTPLILLPHQMNYIRYIPSMSGDNE

SEQ ID NO: 2593042 - protein, 27 aa, Entamoeba histolytica
DRIIKPLGIFFFLSSGVYLFITITAVI

SEQ ID NO: 2593043 - protein, 21 aa, Entamoeba histolytica
DRKLEFLAIPFVYKKNDNSFR

SEQ ID NO: 2593044 - protein, 24 aa, Entamoeba histolytica
DRKWALWFGLILQCVGIVLCIITQ

SEQ ID NO: 2593045 - protein, 21 aa, Entamoeba histolytica
DRLLPFFETSIIPFDPSDAKK

SEQ ID NO: 2593046 - protein, 29 aa, Entamoeba histolytica
DRLTSLFTFHLILLSIFSITLFPEKINKI

SEQ ID NO: 2593047 - protein, 27 aa, Entamoeba histolytica
DRNEILYLLVGYLSCLIPAACIGIFIA

SEQ ID NO: 2593048 - protein, 18 aa, Entamoeba histolytica
DRNKLLSIFVPLITPDLM

SEQ ID NO: 2593049 - protein, 23 aa, Entamoeba histolytica
DRQLIQTIRFIFDKYPTHEIITQ

SEQ ID NO: 2593050 - protein, 30 aa, Entamoeba histolytica
DRSFLIVIISFILIYPLSFSKTLDALKYFS

SEQ ID NO: 2593051 - protein, 25 aa, Entamoeba histolytica
DRSTFIFCYLLFLTLSFVSLIIVSK

SEQ ID NO: 2593052 - protein, 18 aa, Entamoeba histolytica
DRTALIFSYTRRPFSILK

SEQ ID NO: 2593053 - protein, 22 aa, Entamoeba histolytica
DRVHIIYCESKYYNPLTITSQF

SEQ ID NO: 2593054 - protein, 18 aa, Entamoeba histolytica
DRVLICRKGVLLIQQEGK

SEQ ID NO: 2593055 - protein, 25 aa, Entamoeba histolytica
DSAFYAIRVLFICIAYILLRYRYPN

SEQ ID NO: 2593056 - protein, 31 aa, Entamoeba histolytica
DSAIVVPYQKYYADYLILNRLSYKTDFGSVG

SEQ ID NO: 2593057 - protein, 18 aa, Entamoeba histolytica
DSASSMMIGILSVIALFF

SEQ ID NO: 2593058 - protein, 29 aa, Entamoeba histolytica
DSELYDHLYLLLQLYQVFIIPKNQSFVNE

SEQ ID NO: 2593059 - protein, 36 aa, Entamoeba histolytica
DSFDTWIMVIIIILTLIIDIFFLLHSLFSIYFTVYC

SEQ ID NO: 2593060 - protein, 28 aa, Entamoeba histolytica
DSFKLYRKLFDILASPLNFILPVNCYSS

SEQ ID NO: 2593061 - protein, 22 aa, Entamoeba histolytica
DSFYHLMNLYNKPLTPFYNQSL

SEQ ID NO: 2593062 - protein, 19 aa, Entamoeba histolytica
DSGASLTMMLLLATVMLLL

SEQ ID NO: 2593063 - protein, 17 aa, Entamoeba histolytica
DSGDIFMYFVFSQSRQK

SEQ ID NO: 2593064 - protein, 22 aa, Entamoeba histolytica
DSIEWYFRVFICQTKIEGIINS

SEQ ID NO: 2593065 - protein, 23 aa, Entamoeba histolytica
DSILFFILTVFITLLHSFNLFFY

SEQ ID NO: 2593066 - protein, 30 aa, Entamoeba histolytica
DSKSIYNILRFWGMYSLYPSFIPSSFECVV

SEQ ID NO: 2593067 - protein, 26 aa, Entamoeba histolytica
DSLNKKRLIYTLPIKAQTELSPKLDI

SEQ ID NO: 2593068 - protein, 25 aa, Entamoeba histolytica
DSNKLLLYVILFLLSILSNGVSVIK

SEQ ID NO: 2593069 - protein, 23 aa, Entamoeba histolytica
DSRLFFFVGFGSLFTLSCFFVDQ

SEQ ID NO: 2593070 - protein, 25 aa, Entamoeba histolytica
DSTTGEKQPKDIPTKESQKPEETTS

SEQ ID NO: 2593071 - protein, 18 aa, Entamoeba histolytica
DTFLLFVSSCSQSKFIAS

SEQ ID NO: 2593072 - protein, 25 aa, Entamoeba histolytica
DTFPMCIFCIMVLSALFIGIDYRKV

SEQ ID NO: 2593073 - protein, 19 aa, Entamoeba histolytica
DTGLLVYSLKDWVFTSIDS

SEQ ID NO: 2593074 - protein, 22 aa, Entamoeba histolytica
DTIIHKIHWLGTTNEFAVFTDK

SEQ ID NO: 2593075 - protein, 27 aa, Entamoeba histolytica
DTINKLVLKMLYFAIGNMVAGFLQTIC

SEQ ID NO: 2593076 - protein, 25 aa, Entamoeba histolytica
DTISFYDFYFQIKKLIVSTRDMHLR

SEQ ID NO: 2593077 - protein, 23 aa, Entamoeba histolytica
DTKFNIFVFVMIIIQCVICLILA

SEQ ID NO: 2593078 - protein, 20 aa, Entamoeba histolytica
DTLIILPEALYNTVALPTKN

SEQ ID NO: 2593079 - protein, 31 aa, Entamoeba histolytica
DTMYVYIAESSYYTCPLPYTCTDTTNCQHQT

SEQ ID NO: 2593080 - protein, 24 aa, Entamoeba histolytica
DTTKGFWFKIIGSDLTIDISTCES

SEQ ID NO: 2593081 - protein, 23 aa, Entamoeba histolytica
DTTPLEQMILKKVLLTPSEEGYE

SEQ ID NO: 2593082 - protein, 22 aa, Entamoeba histolytica
DTTYKIEKLWKTVSFDDAQEGD

SEQ ID NO: 2593083 - protein, 24 aa, Entamoeba histolytica
DTVKKLCMLLLQFSRDISDTPIIS

SEQ ID NO: 2593084 - protein, 33 aa, Entamoeba histolytica
DTYCSNFSLPLWTLALIIIGIICCLGVFTSIIV

SEQ ID NO: 2593085 - protein, 21 aa, Entamoeba histolytica
DTYGCLQCMRGYFFNSNLECE

SEQ ID NO: 2593086 - protein, 17 aa, Entamoeba histolytica
DVDFTDAIITIKPINNN

SEQ ID NO: 2593087 - protein, 18 aa, Entamoeba histolytica
DVDFTDAIITIKPINNNS

SEQ ID NO: 2593088 - protein, 26 aa, Entamoeba histolytica
DVFFPSLVYILIKANIPFFASNIDYI

SEQ ID NO: 2593089 - protein, 28 aa, Entamoeba histolytica
DVFKGIFTNYIFIGIELLQIIVQTSIVI

SEQ ID NO: 2593090 - protein, 26 aa, Entamoeba histolytica
DVGCSPLKIILCPKKFLNNYACEGRI

SEQ ID NO: 2593091 - protein, 28 aa, Entamoeba histolytica
DVIIFSHLKYLIMTSLISSIPAFIYFFQ

SEQ ID NO: 2593092 - protein, 18 aa, Entamoeba histolytica
DVIYKWEPLPYTARPKFG

SEQ ID NO: 2593093 - protein, 25 aa, Entamoeba histolytica
DVLKRMLWGLIPFFGNFFKQTEENP

SEQ ID NO: 2593094 - protein, 17 aa, Entamoeba histolytica
DVLWLYVNGDEPNWKRE

SEQ ID NO: 2593095 - protein, 27 aa, Entamoeba histolytica
DVNKYQNIVLVSKINRNIISLDKSKCI

SEQ ID NO: 2593096 - protein, 31 aa, Entamoeba histolytica
DVNVYKLLFLLIVNLLFFLCELITGIVIHSL

SEQ ID NO: 2593097 - protein, 20 aa, Entamoeba histolytica
DVPFDYVEFLFMPAREYMDL

SEQ ID NO: 2593098 - protein, 24 aa, Entamoeba histolytica
DVRKGFVHLLLYRGTVNRRSHLNW

SEQ ID NO: 2593099 - protein, 26 aa, Entamoeba histolytica
DVSAWVSGLLYFFGRIPQIIHIYRTK

SEQ ID NO: 2593100 - protein, 18 aa, Entamoeba histolytica
DVSWRRFLNQRLDDYPKL

SEQ ID NO: 2593101 - protein, 20 aa, Entamoeba histolytica
DVTKVYLKVNIRLVSTIYPE

SEQ ID NO: 2593102 - protein, 37 aa, Entamoeba histolytica
DVVHMQIDSNIHKRMYKKYKKHIKCEVSEEVSKGTTE

SEQ ID NO: 2593103 - protein, 18 aa, Entamoeba histolytica
DVVVLTHIHLDHFGYYGI

SEQ ID NO: 2593104 - protein, 20 aa, Entamoeba histolytica
DVYMWAMNIFYLTTTVHPFQ

SEQ ID NO: 2593105 - protein, 25 aa, Entamoeba histolytica
DWISFAFLLFNFGVLGVISIFYISP

SEQ ID NO: 2593106 - protein, 23 aa, Entamoeba histolytica
DWMNGTFLVVCATVAFGMGIDKP

SEQ ID NO: 2593107 - protein, 23 aa, Entamoeba histolytica
DYAISQFRFLVKLLLVHGRYNYR

SEQ ID NO: 2593108 - protein, 18 aa, Entamoeba histolytica
DYDYLHCSFVIPDSLTAS

SEQ ID NO: 2593109 - protein, 28 aa, Entamoeba histolytica
DYELTRIVPLYLAVHIFAESPCKALRVY

SEQ ID NO: 2593110 - protein, 20 aa, Entamoeba histolytica
DYENLLFVYPTEICLGKEKK

SEQ ID NO: 2593111 - protein, 22 aa, Entamoeba histolytica
DYFDTKIFFGLISTFHAHLLMS

SEQ ID NO: 2593112 - protein, 25 aa, Entamoeba histolytica
DYFELIYITFYIWGYLSFGVCCLEI

SEQ ID NO: 2593113 - protein, 18 aa, Entamoeba histolytica
DYFFLLTQDIIIILLIVY

SEQ ID NO: 2593114 - protein, 18 aa, Entamoeba histolytica
DYFILNDSFRIWCIWCIV

SEQ ID NO: 2593115 - protein, 24 aa, Entamoeba histolytica
DYHERPLFNIINPQLTKLIDSSEQ

SEQ ID NO: 2593116 - protein, 20 aa, Entamoeba histolytica
DYHLKLCFCPFCQFGIKSMG

SEQ ID NO: 2593117 - protein, 25 aa, Entamoeba histolytica
DYHTVFIDLLASLMYLPDSSQIHFI

SEQ ID NO: 2593118 - protein, 26 aa, Entamoeba histolytica
DYLETHFLTFLRTKGIWKGKCIPNVK

SEQ ID NO: 2593119 - protein, 26 aa, Entamoeba histolytica
DYLILPLLSLILNLLLFILSSYFIGK

SEQ ID NO: 2593120 - protein, 17 aa, Entamoeba histolytica
DYLLFTENSKVNKVIDG

SEQ ID NO: 2593121 - protein, 17 aa, Entamoeba histolytica
DYNRLLPHFIQEANIME

SEQ ID NO: 2593122 - protein, 26 aa, Entamoeba histolytica
DYRKEIRLFWVSGQPIPQFIIDVCNV

SEQ ID NO: 2593123 - protein, 21 aa, Entamoeba histolytica
DYVFHFLVRVEPFTTMFIRMN

SEQ ID NO: 2593124 - protein, 18 aa, Entamoeba histolytica
DYYKAFLKQLEQGHIPLI

SEQ ID NO: 2593125 - protein, 21 aa, Entamoeba histolytica
EAELLEKIRCPYIVSFIGCVT

SEQ ID NO: 2593126 - protein, 36 aa, Entamoeba histolytica
EAERKVTFLKFFKFIGWILLEKWYCVLFVLCFIAFS

SEQ ID NO: 2593127 - protein, 29 aa, Entamoeba histolytica
EAGCDAMFAFPWYITWFLHSVENIEVGLR

SEQ ID NO: 2593128 - protein, 35 aa, Entamoeba histolytica
EAGGMACLMCCIFTLLGFCCCGLIFCCMRNFKNAV

SEQ ID NO: 2593129 - protein, 30 aa, Entamoeba histolytica; identical to SEQ ID NO: 2396121

SEQ ID NO: 2593130 - protein, 19 aa, Entamoeba histolytica
EALQQGILIAILSSYGYSF

SEQ ID NO: 2593131 - protein, 32 aa, Entamoeba histolytica; identical to SEQ ID NO: 2396131

SEQ ID NO: 2593132 - protein, 17 aa, Entamoeba histolytica
EASTLHLYLKDTIESKY

SEQ ID NO: 2593133 - protein, 24 aa, Entamoeba histolytica
EAWQYPIKLFVHLINIQTDRITSI

SEQ ID NO: 2593134 - protein, 21 aa, Entamoeba histolytica
EAYFFYHFTLFLMSLFIQSDN

SEQ ID NO: 2593135 - protein, 19 aa, Entamoeba histolytica
ECAIGVYYLHSLGIVHRDI

SEQ ID NO: 2593136 - protein, 22 aa, Entamoeba histolytica
ECFYNILPYNVYFDYYSHSSNN

SEQ ID NO: 2593137 - protein, 30 aa, Entamoeba histolytica
ECGFVTFSNYIQYWVLGSTPRMVKVCDITE

SEQ ID NO: 2593138 - protein, 28 aa, Entamoeba histolytica
ECISIFVLLLTFYLWIRAVKSGSPIKAA

SEQ ID NO: 2593139 - protein, 41 aa, Entamoeba histolytica
ECNKEVVWWMIIVIIIIIIIIITIVMIIMMVNYIMKRREKK

SEQ ID NO: 2593140 - protein, 44 aa, Entamoeba histolytica
ECNKEVVWWMIMIIIIIIIIIIIITIVMIIIITNYIMKRKEKKE

SEQ ID NO: 2593141 - protein, 43 aa, Entamoeba histolytica
ECNKEVVWWMIMIIIIIIIIIIIITIVMIIMMVNYIMKRKEKK

SEQ ID NO: 2593142 - protein, 43 aa, Entamoeba histolytica
ECNKEVVWWMIMIIIIIIIIIIIITIVMIIMMVNYIMKRREKK

SEQ ID NO: 2593143 - protein, 43 aa, Entamoeba histolytica
ECNKEVVWWMIMIIIIIIVIIIIITIVMIIMMVNYIMKRREKK

SEQ ID NO: 2593144 - protein, 44 aa, Entamoeba histolytica
ECNKEVVWWMIMIIVIIIVIIIIITIVMIIMITNYIMKRREKKK

SEQ ID NO: 2593145 - protein, 44 aa, Entamoeba histolytica
ECNKEVVWWMIMIIVIIIVIIIIITIVMIIMMVNYIMKRKEKKE

SEQ ID NO: 2593146 - protein, 43 aa, Entamoeba histolytica
ECNKEVVWWMIMIIVIIIVIIIIITIVMIIMMVNYIMKRREKK

SEQ ID NO: 2593147 - protein, 26 aa, Entamoeba histolytica
ECPIPSFCRPSFPTLGMLISKKLKKQ

SEQ ID NO: 2593148 - protein, 25 aa, Entamoeba histolytica
ECSIAKLNIFFQRLLTDMKSFEILL

SEQ ID NO: 2593149 - protein, 19 aa, Entamoeba histolytica
ECTFKFLKLVLQKSQRPFL

SEQ ID NO: 2593150 - protein, 50 aa, Entamoeba histolytica
ECVFNTISLILVIGLPLFGIAIIIILTIIIISYILFALHKKKKLEERKAK

SEQ ID NO: 2593151 - protein, 22 aa, Entamoeba histolytica
ECVLCNYGFVLNNGSCIEVNLP

SEQ ID NO: 2593152 - protein, 18 aa, Entamoeba histolytica
ECVYSLTLLAIIGTPSIT

SEQ ID NO: 2593153 - protein, 24 aa, Entamoeba histolytica
ECYEGCILDYISITSLYIYHKECS

SEQ ID NO: 2593154 - protein, 32 aa, Entamoeba histolytica
EDFKEVFVWKVFYTSLIWVLKNIDKETLLLYF

SEQ ID NO: 2593155 - protein, 22 aa, Entamoeba histolytica
EDFYRPVIVLIQLLFIISNVIA

SEQ ID NO: 2593156 - protein, 18 aa, Entamoeba histolytica
EDGKNWREIYKSLLVLDN

SEQ ID NO: 2593157 - protein, 38 aa, Entamoeba histolytica
EDIENAENYFYYTNTKRMFNLYNIHLKSETVHKESQSA

SEQ ID NO: 2593158 - protein, 26 aa, Entamoeba histolytica
EDIKIYLQFSYLIYTISHDKIYFTSI

SEQ ID NO: 2593159 - protein, 32 aa, Entamoeba histolytica; identical to SEQ ID NO: 2396156

SEQ ID NO: 2593160 - protein, 42 aa, Entamoeba histolytica
EDKPVKQKWLWSLYTILTVMSLITLALTVTTLIILSTKLGEI

SEQ ID NO: 2593161 - protein, 25 aa, Entamoeba histolytica
EDKTLLQSLIDPLLSFFRGNVQHRN

SEQ ID NO: 2593162 - protein, 23 aa, Entamoeba histolytica
EDKTWVKWETGWSLGYKAEQWEK

SEQ ID NO: 2593163 - protein, 31 aa, Entamoeba histolytica; identical to SEQ ID NO: 2396157

SEQ ID NO: 2593164 - protein, 22 aa, Entamoeba histolytica
EDLIHSINIFEEILTALKISIL

SEQ ID NO: 2593165 - protein, 20 aa, Entamoeba histolytica
EDLWCFTPGLFPLIRSGATD

SEQ ID NO: 2593166 - protein, 23 aa, Entamoeba histolytica
EDNKPCHYIYSSLLNYDEFVTDI

SEQ ID NO: 2593167 - protein, 21 aa, Entamoeba histolytica
EDNKVTRKSILKLKKMMSSVM

SEQ ID NO: 2593168 - protein, 24 aa, Entamoeba histolytica
EDNQHFFKPLLFGLFSMVSELYQQ

SEQ ID NO: 2593169 - protein, 18 aa, Entamoeba histolytica
EDRYSFIEYCFVAMIYAM

SEQ ID NO: 2593170 - protein, 26 aa, Entamoeba histolytica
EDSNYFVWLIPYFIGVVLQWIASIID

SEQ ID NO: 2593171 - protein, 17 aa, Entamoeba histolytica
EDSPKTLILFVIRDRDQ

SEQ ID NO: 2593172 - protein, 17 aa, Entamoeba histolytica
EDWAEGFIVKQQRMREV

SEQ ID NO: 2593173 - protein, 23 aa, Entamoeba histolytica
EDYKFRYRRGLPLVLKGINASIE

SEQ ID NO: 2593174 - protein, 21 aa, Entamoeba histolytica
EDYVKLPYKLKVRMLFDTARG

SEQ ID NO: 2593175 - protein, 24 aa, Entamoeba histolytica
EDYVKLPYRLKIRMLFDTARGMQF

SEQ ID NO: 2593176 - protein, 25 aa, Entamoeba histolytica
EEAARLFVLISIRIPDLYESILETL

SEQ ID NO: 2593177 - protein, 23 aa, Entamoeba histolytica
EEAFKLLLFVFEQLDIQIRPKIS

SEQ ID NO: 2593178 - protein, 18 aa, Entamoeba histolytica
EECILCRDGYLLNSNNCI

SEQ ID NO: 2593179 - protein, 17 aa, Entamoeba histolytica
EECIQLTKKYFGVLFRE

SEQ ID NO: 2593180 - protein, 25 aa, Entamoeba histolytica
EEDCTLLCVFGIEDPLRPEVIDAVA

SEQ ID NO: 2593181 - protein, 26 aa, Entamoeba histolytica
EEDLIYDSIFFIPLNRRINVVVKELW

SEQ ID NO: 2593182 - protein, 26 aa, Entamoeba histolytica
EEEIDIHLIYLFIQHEVYKVYSLVLV

SEQ ID NO: 2593183 - protein, 23 aa, Entamoeba histolytica
EEEPKEEFWFISINRYEGKKNHK

SEQ ID NO: 2593184 - protein, 23 aa, Entamoeba histolytica
EEFENYLFSFVQALRLESQEKPG

SEQ ID NO: 2593185 - protein, 27 aa, Entamoeba histolytica
EEGISDMRFFRWKLYTKINGLINKLQP

SEQ ID NO: 2593186 - protein, 28 aa, Entamoeba histolytica
EEGRIQLYDTFLPFLIKALKRTDNEDEK

SEQ ID NO: 2593187 - protein, 21 aa, Entamoeba histolytica
EEGVLYYIRATCAISDCAITL

SEQ ID NO: 2593188 - protein, 28 aa, Entamoeba histolytica
EEHEDWQLWMWFGIVTVVIMAIIVLMVV

SEQ ID NO: 2593189 - protein, 25 aa, Entamoeba histolytica
EEIGRLLTRLYPYTIHKKFETRTAA

SEQ ID NO: 2593190 - protein, 22 aa, Entamoeba histolytica
EEIIIPKPPCPIYILATPSTNQ

SEQ ID NO: 2593191 - protein, 28 aa, Entamoeba histolytica
EEKGIEYILLMVILLFGNGMTIFCLSKM

SEQ ID NO: 2593192 - protein, 51 aa, Entamoeba histolytica
EEKTACIVYSKNQWILYVLSFLIFAIVLIMFCLMLAFHISNYYKEKRRELE

SEQ ID NO: 2593193 - protein, 23 aa, Entamoeba histolytica
EEKYSIQSLIVLNLYLLLKHEVD

SEQ ID NO: 2593194 - protein, 37 aa, Entamoeba histolytica
EELCKSAPVIILWTTLFLVQILLAIIVILIAQTGCRD

SEQ ID NO: 2593195 - protein, 20 aa, Entamoeba histolytica
EELLPIKNLIISGCGTSYYA

SEQ ID NO: 2593196 - protein, 23 aa, Entamoeba histolytica
EELSLFHIFLGEVMFDPYVTINT

SEQ ID NO: 2593197 - protein, 19 aa, Entamoeba histolytica
EEMIKFIFTARADILPFNW

SEQ ID NO: 2593198 - protein, 19 aa, Entamoeba histolytica
EEMKKIVLKVIRQCLNVEI

SEQ ID NO: 2593199 - protein, 31 aa, Entamoeba histolytica
EEMKPLLYIEFIVNCYLLISWMYECIVNLHI

SEQ ID NO: 2593200 - protein, 25 aa, Entamoeba histolytica
EEMNLLLQNTWNHSPLKRISIKEVI

SEQ ID NO: 2593201 - protein, 24 aa, Entamoeba histolytica
EENKKKFIIMIFNDIISIEMNKEM

SEQ ID NO: 2593202 - protein, 34 aa, Entamoeba histolytica; identical to SEQ ID NO: 2396192

SEQ ID NO: 2593203 - protein, 37 aa, Entamoeba histolytica
EEPDPGLRMLGLVKWLLSGFYLMPTGIKKPYNPILGE

SEQ ID NO: 2593204 - protein, 36 aa, Entamoeba histolytica
EEPDPGLRMLGLVKWLLSGFYLMPTGIKKPYNPILN

SEQ ID NO: 2593205 - protein, 41 aa, Entamoeba histolytica
EEPYPILQWILRSCVLIAYFFCFILYFFMNILHHSSSITGS

SEQ ID NO: 2593206 - protein, 25 aa, Entamoeba histolytica
EEQGFQFKMYFVPPVLENNYGFGRA

SEQ ID NO: 2593207 - protein, 18 aa, Entamoeba histolytica
EERYGRIIDLLRKWKNSK

SEQ ID NO: 2593208 - protein, 17 aa, Entamoeba histolytica
EESFLSRTITIRTLIDY

SEQ ID NO: 2593209 - protein, 28 aa, Entamoeba histolytica
EESQIKLLSLILYYCIVSSMGSITFNLE

SEQ ID NO: 2593210 - protein, 25 aa, Entamoeba histolytica
EESSFQLTFLHLFNQSILSSDTYSI

SEQ ID NO: 2593211 - protein, 25 aa, Entamoeba histolytica
EETGSKTLLVVMRLPKENEIKVEEY

SEQ ID NO: 2593212 - protein, 29 aa, Entamoeba histolytica
EETTRISFIYFLLISIIEGVIDKEKEGTT

SEQ ID NO: 2593213 - protein, 17 aa, Entamoeba histolytica
EEVFRINKNIISATSKN

SEQ ID NO: 2593214 - protein, 27 aa, Entamoeba histolytica
EEVLINFYHFLKRYLKVISPLIVSSYV

SEQ ID NO: 2593215 - protein, 24 aa, Entamoeba histolytica
EEWHFWRLLLINIYTLWTVPLLLL

SEQ ID NO: 2593216 - protein, 18 aa, Entamoeba histolytica
EEWKKTQKLLGKTNQLIG

SEQ ID NO: 2593217 - protein, 39 aa, Entamoeba histolytica
EFAGLRMIIFIITIISIVVLLIVIYPYCFLHHYGLKKWS

SEQ ID NO: 2593218 - protein, 26 aa, Entamoeba histolytica
EFDEKYYSYFFKTLIKFSLTNEKAVV

SEQ ID NO: 2593219 - protein, 19 aa, Entamoeba histolytica
EFDYTLLLCPLTQSKTKSC

SEQ ID NO: 2593220 - protein, 23 aa, Entamoeba histolytica
EFEIFIKPLCSCSMKDEIILLAS

SEQ ID NO: 2593221 - protein, 17 aa, Entamoeba histolytica
EFEIFVTPFCTCTIENN

SEQ ID NO: 2593222 - protein, 17 aa, Entamoeba histolytica
EFELFITIKCTTKINDK

SEQ ID NO: 2593223 - protein, 18 aa, Entamoeba histolytica
EFGALYNEDLDKLYFCVI

SEQ ID NO: 2593224 - protein, 17 aa, Entamoeba histolytica
EFGILPPQEYILGDGEY

SEQ ID NO: 2593225 - protein, 24 aa, Entamoeba histolytica
EFHHNLVYFPLYDGMLNNYTSLTS

SEQ ID NO: 2593226 - protein, 19 aa, Entamoeba histolytica
EFHLTLLEIIIFAIKKDIH

SEQ ID NO: 2593227 - protein, 18 aa, Entamoeba histolytica
EFHSHIYLVLLEMIIEVL

SEQ ID NO: 2593228 - protein, 24 aa, Entamoeba histolytica
EFIGSQHFNVWWYRNKMNELCKVS

SEQ ID NO: 2593229 - protein, 18 aa, Entamoeba histolytica
EFILFKLPLICLPIVIII

SEQ ID NO: 2593230 - protein, 18 aa, Entamoeba histolytica
EFLPICIASLIILISYNI

SEQ ID NO: 2593231 - protein, 17 aa, Entamoeba histolytica
EFNLVCYPFFLIPDEVH

SEQ ID NO: 2593232 - protein, 24 aa, Entamoeba histolytica
EFPELQLPANLKGFELKKCCAENE

SEQ ID NO: 2593233 - protein, 18 aa, Entamoeba histolytica
EFSILQPFIRNLINQRTH

SEQ ID NO: 2593234 - protein, 17 aa, Entamoeba histolytica
EFTEIVLKAGYGNILFN

SEQ ID NO: 2593235 - protein, 28 aa, Entamoeba histolytica
EFYINLVIFFVLLVRVALFKQLPEVFKQ

SEQ ID NO: 2593236 - protein, 25 aa, Entamoeba histolytica
EFYVIQQSILLSFLNGFCTITLKRQ

SEQ ID NO: 2593237 - protein, 28 aa, Entamoeba histolytica
EGATQETNIFYKGCSGLLIPKIEQCEIT

SEQ ID NO: 2593238 - protein, 25 aa, Entamoeba histolytica
EGCAICKDGYYWKDKNCYLCQEKCE

SEQ ID NO: 2593239 - protein, 28 aa, Entamoeba histolytica
EGFENKVFYVWFDAPIGYLSITANYTDD

SEQ ID NO: 2593240 - protein, 23 aa, Entamoeba histolytica
EGGYVEWLYAFTDLYDKVIPESA

SEQ ID NO: 2593241 - protein, 24 aa, Entamoeba histolytica
EGINGIVIILNYNTNRISNNIKIM

SEQ ID NO: 2593242 - protein, 24 aa, Entamoeba histolytica
EGKATTPFLLNYLNTHTNSQTVRA

SEQ ID NO: 2593243 - protein, 22 aa, Entamoeba histolytica
EGKCINFKLLNRCIKSKNNKCI

SEQ ID NO: 2593244 - protein, 22 aa, Entamoeba histolytica
EGKHFFAKLPLYQKGLVVQGGE

SEQ ID NO: 2593245 - protein, 29 aa, Entamoeba histolytica
EGKNYSNVLPMFRWRMYYIDDKNTATSFP

SEQ ID NO: 2593246 - protein, 21 aa, Entamoeba histolytica
EGKSIIWELLKQVRPGMDLSR

SEQ ID NO: 2593247 - protein, 32 aa, Entamoeba histolytica; identical to SEQ ID NO: 2396234

SEQ ID NO: 2593248 - protein, 23 aa, Entamoeba histolytica
EGKTVLFMWDLLKGLDNTTIIAP

SEQ ID NO: 2593249 - protein, 22 aa, Entamoeba histolytica
EGMKLFGMMHPINGAITSASNL

SEQ ID NO: 2593250 - protein, 24 aa, Entamoeba histolytica
EGMPDWYYILICKCWQNNPQERLS

SEQ ID NO: 2593251 - protein, 26 aa, Entamoeba histolytica
EGSGNEFGTFMYWAVKRDTKGTTFDK

SEQ ID NO: 2593252 - protein, 21 aa, Entamoeba histolytica
EGSIFKLLSPHADNYIYGSVR

SEQ ID NO: 2593253 - protein, 24 aa, Entamoeba histolytica
EGTFGIVYLGIFRGNKVAIKKMKQ

SEQ ID NO: 2593254 - protein, 22 aa, Entamoeba histolytica
EGTTLYYFKISENNGRYYFKEE

SEQ ID NO: 2593255 - protein, 23 aa, Entamoeba histolytica
EGVCYYFIDYFKTIRDIVGSYLI

SEQ ID NO: 2593256 - protein, 43 aa, Entamoeba histolytica
EHDELPLLSTFILKFIFFIIFALTIGGVIFFIFGKKKNKFRDD

SEQ ID NO: 2593257 - protein, 32 aa, Entamoeba histolytica
EHDELTFIPLKLFYDFLITKVLHEKSFFGDSF

SEQ ID NO: 2593258 - protein, 25 aa, Entamoeba histolytica
EHEELRWFSLFTTDVFMKTTLVMKY

SEQ ID NO: 2593259 - protein, 27 aa, Entamoeba histolytica
EHIIMVLFPLLFPTPWKPKCIKSDVNE

SEQ ID NO: 2593260 - protein, 25 aa, Entamoeba histolytica
EHKSLLHGLFSLYPPALEGLYKKQK

SEQ ID NO: 2593261 - protein, 27 aa, Entamoeba histolytica
EHMASMFVFIFIQIYVFFSWIKSKLSE

SEQ ID NO: 2593262 - protein, 29 aa, Entamoeba histolytica
EHPETCSIWWKLLTIWWTVSTIRLKYYGT

SEQ ID NO: 2593263 - protein, 18 aa, Entamoeba histolytica
EHPSRVLCVFNILSQYDP

SEQ ID NO: 2593264 - protein, 33 aa, Entamoeba histolytica
EIALLLNSIVFFYILSPLPLYSYKQIVISELVK

SEQ ID NO: 2593265 - protein, 32 aa, Entamoeba histolytica
EIAREVFIDLIFIVPLVGVLLFFIGAVCKCCC

SEQ ID NO: 2593266 - protein, 21 aa, Entamoeba histolytica
EIDWVILICRALMTVVVCIAY

SEQ ID NO: 2593267 - protein, 25 aa, Entamoeba histolytica
EIEQKKIFISFLFDGIRSQSISQFS

SEQ ID NO: 2593268 - protein, 23 aa, Entamoeba histolytica
EIESEWYLFSRGIKTEKKKTFKE

SEQ ID NO: 2593269 - protein, 23 aa, Entamoeba histolytica
EIESEWYLFSRGIKTEKKKTFME

SEQ ID NO: 2593270 - protein, 30 aa, Entamoeba histolytica
EIESHTVQYPWNVINILKTSTLTLSKDKTV

SEQ ID NO: 2593271 - protein, 27 aa, Entamoeba histolytica
EIETWDFLHFLLFVSTLIALLMKKGFN

SEQ ID NO: 2593272 - protein, 17 aa, Entamoeba histolytica
EIFQFPIFLIITQFVVS

SEQ ID NO: 2593273 - protein, 20 aa, Entamoeba histolytica
EIFVQYSVDLKLLIALTIHL

SEQ ID NO: 2593274 - protein, 18 aa, Entamoeba histolytica
EIGLFLKIETSSGVCLYI

SEQ ID NO: 2593275 - protein, 17 aa, Entamoeba histolytica
EIIFLSICYGSVENCAK

SEQ ID NO: 2593276 - protein, 20 aa, Entamoeba histolytica
EIIGPSLMPYKCMISGWFTY

SEQ ID NO: 2593277 - protein, 41 aa, Entamoeba histolytica
EIIHTRIEPKQHKRIYNEYKVHLKGEGEVIEPLQEAKETGN

SEQ ID NO: 2593278 - protein, 27 aa, Entamoeba histolytica
EIIINIITRWYIIISIGLIAFSMTFLM

SEQ ID NO: 2593279 - protein, 17 aa, Entamoeba histolytica
EIIIQNMKKGIKIRSNE

SEQ ID NO: 2593280 - protein, 25 aa, Entamoeba histolytica
EIIKLFESFGWLMKLDFTNITSPGL

SEQ ID NO: 2593281 - protein, 18 aa, Entamoeba histolytica
EIINWNRKLHINKGILVT

SEQ ID NO: 2593282 - protein, 17 aa, Entamoeba histolytica
EIISLKGIWYLLDLSQP

SEQ ID NO: 2593283 - protein, 31 aa, Entamoeba histolytica
EIKENIFFYMYFICFFIVPPILHKWGPRFMM

SEQ ID NO: 2593284 - protein, 19 aa, Entamoeba histolytica
EIKGTCIPCTSPCTKCVGV

SEQ ID NO: 2593285 - protein, 20 aa, Entamoeba histolytica
EIKIVSQFKFLFDTYKITNT

SEQ ID NO: 2593286 - protein, 32 aa, Entamoeba histolytica
EIKNYLKQYWPEILWRWYVKKGMYEEAIKCIL

SEQ ID NO: 2593287 - protein, 25 aa, Entamoeba histolytica
EIKRNEFLPELLRLTEIFTGAEENI

SEQ ID NO: 2593288 - protein, 17 aa, Entamoeba histolytica
EILFKRLPMIKTIINFV

SEQ ID NO: 2593289 - protein, 19 aa, Entamoeba histolytica
EILPIFRQQTTTTTQTIAA

SEQ ID NO: 2593290 - protein, 25 aa, Entamoeba histolytica
EINISYRILYPVITRIIPSLGPIEG

SEQ ID NO: 2593291 - protein, 22 aa, Entamoeba histolytica
EINSTIHPSFARFALECSEYKC

SEQ ID NO: 2593292 - protein, 33 aa, Entamoeba histolytica
EINTLSPQYFLFNILIQILLMIVGREQNVINQA

SEQ ID NO: 2593293 - protein, 21 aa, Entamoeba histolytica
EIPGFIELLKVIYSISMREKI

SEQ ID NO: 2593294 - protein, 41 aa, Entamoeba histolytica
EIPLNGIVILPIVDFLYMIIILHFPLIIKSEELSQCILKSL

SEQ ID NO: 2593295 - protein, 23 aa, Entamoeba histolytica
EIPLSLALLPEYIIGILSDFIHS

SEQ ID NO: 2593296 - protein, 28 aa, Entamoeba histolytica
EIPLTVYMLFNWLWLLGTLIYLNCVDPG

SEQ ID NO: 2593297 - protein, 24 aa, Entamoeba histolytica
EIRNSYLLIYTYHDQGWKNLQTIF

SEQ ID NO: 2593298 - protein, 25 aa, Entamoeba histolytica
EIRTKNGMFILIYCSSKVNELFDSL

SEQ ID NO: 2593299 - protein, 31 aa, Entamoeba histolytica; identical to SEQ ID NO: 2395151

SEQ ID NO: 2593300 - protein, 24 aa, Entamoeba histolytica
EISLRVFDFILMDGFCALMSVART

SEQ ID NO: 2593301 - protein, 26 aa, Entamoeba histolytica
EISMKLRIRFMLDSIKGIEYLHSNGI

SEQ ID NO: 2593302 - protein, 26 aa, Entamoeba histolytica
EISRIKKYFLLFVNNLTVGKGLLEKR

SEQ ID NO: 2593303 - protein, 17 aa, Entamoeba histolytica
EISYLFQTQMTLAINYI

SEQ ID NO: 2593304 - protein, 34 aa, Entamoeba histolytica
EITANYDLIILPLYSALPLYKQKRVFFKTPEHAR

SEQ ID NO: 2593305 - protein, 25 aa, Entamoeba histolytica
EITDIFWIIGSICTVILACTNNIVF

SEQ ID NO: 2593306 - protein, 27 aa, Entamoeba histolytica
EITIQRVIPILLHFGSLFKENLLVFNC

SEQ ID NO: 2593307 - protein, 27 aa, Entamoeba histolytica
EITTMRYNLFLYYKNSGLSYNSTLKQY

SEQ ID NO: 2593308 - protein, 27 aa, Entamoeba histolytica
EITTSYEYFGFLPSILPFIQCVLPLIN

SEQ ID NO: 2593309 - protein, 22 aa, Entamoeba histolytica
EIVLNCIKLFDSNEYPIQVILP

SEQ ID NO: 2593310 - protein, 31 aa, Entamoeba histolytica; identical to SEQ ID NO: 2396299

SEQ ID NO: 2593311 - protein, 24 aa, Entamoeba histolytica
EKCFKCLTGFIPYNGQCITLKSIN

SEQ ID NO: 2593312 - protein, 26 aa, Entamoeba histolytica
EKCPTLLIPLLYKHIERYLSLRLLST

SEQ ID NO: 2593313 - protein, 33 aa, Entamoeba histolytica
EKDKRKILLIRYGFCCLIGAITLFFVGMFIVIG

SEQ ID NO: 2593314 - protein, 26 aa, Entamoeba histolytica
EKDVGYPFILYNLNTGGQGFIRIGYC

SEQ ID NO: 2593315 - protein, 27 aa, Entamoeba histolytica
EKEATISLPFYGLNKTTIYNPRNANNL

SEQ ID NO: 2593316 - protein, 24 aa, Entamoeba histolytica
EKEIERLIEWGRDLDFIDEEEIKK

SEQ ID NO: 2593317 - protein, 21 aa, Entamoeba histolytica
EKELVVIVWLLCYNPTKFYQI

SEQ ID NO: 2593318 - protein, 30 aa, Entamoeba histolytica
EKEVSLLRRKKLFVWIEYKNKDVIGHRANV

SEQ ID NO: 2593319 - protein, 26 aa, Entamoeba histolytica
EKFDIKFIIWAWIKCSFYILQTFLIG

SEQ ID NO: 2593320 - protein, 22 aa, Entamoeba histolytica
EKFRCNYIIHFYGAVIIQDNKC

SEQ ID NO: 2593321 - protein, 31 aa, Entamoeba histolytica
EKIREFIKFLIFFQPYFNIKQQKLLISFYAT

SEQ ID NO: 2593322 - protein, 23 aa, Entamoeba histolytica
EKKKFTIAGSYIQQLKYSDEECK

SEQ ID NO: 2593323 - protein, 33 aa, Entamoeba histolytica
EKKVCVRMYDNLLRLFLFAFQSIQQLQDFRDEL

SEQ ID NO: 2593324 - protein, 41 aa, Entamoeba histolytica
EKKYARLTITFAILGIFMSPLFILSFLFSRKSKRKSIRVIG

SEQ ID NO: 2593325 - protein, 30 aa, Entamoeba histolytica; identical to SEQ ID NO: 2396325

SEQ ID NO: 2593326 - protein, 27 aa, Entamoeba histolytica
EKMHSGILKWIIRFHPDLVFSRKNPDI

SEQ ID NO: 2593327 - protein, 28 aa, Entamoeba histolytica
EKMIVRLRKLLYSALLRQNISYYDRKEN

SEQ ID NO: 2593328 - protein, 23 aa, Entamoeba histolytica
EKMKRVCVIPIWLSHEDYPYLLS

SEQ ID NO: 2593329 - protein, 32 aa, Entamoeba histolytica
EKNKRIFVHNFLFDLALEFGFFFDSKLSRKST

SEQ ID NO: 2593330 - protein, 22 aa, Entamoeba histolytica
EKNMFYYCLLFTISIISCFIHC

SEQ ID NO: 2593331 - protein, 25 aa, Entamoeba histolytica
EKNRKIFIQHLLIDLLREKGFQFES

SEQ ID NO: 2593332 - protein, 37 aa, Entamoeba histolytica
EKPMKKRIWWLRIIEEIWLILVGFVRSSFYTITIEIG

SEQ ID NO: 2593333 - protein, 29 aa, Entamoeba histolytica
EKQLLRCLALFLEYAWMKGIDGFNNEVNE

SEQ ID NO: 2593334 - protein, 25 aa, Entamoeba histolytica
EKQNRYRIGHWLELNLLEFPDSVNY

SEQ ID NO: 2593335 - protein, 17 aa, Entamoeba histolytica
EKQSWLPKLTSNTLKTA

SEQ ID NO: 2593336 - protein, 19 aa, Entamoeba histolytica
EKSFIYPCVNIKRKDFSHI

SEQ ID NO: 2593337 - protein, 21 aa, Entamoeba histolytica
EKSFPKTIIPKKVELIKKTSS

SEQ ID NO: 2593338 - protein, 24 aa, Entamoeba histolytica
EKSILDQLPFYAIAKELKIQICTW

SEQ ID NO: 2593339 - protein, 23 aa, Entamoeba histolytica
EKSKDYIYPVIPLLCDALAEKDA

SEQ ID NO: 2593340 - protein, 23 aa, Entamoeba histolytica
EKSPLLLKYIAAESLYTLPEMNL

SEQ ID NO: 2593341 - protein, 21 aa, Entamoeba histolytica
EKTFIIASIRKNPLKIDFILN

SEQ ID NO: 2593342 - protein, 17 aa, Entamoeba histolytica
EKTKKISFFKIGGLLLV

SEQ ID NO: 2593343 - protein, 25 aa, Entamoeba histolytica
EKTKKSLLLMRRTKKSIPSTPGEVK

SEQ ID NO: 2593344 - protein, 47 aa, Entamoeba histolytica
EKVFPSWGIALIIILSIIVMIILIIILGIFIYFIMKHKTIDINIYKT

SEQ ID NO: 2593345 - protein, 23 aa, Entamoeba histolytica
EKVIHPIKYFIRAVLKNPVSAFF

SEQ ID NO: 2593346 - protein, 28 aa, Entamoeba histolytica
EKVWGVVKVLGFISLGVGVGVAIGVIGG

SEQ ID NO: 2593347 - protein, 24 aa, Entamoeba histolytica
EKYSDIFIPFLLIQGTNDESVTME

SEQ ID NO: 2593348 - protein, 22 aa, Entamoeba histolytica
ELAFNGLFGRENWLMQNLTNII

SEQ ID NO: 2593349 - protein, 17 aa, Entamoeba histolytica
ELANALEFCQNKMIVAL

SEQ ID NO: 2593350 - protein, 25 aa, Entamoeba histolytica
ELCGGLFYVYLFYKGELIRASQFIV

SEQ ID NO: 2593351 - protein, 19 aa, Entamoeba histolytica
ELDQLCWTVFWTSEDSRLK

SEQ ID NO: 2593352 - protein, 27 aa, Entamoeba histolytica
ELEIACGFFIFLFSNIFIWTYDRSYLT

SEQ ID NO: 2593353 - protein, 18 aa, Entamoeba histolytica
ELENFACLFFFVGTLVSY

SEQ ID NO: 2593354 - protein, 18 aa, Entamoeba histolytica
ELFIIPAVMTVLDPTSFE

SEQ ID NO: 2593355 - protein, 22 aa, Entamoeba histolytica
ELFMIDILYAFYAFNLKLQLRY

SEQ ID NO: 2593356 - protein, 18 aa, Entamoeba histolytica
ELIHLPSPLLKIAESCLR

SEQ ID NO: 2593357 - protein, 20 aa, Entamoeba histolytica
ELILTIVIVIPLIYKKVGYF

SEQ ID NO: 2593358 - protein, 22 aa, Entamoeba histolytica
ELIPILYLMLLIPLVIARFLVY

SEQ ID NO: 2593359 - protein, 24 aa, Entamoeba histolytica
ELIQELQVILFPSTTMPLSFEDFE

SEQ ID NO: 2593360 - protein, 19 aa, Entamoeba histolytica
ELITPIYIIAEAYGSFSCI

SEQ ID NO: 2593361 - protein, 22 aa, Entamoeba histolytica
ELIYSRKLLVISNIVLDICMIP

SEQ ID NO: 2593362 - protein, 20 aa, Entamoeba histolytica
ELKEIPDYIGYFGLDEDDNK

SEQ ID NO: 2593363 - protein, 23 aa, Entamoeba histolytica
ELKGCKQCYIGYVFDTEKKLCVS

SEQ ID NO: 2593364 - protein, 18 aa, Entamoeba histolytica
ELKPIMPPIGEGAFGMVF

SEQ ID NO: 2593365 - protein, 44 aa, Entamoeba histolytica
ELKPLTHLMFWSIFEGIVFLLWIISLLLLIIIKKVRKNVISKKG

SEQ ID NO: 2593366 - protein, 19 aa, Entamoeba histolytica
ELKPVMPPIGEGAFGLVFR

SEQ ID NO: 2593367 - protein, 17 aa, Entamoeba histolytica
ELKPVMPPIGEGAFGMV

SEQ ID NO: 2593368 - protein, 21 aa, Entamoeba histolytica
ELKYPYCWDLIKDFLVIFFLI

SEQ ID NO: 2593369 - protein, 32 aa, Entamoeba histolytica
ELLDKFRCPQIVYFYGAVFNPKRLTIVMEFAP

SEQ ID NO: 2593370 - protein, 20 aa, Entamoeba histolytica
ELLIIEHFIYTYFGHEGIIL

SEQ ID NO: 2593371 - protein, 18 aa, Entamoeba histolytica
ELLPFDLKIKIMEDIVVG

SEQ ID NO: 2593372 - protein, 24 aa, Entamoeba histolytica
ELLSQLYTFIIKNPIEKYHLLAPL

SEQ ID NO: 2593373 - protein, 17 aa, Entamoeba histolytica
ELMDLKGFYYTLAMQQF

SEQ ID NO: 2593374 - protein, 19 aa, Entamoeba histolytica
ELPLCYILRYLPSNPRLKH

SEQ ID NO: 2593375 - protein, 20 aa, Entamoeba histolytica
ELPLYSSLIQFITDKYYWTY

SEQ ID NO: 2593376 - protein, 29 aa, Entamoeba histolytica
ELPSVLMRLLDCPPLVLSVLQSLKIVLFS

SEQ ID NO: 2593377 - protein, 17 aa, Entamoeba histolytica
ELPYLLERKFNNMFRFD

SEQ ID NO: 2593378 - protein, 39 aa, Entamoeba histolytica
ELQSMIPIILIYPNPFMFIVWFIPQWIKSLKMIGVVKEK

SEQ ID NO: 2593379 - protein, 26 aa, Entamoeba histolytica
ELQTLVFNMFVFAQIFNLFNSRKVNG

SEQ ID NO: 2593380 - protein, 19 aa, Entamoeba histolytica
ELREFRKTFPSVQTILFTA

SEQ ID NO: 2593381 - protein, 24 aa, Entamoeba histolytica
ELREKVWAILLKRKPLNTDEYIQY

SEQ ID NO: 2593382 - protein, 23 aa, Entamoeba histolytica
ELRLLKIVLNWLIPEVFNECLYF

SEQ ID NO: 2593383 - protein, 18 aa, Entamoeba histolytica
ELRLNYHKSILQLASDRR

SEQ ID NO: 2593384 - protein, 30 aa, Entamoeba histolytica
ELRYKILHDAALGILFLHNKNLMHCDLKPQ

SEQ ID NO: 2593385 - protein, 34 aa, Entamoeba histolytica
ELSDNWNKDLLYFYYFLPFNITIDRNKKMYLIPK

SEQ ID NO: 2593386 - protein, 25 aa, Entamoeba histolytica
ELSSFIKCYIPILSTHQYYLNDIEC

SEQ ID NO: 2593387 - protein, 25 aa, Entamoeba histolytica
ELSSIPNIFLLLKSYCDKGKSNFVM

SEQ ID NO: 2593388 - protein, 40 aa, Entamoeba histolytica
ELTMDIITAVLFAFCILCVLLYAAYLTYAKKYRLLREDAT

SEQ ID NO: 2593389 - protein, 32 aa, Entamoeba histolytica
ELWFEHSGYIYLLKQLPRYSTLKLLHKILKSK

SEQ ID NO: 2593390 - protein, 18 aa, Entamoeba histolytica
ELYLIWKKGGYIGLVFDK

SEQ ID NO: 2593391 - protein, 23 aa, Entamoeba histolytica
EMAKKIRDILPEWVFGGLTEEQA

SEQ ID NO: 2593392 - protein, 20 aa, Entamoeba histolytica
EMALITICQYFTEKKPRLKE

SEQ ID NO: 2593393 - protein, 39 aa, Entamoeba histolytica
EMDFGRVINFQYIPPIYFAYFIFIALIEGLSITKVFMNQ

SEQ ID NO: 2593394 - protein, 22 aa, Entamoeba histolytica
EMFVGVFFFCLYLAQTTSLVLM

SEQ ID NO: 2593395 - protein, 20 aa, Entamoeba histolytica
EMKLLILGFVIFCICGILEC

SEQ ID NO: 2593396 - protein, 23 aa, Entamoeba histolytica
EMKMHLMEFPLKDKDFICMKCAT

SEQ ID NO: 2593397 - protein, 25 aa, Entamoeba histolytica
EMLNSFFDIFLYLGQNDKFIQAIYE

SEQ ID NO: 2593398 - protein, 19 aa, Entamoeba histolytica
EMLSIIQKYYRYAFKDMKG

SEQ ID NO: 2593399 - protein, 23 aa, Entamoeba histolytica
EMNQNIVMLWRLLKRESTIRNKL

SEQ ID NO: 2593400 - protein, 18 aa, Entamoeba histolytica
EMPLFEIGIVAFPLAIAG

SEQ ID NO: 2593401 - protein, 17 aa, Entamoeba histolytica
EMQKAIMAVIFAAQAVG

SEQ ID NO: 2593402 - protein, 29 aa, Entamoeba histolytica
EMRISFIETFAWDYSFNQTIPREFLIHPV

SEQ ID NO: 2593403 - protein, 23 aa, Entamoeba histolytica
EMTRIEGMFLYEVKQYKYDDFLY

SEQ ID NO: 2593404 - protein, 18 aa, Entamoeba histolytica
EMVFVIIHTIKLFLDVIN

SEQ ID NO: 2593405 - protein, 20 aa, Entamoeba histolytica
EMVLWVIIKVLLQSFPNYSI

SEQ ID NO: 2593406 - protein, 23 aa, Entamoeba histolytica
EMVNYPFQLIFEFMLEKNAKCLG

SEQ ID NO: 2593407 - protein, 29 aa, Entamoeba histolytica
ENCALEYIVFFFIFVICAFSNQYVSPLFH

SEQ ID NO: 2593408 - protein, 24 aa, Entamoeba histolytica
ENEIKRLIEWGRGLELIDEEEIKK

SEQ ID NO: 2593409 - protein, 25 aa, Entamoeba histolytica
ENELAELFLIIERIMALSKEGLMIH

SEQ ID NO: 2593410 - protein, 19 aa, Entamoeba histolytica
ENFSFVLTGIDGMRKYCYC

SEQ ID NO: 2593411 - protein, 25 aa, Entamoeba histolytica
ENFTDGMFTLPLYKESYEFAKKEAK

SEQ ID NO: 2593412 - protein, 19 aa, Entamoeba histolytica
ENFVLTCRFLMKFRTTQLT

SEQ ID NO: 2593413 - protein, 17 aa, Entamoeba histolytica
ENGKFFGMLQSCDNEFS

SEQ ID NO: 2593414 - protein, 18 aa, Entamoeba histolytica
ENHFLWIDISNPSKEVMV

SEQ ID NO: 2593415 - protein, 18 aa, Entamoeba histolytica
ENHSFFNPWSLKNEYKKL

SEQ ID NO: 2593416 - protein, 21 aa, Entamoeba histolytica
ENIIYSQWIEKILSPYDDVDM

SEQ ID NO: 2593417 - protein, 18 aa, Entamoeba histolytica
ENIPKLKHINIPVEVIHG

SEQ ID NO: 2593418 - protein, 17 aa, Entamoeba histolytica
ENIVITVTLKEVTSEPA

SEQ ID NO: 2593419 - protein, 20 aa, Entamoeba histolytica
ENIWLDRQIYGEGQGLFIAG

SEQ ID NO: 2593420 - protein, 25 aa, Entamoeba histolytica
ENKDIIQLLLKWIKSEVNEIVLPAV

SEQ ID NO: 2593421 - protein, 24 aa, Entamoeba histolytica
ENKGKFYILQGLIAGIKSFGVEER

SEQ ID NO: 2593422 - protein, 22 aa, Entamoeba histolytica
ENKILQLIVIQLLHLHAKVKDD

SEQ ID NO: 2593423 - protein, 25 aa, Entamoeba histolytica
ENKKEYVFLVDLLKKLIVFERKKRM

SEQ ID NO: 2593424 - protein, 23 aa, Entamoeba histolytica
ENKPYTYGIWIKVLSTINEWVLV

SEQ ID NO: 2593425 - protein, 24 aa, Entamoeba histolytica
ENKQYIFENILKFVLPQISNSSSS

SEQ ID NO: 2593426 - protein, 24 aa, Entamoeba histolytica
ENLFPSCLLGMIRLEGFNETTKWL

SEQ ID NO: 2593427 - protein, 17 aa, Entamoeba histolytica
ENLSLLSQLKTVKGVTL

SEQ ID NO: 2593428 - protein, 26 aa, Entamoeba histolytica
ENMAMLVVQHFLLRSVLRTIMDCIDM

SEQ ID NO: 2593429 - protein, 19 aa, Entamoeba histolytica
ENMCKQYYSTTCLNGKCVV

SEQ ID NO: 2593430 - protein, 38 aa, Entamoeba histolytica
ENNKYQWWNFIPLAYLRQFKYTYNIFFLVTIITQFIPA

SEQ ID NO: 2593431 - protein, 30 aa, Entamoeba histolytica
ENNTYVFDYFYYYLPFNFNIERDKKVYLSP

SEQ ID NO: 2593432 - protein, 27 aa, Entamoeba histolytica
ENNTYYYDNFYASLPFTIDIVDGNYII

SEQ ID NO: 2593433 - protein, 27 aa, Entamoeba histolytica
ENNWWSILQFTIWSIIITIIMSSITIT

SEQ ID NO: 2593434 - protein, 22 aa, Entamoeba histolytica
ENPEFFLRILKSGGMLGFFAMD

SEQ ID NO: 2593435 - protein, 20 aa, Entamoeba histolytica
ENPMNYLVLHSINYTPKLYS

SEQ ID NO: 2593436 - protein, 22 aa, Entamoeba histolytica
ENRFFHVPFISLGGIDFLDKKM

SEQ ID NO: 2593437 - protein, 34 aa, Entamoeba histolytica
ENRIMFHFFERFLLCNNLYLTTCFISLSYMFNPT

SEQ ID NO: 2593438 - protein, 34 aa, Entamoeba histolytica
ENSVDWLNYLWEASLFIIPCRYQIQLEIFKQIVN

SEQ ID NO: 2593439 - protein, 42 aa, Entamoeba histolytica
ENVFLSFIRRYFNKSYLGLIIVITFLILITVWGSFQNSIETT

SEQ ID NO: 2593440 - protein, 29 aa, Entamoeba histolytica
ENYAENNYLFLKLTTTATLPTFPTAFKGV

SEQ ID NO: 2593441 - protein, 18 aa, Entamoeba histolytica
ENYYGKFRIEGGKIDFSG

SEQ ID NO: 2593442 - protein, 25 aa, Entamoeba histolytica
EPEVKILIQNLIKTILLSLQQSYFN

SEQ ID NO: 2593443 - protein, 34 aa, Entamoeba histolytica
EPEYLIISPKRKATITIYLTLFCTIKLHGMKIPS

SEQ ID NO: 2593444 - protein, 18 aa, Entamoeba histolytica
EPFVFNVVILFVMLIRSA

SEQ ID NO: 2593445 - protein, 21 aa, Entamoeba histolytica
EPFVPLAPKNFFKPISEVIEM

SEQ ID NO: 2593446 - protein, 25 aa, Entamoeba histolytica
EPIHQILVWYLYDSLKYPLLSLFIA

SEQ ID NO: 2593447 - protein, 30 aa, Entamoeba histolytica
EPKTTLIGYPFFIVYIIAAGLGIFIEGRFE

SEQ ID NO: 2593448 - protein, 17 aa, Entamoeba histolytica
EPMDLEAPILTGRQAHV

SEQ ID NO: 2593449 - protein, 17 aa, Entamoeba histolytica
EPMKLMRKPRKPTEIVV

SEQ ID NO: 2593450 - protein, 25 aa, Entamoeba histolytica
EPNNLLLFIITTLMIYLKANKKIVN

SEQ ID NO: 2593451 - protein, 29 aa, Entamoeba histolytica
EPQDKQIYQFLLHIALKQHKYSDAIRLML

SEQ ID NO: 2593452 - protein, 17 aa, Entamoeba histolytica
EPQIPKTSQLQEGDNVP

SEQ ID NO: 2593453 - protein, 27 aa, Entamoeba histolytica
EPRLAVAVVLLFLYLGIFAGDISQLLT

SEQ ID NO: 2593454 - protein, 21 aa, Entamoeba histolytica
EPSLFIIHFTDLIEYFYDQIT

SEQ ID NO: 2593455 - protein, 24 aa, Entamoeba histolytica
EPSYCDYNYFLDSITLNCIKNSCV

SEQ ID NO: 2593456 - protein, 19 aa, Entamoeba histolytica
EPYFRGCYPCDPGTYRDEQ

SEQ ID NO: 2593457 - protein, 24 aa, Entamoeba histolytica
EPYLTNKLTIWYKIRCINIDIDKA

SEQ ID NO: 2593458 - protein, 24 aa, Entamoeba histolytica
EPYPLNEYPYPWSISKFVCVGRRL

SEQ ID NO: 2593459 - protein, 18 aa, Entamoeba histolytica
EPYVIILDGLYSLYSLEI

SEQ ID NO: 2593460 - protein, 35 aa, Entamoeba histolytica; identical to SEQ ID NO: 2396436

SEQ ID NO: 2593461 - protein, 31 aa, Entamoeba histolytica; identical to SEQ ID NO: 2396437

SEQ ID NO: 2593462 - protein, 24 aa, Entamoeba histolytica
EQCSSLLFWAYLTSLLTLSVGMIG

SEQ ID NO: 2593463 - protein, 24 aa, Entamoeba histolytica
EQENLFRAFFDFDNSNPPPSFKIS

SEQ ID NO: 2593464 - protein, 30 aa, Entamoeba histolytica
EQERQLFTIPRWFVLGIICVVSIFILLLWM

SEQ ID NO: 2593465 - protein, 26 aa, Entamoeba histolytica
EQFKSLLLVYGPFVSSIKLFNGIQGY

SEQ ID NO: 2593466 - protein, 30 aa, Entamoeba histolytica
EQGKPNALFFDFYYSLPFKVAISNTKQMYL

SEQ ID NO: 2593467 - protein, 20 aa, Entamoeba histolytica
EQILPLLMSITLEQQERHIL

SEQ ID NO: 2593468 - protein, 30 aa, Entamoeba histolytica
EQITFYNLTLPYSLHYFLKFLAQNIEYKHY

SEQ ID NO: 2593469 - protein, 24 aa, Entamoeba histolytica
EQITLHIPYTTRTIPFISANSIYL

SEQ ID NO: 2593470 - protein, 28 aa, Entamoeba histolytica
EQKEWEMWMWFGIITAVIVIFCTLVMGT

SEQ ID NO: 2593471 - protein, 22 aa, Entamoeba histolytica
EQLMSDTFLLQLASYKTEELLQ

SEQ ID NO: 2593472 - protein, 24 aa, Entamoeba histolytica
EQNDKFLLRVQPPLVALEGGYACE

SEQ ID NO: 2593473 - protein, 24 aa, Entamoeba histolytica
EQPLHSYAFYLPKSYEISSLVFLN

SEQ ID NO: 2593474 - protein, 34 aa, Entamoeba histolytica
ERAGDEIYYALNILYFVSLVLDPYIPEFGKKVRE

SEQ ID NO: 2593475 - protein, 28 aa, Entamoeba histolytica
EREINDFIVYWIVKLNKKYYKVTICDST

SEQ ID NO: 2593476 - protein, 22 aa, Entamoeba histolytica
ERFINSLKELTKLRSPLLINII

SEQ ID NO: 2593477 - protein, 17 aa, Entamoeba histolytica
ERFNQPWMIPQFVIEGN

SEQ ID NO: 2593478 - protein, 28 aa, Entamoeba histolytica
ERIGFSRILFYLFSDYFKELFDKKQINY

SEQ ID NO: 2593479 - protein, 24 aa, Entamoeba histolytica
ERIRSPYIINFIGSVITVDTLCLV

SEQ ID NO: 2593480 - protein, 21 aa, Entamoeba histolytica
ERKLSIFGLGLAYAGTRKTEM

SEQ ID NO: 2593481 - protein, 22 aa, Entamoeba histolytica
ERKRRNMFSQLKLGELPPQQQL

SEQ ID NO: 2593482 - protein, 19 aa, Entamoeba histolytica
ERTESWFFSLLEASQRKEF

SEQ ID NO: 2593483 - protein, 24 aa, Entamoeba histolytica
ERVMEMLKLLPYSLKIHFVSGLER

SEQ ID NO: 2593484 - protein, 26 aa, Entamoeba histolytica
ESCDFMQFMRPFDTKLKFLITSIQSG

SEQ ID NO: 2593485 - protein, 23 aa, Entamoeba histolytica
ESDVFPLIQFPELSVLLRKSLLT

SEQ ID NO: 2593486 - protein, 27 aa, Entamoeba histolytica
ESDVFSFSIVFWELFYGIHAFSDLKTT

SEQ ID NO: 2593487 - protein, 22 aa, Entamoeba histolytica
ESFTMYLTKFINFPMNTCFELA

SEQ ID NO: 2593488 - protein, 30 aa, Entamoeba histolytica
ESHVVAVMFFFLISLTIIGGISLIILYLPN

SEQ ID NO: 2593489 - protein, 18 aa, Entamoeba histolytica
ESIFLYIINSCCEKEFIM

SEQ ID NO: 2593490 - protein, 19 aa, Entamoeba histolytica
ESIKSLFSLLLKSSPNESQ

SEQ ID NO: 2593491 - protein, 18 aa, Entamoeba histolytica
ESIMFLVIDLFQNKFRFV

SEQ ID NO: 2593492 - protein, 26 aa, Entamoeba histolytica
ESINSFLMLLPFQSFSNKSLIDTYLS

SEQ ID NO: 2593493 - protein, 23 aa, Entamoeba histolytica
ESIQPISLPEILKLDPNGGWGDQ

SEQ ID NO: 2593494 - protein, 33 aa, Entamoeba histolytica
ESIQQAFLIALLNKFGSFILERPIKRSKVTFQT

SEQ ID NO: 2593495 - protein, 26 aa, Entamoeba histolytica
ESISIINALYPLRSLDLCMYYEKSNI

SEQ ID NO: 2593496 - protein, 21 aa, Entamoeba histolytica
ESKCIKLIQKYNLLIECYSDN

SEQ ID NO: 2593497 - protein, 24 aa, Entamoeba histolytica
ESKITCLLYHDYYSVCTDKEDECN

SEQ ID NO: 2593498 - protein, 31 aa, Entamoeba histolytica
ESKQPPPEKEAKPLEIPPTHEENTQNQPHQD

SEQ ID NO: 2593499 - protein, 38 aa, Entamoeba histolytica
ESKYLNIKLFIIIPTHNDFLFISLLQNGTTTLDNTLIY

SEQ ID NO: 2593500 - protein, 21 aa, Entamoeba histolytica
ESLATFIYKLVNFETGTFSTN

SEQ ID NO: 2593501 - protein, 23 aa, Entamoeba histolytica
ESLCLPIFMNLYNNIMELPIQPK

SEQ ID NO: 2593502 - protein, 24 aa, Entamoeba histolytica
ESLILKIIIYVIPIFFGVLMMTFY

SEQ ID NO: 2593503 - protein, 20 aa, Entamoeba histolytica
ESLIYFSYALDEIIEIIIQN

SEQ ID NO: 2593504 - protein, 20 aa, Entamoeba histolytica
ESLIYFSYASDEIIEIIIQN

SEQ ID NO: 2593505 - protein, 24 aa, Entamoeba histolytica
ESLKRMSLFNRILYLFVISIEEKH

SEQ ID NO: 2593506 - protein, 30 aa, Entamoeba histolytica
ESLPYYIDKSYIILTYVPSAELFLLNHQKT

SEQ ID NO: 2593507 - protein, 19 aa, Entamoeba histolytica
ESLSLIYQFLLKILTSSVS

SEQ ID NO: 2593508 - protein, 23 aa, Entamoeba histolytica
ESNEFLMILLLRLSPLFPFPISN

SEQ ID NO: 2593509 - protein, 28 aa, Entamoeba histolytica
ESNKHNIIMLFVLIVFSCICSAYTYDEN

SEQ ID NO: 2593510 - protein, 24 aa, Entamoeba histolytica
ESPKQLIWRCLLNAAQGIQYLHQR

SEQ ID NO: 2593511 - protein, 27 aa, Entamoeba histolytica
ESQIQGTLLRLLISMGYNIVLKKPKMA

SEQ ID NO: 2593512 - protein, 25 aa, Entamoeba histolytica
ESRNGLFLPKLPPKIKEINETTSNK

SEQ ID NO: 2593513 - protein, 28 aa, Entamoeba histolytica
ESSKDYCYWIDLIGIVLPFTVSVKQTHE

SEQ ID NO: 2593514 - protein, 17 aa, Entamoeba histolytica
ESSMKLFKLDGIELQEI

SEQ ID NO: 2593515 - protein, 24 aa, Entamoeba histolytica
ESSQFTMINLLFKMTDKIISIVCD

SEQ ID NO: 2593516 - protein, 24 aa, Entamoeba histolytica
ESSTTIQFFKFINSIMKVNVITGQ

SEQ ID NO: 2593517 - protein, 24 aa, Entamoeba histolytica
ESSVYLLDKYIPIAASFGGMCISL

SEQ ID NO: 2593518 - protein, 17 aa, Entamoeba histolytica
ESTEISVFPYVTDLLTC

SEQ ID NO: 2593519 - protein, 25 aa, Entamoeba histolytica
ESTFFHIDFGYLLNERPKFDANLFA

SEQ ID NO: 2593520 - protein, 27 aa, Entamoeba histolytica
ESVPLLPHIWMGVYGYNLRISVGERYR

SEQ ID NO: 2593521 - protein, 28 aa, Entamoeba histolytica
ESVQQYFKLVVGTLYLNKDIDVGKYCEL

SEQ ID NO: 2593522 - protein, 21 aa, Entamoeba histolytica
ESWRMLIVLLPFIIAGTVAIS

SEQ ID NO: 2593523 - protein, 34 aa, Entamoeba histolytica
ESWVHFYDGYLTLNQIFFDKWRFHELKDLSKLKR

SEQ ID NO: 2593524 - protein, 24 aa, Entamoeba histolytica
ETAELFRDIFFHTAFWMRTSGEVF

SEQ ID NO: 2593525 - protein, 29 aa, Entamoeba histolytica
ETCDVSYQMLYIPFYSLSKKAQSIVNRKL

SEQ ID NO: 2593526 - protein, 24 aa, Entamoeba histolytica
ETDALKVFILLNLNRKDLAAAVVR

SEQ ID NO: 2593527 - protein, 24 aa, Entamoeba histolytica
ETGSKTLLVVMRLPKENEIKVEEY

SEQ ID NO: 2593528 - protein, 25 aa, Entamoeba histolytica
ETIFYSLYITNECQLIFSVFPNISN

SEQ ID NO: 2593529 - protein, 19 aa, Entamoeba histolytica
ETILRVYNILFQCVILPSH

SEQ ID NO: 2593530 - protein, 17 aa, Entamoeba histolytica
ETKNILVVLTSIELLIL

SEQ ID NO: 2593531 - protein, 28 aa, Entamoeba histolytica
ETKSINGMYLYFMVNWTTTVNGKHKQIA

SEQ ID NO: 2593532 - protein, 24 aa, Entamoeba histolytica
ETKTWNWILVIGHIISIIFIFIIY

SEQ ID NO: 2593533 - protein, 27 aa, Entamoeba histolytica
ETLACLIYALFFTFLFLLPLLICERYL

SEQ ID NO: 2593534 - protein, 24 aa, Entamoeba histolytica
ETLYGMCYLLYGLIKTQWSQVENK

SEQ ID NO: 2593535 - protein, 22 aa, Entamoeba histolytica
ETMCKPYYSATCLNGQCVVQAV

SEQ ID NO: 2593536 - protein, 19 aa, Entamoeba histolytica
ETMCKQYYSTTCLNGKCVV

SEQ ID NO: 2593537 - protein, 33 aa, Entamoeba histolytica; identical to SEQ ID NO: 2396510

SEQ ID NO: 2593538 - protein, 25 aa, Entamoeba histolytica
ETNTAQMDIFLNDEIRYVFVYGTGG

SEQ ID NO: 2593539 - protein, 25 aa, Entamoeba histolytica
ETNYILYNELCFSMNLFYCAETNGV

SEQ ID NO: 2593540 - protein, 31 aa, Entamoeba histolytica
ETQKFQIMILLNIFVMVYYIQSWVVLSSESN

SEQ ID NO: 2593541 - protein, 36 aa, Entamoeba histolytica
ETSSGVCLYILLWLSLLLIIMFRYKKLTLEIQEEWR

SEQ ID NO: 2593542 - protein, 17 aa, Entamoeba histolytica
ETVCMMLFIFHNLSRVS

SEQ ID NO: 2593543 - protein, 32 aa, Entamoeba histolytica; identical to SEQ ID NO: 2396523

SEQ ID NO: 2593544 - protein, 17 aa, Entamoeba histolytica
ETYLLISQLLEKTIKSI

SEQ ID NO: 2593545 - protein, 32 aa, Entamoeba histolytica
EVEALFYLPFHPILLTLFVLPTILLSIFQLFY

SEQ ID NO: 2593546 - protein, 22 aa, Entamoeba histolytica
EVELKVILAKMYAKRGWCDDCL

SEQ ID NO: 2593547 - protein, 18 aa, Entamoeba histolytica
EVEWERKTCPCSGDKCII

SEQ ID NO: 2593548 - protein, 32 aa, Entamoeba histolytica
EVFILFMIVYVFSLLYIYFWSNGYAVVASTLI

SEQ ID NO: 2593549 - protein, 35 aa, Entamoeba histolytica
EVFVAYLPLAHIFELCLEFCILSFFGSIGYANART

SEQ ID NO: 2593550 - protein, 25 aa, Entamoeba histolytica
EVGKVFTCIAYFNAIRRPFMNFGYF

SEQ ID NO: 2593551 - protein, 35 aa, Entamoeba histolytica
EVHWYSIYICSALCLFLLTVLVFASYKRVKRIITR

SEQ ID NO: 2593552 - protein, 26 aa, Entamoeba histolytica
EVIDSKTVGILIRRSFHNTGVDIVRI

SEQ ID NO: 2593553 - protein, 35 aa, Entamoeba histolytica
EVIHTQIQSKQHKIMYNLYKAELKGEVTTQITDEV

SEQ ID NO: 2593554 - protein, 17 aa, Entamoeba histolytica
EVLFSPLTEILMYDLKL

SEQ ID NO: 2593555 - protein, 24 aa, Entamoeba histolytica
EVLHPIFLRIVFALDDLLTYQTKD

SEQ ID NO: 2593556 - protein, 29 aa, Entamoeba histolytica
EVPQSYNIWLLICTAIFGALIIITATSSI

SEQ ID NO: 2593557 - protein, 27 aa, Entamoeba histolytica
EVPQTRNLFYLFKDRIIFIESFSEVVK

SEQ ID NO: 2593558 - protein, 37 aa, Entamoeba histolytica
EVQYYSIEWIIILIILTITIIILLSIVTVGVLFIKKQ

SEQ ID NO: 2593559 - protein, 27 aa, Entamoeba histolytica
EVRPSLKWYFMIFFGPNVETMTNSLPK

SEQ ID NO: 2593560 - protein, 21 aa, Entamoeba histolytica
EVTDEVYLVYGPKGSILNVPQ

SEQ ID NO: 2593561 - protein, 22 aa, Entamoeba histolytica
EVTTFLLFQFLAGISYSMLCAL

SEQ ID NO: 2593562 - protein, 29 aa, Entamoeba histolytica
EVVFKVIFFIVFFILFYIANRHSCNNNGN

SEQ ID NO: 2593563 - protein, 26 aa, Entamoeba histolytica
EVVLMICHMFCCSPLQFGISVSGLLV

SEQ ID NO: 2593564 - protein, 22 aa, Entamoeba histolytica
EVYMMYFPLIFYYIIGNRIIET

SEQ ID NO: 2593565 - protein, 23 aa, Entamoeba histolytica
EWGIWLMIVIMLVVGLVGGSGYV

SEQ ID NO: 2593566 - protein, 31 aa, Entamoeba histolytica
EWGVIIIIGCVLCLLWAFYKSKKEAYRQKVL

SEQ ID NO: 2593567 - protein, 19 aa, Entamoeba histolytica
EWKIIFVDGFIRSTKFEYG

SEQ ID NO: 2593568 - protein, 27 aa, Entamoeba histolytica
EYAKYGSLFHLIFKQGMKKLPKEAVRI

SEQ ID NO: 2593569 - protein, 31 aa, Entamoeba histolytica
EYCKSLIDTVFFVAPYVLYIDIQMTVKTIAD

SEQ ID NO: 2593570 - protein, 20 aa, Entamoeba histolytica
EYCPFGKLIGKFKTLRQFCQ

SEQ ID NO: 2593571 - protein, 25 aa, Entamoeba histolytica
EYETVFIRYPSIYVLPTIQESIPYQ

SEQ ID NO: 2593572 - protein, 24 aa, Entamoeba histolytica
EYFDSYFPYYINTLSMFSICPNDK

SEQ ID NO: 2593573 - protein, 18 aa, Entamoeba histolytica
EYGILEESILGAGSYYSY

SEQ ID NO: 2593574 - protein, 29 aa, Entamoeba histolytica
EYHCTKCNLGYWLRKYSSKVSLCEKCPTG

SEQ ID NO: 2593575 - protein, 21 aa, Entamoeba histolytica
EYIFTFSLLIFIVLSMIYGIK

SEQ ID NO: 2593576 - protein, 27 aa, Entamoeba histolytica
EYKIDKQIYLPFILKRIRELANTYLAL

SEQ ID NO: 2593577 - protein, 27 aa, Entamoeba histolytica
EYKSLNAIILLIRIFQQIGDFPFNSFF

SEQ ID NO: 2593578 - protein, 40 aa, Entamoeba histolytica
EYKYLNNIIFVSCFVGIYALYYFIVLVVTLIKSNKISKVM

SEQ ID NO: 2593579 - protein, 24 aa, Entamoeba histolytica
EYLKKEILIFFIEKVPQINNDEIA

SEQ ID NO: 2593580 - protein, 32 aa, Entamoeba histolytica; identical to SEQ ID NO: 2396574

SEQ ID NO: 2593581 - protein, 18 aa, Entamoeba histolytica
EYPMFHPLSFFKRNYQES

SEQ ID NO: 2593582 - protein, 28 aa, Entamoeba histolytica
EYQGIKIRSLYFKALLRQDPGWFDCHKT

SEQ ID NO: 2593583 - protein, 26 aa, Entamoeba histolytica
EYSFTCMYPLFFQVIAHLAVIFLVTT

SEQ ID NO: 2593584 - protein, 25 aa, Entamoeba histolytica
FAAALFFEICFFFTIPSASIHFVVL

SEQ ID NO: 2593585 - protein, 17 aa, Entamoeba histolytica
FACIEIPIYIYILIPIF

SEQ ID NO: 2593586 - protein, 18 aa, Entamoeba histolytica
FAFLFEYIGEKSKDYIYP

SEQ ID NO: 2593587 - protein, 21 aa, Entamoeba histolytica
FAFYLIINILLLLLGQPIILM

SEQ ID NO: 2593588 - protein, 20 aa, Entamoeba histolytica
FAGIIGLYGLIVCILLFINV

SEQ ID NO: 2593589 - protein, 18 aa, Entamoeba histolytica
FAICMLEVYLRKSPYPRE

SEQ ID NO: 2593590 - protein, 18 aa, Entamoeba histolytica
FAILAFFIATLITKEFYA

SEQ ID NO: 2593591 - protein, 26 aa, Entamoeba histolytica
FAISFFLFYILIIFDSLRKPINKMST

SEQ ID NO: 2593592 - protein, 17 aa, Entamoeba histolytica
FAITMYEILNWKTPYDT

SEQ ID NO: 2593593 - protein, 25 aa, Entamoeba histolytica
FAKSIYPYIFNGILFFEECPLKDQH

SEQ ID NO: 2593594 - protein, 20 aa, Entamoeba histolytica
FALFQRWSDQYLLFESLLNN

SEQ ID NO: 2593595 - protein, 19 aa, Entamoeba histolytica
FALGIAFYYDWKVSLAVMA

SEQ ID NO: 2593596 - protein, 29 aa, Entamoeba histolytica
FALSCIACWIVFIFQPTFKPTVSTLMQRN

SEQ ID NO: 2593597 - protein, 27 aa, Entamoeba histolytica
FARIFQTIFLPLIIFNAGFTMKKRNFF

SEQ ID NO: 2593598 - protein, 17 aa, Entamoeba histolytica
FASSRISIYILFGIILI

SEQ ID NO: 2593599 - protein, 20 aa, Entamoeba histolytica
FASYWSIHLLSFSIAIPYIT

SEQ ID NO: 2593600 - protein, 18 aa, Entamoeba histolytica
FCCKWIFTLSMRVRNGLI

SEQ ID NO: 2593601 - protein, 17 aa, Entamoeba histolytica
FCCMLYLSSIRGIPISQ

SEQ ID NO: 2593602 - protein, 23 aa, Entamoeba histolytica
FCFSVIAIFPFDIVRYIGIGCTI

SEQ ID NO: 2593603 - protein, 23 aa, Entamoeba histolytica
FCGYTYLSLYIAGELRIFSDRPE

SEQ ID NO: 2593604 - protein, 22 aa, Entamoeba histolytica
FCIGLFFSFLGDLLLLMDGLQW

SEQ ID NO: 2593605 - protein, 18 aa, Entamoeba histolytica
FCIPIIQLIGLSLGPGIW

SEQ ID NO: 2593606 - protein, 32 aa, Entamoeba histolytica; identical to SEQ ID NO: 2396602

SEQ ID NO: 2593607 - protein, 18 aa, Entamoeba histolytica
FCNKLFPLLQQIMKLMTD

SEQ ID NO: 2593608 - protein, 22 aa, Entamoeba histolytica
FCNQCLNGYYLLNSKCHKCSLP

SEQ ID NO: 2593609 - protein, 25 aa, Entamoeba histolytica
FCPNGIDAVWLWVNGSDPVFHKALE

SEQ ID NO: 2593610 - protein, 19 aa, Entamoeba histolytica
FCQLSLHLNKLKLLQLIKK

SEQ ID NO: 2593611 - protein, 25 aa, Entamoeba histolytica
FCSIFSFIEYFLPPAIPKPRSYGVF

SEQ ID NO: 2593612 - protein, 17 aa, Entamoeba histolytica
FCSSCEDGFFPMGGNCI

SEQ ID NO: 2593613 - protein, 26 aa, Entamoeba histolytica
FCTILMIVILLFIFFVRSFGSKRVVL

SEQ ID NO: 2593614 - protein, 32 aa, Entamoeba histolytica
FCVVTIIPGLILLWKLFVKPKLFKSSPQKYRG

SEQ ID NO: 2593615 - protein, 17 aa, Entamoeba histolytica
FCYSACSLVTKGLKEWG

SEQ ID NO: 2593616 - protein, 26 aa, Entamoeba histolytica
FDEKMELLLTLLVEKLQIIFEKFHQG

SEQ ID NO: 2593617 - protein, 28 aa, Entamoeba histolytica
FDFYSAQLWKLYFPMNLKLKASGEHDKI

SEQ ID NO: 2593618 - protein, 28 aa, Entamoeba histolytica
FDHCHITYIFSLLFYSMLVLPMSFMEIA

SEQ ID NO: 2593619 - protein, 40 aa, Entamoeba histolytica
FDITKKLAGYLMIFSIILALLLLLILSFIQPSYSCLLSSR

SEQ ID NO: 2593620 - protein, 24 aa, Entamoeba histolytica
FDLNYHSPSLFTLPHCPCSGNSCT

SEQ ID NO: 2593621 - protein, 24 aa, Entamoeba histolytica
FDNIMKFVMYLLSANSAEIWTMMI

SEQ ID NO: 2593622 - protein, 25 aa, Entamoeba histolytica
FDNIRKFLQFQLTVNVSAVGLCIIG

SEQ ID NO: 2593623 - protein, 33 aa, Entamoeba histolytica; identical to SEQ ID NO: 2396620

SEQ ID NO: 2593624 - protein, 26 aa, Entamoeba histolytica
FDQWQDEDIIFIFKIFTKLICSEENY

SEQ ID NO: 2593625 - protein, 21 aa, Entamoeba histolytica
FDSHSVISYIDLPWTMNNEFC

SEQ ID NO: 2593626 - protein, 17 aa, Entamoeba histolytica
FDSILKKYIPIQCIPNF

SEQ ID NO: 2593627 - protein, 25 aa, Entamoeba histolytica
FDTEHPFYILLEKREYVLFLSGMVS

SEQ ID NO: 2593628 - protein, 25 aa, Entamoeba histolytica
FDYKQYQMYIGITGFIIITTILLLI

SEQ ID NO: 2593629 - protein, 25 aa, Entamoeba histolytica
FEHLLTSISFIQPFTAQFLLSHYSL

SEQ ID NO: 2593630 - protein, 24 aa, Entamoeba histolytica
FEHPMFLTFMMFVGMMLCLFIHII

SEQ ID NO: 2593631 - protein, 18 aa, Entamoeba histolytica
FEIGIKYTKHTIPIVVKV

SEQ ID NO: 2593632 - protein, 19 aa, Entamoeba histolytica
FEITLLQIVVNLKDTKILT

SEQ ID NO: 2593633 - protein, 25 aa, Entamoeba histolytica
FEKEMSIGLLWFIDNNDFIKFKKSL

SEQ ID NO: 2593634 - protein, 27 aa, Entamoeba histolytica
FEKNKKIFVINILYDLCLEMGYFFDAR

SEQ ID NO: 2593635 - protein, 27 aa, Entamoeba histolytica
FEKNKRIFVINLLYDLCLEKGYFFDAR

SEQ ID NO: 2593636 - protein, 22 aa, Entamoeba histolytica
FEKNVIFPPPEVFFICDNCTDS

SEQ ID NO: 2593637 - protein, 20 aa, Entamoeba histolytica
FELFIIIKCTTKISDKLMII

SEQ ID NO: 2593638 - protein, 17 aa, Entamoeba histolytica
FELKKMEMTDDALGEVC

SEQ ID NO: 2593639 - protein, 18 aa, Entamoeba histolytica
FEMVIALCMYFFTKDDFI

SEQ ID NO: 2593640 - protein, 20 aa, Entamoeba histolytica
FENIPKLKHINIPVEVIHGQ

SEQ ID NO: 2593641 - protein, 24 aa, Entamoeba histolytica
FENNLIFFLMKLHQHLIHKVKRLY

SEQ ID NO: 2593642 - protein, 18 aa, Entamoeba histolytica
FEPKYCQLIFVIDGRRDR

SEQ ID NO: 2593643 - protein, 18 aa, Entamoeba histolytica
FEPRFGITIIQIASSTKL

SEQ ID NO: 2593644 - protein, 17 aa, Entamoeba histolytica
FEQFVCSKLRVLYKLNW

SEQ ID NO: 2593645 - protein, 28 aa, Entamoeba histolytica
FEQKKTLLFFILLQVLSNVLYLVAEENE

SEQ ID NO: 2593646 - protein, 24 aa, Entamoeba histolytica
FEQQLVITIIVISTIFLLCCVCCI

SEQ ID NO: 2593647 - protein, 18 aa, Entamoeba histolytica
FEQYLYIIDTVDSAFECI

SEQ ID NO: 2593648 - protein, 18 aa, Entamoeba histolytica
FERKISLFSLSVCSVLMV

SEQ ID NO: 2593649 - protein, 25 aa, Entamoeba histolytica
FESDIVFLVLLLFALGFSLTITITF

SEQ ID NO: 2593650 - protein, 20 aa, Entamoeba histolytica
FESFFTGYLMFYILAVFNSV

SEQ ID NO: 2593651 - protein, 19 aa, Entamoeba histolytica
FETYVYKDILLSPPAIKGK

SEQ ID NO: 2593652 - protein, 20 aa, Entamoeba histolytica
FEYLLESLGFAFVLPMESSQ

SEQ ID NO: 2593653 - protein, 28 aa, Entamoeba histolytica
FEYSTLLLIILIFIVCLSLPIVKIIRVI

SEQ ID NO: 2593654 - protein, 26 aa, Entamoeba histolytica
FFCCGCSFLFIFFFDRVVVTHGGHAS

SEQ ID NO: 2593655 - protein, 18 aa, Entamoeba histolytica
FFDTTIVHMAPLNPLGSF

SEQ ID NO: 2593656 - protein, 30 aa, Entamoeba histolytica
FFDVIEGLLYFFLYSWALYHLAMTYNKVTI

SEQ ID NO: 2593657 - protein, 25 aa, Entamoeba histolytica
FFFDLHIVCFFIPLGIYFMLKNITD

SEQ ID NO: 2593658 - protein, 28 aa, Entamoeba histolytica
FFFSACFSLLFFYCKNRFGWFVSYKQTY

SEQ ID NO: 2593659 - protein, 18 aa, Entamoeba histolytica
FFGLFPLSLLELLQALTI

SEQ ID NO: 2593660 - protein, 18 aa, Entamoeba histolytica
FFIAFSFAYETKPVLLIL

SEQ ID NO: 2593661 - protein, 18 aa, Entamoeba histolytica
FFIHCCLSHLLNRNPPCL

SEQ ID NO: 2593662 - protein, 20 aa, Entamoeba histolytica
FFIILVLITFCISILTTFTF

SEQ ID NO: 2593663 - protein, 18 aa, Entamoeba histolytica
FFIKLLPNRKLAGEILDI

SEQ ID NO: 2593664 - protein, 31 aa, Entamoeba histolytica; identical to SEQ ID NO: 2396671

SEQ ID NO: 2593665 - protein, 29 aa, Entamoeba histolytica
FFISMKFIPFMWIIYIIGSYFAVPLCNNF

SEQ ID NO: 2593666 - protein, 29 aa, Entamoeba histolytica
FFKWANRILPILLYFSLLTLTILAIRFVL

SEQ ID NO: 2593667 - protein, 22 aa, Entamoeba histolytica
FFKWNWEFELWYLNDDGTNDKL

SEQ ID NO: 2593668 - protein, 19 aa, Entamoeba histolytica
FFLFYKTSSRICTVMTCDE

SEQ ID NO: 2593669 - protein, 17 aa, Entamoeba histolytica
FFLVTIITQFIPACKVG

SEQ ID NO: 2593670 - protein, 19 aa, Entamoeba histolytica
FFMMSGEFLTYRVRKLSFY

SEQ ID NO: 2593671 - protein, 30 aa, Entamoeba histolytica
FFNCCLILLQLFVAGLIVLLLDELLSNGYG

SEQ ID NO: 2593672 - protein, 27 aa, Entamoeba histolytica
FFNETLVSITFPFPLKISHHYTVLFQQ

SEQ ID NO: 2593673 - protein, 17 aa, Entamoeba histolytica
FFREGFISEIMVLVHNF

SEQ ID NO: 2593674 - protein, 17 aa, Entamoeba histolytica
FFSDSLTILRWCFEYHK

SEQ ID NO: 2593675 - protein, 18 aa, Entamoeba histolytica
FFSMILFFFPTVLYCIST

SEQ ID NO: 2593676 - protein, 18 aa, Entamoeba histolytica
FFTGYGSKLLKIIRKGYQ

SEQ ID NO: 2593677 - protein, 17 aa, Entamoeba histolytica
FFTYEYVFASSLFVFWK

SEQ ID NO: 2593678 - protein, 17 aa, Entamoeba histolytica
FFVYFSYIMMLFNNFKD

SEQ ID NO: 2593679 - protein, 26 aa, Entamoeba histolytica
FGALTVGALFYPFLTPSAIEICLCGV

SEQ ID NO: 2593680 - protein, 23 aa, Entamoeba histolytica
FGFFTQGAFYVRSPFGNKTWQSL

SEQ ID NO: 2593681 - protein, 43 aa, Entamoeba histolytica; identical to SEQ ID NO: 2396694

SEQ ID NO: 2593682 - protein, 22 aa, Entamoeba histolytica
FGFIHLIFMVNFYQTVMYIHSL

SEQ ID NO: 2593683 - protein, 19 aa, Entamoeba histolytica
FGFVPHPMYFGGALLFISS

SEQ ID NO: 2593684 - protein, 17 aa, Entamoeba histolytica
FGGFSDIILILINNGRA

SEQ ID NO: 2593685 - protein, 19 aa, Entamoeba histolytica
FGGIVDRYYYDCALFMVHS

SEQ ID NO: 2593686 - protein, 25 aa, Entamoeba histolytica
FGISGFPTLKFFRKGTTEPIEYEGG

SEQ ID NO: 2593687 - protein, 22 aa, Entamoeba histolytica
FGISLFHQMIFKSNLQFQILND

SEQ ID NO: 2593688 - protein, 25 aa, Entamoeba histolytica
FGIVMWEILTRKRPYSKLTPYQIML

SEQ ID NO: 2593689 - protein, 29 aa, Entamoeba histolytica
FGKAYLLSNKKLMRFCPNGIKLNKTVICT

SEQ ID NO: 2593690 - protein, 31 aa, Entamoeba histolytica; identical to SEQ ID NO: 2396705

SEQ ID NO: 2593691 - protein, 17 aa, Entamoeba histolytica
FGLMKFLSKVEEIKHQL

SEQ ID NO: 2593692 - protein, 31 aa, Entamoeba histolytica
FGMCMSIVGYYYFWWLDAVGGIVLSFYIMLN

SEQ ID NO: 2593693 - protein, 30 aa, Entamoeba histolytica
FGPLRQLILFNFFLGGYVFLPYVFSIEKST

SEQ ID NO: 2593694 - protein, 17 aa, Entamoeba histolytica
FGSLQQCLLKTSPSKWK

SEQ ID NO: 2593695 - protein, 19 aa, Entamoeba histolytica
FGSNWIVVKKFPAGDGFFL

SEQ ID NO: 2593696 - protein, 27 aa, Entamoeba histolytica
FGSQNSFLRIYFPTVLNWMIGGVVGQN

SEQ ID NO: 2593697 - protein, 19 aa, Entamoeba histolytica
FGTKFVMKRLFLNWELREN

SEQ ID NO: 2593698 - protein, 28 aa, Entamoeba histolytica
FGYISNCIILLSEFFKFSLDKTYLMEAY

SEQ ID NO: 2593699 - protein, 17 aa, Entamoeba histolytica
FHAVINGKNFFYPAQYY

SEQ ID NO: 2593700 - protein, 19 aa, Entamoeba histolytica
FHDIQLRYLIKKVTLEEEK

SEQ ID NO: 2593701 - protein, 18 aa, Entamoeba histolytica
FHFDHIIITFGLKNKNIK

SEQ ID NO: 2593702 - protein, 27 aa, Entamoeba histolytica
FHFIGFLCLLISPFFLYGPMGMLKKIT

SEQ ID NO: 2593703 - protein, 26 aa, Entamoeba histolytica
FHGGDYLKYTISFVPAILSVRPGETG

SEQ ID NO: 2593704 - protein, 33 aa, Entamoeba histolytica
FHINKLMILSFLSFILLILFSLVVLLQSFVIEV

SEQ ID NO: 2593705 - protein, 18 aa, Entamoeba histolytica
FHKILNYSGIMTDCGKRK

SEQ ID NO: 2593706 - protein, 18 aa, Entamoeba histolytica
FHLTQIVILFIGFIYCVY

SEQ ID NO: 2593707 - protein, 28 aa, Entamoeba histolytica
FHNYRYFFLFLFYLWISMLIVDCHVYFL

SEQ ID NO: 2593708 - protein, 23 aa, Entamoeba histolytica
FHTNQFINIHIFKSTVQPERSDP

SEQ ID NO: 2593709 - protein, 29 aa, Entamoeba histolytica
FIARAFYQSFGLPLIITRGNNVFGPHQFP

SEQ ID NO: 2593710 - protein, 29 aa, Entamoeba histolytica
FIARSFYQSFGLPLIITRGNNVFGPHQFP

SEQ ID NO: 2593711 - protein, 23 aa, Entamoeba histolytica
FICFLMFYVLSMFEALRKPLNIR

SEQ ID NO: 2593712 - protein, 19 aa, Entamoeba histolytica
FICIIVTLKCRSVVSQLVK

SEQ ID NO: 2593713 - protein, 19 aa, Entamoeba histolytica
FICILVIRECFPTFVHLFA

SEQ ID NO: 2593714 - protein, 17 aa, Entamoeba histolytica
FICVPITLVIASYQRKM

SEQ ID NO: 2593715 - protein, 26 aa, Entamoeba histolytica
FIDEIKIQLPFPLTDKHHLLFHIKDI

SEQ ID NO: 2593716 - protein, 17 aa, Entamoeba histolytica
FIDISHNAIKLCLSSEI

SEQ ID NO: 2593717 - protein, 26 aa, Entamoeba histolytica
FIEQKWLRFITIIIYVLLGLTALGMM

SEQ ID NO: 2593718 - protein, 20 aa, Entamoeba histolytica
FIETFPELSPYDPPLLSSYN

SEQ ID NO: 2593719 - protein, 18 aa, Entamoeba histolytica
FIEYCFVAMIYAMKGSKD

SEQ ID NO: 2593720 - protein, 17 aa, Entamoeba histolytica
FIFGKKKNKFRDDRIEL

SEQ ID NO: 2593721 - protein, 35 aa, Entamoeba histolytica; identical to SEQ ID NO: 2396751

SEQ ID NO: 2593722 - protein, 32 aa, Entamoeba histolytica
FIGISPIFLIILILYSQTFLKLIQKYNIQKVN

SEQ ID NO: 2593723 - protein, 17 aa, Entamoeba histolytica
FIGKRGIAVLPLYSIFH

SEQ ID NO: 2593724 - protein, 18 aa, Entamoeba histolytica
FIGLLLIGLLVLQTYLPH

SEQ ID NO: 2593725 - protein, 33 aa, Entamoeba histolytica
FIGSMIYGALFPIFAYFLAEAICMLVTVYLTGM

SEQ ID NO: 2593726 - protein, 23 aa, Entamoeba histolytica
FIGVCILSVLLLISHALKYIIGD

SEQ ID NO: 2593727 - protein, 17 aa, Entamoeba histolytica
FIGYPLLVLSQTCSGTG

SEQ ID NO: 2593728 - protein, 18 aa, Entamoeba histolytica
FIHDGYHFHLFESNEFLK

SEQ ID NO: 2593729 - protein, 30 aa, Entamoeba histolytica
FIHDVFCLTLFSLIVILHIMVWRQGGALLI

SEQ ID NO: 2593730 - protein, 27 aa, Entamoeba histolytica
FIHLCFIVFPILYLCIFKKIVKSHLDD

SEQ ID NO: 2593731 - protein, 23 aa, Entamoeba histolytica
FIIALFFPLFIKNKMWALYVSMI

SEQ ID NO: 2593732 - protein, 25 aa, Entamoeba histolytica
FIIDSMDSIYLRYANTHLFACPDNK

SEQ ID NO: 2593733 - protein, 24 aa, Entamoeba histolytica
FIIGLVINALWLYIILKYKHSTDE

SEQ ID NO: 2593734 - protein, 17 aa, Entamoeba histolytica
FIISLPPSSLRLDAEWL

SEQ ID NO: 2593735 - protein, 27 aa, Entamoeba histolytica
FIIVICTILFFLRKKPLPKEKFGCWVG

SEQ ID NO: 2593736 - protein, 18 aa, Entamoeba histolytica
FIIYCLGQSAKQLKNKQR

SEQ ID NO: 2593737 - protein, 24 aa, Entamoeba histolytica
FIKIPKKVFISLIGKGFNGLVKEI

SEQ ID NO: 2593738 - protein, 20 aa, Entamoeba histolytica
FIKLSYKLKIKMLFDTARGM

SEQ ID NO: 2593739 - protein, 19 aa, Entamoeba histolytica
FILLIEHYFNRKIGLPCCD

SEQ ID NO: 2593740 - protein, 17 aa, Entamoeba histolytica
FILPVNCYSSWINLALL

SEQ ID NO: 2593741 - protein, 19 aa, Entamoeba histolytica
FINFFPKGIPKKKLFPLLL

SEQ ID NO: 2593742 - protein, 17 aa, Entamoeba histolytica
FINILISTIYLFDSMAR

SEQ ID NO: 2593743 - protein, 34 aa, Entamoeba histolytica
FINKYFINYTVFGLTLLWFIVATSNFRKVLFGIL

SEQ ID NO: 2593744 - protein, 29 aa, Entamoeba histolytica
FIPFVFSPFLLLYSILSALLLIYLSHKLL

SEQ ID NO: 2593745 - protein, 20 aa, Entamoeba histolytica
FIPIMLVCHIILLSLHSLCF

SEQ ID NO: 2593746 - protein, 31 aa, Entamoeba histolytica
FIQKLYEPYFKIYFFLISGILCCLNYWTLFG

SEQ ID NO: 2593747 - protein, 19 aa, Entamoeba histolytica
FISFAFSKDLIATITKDGD

SEQ ID NO: 2593748 - protein, 19 aa, Entamoeba histolytica
FISFVFSKDLIATFTKDDD

SEQ ID NO: 2593749 - protein, 18 aa, Entamoeba histolytica
FISVVLSKSLVSECQKSV

SEQ ID NO: 2593750 - protein, 21 aa, Entamoeba histolytica
FISYIALFIGLISFIFIIIIM

SEQ ID NO: 2593751 - protein, 19 aa, Entamoeba histolytica
FITHLYCIDFLFKTHYFLI

SEQ ID NO: 2593752 - protein, 24 aa, Entamoeba histolytica
FITTFNPLIIEPLEFANYVLTVII

SEQ ID NO: 2593753 - protein, 25 aa, Entamoeba histolytica
FIVDAYGYYLGTYLLAKNLNYTQTN

SEQ ID NO: 2593754 - protein, 17 aa, Entamoeba histolytica
FIVGFSNFGLVYSNENN

SEQ ID NO: 2593755 - protein, 17 aa, Entamoeba histolytica
FIVHFYGAVFIPNKVCM

SEQ ID NO: 2593756 - protein, 19 aa, Entamoeba histolytica
FIVIRIAMCFFVVAVALIL

SEQ ID NO: 2593757 - protein, 26 aa, Entamoeba histolytica
FIVLSMTLLAVFATKFTVLGEESLGN

SEQ ID NO: 2593758 - protein, 23 aa, Entamoeba histolytica
FIVSVIIIYFFSSPFTLERLQDT

SEQ ID NO: 2593759 - protein, 30 aa, Entamoeba histolytica
FIVVLMFELYWFTIFFFLLEAYNSFSLTVL

SEQ ID NO: 2593760 - protein, 17 aa, Entamoeba histolytica
FIVYIIGQIFQLGVSSV

SEQ ID NO: 2593761 - protein, 17 aa, Entamoeba histolytica
FIYEFLSKRIGSLSSQT

SEQ ID NO: 2593762 - protein, 18 aa, Entamoeba histolytica
FIYELYQVLWKILDEDNY

SEQ ID NO: 2593763 - protein, 19 aa, Entamoeba histolytica
FIYFCYSFECSPGCIGGCE

SEQ ID NO: 2593764 - protein, 18 aa, Entamoeba histolytica
FIYIVFISICYITFCIEQ

SEQ ID NO: 2593765 - protein, 24 aa, Entamoeba histolytica
FIYYHYQYLELLWILFCVTWAISN

SEQ ID NO: 2593766 - protein, 26 aa, Entamoeba histolytica
FKAGPTWLMILLSSPSILFCLFTVFY

SEQ ID NO: 2593767 - protein, 25 aa, Entamoeba histolytica
FKAIVCGIIIFFVKLWTIQENQGKT

SEQ ID NO: 2593768 - protein, 18 aa, Entamoeba histolytica
FKCIKCKNGYYLNSNNEC

SEQ ID NO: 2593769 - protein, 19 aa, Entamoeba histolytica
FKCIKCKNGYYLNSNNECQ

SEQ ID NO: 2593770 - protein, 18 aa, Entamoeba histolytica
FKCIKCKNGYYLNSNNKC

SEQ ID NO: 2593771 - protein, 19 aa, Entamoeba histolytica
FKCLSCDSSLNLYLLNSQC

SEQ ID NO: 2593772 - protein, 23 aa, Entamoeba histolytica
FKCSFILLKFSLFAIPFTLRIPY

SEQ ID NO: 2593773 - protein, 26 aa, Entamoeba histolytica
FKDRHLFEKLPIGNLLLHYVNWMTNL

SEQ ID NO: 2593774 - protein, 24 aa, Entamoeba histolytica
FKDYKFRYRRGLPLVLKGINASIE

SEQ ID NO: 2593775 - protein, 19 aa, Entamoeba histolytica
FKEAKITFLPTFKIKIGNG

SEQ ID NO: 2593776 - protein, 25 aa, Entamoeba histolytica
FKEKLMWTGITLLVFLVCSQIPLIG

SEQ ID NO: 2593777 - protein, 19 aa, Entamoeba histolytica
FKELLLEFLSYCCFIHQCC

SEQ ID NO: 2593778 - protein, 18 aa, Entamoeba histolytica
FKENRPLDFIYFTDVGVY

SEQ ID NO: 2593779 - protein, 25 aa, Entamoeba histolytica
FKESHEYIFPTYDATFPITMADING

SEQ ID NO: 2593780 - protein, 17 aa, Entamoeba histolytica
FKFFSMTINQRAKMRDG

SEQ ID NO: 2593781 - protein, 20 aa, Entamoeba histolytica
FKFIFSLFELLSIHPEQLSS

SEQ ID NO: 2593782 - protein, 23 aa, Entamoeba histolytica
FKFLAYFNLIIDVRLICVCMGPI

SEQ ID NO: 2593783 - protein, 25 aa, Entamoeba histolytica
FKFTVPFLKYWTFDNIIFHYKNLDI

SEQ ID NO: 2593784 - protein, 29 aa, Entamoeba histolytica
FKGTLIHVVALYLFMLGLLGGLTGTTMDI

SEQ ID NO: 2593785 - protein, 28 aa, Entamoeba histolytica
FKHHYIATLIFFLIMLTSGITTILSWRG

SEQ ID NO: 2593786 - protein, 18 aa, Entamoeba histolytica
FKIFPCLKPKDVRKIPLP

SEQ ID NO: 2593787 - protein, 22 aa, Entamoeba histolytica
FKIIIPLLCLLIPCILEATKVT

SEQ ID NO: 2593788 - protein, 24 aa, Entamoeba histolytica
FKKCTSLITITFPSTLTSLSNNSF

SEQ ID NO: 2593789 - protein, 19 aa, Entamoeba histolytica
FKLGYYLPYSITSKREISY

SEQ ID NO: 2593790 - protein, 24 aa, Entamoeba histolytica
FKLLSQYPIYPWVISTFSEDFRLN

SEQ ID NO: 2593791 - protein, 18 aa, Entamoeba histolytica
FKMYFTRDDLPVVSILFY

SEQ ID NO: 2593792 - protein, 28 aa, Entamoeba histolytica
FKQQYKILLIMLLFLETVIQTNPMFDCN

SEQ ID NO: 2593793 - protein, 24 aa, Entamoeba histolytica
FKQRDCYLLPKYQELYFSLVTSSY

SEQ ID NO: 2593794 - protein, 29 aa, Entamoeba histolytica
FKRFRNKYYPFWLIIFPEGTRAKPEKVVE

SEQ ID NO: 2593795 - protein, 30 aa, Entamoeba histolytica
FKRVILYYIIIILFFVFAFIMVFISLTKIG

SEQ ID NO: 2593796 - protein, 26 aa, Entamoeba histolytica
FKRYYLLFLVSFYLLAFIIPNYLASS

SEQ ID NO: 2593797 - protein, 27 aa, Entamoeba histolytica
FKSDEHLILLLTNYPTVVAALISILIK

SEQ ID NO: 2593798 - protein, 27 aa, Entamoeba histolytica
FKSEHVFLILQLCGSIIFYHSSGETCV

SEQ ID NO: 2593799 - protein, 23 aa, Entamoeba histolytica
FKSWYSYILSLLVGVVYTFGFLQ

SEQ ID NO: 2593800 - protein, 18 aa, Entamoeba histolytica
FKTIYFIELNVPLQFVCC

SEQ ID NO: 2593801 - protein, 23 aa, Entamoeba histolytica
FKTNKMTFFYACLNQICVCLIGL

SEQ ID NO: 2593802 - protein, 24 aa, Entamoeba histolytica
FKTYAWVEMSMFLKSLKIDERSEY

SEQ ID NO: 2593803 - protein, 22 aa, Entamoeba histolytica
FKVLIQLYQAFCKFALIYIRAN

SEQ ID NO: 2593804 - protein, 18 aa, Entamoeba histolytica
FKVYVFNVGQADSQLIVY

SEQ ID NO: 2593805 - protein, 26 aa, Entamoeba histolytica
FKYNETILHLLPPPPKPLRQYTTLEL

SEQ ID NO: 2593806 - protein, 25 aa, Entamoeba histolytica
FKYSDWIDMILILVGLISSLGNGVM

SEQ ID NO: 2593807 - protein, 18 aa, Entamoeba histolytica
FLALMKLYHPSMIDVRGD

SEQ ID NO: 2593808 - protein, 26 aa, Entamoeba histolytica
FLCISGLIHVLLYLNTEWSLNFNVKI

SEQ ID NO: 2593809 - protein, 17 aa, Entamoeba histolytica
FLCTCFVNEIVDVLASK

SEQ ID NO: 2593810 - protein, 21 aa, Entamoeba histolytica
FLCVSSYAQFKVYVFNVGQAD

SEQ ID NO: 2593811 - protein, 29 aa, Entamoeba histolytica
FLDGYDGFIIKLLLKQLPPQVIHKSMKYF

SEQ ID NO: 2593812 - protein, 17 aa, Entamoeba histolytica
FLDLFKRYGIHVTFFII

SEQ ID NO: 2593813 - protein, 18 aa, Entamoeba histolytica
FLFYCYSEKIDLKKNRLD

SEQ ID NO: 2593814 - protein, 26 aa, Entamoeba histolytica
FLGALAWWYPKPWPESYWHIVAIIII

SEQ ID NO: 2593815 - protein, 18 aa, Entamoeba histolytica
FLGIETLILEIWQFPFTT

SEQ ID NO: 2593816 - protein, 26 aa, Entamoeba histolytica
FLHHYGLKKWSMIGLLFHVIVIVIIS

SEQ ID NO: 2593817 - protein, 23 aa, Entamoeba histolytica
FLHTLRLHWVEFQNKFYLGDGIK

SEQ ID NO: 2593818 - protein, 28 aa, Entamoeba histolytica
FLIAGIFYYHFWLLCILFCIARTSFELV

SEQ ID NO: 2593819 - protein, 18 aa, Entamoeba histolytica
FLIATTLSRLLRLHKELL

SEQ ID NO: 2593820 - protein, 17 aa, Entamoeba histolytica
FLIGFICSWTFGSDVLS

SEQ ID NO: 2593821 - protein, 18 aa, Entamoeba histolytica
FLIRNWLSLHILIPIVLY

SEQ ID NO: 2593822 - protein, 27 aa, Entamoeba histolytica
FLISFSFDFLGLAGWALAILGQSPRRE

SEQ ID NO: 2593823 - protein, 17 aa, Entamoeba histolytica
FLKLIQKYNIQKVNKLK

SEQ ID NO: 2593824 - protein, 20 aa, Entamoeba histolytica
FLKSYLINVRNYILMNVRIA

SEQ ID NO: 2593825 - protein, 19 aa, Entamoeba histolytica
FLLIFSFSKQTTNTNEIIK

SEQ ID NO: 2593826 - protein, 20 aa, Entamoeba histolytica
FLLIFTIFICSSTSYECSIG

SEQ ID NO: 2593827 - protein, 18 aa, Entamoeba histolytica
FLLIPSAILIIMGSLIYG

SEQ ID NO: 2593828 - protein, 21 aa, Entamoeba histolytica
FLPFLFICNYLIDIFLLVIVI

SEQ ID NO: 2593829 - protein, 17 aa, Entamoeba histolytica
FLPLFEHGHLIQNDVYK

SEQ ID NO: 2593830 - protein, 18 aa, Entamoeba histolytica
FLPLLRTVSFVNENDILL

SEQ ID NO: 2593831 - protein, 21 aa, Entamoeba histolytica
FLPQIFCLIAIGFRYCKKDII

SEQ ID NO: 2593832 - protein, 22 aa, Entamoeba histolytica
FLPYLFAYPCNEIIFQKPFTFE

SEQ ID NO: 2593833 - protein, 17 aa, Entamoeba histolytica
FLQRLKSFPLWFCKQWL

SEQ ID NO: 2593834 - protein, 27 aa, Entamoeba histolytica
FLRFAPCALVMLFFQLPNFQELFLDHI

SEQ ID NO: 2593835 - protein, 29 aa, Entamoeba histolytica
FLSARIVALYFYNTFLTKWGRSIRPKLGL

SEQ ID NO: 2593836 - protein, 40 aa, Entamoeba histolytica
FLSFDNIVYVFKSPTLLALTLIIIGIIYSLNKIGYAYLID

SEQ ID NO: 2593837 - protein, 18 aa, Entamoeba histolytica
FLSFFIELPLCYILRYLP

SEQ ID NO: 2593838 - protein, 20 aa, Entamoeba histolytica
FLSKHREFLPFEMKYQDLIK

SEQ ID NO: 2593839 - protein, 19 aa, Entamoeba histolytica
FLSLLYWRNYPPSIIGMMV

SEQ ID NO: 2593840 - protein, 24 aa, Entamoeba histolytica
FLTALFLEFLTNPTHQFYPFAMLG

SEQ ID NO: 2593841 - protein, 27 aa, Entamoeba histolytica
FLTFTFVLAFILWPYGGFWIVSGDLFG

SEQ ID NO: 2593842 - protein, 24 aa, Entamoeba histolytica
FLTTYKYFVFKTITIKTFLHQLIS

SEQ ID NO: 2593843 - protein, 25 aa, Entamoeba histolytica
FLVIPLWVFLLRKKISLNFLLLNIV

SEQ ID NO: 2593844 - protein, 22 aa, Entamoeba histolytica
FLVISISLIFIPINYCQKLWPI

SEQ ID NO: 2593845 - protein, 18 aa, Entamoeba histolytica
FLVTPQRLSHLYDLADFF

SEQ ID NO: 2593846 - protein, 17 aa, Entamoeba histolytica
FLYSLRNTKIKKIHFLG

SEQ ID NO: 2593847 - protein, 22 aa, Entamoeba histolytica
FMEGAYSRWLFFKTHFVVYFGN

SEQ ID NO: 2593848 - protein, 28 aa, Entamoeba histolytica
FMIYNTTIFLIIPIILLVSSRISSSYKT

SEQ ID NO: 2593849 - protein, 29 aa, Entamoeba histolytica
FMLDKFRCDYIIHFYGAVFIPNKICMVTE

SEQ ID NO: 2593850 - protein, 18 aa, Entamoeba histolytica
FMMSGEFLTYRVRKLSFY

SEQ ID NO: 2593851 - protein, 22 aa, Entamoeba histolytica
FMQSYLLVQSLFKKVSKSSTRY

SEQ ID NO: 2593852 - protein, 19 aa, Entamoeba histolytica
FMTIYPLLMIASVGNGGFG

SEQ ID NO: 2593853 - protein, 27 aa, Entamoeba histolytica
FMVVAGILLLIRKLIQLLPALAPPSSI

SEQ ID NO: 2593854 - protein, 17 aa, Entamoeba histolytica
FNDFVPFYTKAINQKLD

SEQ ID NO: 2593855 - protein, 23 aa, Entamoeba histolytica
FNDLLKQMLLPITALLSTDKKML

SEQ ID NO: 2593856 - protein, 24 aa, Entamoeba histolytica
FNDNSFRIFPWKKRSKLVFCVPGA

SEQ ID NO: 2593857 - protein, 18 aa, Entamoeba histolytica
FNEKTINFLVNSNDFMMV

SEQ ID NO: 2593858 - protein, 24 aa, Entamoeba histolytica
FNEKTINFLVNSNDFMMVMGPSTQ

SEQ ID NO: 2593859 - protein, 18 aa, Entamoeba histolytica
FNEVIYFIIPILGNFMEE

SEQ ID NO: 2593860 - protein, 22 aa, Entamoeba histolytica
FNFANYFYWLVVPLIMNDKGGS

SEQ ID NO: 2593861 - protein, 21 aa, Entamoeba histolytica
FNFASYFYWLVVPLKCVDMGG

SEQ ID NO: 2593862 - protein, 18 aa, Entamoeba histolytica
FNFIRKFGKKYVGLKCPH

SEQ ID NO: 2593863 - protein, 21 aa, Entamoeba histolytica
FNHVWKEFLETYFVPYKVEGL

SEQ ID NO: 2593864 - protein, 26 aa, Entamoeba histolytica
FNIHSLQLNTLYSSSLIIPLEHTTNQ

SEQ ID NO: 2593865 - protein, 26 aa, Entamoeba histolytica
FNIKFSFALLILMVSLIVAIIIGLGI

SEQ ID NO: 2593866 - protein, 27 aa, Entamoeba histolytica
FNINTRKLNHNVFLMVLKKFVNTEEVV

SEQ ID NO: 2593867 - protein, 24 aa, Entamoeba histolytica
FNISKFIVNRLLLSSNVEFNTSGG

SEQ ID NO: 2593868 - protein, 18 aa, Entamoeba histolytica
FNKGLILFLQYYIHQHHD

SEQ ID NO: 2593869 - protein, 17 aa, Entamoeba histolytica
FNLFRKQSNTEKQFFQV

SEQ ID NO: 2593870 - protein, 25 aa, Entamoeba histolytica
FNLGVIFFYIIVYTVNFILTHFIPN

SEQ ID NO: 2593871 - protein, 18 aa, Entamoeba histolytica
FNLLLREEMHELTQMLLS

SEQ ID NO: 2593872 - protein, 18 aa, Entamoeba histolytica
FNLLSRYPKYLTFEAKAQ

SEQ ID NO: 2593873 - protein, 18 aa, Entamoeba histolytica
FNMFIVISIIFSGIMFIL

SEQ ID NO: 2593874 - protein, 22 aa, Entamoeba histolytica
FNNPFFFYEYIVDSVTFLLFNT

SEQ ID NO: 2593875 - protein, 20 aa, Entamoeba histolytica
FNNRIGFIPPISDCYIIILS

SEQ ID NO: 2593876 - protein, 23 aa, Entamoeba histolytica
FNSFQFDYLILSLNDLVKRHLPN

SEQ ID NO: 2593877 - protein, 23 aa, Entamoeba histolytica
FNSFTIILLVINFLIQNDYLPEL

SEQ ID NO: 2593878 - protein, 24 aa, Entamoeba histolytica
FNSKIPFRFIPFFKIHSITIQTIP

SEQ ID NO: 2593879 - protein, 24 aa, Entamoeba histolytica
FNSSYTFIFFFKVGFYNTLVMDSK

SEQ ID NO: 2593880 - protein, 20 aa, Entamoeba histolytica
FNSVPFDRLLITKMAQFCTR

SEQ ID NO: 2593881 - protein, 32 aa, Entamoeba histolytica
FNVLHEFLSFYVVLMKFINYKLYTNAGLNYPP

SEQ ID NO: 2593882 - protein, 28 aa, Entamoeba histolytica
FNVPSFTPLLIPIFHVTSLTSPIPSCDD

SEQ ID NO: 2593883 - protein, 27 aa, Entamoeba histolytica
FNYEIVNEIAFWYYQQLFEEKCYEYIE

SEQ ID NO: 2593884 - protein, 25 aa, Entamoeba histolytica
FPADIFAFGMVIFETIKWGDAFEQN

SEQ ID NO: 2593885 - protein, 18 aa, Entamoeba histolytica
FPFVIFNHLLEVPQTRNL

SEQ ID NO: 2593886 - protein, 30 aa, Entamoeba histolytica
FPIFHGIMNILFLGYLVFFVTAFFQSIRIE

SEQ ID NO: 2593887 - protein, 41 aa, Entamoeba histolytica
FPITQKIAVILIFLVLMLQFGIMLYFRFAPFIKENEIVSTF

SEQ ID NO: 2593888 - protein, 19 aa, Entamoeba histolytica
FPKSEFKFPWKIAEFISTG

SEQ ID NO: 2593889 - protein, 18 aa, Entamoeba histolytica
FPKSFSPGICELIKKCWA

SEQ ID NO: 2593890 - protein, 18 aa, Entamoeba histolytica
FPLYCMIGFVLYSVQSQH

SEQ ID NO: 2593891 - protein, 23 aa, Entamoeba histolytica
FPNLVLYYLRWKSSFPIPDHLTF

SEQ ID NO: 2593892 - protein, 17 aa, Entamoeba histolytica
FPNVPITTKINNFITNL

SEQ ID NO: 2593893 - protein, 20 aa, Entamoeba histolytica
FPQKWYFIPIMLVCHIILLS

SEQ ID NO: 2593894 - protein, 24 aa, Entamoeba histolytica
FPRFRIYFLGWYLIPAAGGCIKYV

SEQ ID NO: 2593895 - protein, 27 aa, Entamoeba histolytica
FPRNGLLLFVTTLRIGALTTTLEKLKV

SEQ ID NO: 2593896 - protein, 26 aa, Entamoeba histolytica
FPSENIALHKLTLPSGATISGTGSLS

SEQ ID NO: 2593897 - protein, 27 aa, Entamoeba histolytica
FPSHDFLKHICIVWNKCYYSISDRQLT

SEQ ID NO: 2593898 - protein, 32 aa, Entamoeba histolytica
FPSHDFLKHICIVWNKCYYYISDRQLQIQKEI

SEQ ID NO: 2593899 - protein, 31 aa, Entamoeba histolytica
FPSHDFLKHICIVWNKCYYYISDRQLTNQKE

SEQ ID NO: 2593900 - protein, 35 aa, Entamoeba histolytica
FPSKKENVYFILLSFIISLIPITTIQYIPHLCALS

SEQ ID NO: 2593901 - protein, 18 aa, Entamoeba histolytica
FPTPLILPTTPNSILRLN

SEQ ID NO: 2593902 - protein, 27 aa, Entamoeba histolytica
FPVDNRKWYEKIPALKWYKQFHKPRSV

SEQ ID NO: 2593903 - protein, 17 aa, Entamoeba histolytica
FPVFNLTSSFPILSNTL

SEQ ID NO: 2593904 - protein, 33 aa, Entamoeba histolytica
FPVIYLSHHIYFGAILFSLKTLFLIINTFAFNN

SEQ ID NO: 2593905 - protein, 21 aa, Entamoeba histolytica
FPVRKLVPLLLLLICESFTNN

SEQ ID NO: 2593906 - protein, 21 aa, Entamoeba histolytica
FQFIFLMIGLCLLYIGTNILQ

SEQ ID NO: 2593907 - protein, 21 aa, Entamoeba histolytica
FQFPIFLIITQFVVSILILCF

SEQ ID NO: 2593908 - protein, 18 aa, Entamoeba histolytica
FQIFFTKVKHPCSNNYYD

SEQ ID NO: 2593909 - protein, 17 aa, Entamoeba histolytica
FQILLQLHNIVLNINLK

SEQ ID NO: 2593910 - protein, 19 aa, Entamoeba histolytica
FQKLLMILINGLQSTDPNI

SEQ ID NO: 2593911 - protein, 28 aa, Entamoeba histolytica
FQKYGMFIMIGVLILTFFFKGNSGPEPQ

SEQ ID NO: 2593912 - protein, 23 aa, Entamoeba histolytica
FQKYPLFLLAVISLIGQIIISIG

SEQ ID NO: 2593913 - protein, 25 aa, Entamoeba histolytica
FQNLLIIFLICWCLFRISDLMIRFF

SEQ ID NO: 2593914 - protein, 25 aa, Entamoeba histolytica
FQRNTRLLLLSYIPIRSIMEMKSFD

SEQ ID NO: 2593915 - protein, 20 aa, Entamoeba histolytica
FRGFNYAIGASLFICGILLI

SEQ ID NO: 2593916 - protein, 33 aa, Entamoeba histolytica
FRIAYELPIKLPYHYPLWKAMIAITSLLIPIIL

SEQ ID NO: 2593917 - protein, 26 aa, Entamoeba histolytica
FRIGNFAYEFTPIDNFPLSLSCSTLT

SEQ ID NO: 2593918 - protein, 22 aa, Entamoeba histolytica
FRLLNIMYKRIIYIQALGQCTL

SEQ ID NO: 2593919 - protein, 41 aa, Entamoeba histolytica
FRLMTKANLFCLFIVMWTFTFSLTCFAYFLATLMSKTRIAI

SEQ ID NO: 2593920 - protein, 19 aa, Entamoeba histolytica
FRLYVFPRYIIYAAIQAYP

SEQ ID NO: 2593921 - protein, 29 aa, Entamoeba histolytica
FRRAITFIRIGMPIPFYVLKKNIAAYPRY

SEQ ID NO: 2593922 - protein, 27 aa, Entamoeba histolytica
FRRPLPILFCLLLLPLPKNNISLISIF

SEQ ID NO: 2593923 - protein, 27 aa, Entamoeba histolytica
FRRWHQKIPILWTYKPFYEPRTIHLPS

SEQ ID NO: 2593924 - protein, 20 aa, Entamoeba histolytica
FRSCMNFIVWAIPPSVSFVT

SEQ ID NO: 2593925 - protein, 23 aa, Entamoeba histolytica
FRVIRKEIWRAFQKHYKPLIIQA

SEQ ID NO: 2593926 - protein, 19 aa, Entamoeba histolytica
FSAWMFISILQGSVIMMLA

SEQ ID NO: 2593927 - protein, 18 aa, Entamoeba histolytica
FSCFSRMSQFLLNSSHFQ

SEQ ID NO: 2593928 - protein, 19 aa, Entamoeba histolytica
FSCNLLPWAWSPPKFECWW

SEQ ID NO: 2593929 - protein, 27 aa, Entamoeba histolytica
FSDLNQFEFTLYLQLYDIVKECTNCCA

SEQ ID NO: 2593930 - protein, 31 aa, Entamoeba histolytica
FSDRPELWRMIPVIIPMFLAGIIVLTRTRDY

SEQ ID NO: 2593931 - protein, 24 aa, Entamoeba histolytica
FSDYIFCITFFIVGWITNNDSNSE

SEQ ID NO: 2593932 - protein, 24 aa, Entamoeba histolytica
FSELLRMVYYLFCQIKDSSRRTGD

SEQ ID NO: 2593933 - protein, 31 aa, Entamoeba histolytica
FSELNEYLYRYPKLKLIRYPRKPTEIVVYTD

SEQ ID NO: 2593934 - protein, 28 aa, Entamoeba histolytica
FSESTIQLVILLYQLINKNNPMFTDKEI

SEQ ID NO: 2593935 - protein, 38 aa, Entamoeba histolytica
FSEVIQIMIRIIANTFPIIGFWKHVCVVWTKCMCFYPQ

SEQ ID NO: 2593936 - protein, 40 aa, Entamoeba histolytica
FSFAIVMYETFIWGAPYPKETFPFPWNIAEFISQGKRMPQ

SEQ ID NO: 2593937 - protein, 18 aa, Entamoeba histolytica
FSFIQQPLTQELIMSYPG

SEQ ID NO: 2593938 - protein, 25 aa, Entamoeba histolytica
FSFKKVFFRSLALENKIFHFDNQTE

SEQ ID NO: 2593939 - protein, 44 aa, Entamoeba histolytica
FSHEFNFIQYIAYGGSLIFYFGWGFVYGLITWIPPFTIGWDMFG

SEQ ID NO: 2593940 - protein, 20 aa, Entamoeba histolytica
FSIAIFFWLVTFPFILVFVA

SEQ ID NO: 2593941 - protein, 24 aa, Entamoeba histolytica
FSIRYSNIHFYKFNNYSPLVFDKQ

SEQ ID NO: 2593942 - protein, 24 aa, Entamoeba histolytica
FSITMLQIIIWQDPFPKTLYPYPL

SEQ ID NO: 2593943 - protein, 21 aa, Entamoeba histolytica
FSIVFICFWLGSIVISLNTKF

SEQ ID NO: 2593944 - protein, 28 aa, Entamoeba histolytica
FSLHTRQKLLVIPPLLTGNINILFVMYQ

SEQ ID NO: 2593945 - protein, 24 aa, Entamoeba histolytica
FSLKQPLFEPYIPFNARAVEMLNQ

SEQ ID NO: 2593946 - protein, 33 aa, Entamoeba histolytica
FSLSFFISMKFIPFMWIIYIIGSYFAVPLCNNF

SEQ ID NO: 2593947 - protein, 25 aa, Entamoeba histolytica
FSMAMAFIVIYIAIPILTANGMILL

SEQ ID NO: 2593948 - protein, 19 aa, Entamoeba histolytica
FSNIFIWTYDRSYLTAILL

SEQ ID NO: 2593949 - protein, 29 aa, Entamoeba histolytica
FSNIINLLQKLFINIKLPSLLDSKNVSII

SEQ ID NO: 2593950 - protein, 26 aa, Entamoeba histolytica
FSNKSLIDTYLSYYIKLLNVSIERVF

SEQ ID NO: 2593951 - protein, 24 aa, Entamoeba histolytica
FSNKYTLYRFLWFNVREYIFTFSL

SEQ ID NO: 2593952 - protein, 25 aa, Entamoeba histolytica
FSQEECKYLNLYNNMVLRVTSDSYP

SEQ ID NO: 2593953 - protein, 26 aa, Entamoeba histolytica
FSQSKLVYLPALRFFGNLSSKDSNFC

SEQ ID NO: 2593954 - protein, 20 aa, Entamoeba histolytica
FSSFFIASFILCCVACFGVF

SEQ ID NO: 2593955 - protein, 24 aa, Entamoeba histolytica
FSTASFWFIQVISPFVLPLFEKCY

SEQ ID NO: 2593956 - protein, 25 aa, Entamoeba histolytica
FSTITTVLWIYGFASFVFCNDYFDW

SEQ ID NO: 2593957 - protein, 31 aa, Entamoeba histolytica
FSTQIIQHFPKLILLFCVYSWTTFVLSYFTT

SEQ ID NO: 2593958 - protein, 25 aa, Entamoeba histolytica
FSTQQFGYIPELFLWHGRNAYKRTS

SEQ ID NO: 2593959 - protein, 32 aa, Entamoeba histolytica
FSVIALFIYICYLPLLFIAFKTHPLFIADPNG

SEQ ID NO: 2593960 - protein, 23 aa, Entamoeba histolytica
FSVLFLGRKLSIAQWRALALLVT

SEQ ID NO: 2593961 - protein, 24 aa, Entamoeba histolytica
FSWCIPVIVIFYFAQKRNSSKYFI

SEQ ID NO: 2593962 - protein, 22 aa, Entamoeba histolytica
FSYFGPLYILLVLMICICLHAN

SEQ ID NO: 2593963 - protein, 26 aa, Entamoeba histolytica
FSYGLLFIFAYLLLPFLHGHLSTEPI

SEQ ID NO: 2593964 - protein, 24 aa, Entamoeba histolytica
FSYTRRPFSILKAQTTRLISTYVH

SEQ ID NO: 2593965 - protein, 19 aa, Entamoeba histolytica
FTAIINGLVLGWVHAFIFW

SEQ ID NO: 2593966 - protein, 18 aa, Entamoeba histolytica
FTDIVSIILLFLFLLLGG

SEQ ID NO: 2593967 - protein, 27 aa, Entamoeba histolytica
FTDLKTMWLPDIFLYCNIDTQIIIIGN

SEQ ID NO: 2593968 - protein, 25 aa, Entamoeba histolytica
FTETYILRGWSILITLYSFVHFIIL

SEQ ID NO: 2593969 - protein, 23 aa, Entamoeba histolytica
FTFGYNILGFQTYIKYIFDPNLG

SEQ ID NO: 2593970 - protein, 32 aa, Entamoeba histolytica
FTHFAYNLFPMIFFGLILFVLNSFKAANLTIL

SEQ ID NO: 2593971 - protein, 20 aa, Entamoeba histolytica
FTIFNNFLTGNFIPYGVLIY

SEQ ID NO: 2593972 - protein, 40 aa, Entamoeba histolytica
FTIGWDMFGLIYQLILTPSFYLLILLPPLLLGAKEMVVLF

SEQ ID NO: 2593973 - protein, 26 aa, Entamoeba histolytica
FTIIAIFIFFVLLLSDYFIGYRSNAA

SEQ ID NO: 2593974 - protein, 28 aa, Entamoeba histolytica
FTILALFMVFSVWQLSILDTIKLLFFAI

SEQ ID NO: 2593975 - protein, 24 aa, Entamoeba histolytica
FTIRRWNWIILGSEIFSIAIYFIS

SEQ ID NO: 2593976 - protein, 17 aa, Entamoeba histolytica
FTKKRQMIYLQVCDVEK

SEQ ID NO: 2593977 - protein, 19 aa, Entamoeba histolytica
FTKSNELWYYIKVDNTFTS

SEQ ID NO: 2593978 - protein, 24 aa, Entamoeba histolytica
FTKSPTLLNLWKIPIYSVYTTNGA

SEQ ID NO: 2593979 - protein, 20 aa, Entamoeba histolytica
FTLNGILLEPPFVSFSGKTS

SEQ ID NO: 2593980 - protein, 22 aa, Entamoeba histolytica
FTMTSLIEYWNAKTFKIQKSSQ

SEQ ID NO: 2593981 - protein, 20 aa, Entamoeba histolytica
FTPAFQGKMMKLLEIPLSCE

SEQ ID NO: 2593982 - protein, 21 aa, Entamoeba histolytica
FTPNNPWIQPLLQFVCETSLS

SEQ ID NO: 2593983 - protein, 21 aa, Entamoeba histolytica
FTQFEICKTLRFTLAANKTNV

SEQ ID NO: 2593984 - protein, 26 aa, Entamoeba histolytica
FTRRFEYWNFHYNIGGPFLSVEESMK

SEQ ID NO: 2593985 - protein, 33 aa, Entamoeba histolytica
FTSARSPILQLLRCYILFPEHWSTFLALADMHE

SEQ ID NO: 2593986 - protein, 33 aa, Entamoeba histolytica
FTSDYLPIFYVLGLLLQFIMILIDRIIYLCKSI

SEQ ID NO: 2593987 - protein, 25 aa, Entamoeba histolytica
FTTTNIYTLIKLIIKERNIRLVGLS

SEQ ID NO: 2593988 - protein, 17 aa, Entamoeba histolytica
FTVLKLFIKTDDLLRYH

SEQ ID NO: 2593989 - protein, 19 aa, Entamoeba histolytica
FTVYCFVCYILFLNKTYSK

SEQ ID NO: 2593990 - protein, 35 aa, Entamoeba histolytica
FVADHWYTFSTLKQLLIFLLVLTNPSKWKKSFLDA

SEQ ID NO: 2593991 - protein, 20 aa, Entamoeba histolytica
FVAIFLTFLVPIISIIFPLY

SEQ ID NO: 2593992 - protein, 18 aa, Entamoeba histolytica
FVEGGLSYLPLTKEYLNT

SEQ ID NO: 2593993 - protein, 25 aa, Entamoeba histolytica
FVEQTLIPLIITKTGEWVYPLPIEE

SEQ ID NO: 2593994 - protein, 17 aa, Entamoeba histolytica
FVFGYPQFHFTTLKIIH

SEQ ID NO: 2593995 - protein, 19 aa, Entamoeba histolytica
FVFISNALIPLSTCLEGTS

SEQ ID NO: 2593996 - protein, 18 aa, Entamoeba histolytica
FVFTFGVREMVWSNTFLN

SEQ ID NO: 2593997 - protein, 19 aa, Entamoeba histolytica
FVHLLRKLTFQPKHSNLLC

SEQ ID NO: 2593998 - protein, 33 aa, Entamoeba histolytica
FVIALFFLIFYWVGLFFIICFWIMFVVDVIVLI

SEQ ID NO: 2593999 - protein, 25 aa, Entamoeba histolytica
FVIGMFILELTFALISTIMGTIWRV

SEQ ID NO: 2594000 - protein, 18 aa, Entamoeba histolytica
FVKRILIMMLNCDSSIAL

SEQ ID NO: 2594001 - protein, 19 aa, Entamoeba histolytica
FVKVLMFIQQPRVLLRIKY

SEQ ID NO: 2594002 - protein, 19 aa, Entamoeba histolytica
FVLCCITAFWMLESLARTC

SEQ ID NO: 2594003 - protein, 18 aa, Entamoeba histolytica
FVLFFTYCLCKCGDGIRQ

SEQ ID NO: 2594004 - protein, 19 aa, Entamoeba histolytica
FVLGFIFCCLWPINACLYR

SEQ ID NO: 2594005 - protein, 27 aa, Entamoeba histolytica
FVLGLCVLLLLLIFDKTLIEQPSFTLT

SEQ ID NO: 2594006 - protein, 18 aa, Entamoeba histolytica
FVLSSLFTTKLILHSAMF

SEQ ID NO: 2594007 - protein, 19 aa, Entamoeba histolytica
FVLYYFINTMIPFSSFPHV

SEQ ID NO: 2594008 - protein, 23 aa, Entamoeba histolytica
FVMIIIQCVICLILAILSGHSHS

SEQ ID NO: 2594009 - protein, 21 aa, Entamoeba histolytica
FVMKRLFLNWELRENKNIYYG

SEQ ID NO: 2594010 - protein, 24 aa, Entamoeba histolytica
FVNDLMILCPSYLYPQPMSSDKIL

SEQ ID NO: 2594011 - protein, 25 aa, Entamoeba histolytica
FVNLLLTFYYILYASLYIFGCYLLS

SEQ ID NO: 2594012 - protein, 22 aa, Entamoeba histolytica
FVPLIVFNTYIQLRISVGFAGP

SEQ ID NO: 2594013 - protein, 18 aa, Entamoeba histolytica
FVPTILRSIQHFGTKREL

SEQ ID NO: 2594014 - protein, 26 aa, Entamoeba histolytica
FVQVCSIYLAIVPKGYTIQNCPDDPC

SEQ ID NO: 2594015 - protein, 19 aa, Entamoeba histolytica
FVRSQDFIVPLKGIPIGPS

SEQ ID NO: 2594016 - protein, 26 aa, Entamoeba histolytica
FVSVGSFFFTYFFLASFSGATRENMS

SEQ ID NO: 2594017 - protein, 28 aa, Entamoeba histolytica
FVTASFLFIFFYIIVLLLALPATPLNLA

SEQ ID NO: 2594018 - protein, 25 aa, Entamoeba histolytica
FVVTYLFLMLFVFSLMLYSSKQSCF

SEQ ID NO: 2594019 - protein, 27 aa, Entamoeba histolytica
FVVYVCPLSIIMLWPRVEKFGDPNFRK

SEQ ID NO: 2594020 - protein, 18 aa, Entamoeba histolytica
FWCCFIVLFYYYINQQPK

SEQ ID NO: 2594021 - protein, 20 aa, Entamoeba histolytica
FWGIFICCFVIAFAAFFESI

SEQ ID NO: 2594022 - protein, 20 aa, Entamoeba histolytica
FWGLFICCVVIAIAAFYEDI

SEQ ID NO: 2594023 - protein, 25 aa, Entamoeba histolytica
FWLFFFILLCHLVGIYLYGTGFLIT

SEQ ID NO: 2594024 - protein, 17 aa, Entamoeba histolytica
FYEALLLLLIESDKELI

SEQ ID NO: 2594025 - protein, 17 aa, Entamoeba histolytica
FYFVITKASYSLTETTL

SEQ ID NO: 2594026 - protein, 31 aa, Entamoeba histolytica
FYHFNFFGVALFYYPLYFTCTILSIHIVFIL

SEQ ID NO: 2594027 - protein, 20 aa, Entamoeba histolytica
FYIGDGIPFIPLRLPKQPLP

SEQ ID NO: 2594028 - protein, 20 aa, Entamoeba histolytica
FYKIIQFSFLSVAALVLTGV

SEQ ID NO: 2594029 - protein, 24 aa, Entamoeba histolytica
FYKPNPLLIILMGVLIIVGYVLLA

SEQ ID NO: 2594030 - protein, 19 aa, Entamoeba histolytica
FYLGYPRCRFINGPTLCQC

SEQ ID NO: 2594031 - protein, 28 aa, Entamoeba histolytica
FYLLLIGLPMLYCFVPIYNNNLINNREG

SEQ ID NO: 2594032 - protein, 29 aa, Entamoeba histolytica
FYMLVKSPFILCMCLIYSIVILAYNLFGM

SEQ ID NO: 2594033 - protein, 20 aa, Entamoeba histolytica
FYQIGILLAWIFRVNKIEKD

SEQ ID NO: 2594034 - protein, 18 aa, Entamoeba histolytica
FYRGFTLPTFLKECMAYA

SEQ ID NO: 2594035 - protein, 18 aa, Entamoeba histolytica
FYRLCITGLLFNFSAYFL

SEQ ID NO: 2594036 - protein, 22 aa, Entamoeba histolytica
FYRVYPLLIVPFLLLFIIVCIF

SEQ ID NO: 2594037 - protein, 17 aa, Entamoeba histolytica
FYSFFGNGFLVILNTFF

SEQ ID NO: 2594038 - protein, 26 aa, Entamoeba histolytica
FYSRMHLVLSCLGTVSSPLILYVHSH

SEQ ID NO: 2594039 - protein, 18 aa, Entamoeba histolytica
FYSTFKKTIDGLNSHSFV

SEQ ID NO: 2594040 - protein, 30 aa, Entamoeba histolytica
FYTCKMAKLWYLQRMDWIGAFIIVITTTVI

SEQ ID NO: 2594041 - protein, 32 aa, Entamoeba histolytica; identical to SEQ ID NO: 2397068

SEQ ID NO: 2594042 - protein, 26 aa, Entamoeba histolytica
FYVHLLGKNLILLNKYHFTKYAWLLY

SEQ ID NO: 2594043 - protein, 20 aa, Entamoeba histolytica
FYYQSPIINITYKSSSFKNK

SEQ ID NO: 2594044 - protein, 28 aa, Entamoeba histolytica
GAGAVFPFYMIQFIGLLMTLMGMSPDVE

SEQ ID NO: 2594045 - protein, 18 aa, Entamoeba histolytica
GAIFAIVLGLLIVLIIII

SEQ ID NO: 2594046 - protein, 54 aa, Entamoeba histolytica
GAISCRKIPVWLYWVLYVLTIFILYWIFLIITGLFIGLLYRRLNKIIKSDLENL

SEQ ID NO: 2594047 - protein, 28 aa, Entamoeba histolytica
GAKEPEFQIPPIKYSRPTRFLTNAYRTI

SEQ ID NO: 2594048 - protein, 24 aa, Entamoeba histolytica
GALAWWYPKPWLESYWHIVAIIII

SEQ ID NO: 2594049 - protein, 20 aa, Entamoeba histolytica
GALVFIALTIYYIVSQFTHS

SEQ ID NO: 2594050 - protein, 24 aa, Entamoeba histolytica
GANSKVMWYGSLSFQQLVKFKTTP

SEQ ID NO: 2594051 - protein, 25 aa, Entamoeba histolytica
GCEDALIHMLNYVWPNIFETSPHVI

SEQ ID NO: 2594052 - protein, 18 aa, Entamoeba histolytica
GCIRCKIGYYLDPTTSTC

SEQ ID NO: 2594053 - protein, 29 aa, Entamoeba histolytica
GCLCCIIVLTLYYFMPFLPASIRENIVDT

SEQ ID NO: 2594054 - protein, 33 aa, Entamoeba histolytica
GCVLACIVIMLIIVTIISLILFIRIERNIRKRN

SEQ ID NO: 2594055 - protein, 18 aa, Entamoeba histolytica
GDCLSMVFMFASYRVSKG

SEQ ID NO: 2594056 - protein, 31 aa, Entamoeba histolytica; identical to SEQ ID NO: 2397101

SEQ ID NO: 2594057 - protein, 22 aa, Entamoeba histolytica
GDPRIGFWQLGTYGHWGEWHTT

SEQ ID NO: 2594058 - protein, 20 aa, Entamoeba histolytica
GDVYLVHGLISRGGFSSVYT

SEQ ID NO: 2594059 - protein, 25 aa, Entamoeba histolytica
GDVYPEKEFPYIWNIASFIADGKRR

SEQ ID NO: 2594060 - protein, 41 aa, Entamoeba histolytica
GEAEQQFYYYVSPYYFQPILLDLTLVQLLLSYVSPKQFFLT

SEQ ID NO: 2594061 - protein, 17 aa, Entamoeba histolytica
GEDFIRIYYINQNIRRL

SEQ ID NO: 2594062 - protein, 37 aa, Entamoeba histolytica
GEEEALLRAMFDFTFYWYNFMPLSRGTAATGFVFMLA

SEQ ID NO: 2594063 - protein, 23 aa, Entamoeba histolytica
GEESPAQVLPQSGVPTGTEHSEQ

SEQ ID NO: 2594064 - protein, 23 aa, Entamoeba histolytica
GEETKAINMYKWLIEIYYKEEKY

SEQ ID NO: 2594065 - protein, 33 aa, Entamoeba histolytica
GEFSGFMAPWESFFFYWESVLKKGLELSCIIEA

SEQ ID NO: 2594066 - protein, 17 aa, Entamoeba histolytica
GEGCYACQCIEGYYSVH

SEQ ID NO: 2594067 - protein, 33 aa, Entamoeba histolytica; identical to SEQ ID NO: 2397108

SEQ ID NO: 2594068 - protein, 30 aa, Entamoeba histolytica
GEGQGLFIAGLVLIVLGIVLNFCICVCCCK

SEQ ID NO: 2594069 - protein, 20 aa, Entamoeba histolytica
GEHCFYYMDKLRYKHIMLHN

SEQ ID NO: 2594070 - protein, 17 aa, Entamoeba histolytica
GEIILKGILKNCALIHL

SEQ ID NO: 2594071 - protein, 34 aa, Entamoeba histolytica
GEIISIIMSLFYLVYAILLPILQDLYYHDFYFNE

SEQ ID NO: 2594072 - protein, 47 aa, Entamoeba histolytica
GEKERYFHFLSNSFFFERIMTFYIALLFRFHIFIGTPELMRKNANGL

SEQ ID NO: 2594073 - protein, 23 aa, Entamoeba histolytica
GEKYHMIYIIFSGLLNGVISYWM

SEQ ID NO: 2594074 - protein, 17 aa, Entamoeba histolytica
GELFVIPKKLDASQKIP

SEQ ID NO: 2594075 - protein, 18 aa, Entamoeba histolytica
GELLLRGPALFKEYFNRP

SEQ ID NO: 2594076 - protein, 29 aa, Entamoeba histolytica
GELLSLKLVLFILFLVCLIFATVHSHKND

SEQ ID NO: 2594077 - protein, 17 aa, Entamoeba histolytica
GELTCCLCPLFAGLIAT

SEQ ID NO: 2594078 - protein, 26 aa, Entamoeba histolytica
GELVETYYILIMKLMTKYTNEPIQQD

SEQ ID NO: 2594079 - protein, 38 aa, Entamoeba histolytica
GELYNIVLLIYGSPLMFLLVYRFILFSVSYISSSFSYF

SEQ ID NO: 2594080 - protein, 26 aa, Entamoeba histolytica
GENFILTIVVFIALGLMSFLIEKITE

SEQ ID NO: 2594081 - protein, 30 aa, Entamoeba histolytica; identical to SEQ ID NO: 2397117

SEQ ID NO: 2594082 - protein, 31 aa, Entamoeba histolytica
GERATRWRFLGFWICAVLNLFVPNYISGFDY

SEQ ID NO: 2594083 - protein, 38 aa, Entamoeba histolytica; identical to SEQ ID NO: 2397120

SEQ ID NO: 2594084 - protein, 27 aa, Entamoeba histolytica
GEVLLYDAFTLALLFSYSADRKTKSVT

SEQ ID NO: 2594085 - protein, 23 aa, Entamoeba histolytica
GEWYCIYPPFAFVQALERMNSDL

SEQ ID NO: 2594086 - protein, 24 aa, Entamoeba histolytica
GEYDLLLIITLRDLLYLIIKSFTM

SEQ ID NO: 2594087 - protein, 19 aa, Entamoeba histolytica
GEYQICFYVSNAPRYDIEY

SEQ ID NO: 2594088 - protein, 19 aa, Entamoeba histolytica
GFALWLTTKPIVSGNNFGG

SEQ ID NO: 2594089 - protein, 37 aa, Entamoeba histolytica
GFANKKYFLLLLFYVTLMILFVLLINTPLAIYAFFYP

SEQ ID NO: 2594090 - protein, 31 aa, Entamoeba histolytica; identical to SEQ ID NO: 2397127

SEQ ID NO: 2594091 - protein, 23 aa, Entamoeba histolytica
GFDLLNLFIYRKPSLVTTESIMT

SEQ ID NO: 2594092 - protein, 19 aa, Entamoeba histolytica
GFDYNSSIILLIVLIVIVI

SEQ ID NO: 2594093 - protein, 20 aa, Entamoeba histolytica
GFFYQWVMAIGVLLAGIFTL

SEQ ID NO: 2594094 - protein, 21 aa, Entamoeba histolytica
GFGKLRVNFIEFTNGGNLQVS

SEQ ID NO: 2594095 - protein, 32 aa, Entamoeba histolytica
GFGSYIVVILFFFFSHIFYTLFIIVDFIQHYH

SEQ ID NO: 2594096 - protein, 17 aa, Entamoeba histolytica
GFIALILAYFYLLENNV

SEQ ID NO: 2594097 - protein, 21 aa, Entamoeba histolytica
GFIGIPFYSFFGNGFLVILNT

SEQ ID NO: 2594098 - protein, 25 aa, Entamoeba histolytica
GFIVIGIILAIIVITGIIVHKKHRL

SEQ ID NO: 2594099 - protein, 22 aa, Entamoeba histolytica
GFKEEIIISILLLSIITIPFCN

SEQ ID NO: 2594100 - protein, 39 aa, Entamoeba histolytica
GFKNHKYFIQFLWYTLFILILGFLWHCYGLYNSYSLLQQ

SEQ ID NO: 2594101 - protein, 19 aa, Entamoeba histolytica
GFLHFLIGICSIVGGIFTT

SEQ ID NO: 2594102 - protein, 26 aa, Entamoeba histolytica
GFLVVVMVFRFFLCKGRLIVLRRFVT

SEQ ID NO: 2594103 - protein, 19 aa, Entamoeba histolytica
GFLYIIMEYMESGSLLNIV

SEQ ID NO: 2594104 - protein, 21 aa, Entamoeba histolytica
GFPLFIFLLKIVPWEQWYRLL

SEQ ID NO: 2594105 - protein, 18 aa, Entamoeba histolytica
GFSTYAISALKKRFSLTA

SEQ ID NO: 2594106 - protein, 23 aa, Entamoeba histolytica
GFSVITFFMIASYALGSWYGSLV

SEQ ID NO: 2594107 - protein, 18 aa, Entamoeba histolytica
GFTLLRFFVTPYRWVVLR

SEQ ID NO: 2594108 - protein, 25 aa, Entamoeba histolytica
GFVELIFVEFIQSNYFFFCNNGEIC

SEQ ID NO: 2594109 - protein, 25 aa, Entamoeba histolytica
GFVSYHPFYEIMRRMLLSIYELCPT

SEQ ID NO: 2594110 - protein, 25 aa, Entamoeba histolytica
GFVYYLLNGFLISNANGKWFIFHSS

SEQ ID NO: 2594111 - protein, 29 aa, Entamoeba histolytica
GGAAPLMFILVYIALGIIVKIWCLVPLGV

SEQ ID NO: 2594112 - protein, 33 aa, Entamoeba histolytica
GGAIGIFIGMIVDTLLVIIYSNKLGQPKSHSKH

SEQ ID NO: 2594113 - protein, 27 aa, Entamoeba histolytica
GGAYICTFLLMSTLIYWVFGYSFIQKN

SEQ ID NO: 2594114 - protein, 29 aa, Entamoeba histolytica
GGDGRWWAKKRMLIYLKRRWEKSNETVQL

SEQ ID NO: 2594115 - protein, 18 aa, Entamoeba histolytica
GGFIIKNSWTLQSGHSMG

SEQ ID NO: 2594116 - protein, 24 aa, Entamoeba histolytica
GGHYLCTIILSTLPIIFDKAETIA

SEQ ID NO: 2594117 - protein, 23 aa, Entamoeba histolytica
GGHYYLFVGMKRGVDCTLTVSIV

SEQ ID NO: 2594118 - protein, 23 aa, Entamoeba histolytica
GGIGLYLTYFLSKENIHKYKENE

SEQ ID NO: 2594119 - protein, 27 aa, Entamoeba histolytica
GGITLLLIAWILSAFAMYLLTYVSAKT

SEQ ID NO: 2594120 - protein, 32 aa, Entamoeba histolytica
GGIVLSFYIMINWFFTLMEYLSIMSGKAAPKE

SEQ ID NO: 2594121 - protein, 33 aa, Entamoeba histolytica
GGIVLSFYIMLNWFMTLLEYLSIMSGKAAPQEF

SEQ ID NO: 2594122 - protein, 17 aa, Entamoeba histolytica
GGKIDFSGINLKEKMIE

SEQ ID NO: 2594123 - protein, 28 aa, Entamoeba histolytica
GGLLSIVCIITMIWMFSSELNDYFTIRK

SEQ ID NO: 2594124 - protein, 24 aa, Entamoeba histolytica
GGLPLSAIILIGFFIINVTTMNYL

SEQ ID NO: 2594125 - protein, 24 aa, Entamoeba histolytica
GGLVFFHLFRSFMKHTRLTLQPST

SEQ ID NO: 2594126 - protein, 17 aa, Entamoeba histolytica
GGPILYYPDPNKISSGG

SEQ ID NO: 2594127 - protein, 33 aa, Entamoeba histolytica; identical to SEQ ID NO: 2397169

SEQ ID NO: 2594128 - protein, 36 aa, Entamoeba histolytica
GGSTGLLFFFVFCAFWIGYIYVIQLIERFYKPEKGT

SEQ ID NO: 2594129 - protein, 23 aa, Entamoeba histolytica
GGTIYVIILLIIKIISYYRSIKQ

SEQ ID NO: 2594130 - protein, 33 aa, Entamoeba histolytica; identical to SEQ ID NO: 2397171

SEQ ID NO: 2594131 - protein, 30 aa, Entamoeba histolytica
GGVAWSTYWHYFRAGGFIGLILCLIPFVVR

SEQ ID NO: 2594132 - protein, 39 aa, Entamoeba histolytica
GGVKPRKGLWYKVVNNYKYAFPLFIQTNVLLASSTKHTA

SEQ ID NO: 2594133 - protein, 23 aa, Entamoeba histolytica
GGYPLGWTLFGVTFFLIFFVDRV

SEQ ID NO: 2594134 - protein, 17 aa, Entamoeba histolytica
GHFKCLSCDSSLNLYLL

SEQ ID NO: 2594135 - protein, 29 aa, Entamoeba histolytica
GHIISIIFIFIIYGLTCYIPGYSTYDISW

SEQ ID NO: 2594136 - protein, 21 aa, Entamoeba histolytica
GHLDLFIRDWKKYYPAKVMLH

SEQ ID NO: 2594137 - protein, 21 aa, Entamoeba histolytica
GHPLYFYHVHFALNSGMKEDN

SEQ ID NO: 2594138 - protein, 18 aa, Entamoeba histolytica
GHTMMVMEYAPFGSVKKA

SEQ ID NO: 2594139 - protein, 17 aa, Entamoeba histolytica
GHYKISDGFITCLECDD

SEQ ID NO: 2594140 - protein, 25 aa, Entamoeba histolytica
GIAEVQVFAYEKLQLSYKSSRDPHI

SEQ ID NO: 2594141 - protein, 23 aa, Entamoeba histolytica
GIAIVLFCTILCELVYHVGYTIN

SEQ ID NO: 2594142 - protein, 32 aa, Entamoeba histolytica
GIAYMAENLFFYFKFPNLISLPLNFSAETKKN

SEQ ID NO: 2594143 - protein, 26 aa, Entamoeba histolytica
GICEYPWDIIDFIQKDNYLPFPEEAT

SEQ ID NO: 2594144 - protein, 18 aa, Entamoeba histolytica
GICLSCKSGYYLETNKTC

SEQ ID NO: 2594145 - protein, 25 aa, Entamoeba histolytica
GICYVYSFFLFKRKDWDYTGKHIFI

SEQ ID NO: 2594146 - protein, 22 aa, Entamoeba histolytica
GIDVPSLYYYLHPLYAQQIYDS

SEQ ID NO: 2594147 - protein, 19 aa, Entamoeba histolytica
GIECGTPWYWVLTAIGGPL

SEQ ID NO: 2594148 - protein, 28 aa, Entamoeba histolytica
GIEGWLKPLLEIPAFQIKLKMWVESMLI

SEQ ID NO: 2594149 - protein, 25 aa, Entamoeba histolytica
GIEIVLTLYSFLIAFPQSLFINRGN

SEQ ID NO: 2594150 - protein, 17 aa, Entamoeba histolytica
GIELIYELKRRIVELLY

SEQ ID NO: 2594151 - protein, 23 aa, Entamoeba histolytica
GIESSLYMFRWLTLLCCMEFTLF

SEQ ID NO: 2594152 - protein, 18 aa, Entamoeba histolytica
GIFIFMVLSLCLLSYVNH

SEQ ID NO: 2594153 - protein, 19 aa, Entamoeba histolytica
GIFIVDVLMVFMSVLFISQ

SEQ ID NO: 2594154 - protein, 17 aa, Entamoeba histolytica
GIFVAIKTFKMSFTDEE

SEQ ID NO: 2594155 - protein, 30 aa, Entamoeba histolytica
GIGGGAIFPFFTLKIVDLIMCLLSINSDTL

SEQ ID NO: 2594156 - protein, 34 aa, Entamoeba histolytica
GIGMFALVVVALVELLLVLLQRILCGLSRKNATY

SEQ ID NO: 2594157 - protein, 31 aa, Entamoeba histolytica
GIIAAIFIAFIVIVIIVTIIVVVIIKKKGKS

SEQ ID NO: 2594158 - protein, 18 aa, Entamoeba histolytica
GIIGAKHYNFTFSGKTLP

SEQ ID NO: 2594159 - protein, 19 aa, Entamoeba histolytica
GIILRYLPNDRLTLCSNKP

SEQ ID NO: 2594160 - protein, 26 aa, Entamoeba histolytica
GIINVLFLIFVIGSISYFSYDLRQLF

SEQ ID NO: 2594161 - protein, 34 aa, Entamoeba histolytica
GIISIAFMDITLLPFLVFPIVIMGYTHYAKWIGP

SEQ ID NO: 2594162 - protein, 20 aa, Entamoeba histolytica
GIISLMEFFGLKSKVLEAFT

SEQ ID NO: 2594163 - protein, 21 aa, Entamoeba histolytica
GIIVKIWCLVPLGVMAIFLIL

SEQ ID NO: 2594164 - protein, 24 aa, Entamoeba histolytica
GIIVSSIYFGIFLGLAVLAYIIYN

SEQ ID NO: 2594165 - protein, 25 aa, Entamoeba histolytica
GIKCSFIPIILYLMVALLSINSQRY

SEQ ID NO: 2594166 - protein, 17 aa, Entamoeba histolytica
GIKCTFFGIYKTCVLVK

SEQ ID NO: 2594167 - protein, 19 aa, Entamoeba histolytica
GIKDYFINFFPKGIPKKKL

SEQ ID NO: 2594168 - protein, 19 aa, Entamoeba histolytica
GIKLLIKYCDNADYEEIKE

SEQ ID NO: 2594169 - protein, 22 aa, Entamoeba histolytica
GILAGCVIAIILKRRSSGYATL

SEQ ID NO: 2594170 - protein, 25 aa, Entamoeba histolytica
GILFFISMFGFIFYLNMTSNPIVCG

SEQ ID NO: 2594171 - protein, 17 aa, Entamoeba histolytica
GILFKYINPLKTRWYVV

SEQ ID NO: 2594172 - protein, 17 aa, Entamoeba histolytica
GILLFVINIAQLVAFFI

SEQ ID NO: 2594173 - protein, 31 aa, Entamoeba histolytica
GILSIINEVFLQLKLLWPSFNIINTTSDLFN

SEQ ID NO: 2594174 - protein, 17 aa, Entamoeba histolytica
GILSVLVIIPFGFGLPS

SEQ ID NO: 2594175 - protein, 21 aa, Entamoeba histolytica
GINCQTIPSIPFYLKEKTVGS

SEQ ID NO: 2594176 - protein, 28 aa, Entamoeba histolytica
GINDDITYLPFFSFLQFEETIISSLLKN

SEQ ID NO: 2594177 - protein, 23 aa, Entamoeba histolytica
GINGIVIILNYNTNRISNNIIIM

SEQ ID NO: 2594178 - protein, 17 aa, Entamoeba histolytica
GINGIVIVLNYNTNRIS

SEQ ID NO: 2594179 - protein, 23 aa, Entamoeba histolytica
GINGIVIVLNYNTNRISNNIKIM

SEQ ID NO: 2594180 - protein, 32 aa, Entamoeba histolytica
GINQPISMYYPLLTFLVYAISLTDSPFETFQT

SEQ ID NO: 2594181 - protein, 30 aa, Entamoeba histolytica; identical to SEQ ID NO: 2525295

SEQ ID NO: 2594182 - protein, 17 aa, Entamoeba histolytica
GIPFAYFTGGLPLSAII

SEQ ID NO: 2594183 - protein, 28 aa, Entamoeba histolytica
GIPKKKLFPLLLMLLIEGISQNILNAYV

SEQ ID NO: 2594184 - protein, 26 aa, Entamoeba histolytica
GIPPEVWRYYLLINRPEQSDTVFLWN

SEQ ID NO: 2594185 - protein, 18 aa, Entamoeba histolytica
GIPSLLPFLKAVCGSKKS

SEQ ID NO: 2594186 - protein, 20 aa, Entamoeba histolytica
GIQFISYLLTFIGSIVLDSS

SEQ ID NO: 2594187 - protein, 27 aa, Entamoeba histolytica
GIQSIQFFIIFKFIEFFLLDEALYTQF

SEQ ID NO: 2594188 - protein, 24 aa, Entamoeba histolytica
GISFTIFLFICSLVDFLNSLSVCL

SEQ ID NO: 2594189 - protein, 17 aa, Entamoeba histolytica
GISIKRLLEEENRMNAQ

SEQ ID NO: 2594190 - protein, 29 aa, Entamoeba histolytica
GISLITFTTFIIISFPLINLNKLKHKEYL

SEQ ID NO: 2594191 - protein, 21 aa, Entamoeba histolytica
GISLPLFFMGHSMGGLLTSIL

SEQ ID NO: 2594192 - protein, 17 aa, Entamoeba histolytica
GISNYCFTFIRTILHWY

SEQ ID NO: 2594193 - protein, 34 aa, Entamoeba histolytica
GISWIFNYYLNTLPSWRWYYKFHYAPFALDFALY

SEQ ID NO: 2594194 - protein, 32 aa, Entamoeba histolytica
GITGFIIITTILLLILRKYLKRRYETQQWINQ

SEQ ID NO: 2594195 - protein, 21 aa, Entamoeba histolytica
GITIFVWILTFIQSFLFFMTY

SEQ ID NO: 2594196 - protein, 21 aa, Entamoeba histolytica
GITSLPFKITIPMLNFVPEEQ

SEQ ID NO: 2594197 - protein, 27 aa, Entamoeba histolytica
GIVGGAVFPIFTIKFIDLIVMMMELQD

SEQ ID NO: 2594198 - protein, 25 aa, Entamoeba histolytica
GIVGLTRALLILDYMLRYHNDFSAD

SEQ ID NO: 2594199 - protein, 19 aa, Entamoeba histolytica
GIVVVLPFHEDKFSEVIQI

SEQ ID NO: 2594200 - protein, 19 aa, Entamoeba histolytica
GIWGKIVSWLLFIGALLTS

SEQ ID NO: 2594201 - protein, 17 aa, Entamoeba histolytica
GIYYYFQSPVTDTMVVE

SEQ ID NO: 2594202 - protein, 27 aa, Entamoeba histolytica
GKAMLIAIIPRLIFDITMFIPIVAQTI

SEQ ID NO: 2594203 - protein, 20 aa, Entamoeba histolytica
GKCIYYKYVIPNCQIYSGEC

SEQ ID NO: 2594204 - protein, 23 aa, Entamoeba histolytica
GKDLYIDVILISNVVIPFNIHSL

SEQ ID NO: 2594205 - protein, 25 aa, Entamoeba histolytica
GKDNIVFHSVLFPSTLLGTGESWTM

SEQ ID NO: 2594206 - protein, 24 aa, Entamoeba histolytica
GKFKTLRQFCQIWNILSNSKQHYS

SEQ ID NO: 2594207 - protein, 18 aa, Entamoeba histolytica
GKFRIEGGKIDFSGINLK

SEQ ID NO: 2594208 - protein, 41 aa, Entamoeba histolytica
GKIAAIIISIIILVSIIILIGIVIYLLYKRYQRHLEITRAT

SEQ ID NO: 2594209 - protein, 22 aa, Entamoeba histolytica
GKIDCISYCPWYIKTEMTKIRE

SEQ ID NO: 2594210 - protein, 28 aa, Entamoeba histolytica
GKKESEKWGFWKTVVVIGLGAAGVVALV

SEQ ID NO: 2594211 - protein, 20 aa, Entamoeba histolytica
GKKITLYINGLLKSTAKLIN

SEQ ID NO: 2594212 - protein, 26 aa, Entamoeba histolytica
GKLIGWELPYHLFPPSLHPCCQKYSK

SEQ ID NO: 2594213 - protein, 20 aa, Entamoeba histolytica
GKNIDIFPITLGNSSIVGPI

SEQ ID NO: 2594214 - protein, 25 aa, Entamoeba histolytica
GKRLERIPTIPEKLYKIIEECWKPN

SEQ ID NO: 2594215 - protein, 23 aa, Entamoeba histolytica
GKSYQIWLPLGKIQPAKVRPNSF

SEQ ID NO: 2594216 - protein, 24 aa, Entamoeba histolytica
GKTDNYFMEPLYLNCLLTHSDENN

SEQ ID NO: 2594217 - protein, 21 aa, Entamoeba histolytica
GKTLSFLIPIVQRLIELDKTD

SEQ ID NO: 2594218 - protein, 22 aa, Entamoeba histolytica
GKVELRLTAIKYQKKYFNNARM

SEQ ID NO: 2594219 - protein, 22 aa, Entamoeba histolytica
GKVLFLIDGLTIEPIPLTKTMK

SEQ ID NO: 2594220 - protein, 23 aa, Entamoeba histolytica
GKYGILMGIFLPTILLAQPFANT

SEQ ID NO: 2594221 - protein, 24 aa, Entamoeba histolytica
GKYTQFNLEKYKSLLYITVERKEC

SEQ ID NO: 2594222 - protein, 28 aa, Entamoeba histolytica
GLASPVMFIVLFVLIYINMGKWVYVPLI

SEQ ID NO: 2594223 - protein, 48 aa, Entamoeba histolytica
GLASPVMFIVLFVLIYIYMGKWVYIPLIVFVVFNIINFGFGFLSGFLY

SEQ ID NO: 2594224 - protein, 19 aa, Entamoeba histolytica
GLCEVHLVLFIHHLLPEEL

SEQ ID NO: 2594225 - protein, 24 aa, Entamoeba histolytica
GLCLIYLGFLALVGISLGLSSIAP

SEQ ID NO: 2594226 - protein, 35 aa, Entamoeba histolytica
GLDNKGFVNLPYLLRFDFLNILRDFDYLYEKDCPK

SEQ ID NO: 2594227 - protein, 18 aa, Entamoeba histolytica
GLDPIPFRCLLKFSKKEN

SEQ ID NO: 2594228 - protein, 23 aa, Entamoeba histolytica
GLDRRTVIHLFGLTMLHTKKDDY

SEQ ID NO: 2594229 - protein, 30 aa, Entamoeba histolytica
GLELFAIYITSFMLGLLLFAACTFHYQMAS

SEQ ID NO: 2594230 - protein, 24 aa, Entamoeba histolytica
GLELIYLILTMKYDDKHKGNMNVV

SEQ ID NO: 2594231 - protein, 18 aa, Entamoeba histolytica
GLFFVLFFVLLCFVLMLV

SEQ ID NO: 2594232 - protein, 36 aa, Entamoeba histolytica
GLFLLDFILIILSIVFCLWIVLLIVKLELNTEWSFS

SEQ ID NO: 2594233 - protein, 19 aa, Entamoeba histolytica
GLFYIGCYCTTLKETVVTK

SEQ ID NO: 2594234 - protein, 28 aa, Entamoeba histolytica
GLGFSVITFFMIASYALGSWYGSLVIRG

SEQ ID NO: 2594235 - protein, 24 aa, Entamoeba histolytica
GLGITFYMLVWAISIFEPLLADYY

SEQ ID NO: 2594236 - protein, 27 aa, Entamoeba histolytica
GLGPKKIIWWVAIIFTILSIIEVICIP

SEQ ID NO: 2594237 - protein, 26 aa, Entamoeba histolytica
GLGTIIDILIFTLLVSIGLPGGFAQT

SEQ ID NO: 2594238 - protein, 22 aa, Entamoeba histolytica
GLILCLIPFVVRCASRVCYNLF

SEQ ID NO: 2594239 - protein, 37 aa, Entamoeba histolytica
GLILKTKIVYWIYYLLMILLFFFPKIFIPCPSNHKIF

SEQ ID NO: 2594240 - protein, 23 aa, Entamoeba histolytica
GLKGKWFVYTPKETEKVLIQTDD

SEQ ID NO: 2594241 - protein, 30 aa, Entamoeba histolytica
GLLAYFVFFLLYFILYYLPSNKSPFSVVDD

SEQ ID NO: 2594242 - protein, 18 aa, Entamoeba histolytica
GLLEKVRGPDKMLMTIMM

SEQ ID NO: 2594243 - protein, 18 aa, Entamoeba histolytica
GLLIDKWEIIPIEEMLLV

SEQ ID NO: 2594244 - protein, 20 aa, Entamoeba histolytica
GLLLLIILYIWFPKQQKRDR

SEQ ID NO: 2594245 - protein, 19 aa, Entamoeba histolytica
GLLSTYCYIGIFASSAEYL

SEQ ID NO: 2594246 - protein, 27 aa, Entamoeba histolytica
GLSHIKPFFLAILYTKLQYGFFNPFNS

SEQ ID NO: 2594247 - protein, 23 aa, Entamoeba histolytica
GLSQSLLAFLRLIGPLVSSPLVA

SEQ ID NO: 2594248 - protein, 22 aa, Entamoeba histolytica
GLSSFQIFLYGIIPGFYSCTNG

SEQ ID NO: 2594249 - protein, 25 aa, Entamoeba histolytica
GLSSSIFYLFLDRLYIPYYSVLPET

SEQ ID NO: 2594250 - protein, 40 aa, Entamoeba histolytica
GLSTGMKIFIGIFIIVAVITIIAGIIAIIFAVVKTKKSGY

SEQ ID NO: 2594251 - protein, 25 aa, Entamoeba histolytica
GLSVIFERLYLFILNSSLSTPQQKQ

SEQ ID NO: 2594252 - protein, 18 aa, Entamoeba histolytica
GLSYLPLTKEYLNTQISI

SEQ ID NO: 2594253 - protein, 20 aa, Entamoeba histolytica
GLTEGVFLEFPDMAKVPITL

SEQ ID NO: 2594254 - protein, 23 aa, Entamoeba histolytica
GLTVFMCTIFSREWIKVSGSSSA

SEQ ID NO: 2594255 - protein, 23 aa, Entamoeba histolytica
GLVFSFICALFYLLHAFGPCQKC

SEQ ID NO: 2594256 - protein, 23 aa, Entamoeba histolytica
GLVIWIISFISMLAGKRFNKHNR

SEQ ID NO: 2594257 - protein, 26 aa, Entamoeba histolytica
GLVKVILELFSQWLLPNPSKIDHILS

SEQ ID NO: 2594258 - protein, 36 aa, Entamoeba histolytica; identical to SEQ ID NO: 2525490

SEQ ID NO: 2594259 - protein, 20 aa, Entamoeba histolytica
GLYGLIVCILLFINVTKSEY

SEQ ID NO: 2594260 - protein, 23 aa, Entamoeba histolytica
GLYLLIFFLFVYFSILYVKPHII

SEQ ID NO: 2594261 - protein, 22 aa, Entamoeba histolytica
GMEMLLKNYWKLYVKGKRLSKG

SEQ ID NO: 2594262 - protein, 20 aa, Entamoeba histolytica
GMFIVQLVLDIAFFLTCKWA

SEQ ID NO: 2594263 - protein, 18 aa, Entamoeba histolytica
GMFSVLYRFIFSSDVNTF

SEQ ID NO: 2594264 - protein, 20 aa, Entamoeba histolytica
GMIIGYYFYCYKTITVTFTG

SEQ ID NO: 2594265 - protein, 18 aa, Entamoeba histolytica
GMLQYIMIFSSFSWFCVC

SEQ ID NO: 2594266 - protein, 20 aa, Entamoeba histolytica
GMLSQLRHQTIVSLIGAVYT

SEQ ID NO: 2594267 - protein, 31 aa, Entamoeba histolytica
GMMFDFSVYFYWLVLPVLLKKLQAGPILIGA

SEQ ID NO: 2594268 - protein, 18 aa, Entamoeba histolytica
GMMIGFSSIVYLLLVAMQ

SEQ ID NO: 2594269 - protein, 23 aa, Entamoeba histolytica
GMNIKNYWFNPAFNNIFSFKENH

SEQ ID NO: 2594270 - protein, 18 aa, Entamoeba histolytica
GMNYQKLYFAYLTTEPEE

SEQ ID NO: 2594271 - protein, 32 aa, Entamoeba histolytica; identical to SEQ ID NO: 2397287

SEQ ID NO: 2594272 - protein, 19 aa, Entamoeba histolytica
GMYYLHSKIPPIIHRDLKS

SEQ ID NO: 2594273 - protein, 23 aa, Entamoeba histolytica
GNAVFFNNLLFYGGTKVSGGISN

SEQ ID NO: 2594274 - protein, 26 aa, Entamoeba histolytica
GNEDDLLKYMLFWKNSSLLIYDIETS

SEQ ID NO: 2594275 - protein, 29 aa, Entamoeba histolytica
GNEIFKNAILVTPYLPFTTDYNIADKVWK

SEQ ID NO: 2594276 - protein, 25 aa, Entamoeba histolytica
GNFGARLLIKIFSICIDKMYSKKPV

SEQ ID NO: 2594277 - protein, 25 aa, Entamoeba histolytica
GNFIPYGVLIYYNDPALPSLMQCIM

SEQ ID NO: 2594278 - protein, 23 aa, Entamoeba histolytica
GNGSLLTLLLSLLPLVMAGIVAV

SEQ ID NO: 2594279 - protein, 25 aa, Entamoeba histolytica
GNGVIIRFFAWLNYLKENKGKYDRV

SEQ ID NO: 2594280 - protein, 19 aa, Entamoeba histolytica
GNHFLICSIYALFKSYGSD

SEQ ID NO: 2594281 - protein, 23 aa, Entamoeba histolytica
GNIFTNHMVVLVGFGFEAQGEGV

SEQ ID NO: 2594282 - protein, 32 aa, Entamoeba histolytica
GNLILYNIPPCIYYLYPYGNVALWIGLGAFGI

SEQ ID NO: 2594283 - protein, 23 aa, Entamoeba histolytica
GNMALLCFDILLLVFVFWIFTSY

SEQ ID NO: 2594284 - protein, 24 aa, Entamoeba histolytica
GNNIIINLKKPLGPFYSKPVVDEF

SEQ ID NO: 2594285 - protein, 25 aa, Entamoeba histolytica
GNNKRLLCRSLIYNPEPYYSKHNTC

SEQ ID NO: 2594286 - protein, 25 aa, Entamoeba histolytica
GNPTCLTCFGGYYLINNGNECVNAT

SEQ ID NO: 2594287 - protein, 25 aa, Entamoeba histolytica
GNQILGIWIQKLLAPNYDADLISSA

SEQ ID NO: 2594288 - protein, 18 aa, Entamoeba histolytica
GNRFVPKGSFFMCQCIFD

SEQ ID NO: 2594289 - protein, 42 aa, Entamoeba histolytica
GNSFIDIIINFIVTIALYVGLICWVICVIVILVMSCVVIYLK

SEQ ID NO: 2594290 - protein, 26 aa, Entamoeba histolytica
GNTGLFMTSILGLIGFITCSTIALIQ

SEQ ID NO: 2594291 - protein, 25 aa, Entamoeba histolytica
GNYNKTIILFVIKYSFCNYSLIETT

SEQ ID NO: 2594292 - protein, 23 aa, Entamoeba histolytica
GPEGTLLGLLTPSEVFELPQGIS

SEQ ID NO: 2594293 - protein, 23 aa, Entamoeba histolytica
GPEQWDMLMVTKPIVLTTHFLNV

SEQ ID NO: 2594294 - protein, 22 aa, Entamoeba histolytica
GPIFLEPFSMIGGLLWATGNLT

SEQ ID NO: 2594295 - protein, 28 aa, Entamoeba histolytica
GPLRQLILFNFFLGGYVFLPYVFSIEKS

SEQ ID NO: 2594296 - protein, 29 aa, Entamoeba histolytica
GPLRQLILFNFFLGGYVFLPYVFSIEKST

SEQ ID NO: 2594297 - protein, 21 aa, Entamoeba histolytica
GPSLLVPIGLIILTFLQSKDI

SEQ ID NO: 2594298 - protein, 25 aa, Entamoeba histolytica
GPTKQYYFKLLKRQLDLITDDMRWD

SEQ ID NO: 2594299 - protein, 26 aa, Entamoeba histolytica
GQFAPFNILVYLFFKKAYGLYTIKSK

SEQ ID NO: 2594300 - protein, 24 aa, Entamoeba histolytica
GQFLRWFNFACLVLYLYGSLWAYA

SEQ ID NO: 2594301 - protein, 25 aa, Entamoeba histolytica
GQIFAKIFFSLLIGSVFFNIQNDQQ

SEQ ID NO: 2594302 - protein, 20 aa, Entamoeba histolytica
GQILYVPIAIGFVSYHPFYE

SEQ ID NO: 2594303 - protein, 18 aa, Entamoeba histolytica
GQISFFIPVPTSKPKKFK

SEQ ID NO: 2594304 - protein, 24 aa, Entamoeba histolytica
GQKIGDFYIPLNYIVFAGNCKLDK

SEQ ID NO: 2594305 - protein, 22 aa, Entamoeba histolytica
GQKKIKIFNGFYSTATELADVF

SEQ ID NO: 2594306 - protein, 30 aa, Entamoeba histolytica
GQLYIIMLPMSMYLLILTPHLRFLALASAP

SEQ ID NO: 2594307 - protein, 25 aa, Entamoeba histolytica
GQQQGGLVPPRIQEETPSQKEKHEK

SEQ ID NO: 2594308 - protein, 30 aa, Entamoeba histolytica
GQSMKFIPIILLRPLFRIPLKQNDLVIGVI

SEQ ID NO: 2594309 - protein, 34 aa, Entamoeba histolytica; identical to SEQ ID NO: 2397337

SEQ ID NO: 2594310 - protein, 18 aa, Entamoeba histolytica
GQTRTIYVLQNGLIAVIL

SEQ ID NO: 2594311 - protein, 25 aa, Entamoeba histolytica
GQYIKKYFRTIFNYVSKQKEGKIIV

SEQ ID NO: 2594312 - protein, 17 aa, Entamoeba histolytica
GQYSRYLFILMSSKIPD

SEQ ID NO: 2594313 - protein, 26 aa, Entamoeba histolytica
GQYVLTFVMIPLFPPVMKLFNHLDQN

SEQ ID NO: 2594314 - protein, 25 aa, Entamoeba histolytica
GRHNLLLFYLFFLTLIALCLYGFVC

SEQ ID NO: 2594315 - protein, 25 aa, Entamoeba histolytica
GRKGIIYYLSLLLSTKYTKSTKVYY

SEQ ID NO: 2594316 - protein, 44 aa, Entamoeba histolytica
GRQLKYWGTLVIVYWIFFFILLLILILLYIKLTKKIKQEIDDEK

SEQ ID NO: 2594317 - protein, 27 aa, Entamoeba histolytica
GRRRPFMIIGLGVWLFGAIIIVCSSIY

SEQ ID NO: 2594318 - protein, 18 aa, Entamoeba histolytica
GRVFGQRAVAWAFPGEIV

SEQ ID NO: 2594319 - protein, 22 aa, Entamoeba histolytica
GRVIIFIIRCSILFVTTLCACF

SEQ ID NO: 2594320 - protein, 31 aa, Entamoeba histolytica
GRVINTLYRAWIKLLPQDKLLWMSIIQHHKT

SEQ ID NO: 2594321 - protein, 19 aa, Entamoeba histolytica
GRVLIPVTLYAEAGMVTQQ

SEQ ID NO: 2594322 - protein, 25 aa, Entamoeba histolytica
GRVVLPILIPLYIPLEKRTKYCNFE

SEQ ID NO: 2594323 - protein, 23 aa, Entamoeba histolytica
GRYTTLFPLCVVLIFSGIKEIYE

SEQ ID NO: 2594324 - protein, 29 aa, Entamoeba histolytica
GRYYCQVITSLLPVLFAKNENICKERLKY

SEQ ID NO: 2594325 - protein, 50 aa, Entamoeba histolytica
GSCRSKPIGWWVWLLIALGIVFIFICSIVIIFLLIRFTKGHKIDLNVFKT

SEQ ID NO: 2594326 - protein, 69 aa, Entamoeba histolytica
GSEIFSIAIYFISFFVLKSYFDLSFVFSWQFWWKLVVIILLTSIPFIAKFFYQLIFPPKYMTVENRRCP

SEQ ID NO: 2594327 - protein, 25 aa, Entamoeba histolytica
GSEYSIFKYGYSLSLSFLESFRYNY

SEQ ID NO: 2594328 - protein, 20 aa, Entamoeba histolytica
GSFGIVYLGEFRGSKVAIKR

SEQ ID NO: 2594329 - protein, 24 aa, Entamoeba histolytica
GSFGIVYLGIFRGNKVAIKRLKQL

SEQ ID NO: 2594330 - protein, 23 aa, Entamoeba histolytica
GSHTPMFIGQTRVVRYYCQYQRA

SEQ ID NO: 2594331 - protein, 17 aa, Entamoeba histolytica
GSIATIVAFIAIALFFV

SEQ ID NO: 2594332 - protein, 23 aa, Entamoeba histolytica
GSLCLMIFCYCYIKPFRKVIKIE

SEQ ID NO: 2594333 - protein, 17 aa, Entamoeba histolytica
GSLFIAVVCGVTSLLTG

SEQ ID NO: 2594334 - protein, 24 aa, Entamoeba histolytica
GSLRWLPYCHLINNSVFIVHGGLP

SEQ ID NO: 2594335 - protein, 26 aa, Entamoeba histolytica
GSSFASLFMMTFPKYVNSVKPIEGKY

SEQ ID NO: 2594336 - protein, 26 aa, Entamoeba histolytica
GSSLLITFIYYFILFSIEYLSRSYRY

SEQ ID NO: 2594337 - protein, 26 aa, Entamoeba histolytica
GSSRYKIHLYILQLIIQSYSNSLCIE

SEQ ID NO: 2594338 - protein, 33 aa, Entamoeba histolytica
GSSVGLLFIMGLFILLFFVLLRYERADIEVFKQ

SEQ ID NO: 2594339 - protein, 22 aa, Entamoeba histolytica
GSSWYFIMYIVCGTMSLFGSYL

SEQ ID NO: 2594340 - protein, 30 aa, Entamoeba histolytica
GSVMSIMVIPKYIIISFISSQILIFNNENN

SEQ ID NO: 2594341 - protein, 29 aa, Entamoeba histolytica
GSYGLIVFVVLIFIIIRFISLGAFNGRAS

SEQ ID NO: 2594342 - protein, 25 aa, Entamoeba histolytica
GTAATGFVFMLAMLASLNYQINKHI

SEQ ID NO: 2594343 - protein, 26 aa, Entamoeba histolytica
GTAIQVTFKIKILCTCSLSDQLGISA

SEQ ID NO: 2594344 - protein, 31 aa, Entamoeba histolytica
GTCVPVCICCWFLNLFQSKKTRIIYLESVCR

SEQ ID NO: 2594345 - protein, 22 aa, Entamoeba histolytica
GTCVYYCTIPTKLNPDNIVVLE

SEQ ID NO: 2594346 - protein, 20 aa, Entamoeba histolytica
GTCWDFALIGFLEDSYRQNG

SEQ ID NO: 2594347 - protein, 24 aa, Entamoeba histolytica
GTCWIFATISLIESSLRKIAIENG

SEQ ID NO: 2594348 - protein, 17 aa, Entamoeba histolytica
GTDLVCPCQSLTGYECE

SEQ ID NO: 2594349 - protein, 53 aa, Entamoeba histolytica; identical to SEQ ID NO: 2397374

SEQ ID NO: 2594350 - protein, 23 aa, Entamoeba histolytica
GTFGIVYLGIFRGNKVAIKRMKD

SEQ ID NO: 2594351 - protein, 18 aa, Entamoeba histolytica
GTFLLGIPLWYVHVSNVY

SEQ ID NO: 2594352 - protein, 24 aa, Entamoeba histolytica
GTGLGCMMFFIMSSNALGSWYGNF

SEQ ID NO: 2594353 - protein, 23 aa, Entamoeba histolytica
GTHSFYGTWFKYVSTSSQSVFID

SEQ ID NO: 2594354 - protein, 27 aa, Entamoeba histolytica
GTKPKEWTMKYTKYPYWRCGLTFTNEE

SEQ ID NO: 2594355 - protein, 34 aa, Entamoeba histolytica
GTKTMTIWSILILVNIIVFLLSLHSSVFFETPLK

SEQ ID NO: 2594356 - protein, 22 aa, Entamoeba histolytica
GTLGFLPEKVGVQTQLLITVVV

SEQ ID NO: 2594357 - protein, 23 aa, Entamoeba histolytica
GTLPAFFDFFVTSRLRNVLVSIV

SEQ ID NO: 2594358 - protein, 24 aa, Entamoeba histolytica
GTLSIIVFLLFNLIRFTPFDINQK

SEQ ID NO: 2594359 - protein, 27 aa, Entamoeba histolytica
GTLSIIVFLLFNLIRFTPFDINQKYES

SEQ ID NO: 2594360 - protein, 20 aa, Entamoeba histolytica
GTNLNLVSFFKKVNGIDISN

SEQ ID NO: 2594361 - protein, 33 aa, Entamoeba histolytica
GTNTKYHFKGMNKIIIYGLIGSLFIAVVCGVTS

SEQ ID NO: 2594362 - protein, 24 aa, Entamoeba histolytica
GTSVLFIFLIIQGIGLAAFWSPDE

SEQ ID NO: 2594363 - protein, 25 aa, Entamoeba histolytica
GTSYYASMFGCSIMRKLKSFNTVEF

SEQ ID NO: 2594364 - protein, 40 aa, Entamoeba histolytica; identical to SEQ ID NO: 2397390

SEQ ID NO: 2594365 - protein, 25 aa, Entamoeba histolytica
GTTRAYMALTFYDNTKYYLFLQSEE

SEQ ID NO: 2594366 - protein, 27 aa, Entamoeba histolytica
GTVGEIFCFLFFGFSLLPCFDKILGSC

SEQ ID NO: 2594367 - protein, 28 aa, Entamoeba histolytica
GTYSFFIWLGLIIASILFIIWQIVPRKL

SEQ ID NO: 2594368 - protein, 42 aa, Entamoeba histolytica
GTYTFDIWINNKRIKALLFNTHFILPICPSKCLISGKGMEEI

SEQ ID NO: 2594369 - protein, 26 aa, Entamoeba histolytica
GVAAVHEIYFIYKAIIEPSGIILKES

SEQ ID NO: 2594370 - protein, 25 aa, Entamoeba histolytica
GVACPFKICIIPKCSCFIEEDLIII

SEQ ID NO: 2594371 - protein, 29 aa, Entamoeba histolytica
GVDKKRVDYPLWFLCLYDAAGRASKALET

SEQ ID NO: 2594372 - protein, 18 aa, Entamoeba histolytica
GVDWVLVGTLIITGTIIV

SEQ ID NO: 2594373 - protein, 29 aa, Entamoeba histolytica
GVEDYNGFSWTRILLKTGSKTPILNIYDS

SEQ ID NO: 2594374 - protein, 20 aa, Entamoeba histolytica
GVFAPMYFIVVVMLITLTTT

SEQ ID NO: 2594375 - protein, 17 aa, Entamoeba histolytica
GVFAPWVYGISTIILML

SEQ ID NO: 2594376 - protein, 23 aa, Entamoeba histolytica
GVFCKWHYIILYLVAVCLNFPLI

SEQ ID NO: 2594377 - protein, 17 aa, Entamoeba histolytica
GVFIYYDVSPMVLEVTE

SEQ ID NO: 2594378 - protein, 19 aa, Entamoeba histolytica
GVGIAFYYDWKVALCVMAI

SEQ ID NO: 2594379 - protein, 34 aa, Entamoeba histolytica
GVGKAKWWAIIIKYMILLFPIVNLTNEFPLVATT

SEQ ID NO: 2594380 - protein, 28 aa, Entamoeba histolytica
GVGLGMLLFFMMGSLALGSWYGSLVIRG

SEQ ID NO: 2594381 - protein, 24 aa, Entamoeba histolytica
GVHYAYVYFNFKKYIYNTEDGLFY

SEQ ID NO: 2594382 - protein, 19 aa, Entamoeba histolytica
GVIMIYFIPGIVSFVYGGK

SEQ ID NO: 2594383 - protein, 27 aa, Entamoeba histolytica
GVLIAPLIIIVYFFFCYKTIPHFHSLF

SEQ ID NO: 2594384 - protein, 21 aa, Entamoeba histolytica
GVLTYYKWFSIGDNKTQLYDY

SEQ ID NO: 2594385 - protein, 17 aa, Entamoeba histolytica
GVLVSIFIRKLSPDNIL

SEQ ID NO: 2594386 - protein, 21 aa, Entamoeba histolytica
GVPMNYRRDLWKKLLEIDNID

SEQ ID NO: 2594387 - protein, 17 aa, Entamoeba histolytica
GVQFFHTFPYILPNIVC

SEQ ID NO: 2594388 - protein, 35 aa, Entamoeba histolytica
GVSQKAFVIYSQKHIYILNPRRLLGTKAPFEMTRE

SEQ ID NO: 2594389 - protein, 40 aa, Entamoeba histolytica; identical to SEQ ID NO: 2397424

SEQ ID NO: 2594390 - protein, 23 aa, Entamoeba histolytica
GVVCLVWFIVMSCLTFFMTGVFG

SEQ ID NO: 2594391 - protein, 21 aa, Entamoeba histolytica
GVVYLLVIAFMQILTSFCFQL

SEQ ID NO: 2594392 - protein, 25 aa, Entamoeba histolytica
GVYPLSILIMVFSGIWPYTKLVMLL

SEQ ID NO: 2594393 - protein, 33 aa, Entamoeba histolytica; identical to SEQ ID NO: 2397433

SEQ ID NO: 2594394 - protein, 29 aa, Entamoeba histolytica
GVYTMIINYRRPFLSYLEYKETIPLRTFR

SEQ ID NO: 2594395 - protein, 30 aa, Entamoeba histolytica
GVYTMIINYRRPFLSYLEYKETIPLRTFRL

SEQ ID NO: 2594396 - protein, 31 aa, Entamoeba histolytica; identical to SEQ ID NO: 2397434

SEQ ID NO: 2594397 - protein, 24 aa, Entamoeba histolytica
GWKYPINIILHLFLFTVGGLSIGT

SEQ ID NO: 2594398 - protein, 19 aa, Entamoeba histolytica
GWLFLYHPPHYYLGWFNTP

SEQ ID NO: 2594399 - protein, 17 aa, Entamoeba histolytica
GWLYKQLSKISFSLNKI

SEQ ID NO: 2594400 - protein, 19 aa, Entamoeba histolytica
GWQTICQYGYIDPYGGCEK

SEQ ID NO: 2594401 - protein, 18 aa, Entamoeba histolytica
GWSKLIFTYFMPAIVFYQ

SEQ ID NO: 2594402 - protein, 24 aa, Entamoeba histolytica
GWTINIILLYFNWFDENKIVKECI

SEQ ID NO: 2594403 - protein, 26 aa, Entamoeba histolytica
GYCYLLIGLICIGVIFFIISIIDYVC

SEQ ID NO: 2594404 - protein, 28 aa, Entamoeba histolytica
GYDLNQDIWLRNLIYRRYPEISSINSEK

SEQ ID NO: 2594405 - protein, 18 aa, Entamoeba histolytica
GYDQSLLNHMYFAGYFNS

SEQ ID NO: 2594406 - protein, 24 aa, Entamoeba histolytica
GYDQSLLNYMYYTGQFNSLNITVA

SEQ ID NO: 2594407 - protein, 24 aa, Entamoeba histolytica
GYDRLMFCLFFPEFINFFVSIPQL

SEQ ID NO: 2594408 - protein, 25 aa, Entamoeba histolytica
GYICVLIAILFFGSNWIVVKKFPAG

SEQ ID NO: 2594409 - protein, 45 aa, Entamoeba histolytica; identical to SEQ ID NO: 2397444

SEQ ID NO: 2594410 - protein, 25 aa, Entamoeba histolytica
GYIKTFSLMLIICGFIIVVIEMFLY

SEQ ID NO: 2594411 - protein, 29 aa, Entamoeba histolytica
GYIQRPTIPQPFKFISLPSTYQQLINEVL

SEQ ID NO: 2594412 - protein, 21 aa, Entamoeba histolytica
GYLCLFISVILFGSNYIVTKK

SEQ ID NO: 2594413 - protein, 28 aa, Entamoeba histolytica
GYLGIIYYPTFFPLLSQFKLFIKQKLTN

SEQ ID NO: 2594414 - protein, 20 aa, Entamoeba histolytica
GYSFSLYFSALIVMIAFVVF

SEQ ID NO: 2594415 - protein, 21 aa, Entamoeba histolytica
GYYFGLLNIIFVSVSFGIAVF

SEQ ID NO: 2594416 - protein, 19 aa, Entamoeba histolytica
GYYLGICFMKKTINYQQDV

SEQ ID NO: 2594417 - protein, 30 aa, Entamoeba histolytica
GYYLSLIEMIFTLIPMWCRNYKILMEITEV

SEQ ID NO: 2594418 - protein, 34 aa, Entamoeba histolytica
HAKSSILLLPEALKLVPIFVLGAMKTSAFMPFFQ

SEQ ID NO: 2594419 - protein, 31 aa, Entamoeba histolytica
HANIYFAEFMRSMLYLWRLGKIAEVIEKYLN

SEQ ID NO: 2594420 - protein, 25 aa, Entamoeba histolytica
HANSITWILLVFASLLFSFSRHLII

SEQ ID NO: 2594421 - protein, 28 aa, Entamoeba histolytica
HAPSYGYYIPIVIPPKKMLRVSTCNKDT

SEQ ID NO: 2594422 - protein, 17 aa, Entamoeba histolytica
HATLGRTYLYPCDSKSP

SEQ ID NO: 2594423 - protein, 19 aa, Entamoeba histolytica
HAYFVCNKYIAFGRTLPTQ

SEQ ID NO: 2594424 - protein, 18 aa, Entamoeba histolytica
HCELCTTGFYLDNGRCSP

SEQ ID NO: 2594425 - protein, 18 aa, Entamoeba histolytica
HCEWAYPIKFTVIPRPVR

SEQ ID NO: 2594426 - protein, 23 aa, Entamoeba histolytica
HCKTLIIGILLFSICLLLHCFIN

SEQ ID NO: 2594427 - protein, 22 aa, Entamoeba histolytica
HCLSLPVFTILSLLNELMIKIL

SEQ ID NO: 2594428 - protein, 17 aa, Entamoeba histolytica
HCSFVIPDSLTASSKSL

SEQ ID NO: 2594429 - protein, 19 aa, Entamoeba histolytica
HCYTFQYLIGLYEQCRLKL

SEQ ID NO: 2594430 - protein, 23 aa, Entamoeba histolytica
HDFVQYWVCFSIQLYLMYINTIK

SEQ ID NO: 2594431 - protein, 29 aa, Entamoeba histolytica
HDNIIGLIRFALLQLFYQFKTNKMTFFYA

SEQ ID NO: 2594432 - protein, 25 aa, Entamoeba histolytica
HEHQHAFFPLYPLTIRLFSFICSTS

SEQ ID NO: 2594433 - protein, 18 aa, Entamoeba histolytica
HEIGRFILPLTFIITNQY

SEQ ID NO: 2594434 - protein, 24 aa, Entamoeba histolytica
HEKPEDVVLPYKLKMRMLLDCAKG

SEQ ID NO: 2594435 - protein, 18 aa, Entamoeba histolytica
HFDRTPKVWLLGYDEDHK

SEQ ID NO: 2594436 - protein, 21 aa, Entamoeba histolytica
HFFSDPYFFVRDMVLGLGLDC

SEQ ID NO: 2594437 - protein, 25 aa, Entamoeba histolytica
HFITVKLIKRRTIFNRILDLFVISI

SEQ ID NO: 2594438 - protein, 19 aa, Entamoeba histolytica
HFKLSGLLPICYFLEKNDC

SEQ ID NO: 2594439 - protein, 18 aa, Entamoeba histolytica
HFNKKYIIGYIGFNNLGR

SEQ ID NO: 2594440 - protein, 35 aa, Entamoeba histolytica
HFNLLFIISLLLILYLFKILLAIALRYLAFTEVTQ

SEQ ID NO: 2594441 - protein, 20 aa, Entamoeba histolytica
HFRIVAVLLKYWLKTRNLNC

SEQ ID NO: 2594442 - protein, 34 aa, Entamoeba histolytica
HFRKIHYIVMTIFLILFFLFTIILGIFGPSEYSL

SEQ ID NO: 2594443 - protein, 23 aa, Entamoeba histolytica
HFTRKSLFLVLLKEKDMFINLWN

SEQ ID NO: 2594444 - protein, 20 aa, Entamoeba histolytica
HFYFYVILAGMYVLQFIIPP

SEQ ID NO: 2594445 - protein, 24 aa, Entamoeba histolytica
HGDGMAFWLTPEQLEIGTALGGQE

SEQ ID NO: 2594446 - protein, 23 aa, Entamoeba histolytica
HGFPYLCFSLLSFINILLLPNTF

SEQ ID NO: 2594447 - protein, 25 aa, Entamoeba histolytica
HGHWLIFPHLQFLGTLIFYCLAIKT

SEQ ID NO: 2594448 - protein, 31 aa, Entamoeba histolytica
HGIEVLRLVLGRKITMLMFGTNNGKIHCLDG

SEQ ID NO: 2594449 - protein, 21 aa, Entamoeba histolytica
HGILMAYYQYLILARTERGKN

SEQ ID NO: 2594450 - protein, 25 aa, Entamoeba histolytica
HGKIPWYGLVVASVVIPYYIKKNKY

SEQ ID NO: 2594451 - protein, 17 aa, Entamoeba histolytica
HGPTAFMNWFDPDSWYP

SEQ ID NO: 2594452 - protein, 23 aa, Entamoeba histolytica
HGPTAFMNWFDPDSWYPLGRNIG

SEQ ID NO: 2594453 - protein, 25 aa, Entamoeba histolytica
HGTKYYAVRLFLTTMGFCSSNFWKR

SEQ ID NO: 2594454 - protein, 22 aa, Entamoeba histolytica
HGVGGYFFLQAFETIQCLFSIY

SEQ ID NO: 2594455 - protein, 18 aa, Entamoeba histolytica
HGYIPISELPFITKIYLP

SEQ ID NO: 2594456 - protein, 21 aa, Entamoeba histolytica
HHELLSFCLLTTDIITVITIT

SEQ ID NO: 2594457 - protein, 23 aa, Entamoeba histolytica
HHLRLKILLDASKGIQYLHENEM

SEQ ID NO: 2594458 - protein, 19 aa, Entamoeba histolytica
HHLSTIYAYLTKQVDNNKP

SEQ ID NO: 2594459 - protein, 25 aa, Entamoeba histolytica
HICNTTLMLLLRYFELNMDKQTQKF

SEQ ID NO: 2594460 - protein, 17 aa, Entamoeba histolytica
HIDPFVALSFLDATLMI

SEQ ID NO: 2594461 - protein, 21 aa, Entamoeba histolytica
HIDPHHLILLLFKSNETIQTL

SEQ ID NO: 2594462 - protein, 26 aa, Entamoeba histolytica
HIDPYWFHYLMDIGAWLYPTDTFGNM

SEQ ID NO: 2594463 - protein, 24 aa, Entamoeba histolytica
HIENLRIITPFISKWNEAEIKSKQ

SEQ ID NO: 2594464 - protein, 24 aa, Entamoeba histolytica
HIFQTIFLPCIIFNAGFTMKKRNF

SEQ ID NO: 2594465 - protein, 26 aa, Entamoeba histolytica
HIHQTDLVVFYKFGTKFVMKRLFLNW

SEQ ID NO: 2594466 - protein, 17 aa, Entamoeba histolytica
HIINWIGFILFFVRVDK

SEQ ID NO: 2594467 - protein, 18 aa, Entamoeba histolytica
HIIPFVFSWPSCSNPFLY

SEQ ID NO: 2594468 - protein, 23 aa, Entamoeba histolytica
HIIVITLAYYWYKLFGYHPGLVL

SEQ ID NO: 2594469 - protein, 40 aa, Entamoeba histolytica
HIKAFTHDYYYYLFIPLSLYLFDILLRFLHFVFPAKIISK

SEQ ID NO: 2594470 - protein, 26 aa, Entamoeba histolytica
HILHKGFIIIGLFIGVFVLTLISTIV

SEQ ID NO: 2594471 - protein, 18 aa, Entamoeba histolytica
HILIPIVLYLLFSHLYLL

SEQ ID NO: 2594472 - protein, 23 aa, Entamoeba histolytica
HILSYAQFLFLELVDESVAKEIF

SEQ ID NO: 2594473 - protein, 28 aa, Entamoeba histolytica
HIMCYSKVLFFIGFYCILSNSITCTIKT

SEQ ID NO: 2594474 - protein, 17 aa, Entamoeba histolytica
HINKIYQLKSITINLFR

SEQ ID NO: 2594475 - protein, 22 aa, Entamoeba histolytica
HIQSLFFNRIVIIITSPITFEM

SEQ ID NO: 2594476 - protein, 25 aa, Entamoeba histolytica
HISKTLYFQPRLLPHIEPITLNEYW

SEQ ID NO: 2594477 - protein, 24 aa, Entamoeba histolytica
HISLLFLLIFVQQPQFFLAPSTIQ

SEQ ID NO: 2594478 - protein, 18 aa, Entamoeba histolytica
HISNYYKEKRRELEQKKF

SEQ ID NO: 2594479 - protein, 22 aa, Entamoeba histolytica
HISSFHFPILTWVVEDYNQVMK

SEQ ID NO: 2594480 - protein, 18 aa, Entamoeba histolytica
HITLFAIAVFLIVIGSFV

SEQ ID NO: 2594481 - protein, 19 aa, Entamoeba histolytica
HITPPYQVLTFPTLSPTQI

SEQ ID NO: 2594482 - protein, 17 aa, Entamoeba histolytica
HKAFFMMSGEFLTYRVR

SEQ ID NO: 2594483 - protein, 29 aa, Entamoeba histolytica
HKELLTTFITLIYPQLSVTSPTLLAALHI

SEQ ID NO: 2594484 - protein, 24 aa, Entamoeba histolytica
HKFKVFQFPLFICTLSLFGSISSL

SEQ ID NO: 2594485 - protein, 29 aa, Entamoeba histolytica
HKGNKMIWLHTLVCTLILNILLSPGKENE

SEQ ID NO: 2594486 - protein, 22 aa, Entamoeba histolytica
HKGTFISSLLQLNLLIQTCSGM

SEQ ID NO: 2594487 - protein, 23 aa, Entamoeba histolytica
HKKEIIQPPLPIQLQMMKLKTVE

SEQ ID NO: 2594488 - protein, 29 aa, Entamoeba histolytica
HKKGLEIIPNYLFWVGLPSLLVDGVKFTF

SEQ ID NO: 2594489 - protein, 22 aa, Entamoeba histolytica
HKKYLGIDQLLISLISPMCSPE

SEQ ID NO: 2594490 - protein, 23 aa, Entamoeba histolytica
HKNIDGASCMFIILGVIITLLFF

SEQ ID NO: 2594491 - protein, 18 aa, Entamoeba histolytica
HLDVIIFLTQIESNNIAI

SEQ ID NO: 2594492 - protein, 20 aa, Entamoeba histolytica
HLFEKYLMIEYQMCGDIEWN

SEQ ID NO: 2594493 - protein, 19 aa, Entamoeba histolytica
HLIIGLLFYMYVLFDTLDG

SEQ ID NO: 2594494 - protein, 17 aa, Entamoeba histolytica
HLITWKDGKKFFPLGLY

SEQ ID NO: 2594495 - protein, 17 aa, Entamoeba histolytica
HLKAIHYMPFRSRGEFV

SEQ ID NO: 2594496 - protein, 41 aa, Entamoeba histolytica
HLKKKLIIKIIIFTIFIMIILVLILCIIGIIVGVYLMKKST

SEQ ID NO: 2594497 - protein, 21 aa, Entamoeba histolytica
HLKRKILISRLLIGGLITFWI

SEQ ID NO: 2594498 - protein, 18 aa, Entamoeba histolytica
HLLLFCGCFILKIAIYFV

SEQ ID NO: 2594499 - protein, 36 aa, Entamoeba histolytica
HLNKPFEEWDLESFYPFFKEGFCKHLIPAALHRYEE

SEQ ID NO: 2594500 - protein, 37 aa, Entamoeba histolytica
HLQPYKGTILFFVIFTILLHYLYFLDWYTHYETQLHN

SEQ ID NO: 2594501 - protein, 19 aa, Entamoeba histolytica
HLQQLILLQYLFKKNEIEQ

SEQ ID NO: 2594502 - protein, 26 aa, Entamoeba histolytica
HLRSITIYVLYVLVGISIITMVVAVI

SEQ ID NO: 2594503 - protein, 18 aa, Entamoeba histolytica
HLSWYKTLSEKQGERGNY

SEQ ID NO: 2594504 - protein, 22 aa, Entamoeba histolytica
HLTDLLHFLFSLLQSLDFCLNE

SEQ ID NO: 2594505 - protein, 21 aa, Entamoeba histolytica
HLTLKPKETVMFFITTDETEG

SEQ ID NO: 2594506 - protein, 17 aa, Entamoeba histolytica
HLVGDNCLILISIGNSS

SEQ ID NO: 2594507 - protein, 25 aa, Entamoeba histolytica
HLVINCIYVLMNIYIDFKEIHSKDQ

SEQ ID NO: 2594508 - protein, 19 aa, Entamoeba histolytica
HLVLYIGFTLIFISFYHIN

SEQ ID NO: 2594509 - protein, 28 aa, Entamoeba histolytica
HMDIFIFPIAIIIFLYVIRNIVLVIIPI

SEQ ID NO: 2594510 - protein, 25 aa, Entamoeba histolytica
HMEPSQVILFTFQKKYKPLIHVIEG

SEQ ID NO: 2594511 - protein, 21 aa, Entamoeba histolytica
HNELVCRVVLLLLSYVIKEEY

SEQ ID NO: 2594512 - protein, 23 aa, Entamoeba histolytica
HNIRYFYLFLLYGTIVTITNFRK

SEQ ID NO: 2594513 - protein, 22 aa, Entamoeba histolytica
HNLNGVSCISIILSFIFTFIFF

SEQ ID NO: 2594514 - protein, 22 aa, Entamoeba histolytica
HNLNGVSCISIILSVIFTFIFF

SEQ ID NO: 2594515 - protein, 24 aa, Entamoeba histolytica
HNNIPMEQLTLLSVLKVLLSNTPT

SEQ ID NO: 2594516 - protein, 24 aa, Entamoeba histolytica
HNNITILPSLISLPLKLLDISFNN

SEQ ID NO: 2594517 - protein, 24 aa, Entamoeba histolytica
HNNRLLHHAVANAGLLIMIITHAF

SEQ ID NO: 2594518 - protein, 25 aa, Entamoeba histolytica
HNTLTFILCFLLGVCYNFHGNITAG

SEQ ID NO: 2594519 - protein, 24 aa, Entamoeba histolytica
HNTTYLFLMIFDIMLTVLIADVIN

SEQ ID NO: 2594520 - protein, 42 aa, Entamoeba histolytica
HPGLVWSKFWRYMTPIMKFIYTIILFLFSKTPLQGAQTAIYC

SEQ ID NO: 2594521 - protein, 23 aa, Entamoeba histolytica
HPHPMFWKFIQGVGLCYLMLICF

SEQ ID NO: 2594522 - protein, 27 aa, Entamoeba histolytica
HPKSRKLFYYFLINLAFMFVEVAYGWW

SEQ ID NO: 2594523 - protein, 20 aa, Entamoeba histolytica
HPLAACLIVVFIAYSCYGIY

SEQ ID NO: 2594524 - protein, 23 aa, Entamoeba histolytica
HPLEYLTFMLQLFVTHPLTEDFL

SEQ ID NO: 2594525 - protein, 19 aa, Entamoeba histolytica
HPLIVAQQLIFFDSSMFNV

SEQ ID NO: 2594526 - protein, 28 aa, Entamoeba histolytica
HPQPPRFILYYFINALILHFHVYGTIAI

SEQ ID NO: 2594527 - protein, 23 aa, Entamoeba histolytica
HPTKPYTYGQYLKVTLPAGQENT

SEQ ID NO: 2594528 - protein, 27 aa, Entamoeba histolytica
HQEKIFSLWGFIISYVVYKGGCVTIIP

SEQ ID NO: 2594529 - protein, 22 aa, Entamoeba histolytica
HQELLDLKGFYYTLAMQQFGTV

SEQ ID NO: 2594530 - protein, 18 aa, Entamoeba histolytica
HQFLFFDFQDFTWTYFIL

SEQ ID NO: 2594531 - protein, 20 aa, Entamoeba histolytica
HQFYYFFCVMLLIAVCNPYL

SEQ ID NO: 2594532 - protein, 24 aa, Entamoeba histolytica
HQHVSHFFTFFFASQIIGLTRYAF

SEQ ID NO: 2594533 - protein, 33 aa, Entamoeba histolytica; identical to SEQ ID NO: 2397575

SEQ ID NO: 2594534 - protein, 23 aa, Entamoeba histolytica
HQSFLDIVIYRYLLNAVFVYPTE

SEQ ID NO: 2594535 - protein, 28 aa, Entamoeba histolytica
HRDIKPDNLLIFSLDKNVPVFAKITDFG

SEQ ID NO: 2594536 - protein, 25 aa, Entamoeba histolytica
HRDIKPDNLLLFSLEYPATINAKLT

SEQ ID NO: 2594537 - protein, 29 aa, Entamoeba histolytica
HRENSLSTYIFMFLGVLALGMSVIMGNSI

SEQ ID NO: 2594538 - protein, 17 aa, Entamoeba histolytica
HRINSKNALLPIAIENN

SEQ ID NO: 2594539 - protein, 31 aa, Entamoeba histolytica
HRTFISLINILFIVIYWIEVVASLILSFSML

SEQ ID NO: 2594540 - protein, 18 aa, Entamoeba histolytica
HSAHLYQEKEACKFAFEI

SEQ ID NO: 2594541 - protein, 20 aa, Entamoeba histolytica
HSAILIIMTPKMHAQINGIY

SEQ ID NO: 2594542 - protein, 25 aa, Entamoeba histolytica
HSFKQFIVHLLFSIPVGIILVFTTY

SEQ ID NO: 2594543 - protein, 31 aa, Entamoeba histolytica
HSFQTYLVHLYYFFHYCYLSELQFFHSRSLS

SEQ ID NO: 2594544 - protein, 51 aa, Entamoeba histolytica
HSIDLIVRLLARLTLIYPLISMTTYLLKLLPLFIFTLFIQLVSTTPPQQAK

SEQ ID NO: 2594545 - protein, 31 aa, Entamoeba histolytica
HSLPVFNTSIYPLFSIFNVSGMTTLFLLLMT

SEQ ID NO: 2594546 - protein, 25 aa, Entamoeba histolytica
HSNNHSIIMILLGVVLVVLLGISSI

SEQ ID NO: 2594547 - protein, 26 aa, Entamoeba histolytica
HSSGILIWTVWTVMTVLAVTILTVSI

SEQ ID NO: 2594548 - protein, 22 aa, Entamoeba histolytica
HSTFLVYFSTFPGYPYFISLHV

SEQ ID NO: 2594549 - protein, 27 aa, Entamoeba histolytica
HSTRIAIICFLIILTWYCCYGVALYNM

SEQ ID NO: 2594550 - protein, 22 aa, Entamoeba histolytica
HTCFSFLNFTRYQTAGLGIAFP

SEQ ID NO: 2594551 - protein, 26 aa, Entamoeba histolytica
HTDKQFVIWIQVPKKDKFFLQADVEK

SEQ ID NO: 2594552 - protein, 17 aa, Entamoeba histolytica
HTFPLIFLLIDCFFFKQ

SEQ ID NO: 2594553 - protein, 25 aa, Entamoeba histolytica
HTLGKLLVLTRWLGRNPVLHDIDNF

SEQ ID NO: 2594554 - protein, 17 aa, Entamoeba histolytica
HTRWFKIKNYENVPLLV

SEQ ID NO: 2594555 - protein, 37 aa, Entamoeba histolytica
HTVKIDLPKPILATWQFYVVLFTIIGVMTIAFYAFFK

SEQ ID NO: 2594556 - protein, 39 aa, Entamoeba histolytica
HTVRNKCIWILLFGLAVFVTTYMYLGLFLSAGEKMIVRL

SEQ ID NO: 2594557 - protein, 22 aa, Entamoeba histolytica
HTYFEAYVYKDILKAPPQPSFS

SEQ ID NO: 2594558 - protein, 18 aa, Entamoeba histolytica
HVCIVWNKCYNSLFQKII

SEQ ID NO: 2594559 - protein, 18 aa, Entamoeba histolytica
HVFGEIFAENGFLQRSDQ

SEQ ID NO: 2594560 - protein, 25 aa, Entamoeba histolytica
HVIHSPFIFFDTTPIGRILNRFTKD

SEQ ID NO: 2594561 - protein, 18 aa, Entamoeba histolytica
HVISLLLLPIVLYLITHS

SEQ ID NO: 2594562 - protein, 25 aa, Entamoeba histolytica
HVTNIYFLLVAIISLIPQISATNPI

SEQ ID NO: 2594563 - protein, 21 aa, Entamoeba histolytica
HVVPICFNWPVGKHSLHGNKK

SEQ ID NO: 2594564 - protein, 27 aa, Entamoeba histolytica
HYHASWILSNWFFGRTQDWIQTHSEWV

SEQ ID NO: 2594565 - protein, 20 aa, Entamoeba histolytica
HYIAHHCYFFRKSNLKRIYN

SEQ ID NO: 2594566 - protein, 19 aa, Entamoeba histolytica
HYLICKKLIVIGLNSELPH

SEQ ID NO: 2594567 - protein, 27 aa, Entamoeba histolytica
HYNFPADIFAFAITMYQLLSWNDPYPN

SEQ ID NO: 2594568 - protein, 31 aa, Entamoeba histolytica
HYPCPIPDLYIYLIIACCGLVIFILGLILIA

SEQ ID NO: 2594569 - protein, 21 aa, Entamoeba histolytica
HYPIIIKYDKYNQFLYHKVSE

SEQ ID NO: 2594570 - protein, 22 aa, Entamoeba histolytica
HYQVFVLCFGWLLNSGFIAFCY

SEQ ID NO: 2594571 - protein, 35 aa, Entamoeba histolytica
HYSNSILIYLFTLLYIFIYCYTLISNILITGSDES

SEQ ID NO: 2594572 - protein, 24 aa, Entamoeba histolytica
HYYCKELLFYQAQYYLKQKVYQKA

SEQ ID NO: 2594573 - protein, 28 aa, Entamoeba histolytica
HYYTYCLLHFFLYIGMMFCNYNYFNECF

SEQ ID NO: 2594574 - protein, 33 aa, Entamoeba histolytica
ILFIILKLHQLLLKAMKLDLVLSWYLVETNLEL

SEQ ID NO: 2594575 - protein, 17 aa, Entamoeba histolytica
IAAIIIIVIIVAIVIPL

SEQ ID NO: 2594576 - protein, 19 aa, Entamoeba histolytica
IACHYGYHLVGDNCLILIS

SEQ ID NO: 2594577 - protein, 20 aa, Entamoeba histolytica
IADDSWRLLFKTESIRLKKF

SEQ ID NO: 2594578 - protein, 21 aa, Entamoeba histolytica
IAEHLIHRFVLLSKSFEKDPI

SEQ ID NO: 2594579 - protein, 35 aa, Entamoeba histolytica
IAGCLAVIIIIVLVVIFLIFIIQTRRKKKEREEKI

SEQ ID NO: 2594580 - protein, 22 aa, Entamoeba histolytica
IAGFSFFVLIIVSLSIIGLASV

SEQ ID NO: 2594581 - protein, 25 aa, Entamoeba histolytica
IAHASFLDIFSLIHHLSKSHSLSQL

SEQ ID NO: 2594582 - protein, 33 aa, Entamoeba histolytica; identical to SEQ ID NO: 2397627

SEQ ID NO: 2594583 - protein, 25 aa, Entamoeba histolytica
IAKLSMFIFPRYLSIFSIAVYLSTI

SEQ ID NO: 2594584 - protein, 17 aa, Entamoeba histolytica
IALINAAEFDICKNPQI

SEQ ID NO: 2594585 - protein, 21 aa, Entamoeba histolytica
IALKIGYFGMAGGALVFIALT

SEQ ID NO: 2594586 - protein, 21 aa, Entamoeba histolytica
IALLVFVLSWFLPKSINEPKP

SEQ ID NO: 2594587 - protein, 23 aa, Entamoeba histolytica
IALRNRQFVINYYKNLAKEQMKR

SEQ ID NO: 2594588 - protein, 26 aa, Entamoeba histolytica
IAPIIFHNTFWLIKDYYTPINDTIQN

SEQ ID NO: 2594589 - protein, 24 aa, Entamoeba histolytica
IAPVLIVIVFLNGKLNSIQSSPAT

SEQ ID NO: 2594590 - protein, 37 aa, Entamoeba histolytica
IASIFAHKLIWFFIISILTMLFLYITQIGLVIAGRGV

SEQ ID NO: 2594591 - protein, 25 aa, Entamoeba histolytica
IASIPKYIIVVFNSSQILLFNLDTI

SEQ ID NO: 2594592 - protein, 24 aa, Entamoeba histolytica
IASKNNVIIIPQKSIKITGSSMTV

SEQ ID NO: 2594593 - protein, 26 aa, Entamoeba histolytica
IASRFIWDIFCLFAILIHLSCMRSRG

SEQ ID NO: 2594594 - protein, 21 aa, Entamoeba histolytica
IATFFFFLGVLLILFKFTFIG

SEQ ID NO: 2594595 - protein, 26 aa, Entamoeba histolytica
IATQGLSIIAIPLNIFATAKASAYRI

SEQ ID NO: 2594596 - protein, 18 aa, Entamoeba histolytica
IAYARFRLWVFPRYVISA

SEQ ID NO: 2594597 - protein, 19 aa, Entamoeba histolytica
IAYLLPNSFINRFIDCCFS

SEQ ID NO: 2594598 - protein, 30 aa, Entamoeba histolytica; identical to SEQ ID NO: 2397639

SEQ ID NO: 2594599 - protein, 17 aa, Entamoeba histolytica
ICDFTKVERLDLFGYLS

SEQ ID NO: 2594600 - protein, 24 aa, Entamoeba histolytica
ICEDGYFYKLIFVISYIILSLIFI

SEQ ID NO: 2594601 - protein, 31 aa, Entamoeba histolytica
ICELMILCYPMFALFLVFYKNKKEKGYKRSL

SEQ ID NO: 2594602 - protein, 46 aa, Entamoeba histolytica
ICERKSMWWISLIVIPIFILIIVMIYFILTLISKKIIRLKQDNTLN

SEQ ID NO: 2594603 - protein, 19 aa, Entamoeba histolytica
ICFALIILVSTGYPCNDFC

SEQ ID NO: 2594604 - protein, 19 aa, Entamoeba histolytica
ICFFYFTMFIVHAFVEGVS

SEQ ID NO: 2594605 - protein, 22 aa, Entamoeba histolytica
ICGIYFVWVIFNQKRILSNIDK

SEQ ID NO: 2594606 - protein, 25 aa, Entamoeba histolytica
ICGRNNIMIIIKDWNGNVFGSFHEV

SEQ ID NO: 2594607 - protein, 19 aa, Entamoeba histolytica
ICHIYLTKQIPWKTTLVVL

SEQ ID NO: 2594608 - protein, 39 aa, Entamoeba histolytica; identical to SEQ ID NO: 2397648

SEQ ID NO: 2594609 - protein, 17 aa, Entamoeba histolytica
ICIGMFLVLYFYENLSY

SEQ ID NO: 2594610 - protein, 17 aa, Entamoeba histolytica
ICIILISTNFSITEHPL

SEQ ID NO: 2594611 - protein, 26 aa, Entamoeba histolytica
ICIINSIPFPQFLPSIFHMYIQGDRE

SEQ ID NO: 2594612 - protein, 19 aa, Entamoeba histolytica
ICILKGVSPRLPSKGLNTL

SEQ ID NO: 2594613 - protein, 37 aa, Entamoeba histolytica
ICIPSFGMIWIWTIVVSFINWLSYWKSDWNDEVINNK

SEQ ID NO: 2594614 - protein, 23 aa, Entamoeba histolytica
ICLILYICILILYSQGMGSNWYT

SEQ ID NO: 2594615 - protein, 17 aa, Entamoeba histolytica
ICLKCQRGFNLASNQTK

SEQ ID NO: 2594616 - protein, 17 aa, Entamoeba histolytica
ICQPCSVFLPPCQLCDS

SEQ ID NO: 2594617 - protein, 25 aa, Entamoeba histolytica
ICSFGYLCFLIIFKWCNPDKDPAPM

SEQ ID NO: 2594618 - protein, 17 aa, Entamoeba histolytica
ICSIAAILFTLLAIVLF

SEQ ID NO: 2594619 - protein, 26 aa, Entamoeba histolytica
ICSKELYLFWLFNVGNRKTKEEIICN

SEQ ID NO: 2594620 - protein, 17 aa, Entamoeba histolytica
ICSYLNNCKITTISFNL

SEQ ID NO: 2594621 - protein, 38 aa, Entamoeba histolytica
ICTCSYYLIIVVVLVLIAFFLFHKYFVRASIEMQRLEG

SEQ ID NO: 2594622 - protein, 17 aa, Entamoeba histolytica
ICYPVCIPNIIMKVILF

SEQ ID NO: 2594623 - protein, 29 aa, Entamoeba histolytica
IDDGVIQIIINLLQYFLLHSCTGDDLKLL

SEQ ID NO: 2594624 - protein, 24 aa, Entamoeba histolytica
IDDKEYFLPIFSGQPFEGYLTSTY

SEQ ID NO: 2594625 - protein, 24 aa, Entamoeba histolytica
IDEVKIQLPFPLNEKHHLLFVIKD

SEQ ID NO: 2594626 - protein, 39 aa, Entamoeba histolytica
IDFESECIRWLGAFRFILWTLWYCVTLMTTKAKIKTKKY

SEQ ID NO: 2594627 - protein, 26 aa, Entamoeba histolytica
IDFMESVWWVFKQLYEKNLVYRGLKI

SEQ ID NO: 2594628 - protein, 17 aa, Entamoeba histolytica
IDGFVLLIPLTIYLFCF

SEQ ID NO: 2594629 - protein, 25 aa, Entamoeba histolytica
IDGQSYPFTPLEELPFTFSTEVLTF

SEQ ID NO: 2594630 - protein, 17 aa, Entamoeba histolytica
IDGYYNNQIKCLPCNAT

SEQ ID NO: 2594631 - protein, 26 aa, Entamoeba histolytica
IDHKTPFTNLLLIPWNEQSNIIIHNT

SEQ ID NO: 2594632 - protein, 57 aa, Entamoeba histolytica
IDIGSIIIIQLISVLIFIASMILLVIIYRGWALASPAIPPLITPSWLTFGFNEEAPV

SEQ ID NO: 2594633 - protein, 25 aa, Entamoeba histolytica
IDIILFGMIILISLYLLISILSSKV

SEQ ID NO: 2594634 - protein, 19 aa, Entamoeba histolytica
IDIIVILFPLPISNYARII

SEQ ID NO: 2594635 - protein, 22 aa, Entamoeba histolytica
IDKDMMMNVMILKTFYPVEEVM

SEQ ID NO: 2594636 - protein, 25 aa, Entamoeba histolytica
IDKILFLMYCIWTIYVLYDHVYYCF

SEQ ID NO: 2594637 - protein, 24 aa, Entamoeba histolytica
IDKQVIFIIIDILVVLAKYKQTKK

SEQ ID NO: 2594638 - protein, 26 aa, Entamoeba histolytica
IDKQYINLFIEYGGVLKLFDSIAQSE

SEQ ID NO: 2594639 - protein, 28 aa, Entamoeba histolytica
IDKRYRVIAIFDYILYILAEPTTILNDF

SEQ ID NO: 2594640 - protein, 17 aa, Entamoeba histolytica
IDKSYFKMKSSQNMRIV

SEQ ID NO: 2594641 - protein, 21 aa, Entamoeba histolytica
IDKVTKDYYRYSFSSNGAVCT

SEQ ID NO: 2594642 - protein, 20 aa, Entamoeba histolytica
IDMFHRCFSLILSALQQLFI

SEQ ID NO: 2594643 - protein, 27 aa, Entamoeba histolytica
IDMYIGIIFFFYFLAQTLVMVLMSLTM

SEQ ID NO: 2594644 - protein, 21 aa, Entamoeba histolytica
IDNFPLSLSCSTLTFGRSGTE

SEQ ID NO: 2594645 - protein, 25 aa, Entamoeba histolytica
IDNNKRYCIKYYSDSKCFKEEEQQD

SEQ ID NO: 2594646 - protein, 19 aa, Entamoeba histolytica
IDPLSLLPFIVESLKELQM

SEQ ID NO: 2594647 - protein, 28 aa, Entamoeba histolytica
IDPNSLLYIRILIVIMLLCHILMLYCSK

SEQ ID NO: 2594648 - protein, 27 aa, Entamoeba histolytica
IDPTGVHIILLYSGNKMSYCERIKLSP

SEQ ID NO: 2594649 - protein, 40 aa, Entamoeba histolytica
IDSLRMRIFGFHWKTSLPLIFFFTLVFLSFTIFGTRSVRS

SEQ ID NO: 2594650 - protein, 18 aa, Entamoeba histolytica
IDSQLIMFCCGHKYHRDC

SEQ ID NO: 2594651 - protein, 25 aa, Entamoeba histolytica
IDSSPFPLIQLTPLAFINQILTPLQ

SEQ ID NO: 2594652 - protein, 30 aa, Entamoeba histolytica
IDTGGDYLCYQYIVKYRGQLERIEECDWRK

SEQ ID NO: 2594653 - protein, 36 aa, Entamoeba histolytica
IDTVLSLYDRLLYSSPIIPMFILCSIFITHRNELFK

SEQ ID NO: 2594654 - protein, 21 aa, Entamoeba histolytica
IDWKQFFIVFSQGIILLLLTS

SEQ ID NO: 2594655 - protein, 27 aa, Entamoeba histolytica
IDYVLPFFLGLFLTATAFFGAYTFAFR

SEQ ID NO: 2594656 - protein, 25 aa, Entamoeba histolytica
IEAKKYFAVLMKSLLLNNTHLYNLI

SEQ ID NO: 2594657 - protein, 47 aa, Entamoeba histolytica
IECEINIKWWIIVIIIIMILIGMIIIIIILYIILINICLKRNQEYQP

SEQ ID NO: 2594658 - protein, 18 aa, Entamoeba histolytica
IECIQCKSGYYLNSMKEC

SEQ ID NO: 2594659 - protein, 18 aa, Entamoeba histolytica
IECIQCKSGYYLNSNNKC

SEQ ID NO: 2594660 - protein, 25 aa, Entamoeba histolytica
IECNKQWLFINRKNTKCLSDGLNIR

SEQ ID NO: 2594661 - protein, 17 aa, Entamoeba histolytica
IEDIDFPLLKKEIKTNI

SEQ ID NO: 2594662 - protein, 31 aa, Entamoeba histolytica
IEDKAMKKLYPLFLWILSGLFPQFANISGVK

SEQ ID NO: 2594663 - protein, 19 aa, Entamoeba histolytica
IEDSLVTFISKYINQMSLH

SEQ ID NO: 2594664 - protein, 33 aa, Entamoeba histolytica
IEEGDQPFYPFYRKLNKLLFDLHDLHMYFGLES

SEQ ID NO: 2594665 - protein, 26 aa, Entamoeba histolytica
IEEGLCEVAIVYYLFKSLYGDNVVGN

SEQ ID NO: 2594666 - protein, 25 aa, Entamoeba histolytica
IEETKVILLLFKSLLNNLNSKIINK

SEQ ID NO: 2594667 - protein, 17 aa, Entamoeba histolytica
IEFFLLDEALYTQFGFD

SEQ ID NO: 2594668 - protein, 23 aa, Entamoeba histolytica
IEFKTKFPINKLTIIESKEVSIK

SEQ ID NO: 2594669 - protein, 19 aa, Entamoeba histolytica
IEFVELITDNFFSLNALTC

SEQ ID NO: 2594670 - protein, 25 aa, Entamoeba histolytica
IEGYLDYFVLYEPKKNIYPITKFIK

SEQ ID NO: 2594671 - protein, 19 aa, Entamoeba histolytica
IEHKLLYPNQFVFAENLNK

SEQ ID NO: 2594672 - protein, 29 aa, Entamoeba histolytica
IEINNKHFDYLFWEGICLKKEQFKGKEVG

SEQ ID NO: 2594673 - protein, 17 aa, Entamoeba histolytica
IEIRLVVCCIIAGLLFR

SEQ ID NO: 2594674 - protein, 26 aa, Entamoeba histolytica
IEITLIFISCILWIFVIINNSEVKEL

SEQ ID NO: 2594675 - protein, 27 aa, Entamoeba histolytica
IEKELEGPIYLLRTSYQNFISRFGVKF

SEQ ID NO: 2594676 - protein, 28 aa, Entamoeba histolytica
IEKELEGPIYLLRTSYQNFISRFGVKFT

SEQ ID NO: 2594677 - protein, 18 aa, Entamoeba histolytica
IEKELRLNRFALSSSLRF

SEQ ID NO: 2594678 - protein, 19 aa, Entamoeba histolytica
IEKKFVLENFKLLNDMFCV

SEQ ID NO: 2594679 - protein, 29 aa, Entamoeba histolytica
IEKRIMIDSLPYTGVALLGGARSKWSCDE

SEQ ID NO: 2594680 - protein, 31 aa, Entamoeba histolytica
IELHTPLLVFFDKLLQFIPENTPIILEVHGL

SEQ ID NO: 2594681 - protein, 19 aa, Entamoeba histolytica
IELLNEIPGFIELLKVIYS

SEQ ID NO: 2594682 - protein, 25 aa, Entamoeba histolytica
IELNNILCIHLFKVTFHFKTTLPEI

SEQ ID NO: 2594683 - protein, 31 aa, Entamoeba histolytica
IELSVYLPELKWNRIILKPDHPKCLWDCLPE

SEQ ID NO: 2594684 - protein, 25 aa, Entamoeba histolytica
IELTMSFGCYFIVTSQTTFKSISGE

SEQ ID NO: 2594685 - protein, 25 aa, Entamoeba histolytica
IEMLIYISTLLYDIPLTILELLSSM

SEQ ID NO: 2594686 - protein, 25 aa, Entamoeba histolytica
IENDKKMYLIPRYSFKFSVVNPPDE

SEQ ID NO: 2594687 - protein, 25 aa, Entamoeba histolytica
IENDKKMYLIPRYSFKSSVVNPPDE

SEQ ID NO: 2594688 - protein, 19 aa, Entamoeba histolytica
IENIFFATHDLHLTFRISS

SEQ ID NO: 2594689 - protein, 23 aa, Entamoeba histolytica
IENNTDILFINTKQFKVIPEVDL

SEQ ID NO: 2594690 - protein, 27 aa, Entamoeba histolytica
IENSTAIRWFLPLLSLSMKLSSIYQLW

SEQ ID NO: 2594691 - protein, 26 aa, Entamoeba histolytica
IEQLRMNFVLFILATIGGIVGGAVFP

SEQ ID NO: 2594692 - protein, 23 aa, Entamoeba histolytica
IEQYLIFHIINQLSSWINLSKES

SEQ ID NO: 2594693 - protein, 25 aa, Entamoeba histolytica
IEREFIQPQWIFDCVNENFILPCGE

SEQ ID NO: 2594694 - protein, 21 aa, Entamoeba histolytica
IERHLFLIPTFFTVFIFFVSC

SEQ ID NO: 2594695 - protein, 18 aa, Entamoeba histolytica
IERLFTLLYSRIDTRYYS

SEQ ID NO: 2594696 - protein, 18 aa, Entamoeba histolytica
IESAKCIIFMIAGDEVKK

SEQ ID NO: 2594697 - protein, 30 aa, Entamoeba histolytica
IESITFKSIGLPLLFLEPTSNELLIKTIPQ

SEQ ID NO: 2594698 - protein, 25 aa, Entamoeba histolytica
IESLDRIFEIYLILSKELNRPITNK

SEQ ID NO: 2594699 - protein, 18 aa, Entamoeba histolytica
IESLLNWARKLSPIDVNK

SEQ ID NO: 2594700 - protein, 27 aa, Entamoeba histolytica
IESVPLLPHIWMGVYGYNLGISFGEKY

SEQ ID NO: 2594701 - protein, 25 aa, Entamoeba histolytica
IETLKLLQIPMFLNEKYKKIEYSFD

SEQ ID NO: 2594702 - protein, 18 aa, Entamoeba histolytica
IETQFKWMRREIGIGFNG

SEQ ID NO: 2594703 - protein, 26 aa, Entamoeba histolytica
IEVFKQYIYFISIPTFPKYYNIISEH

SEQ ID NO: 2594704 - protein, 19 aa, Entamoeba histolytica
IEVFPKMKLMKHPRKPTEI

SEQ ID NO: 2594705 - protein, 20 aa, Entamoeba histolytica
IEYFILRPLFHSVLPFSLPK

SEQ ID NO: 2594706 - protein, 25 aa, Entamoeba histolytica
IEYHYDLVHFLPCILQRCIDVLNDR

SEQ ID NO: 2594707 - protein, 23 aa, Entamoeba histolytica
IEYKHYLLSILTPLLVEPPPDDP

SEQ ID NO: 2594708 - protein, 30 aa, Entamoeba histolytica
IEYNSLFTSLPILIFSIFDRDVPPYIIYKY

SEQ ID NO: 2594709 - protein, 29 aa, Entamoeba histolytica
IEYSEISILLPKFLTFSALPIESVNKCLY

SEQ ID NO: 2594710 - protein, 17 aa, Entamoeba histolytica
IFAIFCITILTLIVNKI

SEQ ID NO: 2594711 - protein, 18 aa, Entamoeba histolytica
IFALVIAAIFVAFYIFTV

SEQ ID NO: 2594712 - protein, 20 aa, Entamoeba histolytica
IFCLGLYRALYIINWIYRYA

SEQ ID NO: 2594713 - protein, 18 aa, Entamoeba histolytica
IFEQPPLNKIPSFDTAIR

SEQ ID NO: 2594714 - protein, 20 aa, Entamoeba histolytica
IFFGLCLCMILIIGGVQSFA

SEQ ID NO: 2594715 - protein, 19 aa, Entamoeba histolytica
IFFLAMFIIPFSFYKRISF

SEQ ID NO: 2594716 - protein, 22 aa, Entamoeba histolytica
IFFLFYIFLIVMAVFRCESGDA

SEQ ID NO: 2594717 - protein, 25 aa, Entamoeba histolytica
IFGGCGFLLFYFICSVIVDLVIELI

SEQ ID NO: 2594718 - protein, 26 aa, Entamoeba histolytica
IFGGMKFFEIFPFILPNLVCSLITMV

SEQ ID NO: 2594719 - protein, 18 aa, Entamoeba histolytica
IFGIVIFSLFNVALTTQW

SEQ ID NO: 2594720 - protein, 28 aa, Entamoeba histolytica
IFHDFSIYTLIMIFVMSVGGILVALVMT

SEQ ID NO: 2594721 - protein, 17 aa, Entamoeba histolytica
IFHLLRWTQGNEANVER

SEQ ID NO: 2594722 - protein, 25 aa, Entamoeba histolytica
IFICFLMFYVLIMFDALRKPIRQRT

SEQ ID NO: 2594723 - protein, 27 aa, Entamoeba histolytica
IFIFGLGLLFIIFQKKLKKASLDDITL

SEQ ID NO: 2594724 - protein, 18 aa, Entamoeba histolytica
IFIIMIVIVTFVFVLLFY

SEQ ID NO: 2594725 - protein, 29 aa, Entamoeba histolytica
IFINNIICYLYYSYSFIKPDITPVHAFVS

SEQ ID NO: 2594726 - protein, 29 aa, Entamoeba histolytica
IFISLPITLIIVIIIAYLIVFIIGGICYV

SEQ ID NO: 2594727 - protein, 21 aa, Entamoeba histolytica
IFKCSLFFIKIQTPFLNLFVI

SEQ ID NO: 2594728 - protein, 35 aa, Entamoeba histolytica
IFKEEYVKLYFRYLDRYLFNYILHTSPSINVEIAL

SEQ ID NO: 2594729 - protein, 25 aa, Entamoeba histolytica
IFKPYKCYYSFDKWLGYSKDNISLF

SEQ ID NO: 2594730 - protein, 21 aa, Entamoeba histolytica
IFLLLILIPESNCLQIDSPCI

SEQ ID NO: 2594731 - protein, 18 aa, Entamoeba histolytica
IFLLMIELLSMNLHNNII

SEQ ID NO: 2594732 - protein, 18 aa, Entamoeba histolytica
IFLSFYSHLVDSLYFSFL

SEQ ID NO: 2594733 - protein, 42 aa, Entamoeba histolytica; identical to SEQ ID NO: 2397774

SEQ ID NO: 2594734 - protein, 19 aa, Entamoeba histolytica
IFLTPKVYISLAVIVSVII

SEQ ID NO: 2594735 - protein, 26 aa, Entamoeba histolytica
IFMITLFFLIFYWAGVFFVVCFWIMF

SEQ ID NO: 2594736 - protein, 19 aa, Entamoeba histolytica
IFNINFICPQANGEYIYRT

SEQ ID NO: 2594737 - protein, 25 aa, Entamoeba histolytica
IFNNFKIFCDCLYDKKMKEFMNVAS

SEQ ID NO: 2594738 - protein, 32 aa, Entamoeba histolytica
IFNNLAYIYIVILGLFPPLFFGTSMSAFTKRY

SEQ ID NO: 2594739 - protein, 30 aa, Entamoeba histolytica; identical to SEQ ID NO: 2397779

SEQ ID NO: 2594740 - protein, 18 aa, Entamoeba histolytica
IFNWELLSIGAILQYCQM

SEQ ID NO: 2594741 - protein, 24 aa, Entamoeba histolytica
IFPLMKYWFINKQKKSYLLPSEML

SEQ ID NO: 2594742 - protein, 26 aa, Entamoeba histolytica
IFQKLQLLFFCYRIVALVLMFTTLII

SEQ ID NO: 2594743 - protein, 17 aa, Entamoeba histolytica
IFRGECIRCLSQNLLLS

SEQ ID NO: 2594744 - protein, 19 aa, Entamoeba histolytica
IFSIFVVYVGPMCIMMLWP

SEQ ID NO: 2594745 - protein, 21 aa, Entamoeba histolytica
IFSISFIVLLISFIPTLIVAD

SEQ ID NO: 2594746 - protein, 20 aa, Entamoeba histolytica
IFSKKKLCFPDNGRWWNFTI

SEQ ID NO: 2594747 - protein, 22 aa, Entamoeba histolytica
IFSNIFCRNMLLLLSRSTKTAK

SEQ ID NO: 2594748 - protein, 33 aa, Entamoeba histolytica
IFSVTPFPGIGIIQWITCLVLSSLSLVIGQLAI

SEQ ID NO: 2594749 - protein, 17 aa, Entamoeba histolytica
IFSYVFPLLFRLINFIE

SEQ ID NO: 2594750 - protein, 26 aa, Entamoeba histolytica
IFTARADILPFNWISELPLNMKNLEI

SEQ ID NO: 2594751 - protein, 17 aa, Entamoeba histolytica
IFTLIPIILIYSIFTRL

SEQ ID NO: 2594752 - protein, 18 aa, Entamoeba histolytica
IFTQLPDSLLDLSLISCK

SEQ ID NO: 2594753 - protein, 24 aa, Entamoeba histolytica
IFTSVPMYFYPLGYLVGLCDIPVP

SEQ ID NO: 2594754 - protein, 25 aa, Entamoeba histolytica
IFVIPLVYFPWISLLLHVSFISEAI

SEQ ID NO: 2594755 - protein, 37 aa, Entamoeba histolytica
IFVTRAYLRKFYLGRIPYLYFIIFATLTGVVTAPWKN

SEQ ID NO: 2594756 - protein, 18 aa, Entamoeba histolytica
IFVTSSHLFENRYFPVEI

SEQ ID NO: 2594757 - protein, 18 aa, Entamoeba histolytica
IFVVICTCSYYLIIVVVL

SEQ ID NO: 2594758 - protein, 17 aa, Entamoeba histolytica
IFYFFKKNFENKACVVS

SEQ ID NO: 2594759 - protein, 17 aa, Entamoeba histolytica
IFYISWQVIYVIITEVI

SEQ ID NO: 2594760 - protein, 18 aa, Entamoeba histolytica
IFYVFKVVYWTISGLQIK

SEQ ID NO: 2594761 - protein, 18 aa, Entamoeba histolytica
IGADIMISFILKKTVWAQ

SEQ ID NO: 2594762 - protein, 19 aa, Entamoeba histolytica
IGASLFICGILLIIASCLM

SEQ ID NO: 2594763 - protein, 19 aa, Entamoeba histolytica
IGCIRCKIGYYLDPTTSTC

SEQ ID NO: 2594764 - protein, 34 aa, Entamoeba histolytica
IGCLLVIICFLIILVVIFILLRKKIITDSKGIDK

SEQ ID NO: 2594765 - protein, 27 aa, Entamoeba histolytica
IGDICCLNKTIYGNILLGFSKEEFLDQ

SEQ ID NO: 2594766 - protein, 25 aa, Entamoeba histolytica
IGDMIGLLLFILLTYCHYKVIHTSP

SEQ ID NO: 2594767 - protein, 23 aa, Entamoeba histolytica
IGEKLRIVISVIFFFISCFFDIP

SEQ ID NO: 2594768 - protein, 29 aa, Entamoeba histolytica
IGEYIPIQWYLGMIILIAGVILLIVDNSE

SEQ ID NO: 2594769 - protein, 24 aa, Entamoeba histolytica
IGFTIRRWNWIIFASEASSVLMYL

SEQ ID NO: 2594770 - protein, 18 aa, Entamoeba histolytica
IGGFIPFFIKLLPNRKLA

SEQ ID NO: 2594771 - protein, 28 aa, Entamoeba histolytica
IGGGAIFPFFTLKIVDLIMCLLSINSDT

SEQ ID NO: 2594772 - protein, 25 aa, Entamoeba histolytica
IGGILLVITIIILSVTLTSFVIRTK

SEQ ID NO: 2594773 - protein, 24 aa, Entamoeba histolytica
IGGKFTINCPVTVTTLNIIANPEN

SEQ ID NO: 2594774 - protein, 23 aa, Entamoeba histolytica
IGGLITFWIFLFLDNIAILCAIH

SEQ ID NO: 2594775 - protein, 19 aa, Entamoeba histolytica
IGIFLLVQPSHRVRKFTFI

SEQ ID NO: 2594776 - protein, 20 aa, Entamoeba histolytica
IGIGDKRRFIASEPAAFARY

SEQ ID NO: 2594777 - protein, 26 aa, Entamoeba histolytica
IGIHNIRFFFLFISSLSLSLLLGAIT

SEQ ID NO: 2594778 - protein, 17 aa, Entamoeba histolytica
IGILLFLYQLFDSLDGM

SEQ ID NO: 2594779 - protein, 17 aa, Entamoeba histolytica
IGILLIICKMFLSILPA

SEQ ID NO: 2594780 - protein, 18 aa, Entamoeba histolytica
IGILLQFVTTSYSPILLS

SEQ ID NO: 2594781 - protein, 36 aa, Entamoeba histolytica
IGILQVFFVIVSLIALLLCFFVMLLSFTSNVYENSW

SEQ ID NO: 2594782 - protein, 40 aa, Entamoeba histolytica
IGITISAIIIFVVLLCCGGILLYFLLRTTKFDINIYLQQQ

SEQ ID NO: 2594783 - protein, 31 aa, Entamoeba histolytica
IGKKRLWELFFVFLVGFFRCSFFTLTVEIGS

SEQ ID NO: 2594784 - protein, 27 aa, Entamoeba histolytica
IGKRSVRFLIKTLPKYLTFVIKRFERN

SEQ ID NO: 2594785 - protein, 29 aa, Entamoeba histolytica
IGLSQLFISILPIKKRWKMIPLETDYCGP

SEQ ID NO: 2594786 - protein, 18 aa, Entamoeba histolytica
IGLVFVLGGGMWAGKEGP

SEQ ID NO: 2594787 - protein, 22 aa, Entamoeba histolytica
IGLYLILIIINNLVGFIPTHQE

SEQ ID NO: 2594788 - protein, 18 aa, Entamoeba histolytica
IGMAEILMHIIIDNDERL

SEQ ID NO: 2594789 - protein, 24 aa, Entamoeba histolytica
IGMIIGYYFYCYKTITVTFTGQSL

SEQ ID NO: 2594790 - protein, 25 aa, Entamoeba histolytica
IGMYSIVVLIVWTIGQFYGDCLKIF

SEQ ID NO: 2594791 - protein, 17 aa, Entamoeba histolytica
IGNFVPLEPKKYVIFQH

SEQ ID NO: 2594792 - protein, 22 aa, Entamoeba histolytica
IGQDPLLLIRIFHNESYDKTPV

SEQ ID NO: 2594793 - protein, 28 aa, Entamoeba histolytica
IGQHNYLYYYLFVLFTVITTGLNCIIFL

SEQ ID NO: 2594794 - protein, 25 aa, Entamoeba histolytica
IGQYVFIFVGLYSLAAFLTLSFTMF

SEQ ID NO: 2594795 - protein, 38 aa, Entamoeba histolytica
IGSLLQVFLCVYSAIMVILWGARKWLDVSFSSFFIASF

SEQ ID NO: 2594796 - protein, 22 aa, Entamoeba histolytica
IGTILLIWNYQIGIPVLLCIVP

SEQ ID NO: 2594797 - protein, 25 aa, Entamoeba histolytica
IGTNSMYYSLPITKPILSSSNKYIF

SEQ ID NO: 2594798 - protein, 37 aa, Entamoeba histolytica
IGTPSITFVLLFLFALVIIVILILYAHRRDPKKESWE

SEQ ID NO: 2594799 - protein, 23 aa, Entamoeba histolytica
IGVAFTMYYFVSDKHVYLLDFTV

SEQ ID NO: 2594800 - protein, 32 aa, Entamoeba histolytica
IGVALRFITNGLLLIILISLPMGIIAAYEFQG

SEQ ID NO: 2594801 - protein, 33 aa, Entamoeba histolytica
IGVAYILSILNQRELFYQLHFLDGLEKLYNQKL

SEQ ID NO: 2594802 - protein, 17 aa, Entamoeba histolytica
IGVDLFVLPNKFSDIVT

SEQ ID NO: 2594803 - protein, 21 aa, Entamoeba histolytica
IGVFVRMVLFPAVSWVCTFFM

SEQ ID NO: 2594804 - protein, 18 aa, Entamoeba histolytica
IGVKVNINYVPKQKTRLF

SEQ ID NO: 2594805 - protein, 17 aa, Entamoeba histolytica
IGVLISLCDGVLYPLIA

SEQ ID NO: 2594806 - protein, 26 aa, Entamoeba histolytica
IGWIAKSLPWLMFIGGLISSLGYLLT

SEQ ID NO: 2594807 - protein, 39 aa, Entamoeba histolytica
IGYAYLIDSVISYILSISWSSVLYLIQDLGLFKNLLPKP

SEQ ID NO: 2594808 - protein, 18 aa, Entamoeba histolytica
IGYWILFVVSSVFIGLIY

SEQ ID NO: 2594809 - protein, 17 aa, Entamoeba histolytica
IHCYGAVFIPSKICMVT

SEQ ID NO: 2594810 - protein, 18 aa, Entamoeba histolytica
IHDQFMNCLTQWCKARGF

SEQ ID NO: 2594811 - protein, 19 aa, Entamoeba histolytica
IHFPKIPRVVYLNNKCIEA

SEQ ID NO: 2594812 - protein, 26 aa, Entamoeba histolytica
IHGRKNILFLITTTEGWAFGAFIAGH

SEQ ID NO: 2594813 - protein, 24 aa, Entamoeba histolytica
IHGSFIFYHELLPQIFINDKNTSI

SEQ ID NO: 2594814 - protein, 18 aa, Entamoeba histolytica
IHHYGPISTAIYSTIDPA

SEQ ID NO: 2594815 - protein, 24 aa, Entamoeba histolytica
IHNLCIVGIPIVVFKSYSVLLKWF

SEQ ID NO: 2594816 - protein, 19 aa, Entamoeba histolytica
IHPKIRSFIYFIKQFHKEN

SEQ ID NO: 2594817 - protein, 25 aa, Entamoeba histolytica
IHQPRPLIFQKFDKIIMLNRGHMMY

SEQ ID NO: 2594818 - protein, 28 aa, Entamoeba histolytica
IHRDLKPDNLLLFSFSPKVQFAAKISDF

SEQ ID NO: 2594819 - protein, 19 aa, Entamoeba histolytica
IHRKLIFMKNLMEIKTLNQ

SEQ ID NO: 2594820 - protein, 23 aa, Entamoeba histolytica
IHSFLFYIYIQCTNAFVESINTP

SEQ ID NO: 2594821 - protein, 19 aa, Entamoeba histolytica
IHSISNLLKYFFRSLPHGL

SEQ ID NO: 2594822 - protein, 22 aa, Entamoeba histolytica
IHYTVLLIYTWGQRLMGIWISF

SEQ ID NO: 2594823 - protein, 30 aa, Entamoeba histolytica
IIAAIFIAFIVIVIIVTIIVVVIIKKKGKS

SEQ ID NO: 2594824 - protein, 18 aa, Entamoeba histolytica
IIAKIPYIPVQYQSLSIS

SEQ ID NO: 2594825 - protein, 20 aa, Entamoeba histolytica
IIALLICIILISTNFSITEH

SEQ ID NO: 2594826 - protein, 31 aa, Entamoeba histolytica
IIASFSLFFFIGIFIIHLTLVPTKGSFQIKL

SEQ ID NO: 2594827 - protein, 34 aa, Entamoeba histolytica
IICKIQLFVFSCVLYIFICLMFLISTVYQLQIWF

SEQ ID NO: 2594828 - protein, 17 aa, Entamoeba histolytica
IICLARALLKKSKILIM

SEQ ID NO: 2594829 - protein, 25 aa, Entamoeba histolytica
IICSICILFPLIKTLNLLKKNTGTE

SEQ ID NO: 2594830 - protein, 26 aa, Entamoeba histolytica
IIDKGSIIFLLMAYASVMDITEQEHF

SEQ ID NO: 2594831 - protein, 18 aa, Entamoeba histolytica
IIECFYEGYWRNTAKRTS

SEQ ID NO: 2594832 - protein, 19 aa, Entamoeba histolytica
IIEIAFISTPIFYSISVTC

SEQ ID NO: 2594833 - protein, 24 aa, Entamoeba histolytica
IIEKLYFISFLGKEIPLELAKDIF

SEQ ID NO: 2594834 - protein, 25 aa, Entamoeba histolytica
IIEKQRFAILPLYDNKKPIGNKTVS

SEQ ID NO: 2594835 - protein, 18 aa, Entamoeba histolytica
IIEMLRRILQIYSIIHVD

SEQ ID NO: 2594836 - protein, 23 aa, Entamoeba histolytica
IIEQLCHIIWHTLIKQSEYRWCS

SEQ ID NO: 2594837 - protein, 19 aa, Entamoeba histolytica
IIFAFWKELNKAISFGYSS

SEQ ID NO: 2594838 - protein, 21 aa, Entamoeba histolytica
IIFFSYIVFADQYTMVGTNSN

SEQ ID NO: 2594839 - protein, 17 aa, Entamoeba histolytica
IIFFVTLILFMISLFFL

SEQ ID NO: 2594840 - protein, 23 aa, Entamoeba histolytica
IIFLKNKYNGVFQLGLDMLKRLE

SEQ ID NO: 2594841 - protein, 22 aa, Entamoeba histolytica
IIFSGIMFILSIIQPGYTCHAG

SEQ ID NO: 2594842 - protein, 31 aa, Entamoeba histolytica
IIFSQPSTYLFILLYVILAITPLLLRNFCNR

SEQ ID NO: 2594843 - protein, 17 aa, Entamoeba histolytica
IIFYYQPGKYMDIVYCC

SEQ ID NO: 2594844 - protein, 27 aa, Entamoeba histolytica
IIHPSPLVIFLEQTPKLLFFTCVALYA

SEQ ID NO: 2594845 - protein, 36 aa, Entamoeba histolytica; identical to SEQ ID NO: 2397893

SEQ ID NO: 2594846 - protein, 20 aa, Entamoeba histolytica
IIIIIIAILTGMIIGVSCLF

SEQ ID NO: 2594847 - protein, 23 aa, Entamoeba histolytica
IIIIILLFIYISNGSLCGVGCFN

SEQ ID NO: 2594848 - protein, 22 aa, Entamoeba histolytica
IIIILSCIFSLSYSFEQNYEIV

SEQ ID NO: 2594849 - protein, 18 aa, Entamoeba histolytica
IIIKDIINVLLYNTNITL

SEQ ID NO: 2594850 - protein, 20 aa, Entamoeba histolytica
IIIKIIIMLLPIITTLSVYP

SEQ ID NO: 2594851 - protein, 17 aa, Entamoeba histolytica
IIIPLIFGLSYLIHFIF

SEQ ID NO: 2594852 - protein, 17 aa, Entamoeba histolytica
IIITIIFAIAVLGLNAY

SEQ ID NO: 2594853 - protein, 17 aa, Entamoeba histolytica
IIITVNLIVKCTTILKE

SEQ ID NO: 2594854 - protein, 25 aa, Entamoeba histolytica
IIIVIPALIYIIFASNLLPSKKDSL

SEQ ID NO: 2594855 - protein, 23 aa, Entamoeba histolytica
IIIVTLVILYFIRPKKYNKEKEG

SEQ ID NO: 2594856 - protein, 22 aa, Entamoeba histolytica
IIIYSWVLFMLWCYDIINFGYV

SEQ ID NO: 2594857 - protein, 18 aa, Entamoeba histolytica
IIKKILHHYGPISVSILV

SEQ ID NO: 2594858 - protein, 38 aa, Entamoeba histolytica
IILCLVSLCILFILGTLAFWFNTKYKLSFNIIISVLVL

SEQ ID NO: 2594859 - protein, 17 aa, Entamoeba histolytica
IILFIVTFILFIDIISC

SEQ ID NO: 2594860 - protein, 23 aa, Entamoeba histolytica
IILFLFFIYSINGKIHCNNGIKL

SEQ ID NO: 2594861 - protein, 28 aa, Entamoeba histolytica
IILLFIGTLLFYRILPTIITYLNLVLSV

SEQ ID NO: 2594862 - protein, 21 aa, Entamoeba histolytica
IILLKEINPFIKWRLSAIENC

SEQ ID NO: 2594863 - protein, 33 aa, Entamoeba histolytica
IILLLLFIVSLLLFIIYSVLFQARWLMWIINKI

SEQ ID NO: 2594864 - protein, 21 aa, Entamoeba histolytica
IILLVAFFAFYIWAIIDTWKD

SEQ ID NO: 2594865 - protein, 24 aa, Entamoeba histolytica
IILPTIMLIVIFTIIIMLIFHSII

SEQ ID NO: 2594866 - protein, 32 aa, Entamoeba histolytica
IILRRNNEMILNLLLLVFSFIDGFSIDLITNT

SEQ ID NO: 2594867 - protein, 21 aa, Entamoeba histolytica
IILSRLCMMLKYMIEHFKENG

SEQ ID NO: 2594868 - protein, 20 aa, Entamoeba histolytica
IILTMEFANCKFTENVKQVI

SEQ ID NO: 2594869 - protein, 18 aa, Entamoeba histolytica
IILTYIPITMAHVYVMFA

SEQ ID NO: 2594870 - protein, 23 aa, Entamoeba histolytica
IILYYKEVLMPIYMLPINETITN

SEQ ID NO: 2594871 - protein, 17 aa, Entamoeba histolytica
IINCPFINDYKYQMTIY

SEQ ID NO: 2594872 - protein, 21 aa, Entamoeba histolytica
IINDLKYFLESYVFKDILKNP

SEQ ID NO: 2594873 - protein, 27 aa, Entamoeba histolytica
IINGQIKYDFYYINKGIYLNSDSTLSL

SEQ ID NO: 2594874 - protein, 20 aa, Entamoeba histolytica
IINIIALPILYYQAPEMKYA

SEQ ID NO: 2594875 - protein, 33 aa, Entamoeba histolytica
IINIIPIIERLLLYLFYFWDTAGLSLTIKNLLS

SEQ ID NO: 2594876 - protein, 18 aa, Entamoeba histolytica
IINPYTYNFFTLQSLQSK

SEQ ID NO: 2594877 - protein, 25 aa, Entamoeba histolytica
IIPMQIFWYIVYYGMIVFAAIILPF

SEQ ID NO: 2594878 - protein, 19 aa, Entamoeba histolytica
IIPTYDFTVPLCCSILNTV

SEQ ID NO: 2594879 - protein, 18 aa, Entamoeba histolytica
IIRALYDLGFINPTEIQQ

SEQ ID NO: 2594880 - protein, 18 aa, Entamoeba histolytica
IIRIIVQLLQYYLNSEIM

SEQ ID NO: 2594881 - protein, 21 aa, Entamoeba histolytica
IIRTCGVDAVPFWDAIRNCLD

SEQ ID NO: 2594882 - protein, 19 aa, Entamoeba histolytica
IIRTRFVLPSLLTRQVVES

SEQ ID NO: 2594883 - protein, 20 aa, Entamoeba histolytica
IISCGYYNYLSYTKGPLIDN

SEQ ID NO: 2594884 - protein, 26 aa, Entamoeba histolytica
IISICFVFIPPYYSKKMWPLVIVFII

SEQ ID NO: 2594885 - protein, 19 aa, Entamoeba histolytica
IISIPALIYIIFANGILSR

SEQ ID NO: 2594886 - protein, 17 aa, Entamoeba histolytica
IISNLYKLFDLKQPKIQ

SEQ ID NO: 2594887 - protein, 26 aa, Entamoeba histolytica
IISPSWLIIIVLVLLLGFTSYKTFAK

SEQ ID NO: 2594888 - protein, 18 aa, Entamoeba histolytica
IISYSHYYYILVNGIIVD

SEQ ID NO: 2594889 - protein, 25 aa, Entamoeba histolytica
IITKELILVICPLLSSITTNHIELS

SEQ ID NO: 2594890 - protein, 26 aa, Entamoeba histolytica
IITKNKQQILFIKSLKYFNINEPAIS

SEQ ID NO: 2594891 - protein, 19 aa, Entamoeba histolytica
IITLFNMIMTSMPPVFIGA

SEQ ID NO: 2594892 - protein, 31 aa, Entamoeba histolytica
IITTFPRCVLVLYWFAFPYNFMNYRVDGVLV

SEQ ID NO: 2594893 - protein, 25 aa, Entamoeba histolytica
IIVCRMLMIIVVVISYPALMFPTCA

SEQ ID NO: 2594894 - protein, 25 aa, Entamoeba histolytica
IIVFSFVEIPFIPIQIIRVRFDCIE

SEQ ID NO: 2594895 - protein, 25 aa, Entamoeba histolytica
IIVLQTIVIVWLLLKRNKKCIKSVS

SEQ ID NO: 2594896 - protein, 22 aa, Entamoeba histolytica
IIVNGIMKWFESITIEKAKSLK

SEQ ID NO: 2594897 - protein, 20 aa, Entamoeba histolytica
IIVPYINETLLRTVEIEYSI

SEQ ID NO: 2594898 - protein, 27 aa, Entamoeba histolytica
IIVSCIAENFIRFPYPGLPSTDIDGKK

SEQ ID NO: 2594899 - protein, 37 aa, Entamoeba histolytica
IIVSSLFVSFLIVCAVILIIAVVIRKYLNVRSQKQNN

SEQ ID NO: 2594900 - protein, 32 aa, Entamoeba histolytica; identical to SEQ ID NO: 2397971

SEQ ID NO: 2594901 - protein, 19 aa, Entamoeba histolytica
IIYSLLLIYTFRILERRWS

SEQ ID NO: 2594902 - protein, 24 aa, Entamoeba histolytica
IKASFVNFFIVSFALSCIACWIVF

SEQ ID NO: 2594903 - protein, 47 aa, Entamoeba histolytica
IKASKTLVIILSILSILIFLGIIVALILIFLVYKKNKKRSPKTKFRI

SEQ ID NO: 2594904 - protein, 22 aa, Entamoeba histolytica
IKDVILLILQTYIDLTKEINET

SEQ ID NO: 2594905 - protein, 35 aa, Entamoeba histolytica
IKEKYPILQWILRSILFILYLSALLLYFFSNLVHQ

SEQ ID NO: 2594906 - protein, 28 aa, Entamoeba histolytica
IKELYRYAGFIDYILLIGGIIGAMAAGV

SEQ ID NO: 2594907 - protein, 19 aa, Entamoeba histolytica
IKETLPCALTVILAVTIDS

SEQ ID NO: 2594908 - protein, 18 aa, Entamoeba histolytica
IKFIPLGDGILTNKKEIE

SEQ ID NO: 2594909 - protein, 23 aa, Entamoeba histolytica
IKFITHPFLWSFVFMVICGYWNG

SEQ ID NO: 2594910 - protein, 17 aa, Entamoeba histolytica
IKGTCIPCTSPCTKCVG

SEQ ID NO: 2594911 - protein, 41 aa, Entamoeba histolytica
IKHTNALRKCFISYKGYFYTAVVYGIAITWMVPHQFAIEKN

SEQ ID NO: 2594912 - protein, 25 aa, Entamoeba histolytica
IKIKVPTYYIFLNFGDWVMTNYIFI

SEQ ID NO: 2594913 - protein, 18 aa, Entamoeba histolytica
IKIVYVAPELLSCSWKMN

SEQ ID NO: 2594914 - protein, 17 aa, Entamoeba histolytica
IKIWTLICSIAAILFTL

SEQ ID NO: 2594915 - protein, 27 aa, Entamoeba histolytica
IKKAEEPLYLYLISRVFPPVHSLNALS

SEQ ID NO: 2594916 - protein, 31 aa, Entamoeba histolytica
IKKIQIHKKFYYFIILYEMIHEKNILQIINE

SEQ ID NO: 2594917 - protein, 23 aa, Entamoeba histolytica
IKKSPWKELRGKRPMVLRMEKHI

SEQ ID NO: 2594918 - protein, 18 aa, Entamoeba histolytica
IKLFCQVLRCISYLHSKG

SEQ ID NO: 2594919 - protein, 27 aa, Entamoeba histolytica
IKLHPMIRFIFFIISFLIGLTALLLTL

SEQ ID NO: 2594920 - protein, 28 aa, Entamoeba histolytica
IKLHPMIRFIFFIISFLIGLTALLLTLP

SEQ ID NO: 2594921 - protein, 27 aa, Entamoeba histolytica
IKLLSNNRLIRYCPYSFNYSVLCIMNS

SEQ ID NO: 2594922 - protein, 37 aa, Entamoeba histolytica
IKLNEDFWMRHSLIALFSWYVIILLDEQNPTHIENLR

SEQ ID NO: 2594923 - protein, 19 aa, Entamoeba histolytica
IKLRSFHKILNYSGIMTDC

SEQ ID NO: 2594924 - protein, 29 aa, Entamoeba histolytica
IKLTNWFNKILLILSIPFRFIMEFTTPHI

SEQ ID NO: 2594925 - protein, 20 aa, Entamoeba histolytica
IKMGIEIIGIIYNITRSTKD

SEQ ID NO: 2594926 - protein, 19 aa, Entamoeba histolytica
IKMIMRLILEMYPTRTGMV

SEQ ID NO: 2594927 - protein, 22 aa, Entamoeba histolytica
IKNDYTLLKEIYSRCIKSIIKG

SEQ ID NO: 2594928 - protein, 25 aa, Entamoeba histolytica
IKNLSSCFLYLNDDMLLGKKLKPEH

SEQ ID NO: 2594929 - protein, 33 aa, Entamoeba histolytica
IKPEVTYFSLLLLLILISLCSSYFIRMNKPKFG

SEQ ID NO: 2594930 - protein, 19 aa, Entamoeba histolytica
IKPLFLGLCFFLLLCGYQT

SEQ ID NO: 2594931 - protein, 20 aa, Entamoeba histolytica
IKQFSHMLKLLLWHGRNSYI

SEQ ID NO: 2594932 - protein, 34 aa, Entamoeba histolytica; identical to SEQ ID NO: 2398008

SEQ ID NO: 2594933 - protein, 29 aa, Entamoeba histolytica
IKQLLKSIWVYKFFVQLIQKLNTKNKNCI

SEQ ID NO: 2594934 - protein, 30 aa, Entamoeba histolytica
IKQVLLIFRYILLFVILLSFIFNSFIKYIK

SEQ ID NO: 2594935 - protein, 25 aa, Entamoeba histolytica
IKRIDIRIFKLQQPVYYYYISGSKK

SEQ ID NO: 2594936 - protein, 31 aa, Entamoeba histolytica
IKRLTFGYVFVLCFDYLYISNSTKLPVCPTD

SEQ ID NO: 2594937 - protein, 28 aa, Entamoeba histolytica
IKSLEYFIYILLFYTISFKLIGFIVILI

SEQ ID NO: 2594938 - protein, 22 aa, Entamoeba histolytica
IKTFISKLLFRIINLKYQNIMK

SEQ ID NO: 2594939 - protein, 33 aa, Entamoeba histolytica
IKTIINFVLFIISIILFILFINSLYQIIDESYK

SEQ ID NO: 2594940 - protein, 25 aa, Entamoeba histolytica
IKTIYPFMIILLLALFIMMKKTNSS

SEQ ID NO: 2594941 - protein, 17 aa, Entamoeba histolytica
IKTQYFHFIDLQTKQIY

SEQ ID NO: 2594942 - protein, 18 aa, Entamoeba histolytica
IKVLKNKPAYFKQSLIEV

SEQ ID NO: 2594943 - protein, 31 aa, Entamoeba histolytica
IKYERLYTTVKNKLYFFFSSSGNDLLNGLIV

SEQ ID NO: 2594944 - protein, 41 aa, Entamoeba histolytica
IKYGGWVYFTLVMLFFFISSFLLIGSNFWLVIWTDEEKKNN

SEQ ID NO: 2594945 - protein, 26 aa, Entamoeba histolytica
IKYKYLTYGLFMLMLFSLLALHIYWF

SEQ ID NO: 2594946 - protein, 25 aa, Entamoeba histolytica
ILAPFIWEPLLKNVIPRWLAPNILT

SEQ ID NO: 2594947 - protein, 33 aa, Entamoeba histolytica
ILCMTQYFIFLILTLLLILLLQRNLNQSYKVFW

SEQ ID NO: 2594948 - protein, 18 aa, Entamoeba histolytica
ILCSFIVSFFFALFSSKQ

SEQ ID NO: 2594949 - protein, 48 aa, Entamoeba histolytica
ILDVIIFVSILFDYFPFFRRLLSLLLLSQVFIKFYIIIAVNQKKNFVI

SEQ ID NO: 2594950 - protein, 35 aa, Entamoeba histolytica
ILEITLVLLNALMYVLYKRIIFSASLFISMSLIGI

SEQ ID NO: 2594951 - protein, 26 aa, Entamoeba histolytica
ILESTPRLFLEWFNSNELKFDGTIEV

SEQ ID NO: 2594952 - protein, 24 aa, Entamoeba histolytica
ILETILNLIIITLLYFVSETQNLA

SEQ ID NO: 2594953 - protein, 17 aa, Entamoeba histolytica
ILFCLFTVFYGITTDLT

SEQ ID NO: 2594954 - protein, 30 aa, Entamoeba histolytica
ILFFQGLLDWVSLFFITYLFEHISFKDAIE

SEQ ID NO: 2594955 - protein, 18 aa, Entamoeba histolytica
ILFIFLKHEVKGQLCDKT

SEQ ID NO: 2594956 - protein, 17 aa, Entamoeba histolytica
ILFMNVIVFIAITSTFL

SEQ ID NO: 2594957 - protein, 19 aa, Entamoeba histolytica
ILFSSFCCMLYLSSIRGIP

SEQ ID NO: 2594958 - protein, 18 aa, Entamoeba histolytica
ILFVGIYAELEGCAKEIS

SEQ ID NO: 2594959 - protein, 24 aa, Entamoeba histolytica
ILGIAGMLLNKKFKISFSIIFTTL

SEQ ID NO: 2594960 - protein, 25 aa, Entamoeba histolytica
ILHAKNYLHYNIKPSNILLISTNIN

SEQ ID NO: 2594961 - protein, 25 aa, Entamoeba histolytica
ILHDCNYIDFFQWFIKHMKDALENL

SEQ ID NO: 2594962 - protein, 25 aa, Entamoeba histolytica
ILHLSLLILVFGPPYSKALLDFLYK

SEQ ID NO: 2594963 - protein, 19 aa, Entamoeba histolytica
ILIFFFYILVLCYVSNIIG

SEQ ID NO: 2594964 - protein, 29 aa, Entamoeba histolytica
ILIFSTILAMVPFILWLIGNDRYSFTIEK

SEQ ID NO: 2594965 - protein, 22 aa, Entamoeba histolytica
ILIIVWAVMFFIVILKGGEKMD

SEQ ID NO: 2594966 - protein, 17 aa, Entamoeba histolytica
ILILVQSQKQELVRCVT

SEQ ID NO: 2594967 - protein, 25 aa, Entamoeba histolytica
ILKNSPLVLSYYTHLLIALIDSNFF

SEQ ID NO: 2594968 - protein, 21 aa, Entamoeba histolytica
ILKQQFIDGLTFYLQSQSKEE

SEQ ID NO: 2594969 - protein, 17 aa, Entamoeba histolytica
ILKRFIQRYFFPDMYHV

SEQ ID NO: 2594970 - protein, 19 aa, Entamoeba histolytica
ILLFEYLNNDYLAFGCSDS

SEQ ID NO: 2594971 - protein, 17 aa, Entamoeba histolytica
ILLFLYQLFDSLDGMQA

SEQ ID NO: 2594972 - protein, 19 aa, Entamoeba histolytica
ILLITFINEIIASDIVEEQ

SEQ ID NO: 2594973 - protein, 19 aa, Entamoeba histolytica
ILLLCWKKMIRLIESEVQI

SEQ ID NO: 2594974 - protein, 17 aa, Entamoeba histolytica
ILLLLNEMKYYYSFICH

SEQ ID NO: 2594975 - protein, 17 aa, Entamoeba histolytica
ILLLVKSLAKYCEKTTP

SEQ ID NO: 2594976 - protein, 18 aa, Entamoeba histolytica
ILLNGKLRFGNIYGFSII

SEQ ID NO: 2594977 - protein, 28 aa, Entamoeba histolytica
ILLPIIILILLILRFKYQKKRTIAFFHP

SEQ ID NO: 2594978 - protein, 18 aa, Entamoeba histolytica
ILLSIFQLFYKVGEWYVI

SEQ ID NO: 2594979 - protein, 23 aa, Entamoeba histolytica
ILLTGCFILFFIALIFTTVDVKM

SEQ ID NO: 2594980 - protein, 19 aa, Entamoeba histolytica
ILLVGVVIGFLIFNKAKKK

SEQ ID NO: 2594981 - protein, 19 aa, Entamoeba histolytica
ILMLHKISGWLFGIFAIIH

SEQ ID NO: 2594982 - protein, 24 aa, Entamoeba histolytica
ILMLNQFAFILMFSVLLDTFVIRS

SEQ ID NO: 2594983 - protein, 18 aa, Entamoeba histolytica
ILMNSLLFIFKFTLTFVT

SEQ ID NO: 2594984 - protein, 20 aa, Entamoeba histolytica
ILMTIQKIPVVWARAIVEAS

SEQ ID NO: 2594985 - protein, 17 aa, Entamoeba histolytica
ILNAQFLVNIPSGHSKC

SEQ ID NO: 2594986 - protein, 31 aa, Entamoeba histolytica
ILNLIGLIIFLPITFLTLAGGFIFGYSKGLV

SEQ ID NO: 2594987 - protein, 23 aa, Entamoeba histolytica
ILNSEFIILTFIDIFHQYRSIRQ

SEQ ID NO: 2594988 - protein, 23 aa, Entamoeba histolytica
ILNYFRRLCVHPMLVLDDQHPMK

SEQ ID NO: 2594989 - protein, 17 aa, Entamoeba histolytica
ILNYIHHTPLGKIQRNY

SEQ ID NO: 2594990 - protein, 21 aa, Entamoeba histolytica
ILPTQINGYLILDGANPEKVT

SEQ ID NO: 2594991 - protein, 24 aa, Entamoeba histolytica
ILPTYILYRPIYQWIFQRVTEVYM

SEQ ID NO: 2594992 - protein, 18 aa, Entamoeba histolytica
ILQITVYAVLLCYDVKRQ

SEQ ID NO: 2594993 - protein, 34 aa, Entamoeba histolytica
ILQRSYLLIIIVILAIFVIIYILSFITAYLKISL

SEQ ID NO: 2594994 - protein, 23 aa, Entamoeba histolytica
ILQVLNFFILIVQNIFVLSSLLT

SEQ ID NO: 2594995 - protein, 17 aa, Entamoeba histolytica
ILRALNRDYTIPKLIKE

SEQ ID NO: 2594996 - protein, 17 aa, Entamoeba histolytica
ILRGQWFKLKGSDDVLM

SEQ ID NO: 2594997 - protein, 18 aa, Entamoeba histolytica
ILRLYAMIHLARFDPKRK

SEQ ID NO: 2594998 - protein, 28 aa, Entamoeba histolytica
ILRPSLQWYFSILFWRDIKTLKSTFKQT

SEQ ID NO: 2594999 - protein, 17 aa, Entamoeba histolytica
ILRSLHFLSRLIDLFQD

SEQ ID NO: 2595000 - protein, 17 aa, Entamoeba histolytica
ILSFKLGLAPISNQLLH

SEQ ID NO: 2595001 - protein, 32 aa, Entamoeba histolytica
ILSFLGSILLYIILYTIIMFVPGMSVRNISYW

SEQ ID NO: 2595002 - protein, 22 aa, Entamoeba histolytica
ILSFLSPFKNFITTGIIVFFIV

SEQ ID NO: 2595003 - protein, 26 aa, Entamoeba histolytica
ILSGIFVIAFCIISSIIIVILIRKQI

SEQ ID NO: 2595004 - protein, 17 aa, Entamoeba histolytica
ILSIWSIVVYCIFSYLV

SEQ ID NO: 2595005 - protein, 23 aa, Entamoeba histolytica
ILSIYDDFLLFFDKYVTEETFTT

SEQ ID NO: 2595006 - protein, 17 aa, Entamoeba histolytica
ILSIYFDTISFPVIYLS

SEQ ID NO: 2595007 - protein, 34 aa, Entamoeba histolytica
ILSLISGYIVYSLPKLPGMWVYCWTITIVMWTSC

SEQ ID NO: 2595008 - protein, 18 aa, Entamoeba histolytica
ILSLLQLNDQLINVELTK

SEQ ID NO: 2595009 - protein, 17 aa, Entamoeba histolytica
ILSLNILCDLLSEFGYV

SEQ ID NO: 2595010 - protein, 24 aa, Entamoeba histolytica
ILSNLLMILITWIRTFSQLQIENY

SEQ ID NO: 2595011 - protein, 27 aa, Entamoeba histolytica
ILSPRITSVIYPKTPYYLFIHSKYASK

SEQ ID NO: 2595012 - protein, 18 aa, Entamoeba histolytica
ILSTLRGYIPITEEFFNI

SEQ ID NO: 2595013 - protein, 19 aa, Entamoeba histolytica
ILTFYLWIEAVHNNSPILS

SEQ ID NO: 2595014 - protein, 17 aa, Entamoeba histolytica
ILTLFYTFILCTLLFVL

SEQ ID NO: 2595015 - protein, 29 aa, Entamoeba histolytica
ILTNLPPVYTYFYLCVIVSSEGFVKFVII

SEQ ID NO: 2595016 - protein, 22 aa, Entamoeba histolytica
ILTNQFFDLVRYGVTYTLNKND

SEQ ID NO: 2595017 - protein, 56 aa, Entamoeba histolytica
ILTTEAYLFTITFFICSWYYQPGYYVPYLFCCVLFGLFSLFIYSTSLRLKRFYISQ

SEQ ID NO: 2595018 - protein, 26 aa, Entamoeba histolytica
ILTVSGFLFIGVFNSFLVSNERFWKY

SEQ ID NO: 2595019 - protein, 25 aa, Entamoeba histolytica
ILTVSIISLIFFNIKMKSTYQTFQQ

SEQ ID NO: 2595020 - protein, 18 aa, Entamoeba histolytica
ILVVLTSIELLILEKSEN

SEQ ID NO: 2595021 - protein, 18 aa, Entamoeba histolytica
ILWLIGGVQQYLGAYLKL

SEQ ID NO: 2595022 - protein, 28 aa, Entamoeba histolytica
ILYEIYDGIKGLYIPLLDASKQSVDYAQ

SEQ ID NO: 2595023 - protein, 17 aa, Entamoeba histolytica
ILYSLIVFSISVIIFIV

SEQ ID NO: 2595024 - protein, 20 aa, Entamoeba histolytica
ILYVHSHITIVLLKRFEDYL

SEQ ID NO: 2595025 - protein, 18 aa, Entamoeba histolytica
IMCKPFTGTIRPGDYVEL

SEQ ID NO: 2595026 - protein, 28 aa, Entamoeba histolytica
IMEREHFFHGLLIRQYIKLIVKDIQETD

SEQ ID NO: 2595027 - protein, 18 aa, Entamoeba histolytica
IMEYAPFGSLRNLIIKKN

SEQ ID NO: 2595028 - protein, 36 aa, Entamoeba histolytica
IMFSILSIVIPFFVPYLFFTLGVLVVVTIVLWTVVI

SEQ ID NO: 2595029 - protein, 26 aa, Entamoeba histolytica
IMFSMIYELLPILNKKYRVMLITFIM

SEQ ID NO: 2595030 - protein, 18 aa, Entamoeba histolytica
IMFYDYGCSMFLSTNKIV

SEQ ID NO: 2595031 - protein, 17 aa, Entamoeba histolytica
IMFYIQDEVLKIKTNED

SEQ ID NO: 2595032 - protein, 22 aa, Entamoeba histolytica
IMGTALIQLIVKRIYLRKMEYE

SEQ ID NO: 2595033 - protein, 33 aa, Entamoeba histolytica
IMGVLIAILYIISFISILTTLLLVYFNCSYNYK

SEQ ID NO: 2595034 - protein, 26 aa, Entamoeba histolytica
IMIESSLFIPIFSFGIETQKFAYQNN

SEQ ID NO: 2595035 - protein, 17 aa, Entamoeba histolytica
IMKHFIYVVSYSKLQKI

SEQ ID NO: 2595036 - protein, 17 aa, Entamoeba histolytica
IMKLVLNDPLYHWLFNS

SEQ ID NO: 2595037 - protein, 18 aa, Entamoeba histolytica
IMKYRNYWNIPLVSNQQD

SEQ ID NO: 2595038 - protein, 18 aa, Entamoeba histolytica
IMLFVCFGESKSLSRQSK

SEQ ID NO: 2595039 - protein, 21 aa, Entamoeba histolytica
IMNEDVIITIPFGTDYYEIHD

SEQ ID NO: 2595040 - protein, 25 aa, Entamoeba histolytica
IMNHSFIIYIILSIIALLPFITTCI

SEQ ID NO: 2595041 - protein, 18 aa, Entamoeba histolytica
IMSFKSPLKLMNTLLLLP

SEQ ID NO: 2595042 - protein, 39 aa, Entamoeba histolytica
IMSFSTFWIYMRSLLLLFQFFYLMFLITLGLSAQPYVNW

SEQ ID NO: 2595043 - protein, 24 aa, Entamoeba histolytica
IMTASFIIKIIWFRGIVRESSGLL

SEQ ID NO: 2595044 - protein, 18 aa, Entamoeba histolytica
IMVPYTILDWNLNAEPSN

SEQ ID NO: 2595045 - protein, 19 aa, Entamoeba histolytica
IMVSPLCNLTIDDTLSFLS

SEQ ID NO: 2595046 - protein, 20 aa, Entamoeba histolytica
IMVTPFTSQLLSLGNDFIRI

SEQ ID NO: 2595047 - protein, 19 aa, Entamoeba histolytica
INDIDPIKFLLSFAKKYGS

SEQ ID NO: 2595048 - protein, 36 aa, Entamoeba histolytica
INDPIDCTLILTNNWKYPMHFTFHSGDYTKYEIMCK

SEQ ID NO: 2595049 - protein, 20 aa, Entamoeba histolytica
INDTAKWKWGEYKQFHMIAY

SEQ ID NO: 2595050 - protein, 18 aa, Entamoeba histolytica
INDTLLISLLNIIDTMFA

SEQ ID NO: 2595051 - protein, 30 aa, Entamoeba histolytica
INENSGLTLFYYFLPFSINIENDKKMYLIP

SEQ ID NO: 2595052 - protein, 17 aa, Entamoeba histolytica
INFFQSLKMKIFFQIHQ

SEQ ID NO: 2595053 - protein, 38 aa, Entamoeba histolytica
INHIEYILPFFSLPILLCLVFIHPILLLVPLGLFAFNF

SEQ ID NO: 2595054 - protein, 20 aa, Entamoeba histolytica
INICFLINNKQMKFIYEHSQ

SEQ ID NO: 2595055 - protein, 19 aa, Entamoeba histolytica
INIFIPRPLDIQKVIIALV

SEQ ID NO: 2595056 - protein, 17 aa, Entamoeba histolytica
INIIYAIYVFLMICNVQ

SEQ ID NO: 2595057 - protein, 17 aa, Entamoeba histolytica
ININILRSLHFLSRLID

SEQ ID NO: 2595058 - protein, 18 aa, Entamoeba histolytica
INISGYAIILSPYKIHFT

SEQ ID NO: 2595059 - protein, 20 aa, Entamoeba histolytica
INIVILSRLVYRKGIDLAVG

SEQ ID NO: 2595060 - protein, 27 aa, Entamoeba histolytica
INIYLQQQPNYYLYLSGSKKKPPTIEN

SEQ ID NO: 2595061 - protein, 25 aa, Entamoeba histolytica
INKESYILKLLSIFGRYYRNRSHSN

SEQ ID NO: 2595062 - protein, 26 aa, Entamoeba histolytica
INKKDLTTLLIFKYNKQNLTVQVSLQ

SEQ ID NO: 2595063 - protein, 22 aa, Entamoeba histolytica
INKKYCLILNTLLYNKYFTLNE

SEQ ID NO: 2595064 - protein, 28 aa, Entamoeba histolytica
INKNSELTLFSYFLPFTINIDNDKKMYL

SEQ ID NO: 2595065 - protein, 30 aa, Entamoeba histolytica
INKNSELTLFYYFLPFTINIENDKKMYLIP

SEQ ID NO: 2595066 - protein, 23 aa, Entamoeba histolytica
INKQNPLEYLRTLSNKLVSLKNA

SEQ ID NO: 2595067 - protein, 26 aa, Entamoeba histolytica
INKRFSYFFFHWSDLIRTAFFHIILY

SEQ ID NO: 2595068 - protein, 23 aa, Entamoeba histolytica
INLCQTLWISSLSKKAFQISVLQ

SEQ ID NO: 2595069 - protein, 21 aa, Entamoeba histolytica
INLLFIITIFFMFSITNLMLG

SEQ ID NO: 2595070 - protein, 30 aa, Entamoeba histolytica
INLMPPIHLFIPFVLFAGCILSYCFILLLN

SEQ ID NO: 2595071 - protein, 22 aa, Entamoeba histolytica
INLTIKAFYQLYSKGTIISKIG

SEQ ID NO: 2595072 - protein, 26 aa, Entamoeba histolytica
INMATYFCWLIIPLLMKENGASSFLI

SEQ ID NO: 2595073 - protein, 19 aa, Entamoeba histolytica
INMGFVLYYFINTMIPFSS

SEQ ID NO: 2595074 - protein, 26 aa, Entamoeba histolytica
INMSTYFCWLIIPLLMKENGATPFDI

SEQ ID NO: 2595075 - protein, 35 aa, Entamoeba histolytica
INMTRAFLLFSLLQIYWGIDMYIYRRVRINYPFIF

SEQ ID NO: 2595076 - protein, 24 aa, Entamoeba histolytica
INNDRVLQIFYWNNNYCLEYRLNN

SEQ ID NO: 2595077 - protein, 20 aa, Entamoeba histolytica
INNMYRIQVYYKAGGSWGPL

SEQ ID NO: 2595078 - protein, 25 aa, Entamoeba histolytica
INNNKIRIIDNLPILPIQSFSEACN

SEQ ID NO: 2595079 - protein, 26 aa, Entamoeba histolytica
INNNVIYLHQLYLKNALTVRESWIKE

SEQ ID NO: 2595080 - protein, 28 aa, Entamoeba histolytica
INNSYCFLVFYFFLYVPNIVLTIWSYYR

SEQ ID NO: 2595081 - protein, 40 aa, Entamoeba histolytica
INNTKVIHTQIYSNKHKITYNGYDIYLKGKTDVPKETISL

SEQ ID NO: 2595082 - protein, 31 aa, Entamoeba histolytica
INNVLKIKDFWKHVCIVWTMCYNSLPPKKIE

SEQ ID NO: 2595083 - protein, 24 aa, Entamoeba histolytica
INPMRYWRIGVLFGGTIYVIILLI

SEQ ID NO: 2595084 - protein, 22 aa, Entamoeba histolytica
INPNDFDYILKPKSQSSDTTYK

SEQ ID NO: 2595085 - protein, 17 aa, Entamoeba histolytica
INQKFYFIIETDSTTRY

SEQ ID NO: 2595086 - protein, 17 aa, Entamoeba histolytica
INRNAILLATPKKVFLF

SEQ ID NO: 2595087 - protein, 19 aa, Entamoeba histolytica
INSFLFLRVIYCKCSFVMT

SEQ ID NO: 2595088 - protein, 32 aa, Entamoeba histolytica
INSLIIYYLKMNLDFDFFLSVLEFATHKHRFQ

SEQ ID NO: 2595089 - protein, 32 aa, Entamoeba histolytica
INTAKLELTYFYYFLPFVINIERNKKMYLIPI

SEQ ID NO: 2595090 - protein, 26 aa, Entamoeba histolytica
INTKMKYLFLFPIQSLRVYYSIQYFL

SEQ ID NO: 2595091 - protein, 40 aa, Entamoeba histolytica
INTKTQAMFYILLIIACIFFLFIIYWSLMLSRKCTNTLSK

SEQ ID NO: 2595092 - protein, 17 aa, Entamoeba histolytica
INTYPRDWMLCERHFIE

SEQ ID NO: 2595093 - protein, 19 aa, Entamoeba histolytica
INVPLGTWFHLTICLYPNQ

SEQ ID NO: 2595094 - protein, 26 aa, Entamoeba histolytica
INVSYLVLILLFLAKTIFFSVYGIMS

SEQ ID NO: 2595095 - protein, 17 aa, Entamoeba histolytica
INWSTFRGFPIMTGAFC

SEQ ID NO: 2595096 - protein, 20 aa, Entamoeba histolytica
INYFVFLKRGKWGLLGNTPT

SEQ ID NO: 2595097 - protein, 26 aa, Entamoeba histolytica
INYNEQFIYMLLHSLIRNIYQTNGTT

SEQ ID NO: 2595098 - protein, 28 aa, Entamoeba histolytica
IPDKKQFHWLYLHILFKMVHHSLLSEIQ

SEQ ID NO: 2595099 - protein, 19 aa, Entamoeba histolytica
IPEPIYKLITLCWAQEPKE

SEQ ID NO: 2595100 - protein, 31 aa, Entamoeba histolytica; identical to SEQ ID NO: 2398181

SEQ ID NO: 2595101 - protein, 28 aa, Entamoeba histolytica
IPFVFSPFLLLYSILSALLLIYLSHKLL

SEQ ID NO: 2595102 - protein, 36 aa, Entamoeba histolytica
IPGGIIGGLWYCLYLFLLVALMFRFFQAFWDCNKKT

SEQ ID NO: 2595103 - protein, 25 aa, Entamoeba histolytica
IPHAKIVALLLWPSPTPLLYDDMKK

SEQ ID NO: 2595104 - protein, 24 aa, Entamoeba histolytica
IPHQPQLNFIPYQPPQNTPQIIDE

SEQ ID NO: 2595105 - protein, 18 aa, Entamoeba histolytica
IPIILDVCGFYKIIQFSF

SEQ ID NO: 2595106 - protein, 20 aa, Entamoeba histolytica
IPITIPIKKMFWKIYIMLVG

SEQ ID NO: 2595107 - protein, 20 aa, Entamoeba histolytica
IPIYIYILIPIFSSLFVEGA

SEQ ID NO: 2595108 - protein, 18 aa, Entamoeba histolytica
IPLFISEALCFLFLIIFQ

SEQ ID NO: 2595109 - protein, 20 aa, Entamoeba histolytica
IPLRNLEFGILPPQEYILGD

SEQ ID NO: 2595110 - protein, 25 aa, Entamoeba histolytica
IPLRSFFVVFTFILSIILSSFIILV

SEQ ID NO: 2595111 - protein, 27 aa, Entamoeba histolytica
IPLVILWIILIVIEIGIFAVSMTSYFI

SEQ ID NO: 2595112 - protein, 19 aa, Entamoeba histolytica
IPMFICELLCLLFLVIFQG

SEQ ID NO: 2595113 - protein, 23 aa, Entamoeba histolytica
IPNLLIILADNFLYRSYTKENLI

SEQ ID NO: 2595114 - protein, 30 aa, Entamoeba histolytica
IPNMLRLFCLRFLVPGYYMVLQEIYSDRKF

SEQ ID NO: 2595115 - protein, 26 aa, Entamoeba histolytica
IPNTTLIMMKLPFLKQVKDLVDHFPE

SEQ ID NO: 2595116 - protein, 17 aa, Entamoeba histolytica
IPPFTKLEFYNKSKWEI

SEQ ID NO: 2595117 - protein, 18 aa, Entamoeba histolytica
IPPKNYLFEGKLDGVNPA

SEQ ID NO: 2595118 - protein, 17 aa, Entamoeba histolytica
IPQISMVIQFFVLGSLG

SEQ ID NO: 2595119 - protein, 30 aa, Entamoeba histolytica
IPREWYFIPFFFFTQVILLSLHSLCFSQYT

SEQ ID NO: 2595120 - protein, 22 aa, Entamoeba histolytica
IPRTFLKPFKLFKCKEFGDVIA

SEQ ID NO: 2595121 - protein, 17 aa, Entamoeba histolytica
IPSFLNKSKLIYYNNES

SEQ ID NO: 2595122 - protein, 34 aa, Entamoeba histolytica
IPSLIGWKIQHYVVWFILFSLFLDCAISNMVIGQ

SEQ ID NO: 2595123 - protein, 19 aa, Entamoeba histolytica
IPSLLYILWQIIYLIITEG

SEQ ID NO: 2595124 - protein, 25 aa, Entamoeba histolytica
IPTLFYPIIYLFWLDNEKLTSFKPL

SEQ ID NO: 2595125 - protein, 38 aa, Entamoeba histolytica
IPYFNDIIEQYPLKWLDWLLILIAVLVHFVICESVKLV

SEQ ID NO: 2595126 - protein, 22 aa, Entamoeba histolytica
IPYLYLVIVALFTGVVTAPWYG

SEQ ID NO: 2595127 - protein, 18 aa, Entamoeba histolytica
IPYYSSSIQLDNCLIVKQ

SEQ ID NO: 2595128 - protein, 26 aa, Entamoeba histolytica
IQCVTLVLIIIILKTTHVFLVILNQT

SEQ ID NO: 2595129 - protein, 28 aa, Entamoeba histolytica
IQDAEYVFYISLSFTTAIFLRWVNRVDE

SEQ ID NO: 2595130 - protein, 23 aa, Entamoeba histolytica
IQEYVGFIITFNCSSKFTIGCLT

SEQ ID NO: 2595131 - protein, 25 aa, Entamoeba histolytica
IQFFLGVFLCFFALKTNSLFVLSFL

SEQ ID NO: 2595132 - protein, 25 aa, Entamoeba histolytica
IQHHKTWSILLPVAQQWKVLMKKVT

SEQ ID NO: 2595133 - protein, 25 aa, Entamoeba histolytica
IQKKTLDLFLLFIKEYISLFSSMNW

SEQ ID NO: 2595134 - protein, 18 aa, Entamoeba histolytica
IQKMGMVMIFIYSIVFRY

SEQ ID NO: 2595135 - protein, 40 aa, Entamoeba histolytica
IQLEWWIYIIICNGIILLFIMFIIIVILLSHYLFKSKRKD

SEQ ID NO: 2595136 - protein, 29 aa, Entamoeba histolytica
IQLSLVCTLFLYFIPYIRCLAIFSPLCIF

SEQ ID NO: 2595137 - protein, 26 aa, Entamoeba histolytica
IQNDWSCLFVLWLSIAIQFKINNNHH

SEQ ID NO: 2595138 - protein, 26 aa, Entamoeba histolytica
IQNIHNNIHLIAETLTEPAPANSQSA

SEQ ID NO: 2595139 - protein, 17 aa, Entamoeba histolytica
IQNMKKGIKIRSNEMVS

SEQ ID NO: 2595140 - protein, 17 aa, Entamoeba histolytica
IQNVIAPKYAYNFWICC

SEQ ID NO: 2595141 - protein, 18 aa, Entamoeba histolytica
IQQGLFDLFIQTLQTFKN

SEQ ID NO: 2595142 - protein, 23 aa, Entamoeba histolytica
IQSKGAFLLYKGRDAVVTTCNSM

SEQ ID NO: 2595143 - protein, 26 aa, Entamoeba histolytica
IQSYIQKYILVSLKYQTTIPFDKLTL

SEQ ID NO: 2595144 - protein, 17 aa, Entamoeba histolytica
IQTKLLYLGIDNLASSA

SEQ ID NO: 2595145 - protein, 26 aa, Entamoeba histolytica
IQTMIFNAFVFCQIFNEINSRKVNGE

SEQ ID NO: 2595146 - protein, 25 aa, Entamoeba histolytica
IQVDNVILPPWAKGSYRKFVRTNMM

SEQ ID NO: 2595147 - protein, 31 aa, Entamoeba histolytica
IQWKIRMMHIFGPISFLIFSCLFSTITCIII

SEQ ID NO: 2595148 - protein, 22 aa, Entamoeba histolytica
IRALFHLLIVPYLLAIFGNPTK

SEQ ID NO: 2595149 - protein, 18 aa, Entamoeba histolytica
IRCPYIVNFIGSVATADT

SEQ ID NO: 2595150 - protein, 18 aa, Entamoeba histolytica
IRCPYIVNFIGSVTTPDT

SEQ ID NO: 2595151 - protein, 26 aa, Entamoeba histolytica
IRDANLFFAEFIRDLSLLWRHDEIAK

SEQ ID NO: 2595152 - protein, 26 aa, Entamoeba histolytica
IRDLLQLILIFWILLNEFFSFTEVMN

SEQ ID NO: 2595153 - protein, 24 aa, Entamoeba histolytica
IREETFKIVLNWIKLKGSTNQEEV

SEQ ID NO: 2595154 - protein, 23 aa, Entamoeba histolytica
IRGWKNFLFFAIGTLILIGGIVC

SEQ ID NO: 2595155 - protein, 27 aa, Entamoeba histolytica
IRHDLGFRRILFILSLTNGGVSYVQGM

SEQ ID NO: 2595156 - protein, 28 aa, Entamoeba histolytica
IRIASLLHSLLFYSKIYPTINTLLSDNM

SEQ ID NO: 2595157 - protein, 20 aa, Entamoeba histolytica
IRIDSSLFIFVSSPSVDVQN

SEQ ID NO: 2595158 - protein, 18 aa, Entamoeba histolytica
IRIEKSCVYYLNAKSDSY

SEQ ID NO: 2595159 - protein, 27 aa, Entamoeba histolytica
IRIETPQLLTYLYFTSLKDFDNTVWNV

SEQ ID NO: 2595160 - protein, 28 aa, Entamoeba histolytica
IRKSSKDFLILPYNLKLRMLYDTARGMS

SEQ ID NO: 2595161 - protein, 18 aa, Entamoeba histolytica
IRLYNAYVITYCNHYLID

SEQ ID NO: 2595162 - protein, 23 aa, Entamoeba histolytica
IRMKVWKLLLGYYTPRKREWEEI

SEQ ID NO: 2595163 - protein, 27 aa, Entamoeba histolytica
IRNPRLTAIINPKVPYYVFIHSRYASM

SEQ ID NO: 2595164 - protein, 21 aa, Entamoeba histolytica
IRNYIFDSFVFSTTGNDTNKI

SEQ ID NO: 2595165 - protein, 27 aa, Entamoeba histolytica
IRPYSKYVICWFGLDTLQLLNFSIKIR

SEQ ID NO: 2595166 - protein, 19 aa, Entamoeba histolytica
IRRDVWDLILKIQRNRCII

SEQ ID NO: 2595167 - protein, 17 aa, Entamoeba histolytica
IRRLHVFGEIFAENGFL

SEQ ID NO: 2595168 - protein, 19 aa, Entamoeba histolytica
IRSIAIFVIILILSFINKF

SEQ ID NO: 2595169 - protein, 18 aa, Entamoeba histolytica
IRSLFVHKLYNYGNDYGF

SEQ ID NO: 2595170 - protein, 28 aa, Entamoeba histolytica
IRSSRNTHLFFLKPLIPIQLTEIFIQQA

SEQ ID NO: 2595171 - protein, 28 aa, Entamoeba histolytica
IRVILPIYAIIFLFVLVVRYIIQMDVII

SEQ ID NO: 2595172 - protein, 17 aa, Entamoeba histolytica
ISAILINGLAFPSIFFV

SEQ ID NO: 2595173 - protein, 30 aa, Entamoeba histolytica
ISCIPIAILVLLWVLKSLSLMIIPLCTIIT

SEQ ID NO: 2595174 - protein, 18 aa, Entamoeba histolytica
ISCTDICRYLFFNEETGD

SEQ ID NO: 2595175 - protein, 25 aa, Entamoeba histolytica
ISDCYIIILSFDRWRSVLSHWKYYL

SEQ ID NO: 2595176 - protein, 26 aa, Entamoeba histolytica
ISDEMILFVQLIRYISNLPKMYIIYT

SEQ ID NO: 2595177 - protein, 31 aa, Entamoeba histolytica
ISDIIGHILFFLLLVYYKFEPNQLVISEQAI

SEQ ID NO: 2595178 - protein, 22 aa, Entamoeba histolytica
ISDLMIRFFLILFTHQPDDFID

SEQ ID NO: 2595179 - protein, 24 aa, Entamoeba histolytica
ISDPFGSIFIQPYKGFISVCIEWG

SEQ ID NO: 2595180 - protein, 26 aa, Entamoeba histolytica
ISDSTPIYLKFTNSYLRVIPNKCFQI

SEQ ID NO: 2595181 - protein, 22 aa, Entamoeba histolytica
ISDVMISFYLYCGWMDQLTEKL

SEQ ID NO: 2595182 - protein, 24 aa, Entamoeba histolytica
ISDYPFFHMATVPSLLMSSSDSCQ

SEQ ID NO: 2595183 - protein, 36 aa, Entamoeba histolytica
ISEFIIFIIMTIVGILLIIFLFKFFEYSIQMSKNYS

SEQ ID NO: 2595184 - protein, 23 aa, Entamoeba histolytica
ISEFIILILIIRISAVTGISEDS

SEQ ID NO: 2595185 - protein, 24 aa, Entamoeba histolytica
ISFCISEIIPWWLLCCHDSVKEIS

SEQ ID NO: 2595186 - protein, 23 aa, Entamoeba histolytica
ISFFSLIFLVQSTTYEIFIESWS

SEQ ID NO: 2595187 - protein, 27 aa, Entamoeba histolytica
ISFIPMKAFIYHRRSNFLEIINIQYSS

SEQ ID NO: 2595188 - protein, 17 aa, Entamoeba histolytica
ISFISFEASLMIEANES

SEQ ID NO: 2595189 - protein, 23 aa, Entamoeba histolytica
ISFLIEVIKPFKYEFPIISVLTN

SEQ ID NO: 2595190 - protein, 20 aa, Entamoeba histolytica
ISFLWIFNCVKAQDETGCFC

SEQ ID NO: 2595191 - protein, 23 aa, Entamoeba histolytica
ISFNIFNVIWKRFLNKNYGITIN

SEQ ID NO: 2595192 - protein, 29 aa, Entamoeba histolytica
ISFPNLFNSIPFIYLYFSIDGINSIQFEV

SEQ ID NO: 2595193 - protein, 29 aa, Entamoeba histolytica
ISFREDAPLLWKGIIFEPRFGITIIQIAS

SEQ ID NO: 2595194 - protein, 38 aa, Entamoeba histolytica
ISFTIFSIILPFILPYCYFSFIIVLVETIILWSVIIAQ

SEQ ID NO: 2595195 - protein, 29 aa, Entamoeba histolytica
ISGHFFTAIFFFALFVHLLRKLTFQPKHS

SEQ ID NO: 2595196 - protein, 26 aa, Entamoeba histolytica
ISIFISVIVFCCLLALIIGLAVGLSK

SEQ ID NO: 2595197 - protein, 22 aa, Entamoeba histolytica
ISIHLFMLFIMVTITVCGGILS

SEQ ID NO: 2595198 - protein, 18 aa, Entamoeba histolytica
ISILLGVICGLFAVLFVM

SEQ ID NO: 2595199 - protein, 33 aa, Entamoeba histolytica; identical to SEQ ID NO: 2398287

SEQ ID NO: 2595200 - protein, 28 aa, Entamoeba histolytica
ISISLNFGLINLGLVSVAITFLMGSALQ

SEQ ID NO: 2595201 - protein, 25 aa, Entamoeba histolytica
ISISLPITVIFLFAKKRNSTYYFIT

SEQ ID NO: 2595202 - protein, 20 aa, Entamoeba histolytica
ISIVFFLRRGQTFWQTLVSI

SEQ ID NO: 2595203 - protein, 47 aa, Entamoeba histolytica
ISKALNNFFFWGIGSIVYILYFIFVMILFLILHIRLTRKIKQDIDDE

SEQ ID NO: 2595204 - protein, 26 aa, Entamoeba histolytica
ISKEYLALALFYFQKSEFITSFGEMT

SEQ ID NO: 2595205 - protein, 33 aa, Entamoeba histolytica
ISKIPLPPRAAVVLYYSYLGHSLEIISPVLAML

SEQ ID NO: 2595206 - protein, 37 aa, Entamoeba histolytica
ISKLGKLYVFNRYICFWPQLLKFNADVWKFEDISGIK

SEQ ID NO: 2595207 - protein, 38 aa, Entamoeba histolytica
ISKLKNWLLLLFDASYYKIIIWILFTICGGTCAFLFTK

SEQ ID NO: 2595208 - protein, 28 aa, Entamoeba histolytica
ISLDMDFTFLLIFYSLKSRKPTNYIKMN

SEQ ID NO: 2595209 - protein, 24 aa, Entamoeba histolytica
ISLGFFQLLLWKYYPEEPTARIWG

SEQ ID NO: 2595210 - protein, 19 aa, Entamoeba histolytica
ISLHWRPSLYKLGKISSLL

SEQ ID NO: 2595211 - protein, 25 aa, Entamoeba histolytica
ISLIIFFNYFIFSIRWYCGRYLLDP

SEQ ID NO: 2595212 - protein, 19 aa, Entamoeba histolytica
ISLIISIGMPWLVFEVLYP

SEQ ID NO: 2595213 - protein, 26 aa, Entamoeba histolytica
ISLLFIIIGFFFPLVWIINYVLFSNS

SEQ ID NO: 2595214 - protein, 32 aa, Entamoeba histolytica
ISLSNFLHTSIMPPFISFIIKLIGSHRSLYQS

SEQ ID NO: 2595215 - protein, 22 aa, Entamoeba histolytica
ISMLHSFHFIYRQLNPSSILVA

SEQ ID NO: 2595216 - protein, 19 aa, Entamoeba histolytica
ISNGYYFLDKLTECLDKFD

SEQ ID NO: 2595217 - protein, 25 aa, Entamoeba histolytica
ISNQEIMYILEHLQPPLNKTLVEKI

SEQ ID NO: 2595218 - protein, 24 aa, Entamoeba histolytica
ISNTKQMYLLPQSLTDPFNESIPI

SEQ ID NO: 2595219 - protein, 26 aa, Entamoeba histolytica
ISPEAPPLFLFFKCSDNIALDEARKQ

SEQ ID NO: 2595220 - protein, 28 aa, Entamoeba histolytica
ISPSLIALLILYMFQFNNILNQLIQSSV

SEQ ID NO: 2595221 - protein, 27 aa, Entamoeba histolytica
ISQIAMLMFPLMLQFIVAWVKEDEPKK

SEQ ID NO: 2595222 - protein, 25 aa, Entamoeba histolytica
ISRDFLQWFVLYTINQSINIIFIVL

SEQ ID NO: 2595223 - protein, 24 aa, Entamoeba histolytica
ISRKPLLTYMLLKLDCPIKEEQLA

SEQ ID NO: 2595224 - protein, 17 aa, Entamoeba histolytica
ISRYKYIDLCVLRNKFP

SEQ ID NO: 2595225 - protein, 26 aa, Entamoeba histolytica
ISSIPAFIYFFQNILCQVSLANIQPG

SEQ ID NO: 2595226 - protein, 21 aa, Entamoeba histolytica
ISSMWLFFRFFKKYKEELTNG

SEQ ID NO: 2595227 - protein, 28 aa, Entamoeba histolytica
ISSQTLLLLVLFFLAIEELINQNLSQFQ

SEQ ID NO: 2595228 - protein, 18 aa, Entamoeba histolytica
ISSSIPLILSPISTPKVK

SEQ ID NO: 2595229 - protein, 25 aa, Entamoeba histolytica
ISSTLSIPSFYFSYTYDLTRSYQTQ

SEQ ID NO: 2595230 - protein, 25 aa, Entamoeba histolytica
ISTIVLFYLQPFISLNIRGIDNPYH

SEQ ID NO: 2595231 - protein, 18 aa, Entamoeba histolytica
ISVFPYVTDLLTCILSIN

SEQ ID NO: 2595232 - protein, 26 aa, Entamoeba histolytica
ISVLFLVFTFFLIFVSYQSLKTKPQK

SEQ ID NO: 2595233 - protein, 18 aa, Entamoeba histolytica
ISVLGGGYSLYHKFWTER

SEQ ID NO: 2595234 - protein, 24 aa, Entamoeba histolytica
ISVSLMFWILYFKSPSTVFRATDE

SEQ ID NO: 2595235 - protein, 19 aa, Entamoeba histolytica
ISYCLIGYCLAQTKYICQV

SEQ ID NO: 2595236 - protein, 28 aa, Entamoeba histolytica
ISYRDMFRFVIFFIKQKLGKIDAKETFM

SEQ ID NO: 2595237 - protein, 30 aa, Entamoeba histolytica
ITALFILLSYLIYHFIYSNMPRLSDSSLIE

SEQ ID NO: 2595238 - protein, 18 aa, Entamoeba histolytica
ITAYPKELSLTNPEIKIL

SEQ ID NO: 2595239 - protein, 20 aa, Entamoeba histolytica
ITCADGYFMSWIGECKSIDE

SEQ ID NO: 2595240 - protein, 41 aa, Entamoeba histolytica
ITCIIIAIIFPSMYFLMGITILLSIILWIFVLINKTEVMNF

SEQ ID NO: 2595241 - protein, 18 aa, Entamoeba histolytica
ITCSLFYLLIAVCGDLSF

SEQ ID NO: 2595242 - protein, 17 aa, Entamoeba histolytica
ITCVDGYFMSWIGECKL

SEQ ID NO: 2595243 - protein, 19 aa, Entamoeba histolytica
ITCWLALFQNGTGIPYLQF

SEQ ID NO: 2595244 - protein, 22 aa, Entamoeba histolytica
ITDCFFLFITLVAGTGIYAAVL

SEQ ID NO: 2595245 - protein, 23 aa, Entamoeba histolytica
ITDFWKIQHFFDKRLPALRDSAR

SEQ ID NO: 2595246 - protein, 24 aa, Entamoeba histolytica
ITENIDIDLPLLPVSWNCFNPKFR

SEQ ID NO: 2595247 - protein, 19 aa, Entamoeba histolytica
ITETYFILKTLFERMYCVI

SEQ ID NO: 2595248 - protein, 18 aa, Entamoeba histolytica
ITFCGIIMAVAFSGLFLA

SEQ ID NO: 2595249 - protein, 18 aa, Entamoeba histolytica
ITFHILDFKATFVNNGDS

SEQ ID NO: 2595250 - protein, 22 aa, Entamoeba histolytica
ITFNNMFLYPINDLNFTKCPLG

SEQ ID NO: 2595251 - protein, 20 aa, Entamoeba histolytica
ITFSIIFLGLPIYYIAKTYP

SEQ ID NO: 2595252 - protein, 19 aa, Entamoeba histolytica
ITFSSYFIDPFWETPVFAN

SEQ ID NO: 2595253 - protein, 18 aa, Entamoeba histolytica
ITGFSIIIFLHLCFDVLT

SEQ ID NO: 2595254 - protein, 29 aa, Entamoeba histolytica
ITGKLELAPIALPLLINILSSFHCCQNQQ

SEQ ID NO: 2595255 - protein, 23 aa, Entamoeba histolytica
ITGYLIGFIKCWDLTLVVLCMFP

SEQ ID NO: 2595256 - protein, 26 aa, Entamoeba histolytica
ITHDPRILLLYTKTTSLPKMLFISEI

SEQ ID NO: 2595257 - protein, 28 aa, Entamoeba histolytica
ITIELIIIYILLMLSWIAYYPASFNMTI

SEQ ID NO: 2595258 - protein, 21 aa, Entamoeba histolytica
ITIIIAILSFTLICMTIFCFK

SEQ ID NO: 2595259 - protein, 24 aa, Entamoeba histolytica
ITKASIYLVIFALVIAAIFVAFYI

SEQ ID NO: 2595260 - protein, 37 aa, Entamoeba histolytica
ITKASIYLVILVLVIVVIFVAFYIFTSKPVIEIQRLE

SEQ ID NO: 2595261 - protein, 27 aa, Entamoeba histolytica
ITKEIARKLIVFGFNDISKIAHASFLD

SEQ ID NO: 2595262 - protein, 19 aa, Entamoeba histolytica
ITKFLQHKFYQIEGYDIFP

SEQ ID NO: 2595263 - protein, 22 aa, Entamoeba histolytica
ITKHVFIPPSLYYDIDTPLEMM

SEQ ID NO: 2595264 - protein, 25 aa, Entamoeba histolytica
ITKNIIFDTILTDSIYITSSAMLTL

SEQ ID NO: 2595265 - protein, 17 aa, Entamoeba histolytica
ITKQRIRWKKQFELPVQ

SEQ ID NO: 2595266 - protein, 27 aa, Entamoeba histolytica
ITLAPMQVKFLWLCLCNIPSSSSLLEI

SEQ ID NO: 2595267 - protein, 28 aa, Entamoeba histolytica
ITLINSFPFILKFIYELLNPPKHMTVGH

SEQ ID NO: 2595268 - protein, 17 aa, Entamoeba histolytica
ITLLNITDKYKVAVWDT

SEQ ID NO: 2595269 - protein, 18 aa, Entamoeba histolytica
ITLLNMFINLLWQKSSGI

SEQ ID NO: 2595270 - protein, 33 aa, Entamoeba histolytica
ITLPTGLNDLTLNGLFTITKIPLDLTIEDGNVI

SEQ ID NO: 2595271 - protein, 32 aa, Entamoeba histolytica
ITLPTGLNDLTLNGLFTVTKIPLDLTIEDGNV

SEQ ID NO: 2595272 - protein, 17 aa, Entamoeba histolytica
ITLSFGRKCYYYIPYQS

SEQ ID NO: 2595273 - protein, 19 aa, Entamoeba histolytica
ITLSIVCVGLFFILGIAGM

SEQ ID NO: 2595274 - protein, 18 aa, Entamoeba histolytica
ITLSKLRNPFIVNFIGSV

SEQ ID NO: 2595275 - protein, 21 aa, Entamoeba histolytica
ITLTSLYVWVYVMIGWCLFVM

SEQ ID NO: 2595276 - protein, 19 aa, Entamoeba histolytica
ITLVIYYFPSLSEGLIFII

SEQ ID NO: 2595277 - protein, 17 aa, Entamoeba histolytica
ITMLYIELVSFVPFICC

SEQ ID NO: 2595278 - protein, 27 aa, Entamoeba histolytica
ITMNCWDIFLLLSSKSFIILRRNNEMI

SEQ ID NO: 2595279 - protein, 27 aa, Entamoeba histolytica
ITNICILFILYYFSFHGMYILLTIINC

SEQ ID NO: 2595280 - protein, 18 aa, Entamoeba histolytica
ITNSLQILTIILIIMLWF

SEQ ID NO: 2595281 - protein, 25 aa, Entamoeba histolytica
ITNTHICLLIILYQTIQVYCHTVSE

SEQ ID NO: 2595282 - protein, 39 aa, Entamoeba histolytica
ITPATLFMFFGLILIGLILCRLCFPLLFNRGSNIIITLL

SEQ ID NO: 2595283 - protein, 24 aa, Entamoeba histolytica
ITPHLISLVHANIYFAEFMRSMLY

SEQ ID NO: 2595284 - protein, 25 aa, Entamoeba histolytica
ITPLRYFVCFVLSNLPIIYLLYYVI

SEQ ID NO: 2595285 - protein, 28 aa, Entamoeba histolytica
ITPYHNNLLQLLMYFYDISIDLDVIEHQ

SEQ ID NO: 2595286 - protein, 42 aa, Entamoeba histolytica
ITQIVYFMTIIVLPILHMISLFVLWFAPLQRRFQSFLYHCCE

SEQ ID NO: 2595287 - protein, 23 aa, Entamoeba histolytica
ITRGSYFKVQIPDVAYTVTVRTC

SEQ ID NO: 2595288 - protein, 18 aa, Entamoeba histolytica
ITRYPLFIQTLISGISQE

SEQ ID NO: 2595289 - protein, 26 aa, Entamoeba histolytica
ITSKPYFIPHFGLLPTLNLLSIESLK

SEQ ID NO: 2595290 - protein, 17 aa, Entamoeba histolytica
ITSLYIYHKECSIKTLR

SEQ ID NO: 2595291 - protein, 33 aa, Entamoeba histolytica
ITSSVFGLLTLLYPFIWQGVLIPFVPVQLQEFL

SEQ ID NO: 2595292 - protein, 26 aa, Entamoeba histolytica
ITTGLNCIIFLLFQFKKLHIECRLIS

SEQ ID NO: 2595293 - protein, 31 aa, Entamoeba histolytica; identical to SEQ ID NO: 2398396

SEQ ID NO: 2595294 - protein, 30 aa, Entamoeba histolytica
ITVHSKTPMWLILLIAFLSFDNIVYVFKSP

SEQ ID NO: 2595295 - protein, 22 aa, Entamoeba histolytica
ITVIKVIFNQTFFLPTSIEEIN

SEQ ID NO: 2595296 - protein, 33 aa, Entamoeba histolytica
ITVIPGIIFLWKVIIKPLLFPTNTKKYKGEKTY

SEQ ID NO: 2595297 - protein, 25 aa, Entamoeba histolytica
ITVITIYSISFWYPSGIISYDGLFS

SEQ ID NO: 2595298 - protein, 21 aa, Entamoeba histolytica
ITWERMVLMGHSLGGGVSISF

SEQ ID NO: 2595299 - protein, 24 aa, Entamoeba histolytica
ITWLIFYIVAIYLFNKPRLLVYLN

SEQ ID NO: 2595300 - protein, 32 aa, Entamoeba histolytica
IVAGIFIIGVWIWYLRRPYPVYLVSFATSIPD

SEQ ID NO: 2595301 - protein, 31 aa, Entamoeba histolytica
IVAIKGTFPFIWIFLVFASICYWASNQFAPN

SEQ ID NO: 2595302 - protein, 25 aa, Entamoeba histolytica
IVDSLVLLGLDMKKGKQYESRIGIS

SEQ ID NO: 2595303 - protein, 23 aa, Entamoeba histolytica
IVDWTIPIFQFPLSGIITFVIGG

SEQ ID NO: 2595304 - protein, 19 aa, Entamoeba histolytica
IVEILDHFLYCNHLCIVTE

SEQ ID NO: 2595305 - protein, 22 aa, Entamoeba histolytica
IVEQKPKYSILLPGIESKEQAK

SEQ ID NO: 2595306 - protein, 19 aa, Entamoeba histolytica
IVFIAPFSVSVPEAIEIGC

SEQ ID NO: 2595307 - protein, 19 aa, Entamoeba histolytica
IVFLLEFISSLLFLWCICI

SEQ ID NO: 2595308 - protein, 28 aa, Entamoeba histolytica
IVFMPIYIVLFCTLIFKCISLAPSITLP

SEQ ID NO: 2595309 - protein, 25 aa, Entamoeba histolytica
IVFPLIVVFLMFFLGIETLILEIWQ

SEQ ID NO: 2595310 - protein, 27 aa, Entamoeba histolytica
IVFSTHSMFIAFSLLYIGAAAETKTQL

SEQ ID NO: 2595311 - protein, 25 aa, Entamoeba histolytica
IVGGAVFPIFTIKFIDLIVMMMELQ

SEQ ID NO: 2595312 - protein, 31 aa, Entamoeba histolytica
IVGGCGIIILIMLISIFYFVFRTKKRVSISV

SEQ ID NO: 2595313 - protein, 34 aa, Entamoeba histolytica
IVGGIILLLAIIIILCSILILVFARNSYTRLSDI

SEQ ID NO: 2595314 - protein, 22 aa, Entamoeba histolytica
IVGQFFCYIQLKEYQNAIKSLI

SEQ ID NO: 2595315 - protein, 29 aa, Entamoeba histolytica
IVHNFHFETLPSIFWSLLNSGNNKRLLCR

SEQ ID NO: 2595316 - protein, 28 aa, Entamoeba histolytica
IVICFKYFPIIIIVLFVLLVIVTAISFQ

SEQ ID NO: 2595317 - protein, 17 aa, Entamoeba histolytica
IVIIIDYVIGQTNSTSE

SEQ ID NO: 2595318 - protein, 19 aa, Entamoeba histolytica
IVITLFAYCQGAIIVDYGY

SEQ ID NO: 2595319 - protein, 22 aa, Entamoeba histolytica
IVIVIPLIYKKVGYFNFNWTIT

SEQ ID NO: 2595320 - protein, 44 aa, Entamoeba histolytica
IVIVTFVFVLLFYYRCMKLIVGWLLFSVILLLMLFGGSIMKSLL

SEQ ID NO: 2595321 - protein, 27 aa, Entamoeba histolytica
IVKDFIQFYYVRLFGTVFGDYLNGKSF

SEQ ID NO: 2595322 - protein, 27 aa, Entamoeba histolytica
IVKFIDSLIFNPLKVSLFGRNLKTIII

SEQ ID NO: 2595323 - protein, 31 aa, Entamoeba histolytica
IVKQGFEYYIVITTPYLLIFESELKLNKMEY

SEQ ID NO: 2595324 - protein, 25 aa, Entamoeba histolytica
IVLFWVFVLVWRKKKLITFIVYCCL

SEQ ID NO: 2595325 - protein, 17 aa, Entamoeba histolytica
IVLKVIRQCLNVEIIGK

SEQ ID NO: 2595326 - protein, 17 aa, Entamoeba histolytica
IVLTPSCIHLLLLALKD

SEQ ID NO: 2595327 - protein, 18 aa, Entamoeba histolytica
IVLYLLFSHLYLLKYHFV

SEQ ID NO: 2595328 - protein, 26 aa, Entamoeba histolytica
IVMLKHYELLLPLYFDYHFTVTKAMK

SEQ ID NO: 2595329 - protein, 25 aa, Entamoeba histolytica
IVMRAQDLILRLFNKLSSEEKQYFK

SEQ ID NO: 2595330 - protein, 17 aa, Entamoeba histolytica
IVMYFLLGIWYFMYMID

SEQ ID NO: 2595331 - protein, 18 aa, Entamoeba histolytica
IVNAFRKRKGFDPKVFLV

SEQ ID NO: 2595332 - protein, 29 aa, Entamoeba histolytica
IVNAFWHGFYPGYLLFFFCCGIPYEFCSK

SEQ ID NO: 2595333 - protein, 31 aa, Entamoeba histolytica
IVQTVYQLGIMLPIVFAGKYIPFLNSPCGFV

SEQ ID NO: 2595334 - protein, 58 aa, Entamoeba histolytica
IVRYPLHILPPLKSIPLRTIVWILFYAPLKFFYLAIQLLYLLLFKLPNYSHILIQNPP

SEQ ID NO: 2595335 - protein, 18 aa, Entamoeba histolytica
IVSFFFALFSSKQIVPHQ

SEQ ID NO: 2595336 - protein, 23 aa, Entamoeba histolytica
IVSIILLFLFLLLGGLTLDGFIS

SEQ ID NO: 2595337 - protein, 26 aa, Entamoeba histolytica
IVSIILYTLFIKIPFKYQSLTNMIMI

SEQ ID NO: 2595338 - protein, 25 aa, Entamoeba histolytica
IVSVIALILFIIYSLTVFSSELLLP

SEQ ID NO: 2595339 - protein, 20 aa, Entamoeba histolytica
IVSWLLFIGALLTSTGLLLN

SEQ ID NO: 2595340 - protein, 19 aa, Entamoeba histolytica
IVSYEVFLRKIPYGNGCFV

SEQ ID NO: 2595341 - protein, 17 aa, Entamoeba histolytica
IVTFILFIDIISCIASA

SEQ ID NO: 2595342 - protein, 22 aa, Entamoeba histolytica
IVTICHSFSILSTLRGYIPITE

SEQ ID NO: 2595343 - protein, 26 aa, Entamoeba histolytica
IVTMEEWFWELINLGWNQNPKERITM

SEQ ID NO: 2595344 - protein, 25 aa, Entamoeba histolytica
IVTQFSNVFIILRPHQYGIVIEIYR

SEQ ID NO: 2595345 - protein, 25 aa, Entamoeba histolytica
IVTSILIDYTFDYCFEFIISSSTIS

SEQ ID NO: 2595346 - protein, 27 aa, Entamoeba histolytica
IVVASPQIFQLFYLAVQKFTLPDDLNS

SEQ ID NO: 2595347 - protein, 23 aa, Entamoeba histolytica
IVVFILICLVIAYYLFISYQQFN

SEQ ID NO: 2595348 - protein, 27 aa, Entamoeba histolytica
IVVFTILCIYWVIDAINYKPILVCDND

SEQ ID NO: 2595349 - protein, 21 aa, Entamoeba histolytica
IVVLFIALCIMLPIIICMKDF

SEQ ID NO: 2595350 - protein, 18 aa, Entamoeba histolytica
IVVMLLMFDPIVAIMIVL

SEQ ID NO: 2595351 - protein, 21 aa, Entamoeba histolytica
IVVVLGIIWFAIGIVYVALSL

SEQ ID NO: 2595352 - protein, 20 aa, Entamoeba histolytica
IWNICRLEDYHVVSSIIRTC

SEQ ID NO: 2595353 - protein, 28 aa, Entamoeba histolytica
IWPYTKLVILLFTWFMPSTLVVPKVRGI

SEQ ID NO: 2595354 - protein, 27 aa, Entamoeba histolytica
IYDETMAKLLLRLLAYFHEHVSETDQI

SEQ ID NO: 2595355 - protein, 26 aa, Entamoeba histolytica
IYDYANPIILPFSQFFRYSQTLVSST

SEQ ID NO: 2595356 - protein, 17 aa, Entamoeba histolytica
IYECKYIDNKLSNVIVY

SEQ ID NO: 2595357 - protein, 20 aa, Entamoeba histolytica
IYEIIKRLMKIRLSPYIVIT

SEQ ID NO: 2595358 - protein, 18 aa, Entamoeba histolytica
IYEMFRVFRIIDLTKENK

SEQ ID NO: 2595359 - protein, 23 aa, Entamoeba histolytica
IYFIIFVIILQLSAIYLYGTGFL

SEQ ID NO: 2595360 - protein, 22 aa, Entamoeba histolytica
IYFTTQLVQCQIEIAQNAMFFS

SEQ ID NO: 2595361 - protein, 27 aa, Entamoeba histolytica
IYFVQPFLKSYLFWTSQTLLYCGLTYT

SEQ ID NO: 2595362 - protein, 19 aa, Entamoeba histolytica
IYGKWFKLNMNFSGYISIE

SEQ ID NO: 2595363 - protein, 18 aa, Entamoeba histolytica
IYGLIYGLTIYFSCKPFI

SEQ ID NO: 2595364 - protein, 18 aa, Entamoeba histolytica
IYGPFINIPPSVTSSLLS

SEQ ID NO: 2595365 - protein, 23 aa, Entamoeba histolytica
IYHGKFVFPYDYPKNPPEVYFFT

SEQ ID NO: 2595366 - protein, 23 aa, Entamoeba histolytica
IYIGCIVAFLLFKLYHNYILTIY

SEQ ID NO: 2595367 - protein, 34 aa, Entamoeba histolytica
IYINMGKWVYVPLIVFIAFLLLNIGFGFLNGKLF

SEQ ID NO: 2595368 - protein, 26 aa, Entamoeba histolytica
IYIPEDYVILIISMLCDIIIKKEVES

SEQ ID NO: 2595369 - protein, 21 aa, Entamoeba histolytica
IYKFISPYYFPKEIKTLFDTI

SEQ ID NO: 2595370 - protein, 18 aa, Entamoeba histolytica
IYKLVIFEGYQPYYLEEF

SEQ ID NO: 2595371 - protein, 26 aa, Entamoeba histolytica
IYLVAFLILLIVTLIIVSLSAFFQSQ

SEQ ID NO: 2595372 - protein, 22 aa, Entamoeba histolytica
IYLYVYPAYGFVTLMLRTIASV

SEQ ID NO: 2595373 - protein, 21 aa, Entamoeba histolytica
IYNCFGKCELNFTSASRYGLN

SEQ ID NO: 2595374 - protein, 24 aa, Entamoeba histolytica
IYNNDSIVHLLNPNLPFGGNCQSG

SEQ ID NO: 2595375 - protein, 38 aa, Entamoeba histolytica
IYPITKFIKWAYKLPTMSFPIDFKPLFMFDIESIKPTK

SEQ ID NO: 2595376 - protein, 18 aa, Entamoeba histolytica
IYRDIFNLYIVKLQEFSH

SEQ ID NO: 2595377 - protein, 30 aa, Entamoeba histolytica
IYSFAITMYEVWNWKIVYQDKSRFRYPWDI

SEQ ID NO: 2595378 - protein, 33 aa, Entamoeba histolytica
IYSFAVTMLQIITWQDPFPKSEFRFPWSIANAT

SEQ ID NO: 2595379 - protein, 42 aa, Entamoeba histolytica
IYSFGMIMFETVHWEPPFPKKLFPYEWTIARFVTEGKRPSFK

SEQ ID NO: 2595380 - protein, 18 aa, Entamoeba histolytica
IYSKFEYLINCEEKGITS

SEQ ID NO: 2595381 - protein, 25 aa, Entamoeba histolytica
IYSLGEDLILLKPYNAKSIFYSLIQ

SEQ ID NO: 2595382 - protein, 26 aa, Entamoeba histolytica
IYSLGMLYIIIHMQFIPSKKQYISWV

SEQ ID NO: 2595383 - protein, 30 aa, Entamoeba histolytica
IYSQLITFPLFLFFAFIHFHSIPYHNVIPV

SEQ ID NO: 2595384 - protein, 23 aa, Entamoeba histolytica
IYSTLVCFLIFLGLSCGEIQKPL

SEQ ID NO: 2595385 - protein, 23 aa, Entamoeba histolytica
IYVETVGLLFQFLTNIPYTIYHS

SEQ ID NO: 2595386 - protein, 24 aa, Entamoeba histolytica
IYYSTVQFGFIVVIFYDIRSSRSA

SEQ ID NO: 2595387 - protein, 23 aa, Entamoeba histolytica
KHHLIQLVLMMDVVLELILKIIK

SEQ ID NO: 2595388 - protein, 24 aa, Entamoeba histolytica
KQHLIQLVLMMDVVLELILKIIKK

SEQ ID NO: 2595389 - protein, 24 aa, Entamoeba histolytica
KAATKCVPALLRVFFQAVSVRYNS

SEQ ID NO: 2595390 - protein, 28 aa, Entamoeba histolytica
KACLTIFYLFKVVYWIISGLQIRAGYNI

SEQ ID NO: 2595391 - protein, 28 aa, Entamoeba histolytica
KADNQTLTDFYLFFSIVAEQQPIDLSKV

SEQ ID NO: 2595392 - protein, 30 aa, Entamoeba histolytica
KAEEVFKIIFRLAPNHCFAHYLRGVLFQQI

SEQ ID NO: 2595393 - protein, 17 aa, Entamoeba histolytica
KAMIAITSLLIPIILDV

SEQ ID NO: 2595394 - protein, 31 aa, Entamoeba histolytica
KANYFTPNYVLYLPYYLLGSQVTLRIITTSI

SEQ ID NO: 2595395 - protein, 25 aa, Entamoeba histolytica
KAPKHIYDFLITELNWEEFIDQLSK

SEQ ID NO: 2595396 - protein, 28 aa, Entamoeba histolytica
KAQTLICAYLMRIKLPKYLKHTLYSMLP

SEQ ID NO: 2595397 - protein, 25 aa, Entamoeba histolytica
KARISTPIDLFNLLEVLYSSDPIAS

SEQ ID NO: 2595398 - protein, 19 aa, Entamoeba histolytica
KARVSNNMFLSDKINFIRT

SEQ ID NO: 2595399 - protein, 21 aa, Entamoeba histolytica
KATQMSWALKIDRLREAFSNG

SEQ ID NO: 2595400 - protein, 26 aa, Entamoeba histolytica
KCETNPYCILFDGSCNRCIKCKPSYG

SEQ ID NO: 2595401 - protein, 26 aa, Entamoeba histolytica
KCIETPFIYDYPKSIPLKQNIFIILY

SEQ ID NO: 2595402 - protein, 17 aa, Entamoeba histolytica
KCIKCKNGYYLNSKHEC

SEQ ID NO: 2595403 - protein, 17 aa, Entamoeba histolytica
KCITCVDGYFMSWIGEC

SEQ ID NO: 2595404 - protein, 23 aa, Entamoeba histolytica
KCLDVLDYKLIIGTTFDEYKCEW

SEQ ID NO: 2595405 - protein, 20 aa, Entamoeba histolytica
KCLWDCLPEKKLNICDVENS

SEQ ID NO: 2595406 - protein, 17 aa, Entamoeba histolytica
KCMCFYPQAVLEESIHI

SEQ ID NO: 2595407 - protein, 24 aa, Entamoeba histolytica
KCMIFFVIFTICLCLLYFCDWKVH

SEQ ID NO: 2595408 - protein, 24 aa, Entamoeba histolytica
KCNYQLWRLITPIFLHGGIIHLLC

SEQ ID NO: 2595409 - protein, 29 aa, Entamoeba histolytica
KCPKMTFFIKYIRYLSYLNPYTYCHKNEE

SEQ ID NO: 2595410 - protein, 19 aa, Entamoeba histolytica
KCQDALDVQLPYTALHTFS

SEQ ID NO: 2595411 - protein, 22 aa, Entamoeba histolytica
KCTTLFNLKSIQSIAFSIKSTT

SEQ ID NO: 2595412 - protein, 51 aa, Entamoeba histolytica
KCVSSLNYGLIIGVPLICILIIIILSALLVYYFINLHFIHYFNKKQGVIPQ

SEQ ID NO: 2595413 - protein, 37 aa, Entamoeba histolytica
KCWDLTLVIMAVTPFMLITVLFLGFFATKFTAKGENS

SEQ ID NO: 2595414 - protein, 32 aa, Entamoeba histolytica
KCWDLTLVVLCMFPFIMVSMMGLGMSAGIFTM

SEQ ID NO: 2595415 - protein, 19 aa, Entamoeba histolytica
KCYFGFIPITINGTTKCSP

SEQ ID NO: 2595416 - protein, 17 aa, Entamoeba histolytica
KCYPNLPSNVLIASLRL

SEQ ID NO: 2595417 - protein, 21 aa, Entamoeba histolytica
KCYYFYVIIIEILCFIILIIT

SEQ ID NO: 2595418 - protein, 21 aa, Entamoeba histolytica
KDAHHKWFVYCFLDILIEINK

SEQ ID NO: 2595419 - protein, 28 aa, Entamoeba histolytica
KDASLALMAKKPLLFTSDIIVNKLTLSR

SEQ ID NO: 2595420 - protein, 24 aa, Entamoeba histolytica
KDCESLSKFLINYGIRATHYHAGL

SEQ ID NO: 2595421 - protein, 21 aa, Entamoeba histolytica
KDCSFVNLWKKFAPSLTHDKF

SEQ ID NO: 2595422 - protein, 23 aa, Entamoeba histolytica
KDETHYFIKVKLSIPKHCYGYLN

SEQ ID NO: 2595423 - protein, 27 aa, Entamoeba histolytica
KDFGAIAILFLPMTFIASLFGMNVTVP

SEQ ID NO: 2595424 - protein, 38 aa, Entamoeba histolytica
KDFHKMGGWFKVCIAILISILVLTVGVIIFGSFRESQL

SEQ ID NO: 2595425 - protein, 26 aa, Entamoeba histolytica
KDIEKWIEKTLYWYKIKEKEGAEEWK

SEQ ID NO: 2595426 - protein, 20 aa, Entamoeba histolytica
KDIYIITQFFILGSLSQFIQ

SEQ ID NO: 2595427 - protein, 24 aa, Entamoeba histolytica
KDKINIVYFVVLMVFALRELMVSV

SEQ ID NO: 2595428 - protein, 27 aa, Entamoeba histolytica
KDKIYIRAIIFFLLSVTFLIISILFVF

SEQ ID NO: 2595429 - protein, 25 aa, Entamoeba histolytica
KDMIPYWVLFILSFSPHDLNRTQEN

SEQ ID NO: 2595430 - protein, 17 aa, Entamoeba histolytica
KDMKIPYSIWFSKSKST

SEQ ID NO: 2595431 - protein, 22 aa, Entamoeba histolytica
KDPFDVIRRFADLFVPLKCPHA

SEQ ID NO: 2595432 - protein, 26 aa, Entamoeba histolytica
KDPKERVLIQSACKRLQFGEPGKSEI

SEQ ID NO: 2595433 - protein, 30 aa, Entamoeba histolytica; identical to SEQ ID NO: 2398548

SEQ ID NO: 2595434 - protein, 32 aa, Entamoeba histolytica
KDSFDYWSLIKNPMIIMALVSLGLIGFSKLSM

SEQ ID NO: 2595435 - protein, 17 aa, Entamoeba histolytica
KDSFLGWKYVDFNNSKF

SEQ ID NO: 2595436 - protein, 29 aa, Entamoeba histolytica
KDSLKRLFPFMQFFLLTGVLFLLTDEVFI

SEQ ID NO: 2595437 - protein, 22 aa, Entamoeba histolytica
KDSRFITTLLNIPGINPYAPDN

SEQ ID NO: 2595438 - protein, 43 aa, Entamoeba histolytica
KDTIIYLSSIIIFYIFFWTALLFIHLFIYTKLNKIITKELNEQ

SEQ ID NO: 2595439 - protein, 24 aa, Entamoeba histolytica
KDTPLLLVVGQWLTALFSINFDKC

SEQ ID NO: 2595440 - protein, 28 aa, Entamoeba histolytica
KDVGWENYFFPLPDYVASYSFLIEPTQE

SEQ ID NO: 2595441 - protein, 22 aa, Entamoeba histolytica
KDVPVFIFFGIYASADTDYFVK

SEQ ID NO: 2595442 - protein, 25 aa, Entamoeba histolytica
KDVQLKFLLEYILENSVISLSRSIA

SEQ ID NO: 2595443 - protein, 24 aa, Entamoeba histolytica
KDWDLTLVIMSMSPFIVLSMTLLA

SEQ ID NO: 2595444 - protein, 19 aa, Entamoeba histolytica
KDYIFEELFDKCKKLYIDE

SEQ ID NO: 2595445 - protein, 30 aa, Entamoeba histolytica
KDYISSISFCWWLLNGILSSITIFFISYVV

SEQ ID NO: 2595446 - protein, 31 aa, Entamoeba histolytica
KDYVTYIIMGILLCVLIITSLFVAFLADCRH

SEQ ID NO: 2595447 - protein, 47 aa, Entamoeba histolytica
KECKSSPVWWVIVLVIIGGIIFFIIFIVLIIFIVRKTIKRISIKHVI

SEQ ID NO: 2595448 - protein, 48 aa, Entamoeba histolytica
KECKSSPVWWVIVLVVIGGIILVVIFIIILLVFIRTVMTKITKYSQNK

SEQ ID NO: 2595449 - protein, 30 aa, Entamoeba histolytica
KEDFILPSITFILQTKLIISSSLIIQNNEN

SEQ ID NO: 2595450 - protein, 25 aa, Entamoeba histolytica
KEDGREFFIMRNSWYDGWGDGDNYL

SEQ ID NO: 2595451 - protein, 23 aa, Entamoeba histolytica
KEDVINIYCILDWFIENDQQKKK

SEQ ID NO: 2595452 - protein, 27 aa, Entamoeba histolytica
KEEKQIIINYMYWKNFIQAHYPEVTDF

SEQ ID NO: 2595453 - protein, 23 aa, Entamoeba histolytica
KEEYCIFINKLLQLLQIKKVIKN

SEQ ID NO: 2595454 - protein, 27 aa, Entamoeba histolytica
KEGDIIFLEAPLLYLITNEPIKFKHII

SEQ ID NO: 2595455 - protein, 24 aa, Entamoeba histolytica
KEGYKLISNVLLDIALYNEGTVIF

SEQ ID NO: 2595456 - protein, 19 aa, Entamoeba histolytica
KEHYKLPSDIYSFAITMYE

SEQ ID NO: 2595457 - protein, 23 aa, Entamoeba histolytica
KEHYQLIQLFIYALQNPYQLEQN

SEQ ID NO: 2595458 - protein, 26 aa, Entamoeba histolytica
KEIKEILIFIMNTFPKIEPTCIGYVG

SEQ ID NO: 2595459 - protein, 27 aa, Entamoeba histolytica
KEIKRNEFLPELLRLTEIFTGAEENIE

SEQ ID NO: 2595460 - protein, 17 aa, Entamoeba histolytica
KEILLSKNTLGISLTSA

SEQ ID NO: 2595461 - protein, 22 aa, Entamoeba histolytica
KEINLIPLAQEDIKCRGGPPLR

SEQ ID NO: 2595462 - protein, 39 aa, Entamoeba histolytica
KEIREKRFNGLRRAWLLSYSFAIVIVTMLVTFYNNVFHQ

SEQ ID NO: 2595463 - protein, 28 aa, Entamoeba histolytica
KEIVLSWFSFLPIDSYPDDILSFLFTIF

SEQ ID NO: 2595464 - protein, 25 aa, Entamoeba histolytica
KEIYDVLIKWGYFIQMPSVSPFIEQ

SEQ ID NO: 2595465 - protein, 17 aa, Entamoeba histolytica
KEKAEVAIPLIYNAKGF

SEQ ID NO: 2595466 - protein, 23 aa, Entamoeba histolytica
KEKERPYMFISGNSTILRVQEDY

SEQ ID NO: 2595467 - protein, 26 aa, Entamoeba histolytica
KEKNIQIRLFMKIKILIDAAKGISYL

SEQ ID NO: 2595468 - protein, 26 aa, Entamoeba histolytica
KELTKLRSPLLINIIGAVTTPEHECM

SEQ ID NO: 2595469 - protein, 23 aa, Entamoeba histolytica
KENIWWVSIIIVGGCGIIILIML

SEQ ID NO: 2595470 - protein, 71 aa, Entamoeba histolytica
KENPIWYKIRTLLGPPPFILFACLFSTFFIIVIPIIFRSFYFLISFFGTLTIVLWFAVALNWKDIKVFLKE

SEQ ID NO: 2595471 - protein, 17 aa, Entamoeba histolytica
KEQIIFIGICNGSLIRL

SEQ ID NO: 2595472 - protein, 28 aa, Entamoeba histolytica
KEQIMQPFFIFQVVCSILWMMDDMPIFA

SEQ ID NO: 2595473 - protein, 25 aa, Entamoeba histolytica
KERGIFITGGIIKIGEKGKIIMKGG

SEQ ID NO: 2595474 - protein, 29 aa, Entamoeba histolytica
KERLKYSWVIYSLLIKSIIGYLKDYKAFD

SEQ ID NO: 2595475 - protein, 39 aa, Entamoeba histolytica
KESCIPNVVWWIVLLEIITAILILIIIVSIVCVVTKVFI

SEQ ID NO: 2595476 - protein, 24 aa, Entamoeba histolytica
KESIYALFALLLHTNPVISELFTT

SEQ ID NO: 2595477 - protein, 27 aa, Entamoeba histolytica
KESTLKEIIVFLIKEFQHLFPENVSDI

SEQ ID NO: 2595478 - protein, 17 aa, Entamoeba histolytica
KESVIEHKLLYPNQFVF

SEQ ID NO: 2595479 - protein, 51 aa, Entamoeba histolytica
KETIPFWLCALISYVPPLLLILLFSLFKKSSKFLFYSLFCLILCISSNIAI

SEQ ID NO: 2595480 - protein, 24 aa, Entamoeba histolytica
KETKLIMCYPNELRKWLINEAKKN

SEQ ID NO: 2595481 - protein, 24 aa, Entamoeba histolytica
KEVLSFIVISIPVTILLAIYSIIA

SEQ ID NO: 2595482 - protein, 20 aa, Entamoeba histolytica
KEWMRICHELLDAFKAHKKS

SEQ ID NO: 2595483 - protein, 21 aa, Entamoeba histolytica
KEYAIFRKKQQAYLLINMLRV

SEQ ID NO: 2595484 - protein, 25 aa, Entamoeba histolytica
KEYIIILFIIILSRTSYFWGEKYKK

SEQ ID NO: 2595485 - protein, 17 aa, Entamoeba histolytica
KEYITYRFIHQYGFDLN

SEQ ID NO: 2595486 - protein, 24 aa, Entamoeba histolytica
KEYKWYHFYKSEFYARWFNVDTTD

SEQ ID NO: 2595487 - protein, 28 aa, Entamoeba histolytica
KEYSFSITIPPAPTRTFYRSCLYDSLAP

SEQ ID NO: 2595488 - protein, 22 aa, Entamoeba histolytica
KEYYLALSTLLQNVAYQGLSVQ

SEQ ID NO: 2595489 - protein, 28 aa, Entamoeba histolytica
KEYYSIYILFIHLFISHINMLILFNNTQ

SEQ ID NO: 2595490 - protein, 17 aa, Entamoeba histolytica
KFFFDDFVSVLGVDNDG

SEQ ID NO: 2595491 - protein, 19 aa, Entamoeba histolytica
KFGLAFVLFILMSLTILLE

SEQ ID NO: 2595492 - protein, 25 aa, Entamoeba histolytica
KFGRLFQTFSSFITGYLIGFIKCWD

SEQ ID NO: 2595493 - protein, 20 aa, Entamoeba histolytica
KFGRRRIFLVVGAIIDILGL

SEQ ID NO: 2595494 - protein, 23 aa, Entamoeba histolytica
KFHKQCIFGWFRSTGRHDCPLCT

SEQ ID NO: 2595495 - protein, 26 aa, Entamoeba histolytica
KFIIDKIDLVDPFFAYITLKAFKEPT

SEQ ID NO: 2595496 - protein, 18 aa, Entamoeba histolytica
KFKERIIQLIQTKKKYLL

SEQ ID NO: 2595497 - protein, 24 aa, Entamoeba histolytica
KFKLETFGFVSFLFVFNEKTHEYT

SEQ ID NO: 2595498 - protein, 20 aa, Entamoeba histolytica
KFLIKIDPAIILLKKGEACK

SEQ ID NO: 2595499 - protein, 24 aa, Entamoeba histolytica
KFLPPILVYFFSTAVVHFLIASLC

SEQ ID NO: 2595500 - protein, 18 aa, Entamoeba histolytica
KFLQFQLTVNVSAVVLCI

SEQ ID NO: 2595501 - protein, 27 aa, Entamoeba histolytica
KFNSILLTALLKPFQRYRYYEPKLIML

SEQ ID NO: 2595502 - protein, 27 aa, Entamoeba histolytica
KFRCEYIVHFYGAVFIPTKICLVTEYV

SEQ ID NO: 2595503 - protein, 17 aa, Entamoeba histolytica
KFRSDFIVHFYGAVFIP

SEQ ID NO: 2595504 - protein, 23 aa, Entamoeba histolytica
KFYLHVFICLLAPLAPRFISYFF

SEQ ID NO: 2595505 - protein, 23 aa, Entamoeba histolytica
KGCAICKKGYYYDKKNYRCNKCD

SEQ ID NO: 2595506 - protein, 18 aa, Entamoeba histolytica
KGCDSCEDGYYLVFNECF

SEQ ID NO: 2595507 - protein, 25 aa, Entamoeba histolytica
KGDTGLLVYSLKDWVFTSIDSILND

SEQ ID NO: 2595508 - protein, 23 aa, Entamoeba histolytica
KGENLLVFSLNPHSPVCAKLTDF

SEQ ID NO: 2595509 - protein, 29 aa, Entamoeba histolytica
KGETQWYAYPIQYIILLFPVVNLCNSYPL

SEQ ID NO: 2595510 - protein, 32 aa, Entamoeba histolytica; identical to SEQ ID NO: 2398645

SEQ ID NO: 2595511 - protein, 25 aa, Entamoeba histolytica
KGIPIGMYNIMKYLYNSLSNNLDWF

SEQ ID NO: 2595512 - protein, 17 aa, Entamoeba histolytica
KGIPLYIKPTCAKISNE

SEQ ID NO: 2595513 - protein, 21 aa, Entamoeba histolytica
KGIYKIQIYTKKYKGWGLLQN

SEQ ID NO: 2595514 - protein, 18 aa, Entamoeba histolytica
KGLYLSQEDIKKILSEIL

SEQ ID NO: 2595515 - protein, 17 aa, Entamoeba histolytica
KGMLISNTLFRMGGAAI

SEQ ID NO: 2595516 - protein, 31 aa, Entamoeba histolytica
KGMMIINAFLLTLFFIITYGLVGYSMKKQQI

SEQ ID NO: 2595517 - protein, 24 aa, Entamoeba histolytica
KGNELLIMNLFQKDNMLYGINSFC

SEQ ID NO: 2595518 - protein, 25 aa, Entamoeba histolytica
KGNKEGIILPFALKNKILLDTAKGM

SEQ ID NO: 2595519 - protein, 24 aa, Entamoeba histolytica
KGNYEIQLLIIKATEFILYVEKKG

SEQ ID NO: 2595520 - protein, 20 aa, Entamoeba histolytica
KGQWFFVEGANLNIKFDTCS

SEQ ID NO: 2595521 - protein, 26 aa, Entamoeba histolytica
KGSPFMQTIVKLLRLLHTMNNNGCMM

SEQ ID NO: 2595522 - protein, 21 aa, Entamoeba histolytica
KGVPNYFIFNATRQKELWTTV

SEQ ID NO: 2595523 - protein, 17 aa, Entamoeba histolytica
KGVWYHITAPEDKTLQA

SEQ ID NO: 2595524 - protein, 23 aa, Entamoeba histolytica
KGWQTICQYGYADPYGGCEKCNG

SEQ ID NO: 2595525 - protein, 24 aa, Entamoeba histolytica
KGWQTICQYGYTDPYGGCEKCNGG

SEQ ID NO: 2595526 - protein, 45 aa, Entamoeba histolytica
KGYDWKLILVACIGIIVTFMVLIGAFIFFNNKYPNWIGNCLRKNN

SEQ ID NO: 2595527 - protein, 20 aa, Entamoeba histolytica
KHCYGYLNVIALTFVTVPGT

SEQ ID NO: 2595528 - protein, 23 aa, Entamoeba histolytica
KHGFLLEFPKLRNEPRLLTSIQS

SEQ ID NO: 2595529 - protein, 25 aa, Entamoeba histolytica
KHGPFALIEKGLPVILIILDDEHAN

SEQ ID NO: 2595530 - protein, 20 aa, Entamoeba histolytica
KHIIISLATLSRDILHSNNS

SEQ ID NO: 2595531 - protein, 29 aa, Entamoeba histolytica
KHMHRAILFFYNNTLPYFFKMELVCRRNI

SEQ ID NO: 2595532 - protein, 24 aa, Entamoeba histolytica
KHNDILILVGAIAELRQMFVDLAV

SEQ ID NO: 2595533 - protein, 24 aa, Entamoeba histolytica
KHQPFILMDIFFDILPYIQSNKIS

SEQ ID NO: 2595534 - protein, 28 aa, Entamoeba histolytica
KHSEEFVPIMFWIIVQKIPKGTVNDITI

SEQ ID NO: 2595535 - protein, 25 aa, Entamoeba histolytica
KHSNRFVLFRVIWNNYKHEYIFCTL

SEQ ID NO: 2595536 - protein, 21 aa, Entamoeba histolytica
KHSNRFVLLRVLLNNFRHEWL

SEQ ID NO: 2595537 - protein, 18 aa, Entamoeba histolytica
KHTGIYYYFQSPVTDTMV

SEQ ID NO: 2595538 - protein, 21 aa, Entamoeba histolytica
KHTIFLLNYQALQPILNTISA

SEQ ID NO: 2595539 - protein, 17 aa, Entamoeba histolytica
KHVFYRGFTLPTFLKEC

SEQ ID NO: 2595540 - protein, 27 aa, Entamoeba histolytica
KHVWPSLLFMVLITFLLSVVIDNIPVV

SEQ ID NO: 2595541 - protein, 27 aa, Entamoeba histolytica
KHYSVIDDMFIYDLEFKSNGSVNFLVT

SEQ ID NO: 2595542 - protein, 17 aa, Entamoeba histolytica
KIAIYFVQPFLKSYLFW

SEQ ID NO: 2595543 - protein, 32 aa, Entamoeba histolytica
KICPYITRHKWLFISLYFVGIMVCGILSPLAT

SEQ ID NO: 2595544 - protein, 23 aa, Entamoeba histolytica
KIDIIITFIVFVLSKLFGLLPPF

SEQ ID NO: 2595545 - protein, 27 aa, Entamoeba histolytica
KIDIPVFWPILLVYFIVLFVVTMHSQI

SEQ ID NO: 2595546 - protein, 23 aa, Entamoeba histolytica
KIDKMYFVYFLKFGIAIGIHLSI

SEQ ID NO: 2595547 - protein, 31 aa, Entamoeba histolytica
KIETIHFLQDLLLDYGYFFTLATEKGKKSTN

SEQ ID NO: 2595548 - protein, 18 aa, Entamoeba histolytica
KIFILTKNQITLTFQKVL

SEQ ID NO: 2595549 - protein, 17 aa, Entamoeba histolytica
KIFQVLRRGPIKREPKD

SEQ ID NO: 2595550 - protein, 17 aa, Entamoeba histolytica
KIFWLNIVGAILAAISV

SEQ ID NO: 2595551 - protein, 33 aa, Entamoeba histolytica
KIGQILLWLSLGVYLFYILAIYLTNKLSKEIVI

SEQ ID NO: 2595552 - protein, 26 aa, Entamoeba histolytica
KIHSCDFLFPMNFPQSLQSLDLFIEN

SEQ ID NO: 2595553 - protein, 22 aa, Entamoeba histolytica
KIHYLFICVYIVVSLIVVYGLQ

SEQ ID NO: 2595554 - protein, 35 aa, Entamoeba histolytica
KIICVIIIILIIILVLIGFISGIFFFIKKQRKHRQ

SEQ ID NO: 2595555 - protein, 17 aa, Entamoeba histolytica
KIIDSNIYLNLINEHAL

SEQ ID NO: 2595556 - protein, 17 aa, Entamoeba histolytica
KIILLLLNEMKYYYSFI

SEQ ID NO: 2595557 - protein, 59 aa, Entamoeba histolytica
KIIRIHTGFNTVDLILCCCGGLLLLIFIAYIALIVIGLVKGWLKPSCSVTIWTINVDLQ

SEQ ID NO: 2595558 - protein, 26 aa, Entamoeba histolytica
KIISWQLLCRSILYSLSVVNAPRVYF

SEQ ID NO: 2595559 - protein, 20 aa, Entamoeba histolytica
KIKAYFHITNFGKRLLKNQG

SEQ ID NO: 2595560 - protein, 24 aa, Entamoeba histolytica
KIKDFIIFGIPLMILSFVAAVGLS

SEQ ID NO: 2595561 - protein, 21 aa, Entamoeba histolytica
KIKHHLYDKLLSFVRNYCISK

SEQ ID NO: 2595562 - protein, 30 aa, Entamoeba histolytica
KIKLHEIPQLPEYIKYLYVQTRDSNIIINQ

SEQ ID NO: 2595563 - protein, 31 aa, Entamoeba histolytica
KIKSIIYYVLSWIPFFNLFITLNKSLECNNK

SEQ ID NO: 2595564 - protein, 22 aa, Entamoeba histolytica
KIKSMAPHQLAELWKGIDEMRI

SEQ ID NO: 2595565 - protein, 24 aa, Entamoeba histolytica
KILCYHFLLIILSSCIKLFSFHVI

SEQ ID NO: 2595566 - protein, 19 aa, Entamoeba histolytica
KILDDLAIALQFLHQNQII

SEQ ID NO: 2595567 - protein, 30 aa, Entamoeba histolytica; identical to SEQ ID NO: 2398698

SEQ ID NO: 2595568 - protein, 28 aa, Entamoeba histolytica
KILHSISIPHPFWCKYIKIHQTSWYGKE

SEQ ID NO: 2595569 - protein, 17 aa, Entamoeba histolytica
KILIYIPIILVIGMIVF

SEQ ID NO: 2595570 - protein, 27 aa, Entamoeba histolytica
KINCYLFILFILFTKSRLVNESEFYLE

SEQ ID NO: 2595571 - protein, 28 aa, Entamoeba histolytica
KINEDLILSFLLCGIILAPAYVLIYQNL

SEQ ID NO: 2595572 - protein, 28 aa, Entamoeba histolytica
KINITSILHLWLMVSIPKFDITKSFKSQ

SEQ ID NO: 2595573 - protein, 18 aa, Entamoeba histolytica
KINQIFSFIISHTPVVFP

SEQ ID NO: 2595574 - protein, 17 aa, Entamoeba histolytica
KINQIIHCLYGIKSIQF

SEQ ID NO: 2595575 - protein, 24 aa, Entamoeba histolytica
KINYDFMLDIIKLLQQLLENKADK

SEQ ID NO: 2595576 - protein, 17 aa, Entamoeba histolytica
KIPLLNENYLTEITTDF

SEQ ID NO: 2595577 - protein, 22 aa, Entamoeba histolytica
KIPYSAWFSKKKKGLLKISQIL

SEQ ID NO: 2595578 - protein, 21 aa, Entamoeba histolytica
KIRDMKIPYTIWFSKSKSTLE

SEQ ID NO: 2595579 - protein, 26 aa, Entamoeba histolytica
KIRDMKIPYTVWFSKSKSSLIMLSDL

SEQ ID NO: 2595580 - protein, 19 aa, Entamoeba histolytica
KIRIINPFSGSICCGCSDT

SEQ ID NO: 2595581 - protein, 17 aa, Entamoeba histolytica
KIRNKLIEQHLLHDVFV

SEQ ID NO: 2595582 - protein, 18 aa, Entamoeba histolytica
KISFFKIGGLLLVASVLV

SEQ ID NO: 2595583 - protein, 25 aa, Entamoeba histolytica
KITADLFLVFLKQLKEKSQDFVIQN

SEQ ID NO: 2595584 - protein, 47 aa, Entamoeba histolytica
KITFTGHYANLFLRFIRRLLTSRGNYIFKENISFGFNLLKSTISLCD

SEQ ID NO: 2595585 - protein, 19 aa, Entamoeba histolytica
KITQSNIKFIPLGDGILTS

SEQ ID NO: 2595586 - protein, 35 aa, Entamoeba histolytica
KITYGIIILIVLTILIIILITIGMFIVIYRIYNKR

SEQ ID NO: 2595587 - protein, 21 aa, Entamoeba histolytica
KIVDNWVLFSTKITTEKKKTF

SEQ ID NO: 2595588 - protein, 18 aa, Entamoeba histolytica
KIVIPNIREYFKEMKRII

SEQ ID NO: 2595589 - protein, 19 aa, Entamoeba histolytica
KIVLKVIRQCLNVEIIGKE

SEQ ID NO: 2595590 - protein, 18 aa, Entamoeba histolytica
KIVMCQCGMYYKGETRSC

SEQ ID NO: 2595591 - protein, 34 aa, Entamoeba histolytica
KIVPWEQWYRLLQSIILFILILISLVSVFILEHK

SEQ ID NO: 2595592 - protein, 22 aa, Entamoeba histolytica
KKAFLVGFPDNVAIRQPDNTYL

SEQ ID NO: 2595593 - protein, 18 aa, Entamoeba histolytica
KKAILNRAGIDGGSRVQD

SEQ ID NO: 2595594 - protein, 21 aa, Entamoeba histolytica
KKDFNHFVFSLNNPYHNPMKF

SEQ ID NO: 2595595 - protein, 30 aa, Entamoeba histolytica
KKDSRYFIAFRWFMAQLLINAKSCLAYSWI

SEQ ID NO: 2595596 - protein, 30 aa, Entamoeba histolytica
KKEFRIPISIFIDQQFLALMKLYHPSMIDV

SEQ ID NO: 2595597 - protein, 25 aa, Entamoeba histolytica
KKEIWVKEIYKEGCWYAFNTNGQQK

SEQ ID NO: 2595598 - protein, 25 aa, Entamoeba histolytica
KKERKFIDKLLGVVKVVGVITLAGA

SEQ ID NO: 2595599 - protein, 19 aa, Entamoeba histolytica
KKEYIANLCQVFVVLEVYK

SEQ ID NO: 2595600 - protein, 26 aa, Entamoeba histolytica
KKFDFNMLFLIIYSVSVFYFSCVMSR

SEQ ID NO: 2595601 - protein, 21 aa, Entamoeba histolytica
KKFFPLGCYMNWYDDFDIEHF

SEQ ID NO: 2595602 - protein, 36 aa, Entamoeba histolytica
KKFKISFSIIFTTLILFFICVCIIIGILFIIQPDYA

SEQ ID NO: 2595603 - protein, 44 aa, Entamoeba histolytica
KKGKAVEFEIFIKPLCTCSLNESILLVALDMKKGKQFNCKINLN

SEQ ID NO: 2595604 - protein, 29 aa, Entamoeba histolytica
KKHPSIFNLIFFRRSFPQIIKGRKGSLNV

SEQ ID NO: 2595605 - protein, 28 aa, Entamoeba histolytica
KKIINITELFIPIIFNSLSLQDNYIQTM

SEQ ID NO: 2595606 - protein, 27 aa, Entamoeba histolytica
KKIIVKNIKFILIGGLMIMLMLNFNGI

SEQ ID NO: 2595607 - protein, 29 aa, Entamoeba histolytica
KKIKYWLPRIIFFVFFFAAVELVFIYNKS

SEQ ID NO: 2595608 - protein, 23 aa, Entamoeba histolytica
KKILMIIMPYPFLGTWERKYVIG

SEQ ID NO: 2595609 - protein, 24 aa, Entamoeba histolytica
KKKIQILQFCYFLVFVRLVICTLY

SEQ ID NO: 2595610 - protein, 17 aa, Entamoeba histolytica
KKKLIPLLLLSFLESMN

SEQ ID NO: 2595611 - protein, 25 aa, Entamoeba histolytica
KKKSSLFLLFSLLSLGLSASMCLGV

SEQ ID NO: 2595612 - protein, 29 aa, Entamoeba histolytica
KKKTIRNGLLYLLFFLQQKETPLRKRDRE

SEQ ID NO: 2595613 - protein, 25 aa, Entamoeba histolytica
KKLDKYLRIKFVLDCAKGIQYLHTN

SEQ ID NO: 2595614 - protein, 21 aa, Entamoeba histolytica
KKLEPFACELLALTAHRAEQL

SEQ ID NO: 2595615 - protein, 33 aa, Entamoeba histolytica
KKLFGTTGMGHLLVLVIGGIGILVVIYVVAFKL

SEQ ID NO: 2595616 - protein, 23 aa, Entamoeba histolytica
KKLKIPYIVLFHLKQKLTSLLLH

SEQ ID NO: 2595617 - protein, 23 aa, Entamoeba histolytica
KKLLMQFYGVWVASVFAKMEACG

SEQ ID NO: 2595618 - protein, 17 aa, Entamoeba histolytica
KKLLQDYWCIQGVLNAI

SEQ ID NO: 2595619 - protein, 29 aa, Entamoeba histolytica
KKLWIKISIWIICPIICLAVLLLTLLLLY

SEQ ID NO: 2595620 - protein, 22 aa, Entamoeba histolytica
KKMILHVRLNFLTQFMVQDETV

SEQ ID NO: 2595621 - protein, 24 aa, Entamoeba histolytica
KKMNIPMSYLKYYSDHVLSNGCPN

SEQ ID NO: 2595622 - protein, 21 aa, Entamoeba histolytica
KKMYLIPRHFFKSRYVKPPKE

SEQ ID NO: 2595623 - protein, 35 aa, Entamoeba histolytica
KKNPSLIRAVIKREWWPFLLSFIAITISQIAMLMF

SEQ ID NO: 2595624 - protein, 24 aa, Entamoeba histolytica
KKNYDWMILILINKIISVFITTNS

SEQ ID NO: 2595625 - protein, 40 aa, Entamoeba histolytica
KKNYLPLVISIFSSLFFIISLVLIIVIWGYPITLPDPNQS

SEQ ID NO: 2595626 - protein, 21 aa, Entamoeba histolytica
KKQFIFCTEPFRIPFAGIVDI

SEQ ID NO: 2595627 - protein, 23 aa, Entamoeba histolytica
KKQKPYIWMTFNEYQLISNADTN

SEQ ID NO: 2595628 - protein, 25 aa, Entamoeba histolytica
KKSDYNMEFLPFTAQFMDSFTKMQK

SEQ ID NO: 2595629 - protein, 26 aa, Entamoeba histolytica
KKSLCKRIIQFPGWFFKQFFRTDPKG

SEQ ID NO: 2595630 - protein, 21 aa, Entamoeba histolytica
KKTCPPPPPPPCRGKDCEGPH

SEQ ID NO: 2595631 - protein, 25 aa, Entamoeba histolytica
KKTHKQFIHPIKNKTPHPSSVTPPS

SEQ ID NO: 2595632 - protein, 35 aa, Entamoeba histolytica
KKTQFITILLFFFTSLCWIILSLLLMFLDYQYHLK

SEQ ID NO: 2595633 - protein, 25 aa, Entamoeba histolytica
KKVFSLYIIFITLLQFQLLNNYDQE

SEQ ID NO: 2595634 - protein, 21 aa, Entamoeba histolytica
KKVIFNFVLSHKLFNTLFCHW

SEQ ID NO: 2595635 - protein, 28 aa, Entamoeba histolytica
KKVKVKSLLPFLHIQKILAPNGEIIFSF

SEQ ID NO: 2595636 - protein, 23 aa, Entamoeba histolytica
KKVMKIFIHFIIKYMEENIKNKE

SEQ ID NO: 2595637 - protein, 43 aa, Entamoeba histolytica
KKVVLQKNYIPWISLVRIFYLSLMSLYPYKTFFSVKSDIPDFI

SEQ ID NO: 2595638 - protein, 23 aa, Entamoeba histolytica
KKYPKLYIILNPFSGTKKGETIM

SEQ ID NO: 2595639 - protein, 20 aa, Entamoeba histolytica
KLANTKLRLKRLTNSLIHHC

SEQ ID NO: 2595640 - protein, 18 aa, Entamoeba histolytica
KLAYLYIMNYAKTQQDNA

SEQ ID NO: 2595641 - protein, 17 aa, Entamoeba histolytica
KLCFPDNGRWWNFTIVN

SEQ ID NO: 2595642 - protein, 25 aa, Entamoeba histolytica
KLDDFWNIVLGAKAVICCRVTPLIK

SEQ ID NO: 2595643 - protein, 18 aa, Entamoeba histolytica
KLDILHFFPSILQKCLED

SEQ ID NO: 2595644 - protein, 25 aa, Entamoeba histolytica
KLDIRHFFNDYGLLNIYYNGWSAPE

SEQ ID NO: 2595645 - protein, 37 aa, Entamoeba histolytica; identical to SEQ ID NO: 2398773

SEQ ID NO: 2595646 - protein, 27 aa, Entamoeba histolytica
KLFVGMLICLIFSEALALYGFIVALIM

SEQ ID NO: 2595647 - protein, 20 aa, Entamoeba histolytica
KLHDLFLFEGGIKLRDCLSH

SEQ ID NO: 2595648 - protein, 32 aa, Entamoeba histolytica
KLHTISILKNSWFFYELIVKSLTLEMDSSGLL

SEQ ID NO: 2595649 - protein, 29 aa, Entamoeba histolytica
KLIHQHLYLFVFFLIFGLYVSLYFEMSQQ

SEQ ID NO: 2595650 - protein, 20 aa, Entamoeba histolytica
KLIIYFFLVNSVQFSIEFSY

SEQ ID NO: 2595651 - protein, 22 aa, Entamoeba histolytica
KLIKYMKQHFCLAFIKMMINEY

SEQ ID NO: 2595652 - protein, 28 aa, Entamoeba histolytica
KLITIILFLFILLLIAFFIPNSPLKSVI

SEQ ID NO: 2595653 - protein, 23 aa, Entamoeba histolytica
KLITKLRKIPIKIEVWKLILERR

SEQ ID NO: 2595654 - protein, 20 aa, Entamoeba histolytica
KLIVQSHYPIIIKYDKYNQF

SEQ ID NO: 2595655 - protein, 20 aa, Entamoeba histolytica
KLKDLKYETLVKYTAGQGQV

SEQ ID NO: 2595656 - protein, 23 aa, Entamoeba histolytica
KLKKMIIEWSINIKVFDKKNDKK

SEQ ID NO: 2595657 - protein, 23 aa, Entamoeba histolytica
KLKRNFYTVLIHNFRLECPIKEK

SEQ ID NO: 2595658 - protein, 21 aa, Entamoeba histolytica
KLLEYNLKINQIFSFIISHTP

SEQ ID NO: 2595659 - protein, 17 aa, Entamoeba histolytica
KLLIYDEQKIDKLNRYC

SEQ ID NO: 2595660 - protein, 18 aa, Entamoeba histolytica
KLLNNQLIPVLFAVCCRE

SEQ ID NO: 2595661 - protein, 34 aa, Entamoeba histolytica
KLLQYQPFIIAFFVITSFLFLLKKFFIPNDFIKT

SEQ ID NO: 2595662 - protein, 19 aa, Entamoeba histolytica
KLMYLFDRNTELKKIVLSS

SEQ ID NO: 2595663 - protein, 22 aa, Entamoeba histolytica
KLNMSSMDVVWIKGYESDHECP

SEQ ID NO: 2595664 - protein, 28 aa, Entamoeba histolytica
KLNPEKRYFFFFTFHDDNLLINFNIKIV

SEQ ID NO: 2595665 - protein, 28 aa, Entamoeba histolytica
KLPDAHIPWYRYLLFTIAMACCVVLCIL

SEQ ID NO: 2595666 - protein, 24 aa, Entamoeba histolytica
KLPETLVFHLKRFGYNEQFQIVKY

SEQ ID NO: 2595667 - protein, 17 aa, Entamoeba histolytica
KLPYKRSFYMTYSQKSY

SEQ ID NO: 2595668 - protein, 27 aa, Entamoeba histolytica
KLQSFSVWLVCILPHSLKVHQGMVSFV

SEQ ID NO: 2595669 - protein, 17 aa, Entamoeba histolytica
KLRIKLLIDASKGIKYL

SEQ ID NO: 2595670 - protein, 17 aa, Entamoeba histolytica
KLSFLIPSFMRKRSNSP

SEQ ID NO: 2595671 - protein, 25 aa, Entamoeba histolytica
KLSRDRSLVILKIRNFGTLNIGNPQ

SEQ ID NO: 2595672 - protein, 24 aa, Entamoeba histolytica
KLSSFFSFLPMLSDSLLSLIYGVF

SEQ ID NO: 2595673 - protein, 42 aa, Entamoeba histolytica; identical to SEQ ID NO: 2398809

SEQ ID NO: 2595674 - protein, 26 aa, Entamoeba histolytica
KLSWWSLLELAGFVILFFATLVYNRV

SEQ ID NO: 2595675 - protein, 27 aa, Entamoeba histolytica
KLTEIFKVFVLYFKFNSKENILINSFK

SEQ ID NO: 2595676 - protein, 17 aa, Entamoeba histolytica
KLTLTGTRTIKTLKLSK

SEQ ID NO: 2595677 - protein, 28 aa, Entamoeba histolytica
KLTSLLLHYIYLLPIYKNNTLISVLNEK

SEQ ID NO: 2595678 - protein, 23 aa, Entamoeba histolytica
KLTVDYLGIIPLLVEALKEIHNN

SEQ ID NO: 2595679 - protein, 37 aa, Entamoeba histolytica
KLVEPSLMTLKFKEQTFTLYPIECSEGMKYDFKECDG

SEQ ID NO: 2595680 - protein, 24 aa, Entamoeba histolytica
KLVFIQENLLIVPPLHNFYNFLLK

SEQ ID NO: 2595681 - protein, 21 aa, Entamoeba histolytica
KLVGVLKIMLLDIKQLPPVRI

SEQ ID NO: 2595682 - protein, 50 aa, Entamoeba histolytica
KLYCSKMPKWSIYPLAFIPGVVLYLLVWVILFIIFLRKHIRLTKMIEIEQ

SEQ ID NO: 2595683 - protein, 17 aa, Entamoeba histolytica
KLYFIPYLHKNYIDDHP

SEQ ID NO: 2595684 - protein, 17 aa, Entamoeba histolytica
KLYVYLDLNLESALSTK

SEQ ID NO: 2595685 - protein, 25 aa, Entamoeba histolytica
KMCCLINVLIMPYCSFNIQQEFKCI

SEQ ID NO: 2595686 - protein, 20 aa, Entamoeba histolytica
KMCIAIEFAPDGSLGHVLKK

SEQ ID NO: 2595687 - protein, 25 aa, Entamoeba histolytica
KMELIVFPIALIILLYVVQSPVLLI

SEQ ID NO: 2595688 - protein, 18 aa, Entamoeba histolytica
KMKSFIFNSILITGKLKT

SEQ ID NO: 2595689 - protein, 18 aa, Entamoeba histolytica
KMLFISEISLSYQLAFQL

SEQ ID NO: 2595690 - protein, 32 aa, Entamoeba histolytica
KMLFLGSILIYGYPLVLNIILITLQLCNHPPL

SEQ ID NO: 2595691 - protein, 20 aa, Entamoeba histolytica
KMLKMPIDIQIFLSKLFDKE

SEQ ID NO: 2595692 - protein, 18 aa, Entamoeba histolytica
KMMALRKSAQSQSPDISV

SEQ ID NO: 2595693 - protein, 19 aa, Entamoeba histolytica
KMNVFKMLWNQITDFIVMI

SEQ ID NO: 2595694 - protein, 21 aa, Entamoeba histolytica
KMNWKAIINILNLAAVDSSPN

SEQ ID NO: 2595695 - protein, 19 aa, Entamoeba histolytica
KMPTYIDNMVKYYITLLQH

SEQ ID NO: 2595696 - protein, 18 aa, Entamoeba histolytica
KMQPELIRFIFASMKTEN

SEQ ID NO: 2595697 - protein, 17 aa, Entamoeba histolytica
KMVQNLILIYDPSFIFY

SEQ ID NO: 2595698 - protein, 17 aa, Entamoeba histolytica
KNAIHFIGSFKFGSFTL

SEQ ID NO: 2595699 - protein, 29 aa, Entamoeba histolytica
KNATNMAFLYFVRYPLLEKIYENIIKNEE

SEQ ID NO: 2595700 - protein, 28 aa, Entamoeba histolytica
KNAVQTFFRYFGLLSYLIPISCAVSLEV

SEQ ID NO: 2595701 - protein, 24 aa, Entamoeba histolytica
KNCALIHLLRVILWAVREPLKSNF

SEQ ID NO: 2595702 - protein, 25 aa, Entamoeba histolytica
KNCKYFLFFLLSMSISLITISYYCI

SEQ ID NO: 2595703 - protein, 25 aa, Entamoeba histolytica
KNCQFSYSMLLMKLSLQTTEAVCDG

SEQ ID NO: 2595704 - protein, 25 aa, Entamoeba histolytica
KNEINLLYFIVLPVSQLEGCMNKSA

SEQ ID NO: 2595705 - protein, 25 aa, Entamoeba histolytica
KNELLYKVMILIGLNDIVFTSLRYS

SEQ ID NO: 2595706 - protein, 24 aa, Entamoeba histolytica
KNFANNLIFIFAKTNFIVTGNTVS

SEQ ID NO: 2595707 - protein, 21 aa, Entamoeba histolytica
KNFFHSQLFWGIISMIICGYW

SEQ ID NO: 2595708 - protein, 24 aa, Entamoeba histolytica
KNFSNNLIFIFAKTNFIVTGNTVA

SEQ ID NO: 2595709 - protein, 22 aa, Entamoeba histolytica
KNIDGASCLFIILGVIITLLFF

SEQ ID NO: 2595710 - protein, 22 aa, Entamoeba histolytica
KNIDGASCMFIILGVIITLLFF

SEQ ID NO: 2595711 - protein, 22 aa, Entamoeba histolytica
KNINKFYTFLTFEISSGLSTKL

SEQ ID NO: 2595712 - protein, 27 aa, Entamoeba histolytica
KNKIDKMLFFNFSFGPAIVTLFASIFL

SEQ ID NO: 2595713 - protein, 25 aa, Entamoeba histolytica
KNKKNKFYIMKLDKAAPPAIAFLTT

SEQ ID NO: 2595714 - protein, 32 aa, Entamoeba histolytica; identical to SEQ ID NO: 2398856

SEQ ID NO: 2595715 - protein, 24 aa, Entamoeba histolytica
KNKTYIYLGYIMQLGLFGASCVIT

SEQ ID NO: 2595716 - protein, 17 aa, Entamoeba histolytica
KNLILNVDKVKIVNKAK

SEQ ID NO: 2595717 - protein, 36 aa, Entamoeba histolytica
KNLQLIGWIMVCVIIGILLIVIAGIYLFYRYRHEKK

SEQ ID NO: 2595718 - protein, 22 aa, Entamoeba histolytica
KNMYLILIVVFFGWISWTPMKE

SEQ ID NO: 2595719 - protein, 32 aa, Entamoeba histolytica
KNNIFGMMGVIFYWIITQKNYIIKEEYVDTLI

SEQ ID NO: 2595720 - protein, 17 aa, Entamoeba histolytica
KNNILTCESLIKSLVAI

SEQ ID NO: 2595721 - protein, 39 aa, Entamoeba histolytica
KNNINFKWRLSQYITWYIVFSLLMSMLMLSIIIGYHVIT

SEQ ID NO: 2595722 - protein, 41 aa, Entamoeba histolytica
KNNLNIIIPVVVVIIIIIVTILIIIIVIVSWKSIHKKNTTK

SEQ ID NO: 2595723 - protein, 25 aa, Entamoeba histolytica
KNNMKFFVQFIFYSSSALLLSSIIN

SEQ ID NO: 2595724 - protein, 35 aa, Entamoeba histolytica
KNNNQMKVIWNILNMNSELLFQLHPELLNNEKTHV

SEQ ID NO: 2595725 - protein, 47 aa, Entamoeba histolytica
KNQSKRWYGFIVPLIFVLFLGVIFYMWIYPLLYKLVSSLLKSRFSIR

SEQ ID NO: 2595726 - protein, 22 aa, Entamoeba histolytica
KNRIFWFSIFTSVVLIVTLLHL

SEQ ID NO: 2595727 - protein, 44 aa, Entamoeba histolytica
KNRTPDPVLIPFWKIWFDALKDKTLIILIIAAIVSLILAFVVPN

SEQ ID NO: 2595728 - protein, 22 aa, Entamoeba histolytica
KNSYYLMNIMLRLIKILQEPSE

SEQ ID NO: 2595729 - protein, 17 aa, Entamoeba histolytica
KNTLGISLTSALMLCQI

SEQ ID NO: 2595730 - protein, 26 aa, Entamoeba histolytica
KNTQKTTFFTFASKMLAYPTLNDHEK

SEQ ID NO: 2595731 - protein, 19 aa, Entamoeba histolytica
KNVCIPYTVWFSKSRRYLN

SEQ ID NO: 2595732 - protein, 22 aa, Entamoeba histolytica
KNVDGRFFCVMELTVMNGEVVQ

SEQ ID NO: 2595733 - protein, 23 aa, Entamoeba histolytica
KNVKLMIFESIKPFNKIGFQQFA

SEQ ID NO: 2595734 - protein, 27 aa, Entamoeba histolytica
KNWREIYKSLLVLDNILKNGSEEAVNI

SEQ ID NO: 2595735 - protein, 20 aa, Entamoeba histolytica
KNYLFIISGIWFGLIHFVNI

SEQ ID NO: 2595736 - protein, 21 aa, Entamoeba histolytica
KNYLFIISGIWFGLIHFVNIG

SEQ ID NO: 2595737 - protein, 21 aa, Entamoeba histolytica
KNYSYLFKHDYTFSTNVISCK

SEQ ID NO: 2595738 - protein, 18 aa, Entamoeba histolytica
KNYYSLGNSCGLCTGLEG

SEQ ID NO: 2595739 - protein, 28 aa, Entamoeba histolytica
KPDNDFDIYLPFYLQDTKPLLTVTIHKM

SEQ ID NO: 2595740 - protein, 27 aa, Entamoeba histolytica
KPDSYKFGHGFWYQFTAKKDKVYINTC

SEQ ID NO: 2595741 - protein, 34 aa, Entamoeba histolytica
KPESSNFLILLFFPSVLSLLIPYIHRPFKLPEQS

SEQ ID NO: 2595742 - protein, 18 aa, Entamoeba histolytica
KPLGLIEGEWKWKPKRNN

SEQ ID NO: 2595743 - protein, 30 aa, Entamoeba histolytica
KPLLCFTRFFIVKLLMILLLCISCGLVIVG

SEQ ID NO: 2595744 - protein, 18 aa, Entamoeba histolytica
KPLNELKIIIKLLTRMLL

SEQ ID NO: 2595745 - protein, 26 aa, Entamoeba histolytica
KPNDSYLISLYEFIRTMIITYKEFIF

SEQ ID NO: 2595746 - protein, 18 aa, Entamoeba histolytica
KPNHIIVLFGSQHKGHLP

SEQ ID NO: 2595747 - protein, 21 aa, Entamoeba histolytica
KPNQVWIGATLISGGVPIAIE

SEQ ID NO: 2595748 - protein, 22 aa, Entamoeba histolytica
KPPKLSLQFKKIPTNPFDEPTT

SEQ ID NO: 2595749 - protein, 22 aa, Entamoeba histolytica
KPQILFDMITKILQKYSEMMKK

SEQ ID NO: 2595750 - protein, 26 aa, Entamoeba histolytica
KPTFSSIFKYLVFNTYLSIGGKFTLT

SEQ ID NO: 2595751 - protein, 17 aa, Entamoeba histolytica
KPTKELLKRKPFGKYNS

SEQ ID NO: 2595752 - protein, 23 aa, Entamoeba histolytica
KPYGSNYFGGMFKLALTNTDGNN

SEQ ID NO: 2595753 - protein, 22 aa, Entamoeba histolytica
KQCDKCFGMYSLQSGQCTKKNE

SEQ ID NO: 2595754 - protein, 25 aa, Entamoeba histolytica
KQDLTSLLFNIPFNPQTDLNKTHEM

SEQ ID NO: 2595755 - protein, 27 aa, Entamoeba histolytica
KQEDVIEFYMFFINALLPLTQCFQGQI

SEQ ID NO: 2595756 - protein, 20 aa, Entamoeba histolytica
KQEFELILPLINKSIKKALS

SEQ ID NO: 2595757 - protein, 19 aa, Entamoeba histolytica
KQEWPLFHSTCGDGIVLEL

SEQ ID NO: 2595758 - protein, 42 aa, Entamoeba histolytica
KQKKSMKWIYSIIVIPVIIAIGYILYVFIRQSNNTQHSNLMD

SEQ ID NO: 2595759 - protein, 22 aa, Entamoeba histolytica
KQKTRLFNFESCKNSTAAQCLL

SEQ ID NO: 2595760 - protein, 21 aa, Entamoeba histolytica
KQKYRFGKWFKINLNQVTNAV

SEQ ID NO: 2595761 - protein, 25 aa, Entamoeba histolytica
KQLKKIHFELYRTLGTILFNCRLSL

SEQ ID NO: 2595762 - protein, 27 aa, Entamoeba histolytica
KQLLVKDVYLLIIKYTQQTDFLSYLKS

SEQ ID NO: 2595763 - protein, 26 aa, Entamoeba histolytica
KQLQACIHIIGLFPLFAILEKEEYSG

SEQ ID NO: 2595764 - protein, 17 aa, Entamoeba histolytica
KQLYFLEDSPTVQWKFQ

SEQ ID NO: 2595765 - protein, 20 aa, Entamoeba histolytica
KQPLHFTFHSGDYTKYEIMC

SEQ ID NO: 2595766 - protein, 26 aa, Entamoeba histolytica
KQQCHPYLLSMYFITLEKQSYEEKLN

SEQ ID NO: 2595767 - protein, 25 aa, Entamoeba histolytica
KQQFKLFLIHLLQSDSPPALLRAYS

SEQ ID NO: 2595768 - protein, 20 aa, Entamoeba histolytica
KQQIAFHKFKPMILNLVFMI

SEQ ID NO: 2595769 - protein, 20 aa, Entamoeba histolytica
KQRLSVIHYLYSLIPLATVI

SEQ ID NO: 2595770 - protein, 17 aa, Entamoeba histolytica
KQRPVFSEIDRITSKLF

SEQ ID NO: 2595771 - protein, 23 aa, Entamoeba histolytica
KQSLLLVLHIGILILPFIGIIHG

SEQ ID NO: 2595772 - protein, 39 aa, Entamoeba histolytica
KQVIKIINDVFPIKDFWTHVCIVWTKCLYSLSRKQLEKG

SEQ ID NO: 2595773 - protein, 26 aa, Entamoeba histolytica
KQVIYPFFGSPLFLSNVCEIYLLYLY

SEQ ID NO: 2595774 - protein, 30 aa, Entamoeba histolytica
KQVMELIPEFFYFPEFLKNFDHFDLKKRNE

SEQ ID NO: 2595775 - protein, 17 aa, Entamoeba histolytica
KQVPICRNLYRITVWDS

SEQ ID NO: 2595776 - protein, 22 aa, Entamoeba histolytica
KQWKIYFDYLKGESTYDIELTS

SEQ ID NO: 2595777 - protein, 20 aa, Entamoeba histolytica
KQYISWVMALFELSSHCKEC

SEQ ID NO: 2595778 - protein, 29 aa, Entamoeba histolytica
KQYKYDDFLYFIKVLYGVSPKITVTNDNK

SEQ ID NO: 2595779 - protein, 34 aa, Entamoeba histolytica; identical to SEQ ID NO: 2398921

SEQ ID NO: 2595780 - protein, 21 aa, Entamoeba histolytica
KRALQLMLILLFFGMGCLVLT

SEQ ID NO: 2595781 - protein, 24 aa, Entamoeba histolytica
KRDENFYYIFVNVKEFKVVTVSLT

SEQ ID NO: 2595782 - protein, 21 aa, Entamoeba histolytica
KRDLLIYGGYFPDKQQWLKQR

SEQ ID NO: 2595783 - protein, 23 aa, Entamoeba histolytica
KREPKLMDFPPLEFAKQITLFTS

SEQ ID NO: 2595784 - protein, 21 aa, Entamoeba histolytica
KRFMTIYHQPVLLTFDDFVDR

SEQ ID NO: 2595785 - protein, 25 aa, Entamoeba histolytica
KRGKGLISLFIALMKLLYSNQNTEF

SEQ ID NO: 2595786 - protein, 25 aa, Entamoeba histolytica
KRHNKFIVEYLLEAVLSIACILFGP

SEQ ID NO: 2595787 - protein, 40 aa, Entamoeba histolytica
KRIKERRTLWILWAFWWFVYALVCVMAFGALKYFGSNDDF

SEQ ID NO: 2595788 - protein, 26 aa, Entamoeba histolytica
KRKETLVSMKMKIKFMIDAAKGISYL

SEQ ID NO: 2595789 - protein, 26 aa, Entamoeba histolytica
KRKHSDIVIPIKLHLFTQLDCSLDPD

SEQ ID NO: 2595790 - protein, 23 aa, Entamoeba histolytica
KRKLFFYVSLFLSMSIYGSLAIM

SEQ ID NO: 2595791 - protein, 41 aa, Entamoeba histolytica
KRLKERRTLWYVWALWWFIYAVVCVATFTVLKLFIKTDDLL

SEQ ID NO: 2595792 - protein, 45 aa, Entamoeba histolytica
KRLSKWMYIGLAIGCFFVTDIVLYLLVLFFSWICERKLDKVILAE

SEQ ID NO: 2595793 - protein, 20 aa, Entamoeba histolytica
KRLVIPLKVDFKGIVSNEEV

SEQ ID NO: 2595794 - protein, 17 aa, Entamoeba histolytica
KRMFVSDEKLKVITEAT

SEQ ID NO: 2595795 - protein, 21 aa, Entamoeba histolytica
KRMRGRLLASYIKAAGQVISV

SEQ ID NO: 2595796 - protein, 18 aa, Entamoeba histolytica
KRNEFIPELLRRTEILTG

SEQ ID NO: 2595797 - protein, 17 aa, Entamoeba histolytica
KRNEFLPELLRRTEING

SEQ ID NO: 2595798 - protein, 20 aa, Entamoeba histolytica
KRSIMLLRLLKSGMNKEMII

SEQ ID NO: 2595799 - protein, 29 aa, Entamoeba histolytica
KRSTRIMIQILLYCWLCYNSKNEKEWKIL

SEQ ID NO: 2595800 - protein, 44 aa, Entamoeba histolytica
KRSVTLRGYWQIFGYVVVAILIVLILYLSFFKSKKSTAIKRLHK

SEQ ID NO: 2595801 - protein, 20 aa, Entamoeba histolytica
KRTILKLKHSFPSVLEREEV

SEQ ID NO: 2595802 - protein, 28 aa, Entamoeba histolytica
KRTINVVSPYKVRLVWKEIRGVWQWIEG

SEQ ID NO: 2595803 - protein, 37 aa, Entamoeba histolytica
KRTTEISFYLLNKTEYIPMGYYPITTVPIKLMNNIQK

SEQ ID NO: 2595804 - protein, 24 aa, Entamoeba histolytica
KRTYSFIVIFVYFALVISSIIISS

SEQ ID NO: 2595805 - protein, 18 aa, Entamoeba histolytica
KRVIALISTVLYGVGTQS

SEQ ID NO: 2595806 - protein, 42 aa, Entamoeba histolytica
KRWYIQPIVLIKLLYNLIVLCLKYFGILLSPSLLLKKQWTYY

SEQ ID NO: 2595807 - protein, 20 aa, Entamoeba histolytica
KRYYQTLVQIKKSNYMKYHN

SEQ ID NO: 2595808 - protein, 18 aa, Entamoeba histolytica
KSALWKEEWNSKKLTSLI

SEQ ID NO: 2595809 - protein, 27 aa, Entamoeba histolytica
KSCSAILFWCYMFAILNIIFGVVLSMK

SEQ ID NO: 2595810 - protein, 24 aa, Entamoeba histolytica
KSDFHVITPCKSLYFDDPDKPGTK

SEQ ID NO: 2595811 - protein, 24 aa, Entamoeba histolytica
KSDNILLFDLNLEAPVRAKLTDFG

SEQ ID NO: 2595812 - protein, 23 aa, Entamoeba histolytica
KSELRCISLIKLINFLSTNLKDK

SEQ ID NO: 2595813 - protein, 25 aa, Entamoeba histolytica
KSENLFLSLIKLLEGYLANSLVEVS

SEQ ID NO: 2595814 - protein, 20 aa, Entamoeba histolytica
KSFFRVFDDKNTQKTTFFTF

SEQ ID NO: 2595815 - protein, 25 aa, Entamoeba histolytica
KSFKKGIITLIIATSTLALGVNLPA

SEQ ID NO: 2595816 - protein, 26 aa, Entamoeba histolytica
KSIDCPGYLVCYSTCSFVSTASSVSD

SEQ ID NO: 2595817 - protein, 22 aa, Entamoeba histolytica
KSIDGTSCVFVILSILITFLLI

SEQ ID NO: 2595818 - protein, 26 aa, Entamoeba histolytica
KSIIIKYADFINPLYGLNLCSSTLEN

SEQ ID NO: 2595819 - protein, 32 aa, Entamoeba histolytica
KSILKLIHKLPSVSIVVFLFTSNSLNILKEMI

SEQ ID NO: 2595820 - protein, 23 aa, Entamoeba histolytica
KSISYFEYFFELCFTRGVGCENL

SEQ ID NO: 2595821 - protein, 43 aa, Entamoeba histolytica
KSKEWIMAISIGSTILILFVVIIVIIAWILSRRRTTRKGNTYK

SEQ ID NO: 2595822 - protein, 25 aa, Entamoeba histolytica
KSKTLFNLISFSLIILLIIESLQYP

SEQ ID NO: 2595823 - protein, 25 aa, Entamoeba histolytica
KSLPEMMRLPIIQGFIGRSECAVEP

SEQ ID NO: 2595824 - protein, 24 aa, Entamoeba histolytica
KSLYLSYFIILNINVCAIAISFIY

SEQ ID NO: 2595825 - protein, 25 aa, Entamoeba histolytica
KSNDKYLLDIQPSLVILDGGYACEF

SEQ ID NO: 2595826 - protein, 41 aa, Entamoeba histolytica
KSNTIYYIIGGVICGILLLLLIIIGVAIIVFFVTRKKKGSE

SEQ ID NO: 2595827 - protein, 23 aa, Entamoeba histolytica
KSQIYREIIFMKIIRNSYIVQLH

SEQ ID NO: 2595828 - protein, 21 aa, Entamoeba histolytica
KSQWMLLFELVSPCLSKLVKK

SEQ ID NO: 2595829 - protein, 32 aa, Entamoeba histolytica; identical to SEQ ID NO: 2398986

SEQ ID NO: 2595830 - protein, 17 aa, Entamoeba histolytica
KSSKLGFGWLLKAAQQG

SEQ ID NO: 2595831 - protein, 23 aa, Entamoeba histolytica
KSSKLIMNLFQLMTDSNIAVFQE

SEQ ID NO: 2595832 - protein, 17 aa, Entamoeba histolytica
KSTLNPFYGYEPAPNGT

SEQ ID NO: 2595833 - protein, 39 aa, Entamoeba histolytica
KSTNTRRMYILAGCYYLVTKGWSFLFSKEQRIAEKLHHF

SEQ ID NO: 2595834 - protein, 40 aa, Entamoeba histolytica
KSTNTRRMYILAGCYYLVTKGWSFLISKEQRRAEKLHHFF

SEQ ID NO: 2595835 - protein, 19 aa, Entamoeba histolytica
KSWLCVFPGCKESVKTHYN

SEQ ID NO: 2595836 - protein, 29 aa, Entamoeba histolytica
KSWWTPKKIAGMMFYIAGLMLLISHLTSK

SEQ ID NO: 2595837 - protein, 26 aa, Entamoeba histolytica
KSYDKEPYVILPNKDFRFSTEFEYGG

SEQ ID NO: 2595838 - protein, 23 aa, Entamoeba histolytica
KSYFKKGFSKLFLPLGFSGILSI

SEQ ID NO: 2595839 - protein, 24 aa, Entamoeba histolytica
KSYIDKTFYLKYLPEPNKKITVLF

SEQ ID NO: 2595840 - protein, 24 aa, Entamoeba histolytica
KTAKYALSVLLKKVIMLDTDSRYQ

SEQ ID NO: 2595841 - protein, 22 aa, Entamoeba histolytica
KTCDKCFGMYSLQGGKCTQKND

SEQ ID NO: 2595842 - protein, 19 aa, Entamoeba histolytica
KTCFSSAIYYMSCSSDKYL

SEQ ID NO: 2595843 - protein, 18 aa, Entamoeba histolytica
KTCIVCEDGYVYDSYTKQ

SEQ ID NO: 2595844 - protein, 18 aa, Entamoeba histolytica
KTCLSCISGFMIQDNTCI

SEQ ID NO: 2595845 - protein, 28 aa, Entamoeba histolytica
KTDLISWIYIIRIILFSLTKLYPQTEYF

SEQ ID NO: 2595846 - protein, 18 aa, Entamoeba histolytica
KTELINLFEQLAIFIRKS

SEQ ID NO: 2595847 - protein, 26 aa, Entamoeba histolytica
KTESILPIYFLLLQQSAALAFFWSPC

SEQ ID NO: 2595848 - protein, 18 aa, Entamoeba histolytica
KTFFSVKSDIPDFIKTHW

SEQ ID NO: 2595849 - protein, 30 aa, Entamoeba histolytica
KTFKEKVWGVVKVLGFISLGVGVGVAIGVI

SEQ ID NO: 2595850 - protein, 24 aa, Entamoeba histolytica
KTFMEKVWGVVKVLGVISLGVGVG

SEQ ID NO: 2595851 - protein, 18 aa, Entamoeba histolytica
KTFNFNKINSFIPMCTES

SEQ ID NO: 2595852 - protein, 23 aa, Entamoeba histolytica
KTFNPLELVLNNSLINLNKRGLF

SEQ ID NO: 2595853 - protein, 22 aa, Entamoeba histolytica
KTFYYSSIVVHLFLYGVIAIIS

SEQ ID NO: 2595854 - protein, 22 aa, Entamoeba histolytica
KTGVLKAFAFLFEYIGEKSKDY

SEQ ID NO: 2595855 - protein, 25 aa, Entamoeba histolytica
KTHSFQILVLILYSKHNLISHGVLQ

SEQ ID NO: 2595856 - protein, 17 aa, Entamoeba histolytica
KTINFLVNSNDFMMVMG

SEQ ID NO: 2595857 - protein, 24 aa, Entamoeba histolytica
KTISEPFTFYLKSITHPCIERAIE

SEQ ID NO: 2595858 - protein, 20 aa, Entamoeba histolytica
KTLFLIINTFAFNNTIDQSY

SEQ ID NO: 2595859 - protein, 22 aa, Entamoeba histolytica
KTLIEYINAQQFRYGFDSVITV

SEQ ID NO: 2595860 - protein, 23 aa, Entamoeba histolytica
KTLLSICEYLIDSGINSDLFEQC

SEQ ID NO: 2595861 - protein, 32 aa, Entamoeba histolytica
KTLPIFIISQLLLRLLLILWTLCVIFPSNSFF

SEQ ID NO: 2595862 - protein, 20 aa, Entamoeba histolytica
KTMLKFLIRSSHKNTFKMIK

SEQ ID NO: 2595863 - protein, 22 aa, Entamoeba histolytica
KTMSIPLTNLYSQGLLKINKEG

SEQ ID NO: 2595864 - protein, 25 aa, Entamoeba histolytica
KTNEIRFLHIFPLNILFACYNGYLT

SEQ ID NO: 2595865 - protein, 23 aa, Entamoeba histolytica
KTNLRAFWQFLVSMGLIGIVGAY

SEQ ID NO: 2595866 - protein, 23 aa, Entamoeba histolytica
KTNPFIIMRLGILAFIIALFFPL

SEQ ID NO: 2595867 - protein, 22 aa, Entamoeba histolytica
KTPFAWKTLITSSISLGFNLTN

SEQ ID NO: 2595868 - protein, 30 aa, Entamoeba histolytica
KTPHRVSVFNWFWNRQSYIPNEPYSTQLRR

SEQ ID NO: 2595869 - protein, 25 aa, Entamoeba histolytica
KTQQIVTYLPPLFIQRNYSIKCIVS

SEQ ID NO: 2595870 - protein, 23 aa, Entamoeba histolytica
KTRIKFMCLRLPSERVWLGCEDE

SEQ ID NO: 2595871 - protein, 23 aa, Entamoeba histolytica
KTRKIWGFCILTISFILNNIGFY

SEQ ID NO: 2595872 - protein, 22 aa, Entamoeba histolytica
KTRQYLRKYKLGRIPYLYLVIV

SEQ ID NO: 2595873 - protein, 24 aa, Entamoeba histolytica
KTSAFMPFFQLNSMSTGYGINGII

SEQ ID NO: 2595874 - protein, 34 aa, Entamoeba histolytica
KTSCPDYIFVKPTTSLWWVSATTFIFCIICVFIF

SEQ ID NO: 2595875 - protein, 29 aa, Entamoeba histolytica
KTSKYNLFTFLPLVLLEQFRKLANIYFLI

SEQ ID NO: 2595876 - protein, 18 aa, Entamoeba histolytica
KTTCIFNMKYSNVQFSLF

SEQ ID NO: 2595877 - protein, 21 aa, Entamoeba histolytica
KTTIFKITQSNIKFISLGDGI

SEQ ID NO: 2595878 - protein, 17 aa, Entamoeba histolytica
KTTWLVSLLIIVTYHIA

SEQ ID NO: 2595879 - protein, 21 aa, Entamoeba histolytica
KTVCYPFVYVWNKLPSIVRSS

SEQ ID NO: 2595880 - protein, 18 aa, Entamoeba histolytica
KTVGGLAWYFVKLIEINH

SEQ ID NO: 2595881 - protein, 21 aa, Entamoeba histolytica
KVAAKRIAWAKSINAGQICVC

SEQ ID NO: 2595882 - protein, 20 aa, Entamoeba histolytica
KVALCVMAIAPVLIVIVFLN

SEQ ID NO: 2595883 - protein, 26 aa, Entamoeba histolytica
KVARDWFLFLMSHDATLFISIVMGVL

SEQ ID NO: 2595884 - protein, 37 aa, Entamoeba histolytica
KVAYIKNYVWLDSFPMVLTGWLQLGPGFYKILEIKTM

SEQ ID NO: 2595885 - protein, 28 aa, Entamoeba histolytica
KVDIYNLGCLFFFIARKEHPFGPLIDRS

SEQ ID NO: 2595886 - protein, 29 aa, Entamoeba histolytica
KVEAPSLSTLLFFTILKLSPVCLTQILHT

SEQ ID NO: 2595887 - protein, 19 aa, Entamoeba histolytica
KVERLDLFGYLSCKELHLK

SEQ ID NO: 2595888 - protein, 21 aa, Entamoeba histolytica
KVFFITKRYTVLNFIGLGFSI

SEQ ID NO: 2595889 - protein, 27 aa, Entamoeba histolytica
KVFHHETLRLLQYPVINAILAGHNVLA

SEQ ID NO: 2595890 - protein, 21 aa, Entamoeba histolytica
KVFLCLVLMWTNSLPIYLFSI

SEQ ID NO: 2595891 - protein, 20 aa, Entamoeba histolytica
KVFLQLDFYIYIIAIALVSG

SEQ ID NO: 2595892 - protein, 22 aa, Entamoeba histolytica
KVGGIALLLALILKSDTKIKFD

SEQ ID NO: 2595893 - protein, 22 aa, Entamoeba histolytica
KVGYYGTFYFLDKNCTQEANFG

SEQ ID NO: 2595894 - protein, 18 aa, Entamoeba histolytica
KVIGLIFAIGSGLWCGKV

SEQ ID NO: 2595895 - protein, 18 aa, Entamoeba histolytica
KVILFSHEFNFIQYIAYG

SEQ ID NO: 2595896 - protein, 17 aa, Entamoeba histolytica
KVLLCSLLSYHLVSAIK

SEQ ID NO: 2595897 - protein, 17 aa, Entamoeba histolytica
KVLPLIHPTIKNDLYKT

SEQ ID NO: 2595898 - protein, 17 aa, Entamoeba histolytica
KVLYHKFDKLENVPHIS

SEQ ID NO: 2595899 - protein, 40 aa, Entamoeba histolytica; identical to SEQ ID NO: 2399049

SEQ ID NO: 2595900 - protein, 36 aa, Entamoeba histolytica
KVNIKELFRYAGVFEIILLIIGIIGSIGVGCLNPLL

SEQ ID NO: 2595901 - protein, 36 aa, Entamoeba histolytica
KVQKILIVINALTSCNLFFLLFADICNKNIPNFIHS

SEQ ID NO: 2595902 - protein, 23 aa, Entamoeba histolytica
KVSHYLKIKFCLDAAKAIEYLHS

SEQ ID NO: 2595903 - protein, 39 aa, Entamoeba histolytica
KVSSVILTVLQILVVLPEKDLYVLPNTQIPYQVFTTKRN

SEQ ID NO: 2595904 - protein, 32 aa, Entamoeba histolytica
KVSVIKLFKYSDWIDMILLVVGLISSIGNGVM

SEQ ID NO: 2595905 - protein, 19 aa, Entamoeba histolytica
KVSVLFTLFVLSPFVIFCC

SEQ ID NO: 2595906 - protein, 21 aa, Entamoeba histolytica
KVVKLPPLKFLFESDCFSVLQ

SEQ ID NO: 2595907 - protein, 17 aa, Entamoeba histolytica
KVVSWLSHYSHLILIQR

SEQ ID NO: 2595908 - protein, 21 aa, Entamoeba histolytica
KVYPLKCSDKYYYINRYLDSV

SEQ ID NO: 2595909 - protein, 18 aa, Entamoeba histolytica
KVYSLCGGLVISDLPEDQ

SEQ ID NO: 2595910 - protein, 26 aa, Entamoeba histolytica
KVYTMQYFIWWFVLLPFVVPKIIEGA

SEQ ID NO: 2595911 - protein, 27 aa, Entamoeba histolytica
KVYTMQYFIWWFVLLPFVVPKIIEGAL

SEQ ID NO: 2595912 - protein, 20 aa, Entamoeba histolytica
KWDRPYPENVFKYPWNIAEY

SEQ ID NO: 2595913 - protein, 19 aa, Entamoeba histolytica
KWHYFLLDFCYYTNFLLLV

SEQ ID NO: 2595914 - protein, 27 aa, Entamoeba histolytica
KWIIEGTPFLWYLLNTLLIISTPLCIL

SEQ ID NO: 2595915 - protein, 27 aa, Entamoeba histolytica
KWIKLPDAYIPIWRYIVYGIAMLICIG

SEQ ID NO: 2595916 - protein, 19 aa, Entamoeba histolytica
KWKQQYIYSISKDGELTFE

SEQ ID NO: 2595917 - protein, 18 aa, Entamoeba histolytica
KWKWGEYKQFHMIAYIND

SEQ ID NO: 2595918 - protein, 30 aa, Entamoeba histolytica
KWMKLPDAPVPIWRYFVFGTAMFCCLVLCI

SEQ ID NO: 2595919 - protein, 24 aa, Entamoeba histolytica
KWNDVFFYFLFNTAAICSVILAIY

SEQ ID NO: 2595920 - protein, 20 aa, Entamoeba histolytica
KWYCVVFVIVFIAFSMIVYF

SEQ ID NO: 2595921 - protein, 27 aa, Entamoeba histolytica
KYCIIITIIRFLFTPLRSIILRRYCFI

SEQ ID NO: 2595922 - protein, 24 aa, Entamoeba histolytica
KYFDDIDFCLYFNDSKEIATEYYT

SEQ ID NO: 2595923 - protein, 32 aa, Entamoeba histolytica
KYFNDLHRYFRLFPRMYLLVNSFYSIFDDTVS

SEQ ID NO: 2595924 - protein, 20 aa, Entamoeba histolytica
KYFRREYIFVRDFITGLSTK

SEQ ID NO: 2595925 - protein, 22 aa, Entamoeba histolytica
KYFYSFIGLLGLSYLVIGSLVL

SEQ ID NO: 2595926 - protein, 26 aa, Entamoeba histolytica
KYGGFLFYLVVIFQLGYFIYKIIDKK

SEQ ID NO: 2595927 - protein, 30 aa, Entamoeba histolytica
KYGSYETYYYDIELWYSLLARSKVPFLTFN

SEQ ID NO: 2595928 - protein, 20 aa, Entamoeba histolytica
KYGYVLYSPNGWNETIIDSV

SEQ ID NO: 2595929 - protein, 18 aa, Entamoeba histolytica
KYHPIVWVQLFVSAIFSI

SEQ ID NO: 2595930 - protein, 21 aa, Entamoeba histolytica
KYIELAKCIIFMIAGDEVKKT

SEQ ID NO: 2595931 - protein, 26 aa, Entamoeba histolytica
KYIGNTLSFLRRIILKKNPEQCLGVL

SEQ ID NO: 2595932 - protein, 18 aa, Entamoeba histolytica
KYIRVLVACLPQFKPNDL

SEQ ID NO: 2595933 - protein, 41 aa, Entamoeba histolytica
KYKNEVIGLLLLGFIYTVHCFFTIYCFFISIISTKSRQISK

SEQ ID NO: 2595934 - protein, 26 aa, Entamoeba histolytica
KYLEYPFIFSILPYNNIFFSSFQGWN

SEQ ID NO: 2595935 - protein, 21 aa, Entamoeba histolytica
KYLNCMLEHLSLIFTQRSCST

SEQ ID NO: 2595936 - protein, 19 aa, Entamoeba histolytica
KYLYQWLCTIQDNPEWYQF

SEQ ID NO: 2595937 - protein, 18 aa, Entamoeba histolytica
KYMMIIVHTPDNPKYVFH

SEQ ID NO: 2595938 - protein, 22 aa, Entamoeba histolytica
KYNFCPFFMMTFKASWEMFKQT

SEQ ID NO: 2595939 - protein, 29 aa, Entamoeba histolytica
KYNFLRKKTLYYKWIYPIAIAIDITLRFG

SEQ ID NO: 2595940 - protein, 28 aa, Entamoeba histolytica
KYNISLYSKYFYLIQLQTKENIASIILT

SEQ ID NO: 2595941 - protein, 19 aa, Entamoeba histolytica
KYNMLVLDTIFRTYFRVLK

SEQ ID NO: 2595942 - protein, 24 aa, Entamoeba histolytica
KYQQRILQIILRNSLNKQDVLMLS

SEQ ID NO: 2595943 - protein, 17 aa, Entamoeba histolytica
KYSIPSDLPYFPFGQDI

SEQ ID NO: 2595944 - protein, 35 aa, Entamoeba histolytica
KYSVYFNAGILILVTLISFFIGWHMVMAIGGADMP

SEQ ID NO: 2595945 - protein, 24 aa, Entamoeba histolytica
KYSYSPKAVYFLGGVLLVVIALLS

SEQ ID NO: 2595946 - protein, 34 aa, Entamoeba histolytica
KYTVTFVLLILIVFPFCYFIYYLFSITNDASEGG

SEQ ID NO: 2595947 - protein, 17 aa, Entamoeba histolytica
KYTWARRISLILGITYG

SEQ ID NO: 2595948 - protein, 25 aa, Entamoeba histolytica
KYVIKRYHHFFIIKTDAASSTHLDM

SEQ ID NO: 2595949 - protein, 29 aa, Entamoeba histolytica
KYWKRKSIVIILLVVLVLGIIGIIIGVCF

SEQ ID NO: 2595950 - protein, 20 aa, Entamoeba histolytica
KYYISNFFSYFGPLYILLVL

SEQ ID NO: 2595951 - protein, 31 aa, Entamoeba histolytica
LADLYDIESLYVIFFFILKNLKEETVQQWLV

SEQ ID NO: 2595952 - protein, 33 aa, Entamoeba histolytica; identical to SEQ ID NO: 2399098

SEQ ID NO: 2595953 - protein, 25 aa, Entamoeba histolytica
LAEVLLHFEQLIKKELWHINEEEIK

SEQ ID NO: 2595954 - protein, 19 aa, Entamoeba histolytica
LAEYMDLELMPLPSTNYSD

SEQ ID NO: 2595955 - protein, 17 aa, Entamoeba histolytica
LAFIVPHAKKECSSNID

SEQ ID NO: 2595956 - protein, 23 aa, Entamoeba histolytica
LAGHNVLALMPTGGGKSLCYQLP

SEQ ID NO: 2595957 - protein, 26 aa, Entamoeba histolytica
LAIGYEYFHFYYSPYFSQQVKFTNYC

SEQ ID NO: 2595958 - protein, 20 aa, Entamoeba histolytica
LAIILAITPNILKSFLGRYV

SEQ ID NO: 2595959 - protein, 19 aa, Entamoeba histolytica
LAITGVYPLTIKTLNRDKS

SEQ ID NO: 2595960 - protein, 22 aa, Entamoeba histolytica
LAIVIVEAFDRKCPYSMLGSSW

SEQ ID NO: 2595961 - protein, 17 aa, Entamoeba histolytica
LALILKSDTKIKFDLSL

SEQ ID NO: 2595962 - protein, 19 aa, Entamoeba histolytica
LALLLNLPQSSELFKMKLN

SEQ ID NO: 2595963 - protein, 17 aa, Entamoeba histolytica
LALSTSYIWTGANSNLF

SEQ ID NO: 2595964 - protein, 17 aa, Entamoeba histolytica
LANLSIAFFERFHRYFL

SEQ ID NO: 2595965 - protein, 17 aa, Entamoeba histolytica
LAPIPFGLISKFIKNRT

SEQ ID NO: 2595966 - protein, 18 aa, Entamoeba histolytica
LARSLLDLGLKKGDVVGF

SEQ ID NO: 2595967 - protein, 24 aa, Entamoeba histolytica
LASLTKFTFFGISSTLLLMIAIPT

SEQ ID NO: 2595968 - protein, 25 aa, Entamoeba histolytica
LASSYLDILLVVLAGFQDSLLHDNF

SEQ ID NO: 2595969 - protein, 27 aa, Entamoeba histolytica
LATIYIMSIMLRYMFNLNVLPKEFNEN

SEQ ID NO: 2595970 - protein, 18 aa, Entamoeba histolytica
LATNKLLDDILSVSFQKI

SEQ ID NO: 2595971 - protein, 22 aa, Entamoeba histolytica
LATTLVFLFRAEPYMKMHIQLF

SEQ ID NO: 2595972 - protein, 25 aa, Entamoeba histolytica
LATVILLMLWITLFTVMGFVKDPRN

SEQ ID NO: 2595973 - protein, 25 aa, Entamoeba histolytica
LAYVGFFQMFPTIIKGIYSALDNGS

SEQ ID NO: 2595974 - protein, 18 aa, Entamoeba histolytica
LCCVACFGVFIFQPTFSC

SEQ ID NO: 2595975 - protein, 25 aa, Entamoeba histolytica
LCDFSYCIVYLLTSFYPVLLSIFES

SEQ ID NO: 2595976 - protein, 17 aa, Entamoeba histolytica
LCDKCREGCNYCNSTHC

SEQ ID NO: 2595977 - protein, 17 aa, Entamoeba histolytica
LCDMFLQKTVHSNLCLC

SEQ ID NO: 2595978 - protein, 25 aa, Entamoeba histolytica
LCEQIHFFLPFHFINIEDNFVDIKF

SEQ ID NO: 2595979 - protein, 20 aa, Entamoeba histolytica
LCFFISPLIIFFSRSKLPLT

SEQ ID NO: 2595980 - protein, 17 aa, Entamoeba histolytica
LCFIAFSLVVYFTDWKM

SEQ ID NO: 2595981 - protein, 17 aa, Entamoeba histolytica
LCFIISKTPEENLICVG

SEQ ID NO: 2595982 - protein, 20 aa, Entamoeba histolytica
LCFLGIRINYLGLAIICFVM

SEQ ID NO: 2595983 - protein, 18 aa, Entamoeba histolytica
LCFLLVIVLGDNTNTTVD

SEQ ID NO: 2595984 - protein, 18 aa, Entamoeba histolytica
LCFVSLCFFPLDVIITLG

SEQ ID NO: 2595985 - protein, 24 aa, Entamoeba histolytica
LCGELFIGFSHLYYIIAKDPQELF

SEQ ID NO: 2595986 - protein, 17 aa, Entamoeba histolytica
LCIAYIIVILFFNFAGT

SEQ ID NO: 2595987 - protein, 19 aa, Entamoeba histolytica
LCIFNLIPFSLIYDVINIV

SEQ ID NO: 2595988 - protein, 31 aa, Entamoeba histolytica
LCISASIFSILFIIMVYFIAKKEPSVYLVGF

SEQ ID NO: 2595989 - protein, 18 aa, Entamoeba histolytica
LCKLLAIHEIPTEVFQKL

SEQ ID NO: 2595990 - protein, 18 aa, Entamoeba histolytica
LCKNVILHYHYFITIQTE

SEQ ID NO: 2595991 - protein, 26 aa, Entamoeba histolytica
LCLCVSIMFWILYFKSPSAVFRVSDD

SEQ ID NO: 2595992 - protein, 25 aa, Entamoeba histolytica
LCLLPLLIVILLIVLPSLISCIKKR

SEQ ID NO: 2595993 - protein, 26 aa, Entamoeba histolytica
LCLLPLLIVILLIVLPSLISCIKKRQ

SEQ ID NO: 2595994 - protein, 17 aa, Entamoeba histolytica
LCLVSCAVMVLLVIVEK

SEQ ID NO: 2595995 - protein, 20 aa, Entamoeba histolytica
LCLYRMCPIIPFTISNYILS

SEQ ID NO: 2595996 - protein, 23 aa, Entamoeba histolytica
LCNRFSLQITFLESLLDLDYSNQ

SEQ ID NO: 2595997 - protein, 25 aa, Entamoeba histolytica
LCPDPFTECLTSKTPVPGKLNLRSS

SEQ ID NO: 2595998 - protein, 21 aa, Entamoeba histolytica
LCPNNNLPLVLTTNSDDKINV

SEQ ID NO: 2595999 - protein, 20 aa, Entamoeba histolytica
LCPNNNLPLVLTTSSDDKIN

SEQ ID NO: 2596000 - protein, 21 aa, Entamoeba histolytica
LCQILLHFNLIYANSSKRNQN

SEQ ID NO: 2596001 - protein, 17 aa, Entamoeba histolytica
LCTLCCLAQNLTINIFH

SEQ ID NO: 2596002 - protein, 19 aa, Entamoeba histolytica
LCTTTIVDSLVLLGLDMKK

SEQ ID NO: 2596003 - protein, 17 aa, Entamoeba histolytica
LCVIFPMIILDVKSYID

SEQ ID NO: 2596004 - protein, 28 aa, Entamoeba histolytica
LCVYLINGHWKYYLDPISSLIVSLVMMV

SEQ ID NO: 2596005 - protein, 25 aa, Entamoeba histolytica
LCYNHNILGHWFRFVGNKTVSYQIK

SEQ ID NO: 2596006 - protein, 26 aa, Entamoeba histolytica
LCYNIPIIIFVFYFWIINGSDSCNII

SEQ ID NO: 2596007 - protein, 24 aa, Entamoeba histolytica
LDAFDSVMKITLGTTLIGAIIIIA

SEQ ID NO: 2596008 - protein, 25 aa, Entamoeba histolytica
LDAFDSVMKITLGTTLIGAIIIIAF

SEQ ID NO: 2596009 - protein, 20 aa, Entamoeba histolytica
LDAYYNALAKTTLYLLLSLN

SEQ ID NO: 2596010 - protein, 25 aa, Entamoeba histolytica
LDCSFNRIFSFPPILSLTSLNIISN

SEQ ID NO: 2596011 - protein, 24 aa, Entamoeba histolytica
LDDLIYKPLLLHSNSLHTEVDLIQ

SEQ ID NO: 2596012 - protein, 23 aa, Entamoeba histolytica
LDDTCTSLFYYAPTIKSCKCISI

SEQ ID NO: 2596013 - protein, 25 aa, Entamoeba histolytica
LDDYPKLKLIRYPRKPTEIVVYTDS

SEQ ID NO: 2596014 - protein, 20 aa, Entamoeba histolytica
LDEMKLVGLLLVYGIVHNKK

SEQ ID NO: 2596015 - protein, 21 aa, Entamoeba histolytica
LDHEHLYFLYLEINEEYAATI

SEQ ID NO: 2596016 - protein, 19 aa, Entamoeba histolytica
LDHFLYCNHLCIVTELLGC

SEQ ID NO: 2596017 - protein, 23 aa, Entamoeba histolytica
LDIRHFFNDYGLLNIYYNGWSAP

SEQ ID NO: 2596018 - protein, 20 aa, Entamoeba histolytica
LDIRWRYKLILSFCSSALIV

SEQ ID NO: 2596019 - protein, 22 aa, Entamoeba histolytica
LDKFRCDYIINFFGACCLKDHI

SEQ ID NO: 2596020 - protein, 29 aa, Entamoeba histolytica
LDKFRCDYVVYFYGAVFVPNKICIVTEFA

SEQ ID NO: 2596021 - protein, 28 aa, Entamoeba histolytica
LDKFRDEYIIHFYGAVFIPNKICIVTEY

SEQ ID NO: 2596022 - protein, 28 aa, Entamoeba histolytica
LDKFRDEYIIHFYGAVFIPNKICMVTEY

SEQ ID NO: 2596023 - protein, 29 aa, Entamoeba histolytica
LDKFRNDYIVHFYGAVFIPNKICMVMEFA

SEQ ID NO: 2596024 - protein, 28 aa, Entamoeba histolytica
LDKFRNEYIIHFYGAVFIPNKICMVTEF

SEQ ID NO: 2596025 - protein, 27 aa, Entamoeba histolytica
LDKFRNEYIIHFYGAVFIPSKICMVTE

SEQ ID NO: 2596026 - protein, 28 aa, Entamoeba histolytica
LDKFRNEYIIQFYGAVFIPNKICMVTEY

SEQ ID NO: 2596027 - protein, 28 aa, Entamoeba histolytica
LDKFRNEYLVHFYGAVFIPNKICMVNEF

SEQ ID NO: 2596028 - protein, 30 aa, Entamoeba histolytica
LDKFRSDYIIHFYGAIFIPNKICLVTEYAY

SEQ ID NO: 2596029 - protein, 28 aa, Entamoeba histolytica
LDKFRSDYIIHFYGAVFIPNKICMVTEY

SEQ ID NO: 2596030 - protein, 27 aa, Entamoeba histolytica
LDKFRSDYIIYFYGSVLFKNKRYLITE

SEQ ID NO: 2596031 - protein, 26 aa, Entamoeba histolytica
LDKFRSDYIVYFYGAVFIPSKMCIVT

SEQ ID NO: 2596032 - protein, 28 aa, Entamoeba histolytica
LDKFRSEYIIHFYGAVVIPGKVCMVTEF

SEQ ID NO: 2596033 - protein, 17 aa, Entamoeba histolytica
LDLYRTQLALRKKNHEE

SEQ ID NO: 2596034 - protein, 27 aa, Entamoeba histolytica
LDNGFRTFIIYFAFAVLINITRSCDSS

SEQ ID NO: 2596035 - protein, 20 aa, Entamoeba histolytica
LDNTSSVFICLAIIIGFLLF

SEQ ID NO: 2596036 - protein, 28 aa, Entamoeba histolytica
LDPCRMISIWFLSVLMYYIFNKKYGEPL

SEQ ID NO: 2596037 - protein, 26 aa, Entamoeba histolytica
LDSTTPWYYILAYLYVIVYGSSLLIT

SEQ ID NO: 2596038 - protein, 26 aa, Entamoeba histolytica
LDSYVMVLMIVAFYFDIPLPIRHPES

SEQ ID NO: 2596039 - protein, 18 aa, Entamoeba histolytica
LDTELKYVIKRYHHFFII

SEQ ID NO: 2596040 - protein, 29 aa, Entamoeba histolytica
LDYQISPKKALLRYLIKTPTQKISKMVKI

SEQ ID NO: 2596041 - protein, 17 aa, Entamoeba histolytica
LECSYTLLPYETLLRMN

SEQ ID NO: 2596042 - protein, 32 aa, Entamoeba histolytica
LEDLYDIESLYVIFFFILKNLRETTIQQWLVS

SEQ ID NO: 2596043 - protein, 24 aa, Entamoeba histolytica
LEDPLLVLSPLNQNLFVQLLDAIF

SEQ ID NO: 2596044 - protein, 19 aa, Entamoeba histolytica
LEDVDLNIFFGTNETLFTP

SEQ ID NO: 2596045 - protein, 17 aa, Entamoeba histolytica
LEFCQNKMIVALHKQFP

SEQ ID NO: 2596046 - protein, 25 aa, Entamoeba histolytica
LEHVPYLFVIIYGLSFFFQNMGPNT

SEQ ID NO: 2596047 - protein, 28 aa, Entamoeba histolytica
LEIASGMPEWYFLIIQNCWKQNPSERYN

SEQ ID NO: 2596048 - protein, 18 aa, Entamoeba histolytica
LEIIHIVILLIGTCISYK

SEQ ID NO: 2596049 - protein, 19 aa, Entamoeba histolytica
LEIILLLREILQSQLTIYS

SEQ ID NO: 2596050 - protein, 18 aa, Entamoeba histolytica
LEIITWKDSFPKESYPHP

SEQ ID NO: 2596051 - protein, 28 aa, Entamoeba histolytica
LEKSSRVFGFFPLEFFGPPIVVLFMAIS

SEQ ID NO: 2596052 - protein, 20 aa, Entamoeba histolytica
LELWSLFDFLMPGFLGTEKE

SEQ ID NO: 2596053 - protein, 26 aa, Entamoeba histolytica
LELYDPIQFLTLWSKSISFIPMKAFI

SEQ ID NO: 2596054 - protein, 22 aa, Entamoeba histolytica
LELYVPFLFVFVHLITSPNGDD

SEQ ID NO: 2596055 - protein, 25 aa, Entamoeba histolytica
LENLKFIHFTVYGTVAVFGNQYIDF

SEQ ID NO: 2596056 - protein, 25 aa, Entamoeba histolytica
LEQLVIKYPNFFDDITLVSGTQLSS

SEQ ID NO: 2596057 - protein, 30 aa, Entamoeba histolytica; identical to SEQ ID NO: 2399193

SEQ ID NO: 2596058 - protein, 23 aa, Entamoeba histolytica
LERFYTFFISYFFQLTTKTDIHF

SEQ ID NO: 2596059 - protein, 25 aa, Entamoeba histolytica
LERNKVFHFIAIPFVFDKIKNKIPS

SEQ ID NO: 2596060 - protein, 23 aa, Entamoeba histolytica
LESKLWKYLCPFVSFSMKQKNII

SEQ ID NO: 2596061 - protein, 30 aa, Entamoeba histolytica
LESLLKLLGLIYDILPYFIKTSRDVLLLDY

SEQ ID NO: 2596062 - protein, 24 aa, Entamoeba histolytica
LETPFVSLNFLKFKSQQLLVEVFN

SEQ ID NO: 2596063 - protein, 18 aa, Entamoeba histolytica
LEVFMYEPMDLEAPILTG

SEQ ID NO: 2596064 - protein, 17 aa, Entamoeba histolytica
LEVNPVRQTLKAGFGIE

SEQ ID NO: 2596065 - protein, 26 aa, Entamoeba histolytica
LEVSCLPLFDLLSLPNLRRLEIRAGR

SEQ ID NO: 2596066 - protein, 19 aa, Entamoeba histolytica
LEYIGPLVLYFIPFFILKF

SEQ ID NO: 2596067 - protein, 19 aa, Entamoeba histolytica
LFALSLGFILFFYSSFTSE

SEQ ID NO: 2596068 - protein, 19 aa, Entamoeba histolytica
LFATIIICGGILISISGGS

SEQ ID NO: 2596069 - protein, 18 aa, Entamoeba histolytica
LFCLQCAENFYFVSSNTC

SEQ ID NO: 2596070 - protein, 24 aa, Entamoeba histolytica
LFCTTKIMGMKIPYTIYFSKKKET

SEQ ID NO: 2596071 - protein, 25 aa, Entamoeba histolytica
LFDDLTFDLTLPPRAFITSQELLMN

SEQ ID NO: 2596072 - protein, 20 aa, Entamoeba histolytica
LFEEPFQKFIYTIAIQASHY

SEQ ID NO: 2596073 - protein, 22 aa, Entamoeba histolytica
LFEFWAHLLYICKYGHMSSSMV

SEQ ID NO: 2596074 - protein, 20 aa, Entamoeba histolytica
LFFFISFCISDYCKKIEPNS

SEQ ID NO: 2596075 - protein, 17 aa, Entamoeba histolytica
LFFINKLPEITFFIFNL

SEQ ID NO: 2596076 - protein, 20 aa, Entamoeba histolytica
LFFNHGIWHLIVWFANFQHS

SEQ ID NO: 2596077 - protein, 20 aa, Entamoeba histolytica
LFFYCFYIKMNWIQSHPFLL

SEQ ID NO: 2596078 - protein, 23 aa, Entamoeba histolytica
LFGTLILLVVFNKALPALPISIF

SEQ ID NO: 2596079 - protein, 25 aa, Entamoeba histolytica
LFHIGLLYLFIYCSNADEGIVCYWK

SEQ ID NO: 2596080 - protein, 17 aa, Entamoeba histolytica
LFIGYLTEKVPNLEQWA

SEQ ID NO: 2596081 - protein, 24 aa, Entamoeba histolytica
LFIIVFLILLINESCFGKKCQCGD

SEQ ID NO: 2596082 - protein, 19 aa, Entamoeba histolytica
LFIKKYEIFVQYSVDLKLL

SEQ ID NO: 2596083 - protein, 18 aa, Entamoeba histolytica
LFINLVSSQFLSIKSHID

SEQ ID NO: 2596084 - protein, 17 aa, Entamoeba histolytica
LFINTIIYFFIGSLYLI

SEQ ID NO: 2596085 - protein, 30 aa, Entamoeba histolytica
LFISRLCIPPIIQFFHLLNNTPELILCLAS

SEQ ID NO: 2596086 - protein, 17 aa, Entamoeba histolytica
LFISTCIGSCWMSQEEL

SEQ ID NO: 2596087 - protein, 28 aa, Entamoeba histolytica
LFITSLQILIICILKFRTNLKTEIALLL

SEQ ID NO: 2596088 - protein, 18 aa, Entamoeba histolytica
LFIYSITNAQITVNFDEI

SEQ ID NO: 2596089 - protein, 23 aa, Entamoeba histolytica
LFKEDIVRIWKYLWKFIDISVDI

SEQ ID NO: 2596090 - protein, 17 aa, Entamoeba histolytica
LFKMISDKKIKRGTMVV

SEQ ID NO: 2596091 - protein, 17 aa, Entamoeba histolytica
LFKTYQLVSSAMKNAIT

SEQ ID NO: 2596092 - protein, 17 aa, Entamoeba histolytica
LFLCGLNFKYYGIVRSC

SEQ ID NO: 2596093 - protein, 18 aa, Entamoeba histolytica
LFLIIFHSVYSWTSSFFV

SEQ ID NO: 2596094 - protein, 22 aa, Entamoeba histolytica
LFLLFTIFCDAFCLQEAMIGVI

SEQ ID NO: 2596095 - protein, 22 aa, Entamoeba histolytica
LFLLLFDIILLYRKLILGWYSI

SEQ ID NO: 2596096 - protein, 20 aa, Entamoeba histolytica
LFLLLICFVYGGITEEVYNQ

SEQ ID NO: 2596097 - protein, 20 aa, Entamoeba histolytica
LFLLVMVILGFIVFVLLHYV

SEQ ID NO: 2596098 - protein, 24 aa, Entamoeba histolytica
LFLSFTFILLPMKFAKLFTVGNIL

SEQ ID NO: 2596099 - protein, 18 aa, Entamoeba histolytica
LFLVGALSNYLKNPSFEE

SEQ ID NO: 2596100 - protein, 18 aa, Entamoeba histolytica
LFLVVISFSLFLLYHLSD

SEQ ID NO: 2596101 - protein, 23 aa, Entamoeba histolytica
LFLVYIAFFVLLESIHRLIHPSD

SEQ ID NO: 2596102 - protein, 24 aa, Entamoeba histolytica
LFNFASYFYWLVVPLKCVDMGGST

SEQ ID NO: 2596103 - protein, 17 aa, Entamoeba histolytica
LFNLDHYLNPKPAPQKH

SEQ ID NO: 2596104 - protein, 17 aa, Entamoeba histolytica
LFNTFKEEECLSSYTPL

SEQ ID NO: 2596105 - protein, 18 aa, Entamoeba histolytica
LFPFSNLPRHLLVAFLYN

SEQ ID NO: 2596106 - protein, 32 aa, Entamoeba histolytica
LFQEYNLFIKFIPFINAYLFPLTTDIETLNHF

SEQ ID NO: 2596107 - protein, 19 aa, Entamoeba histolytica
LFQICSCPIFVYIKKPDLF

SEQ ID NO: 2596108 - protein, 17 aa, Entamoeba histolytica
LFSLEYPATINAKLTDF

SEQ ID NO: 2596109 - protein, 25 aa, Entamoeba histolytica
LFSLKKEVIPIKLRIKFMIDAANGI

SEQ ID NO: 2596110 - protein, 18 aa, Entamoeba histolytica
LFSLVPMIVDMICKIKMD

SEQ ID NO: 2596111 - protein, 27 aa, Entamoeba histolytica
LFSPFLPITIFLYPATLPLLLPLLPSL

SEQ ID NO: 2596112 - protein, 20 aa, Entamoeba histolytica
LFTLFVLSPFVIFCCVGVFD

SEQ ID NO: 2596113 - protein, 20 aa, Entamoeba histolytica
LFTLIIATPISCNSYQSQTE

SEQ ID NO: 2596114 - protein, 23 aa, Entamoeba histolytica
LFVHIVDRPLVPGRFKILNKHIT

SEQ ID NO: 2596115 - protein, 17 aa, Entamoeba histolytica
LFVRMVIVPIICIGIHF

SEQ ID NO: 2596116 - protein, 18 aa, Entamoeba histolytica
LFYNILNCFGYDVIGTGC

SEQ ID NO: 2596117 - protein, 18 aa, Entamoeba histolytica
LFYPIIEIATCKFSDLFI

SEQ ID NO: 2596118 - protein, 23 aa, Entamoeba histolytica
LFYTFILCTLLFVLTIFILYIVI

SEQ ID NO: 2596119 - protein, 26 aa, Entamoeba histolytica
LGAVMFFIMGAFSLGSWYASVVLRGK

SEQ ID NO: 2596120 - protein, 27 aa, Entamoeba histolytica
LGAYLKLIGILKPYKKYCFIQNYIIGV

SEQ ID NO: 2596121 - protein, 18 aa, Entamoeba histolytica
LGCCLASVWTPFQKKSSC

SEQ ID NO: 2596122 - protein, 28 aa, Entamoeba histolytica
LGCCLFIRVIPVEDLIILLSALVLQRKL

SEQ ID NO: 2596123 - protein, 21 aa, Entamoeba histolytica
LGCFRCEDGFFLDLKGSCSPC

SEQ ID NO: 2596124 - protein, 17 aa, Entamoeba histolytica
LGEEILNWARKTSFLEC

SEQ ID NO: 2596125 - protein, 24 aa, Entamoeba histolytica
LGETTSLCDYYLFKEGYALCQKCK

SEQ ID NO: 2596126 - protein, 22 aa, Entamoeba histolytica
LGEVSLFYYLPNLFYLSNGTTI

SEQ ID NO: 2596127 - protein, 18 aa, Entamoeba histolytica
LGFGWLLKAAQQGNVKGM

SEQ ID NO: 2596128 - protein, 17 aa, Entamoeba histolytica
LGFVRSKCPTTNFIINS

SEQ ID NO: 2596129 - protein, 36 aa, Entamoeba histolytica
LGIATAIVIIFLIIMTFLTWFFVSRCWKNKYTESEI

SEQ ID NO: 2596130 - protein, 24 aa, Entamoeba histolytica
LGIDVLWCFFIGISVFYSFTISIS

SEQ ID NO: 2596131 - protein, 21 aa, Entamoeba histolytica
LGIGFVFIAVVVVVLYLIFEL

SEQ ID NO: 2596132 - protein, 25 aa, Entamoeba histolytica
LGIILPDTIYLLTLISLVMCYKQRL

SEQ ID NO: 2596133 - protein, 17 aa, Entamoeba histolytica
LGIIQYSYSNECTCTVS

SEQ ID NO: 2596134 - protein, 29 aa, Entamoeba histolytica
LGISLTSALMLCQIADFIQFPLQIHSIGI

SEQ ID NO: 2596135 - protein, 21 aa, Entamoeba histolytica
LGITNLWYHFIPNENRFFHVP

SEQ ID NO: 2596136 - protein, 24 aa, Entamoeba histolytica
LGIVSFCFVIFDIAGLYGCIAHNF

SEQ ID NO: 2596137 - protein, 34 aa, Entamoeba histolytica
LGKPCYLMYMQLIGYLLLIGMELYDKIYNDATIL

SEQ ID NO: 2596138 - protein, 27 aa, Entamoeba histolytica
LGLFAFNFYLRPKLVPVLIGYMLSIIP

SEQ ID NO: 2596139 - protein, 29 aa, Entamoeba histolytica
LGLGFSIITFFMIASYALGSWYGSLVIRG

SEQ ID NO: 2596140 - protein, 29 aa, Entamoeba histolytica
LGLGFSVITFFMIASYALGSWYGSLVIRG

SEQ ID NO: 2596141 - protein, 18 aa, Entamoeba histolytica
LGLLFYLVPCVETYVCVN

SEQ ID NO: 2596142 - protein, 31 aa, Entamoeba histolytica
LGLQKMLCLISYFFVMILYPEKNEKVHFIRK

SEQ ID NO: 2596143 - protein, 26 aa, Entamoeba histolytica
LGLSRLYYFLNPNNVEYFFAPYLSMK

SEQ ID NO: 2596144 - protein, 19 aa, Entamoeba histolytica
LGMFGISPIILGSFKCTVM

SEQ ID NO: 2596145 - protein, 17 aa, Entamoeba histolytica
LGNPLKGFGMWYGSGNT

SEQ ID NO: 2596146 - protein, 27 aa, Entamoeba histolytica
LGPDDAIFPIYRLPKDQIKKEYPTEKE

SEQ ID NO: 2596147 - protein, 25 aa, Entamoeba histolytica
LGRRIPIINIFLSPFVFASLVVMCD

SEQ ID NO: 2596148 - protein, 18 aa, Entamoeba histolytica
LGSLFFKRGNVLRKILSN

SEQ ID NO: 2596149 - protein, 29 aa, Entamoeba histolytica
LGSLTTLLFFYKPLVRIFGLRLTYVMTII

SEQ ID NO: 2596150 - protein, 28 aa, Entamoeba histolytica
LGTILFALLVFLLPTSIIYYLYFTFVLM

SEQ ID NO: 2596151 - protein, 31 aa, Entamoeba histolytica
LGTILFNCRLSLYLPLFLKQFIPIIEQIQLY

SEQ ID NO: 2596152 - protein, 21 aa, Entamoeba histolytica
LGTWFHLTICLYPNQPILCFV

SEQ ID NO: 2596153 - protein, 18 aa, Entamoeba histolytica
LGTWYRVIAPHDGTFYLL

SEQ ID NO: 2596154 - protein, 19 aa, Entamoeba histolytica
LGVFTRMVLFTAAVSLIFT

SEQ ID NO: 2596155 - protein, 21 aa, Entamoeba histolytica
LGWGIFTLIAAGLWIGVVFVG

SEQ ID NO: 2596156 - protein, 23 aa, Entamoeba histolytica
LGYAILPFIYLPKKVYIIPMLAV

SEQ ID NO: 2596157 - protein, 21 aa, Entamoeba histolytica
LGYIHDFVNRMYAMMVDKNCD

SEQ ID NO: 2596158 - protein, 19 aa, Entamoeba histolytica
LHCFINYSFILLALTIAFF

SEQ ID NO: 2596159 - protein, 19 aa, Entamoeba histolytica
LHCTTKIFGLKIHVSCYFS

SEQ ID NO: 2596160 - protein, 23 aa, Entamoeba histolytica
LHCTTKIMGMKIPYTVWFSKHSK

SEQ ID NO: 2596161 - protein, 21 aa, Entamoeba histolytica
LHDGFLDISLLHISQFPLTSQ

SEQ ID NO: 2596162 - protein, 25 aa, Entamoeba histolytica
LHEEYLPYLYSIINQVILILDTRCT

SEQ ID NO: 2596163 - protein, 32 aa, Entamoeba histolytica
LHEKKWLNIFFNWIPEMVFMICSFGYLCFLII

SEQ ID NO: 2596164 - protein, 18 aa, Entamoeba histolytica
LHFAARLPFSYYYFVSFL

SEQ ID NO: 2596165 - protein, 29 aa, Entamoeba histolytica
LHFVSVLVLFFFSFLYCLTKKVSWQPIPS

SEQ ID NO: 2596166 - protein, 26 aa, Entamoeba histolytica
LHIHLPYGQRISNWFKMLFTSIAHPC

SEQ ID NO: 2596167 - protein, 29 aa, Entamoeba histolytica
LHILCPLLLLIFIYLPLRKHYTLGYTVLA

SEQ ID NO: 2596168 - protein, 45 aa, Entamoeba histolytica
LHISPKLHWKFTFTVSLFILSFILTIICSILLTIFQPFISLNIRE

SEQ ID NO: 2596169 - protein, 19 aa, Entamoeba histolytica
LHKAFFMMSGEFLTYRVRK

SEQ ID NO: 2596170 - protein, 28 aa, Entamoeba histolytica
LHKIYYQHPFFINPFMPLFPEYSVIFTV

SEQ ID NO: 2596171 - protein, 27 aa, Entamoeba histolytica
LHLESNNGIWYIISSYEGRFNKITTQT

SEQ ID NO: 2596172 - protein, 18 aa, Entamoeba histolytica
LHLKPRLKIKFMIDTAKG

SEQ ID NO: 2596173 - protein, 24 aa, Entamoeba histolytica
LHNSNLFILKTFTISSSGVYVNPV

SEQ ID NO: 2596174 - protein, 19 aa, Entamoeba histolytica
LHQFVYFYEINVPTISPMT

SEQ ID NO: 2596175 - protein, 23 aa, Entamoeba histolytica
LHQIILLKPSEIFVAAAIGIQCV

SEQ ID NO: 2596176 - protein, 18 aa, Entamoeba histolytica
LHQNQILHRDVKGENLLI

SEQ ID NO: 2596177 - protein, 28 aa, Entamoeba histolytica
LHRDVKGENLLIFSLNPHSPVCAKLTDF

SEQ ID NO: 2596178 - protein, 20 aa, Entamoeba histolytica
LIACIYLVFSNKFLLPSHVK

SEQ ID NO: 2596179 - protein, 20 aa, Entamoeba histolytica
LIAKVIGLVFVLGGGMWAGK

SEQ ID NO: 2596180 - protein, 28 aa, Entamoeba histolytica
LIATNHIWPLTFVSVPPLEALKPIIVMF

SEQ ID NO: 2596181 - protein, 19 aa, Entamoeba histolytica
LICINCYNGFGISKDLKTC

SEQ ID NO: 2596182 - protein, 19 aa, Entamoeba histolytica
LICLLSCIIVIRYKSLRDE

SEQ ID NO: 2596183 - protein, 38 aa, Entamoeba histolytica
LIDINDFIFLIQYYINCISLISFYYFTSQWNISSFCNK

SEQ ID NO: 2596184 - protein, 18 aa, Entamoeba histolytica
LIEELTTLKFIIINKPLN

SEQ ID NO: 2596185 - protein, 18 aa, Entamoeba histolytica
LIELKKTYFSIEDYPIFL

SEQ ID NO: 2596186 - protein, 17 aa, Entamoeba histolytica
LIEPNDNLPTEPLFGVF

SEQ ID NO: 2596187 - protein, 29 aa, Entamoeba histolytica
LIERCRENFVLGNWFYWYLTVECGCTNGD

SEQ ID NO: 2596188 - protein, 22 aa, Entamoeba histolytica
LIFCFAGWYYLVHHQRVSDLEL

SEQ ID NO: 2596189 - protein, 23 aa, Entamoeba histolytica
LIFGPNIKSIYINKLTTDKPLTL

SEQ ID NO: 2596190 - protein, 18 aa, Entamoeba histolytica
LIFHRLLILQTCIDSYII

SEQ ID NO: 2596191 - protein, 22 aa, Entamoeba histolytica
LIFIHLFVFYMCYVIYIFITLL

SEQ ID NO: 2596192 - protein, 20 aa, Entamoeba histolytica
LIFIILFTNAEKRQITTVQT

SEQ ID NO: 2596193 - protein, 26 aa, Entamoeba histolytica
LIFPEKFFVLYISVAIWPFCTAFYWP

SEQ ID NO: 2596194 - protein, 25 aa, Entamoeba histolytica
LIFSFLITLFLFQVIISPSKTSFDV

SEQ ID NO: 2596195 - protein, 19 aa, Entamoeba histolytica
LIFTYFMPAIVFYQTATAI

SEQ ID NO: 2596196 - protein, 22 aa, Entamoeba histolytica
LIFVPFVIPLFYKKTPLQEDQY

SEQ ID NO: 2596197 - protein, 20 aa, Entamoeba histolytica
LIGFNWMHLASVVEYLITAI

SEQ ID NO: 2596198 - protein, 23 aa, Entamoeba histolytica
LIGLLRGILRRRKDLKVVVMSAT

SEQ ID NO: 2596199 - protein, 19 aa, Entamoeba histolytica
LIGMYAYLDILQSPLKEDQ

SEQ ID NO: 2596200 - protein, 18 aa, Entamoeba histolytica
LIICIHAKAYDCIPSGDK

SEQ ID NO: 2596201 - protein, 18 aa, Entamoeba histolytica
LIICIHAKAYDCNPSGDK

SEQ ID NO: 2596202 - protein, 17 aa, Entamoeba histolytica
LIICIHAKAYDCNQSGN

SEQ ID NO: 2596203 - protein, 24 aa, Entamoeba histolytica
LIICIVFSSFHVIALIALISAISL

SEQ ID NO: 2596204 - protein, 24 aa, Entamoeba histolytica
LIIFFYFAWSYAFTQNFKFISTKQ

SEQ ID NO: 2596205 - protein, 18 aa, Entamoeba histolytica
LIIIVGILIIISLVGSRA

SEQ ID NO: 2596206 - protein, 18 aa, Entamoeba histolytica
LIILLIIESLQYPHHLFL

SEQ ID NO: 2596207 - protein, 22 aa, Entamoeba histolytica
LIIMGSLIYGMILGAVTGFYQM

SEQ ID NO: 2596208 - protein, 26 aa, Entamoeba histolytica
LIIQKEYIHLIIFNTLIINQWESTPT

SEQ ID NO: 2596209 - protein, 24 aa, Entamoeba histolytica
LIISPRIIFKFLSVSLAFIMFIYL

SEQ ID NO: 2596210 - protein, 32 aa, Entamoeba histolytica
LIITGTIIVLIFIILLFILLSCFIKSKKVDIE

SEQ ID NO: 2596211 - protein, 20 aa, Entamoeba histolytica
LIITLTIVFAGKYIPFLDAP

SEQ ID NO: 2596212 - protein, 18 aa, Entamoeba histolytica
LIIYSLADNVYFYKDGAL

SEQ ID NO: 2596213 - protein, 27 aa, Entamoeba histolytica
LIKDFLVIFFLIIITRTSFFWGRIYKK

SEQ ID NO: 2596214 - protein, 18 aa, Entamoeba histolytica
LIKGFWFRIKGAEQTIVI

SEQ ID NO: 2596215 - protein, 19 aa, Entamoeba histolytica
LIKKNWFYLFGTAGCWFFF

SEQ ID NO: 2596216 - protein, 18 aa, Entamoeba histolytica
LIKYKKIKSLLSTFIQPI

SEQ ID NO: 2596217 - protein, 21 aa, Entamoeba histolytica
LILCFVGWYFLTKTQSISSLE

SEQ ID NO: 2596218 - protein, 18 aa, Entamoeba histolytica
LILCLIIKLVMIASAIIF

SEQ ID NO: 2596219 - protein, 37 aa, Entamoeba histolytica
LILEGWWFLVMACAVVVISFLWYLARPCLGGVRGTQG

SEQ ID NO: 2596220 - protein, 17 aa, Entamoeba histolytica
LILFIRIERNIRKRNSE

SEQ ID NO: 2596221 - protein, 20 aa, Entamoeba histolytica
LILFLQYYIHQHHDPFFLDF

SEQ ID NO: 2596222 - protein, 27 aa, Entamoeba histolytica
LILGIIVIYIFWLVFGIIRTYSESRKL

SEQ ID NO: 2596223 - protein, 21 aa, Entamoeba histolytica
LILIASAVVSLILAFIVPHAK

SEQ ID NO: 2596224 - protein, 18 aa, Entamoeba histolytica
LILKNSKVLFTSEQKFKR

SEQ ID NO: 2596225 - protein, 30 aa, Entamoeba histolytica
LILLASRITALFYYNVFLTTWGRSIRPKLG

SEQ ID NO: 2596226 - protein, 20 aa, Entamoeba histolytica
LILLVLHYIGVDFLLDALHF

SEQ ID NO: 2596227 - protein, 36 aa, Entamoeba histolytica
LILNIVLGQRPPLINSIPVPCKELLLSCWKINTERL

SEQ ID NO: 2596228 - protein, 34 aa, Entamoeba histolytica
LILRILNMLFLYKIPIKIRLLFSTIFNLVGLFGM

SEQ ID NO: 2596229 - protein, 19 aa, Entamoeba histolytica
LILTILSFNIEISSLFATL

SEQ ID NO: 2596230 - protein, 30 aa, Entamoeba histolytica
LIMDVICLPLYFIYRPIYQWIFQRVTEVYM

SEQ ID NO: 2596231 - protein, 27 aa, Entamoeba histolytica
LIMTAVYIIFFTLLAAVTYILHISPKL

SEQ ID NO: 2596232 - protein, 18 aa, Entamoeba histolytica
LINGLLFYMYVLFDTLDG

SEQ ID NO: 2596233 - protein, 21 aa, Entamoeba histolytica
LINIFFFICLTNGCQCIIYSN

SEQ ID NO: 2596234 - protein, 17 aa, Entamoeba histolytica
LIPFDNLPRHLLVAFLY

SEQ ID NO: 2596235 - protein, 17 aa, Entamoeba histolytica
LIPTFFTVFIFFVSCCP

SEQ ID NO: 2596236 - protein, 20 aa, Entamoeba histolytica
LIPTLLMFFAISKLLGFTLS

SEQ ID NO: 2596237 - protein, 31 aa, Entamoeba histolytica
LIQQYPIFHTYILNSFPFIPLKISHDFTVEG

SEQ ID NO: 2596238 - protein, 17 aa, Entamoeba histolytica
LIRCEPFSHFGIELQGG

SEQ ID NO: 2596239 - protein, 17 aa, Entamoeba histolytica
LIRSFGIAFSSFKSPHA

SEQ ID NO: 2596240 - protein, 22 aa, Entamoeba histolytica
LIRYSALFISILIPFVLGSISS

SEQ ID NO: 2596241 - protein, 31 aa, Entamoeba histolytica
LISFTLDIILLFLTLLFSVLIIISHWKKPCL

SEQ ID NO: 2596242 - protein, 18 aa, Entamoeba histolytica
LISFVLFPRMPRNRSDIT

SEQ ID NO: 2596243 - protein, 30 aa, Entamoeba histolytica
LISIHQIMRFLLMISYVYPSLVFTDGPFFP

SEQ ID NO: 2596244 - protein, 17 aa, Entamoeba histolytica
LISISLAECDSNQYLNN

SEQ ID NO: 2596245 - protein, 18 aa, Entamoeba histolytica
LISLLNIIDTMFASSNPK

SEQ ID NO: 2596246 - protein, 18 aa, Entamoeba histolytica
LISLLYIGVFAFVGVFCG

SEQ ID NO: 2596247 - protein, 25 aa, Entamoeba histolytica
LISNTFCIILLHKELKGHLWVLVVG

SEQ ID NO: 2596248 - protein, 17 aa, Entamoeba histolytica
LISQLLEKTIKSIVGQE

SEQ ID NO: 2596249 - protein, 18 aa, Entamoeba histolytica
LISRIFQTKIKIIEWLNS

SEQ ID NO: 2596250 - protein, 23 aa, Entamoeba histolytica
LISSPFFEGMFFEAINSIEFNCD

SEQ ID NO: 2596251 - protein, 26 aa, Entamoeba histolytica
LISYVYLYIVVYFWQKHTIKIYANPK

SEQ ID NO: 2596252 - protein, 25 aa, Entamoeba histolytica
LITETYIILSILLFIISFNQMRKVS

SEQ ID NO: 2596253 - protein, 20 aa, Entamoeba histolytica
LITGWFRLCGGIYNIVEIIP

SEQ ID NO: 2596254 - protein, 31 aa, Entamoeba histolytica
LITLYSFVHFIILLIFYFVDIEEHWGLMLCG

SEQ ID NO: 2596255 - protein, 18 aa, Entamoeba histolytica
LITRAYDLTFALYVNDVF

SEQ ID NO: 2596256 - protein, 24 aa, Entamoeba histolytica
LITRGVFCFIRKSGNIYALLNNEE

SEQ ID NO: 2596257 - protein, 27 aa, Entamoeba histolytica
LITSLKFLQLIIYKTLPKSGPVSADVF

SEQ ID NO: 2596258 - protein, 37 aa, Entamoeba histolytica
LITSVNGESLLLFNLNDYKFYYIQYSCPKTISTETQS

SEQ ID NO: 2596259 - protein, 22 aa, Entamoeba histolytica
LITVFSLYILSIIILPICVWTF

SEQ ID NO: 2596260 - protein, 23 aa, Entamoeba histolytica
LIVDGQLILYLQSFARYLVSVLQ

SEQ ID NO: 2596261 - protein, 27 aa, Entamoeba histolytica
LIVGFSFFLLLVVGIIFIYLIGGSLNS

SEQ ID NO: 2596262 - protein, 23 aa, Entamoeba histolytica
LIVMIPFCVFIYRFEWTLDNNQV

SEQ ID NO: 2596263 - protein, 19 aa, Entamoeba histolytica
LIVQLLITLIFISINGKLN

SEQ ID NO: 2596264 - protein, 26 aa, Entamoeba histolytica
LIVSIVLFIFFIIKYRVYKKNEVILA

SEQ ID NO: 2596265 - protein, 25 aa, Entamoeba histolytica
LIVSPTLNIIPWELLEPFKNCVRYF

SEQ ID NO: 2596266 - protein, 29 aa, Entamoeba histolytica
LIVTSWGCAVGEYYYNFFRGCWDCSDESF

SEQ ID NO: 2596267 - protein, 20 aa, Entamoeba histolytica
LIVVIIISFFIGWHMVMAIG

SEQ ID NO: 2596268 - protein, 21 aa, Entamoeba histolytica
LIVVIIISFFIGWHMVMAIGG

SEQ ID NO: 2596269 - protein, 21 aa, Entamoeba histolytica
LIWYCVAIPSIKLIENFPYKE

SEQ ID NO: 2596270 - protein, 18 aa, Entamoeba histolytica
LIYKSTPQFKSKYIEILG

SEQ ID NO: 2596271 - protein, 19 aa, Entamoeba histolytica
LIYSMFLAIQILSEEYESN

SEQ ID NO: 2596272 - protein, 18 aa, Entamoeba histolytica
LKAFGISLFFLSALGIRM

SEQ ID NO: 2596273 - protein, 24 aa, Entamoeba histolytica
LKALQMLWVNMIMDTLAALALGTE

SEQ ID NO: 2596274 - protein, 17 aa, Entamoeba histolytica
LKCFAYENGKEIDSFVL

SEQ ID NO: 2596275 - protein, 22 aa, Entamoeba histolytica
LKCITLYIHLLMERLITETQFV

SEQ ID NO: 2596276 - protein, 36 aa, Entamoeba histolytica; identical to SEQ ID NO: 2399422

SEQ ID NO: 2596277 - protein, 29 aa, Entamoeba histolytica
LKEYPQKPFTLYLIKRPAIVNLQNIVKRQ

SEQ ID NO: 2596278 - protein, 20 aa, Entamoeba histolytica
LKGFLWGYVAIILGIIATLL

SEQ ID NO: 2596279 - protein, 17 aa, Entamoeba histolytica
LKGINKWLLYDSEFQLP

SEQ ID NO: 2596280 - protein, 42 aa, Entamoeba histolytica
LKHLGMAPEIYRYFKVILITMQIILLSPLIYNELKKKIKEFN

SEQ ID NO: 2596281 - protein, 31 aa, Entamoeba histolytica
LKHQNLFFIRFLFILLLTFHCSFTVFLGSRR

SEQ ID NO: 2596282 - protein, 18 aa, Entamoeba histolytica
LKINGVLLQYLLFCSELY

SEQ ID NO: 2596283 - protein, 29 aa, Entamoeba histolytica
LKIQISVHIFFLVAIVVTIIFIIMIICYL

SEQ ID NO: 2596284 - protein, 26 aa, Entamoeba histolytica
LKKEFKKTMLKAFKKVQMNYIQNESN

SEQ ID NO: 2596285 - protein, 17 aa, Entamoeba histolytica
LKKIKAYFHITNFGKRL

SEQ ID NO: 2596286 - protein, 20 aa, Entamoeba histolytica
LKKKYVFQLFVGNKSLNICS

SEQ ID NO: 2596287 - protein, 23 aa, Entamoeba histolytica
LKLHAQLLVFTPTCGISLESILE

SEQ ID NO: 2596288 - protein, 20 aa, Entamoeba histolytica
LKLILLNPNKKVFSLYIIFI

SEQ ID NO: 2596289 - protein, 22 aa, Entamoeba histolytica
LKLLNNPDLCLVSCAVMVLLVI

SEQ ID NO: 2596290 - protein, 20 aa, Entamoeba histolytica
LKLLVRLLIHFISVMDDKQS

SEQ ID NO: 2596291 - protein, 30 aa, Entamoeba histolytica
LKNLKVLSLIGNPLIFYPRSLESCCDVSIQ

SEQ ID NO: 2596292 - protein, 20 aa, Entamoeba histolytica
LKNYSLKKLLQLGITQKDAE

SEQ ID NO: 2596293 - protein, 26 aa, Entamoeba histolytica
LKPGKNYFIFLTTNNLQQVQLRMDVK

SEQ ID NO: 2596294 - protein, 29 aa, Entamoeba histolytica
LKQHLYSQKGIWYRVSLSTPQTLIIDTCF

SEQ ID NO: 2596295 - protein, 26 aa, Entamoeba histolytica
LKQNIFIILYHFFTFKEVKNIIEVIT

SEQ ID NO: 2596296 - protein, 19 aa, Entamoeba histolytica
LKQNLIPFGMFLFSSNPIR

SEQ ID NO: 2596297 - protein, 22 aa, Entamoeba histolytica
LKQQFYLFLPEIKMIQKFLTDI

SEQ ID NO: 2596298 - protein, 25 aa, Entamoeba histolytica
LKRKKLLVLVALGPSLLVPIGLIIL

SEQ ID NO: 2596299 - protein, 38 aa, Entamoeba histolytica
LKSHWSLSQFFLWIIVFLLLHISFTISLILGYGGIIVS

SEQ ID NO: 2596300 - protein, 30 aa, Entamoeba histolytica
LKSVLCVLGSLKFYHPKLVTIKDKRIGELV

SEQ ID NO: 2596301 - protein, 29 aa, Entamoeba histolytica
LKTLNQFCILSIQYLFYQKSKQENKTQTT

SEQ ID NO: 2596302 - protein, 21 aa, Entamoeba histolytica
LKTRDIFGEESLYTVLSLVGE

SEQ ID NO: 2596303 - protein, 22 aa, Entamoeba histolytica
LKTSTLRTYLEKEVPIRCSMLM

SEQ ID NO: 2596304 - protein, 18 aa, Entamoeba histolytica
LKTVIAIGAIIITVGAIG

SEQ ID NO: 2596305 - protein, 17 aa, Entamoeba histolytica
LKTYLLQNPTHNSSLLF

SEQ ID NO: 2596306 - protein, 23 aa, Entamoeba histolytica
LKYPDCHYLSYLFDLSLNIDNTY

SEQ ID NO: 2596307 - protein, 25 aa, Entamoeba histolytica
LLADSRLLWWIKNNNKTITLWNDLF

SEQ ID NO: 2596308 - protein, 20 aa, Entamoeba histolytica
LLALCTMLVVALGLLFSPNG

SEQ ID NO: 2596309 - protein, 25 aa, Entamoeba histolytica
LLALHIYWFYLIIQMLIHLISGKGA

SEQ ID NO: 2596310 - protein, 18 aa, Entamoeba histolytica
LLALQMDNLFYKLDNENN

SEQ ID NO: 2596311 - protein, 55 aa, Entamoeba histolytica
LLAMKHHRPFYLFTSYIVFVLYCWYYSYSLILILLPLFIYLISFIIETDDYPHTY

SEQ ID NO: 2596312 - protein, 34 aa, Entamoeba histolytica
LLASLKCFSNWRLVLLFPLALLFGFSRSFYYTSM

SEQ ID NO: 2596313 - protein, 27 aa, Entamoeba histolytica
LLAYSILGLFFEWKIPLKYIKVVLQVA

SEQ ID NO: 2596314 - protein, 19 aa, Entamoeba histolytica
LLCIGLLSHYVSLVIKLPI

SEQ ID NO: 2596315 - protein, 17 aa, Entamoeba histolytica
LLCKMKLVILQNRYVPW

SEQ ID NO: 2596316 - protein, 24 aa, Entamoeba histolytica
LLCTISMIFFILHLHEIFKTFIDV

SEQ ID NO: 2596317 - protein, 18 aa, Entamoeba histolytica
LLDDILSVSFQKIIKDNQ

SEQ ID NO: 2596318 - protein, 25 aa, Entamoeba histolytica
LLDFQLKIYFLFQQWLQSLVLYLCL

SEQ ID NO: 2596319 - protein, 20 aa, Entamoeba histolytica
LLDIIKNFFGFQFKEEVKKK

SEQ ID NO: 2596320 - protein, 27 aa, Entamoeba histolytica
LLDKIQWRTLMELSTKWRQISEPNDPV

SEQ ID NO: 2596321 - protein, 30 aa, Entamoeba histolytica
LLEFNNFFLTFVGFALFALITLGILIGMES

SEQ ID NO: 2596322 - protein, 26 aa, Entamoeba histolytica
LLFAIPQFILIYILRVILVENIFLKL

SEQ ID NO: 2596323 - protein, 32 aa, Entamoeba histolytica
LLFDSDVYIRTLILFLPLLVVFNKERIDGTVR

SEQ ID NO: 2596324 - protein, 20 aa, Entamoeba histolytica
LLFGTLAIIIALNGNFPFIW

SEQ ID NO: 2596325 - protein, 25 aa, Entamoeba histolytica
LLFNFSAYFLWTVIPLKANDLGASS

SEQ ID NO: 2596326 - protein, 17 aa, Entamoeba histolytica
LLFQHNSVSSLLCFISI

SEQ ID NO: 2596327 - protein, 18 aa, Entamoeba histolytica
LLFTPLRIISYFYQLIFL

SEQ ID NO: 2596328 - protein, 18 aa, Entamoeba histolytica
LLFVLYSNAERLCIPIAE

SEQ ID NO: 2596329 - protein, 18 aa, Entamoeba histolytica
LLFYTLYVPTIDSIVIIF

SEQ ID NO: 2596330 - protein, 20 aa, Entamoeba histolytica
LLGIFILFFISTGHLILDST

SEQ ID NO: 2596331 - protein, 20 aa, Entamoeba histolytica
LLGIILCVYSLIPKPTMGIV

SEQ ID NO: 2596332 - protein, 28 aa, Entamoeba histolytica
LLGLYRMIRFMIINDIPFIEILDTTGLY

SEQ ID NO: 2596333 - protein, 24 aa, Entamoeba histolytica
LLHILLQHCALINQLPPVTISLLF

SEQ ID NO: 2596334 - protein, 19 aa, Entamoeba histolytica
LLICVTLVFIIFHRNQSKV

SEQ ID NO: 2596335 - protein, 19 aa, Entamoeba histolytica
LLIHCISYFIQKDLSLSLF

SEQ ID NO: 2596336 - protein, 24 aa, Entamoeba histolytica
LLIIPIVNVIIIILTSFGLMYPIS

SEQ ID NO: 2596337 - protein, 20 aa, Entamoeba histolytica
LLILILLIRLILIYLTNFEI

SEQ ID NO: 2596338 - protein, 17 aa, Entamoeba histolytica
LLILQTCIDSYIIGMRE

SEQ ID NO: 2596339 - protein, 19 aa, Entamoeba histolytica
LLKDSPFNLIIGPGGMTPE

SEQ ID NO: 2596340 - protein, 18 aa, Entamoeba histolytica
LLKFIVMIELFMQPHQIT

SEQ ID NO: 2596341 - protein, 19 aa, Entamoeba histolytica
LLKNKTTSFLPLLRTVSFV

SEQ ID NO: 2596342 - protein, 17 aa, Entamoeba histolytica
LLKTKEKEHWGYNEIGD

SEQ ID NO: 2596343 - protein, 17 aa, Entamoeba histolytica
LLKYFFRSLPHGLIPQT

SEQ ID NO: 2596344 - protein, 20 aa, Entamoeba histolytica
LLLFIYLSSATLTDISYDSN

SEQ ID NO: 2596345 - protein, 22 aa, Entamoeba histolytica
LLLFLRFYNHQSCDPYFLDFIQ

SEQ ID NO: 2596346 - protein, 17 aa, Entamoeba histolytica
LLLINYVLAYTCTTATE

SEQ ID NO: 2596347 - protein, 25 aa, Entamoeba histolytica
LLLISSICIFFLLVILPNIHSITQK

SEQ ID NO: 2596348 - protein, 17 aa, Entamoeba histolytica
LLLLFCVLCLSDNCKNY

SEQ ID NO: 2596349 - protein, 23 aa, Entamoeba histolytica
LLLMDGLQWFACGLVSFLMCHIC

SEQ ID NO: 2596350 - protein, 19 aa, Entamoeba histolytica
LLLMIFERINFDELFFECI

SEQ ID NO: 2596351 - protein, 18 aa, Entamoeba histolytica
LLLTLISYCFGETLCQKE

SEQ ID NO: 2596352 - protein, 33 aa, Entamoeba histolytica
LLMEMNIFITIFVGFAVWALITLAILIGMESLS

SEQ ID NO: 2596353 - protein, 18 aa, Entamoeba histolytica
LLMILLYVEFIKLRYYFV

SEQ ID NO: 2596354 - protein, 39 aa, Entamoeba histolytica
LLMVCIPGIIVYELMLIILLIIFLIQYHILNDKIIFEQK

SEQ ID NO: 2596355 - protein, 17 aa, Entamoeba histolytica
LLNEMIYFIDSTTIKSC

SEQ ID NO: 2596356 - protein, 25 aa, Entamoeba histolytica
LLNKPYSFPIDVYAFAIVSYEVFLR

SEQ ID NO: 2596357 - protein, 25 aa, Entamoeba histolytica
LLNNLVCYLIKQMKMFSTNPLIAFH

SEQ ID NO: 2596358 - protein, 26 aa, Entamoeba histolytica
LLNSMGYTIILKRPKKVKVKSLLPFL

SEQ ID NO: 2596359 - protein, 18 aa, Entamoeba histolytica
LLPAIISMITFSVALRSM

SEQ ID NO: 2596360 - protein, 26 aa, Entamoeba histolytica
LLPFLKAVCGSKKSWYARHTGLKCIQ

SEQ ID NO: 2596361 - protein, 19 aa, Entamoeba histolytica
LLPLRLKHQYHDGYTGWRI

SEQ ID NO: 2596362 - protein, 23 aa, Entamoeba histolytica
LLQLCKFKYTFIDKRLAEIISRG

SEQ ID NO: 2596363 - protein, 19 aa, Entamoeba histolytica
LLQLMIPLCKIDRIDEVIA

SEQ ID NO: 2596364 - protein, 22 aa, Entamoeba histolytica
LLQVVLVFWILMSEFFSFTQVM

SEQ ID NO: 2596365 - protein, 26 aa, Entamoeba histolytica
LLRFFVTPYRWVVLRRYFFLQGIIYF

SEQ ID NO: 2596366 - protein, 17 aa, Entamoeba histolytica
LLRKFIERWGYSQPLNT

SEQ ID NO: 2596367 - protein, 33 aa, Entamoeba histolytica
LLRVLLNNFRHEWLLSFLGLIGGIGAGAVFPFY

SEQ ID NO: 2596368 - protein, 22 aa, Entamoeba histolytica
LLSFFIYYYLFLIHTSHWQYAK

SEQ ID NO: 2596369 - protein, 29 aa, Entamoeba histolytica
LLSIFTPSILFHMLSLQSLPINIVIAVMK

SEQ ID NO: 2596370 - protein, 17 aa, Entamoeba histolytica
LLSKQMLIKIAIQVTYQ

SEQ ID NO: 2596371 - protein, 28 aa, Entamoeba histolytica
LLSLPTLLLLFFFPFDFNISVIELTLLI

SEQ ID NO: 2596372 - protein, 18 aa, Entamoeba histolytica
LLSMSLSSTMEYLRTIPF

SEQ ID NO: 2596373 - protein, 24 aa, Entamoeba histolytica
LLSNKRLMRFCPNGITLNKNVICT

SEQ ID NO: 2596374 - protein, 25 aa, Entamoeba histolytica
LLSSIQLLYILFFSPKQGVSDKNLL

SEQ ID NO: 2596375 - protein, 28 aa, Entamoeba histolytica
LLSTESFIPCIFILEKQWKKLNKKPLIE

SEQ ID NO: 2596376 - protein, 39 aa, Entamoeba histolytica
LLSVGILINIILILPLLLFIWRFIIRRIIHPNPIQKYHA

SEQ ID NO: 2596377 - protein, 26 aa, Entamoeba histolytica
LLSYGVWCLIGFFVYSIYKFLTSINK

SEQ ID NO: 2596378 - protein, 26 aa, Entamoeba histolytica
LLTPLNHYALLFPQLLIPTKIEESST

SEQ ID NO: 2596379 - protein, 29 aa, Entamoeba histolytica
LLVIKVFDCLFIFLINRISFHFREGHVHE

SEQ ID NO: 2596380 - protein, 20 aa, Entamoeba histolytica
LLVLPPIYTTLQYLKTIDIS

SEQ ID NO: 2596381 - protein, 27 aa, Entamoeba histolytica
LLVNDVKIFYCKYNDPLYIKIEKLEII

SEQ ID NO: 2596382 - protein, 25 aa, Entamoeba histolytica
LLVPSFVHLFGELNWWPIKYEINTT

SEQ ID NO: 2596383 - protein, 26 aa, Entamoeba histolytica
LLVRTVCYTYFLYSLIIDELGDIIHN

SEQ ID NO: 2596384 - protein, 27 aa, Entamoeba histolytica
LLYKEKVFQYCFPLDFVKVLMFIQQPR

SEQ ID NO: 2596385 - protein, 20 aa, Entamoeba histolytica
LLYKYIPSVDLLKKTLATIL

SEQ ID NO: 2596386 - protein, 19 aa, Entamoeba histolytica
LLYLVPSMVIPFLIYAYYS

SEQ ID NO: 2596387 - protein, 21 aa, Entamoeba histolytica
LLYMSPLIRQWNDNICILVGG

SEQ ID NO: 2596388 - protein, 26 aa, Entamoeba histolytica
LLYNYAAFLFWLVVPLVATKQDASNW

SEQ ID NO: 2596389 - protein, 23 aa, Entamoeba histolytica
LLYTFHGKENPKYKLIFSPTTGA

SEQ ID NO: 2596390 - protein, 27 aa, Entamoeba histolytica
LMDDNSLFFGILTMELTTINQIFYNGT

SEQ ID NO: 2596391 - protein, 28 aa, Entamoeba histolytica
LMEFYIFIVFIWIFFHVDHLRFLAIKEK

SEQ ID NO: 2596392 - protein, 17 aa, Entamoeba histolytica
LMELLKKDGFQIKTKRS

SEQ ID NO: 2596393 - protein, 24 aa, Entamoeba histolytica
LMESWRRSIIFSEKLKQITKRQKN

SEQ ID NO: 2596394 - protein, 26 aa, Entamoeba histolytica
LMFINDNLWILWIMGVMYAFSYVLFW

SEQ ID NO: 2596395 - protein, 20 aa, Entamoeba histolytica
LMFITTLTILIIFSILQAFS

SEQ ID NO: 2596396 - protein, 19 aa, Entamoeba histolytica
LMHCDLKPQNILIYSYNSL

SEQ ID NO: 2596397 - protein, 30 aa, Entamoeba histolytica
LMIEMKKWMKLYKLDLRIIRALYDLGFINP

SEQ ID NO: 2596398 - protein, 17 aa, Entamoeba histolytica
LMIQKILFFNSKVLTLI

SEQ ID NO: 2596399 - protein, 28 aa, Entamoeba histolytica
LMITLMSLLILPLTFFKNLSALKFTSII

SEQ ID NO: 2596400 - protein, 27 aa, Entamoeba histolytica
LMIYNSILLFSWLYNYFVFALDDIGRV

SEQ ID NO: 2596401 - protein, 28 aa, Entamoeba histolytica
LMKEEPTLFYLLEYFKSDGLLKQMYGVN

SEQ ID NO: 2596402 - protein, 23 aa, Entamoeba histolytica
LMKKVCPTIMLGIPRIYEKIIEK

SEQ ID NO: 2596403 - protein, 17 aa, Entamoeba histolytica
LMKLDFTNITSPGLLRI

SEQ ID NO: 2596404 - protein, 17 aa, Entamoeba histolytica
LMMSLSCIFIIPVAFSS

SEQ ID NO: 2596405 - protein, 21 aa, Entamoeba histolytica
LMNIIFYLGTVDDLINFLQIS

SEQ ID NO: 2596406 - protein, 19 aa, Entamoeba histolytica
LMPQYVYDTLIILPEALYN

SEQ ID NO: 2596407 - protein, 22 aa, Entamoeba histolytica
LMSLTTIWTYKRSIFLIGQTII

SEQ ID NO: 2596408 - protein, 40 aa, Entamoeba histolytica
LMSRVIYLRDFIIKTAKKFYQMMYWIIGIPAVAVEYNPIT

SEQ ID NO: 2596409 - protein, 18 aa, Entamoeba histolytica
LMTNKRYNSYLSKRMRVI

SEQ ID NO: 2596410 - protein, 18 aa, Entamoeba histolytica
LMTTFWQYRTPPVNSIHE

SEQ ID NO: 2596411 - protein, 18 aa, Entamoeba histolytica
LMVFMSVLFISQTLSMIA

SEQ ID NO: 2596412 - protein, 18 aa, Entamoeba histolytica
LMVKLEVASIFPLITGNA

SEQ ID NO: 2596413 - protein, 17 aa, Entamoeba histolytica
LMYFCCVILLKVKCHVK

SEQ ID NO: 2596414 - protein, 25 aa, Entamoeba histolytica
LNALQMLWVNMIMDTLAALALGTEK

SEQ ID NO: 2596415 - protein, 18 aa, Entamoeba histolytica
LNATSCLFNLIIPKSFTS

SEQ ID NO: 2596416 - protein, 19 aa, Entamoeba histolytica
LNCLFYTRNGTLIKIIPLN

SEQ ID NO: 2596417 - protein, 22 aa, Entamoeba histolytica
LNCNILYNSSMLQNIVFNSSLI

SEQ ID NO: 2596418 - protein, 24 aa, Entamoeba histolytica
LNCRYFIIFLIVTTMLCYHSCFLS

SEQ ID NO: 2596419 - protein, 24 aa, Entamoeba histolytica
LNCSSDIWTLLFPNGMTVSSTPRK

SEQ ID NO: 2596420 - protein, 31 aa, Entamoeba histolytica
LNDDNLVLIALPRYPLLTGWKTEFMIGYSLP

SEQ ID NO: 2596421 - protein, 33 aa, Entamoeba histolytica
LNDFDIWALSRPIQLIFLLRPNSFDTLVLALTK

SEQ ID NO: 2596422 - protein, 22 aa, Entamoeba histolytica
LNDIVFTSLRYSHQKKYLFLTV

SEQ ID NO: 2596423 - protein, 19 aa, Entamoeba histolytica
LNDLLLLKTYLLQNPTHNS

SEQ ID NO: 2596424 - protein, 18 aa, Entamoeba histolytica
LNEKIPITLRYGQLGNIL

SEQ ID NO: 2596425 - protein, 18 aa, Entamoeba histolytica
LNEKVPITLRYGQLGNIL

SEQ ID NO: 2596426 - protein, 22 aa, Entamoeba histolytica
LNEPLYLFRVTSSDYIANNNIT

SEQ ID NO: 2596427 - protein, 18 aa, Entamoeba histolytica
LNEWIDLIFGFKQTGEPA

SEQ ID NO: 2596428 - protein, 44 aa, Entamoeba histolytica
LNFGDWVMTNYIFIAVIPVWIIFFILLFGYYTLKVVVIRQAEEV

SEQ ID NO: 2596429 - protein, 79 aa, Entamoeba histolytica
LNFIGLGFSIILFIGLLLLQQEFPFFDNWVWYRVFIQMLQTPVFYALVLLIPLILFSKDFLWRHLKRKFIPSPNHITEE

SEQ ID NO: 2596430 - protein, 23 aa, Entamoeba histolytica
LNFIIFIFSVVVVKIYVFFLAGF

SEQ ID NO: 2596431 - protein, 22 aa, Entamoeba histolytica
LNFLMITMWLACIFSNRKMFLN

SEQ ID NO: 2596432 - protein, 20 aa, Entamoeba histolytica
LNGTSCIFVILSVVVTFLFF

SEQ ID NO: 2596433 - protein, 30 aa, Entamoeba histolytica
LNIEHRNTLGRYLFLMNIIAINKRLNRMGE

SEQ ID NO: 2596434 - protein, 23 aa, Entamoeba histolytica
LNIFILLEYLYQPILTYLIPRNL

SEQ ID NO: 2596435 - protein, 18 aa, Entamoeba histolytica
LNIGDCRSYLYSNSTLRT

SEQ ID NO: 2596436 - protein, 21 aa, Entamoeba histolytica
LNIGLFLFPILETLDPVNGIT

SEQ ID NO: 2596437 - protein, 25 aa, Entamoeba histolytica
LNIHIHSLFFNKLVKILLTCTNKLM

SEQ ID NO: 2596438 - protein, 22 aa, Entamoeba histolytica
LNIIMECNTLHFASTKSIGLRK

SEQ ID NO: 2596439 - protein, 28 aa, Entamoeba histolytica
LNILKVMILILFFSYLMNFFFKHRKTIK

SEQ ID NO: 2596440 - protein, 19 aa, Entamoeba histolytica
LNIVPVVFSLLQLFSLDSF

SEQ ID NO: 2596441 - protein, 32 aa, Entamoeba histolytica
LNKIQYEFLAPFLPLISWQLAHVDLSWSLTQP

SEQ ID NO: 2596442 - protein, 25 aa, Entamoeba histolytica
LNKTTYGNILLGFSKEAFLDQAIDE

SEQ ID NO: 2596443 - protein, 18 aa, Entamoeba histolytica
LNLFQAIRRSIFNTPLTL

SEQ ID NO: 2596444 - protein, 18 aa, Entamoeba histolytica
LNLKMIYTDYLLSSLKSN

SEQ ID NO: 2596445 - protein, 26 aa, Entamoeba histolytica
LNMIPFLLIIDCIGLILIQFYSLPSS

SEQ ID NO: 2596446 - protein, 32 aa, Entamoeba histolytica
LNMLLSVIHFNIYRIFYIYDSLSTSLFQILNS

SEQ ID NO: 2596447 - protein, 30 aa, Entamoeba histolytica
LNNKLTRLVKAYFLMCEIIEFNETKENEEG

SEQ ID NO: 2596448 - protein, 25 aa, Entamoeba histolytica
LNPSSFILIPTILKSIQKLEKLPNV

SEQ ID NO: 2596449 - protein, 22 aa, Entamoeba histolytica
LNQFRCDYIVYFYGSVINPSNF

SEQ ID NO: 2596450 - protein, 24 aa, Entamoeba histolytica
LNQYLPFYILMIVGVINSIMMLFT

SEQ ID NO: 2596451 - protein, 18 aa, Entamoeba histolytica
LNRHFFTFIFDQLEIVIQ

SEQ ID NO: 2596452 - protein, 18 aa, Entamoeba histolytica
LNRIICWVLMISHNFTTP

SEQ ID NO: 2596453 - protein, 28 aa, Entamoeba histolytica
LNRMVSGLIYFFVTPFIDIQIHDSTYVN

SEQ ID NO: 2596454 - protein, 26 aa, Entamoeba histolytica
LNSMQMLWVNLIMDTLAALALGTEKP

SEQ ID NO: 2596455 - protein, 28 aa, Entamoeba histolytica
LNSQHKYILSIAFFLIGGAITEAIQISF

SEQ ID NO: 2596456 - protein, 20 aa, Entamoeba histolytica
LNTLLYNKYFTLNEYYLLFI

SEQ ID NO: 2596457 - protein, 27 aa, Entamoeba histolytica
LNYVNYIIGQFLKDLLRFYSRTTTMEA

SEQ ID NO: 2596458 - protein, 35 aa, Entamoeba histolytica
LPAQVTFFIIIFFFVFLILSFLNIIKWICCRTTKR

SEQ ID NO: 2596459 - protein, 29 aa, Entamoeba histolytica
LPDIYNYILDTYLFVRKYFTLDNEGKMQL

SEQ ID NO: 2596460 - protein, 21 aa, Entamoeba histolytica
LPDYGAFLFYASYGIETRGSS

SEQ ID NO: 2596461 - protein, 38 aa, Entamoeba histolytica
LPEIIFMSCTFGYLCFLILIKWMFFIEDAPMITNVFLE

SEQ ID NO: 2596462 - protein, 24 aa, Entamoeba histolytica
LPEKILLTIYPISLYYGLFILFVI

SEQ ID NO: 2596463 - protein, 20 aa, Entamoeba histolytica
LPFLKAVCGSKKSWYARHTG

SEQ ID NO: 2596464 - protein, 39 aa, Entamoeba histolytica
LPIFLTLEKNRKLILGFYIIIIVIVFPVSVWLMVKKCNK

SEQ ID NO: 2596465 - protein, 18 aa, Entamoeba histolytica
LPIKCNVGYFMYHSKECR

SEQ ID NO: 2596466 - protein, 27 aa, Entamoeba histolytica
LPISLQLHFLVWPLEQRTDICQYLINT

SEQ ID NO: 2596467 - protein, 28 aa, Entamoeba histolytica
LPISLSILIITFIPLVYYVITEESIFHN

SEQ ID NO: 2596468 - protein, 25 aa, Entamoeba histolytica
LPKKYLNIMHLLPQTFRVNYLSSHI

SEQ ID NO: 2596469 - protein, 25 aa, Entamoeba histolytica
LPLLYSLVTVIFWFIIAQGLVYLIT

SEQ ID NO: 2596470 - protein, 19 aa, Entamoeba histolytica
LPLYLVCLNGIRNLLQLAS

SEQ ID NO: 2596471 - protein, 19 aa, Entamoeba histolytica
LPNLVRYYMSYSDRNFIYI

SEQ ID NO: 2596472 - protein, 24 aa, Entamoeba histolytica
LPPEQQLLIFSPPPPDTRKIVLST

SEQ ID NO: 2596473 - protein, 32 aa, Entamoeba histolytica
LPPQHNIIRIPWRRILFTPNPKKPTIWDDIKI

SEQ ID NO: 2596474 - protein, 22 aa, Entamoeba histolytica
LPSIPFIQIEILQNALKRLHVA

SEQ ID NO: 2596475 - protein, 25 aa, Entamoeba histolytica
LPSLMQCIMLTLFAIPLDKIFQESK

SEQ ID NO: 2596476 - protein, 20 aa, Entamoeba histolytica
LPSMRQPLYSNVDIILVCYS

SEQ ID NO: 2596477 - protein, 23 aa, Entamoeba histolytica
LPSYYMLIFFFYSFSILSLVVSY

SEQ ID NO: 2596478 - protein, 22 aa, Entamoeba histolytica
LPTSNFFRYCLTGFLYNYSVFF

SEQ ID NO: 2596479 - protein, 20 aa, Entamoeba histolytica
LPTYLESICLMLVSFKSIEI

SEQ ID NO: 2596480 - protein, 24 aa, Entamoeba histolytica
LPVKICFALYGLLTKYQTKQRNGF

SEQ ID NO: 2596481 - protein, 25 aa, Entamoeba histolytica
LQCVSNLLGIPREVPVIIPPSELID

SEQ ID NO: 2596482 - protein, 33 aa, Entamoeba histolytica
LQDIIDKKLQLPPLLRSRIILDAAKGIAVLHSK

SEQ ID NO: 2596483 - protein, 36 aa, Entamoeba histolytica
LQEKIVVNKLTIWDYLLFLNGIVLASVLVYITLKVI

SEQ ID NO: 2596484 - protein, 25 aa, Entamoeba histolytica
LQGIILTMDFNSCKFSTTVKQVIKI

SEQ ID NO: 2596485 - protein, 19 aa, Entamoeba histolytica
LQGKFIYIKALILSITSDP

SEQ ID NO: 2596486 - protein, 18 aa, Entamoeba histolytica
LQHTPILNYIHHTPLGKI

SEQ ID NO: 2596487 - protein, 26 aa, Entamoeba histolytica
LQIPKEFVSLMVILIFVVSGRIKNYD

SEQ ID NO: 2596488 - protein, 17 aa, Entamoeba histolytica
LQITHYCIILHSIILNK

SEQ ID NO: 2596489 - protein, 19 aa, Entamoeba histolytica
LQKNYLIIFKTTDGSIYGT

SEQ ID NO: 2596490 - protein, 22 aa, Entamoeba histolytica
LQLLDFIVPFEYTSFCKAPCTL

SEQ ID NO: 2596491 - protein, 26 aa, Entamoeba histolytica
LQLVLTVYRFVSFLIMFITCAVQLGK

SEQ ID NO: 2596492 - protein, 30 aa, Entamoeba histolytica
LQMKLDILFICFLLVLLSFLAGLCLLSQII

SEQ ID NO: 2596493 - protein, 18 aa, Entamoeba histolytica
LQMLWVNLIMDTMAALAL

SEQ ID NO: 2596494 - protein, 26 aa, Entamoeba histolytica
LQNIMKPLLLPLFEQSNQNMWEQVRK

SEQ ID NO: 2596495 - protein, 25 aa, Entamoeba histolytica
LQNNKYNWFRPASFFPLGYMYEILD

SEQ ID NO: 2596496 - protein, 34 aa, Entamoeba histolytica
LQNPAFILFVLGFFLPCIWIYNIVKYRNSGDLIE

SEQ ID NO: 2596497 - protein, 42 aa, Entamoeba histolytica
LQSATFILGEYYFNSLWMIMCLLPPPQSFIDQFKDRHLFEKL

SEQ ID NO: 2596498 - protein, 23 aa, Entamoeba histolytica
LQSFVHEILLFFYISFLFILLFN

SEQ ID NO: 2596499 - protein, 36 aa, Entamoeba histolytica
LQSSNIIFSVYLFTLLLLWLYFNTQRISIVFPLIII

SEQ ID NO: 2596500 - protein, 25 aa, Entamoeba histolytica
LQTHNALFMIYPNWINEMGITAESE

SEQ ID NO: 2596501 - protein, 23 aa, Entamoeba histolytica
LQTICFFVLSEYQGIKIRSLYFK

SEQ ID NO: 2596502 - protein, 23 aa, Entamoeba histolytica
LQTYGTLKRLALTQFRLLNIMYK

SEQ ID NO: 2596503 - protein, 46 aa, Entamoeba histolytica
LQVLTIIFVLLLNLLSSILFMPLLIILSYVYISIIIFYIDSSQNLQ

SEQ ID NO: 2596504 - protein, 17 aa, Entamoeba histolytica
LQVTLIDKLLRMNSFKP

SEQ ID NO: 2596505 - protein, 26 aa, Entamoeba histolytica
LQYFHILVNFLFIGFILSIIKYFNRD

SEQ ID NO: 2596506 - protein, 18 aa, Entamoeba histolytica
LQYFIKKRKLLLHQIIGV

SEQ ID NO: 2596507 - protein, 22 aa, Entamoeba histolytica
LRESNFPSEWFFLIDSLKNVEI

SEQ ID NO: 2596508 - protein, 17 aa, Entamoeba histolytica
LRHICVVELIGAVYTEG

SEQ ID NO: 2596509 - protein, 28 aa, Entamoeba histolytica
LRKENEDFFVIPYRLKLRVLFDTAKGMA

SEQ ID NO: 2596510 - protein, 26 aa, Entamoeba histolytica
LRKLGWLTFLDVLPLPITPSWGRILE

SEQ ID NO: 2596511 - protein, 24 aa, Entamoeba histolytica
LRKRKKLPLGFKFLQVIQEKDFEK

SEQ ID NO: 2596512 - protein, 23 aa, Entamoeba histolytica
LRMFYDMYLFTYVVILKSTRNGK

SEQ ID NO: 2596513 - protein, 18 aa, Entamoeba histolytica
LRNPFIVNFIGSVNYTKD

SEQ ID NO: 2596514 - protein, 17 aa, Entamoeba histolytica
LRNPFVVNYVGSVTYIP

SEQ ID NO: 2596515 - protein, 18 aa, Entamoeba histolytica
LRNQSFGTFLFVALLLIF

SEQ ID NO: 2596516 - protein, 39 aa, Entamoeba histolytica; identical to SEQ ID NO: 2399668

SEQ ID NO: 2596517 - protein, 24 aa, Entamoeba histolytica
LRSEFWIQIYYLIITFGVIITPFV

SEQ ID NO: 2596518 - protein, 19 aa, Entamoeba histolytica
LRSSIYKLFLQPKRLVKEI

SEQ ID NO: 2596519 - protein, 31 aa, Entamoeba histolytica
LRTAGEYFPYLIRKSWPYLPLIFKESYCTRK

SEQ ID NO: 2596520 - protein, 31 aa, Entamoeba histolytica
LRTIHSEGLLFLFMKVIPDNFVLTFGCFGID

SEQ ID NO: 2596521 - protein, 21 aa, Entamoeba histolytica
LRVIFHRDFFPKEASLPTFNS

SEQ ID NO: 2596522 - protein, 17 aa, Entamoeba histolytica
LRYNLPIIMCLISTIIE

SEQ ID NO: 2596523 - protein, 19 aa, Entamoeba histolytica
LSCIKCESGYYLDTLKCTK

SEQ ID NO: 2596524 - protein, 20 aa, Entamoeba histolytica
LSDERYGVVALDALCNEIIK

SEQ ID NO: 2596525 - protein, 26 aa, Entamoeba histolytica
LSDNFNNFLFWFIVEHPKMPVVDFTD

SEQ ID NO: 2596526 - protein, 18 aa, Entamoeba histolytica
LSDPSFSCFSRMSQFLLN

SEQ ID NO: 2596527 - protein, 25 aa, Entamoeba histolytica
LSDYIKRCLILLVGLHPNFVIDEHL

SEQ ID NO: 2596528 - protein, 35 aa, Entamoeba histolytica
LSDYMLTYNPIPLLYYFILQLISVIFTLLKSIIET

SEQ ID NO: 2596529 - protein, 25 aa, Entamoeba histolytica
LSFDGRFPFIWTYSTLVASCYWISK

SEQ ID NO: 2596530 - protein, 17 aa, Entamoeba histolytica
LSFFILSIVILSCGLNE

SEQ ID NO: 2596531 - protein, 18 aa, Entamoeba histolytica
LSFIFNSFIKYIKIFRIE

SEQ ID NO: 2596532 - protein, 23 aa, Entamoeba histolytica
LSFTIMNFLKYCRFNGFFNKEDK

SEQ ID NO: 2596533 - protein, 25 aa, Entamoeba histolytica
LSGFLLPILSIFRLIKGKLVIVIPF

SEQ ID NO: 2596534 - protein, 39 aa, Entamoeba histolytica
LSGGEIFGIIVAVLFLVVILLVIGLFVGYIGYKKYQNKH

SEQ ID NO: 2596535 - protein, 21 aa, Entamoeba histolytica
LSHFHLILYIVGMNTGPMLSS

SEQ ID NO: 2596536 - protein, 18 aa, Entamoeba histolytica
LSHFLGIFISSTLYFICY

SEQ ID NO: 2596537 - protein, 32 aa, Entamoeba histolytica
LSHLRKMMKIVLYPIYITIPMIRSQKFSSFPT

SEQ ID NO: 2596538 - protein, 34 aa, Entamoeba histolytica
LSHWIVKKRIFSITLLVIVSILFIDAFSRMKHCE

SEQ ID NO: 2596539 - protein, 19 aa, Entamoeba histolytica
LSHYVSLVIKLPIKKSHIT

SEQ ID NO: 2596540 - protein, 17 aa, Entamoeba histolytica
LSICIHAKAYDCIPLGD

SEQ ID NO: 2596541 - protein, 22 aa, Entamoeba histolytica
LSIDPLALLPFIIESLKELNTQ

SEQ ID NO: 2596542 - protein, 29 aa, Entamoeba histolytica
LSIFLVVVYLYLLLYHPNEIPFKYETKHI

SEQ ID NO: 2596543 - protein, 25 aa, Entamoeba histolytica
LSIILTIIAVIFLVVRWRQKKNNIK

SEQ ID NO: 2596544 - protein, 21 aa, Entamoeba histolytica
LSIILVWLFNLIPQNGFFSWT

SEQ ID NO: 2596545 - protein, 19 aa, Entamoeba histolytica
LSIKFLKQNPLPKTIYTIY

SEQ ID NO: 2596546 - protein, 25 aa, Entamoeba histolytica
LSIKLQLITIWNKMKLKLIMPKGIW

SEQ ID NO: 2596547 - protein, 17 aa, Entamoeba histolytica
LSILIPFLAVIKGSLTL

SEQ ID NO: 2596548 - protein, 18 aa, Entamoeba histolytica
LSILLNFIENHYLNVHSN

SEQ ID NO: 2596549 - protein, 17 aa, Entamoeba histolytica
LSILPFSSTGKDSLLPI

SEQ ID NO: 2596550 - protein, 25 aa, Entamoeba histolytica
LSIQQPYAPGYWIKVTTKKTQYVAI

SEQ ID NO: 2596551 - protein, 27 aa, Entamoeba histolytica
LSIRPYPTKFFWNFLSLYNVCLILIRL

SEQ ID NO: 2596552 - protein, 22 aa, Entamoeba histolytica
LSIVVILTIFMYSIGHHEIFGM

SEQ ID NO: 2596553 - protein, 32 aa, Entamoeba histolytica
LSKAMSWYTKFLWKFKWIILTVVILCCIVLCV

SEQ ID NO: 2596554 - protein, 17 aa, Entamoeba histolytica
LSKILFCSLMGLSILMI

SEQ ID NO: 2596555 - protein, 24 aa, Entamoeba histolytica
LSKILLIPYTILVVGLLALTIIIS

SEQ ID NO: 2596556 - protein, 29 aa, Entamoeba histolytica
LSKKSIEIIKLPPFNELKLPRLDAFSSDA

SEQ ID NO: 2596557 - protein, 17 aa, Entamoeba histolytica
LSKLISPDFSYIFNVIK

SEQ ID NO: 2596558 - protein, 30 aa, Entamoeba histolytica
LSKRPTHYFLYYINDIILHLVIYGTVGIIQ

SEQ ID NO: 2596559 - protein, 19 aa, Entamoeba histolytica
LSKVYFLQLFEFVFNTQQQ

SEQ ID NO: 2596560 - protein, 28 aa, Entamoeba histolytica
LSLDSHFFDIFFDFLFTHMNITKSQHII

SEQ ID NO: 2596561 - protein, 29 aa, Entamoeba histolytica
LSLEKQFRTIWSYFFGYWKDPNTENFATR

SEQ ID NO: 2596562 - protein, 25 aa, Entamoeba histolytica
LSLGFPAFLLLYVNTLPLLLFRSHF

SEQ ID NO: 2596563 - protein, 28 aa, Entamoeba histolytica
LSLINVIAPFTFYLDKLPIITINDNPTS

SEQ ID NO: 2596564 - protein, 20 aa, Entamoeba histolytica
LSLLIILSSSFVIPSSSIDD

SEQ ID NO: 2596565 - protein, 57 aa, Entamoeba histolytica
LSLQEYIYFFKGRLWFTLEFISFIGMFYSFITLHFILVIIFCICFILILIIPTQTIT

SEQ ID NO: 2596566 - protein, 25 aa, Entamoeba histolytica
LSLYLLIPFIFVTIVLFYYNKFPSK

SEQ ID NO: 2596567 - protein, 25 aa, Entamoeba histolytica
LSLYNVCLILIRLFFQLPGFCLTPN

SEQ ID NO: 2596568 - protein, 37 aa, Entamoeba histolytica
LSNAPNLFFQIKPLYTLLLQVLIPQLPVIINSTLQYH

SEQ ID NO: 2596569 - protein, 20 aa, Entamoeba histolytica
LSNGFTVSAPYKLTINKLGS

SEQ ID NO: 2596570 - protein, 19 aa, Entamoeba histolytica
LSNKRLMRFCPNGIKLNKT

SEQ ID NO: 2596571 - protein, 25 aa, Entamoeba histolytica
LSNLPIIYLLYYVITLIVSMFNNEF

SEQ ID NO: 2596572 - protein, 35 aa, Entamoeba histolytica
LSNPKHYDLFLKTHFISFLFKILPFKSTPTDEKIN

SEQ ID NO: 2596573 - protein, 19 aa, Entamoeba histolytica
LSNRYLITNLFPDVLVIDD

SEQ ID NO: 2596574 - protein, 26 aa, Entamoeba histolytica
LSPRVSVILRKDIPYYLFIHSKYASK

SEQ ID NO: 2596575 - protein, 30 aa, Entamoeba histolytica; identical to SEQ ID NO: 2399730

SEQ ID NO: 2596576 - protein, 24 aa, Entamoeba histolytica
LSQSLVALFRLFAPLISSPLIAWS

SEQ ID NO: 2596577 - protein, 25 aa, Entamoeba histolytica
LSQTPMVFILIYLLTLFTLCLCVNR

SEQ ID NO: 2596578 - protein, 27 aa, Entamoeba histolytica
LSREGRFRFGGFWGKKWAKLTINKNES

SEQ ID NO: 2596579 - protein, 33 aa, Entamoeba histolytica
LSSGLIFVIYYFRMYFMMLIFGASHGLFFLPIL

SEQ ID NO: 2596580 - protein, 30 aa, Entamoeba histolytica; identical to SEQ ID NO: 2532854

SEQ ID NO: 2596581 - protein, 27 aa, Entamoeba histolytica
LSSRDIIFISIGSLLGFVMCLCFMMIG

SEQ ID NO: 2596582 - protein, 39 aa, Entamoeba histolytica
LSTCRLSIILLWSILFVLSLLFFYTILRVLLRLNSMNHP

SEQ ID NO: 2596583 - protein, 24 aa, Entamoeba histolytica
LSTFICFLLYGWTLIYMLFTYSEI

SEQ ID NO: 2596584 - protein, 22 aa, Entamoeba histolytica
LSTIPDVQYILSRYPLDRTIDH

SEQ ID NO: 2596585 - protein, 29 aa, Entamoeba histolytica
LSTMFTIFSLLIICLLVGSILLIINIIPI

SEQ ID NO: 2596586 - protein, 20 aa, Entamoeba histolytica
LSTYFDYFFLLTQDIIIILL

SEQ ID NO: 2596587 - protein, 25 aa, Entamoeba histolytica
LSVFPILIFLIIEVVVHYLPAPSFE

SEQ ID NO: 2596588 - protein, 21 aa, Entamoeba histolytica
LSVIAYILLLISSIAHFIHFK

SEQ ID NO: 2596589 - protein, 19 aa, Entamoeba histolytica
LSVIYLCYAYVSWSSERSL

SEQ ID NO: 2596590 - protein, 24 aa, Entamoeba histolytica
LSVKEFFSYFTLSSYLIPIACAVC

SEQ ID NO: 2596591 - protein, 17 aa, Entamoeba histolytica
LSVLLIVAIIVGLIVYK

SEQ ID NO: 2596592 - protein, 21 aa, Entamoeba histolytica
LSVLVIIPFGFGLPSHTFDEK

SEQ ID NO: 2596593 - protein, 26 aa, Entamoeba histolytica
LSVMLSWVFIIVFAAIIHGQWFSIFN

SEQ ID NO: 2596594 - protein, 30 aa, Entamoeba histolytica
LSWNDPYPNDKFKYPWNIASFIMNGDRLPK

SEQ ID NO: 2596595 - protein, 20 aa, Entamoeba histolytica
LSWPIMLRFAYQIASGMASL

SEQ ID NO: 2596596 - protein, 27 aa, Entamoeba histolytica
LSYDIFQIMHKLLFGSSLVFKTRKIWG

SEQ ID NO: 2596597 - protein, 19 aa, Entamoeba histolytica
LSYLPLTKEYLNTPISITW

SEQ ID NO: 2596598 - protein, 25 aa, Entamoeba histolytica
LSYLVKTYCFLQLPKESEKILQEFF

SEQ ID NO: 2596599 - protein, 17 aa, Entamoeba histolytica
LSYVSPKQFFLTSFVMF

SEQ ID NO: 2596600 - protein, 23 aa, Entamoeba histolytica
LTCAMFDFIFLTTNENIFIITNR

SEQ ID NO: 2596601 - protein, 27 aa, Entamoeba histolytica
LTCYKYAAKPPLTAAYFLEKTYDVTNK

SEQ ID NO: 2596602 - protein, 23 aa, Entamoeba histolytica
LTFKIIVLLYVACGLCLFTIVRI

SEQ ID NO: 2596603 - protein, 27 aa, Entamoeba histolytica
LTFVYALFRLYVFPMYIIRAGLIAINY

SEQ ID NO: 2596604 - protein, 31 aa, Entamoeba histolytica
LTGILVHFSLYILTLFILIGFIIGEVYNNFI

SEQ ID NO: 2596605 - protein, 28 aa, Entamoeba histolytica
LTGLLSLIYLFWLMFAIIRSFSEARKLG

SEQ ID NO: 2596606 - protein, 27 aa, Entamoeba histolytica
LTGTRTIKTLKLSKSCPLIIETEIKVE

SEQ ID NO: 2596607 - protein, 41 aa, Entamoeba histolytica
LTGVIFGLCLMFIGLILLIVLLCWPETLVYWERNKCFAMQS

SEQ ID NO: 2596608 - protein, 26 aa, Entamoeba histolytica
LTIDILQTLFYLQVSYRTNKMPLLNG

SEQ ID NO: 2596609 - protein, 26 aa, Entamoeba histolytica
LTIIYNSWILCEAILIELGYSSVTYT

SEQ ID NO: 2596610 - protein, 33 aa, Entamoeba histolytica
LTIKRFITVLITIVLLFLFYTLNKQRNIYCTEV

SEQ ID NO: 2596611 - protein, 33 aa, Entamoeba histolytica
LTKIFSKYLFSKQFQPIAYKLLLNYFISNYKEK

SEQ ID NO: 2596612 - protein, 36 aa, Entamoeba histolytica; identical to SEQ ID NO: 2399784

SEQ ID NO: 2596613 - protein, 19 aa, Entamoeba histolytica
LTLQRSLIYSLGRVIRESC

SEQ ID NO: 2596614 - protein, 24 aa, Entamoeba histolytica
LTNEFIELFVPLQIQRKVGEIGIV

SEQ ID NO: 2596615 - protein, 24 aa, Entamoeba histolytica
LTNIAPDFLLYEPSKISNGMVSAF

SEQ ID NO: 2596616 - protein, 21 aa, Entamoeba histolytica
LTNKITLTLVINSLQKIPSIG

SEQ ID NO: 2596617 - protein, 33 aa, Entamoeba histolytica
LTNKWNQMDFIYFYQLMIKFFTQIHVNEFPLCV

SEQ ID NO: 2596618 - protein, 24 aa, Entamoeba histolytica
LTNLLILLIELLPFLNGNSRKRVV

SEQ ID NO: 2596619 - protein, 25 aa, Entamoeba histolytica
LTNNWKYPMHFTFHSGDYTKYEIMC

SEQ ID NO: 2596620 - protein, 26 aa, Entamoeba histolytica
LTNNWKYPMHFTFHSGDYTKYEIMCK

SEQ ID NO: 2596621 - protein, 19 aa, Entamoeba histolytica
LTNPKFQRFTFSSFNLEDN

SEQ ID NO: 2596622 - protein, 39 aa, Entamoeba histolytica
LTNQKQLWYLVLIPIFCILILFMISILVCVYKIYQRRIQ

SEQ ID NO: 2596623 - protein, 19 aa, Entamoeba histolytica
LTQFNGLYGTFYKIKQNGV

SEQ ID NO: 2596624 - protein, 18 aa, Entamoeba histolytica
LTREDFFYNKFAADLKRP

SEQ ID NO: 2596625 - protein, 18 aa, Entamoeba histolytica
LTSAFGYYLSLIEMIFTL

SEQ ID NO: 2596626 - protein, 19 aa, Entamoeba histolytica
LTSALLFDYLCEHPKERID

SEQ ID NO: 2596627 - protein, 22 aa, Entamoeba histolytica
LTSIIFIIIFDFISTIISIPFK

SEQ ID NO: 2596628 - protein, 18 aa, Entamoeba histolytica
LTSILTTVPVQNATVTLI

SEQ ID NO: 2596629 - protein, 25 aa, Entamoeba histolytica
LTTKLTTVLLPIIDPLFLSNQTMRL

SEQ ID NO: 2596630 - protein, 35 aa, Entamoeba histolytica
LTTSSIQFKSISPSTLPLIISDTLTFTTMNITNTN

SEQ ID NO: 2596631 - protein, 24 aa, Entamoeba histolytica
LTVAFPISYAIVKKRVRSFNELLD

SEQ ID NO: 2596632 - protein, 17 aa, Entamoeba histolytica
LTVRETCRFNYNYNETI

SEQ ID NO: 2596633 - protein, 29 aa, Entamoeba histolytica
LTVSFIFICIGVWLFFKIKALQPTQPLQH

SEQ ID NO: 2596634 - protein, 17 aa, Entamoeba histolytica
LTVTLKVILFSHEFNFI

SEQ ID NO: 2596635 - protein, 22 aa, Entamoeba histolytica
LTYFDLYEFCMKATNLFLIQTN

SEQ ID NO: 2596636 - protein, 19 aa, Entamoeba histolytica
LVASKQVIYPFFGSPLFLS

SEQ ID NO: 2596637 - protein, 19 aa, Entamoeba histolytica
LVCMVIGIIIIFYLLSVSS

SEQ ID NO: 2596638 - protein, 19 aa, Entamoeba histolytica
LVCSSMLSILPFSSTGKDS

SEQ ID NO: 2596639 - protein, 19 aa, Entamoeba histolytica
LVCYKCNATYFLSIDQKRC

SEQ ID NO: 2596640 - protein, 18 aa, Entamoeba histolytica
LVEILLDKLIDTIKQYPC

SEQ ID NO: 2596641 - protein, 24 aa, Entamoeba histolytica
LVEKGKLIVPKSGYYTLFMKADDL

SEQ ID NO: 2596642 - protein, 17 aa, Entamoeba histolytica
LVEQKQILLLAQAFNVC

SEQ ID NO: 2596643 - protein, 17 aa, Entamoeba histolytica
LVFGRFSNRLYTAYTTF

SEQ ID NO: 2596644 - protein, 28 aa, Entamoeba histolytica
LVFMIIELGIIIVFFIKCGKKLIHQHLY

SEQ ID NO: 2596645 - protein, 19 aa, Entamoeba histolytica
LVFSLTLSFSLSASCNQGL

SEQ ID NO: 2596646 - protein, 28 aa, Entamoeba histolytica
LVFTTYNYYYFSLVPPVSFKLATTLSSE

SEQ ID NO: 2596647 - protein, 29 aa, Entamoeba histolytica
LVFVIAYIFWLIYILVRSFSDGIKLGKTK

SEQ ID NO: 2596648 - protein, 19 aa, Entamoeba histolytica
LVGCFAQHTVYYFKESDIG

SEQ ID NO: 2596649 - protein, 27 aa, Entamoeba histolytica
LVGKTYVPLFPYFKDLKGCFRVVADDY

SEQ ID NO: 2596650 - protein, 17 aa, Entamoeba histolytica
LVGLYYVSVRIFFINSH

SEQ ID NO: 2596651 - protein, 17 aa, Entamoeba histolytica
LVGMLCSLLILHIYWFK

SEQ ID NO: 2596652 - protein, 18 aa, Entamoeba histolytica
LVHGIKYKLTAYIKVKNV

SEQ ID NO: 2596653 - protein, 24 aa, Entamoeba histolytica
LVHHIKLWADRYPFRAEIKGGSVR

SEQ ID NO: 2596654 - protein, 18 aa, Entamoeba histolytica
LVIDLFQNKFRFVEDKYN

SEQ ID NO: 2596655 - protein, 33 aa, Entamoeba histolytica
LVIPSALLIIIFVIIVIIVIIFSCTRCCCGPCC

SEQ ID NO: 2596656 - protein, 43 aa, Entamoeba histolytica
LVITGSCAPVLFLIVCIILLCIITYWAFIPIGVCLVFVSVNTI

SEQ ID NO: 2596657 - protein, 23 aa, Entamoeba histolytica
LVKCPELFQTYLKPEIDFYQKDN

SEQ ID NO: 2596658 - protein, 22 aa, Entamoeba histolytica
LVKKFWLWCKPYEKDHKWISWG

SEQ ID NO: 2596659 - protein, 35 aa, Entamoeba histolytica
LVKVVNRIIFKLDSLVRPFTAKLLVVITPLLDDAD

SEQ ID NO: 2596660 - protein, 36 aa, Entamoeba histolytica
LVKVVNRIIFKLDSLVRPFTAKLLVVITPLLDDADF

SEQ ID NO: 2596661 - protein, 18 aa, Entamoeba histolytica
LVLALRSPVPKQINMIIS

SEQ ID NO: 2596662 - protein, 23 aa, Entamoeba histolytica
LVLFKAIYFWISAPLGILLFRYE

SEQ ID NO: 2596663 - protein, 17 aa, Entamoeba histolytica
LVLFKIHSFAQCSYGCS

SEQ ID NO: 2596664 - protein, 16 aa, Entamoeba histolytica
LVLMFLFLLQKLRRVN

SEQ ID NO: 2596665 - protein, 24 aa, Entamoeba histolytica
LVLNDPLYHWLFNSAVSPDNTTTR

SEQ ID NO: 2596666 - protein, 17 aa, Entamoeba histolytica
LVLNFLMITMWLACIFS

SEQ ID NO: 2596667 - protein, 28 aa, Entamoeba histolytica
LVLSCLLHPFYFITFALDNPITLHINHS

SEQ ID NO: 2596668 - protein, 25 aa, Entamoeba histolytica
LVLYFIPFFILKFLNRTILYQQYMA

SEQ ID NO: 2596669 - protein, 24 aa, Entamoeba histolytica
LVMTITEWVILLFSVSCLSENIVC

SEQ ID NO: 2596670 - protein, 18 aa, Entamoeba histolytica
LVNLPDHCKSVSPSALNF

SEQ ID NO: 2596671 - protein, 26 aa, Entamoeba histolytica
LVPFHSFLDLYIIPSILNITLEPIHV

SEQ ID NO: 2596672 - protein, 27 aa, Entamoeba histolytica
LVPFTKIIHHILSFCLNPFYLNEQNYG

SEQ ID NO: 2596673 - protein, 17 aa, Entamoeba histolytica
LVPLDKDKQVVYSIYQC

SEQ ID NO: 2596674 - protein, 17 aa, Entamoeba histolytica
LVSFFKKVNGIDISNSK

SEQ ID NO: 2596675 - protein, 18 aa, Entamoeba histolytica
LVSLLIIVTYHIAQIGII

SEQ ID NO: 2596676 - protein, 27 aa, Entamoeba histolytica
LVSLTPILPCFICDGGLLILSRIPLKD

SEQ ID NO: 2596677 - protein, 25 aa, Entamoeba histolytica
LVSPKKSFLRFILKSKSNMVSKNLK

SEQ ID NO: 2596678 - protein, 26 aa, Entamoeba histolytica
LVSSSLPWLVFIYLIKPVMSISSTFS

SEQ ID NO: 2596679 - protein, 21 aa, Entamoeba histolytica
LVTEFCPLGSLRRYIKTNSMS

SEQ ID NO: 2596680 - protein, 17 aa, Entamoeba histolytica
LVTLMLELSPFMAFVLY

SEQ ID NO: 2596681 - protein, 28 aa, Entamoeba histolytica
LVVLEFIIFALYLIFFKTKKDKIYIRAI

SEQ ID NO: 2596682 - protein, 18 aa, Entamoeba histolytica
LVVSLGIFIIYYLLNQII

SEQ ID NO: 2596683 - protein, 19 aa, Entamoeba histolytica
LVWKEIRGVWQWIEGKTYE

SEQ ID NO: 2596684 - protein, 19 aa, Entamoeba histolytica
LVYSLKDWVFTSIDSILND

SEQ ID NO: 2596685 - protein, 17 aa, Entamoeba histolytica
LWFCKQWLRTDEKGASL

SEQ ID NO: 2596686 - protein, 19 aa, Entamoeba histolytica
LWFLLSWTVMVVCGATAVY

SEQ ID NO: 2596687 - protein, 17 aa, Entamoeba histolytica
LWGVTHFRISKDSGIIN

SEQ ID NO: 2596688 - protein, 18 aa, Entamoeba histolytica
LWMSIIQHHKTWSILLPV

SEQ ID NO: 2596689 - protein, 33 aa, Entamoeba histolytica
LWTLWIILWSFQFLVFAVVVCSLIMLGFRSGTM

SEQ ID NO: 2596690 - protein, 18 aa, Entamoeba histolytica
LWVCTLSSLILIIPNFHT

SEQ ID NO: 2596691 - protein, 20 aa, Entamoeba histolytica
LWVLIKRNALIQWRSPGKVI

SEQ ID NO: 2596692 - protein, 29 aa, Entamoeba histolytica
LYDDYMMALYNFIFTSIPPVFISFFDSDL

SEQ ID NO: 2596693 - protein, 22 aa, Entamoeba histolytica
LYEACSFIKPYSNKVLFPNSWS

SEQ ID NO: 2596694 - protein, 27 aa, Entamoeba histolytica
LYEPFMKLMYYLFVPISATLILCVIIT

SEQ ID NO: 2596695 - protein, 25 aa, Entamoeba histolytica
LYERSILFSDFLVYCSDNKIVDGLT

SEQ ID NO: 2596696 - protein, 20 aa, Entamoeba histolytica
LYFEARFLPLISQKKNKQPK

SEQ ID NO: 2596697 - protein, 18 aa, Entamoeba histolytica
LYFVYMVVGILAFRTHPI

SEQ ID NO: 2596698 - protein, 23 aa, Entamoeba histolytica
LYGIILMYLLPFFVQFPMCLFTA

SEQ ID NO: 2596699 - protein, 18 aa, Entamoeba histolytica
LYGTYVYDILSLLLTGFE

SEQ ID NO: 2596700 - protein, 19 aa, Entamoeba histolytica
LYILICYGKLIQVNLEKGN

SEQ ID NO: 2596701 - protein, 30 aa, Entamoeba histolytica
LYLSGLTSILFNIPLIPKCNSKYELFGGQV

SEQ ID NO: 2596702 - protein, 18 aa, Entamoeba histolytica
LYLVTFNRDYAKASELLV

SEQ ID NO: 2596703 - protein, 32 aa, Entamoeba histolytica
LYNQTNCIKLANTKLRLKRLTNSLIHHCEKET

SEQ ID NO: 2596704 - protein, 17 aa, Entamoeba histolytica
LYNYPLLNHDQVCSLCF

SEQ ID NO: 2596705 - protein, 25 aa, Entamoeba histolytica
LYPSQFVWFRHIYLAFSTYTKLNQL

SEQ ID NO: 2596706 - protein, 30 aa, Entamoeba histolytica
LYQLGIDRTFLFHILYNLAQKLKDGNLYAL

SEQ ID NO: 2596707 - protein, 22 aa, Entamoeba histolytica
LYSCYSIYYIFATILSMQVPFI

SEQ ID NO: 2596708 - protein, 17 aa, Entamoeba histolytica
LYSPFPYGYESETLYGM

SEQ ID NO: 2596709 - protein, 20 aa, Entamoeba histolytica
LYTDIFGQKKIKIFNGFYST

SEQ ID NO: 2596710 - protein, 20 aa, Entamoeba histolytica
LYTRSSILVMLFFSYQLLSI

SEQ ID NO: 2596711 - protein, 18 aa, Entamoeba histolytica
LYYLIRCEPFSHFGIELQ

SEQ ID NO: 2596712 - protein, 37 aa, Entamoeba histolytica
LYYTLNYIFCRTMLSILFSIIKAFLSKAFYGIGNPLE

SEQ ID NO: 2596713 - protein, 48 aa, Entamoeba histolytica
MACSKTNWALIIPLVIVGIILIIVIIIIIIGIVWWRRKKTAKDESKAI

SEQ ID NO: 2596714 - protein, 35 aa, Entamoeba histolytica
MADKAIWRIIFIISPIALILLILGIVGLVVTTYLL

SEQ ID NO: 2596715 - protein, 26 aa, Entamoeba histolytica
MAIIVLMVVAIFIYEFIQKKRYNRFS

SEQ ID NO: 2596716 - protein, 25 aa, Entamoeba histolytica
MALDILQPLLLLISSSKMISTCNSF

SEQ ID NO: 2596717 - protein, 20 aa, Entamoeba histolytica
MALTFYRFFAFSVMLITCIV

SEQ ID NO: 2596718 - protein, 17 aa, Entamoeba histolytica
MATNPLNFTIKSIKTMY

SEQ ID NO: 2596719 - protein, 22 aa, Entamoeba histolytica
MATQNILLFLIFLVLFGIFIKG

SEQ ID NO: 2596720 - protein, 18 aa, Entamoeba histolytica
MCFFVVAVALILIFPEKF

SEQ ID NO: 2596721 - protein, 18 aa, Entamoeba histolytica
MDITPICSTTILQQIRFS

SEQ ID NO: 2596722 - protein, 21 aa, Entamoeba histolytica
MDLCLHIVQYIDVIEPWLQSY

SEQ ID NO: 2596723 - protein, 37 aa, Entamoeba histolytica
MDNFEHFFVHWYYQARIFFFKLIHLKMTLAPSFRING

SEQ ID NO: 2596724 - protein, 32 aa, Entamoeba histolytica
MDNIKGILMTRISLLLPLLLEFIKQNKLNERY

SEQ ID NO: 2596725 - protein, 27 aa, Entamoeba histolytica
MDNSQMHWFYGINFLVHRLFFQFFDSN

SEQ ID NO: 2596726 - protein, 27 aa, Entamoeba histolytica
MDVSELLEILFWKYLKEEPGTSAELDK

SEQ ID NO: 2596727 - protein, 27 aa, Entamoeba histolytica
MEDPQTTFLFILQSFVSLIYNNKYAQI

SEQ ID NO: 2596728 - protein, 17 aa, Entamoeba histolytica
MEDRPYLYLYQNVNDTA

SEQ ID NO: 2596729 - protein, 17 aa, Entamoeba histolytica
MEETHRNVFLYILKTIK

SEQ ID NO: 2596730 - protein, 24 aa, Entamoeba histolytica
MEETVLLGALVIGSIFIGSSVEKK

SEQ ID NO: 2596731 - protein, 17 aa, Entamoeba histolytica
MEGIPLNQLTFPKIKTA

SEQ ID NO: 2596732 - protein, 19 aa, Entamoeba histolytica
MEGVGSLLFIPQINEMWSI

SEQ ID NO: 2596733 - protein, 33 aa, Entamoeba histolytica
MEKEINTFTIWIPLEESFLGTKKRIQLNHGLVT

SEQ ID NO: 2596734 - protein, 29 aa, Entamoeba histolytica
MEMGDEAYLVKWKLFRSLALEDLKKTYGR

SEQ ID NO: 2596735 - protein, 27 aa, Entamoeba histolytica
MENDTFDIILSTIFMWMKLYSKDEDAW

SEQ ID NO: 2596736 - protein, 22 aa, Entamoeba histolytica
MEWGHFLICFIAIMISQLSTLV

SEQ ID NO: 2596737 - protein, 23 aa, Entamoeba histolytica
MEWGHFLICFIAIMISQLSTLVI

SEQ ID NO: 2596738 - protein, 46 aa, Entamoeba histolytica
MEYSYFNEIVFISLLYSIALLLLLIVTFSLIGFYFYSNRKFKRNQD

SEQ ID NO: 2596739 - protein, 29 aa, Entamoeba histolytica
MFDGFLVLKMPFPLSYRFKLITQQGLGGM

SEQ ID NO: 2596740 - protein, 27 aa, Entamoeba histolytica
MFETMKWGPAYPKEQFKYPWQIAQFVS

SEQ ID NO: 2596741 - protein, 31 aa, Entamoeba histolytica; identical to SEQ ID NO: 2399895

SEQ ID NO: 2596742 - protein, 34 aa, Entamoeba histolytica
MFIGDYQPPFDLFKNIFLLLNAVISPYVLVAVHT

SEQ ID NO: 2596743 - protein, 18 aa, Entamoeba histolytica
MFIYQLVPIMFFTYFVSG

SEQ ID NO: 2596744 - protein, 20 aa, Entamoeba histolytica
MFKMFVYIVLSIENNSLYSR

SEQ ID NO: 2596745 - protein, 28 aa, Entamoeba histolytica
MFLLSIVIYLFWLLFEVIRSFSERRKMS

SEQ ID NO: 2596746 - protein, 19 aa, Entamoeba histolytica
MFPVVWNLYYGINDSSPHG

SEQ ID NO: 2596747 - protein, 20 aa, Entamoeba histolytica
MFREFLLRVHPQLYTHLLKS

SEQ ID NO: 2596748 - protein, 19 aa, Entamoeba histolytica
MFSILFEIIELAPFVEFPE

SEQ ID NO: 2596749 - protein, 25 aa, Entamoeba histolytica
MFSMIYELLPILNKKYRVMLITFIM

SEQ ID NO: 2596750 - protein, 18 aa, Entamoeba histolytica
MFSTSLFFYCFYIKMNWI

SEQ ID NO: 2596751 - protein, 37 aa, Entamoeba histolytica
MGIVGYTIWIILTIIYFCLTWTYFNKAIYLTGASTLG

SEQ ID NO: 2596752 - protein, 17 aa, Entamoeba histolytica
MGIWIKSCEQHIIHSCK

SEQ ID NO: 2596753 - protein, 25 aa, Entamoeba histolytica
MGLLIIYLFWLIFSIIRSFSEVRKL

SEQ ID NO: 2596754 - protein, 33 aa, Entamoeba histolytica
MGMFCAAIVFIVLTLWWFYKAITFTGYVQPDDH

SEQ ID NO: 2596755 - protein, 34 aa, Entamoeba histolytica
MGMFCAAVVFIVLTLWWFYKAITFTGYVQPDDHC

SEQ ID NO: 2596756 - protein, 24 aa, Entamoeba histolytica
MGNNQLFFVCKEYGKSMVMITVGN

SEQ ID NO: 2596757 - protein, 21 aa, Entamoeba histolytica
MGVMFLMRIICVYMTLLNDPS

SEQ ID NO: 2596758 - protein, 17 aa, Entamoeba histolytica
MHLASVVEYLITAITIV

SEQ ID NO: 2596759 - protein, 18 aa, Entamoeba histolytica
MHLVIFFSTLLPSLQDKL

SEQ ID NO: 2596760 - protein, 22 aa, Entamoeba histolytica
MIAVVLCFSLIKIQPSLECKLY

SEQ ID NO: 2596761 - protein, 25 aa, Entamoeba histolytica
MICANSCFFLPFGYQTNLMVMKDGG

SEQ ID NO: 2596762 - protein, 26 aa, Entamoeba histolytica
MIDKEKHMYLIPKYYYKNAKIDVPSE

SEQ ID NO: 2596763 - protein, 27 aa, Entamoeba histolytica
MIEQLRMNFVLFILATIGGIVGGAVFP

SEQ ID NO: 2596764 - protein, 19 aa, Entamoeba histolytica
MIFLITGILFFISMFGFIF

SEQ ID NO: 2596765 - protein, 17 aa, Entamoeba histolytica
MIGFMYLSSYPITVTLR

SEQ ID NO: 2596766 - protein, 40 aa, Entamoeba histolytica
MIIDVILFIIVWITLFGIILYLFYPTLPPEIYPTPTIVKQ

SEQ ID NO: 2596767 - protein, 30 aa, Entamoeba histolytica
MIIICIGIITMISFFCYVGLFMAAGEKMIG

SEQ ID NO: 2596768 - protein, 17 aa, Entamoeba histolytica
MIKLKRIIKLKCNIPVG

SEQ ID NO: 2596769 - protein, 31 aa, Entamoeba histolytica
MIMITEIFGFILLVVILYDLYLLYKRETHTV

SEQ ID NO: 2596770 - protein, 29 aa, Entamoeba histolytica
MINEYLYHSIIELLTILPPSVNIIEKFQS

SEQ ID NO: 2596771 - protein, 32 aa, Entamoeba histolytica
MINTTNYIFILRFLWILIVHRRARGITTNDIF

SEQ ID NO: 2596772 - protein, 28 aa, Entamoeba histolytica
MIQKLRFFVRLIPLFIPILLIGMYLLFY

SEQ ID NO: 2596773 - protein, 24 aa, Entamoeba histolytica
MISLHFYLDACFIFSLLNNASNDS

SEQ ID NO: 2596774 - protein, 22 aa, Entamoeba histolytica
MIVIVVVVIITLVVIRIHKKKK

SEQ ID NO: 2596775 - protein, 19 aa, Entamoeba histolytica
MIWFEYALIKESHGYWIVA

SEQ ID NO: 2596776 - protein, 30 aa, Entamoeba histolytica
MIYGALFPIFAYFLAEAICMLVTVYLTGMS

SEQ ID NO: 2596777 - protein, 18 aa, Entamoeba histolytica
MIYTDYLLSSLKSNDSLI

SEQ ID NO: 2596778 - protein, 28 aa, Entamoeba histolytica
MKDKQKLLQPYLIALIDSLFPKGKLNEI

SEQ ID NO: 2596779 - protein, 26 aa, Entamoeba histolytica
MKEFINAFFIIKQYFSVLSIHNENRI

SEQ ID NO: 2596780 - protein, 23 aa, Entamoeba histolytica
MKEVALYTHHLLDHNFTEWNIDS

SEQ ID NO: 2596781 - protein, 27 aa, Entamoeba histolytica
MKEYIQLFLPIILLMGKTALPQIRGRC

SEQ ID NO: 2596782 - protein, 20 aa, Entamoeba histolytica
MKFRPSRPHFVELISFEDQN

SEQ ID NO: 2596783 - protein, 19 aa, Entamoeba histolytica
MKGVAYFDLLVYYHKKIQK

SEQ ID NO: 2596784 - protein, 26 aa, Entamoeba histolytica
MKIIENIMSTIYYLFNYKRDMEIKEN

SEQ ID NO: 2596785 - protein, 25 aa, Entamoeba histolytica
MKIKPTYEWFLGGLVFILVVCTPCL

SEQ ID NO: 2596786 - protein, 22 aa, Entamoeba histolytica
MKIMFNLTFPFVILKALINTHS

SEQ ID NO: 2596787 - protein, 33 aa, Entamoeba histolytica; identical to SEQ ID NO: 2399943

SEQ ID NO: 2596788 - protein, 31 aa, Entamoeba histolytica
MKKVKQWWVLLIILIVFSSFTPLGAIIGKFV

SEQ ID NO: 2596789 - protein, 34 aa, Entamoeba histolytica
MKKWPENALIAIGGFLFLRFINPAIVSPHRFGSN

SEQ ID NO: 2596790 - protein, 26 aa, Entamoeba histolytica
MKLKNLLYVSYQLRTPLLFEPIVKFI

SEQ ID NO: 2596791 - protein, 21 aa, Entamoeba histolytica
MKLVILQNRYVPWISLARIFY

SEQ ID NO: 2596792 - protein, 46 aa, Entamoeba histolytica
MKNKIIKIQILLIFHMIKLMLVLMIFLIIIITLMEHQVCLCFLLLL

SEQ ID NO: 2596793 - protein, 17 aa, Entamoeba histolytica
MKPVIADDSWRLLFKTE

SEQ ID NO: 2596794 - protein, 21 aa, Entamoeba histolytica
MKSLRHPCILQFFGSGMDNNF

SEQ ID NO: 2596795 - protein, 27 aa, Entamoeba histolytica
MKTSTGIITFIWIIEQFIEKTIIINKT

SEQ ID NO: 2596796 - protein, 29 aa, Entamoeba histolytica
MKVKTIHKLYSPLFFYTQTLFSKNDKSIV

SEQ ID NO: 2596797 - protein, 29 aa, Entamoeba histolytica
MLASSLLIRLIPFLRIFELFMIDILYAFY

SEQ ID NO: 2596798 - protein, 27 aa, Entamoeba histolytica
MLCSLLILHIYWFKLIIEMIFKVASHE

SEQ ID NO: 2596799 - protein, 27 aa, Entamoeba histolytica
MLELSPFMAFVLYLVYIQIDYHLEVGK

SEQ ID NO: 2596800 - protein, 21 aa, Entamoeba histolytica
MLFDARWLLLEMGLMAIYCGI

SEQ ID NO: 2596801 - protein, 43 aa, Entamoeba histolytica; identical to SEQ ID NO: 2399952

SEQ ID NO: 2596802 - protein, 29 aa, Entamoeba histolytica
MLIFIMTIAFIIKIIWYRGVIRENSGLLM

SEQ ID NO: 2596803 - protein, 17 aa, Entamoeba histolytica
MLIIVIVSNVVIGFTQE

SEQ ID NO: 2596804 - protein, 28 aa, Entamoeba histolytica
MLITIIFFIFLIWYFKKYSFKLGVLLVF

SEQ ID NO: 2596805 - protein, 19 aa, Entamoeba histolytica
MLLAIFWRKQKQYVFHFTG

SEQ ID NO: 2596806 - protein, 24 aa, Entamoeba histolytica
MLLIIFFILFWFFKGDELITSGQE

SEQ ID NO: 2596807 - protein, 39 aa, Entamoeba histolytica
MLNWTSFSFDEYMEGLIAPIPLQQPVYKEPKLSDLVTLN

SEQ ID NO: 2596808 - protein, 19 aa, Entamoeba histolytica
MLQCFTWEDPFPKTQFKFA

SEQ ID NO: 2596809 - protein, 25 aa, Entamoeba histolytica
MLQFFLEEFQNILLPILKASLTTNG

SEQ ID NO: 2596810 - protein, 17 aa, Entamoeba histolytica
MLTPLTCRCGKTKIMPP

SEQ ID NO: 2596811 - protein, 22 aa, Entamoeba histolytica
MLTQLRHKCVVEFIGAVYTEGE

SEQ ID NO: 2596812 - protein, 22 aa, Entamoeba histolytica
MLTQYRHPCIVNLVGAVYTEGE

SEQ ID NO: 2596813 - protein, 38 aa, Entamoeba histolytica
MLVEYILDFFPIQLTILIITILILITFAFQSILMAFRV

SEQ ID NO: 2596814 - protein, 18 aa, Entamoeba histolytica
MLVFLIGILLIICKMFLS

SEQ ID NO: 2596815 - protein, 20 aa, Entamoeba histolytica
MLVFVVFFTLNIRSEFQLFG

SEQ ID NO: 2596816 - protein, 26 aa, Entamoeba histolytica
MLVIDPLAFRSWDDYVLNNLKHSEQL

SEQ ID NO: 2596817 - protein, 17 aa, Entamoeba histolytica
MLVLIFIGFLIIKKVIN

SEQ ID NO: 2596818 - protein, 24 aa, Entamoeba histolytica
MMCFSLEYLLTDLLANSSVRLFGV

SEQ ID NO: 2596819 - protein, 32 aa, Entamoeba histolytica
MMDDMPIFAFMMLIMLFIFEGMTTFTRMKNYG

SEQ ID NO: 2596820 - protein, 17 aa, Entamoeba histolytica
MMFIGMFGCLFVFEGKH

SEQ ID NO: 2596821 - protein, 17 aa, Entamoeba histolytica
MMILLTSILLVFLQIIT

SEQ ID NO: 2596822 - protein, 34 aa, Entamoeba histolytica
MMIRNLFGTLLSFFDITPLGRLLNYFSRDLRFVD

SEQ ID NO: 2596823 - protein, 18 aa, Entamoeba histolytica
MMLFFMMLALSFFFGNQQ

SEQ ID NO: 2596824 - protein, 18 aa, Entamoeba histolytica
MMLVLILIEIGSLCLMIF

SEQ ID NO: 2596825 - protein, 18 aa, Entamoeba histolytica
MMLYVLFYLIFKIFLIVI

SEQ ID NO: 2596826 - protein, 19 aa, Entamoeba histolytica
MMMPIVIYMIEEYEFFKKW

SEQ ID NO: 2596827 - protein, 18 aa, Entamoeba histolytica
MMNPLFSMIVVLVTIFLC

SEQ ID NO: 2596828 - protein, 26 aa, Entamoeba histolytica
MMSCIVTIPWIIFYFIIEKQYEYTIS

SEQ ID NO: 2596829 - protein, 19 aa, Entamoeba histolytica
MMTLWNIFLIIFTNLSIKY

SEQ ID NO: 2596830 - protein, 25 aa, Entamoeba histolytica
MNCKNQIIGLILFTNTAKNTTTIIN

SEQ ID NO: 2596831 - protein, 17 aa, Entamoeba histolytica
MNCLTQWCKARGFKDGI

SEQ ID NO: 2596832 - protein, 22 aa, Entamoeba histolytica
MNKFWMIIFNFALSLGAFFGFI

SEQ ID NO: 2596833 - protein, 18 aa, Entamoeba histolytica
MNKLPGIFVVCTQSIYIV

SEQ ID NO: 2596834 - protein, 25 aa, Entamoeba histolytica
MNMSTYFFWLVVPLLMQDRDASSFQ

SEQ ID NO: 2596835 - protein, 26 aa, Entamoeba histolytica
MNSIIQFIQNCLLRIILFVCGIYSIQ

SEQ ID NO: 2596836 - protein, 25 aa, Entamoeba histolytica
MNVQRLDRILPPIISILLTQQDERN

SEQ ID NO: 2596837 - protein, 19 aa, Entamoeba histolytica
MNWLGDWGSQFGLLAIGFE

SEQ ID NO: 2596838 - protein, 24 aa, Entamoeba histolytica
MNYAAYLMFPLICLCIKIIFNEKE

SEQ ID NO: 2596839 - protein, 17 aa, Entamoeba histolytica
MPCLYPMAVALTFSREV

SEQ ID NO: 2596840 - protein, 19 aa, Entamoeba histolytica
MPIYIVLFCTLIFKCISLA

SEQ ID NO: 2596841 - protein, 18 aa, Entamoeba histolytica
MPKWLQMIVGLILAIASG

SEQ ID NO: 2596842 - protein, 17 aa, Entamoeba histolytica
MPPIGEGAFGMVFRGTY

SEQ ID NO: 2596843 - protein, 32 aa, Entamoeba histolytica
MPSDIYSLAITMYQTWSWKNPYDKDEGSRFKY

SEQ ID NO: 2596844 - protein, 33 aa, Entamoeba histolytica; identical to SEQ ID NO: 2399990

SEQ ID NO: 2596845 - protein, 17 aa, Entamoeba histolytica
MQKRKLILYWNKENTLF

SEQ ID NO: 2596846 - protein, 27 aa, Entamoeba histolytica
MQPMNYLVNLVFTYLCGYYQINIVPMV

SEQ ID NO: 2596847 - protein, 19 aa, Entamoeba histolytica
MQTARTRSLIPSELKIQEC

SEQ ID NO: 2596848 - protein, 19 aa, Entamoeba histolytica
MRCPYIINFIGAVDTPGYY

SEQ ID NO: 2596849 - protein, 19 aa, Entamoeba histolytica
MRFLAIYIPHISVICAIII

SEQ ID NO: 2596850 - protein, 18 aa, Entamoeba histolytica
MRKILLEIAYCYLNFCIA

SEQ ID NO: 2596851 - protein, 18 aa, Entamoeba histolytica
MRLFLSSIFTSFLPQPIQ

SEQ ID NO: 2596852 - protein, 35 aa, Entamoeba histolytica
MSARTIILKILLNNWFNLLFLHWSSDVRKGFVHLL

SEQ ID NO: 2596853 - protein, 33 aa, Entamoeba histolytica
MSCIIVSFFVILLFNIVFFVIKNCFLNEPSIIE

SEQ ID NO: 2596854 - protein, 48 aa, Entamoeba histolytica
MSCSKTNWALIIPLVIVAVIIIVILLLVLIGIIWWRRSRSVKAETAAI

SEQ ID NO: 2596855 - protein, 49 aa, Entamoeba histolytica
MSKGITNFLFWGIGSIIYIIFYILLLLLILFIYYHLIKQIKQEINDEKL

SEQ ID NO: 2596856 - protein, 28 aa, Entamoeba histolytica
MSKIIQKVESLIYFSYASDEIIEIIIQN

SEQ ID NO: 2596857 - protein, 29 aa, Entamoeba histolytica
MSLLCVLLLLHIYWFTLILKMVYKIITER

SEQ ID NO: 2596858 - protein, 17 aa, Entamoeba histolytica
MSPFIVLSMTLLAVFAT

SEQ ID NO: 2596859 - protein, 24 aa, Entamoeba histolytica
MSRNPLILLIKAKGKIFGAYMNDP

SEQ ID NO: 2596860 - protein, 26 aa, Entamoeba histolytica
MSTYPIFLNWYNFFIAFGLVLMATFM

SEQ ID NO: 2596861 - protein, 26 aa, Entamoeba histolytica
MTDCSLFFFYVLMRMAFKPIMAKLFG

SEQ ID NO: 2596862 - protein, 24 aa, Entamoeba histolytica
MTDVWWNVITQCWDHIPSKRPAFK

SEQ ID NO: 2596863 - protein, 22 aa, Entamoeba histolytica
MTFRMLCSIAFFSLLIETISFG

SEQ ID NO: 2596864 - protein, 18 aa, Entamoeba histolytica
MTFTKGIGSPKYMAPEIL

SEQ ID NO: 2596865 - protein, 33 aa, Entamoeba histolytica
MTHTKPFLFGVKHYKDFYAIQQGVLIALANQCF

SEQ ID NO: 2596866 - protein, 23 aa, Entamoeba histolytica
MTIDSMYFTPFSTLNYTKCPTSS

SEQ ID NO: 2596867 - protein, 42 aa, Entamoeba histolytica
MTIGITIGTFIIVLIIVIIITIIITIFYLQHKKEKKKMDNIC

SEQ ID NO: 2596868 - protein, 17 aa, Entamoeba histolytica
MTPFLIILAYIHLIACW

SEQ ID NO: 2596869 - protein, 42 aa, Entamoeba histolytica
MTTMQLLYCSIFNFAPLPLYIGWYMIFFTTMFNQLPIIMFIT

SEQ ID NO: 2596870 - protein, 33 aa, Entamoeba histolytica
MTYTPSWKSIVIPLLIGFIVPLISNIIPIKKAL

SEQ ID NO: 2596871 - protein, 18 aa, Entamoeba histolytica
MVCSIICALLAILPAFSN

SEQ ID NO: 2596872 - protein, 21 aa, Entamoeba histolytica
MVDELLFNDCSFFSSINGITA

SEQ ID NO: 2596873 - protein, 30 aa, Entamoeba histolytica; identical to SEQ ID NO: 2400021

SEQ ID NO: 2596874 - protein, 17 aa, Entamoeba histolytica
MVEAIDFVFWLMDKQDL

SEQ ID NO: 2596875 - protein, 18 aa, Entamoeba histolytica
MVFMFLFVLVLIPPFLLS

SEQ ID NO: 2596876 - protein, 18 aa, Entamoeba histolytica
MVFYIQREVPRHPVAFVI

SEQ ID NO: 2596877 - protein, 19 aa, Entamoeba histolytica
MVIQYFQLGSLGNYIRHEK

SEQ ID NO: 2596878 - protein, 39 aa, Entamoeba histolytica
MVLMSLTMIWTYKRIFFLIFQLFYIIMLIVFAVSRNAYV

SEQ ID NO: 2596879 - protein, 19 aa, Entamoeba histolytica
MVMTDMFENIPKLKHINIP

SEQ ID NO: 2596880 - protein, 19 aa, Entamoeba histolytica
MVPALFLRRIYDIGMSKID

SEQ ID NO: 2596881 - protein, 17 aa, Entamoeba histolytica
MVSNMFIGLLAYVNLYC

SEQ ID NO: 2596882 - protein, 18 aa, Entamoeba histolytica
MVVYVSLFVLIGGLLIIM

SEQ ID NO: 2596883 - protein, 32 aa, Entamoeba histolytica
MVYGSLFLLTFIYYFILFSIEYLSRSYRYLFG

SEQ ID NO: 2596884 - protein, 17 aa, Entamoeba histolytica
MWLSQQLDPFIKTNSEE

SEQ ID NO: 2596885 - protein, 17 aa, Entamoeba histolytica
MWNIWMEKDDNGDIAIM

SEQ ID NO: 2596886 - protein, 18 aa, Entamoeba histolytica
MYAQPMYNQPMYDQSTPM

SEQ ID NO: 2596887 - protein, 22 aa, Entamoeba histolytica
MYHPALMIYQFLSELGFVNAQL

SEQ ID NO: 2596888 - protein, 23 aa, Entamoeba histolytica
MYIGILFFCYFIAQTLVMSVMSF

SEQ ID NO: 2596889 - protein, 18 aa, Entamoeba histolytica
MYMYMYFCIPLTKELYSQ

SEQ ID NO: 2596890 - protein, 25 aa, Entamoeba histolytica
MYNNPIRMIIIDFILSIDGSGNIPI

SEQ ID NO: 2596891 - protein, 26 aa, Entamoeba histolytica
MYSYPTIFEFTPYLLSFLTYHTFSHR

SEQ ID NO: 2596892 - protein, 31 aa, Entamoeba histolytica
NACLTACDIFLMYLPTLLSSSSFILLKQQIL

SEQ ID NO: 2596893 - protein, 36 aa, Entamoeba histolytica
NAHFTFFVLAVIPFINFLLLLLIPKSINYPKQEVQY

SEQ ID NO: 2596894 - protein, 20 aa, Entamoeba histolytica
NAHIIVYPINNMYRIQVYYK

SEQ ID NO: 2596895 - protein, 23 aa, Entamoeba histolytica
NAIRRPFMNFGYFVSCLTTFKVA

SEQ ID NO: 2596896 - protein, 23 aa, Entamoeba histolytica
NALALQLKWANLTYLRDGKPQYK

SEQ ID NO: 2596897 - protein, 23 aa, Entamoeba histolytica
NALQMLWVNMIMDTLAALALGTE

SEQ ID NO: 2596898 - protein, 20 aa, Entamoeba histolytica
NALRPYVVKCGESNYRVGTD

SEQ ID NO: 2596899 - protein, 21 aa, Entamoeba histolytica
NARDWAISRNRFWGTPIPIWT

SEQ ID NO: 2596900 - protein, 26 aa, Entamoeba histolytica
NARKTYYINVIPTLFKYPSYTLRTYQ

SEQ ID NO: 2596901 - protein, 21 aa, Entamoeba histolytica
NASLYLKKIAPPLGTLMSASK

SEQ ID NO: 2596902 - protein, 39 aa, Entamoeba histolytica; identical to SEQ ID NO: 2400058

SEQ ID NO: 2596903 - protein, 31 aa, Entamoeba histolytica
NASSVLHYILDLPIIALLLTLIPPGTVDYEK

SEQ ID NO: 2596904 - protein, 25 aa, Entamoeba histolytica
NATDDPFIIDYFKRTVLVKENMFEQ

SEQ ID NO: 2596905 - protein, 26 aa, Entamoeba histolytica
NATESLQWFYGINYLVHRIFFTFYDN

SEQ ID NO: 2596906 - protein, 23 aa, Entamoeba histolytica
NAVEFNLFVKPYCTCKVDDPILI

SEQ ID NO: 2596907 - protein, 20 aa, Entamoeba histolytica
NAVFRPEAILENSICFEGKK

SEQ ID NO: 2596908 - protein, 36 aa, Entamoeba histolytica
NCKESFEICYGCFLCGLIPIFISPKVSIIEINKVIQ

SEQ ID NO: 2596909 - protein, 19 aa, Entamoeba histolytica
NCKIKLKIFLDAAKGIQYL

SEQ ID NO: 2596910 - protein, 26 aa, Entamoeba histolytica
NCKITTISFNLLLSFISYILSNQKNK

SEQ ID NO: 2596911 - protein, 25 aa, Entamoeba histolytica
NCPCKGIYCHIIIYSSIINEPLINI

SEQ ID NO: 2596912 - protein, 28 aa, Entamoeba histolytica
NCPEPSFPWFYKLWRVQGYYNLLILKCY

SEQ ID NO: 2596913 - protein, 34 aa, Entamoeba histolytica
NCQWALYNNGRLLNPLNFYFYPEFEISDSKPFIF

SEQ ID NO: 2596914 - protein, 23 aa, Entamoeba histolytica
NCQWIFVVVITLISIILLVAFFA

SEQ ID NO: 2596915 - protein, 17 aa, Entamoeba histolytica
NCTTCIAGYLLNSISSC

SEQ ID NO: 2596916 - protein, 39 aa, Entamoeba histolytica
NCTVNIIAVILISLIIFISISAIIIGIIIYIAIKINKYK

SEQ ID NO: 2596917 - protein, 30 aa, Entamoeba histolytica
NCVSVLEMLFISFPLDFIGEYLLMFNSFPD

SEQ ID NO: 2596918 - protein, 29 aa, Entamoeba histolytica
NCYSSWINLALLIILKSPFPNKFQERPEP

SEQ ID NO: 2596919 - protein, 20 aa, Entamoeba histolytica
NDCTLISSLLLNFTKGVSFY

SEQ ID NO: 2596920 - protein, 40 aa, Entamoeba histolytica
NDDHSFNYWIVISFGILAILILIIALAIGLTIVIISYRKM

SEQ ID NO: 2596921 - protein, 23 aa, Entamoeba histolytica
NDFDVLPYTLTLKPTMQLMKTVI

SEQ ID NO: 2596922 - protein, 22 aa, Entamoeba histolytica
NDFFYIDSFIPSYNYKINPNVS

SEQ ID NO: 2596923 - protein, 24 aa, Entamoeba histolytica
NDFSLPTFGFTVYGGLKVNGVLTI

SEQ ID NO: 2596924 - protein, 24 aa, Entamoeba histolytica
NDFSNLLVLLRNVLCVIFPMIILD

SEQ ID NO: 2596925 - protein, 30 aa, Entamoeba histolytica
NDGNIGWYWLIFIFSFISGFIPSIRELSKK

SEQ ID NO: 2596926 - protein, 26 aa, Entamoeba histolytica
NDGQSPFIYFLRFHDEPTIVECLEAF

SEQ ID NO: 2596927 - protein, 24 aa, Entamoeba histolytica
NDGVAPFYYHWKIHYGLVDPITFE

SEQ ID NO: 2596928 - protein, 27 aa, Entamoeba histolytica
NDKEYTFFFCFLKFIPCYSILGCICSI

SEQ ID NO: 2596929 - protein, 23 aa, Entamoeba histolytica
NDLFNYIFTANSHFALFLTDLLR

SEQ ID NO: 2596930 - protein, 20 aa, Entamoeba histolytica
NDLKYYLNAYVFKDILKNPP

SEQ ID NO: 2596931 - protein, 19 aa, Entamoeba histolytica
NDMYFDSLFIYLDEINLGK

SEQ ID NO: 2596932 - protein, 27 aa, Entamoeba histolytica
NDMYLGLFFFIFYFAQTVAMVLMSLTT

SEQ ID NO: 2596933 - protein, 22 aa, Entamoeba histolytica
NDNYYHLPIQRTYINSIPTNLH

SEQ ID NO: 2596934 - protein, 17 aa, Entamoeba histolytica
NDPFYWMRLVMASNRGS

SEQ ID NO: 2596935 - protein, 17 aa, Entamoeba histolytica
NDPFYWMRLVMASNTEN

SEQ ID NO: 2596936 - protein, 29 aa, Entamoeba histolytica
NDSKSFVNPLIVVTGIVVVVVSICIGYKC

SEQ ID NO: 2596937 - protein, 30 aa, Entamoeba histolytica
NDTEIEDFFIIFIWILKNINKNMLQYYIVS

SEQ ID NO: 2596938 - protein, 23 aa, Entamoeba histolytica
NDVHYFIKPLFLNWAMFLGMTLC

SEQ ID NO: 2596939 - protein, 29 aa, Entamoeba histolytica
NDYGNEGFLLMIFYYLGCTLTLRKIKKEG

SEQ ID NO: 2596940 - protein, 23 aa, Entamoeba histolytica
NDYILSASFLSYYQVRKYYLHVF

SEQ ID NO: 2596941 - protein, 22 aa, Entamoeba histolytica
NDYNVIFGMFKDFVEKVVTSTG

SEQ ID NO: 2596942 - protein, 17 aa, Entamoeba histolytica
NDYSYHFTYNFTYSLQK

SEQ ID NO: 2596943 - protein, 21 aa, Entamoeba histolytica
NECMRLFMKIKRLLDSTQNIL

SEQ ID NO: 2596944 - protein, 23 aa, Entamoeba histolytica
NEDDLLKYMLFWKNSTVLVYDIE

SEQ ID NO: 2596945 - protein, 29 aa, Entamoeba histolytica
NEEENIIYSQWIEKILSPYDDVDMIVSGR

SEQ ID NO: 2596946 - protein, 38 aa, Entamoeba histolytica
NEEGVLLNCFLMILPVLKPHRRLAIALAIEYLKKMNCC

SEQ ID NO: 2596947 - protein, 26 aa, Entamoeba histolytica
NEEPALSTAFIYYDSTNKKCSNYEKG

SEQ ID NO: 2596948 - protein, 19 aa, Entamoeba histolytica
NEFLYIVGVLAEIYISIGL

SEQ ID NO: 2596949 - protein, 26 aa, Entamoeba histolytica
NEGLVPNLWVKGIIVPYINETLLRTV

SEQ ID NO: 2596950 - protein, 25 aa, Entamoeba histolytica
NEHFKKLIKYLPQFTSLVIVGGMAI

SEQ ID NO: 2596951 - protein, 18 aa, Entamoeba histolytica
NEIERLIEWGRGKELIDE

SEQ ID NO: 2596952 - protein, 26 aa, Entamoeba histolytica
NEIGDIPHLLLFKNINILIKDYLISP

SEQ ID NO: 2596953 - protein, 20 aa, Entamoeba histolytica
NEKHRILPFNSYYGIINSLI

SEQ ID NO: 2596954 - protein, 21 aa, Entamoeba histolytica
NELFNQWIRNMNLVIMGDCLS

SEQ ID NO: 2596955 - protein, 28 aa, Entamoeba histolytica
NELHNVDLSLYLKLLIDRIKFGVCNDIV

SEQ ID NO: 2596956 - protein, 19 aa, Entamoeba histolytica
NELKYYLNAYVFKDILKNP

SEQ ID NO: 2596957 - protein, 28 aa, Entamoeba histolytica
NEMIKYQIQILYFLMPTYKDNSLYKEKV

SEQ ID NO: 2596958 - protein, 30 aa, Entamoeba histolytica
NEMVNFRTAFYQCLGLLLYNIPLSYHVGFL

SEQ ID NO: 2596959 - protein, 23 aa, Entamoeba histolytica
NENGILFKFLKNGKSFLTSQRIQ

SEQ ID NO: 2596960 - protein, 21 aa, Entamoeba histolytica
NEPGLFGYYIADEPSTSCVSS

SEQ ID NO: 2596961 - protein, 18 aa, Entamoeba histolytica
NEPSCYQVFHDEIYMAMG

SEQ ID NO: 2596962 - protein, 18 aa, Entamoeba histolytica
NERNIKFFKAPSSSLFSN

SEQ ID NO: 2596963 - protein, 23 aa, Entamoeba histolytica
NERPKFDANLFAIPSVLRNQLQE

SEQ ID NO: 2596964 - protein, 27 aa, Entamoeba histolytica
NERSRLLPYTLFRLGGAAIILTNKWNL

SEQ ID NO: 2596965 - protein, 25 aa, Entamoeba histolytica
NESKRQFLVHLFQLVLTGAVMMILK

SEQ ID NO: 2596966 - protein, 23 aa, Entamoeba histolytica
NETGFLNYYLYNIKLCTPANSVN

SEQ ID NO: 2596967 - protein, 33 aa, Entamoeba histolytica; identical to SEQ ID NO: 2400136

SEQ ID NO: 2596968 - protein, 27 aa, Entamoeba histolytica
NFAGIFGFFLLFIIPGVLQIYSKFIIR

SEQ ID NO: 2596969 - protein, 18 aa, Entamoeba histolytica
NFCAFLLIVITVFVIYIA

SEQ ID NO: 2596970 - protein, 21 aa, Entamoeba histolytica
NFDATSNVFVILSLIITIFFF

SEQ ID NO: 2596971 - protein, 21 aa, Entamoeba histolytica
NFDSTASTFIILCLIITFLFF

SEQ ID NO: 2596972 - protein, 25 aa, Entamoeba histolytica
NFDSYEPILLPYYVDALVTSNKQSS

SEQ ID NO: 2596973 - protein, 25 aa, Entamoeba histolytica
NFDYSYPIDVYAYGIVLYETYIEKG

SEQ ID NO: 2596974 - protein, 20 aa, Entamoeba histolytica
NFFIVVCIVTLFETSALHRL

SEQ ID NO: 2596975 - protein, 17 aa, Entamoeba histolytica
NFFVNMSHYMFRASVDE

SEQ ID NO: 2596976 - protein, 23 aa, Entamoeba histolytica
NFIEIMGPKWYDWFLPTPPIGDG

SEQ ID NO: 2596977 - protein, 19 aa, Entamoeba histolytica
NFIIPKDVYFDFNTLTKKP

SEQ ID NO: 2596978 - protein, 26 aa, Entamoeba histolytica
NFIVDAYGYYLGTYFLAKNLNYTQTN

SEQ ID NO: 2596979 - protein, 19 aa, Entamoeba histolytica
NFLGEILRSIKFIKYNAWE

SEQ ID NO: 2596980 - protein, 18 aa, Entamoeba histolytica
NFLKLRFCQDIARGMLYL

SEQ ID NO: 2596981 - protein, 20 aa, Entamoeba histolytica
NFLVHRLFFQFFDSNRISSK

SEQ ID NO: 2596982 - protein, 19 aa, Entamoeba histolytica
NFMYTVFMIYNTTIFLIIP

SEQ ID NO: 2596983 - protein, 17 aa, Entamoeba histolytica
NFPAYFAQNFATLLYYF

SEQ ID NO: 2596984 - protein, 26 aa, Entamoeba histolytica
NFPQHILPLVFNWPSSQNAACYYCAA

SEQ ID NO: 2596985 - protein, 17 aa, Entamoeba histolytica
NFRAIVFIKRGLSGIEV

SEQ ID NO: 2596986 - protein, 20 aa, Entamoeba histolytica
NFSDFFQLNKTNPTFSFFNE

SEQ ID NO: 2596987 - protein, 18 aa, Entamoeba histolytica
NFSVSIILTILFALSVIS

SEQ ID NO: 2596988 - protein, 34 aa, Entamoeba histolytica
NFTMRFIFTILCASLCLLFIIATSSIFLILKRER

SEQ ID NO: 2596989 - protein, 22 aa, Entamoeba histolytica
NFTTSWKDGKAFCALVHHFKPE

SEQ ID NO: 2596990 - protein, 34 aa, Entamoeba histolytica
NFVICIILIVTLTLLLIPIPNILKKQILSLSHWI

SEQ ID NO: 2596991 - protein, 25 aa, Entamoeba histolytica
NFVSFNFFIMYFAQTIMFGIMSFTD

SEQ ID NO: 2596992 - protein, 25 aa, Entamoeba histolytica
NFYNGFLFPLLFYSTWQSFYLIYTE

SEQ ID NO: 2596993 - protein, 24 aa, Entamoeba histolytica
NGCSNLINVILPYTLREIKESAFS

SEQ ID NO: 2596994 - protein, 24 aa, Entamoeba histolytica
NGEDPFNFIRKFGKKYIGFNSPHA

SEQ ID NO: 2596995 - protein, 32 aa, Entamoeba histolytica
NGEHNIFERLFTNWYFLVICGGICICQIIIVQ

SEQ ID NO: 2596996 - protein, 34 aa, Entamoeba histolytica
NGEICPIPHSFLIFIRIISLFVMTIPSAFEFSQQ

SEQ ID NO: 2596997 - protein, 25 aa, Entamoeba histolytica
NGEYCYFYLDNLKYNSLYLDETNKI

SEQ ID NO: 2596998 - protein, 43 aa, Entamoeba histolytica
NGFERIKANLFLANFIRDLMRFWKLAYVVGLIDMVMDWYAFGG

SEQ ID NO: 2596999 - protein, 30 aa, Entamoeba histolytica
NGFILLNIANYLHYILIALPSECITKKCFD

SEQ ID NO: 2597000 - protein, 24 aa, Entamoeba histolytica
NGIEVIHLFTGKPLLHVSLSSTTM

SEQ ID NO: 2597001 - protein, 32 aa, Entamoeba histolytica
NGIEVIHLFTGKPLLHVTLLTSTISAASSFAD

SEQ ID NO: 2597002 - protein, 30 aa, Entamoeba histolytica
NGINDGLIILIMWMNLFSYDINPIPKEVEN

SEQ ID NO: 2597003 - protein, 17 aa, Entamoeba histolytica
NGISGMLVLTIFTILMV

SEQ ID NO: 2597004 - protein, 25 aa, Entamoeba histolytica
NGKDNFRLHYYNISINLYYENVNET

SEQ ID NO: 2597005 - protein, 22 aa, Entamoeba histolytica
NGKYNMGLLVNLPDHCKSVSPS

SEQ ID NO: 2597006 - protein, 17 aa, Entamoeba histolytica
NGLAFPSIFFVAKIFKL

SEQ ID NO: 2597007 - protein, 18 aa, Entamoeba histolytica
NGLEAVNYYSIKLGSNVA

SEQ ID NO: 2597008 - protein, 26 aa, Entamoeba histolytica
NGLIAVILVCDIRFPPKLAFATMKNI

SEQ ID NO: 2597009 - protein, 21 aa, Entamoeba histolytica
NGLIIIRSIFMLLMLDCSKEE

SEQ ID NO: 2597010 - protein, 30 aa, Entamoeba histolytica
NGLKNYLIIIRYYCLLLKYNYINENCNIIN

SEQ ID NO: 2597011 - protein, 29 aa, Entamoeba histolytica
NGLVLGWVHAFIFWKYSVLMYVAGQELKK

SEQ ID NO: 2597012 - protein, 24 aa, Entamoeba histolytica
NGMCYQCPIGCSLCSGPDSCITCE

SEQ ID NO: 2597013 - protein, 27 aa, Entamoeba histolytica
NGNIGYYVLIFIISLISGAIPSIRALS

SEQ ID NO: 2597014 - protein, 18 aa, Entamoeba histolytica
NGNLCDKCREGCNYCNST

SEQ ID NO: 2597015 - protein, 25 aa, Entamoeba histolytica
NGQGLWNIIQIFDWTVYKKPNEEPP

SEQ ID NO: 2597016 - protein, 25 aa, Entamoeba histolytica
NGSPELLYYLYKFFGNELVKGISPR

SEQ ID NO: 2597017 - protein, 23 aa, Entamoeba histolytica
NGSSKWWYSVVIYEHTLGIKSVE

SEQ ID NO: 2597018 - protein, 17 aa, Entamoeba histolytica
NGTVCIANFFATERQVD

SEQ ID NO: 2597019 - protein, 20 aa, Entamoeba histolytica
NGVFLLSVAFFIIIEAIQRF

SEQ ID NO: 2597020 - protein, 23 aa, Entamoeba histolytica
NGVGLLITLWKLTRVFTLNFKEK

SEQ ID NO: 2597021 - protein, 26 aa, Entamoeba histolytica
NGVPGTIKTPISNEKILENGGQNEEG

SEQ ID NO: 2597022 - protein, 26 aa, Entamoeba histolytica
NGVQQLVKPVWYILNSTKDTTFTVST

SEQ ID NO: 2597023 - protein, 42 aa, Entamoeba histolytica
NGVVYKEEQEVRMYKIYSSKTKRMYNTYHVHLKTKAEVSTTE

SEQ ID NO: 2597024 - protein, 31 aa, Entamoeba histolytica
NHAMDCTYLSKYYIFKARPLQEFIPHEYLWN

SEQ ID NO: 2597025 - protein, 25 aa, Entamoeba histolytica
NHFSHNLFIYPLKVTSSSFSLKKKF

SEQ ID NO: 2597026 - protein, 31 aa, Entamoeba histolytica
NHIISLLVLIFCIIIILVSFNLSLSNMFYKL

SEQ ID NO: 2597027 - protein, 23 aa, Entamoeba histolytica
NHNLNGVSCISLILYVIFTFIFF

SEQ ID NO: 2597028 - protein, 20 aa, Entamoeba histolytica
NHQIAIFREILWAVSNFAGD

SEQ ID NO: 2597029 - protein, 29 aa, Entamoeba histolytica
NHQQLLDYINLLHAKLYIIKTGLSNKFIG

SEQ ID NO: 2597030 - protein, 27 aa, Entamoeba histolytica
NHSKKKWLMIIFHTPNNPKYVFYFDPQ

SEQ ID NO: 2597031 - protein, 27 aa, Entamoeba histolytica
NHSRNKWLMIIFHTPNNPKYVFYFEPQ

SEQ ID NO: 2597032 - protein, 18 aa, Entamoeba histolytica
NIAKNDLFKMISDKKIKR

SEQ ID NO: 2597033 - protein, 17 aa, Entamoeba histolytica
NICFIITFGYLLYRHIY

SEQ ID NO: 2597034 - protein, 20 aa, Entamoeba histolytica
NIDNGLLDIIKNFFGFQFKE

SEQ ID NO: 2597035 - protein, 22 aa, Entamoeba histolytica
NIDNLFLLLDIQRTSKPLIIQK

SEQ ID NO: 2597036 - protein, 26 aa, Entamoeba histolytica
NIENDKKMYLIPRYSFKFSVVNPPDE

SEQ ID NO: 2597037 - protein, 17 aa, Entamoeba histolytica
NIFFLVTIITQFIPACK

SEQ ID NO: 2597038 - protein, 19 aa, Entamoeba histolytica
NIFNWKKALIVLFQGMTMA

SEQ ID NO: 2597039 - protein, 28 aa, Entamoeba histolytica
NIFSSIVNYLIDLFPNDTSFAYYINSQN

SEQ ID NO: 2597040 - protein, 26 aa, Entamoeba histolytica
NIGIQSLYFAILSTMGYTLLLEKPKK

SEQ ID NO: 2597041 - protein, 27 aa, Entamoeba histolytica
NIGYWLPLLFCLPFVFYFTFIPTFNFC

SEQ ID NO: 2597042 - protein, 18 aa, Entamoeba histolytica
NIILIYEREIPIKQEKEI

SEQ ID NO: 2597043 - protein, 18 aa, Entamoeba histolytica
NIILPFDLKMRILYDTSK

SEQ ID NO: 2597044 - protein, 25 aa, Entamoeba histolytica
NIINKDVYYLYLGINNEYEINWSCF

SEQ ID NO: 2597045 - protein, 21 aa, Entamoeba histolytica
NIIVQIFIGAICLALIYLRNG

SEQ ID NO: 2597046 - protein, 21 aa, Entamoeba histolytica
NIKHYTIVIDQLKDKIQKLQK

SEQ ID NO: 2597047 - protein, 28 aa, Entamoeba histolytica
NIKIIQLFCDFIYASWKLIQQKGIYETI

SEQ ID NO: 2597048 - protein, 27 aa, Entamoeba histolytica
NIKNKLFDFLFYIIKKGRYGIIGIWII

SEQ ID NO: 2597049 - protein, 20 aa, Entamoeba histolytica
NIKSPLLIPMPFINSSEYPH

SEQ ID NO: 2597050 - protein, 28 aa, Entamoeba histolytica
NILAPLVVLILLYTPLKLDYVWRTALAL

SEQ ID NO: 2597051 - protein, 17 aa, Entamoeba histolytica
NILFPAIGRGTFGNVYK

SEQ ID NO: 2597052 - protein, 21 aa, Entamoeba histolytica
NILFQCVILPSHLKFEQGVCC

SEQ ID NO: 2597053 - protein, 24 aa, Entamoeba histolytica
NILGCLCIFFFIMQLIYKYLRGVI

SEQ ID NO: 2597054 - protein, 19 aa, Entamoeba histolytica
NILGHIFYKPKHAILLMIV

SEQ ID NO: 2597055 - protein, 22 aa, Entamoeba histolytica
NILKTYLLYIVIQKNIVLTVHS

SEQ ID NO: 2597056 - protein, 30 aa, Entamoeba histolytica
NILPFYFCQQYGIVQLIWNTFDKLILLFNN

SEQ ID NO: 2597057 - protein, 21 aa, Entamoeba histolytica
NIMKGLPLDLFNLTNLSILDV

SEQ ID NO: 2597058 - protein, 30 aa, Entamoeba histolytica
NIMSFGRQINLYLLSLLSNKKQLVLKKEDK

SEQ ID NO: 2597059 - protein, 21 aa, Entamoeba histolytica
NINKLEIFSFNPESSYIKSYE

SEQ ID NO: 2597060 - protein, 22 aa, Entamoeba histolytica
NINLDLFPFNHSYRKELYFIEE

SEQ ID NO: 2597061 - protein, 21 aa, Entamoeba histolytica
NINNLFCPIVVYLNTNGVDKL

SEQ ID NO: 2597062 - protein, 25 aa, Entamoeba histolytica
NINSKEFILMEIYLDQLRKDCKADK

SEQ ID NO: 2597063 - protein, 40 aa, Entamoeba histolytica
NIPFIGSPLLLFKAWMLRWWKIMYLRLLDLQKWKVIYGLY

SEQ ID NO: 2597064 - protein, 17 aa, Entamoeba histolytica
NIPLYHIIENWKRKTRG

SEQ ID NO: 2597065 - protein, 18 aa, Entamoeba histolytica
NIQPGLYAVLTQVKILSA

SEQ ID NO: 2597066 - protein, 27 aa, Entamoeba histolytica
NIQQENLYLLLTLLQQFGICYILTKQF

SEQ ID NO: 2597067 - protein, 20 aa, Entamoeba histolytica
NIRIVEMVFLLMDILMEFGY

SEQ ID NO: 2597068 - protein, 25 aa, Entamoeba histolytica
NIRSYPIWTNWWGENFHWKERVKEV

SEQ ID NO: 2597069 - protein, 18 aa, Entamoeba histolytica
NISILLNNIHLANTLSLV

SEQ ID NO: 2597070 - protein, 19 aa, Entamoeba histolytica
NITDIIPYPINIKVNEQEM

SEQ ID NO: 2597071 - protein, 28 aa, Entamoeba histolytica
NITEYKPLMYCLLIVFGLTIILSFEIIP

SEQ ID NO: 2597072 - protein, 23 aa, Entamoeba histolytica
NIVIVFIFIIVLSILLFDGYDAS

SEQ ID NO: 2597073 - protein, 26 aa, Entamoeba histolytica
NIVMISSVIFYWFYPHEFKLHENLIV

SEQ ID NO: 2597074 - protein, 32 aa, Entamoeba histolytica
NIVSDFVYFFAYKNEAWGFTKISAKTKPFVFF

SEQ ID NO: 2597075 - protein, 25 aa, Entamoeba histolytica
NIVTLLVFIWLMTWMYCWANSRVNL

SEQ ID NO: 2597076 - protein, 33 aa, Entamoeba histolytica
NIVTQAIYQLFVLLFLLYCGRELTFLNAPCAYI

SEQ ID NO: 2597077 - protein, 18 aa, Entamoeba histolytica
NIYRLSFVMVMNFCYFLF

SEQ ID NO: 2597078 - protein, 19 aa, Entamoeba histolytica
NIYSFFYSTFKKTIDGLNS

SEQ ID NO: 2597079 - protein, 29 aa, Entamoeba histolytica
NIYSSHSLIILSLIKIKELYFYCIKCSIK

SEQ ID NO: 2597080 - protein, 29 aa, Entamoeba histolytica
NIYTTLTFFGIFAEFITALTLAARVEERR

SEQ ID NO: 2597081 - protein, 29 aa, Entamoeba histolytica
NKAICIGVLVLWLALLITFSLTSKIEDME

SEQ ID NO: 2597082 - protein, 28 aa, Entamoeba histolytica
NKAQFIIKNWIYIKSILTIICFFVSITS

SEQ ID NO: 2597083 - protein, 24 aa, Entamoeba histolytica
NKCEKCFDGYYLKNQQCIAKDKNC

SEQ ID NO: 2597084 - protein, 25 aa, Entamoeba histolytica
NKCNILLPTFLMYKALCLDTFASLT

SEQ ID NO: 2597085 - protein, 19 aa, Entamoeba histolytica
NKCVLIVGFVIVLGLIAGG

SEQ ID NO: 2597086 - protein, 22 aa, Entamoeba histolytica
NKDILIIIETYLQFLCLSCKTD

SEQ ID NO: 2597087 - protein, 29 aa, Entamoeba histolytica
NKDNHYYYDFMYAVLPFIPDIVDNEVVLY

SEQ ID NO: 2597088 - protein, 27 aa, Entamoeba histolytica
NKEHYVVLPLFALDLLFICLKEVVGYC

SEQ ID NO: 2597089 - protein, 46 aa, Entamoeba histolytica
NKEKNWRLGLYIICPLLGILLIGNVFVIVLYIIRKFRNNSYTSLSM

SEQ ID NO: 2597090 - protein, 27 aa, Entamoeba histolytica
NKENTLFTYVLLFIGLLTVGMSIVMGK

SEQ ID NO: 2597091 - protein, 24 aa, Entamoeba histolytica
NKEQKWIWPTAIRFVPLFACASVF

SEQ ID NO: 2597092 - protein, 24 aa, Entamoeba histolytica
NKEYFIAIGIFLQIYEIKKRESDQ

SEQ ID NO: 2597093 - protein, 26 aa, Entamoeba histolytica
NKGSKPIFSALMQSLLKLFTEISEYD

SEQ ID NO: 2597094 - protein, 23 aa, Entamoeba histolytica
NKIIKFIYILTEHISFFGCVVIL

SEQ ID NO: 2597095 - protein, 22 aa, Entamoeba histolytica
NKIIQMLFSCKSTKLKKILIDV

SEQ ID NO: 2597096 - protein, 21 aa, Entamoeba histolytica
NKILTELLRFLPVSDLAIREE

SEQ ID NO: 2597097 - protein, 26 aa, Entamoeba histolytica
NKINPKALFYFPIKTKIIALTVDDAP

SEQ ID NO: 2597098 - protein, 26 aa, Entamoeba histolytica
NKITTFITILFQFLRAFGLNTFAGKE

SEQ ID NO: 2597099 - protein, 21 aa, Entamoeba histolytica
NKIVQYILRYPRRCSTHIYPR

SEQ ID NO: 2597100 - protein, 24 aa, Entamoeba histolytica
NKKGEWVRIRAIPFKPTTNLKNNE

SEQ ID NO: 2597101 - protein, 22 aa, Entamoeba histolytica
NKKIGEQLLDWAKKSLSIDSCD

SEQ ID NO: 2597102 - protein, 22 aa, Entamoeba histolytica
NKKIGEQLLDWAKKSLSIDSCN

SEQ ID NO: 2597103 - protein, 38 aa, Entamoeba histolytica
NKKITVLFLKIFLINPTRFCTMYLSPYFSQVFKDIFHC

SEQ ID NO: 2597104 - protein, 18 aa, Entamoeba histolytica
NKKWKKMIEIWKETVPHK

SEQ ID NO: 2597105 - protein, 22 aa, Entamoeba histolytica
NKLEYFYSVVLRLTLLSPNVCL

SEQ ID NO: 2597106 - protein, 17 aa, Entamoeba histolytica
NKLICLMNYYNSQQSIK

SEQ ID NO: 2597107 - protein, 24 aa, Entamoeba histolytica
NKNAVLYLLSFWNKVITSTQLNGD

SEQ ID NO: 2597108 - protein, 26 aa, Entamoeba histolytica
NKRDKYMLVIIHLPKSPKYVFHTEPE

SEQ ID NO: 2597109 - protein, 25 aa, Entamoeba histolytica
NKRPNILLKYLISNPRFIANFCNNV

SEQ ID NO: 2597110 - protein, 31 aa, Entamoeba histolytica
NKSEKLIITTWWRWLIFSINGIMVVIMNIKY

SEQ ID NO: 2597111 - protein, 24 aa, Entamoeba histolytica
NKTKELWKCGSCRNSTIYKCESKP

SEQ ID NO: 2597112 - protein, 19 aa, Entamoeba histolytica
NKTTYGNILLVFSTEEFLD

SEQ ID NO: 2597113 - protein, 25 aa, Entamoeba histolytica
NKTVKPLFTPQRWIDKAIPGGSNLQ

SEQ ID NO: 2597114 - protein, 22 aa, Entamoeba histolytica
NKVCVKKFFKSKAGIILGCVIG

SEQ ID NO: 2597115 - protein, 26 aa, Entamoeba histolytica
NKVFHYLEFILTLLKPFNSQSYVACF

SEQ ID NO: 2597116 - protein, 17 aa, Entamoeba histolytica
NKVFITNSSGIEGIISQ

SEQ ID NO: 2597117 - protein, 26 aa, Entamoeba histolytica
NKVLIICVTSFILFLGVLIMVVPENE

SEQ ID NO: 2597118 - protein, 21 aa, Entamoeba histolytica
NKVMLFSMYVSCGISIVLIII

SEQ ID NO: 2597119 - protein, 27 aa, Entamoeba histolytica
NKVNTLIVKSFFWWDNYLDKLTECLDK

SEQ ID NO: 2597120 - protein, 17 aa, Entamoeba histolytica
NKWHYFLLDFCYFTNCV

SEQ ID NO: 2597121 - protein, 18 aa, Entamoeba histolytica
NKYFTLNEYYLLFIITEH

SEQ ID NO: 2597122 - protein, 19 aa, Entamoeba histolytica
NKYIDLKKTLLPWSCFVKV

SEQ ID NO: 2597123 - protein, 24 aa, Entamoeba histolytica
NKYQRWIYNPLQYSINYSLLSILN

SEQ ID NO: 2597124 - protein, 24 aa, Entamoeba histolytica
NLARVLSRICFLCGLFGGIKSNQL

SEQ ID NO: 2597125 - protein, 18 aa, Entamoeba histolytica
NLCDHFKFTVPFLKYWTF

SEQ ID NO: 2597126 - protein, 25 aa, Entamoeba histolytica
NLEGGCWLLFVAVIIYTVCSIAIMK

SEQ ID NO: 2597127 - protein, 20 aa, Entamoeba histolytica
NLESSYLIVSKFINYVSSTS

SEQ ID NO: 2597128 - protein, 23 aa, Entamoeba histolytica
NLFQEFPTYNFSMGPAVITLFAA

SEQ ID NO: 2597129 - protein, 27 aa, Entamoeba histolytica
NLFSVQSLVLLFLKWMNVGKNCNFPLN

SEQ ID NO: 2597130 - protein, 27 aa, Entamoeba histolytica
NLGIPRLYYHFFPLKAHIIQAPFTSVG

SEQ ID NO: 2597131 - protein, 26 aa, Entamoeba histolytica
NLIESPYILKLYGISFDPLALVMDIC

SEQ ID NO: 2597132 - protein, 21 aa, Entamoeba histolytica
NLIEYALMSVLLLLGTKVLTI

SEQ ID NO: 2597133 - protein, 31 aa, Entamoeba histolytica
NLIKKSFGYYIFIVELFLVSLPMKGHILKQQ

SEQ ID NO: 2597134 - protein, 23 aa, Entamoeba histolytica
NLITYFINKSFYFNFEQIHTKQI

SEQ ID NO: 2597135 - protein, 18 aa, Entamoeba histolytica
NLITYIIITPFQSATQSI

SEQ ID NO: 2597136 - protein, 26 aa, Entamoeba histolytica
NLIVQFIVFLPCVWAFVVGLTRFYDH

SEQ ID NO: 2597137 - protein, 26 aa, Entamoeba histolytica
NLKEIPWMILGFIGSMIYGALFPIFA

SEQ ID NO: 2597138 - protein, 25 aa, Entamoeba histolytica
NLKMKRIILIVFGATFVVAICIVCV

SEQ ID NO: 2597139 - protein, 18 aa, Entamoeba histolytica
NLLIIESLGTLPTSTPIN

SEQ ID NO: 2597140 - protein, 21 aa, Entamoeba histolytica
NLLILSTKLHRFEITFEVMLF

SEQ ID NO: 2597141 - protein, 17 aa, Entamoeba histolytica
NLLLFILSSYFIGKVYE

SEQ ID NO: 2597142 - protein, 26 aa, Entamoeba histolytica
NLLLTYPIIFHQFLTELSYDQLWARN

SEQ ID NO: 2597143 - protein, 21 aa, Entamoeba histolytica
NLLQHVIYLIKTSLIASVPGC

SEQ ID NO: 2597144 - protein, 22 aa, Entamoeba histolytica
NLLVDCIWRFLETPFKFRMEKT

SEQ ID NO: 2597145 - protein, 18 aa, Entamoeba histolytica
NLMFLFSIIYVSLCIVLS

SEQ ID NO: 2597146 - protein, 42 aa, Entamoeba histolytica
NLPSNVYFACQGTMYVYIAESSYYTCPLPYTCTDTTNCQHQT

SEQ ID NO: 2597147 - protein, 24 aa, Entamoeba histolytica
NLQELSYFCFFLLVSHMVTVSFDL

SEQ ID NO: 2597148 - protein, 25 aa, Entamoeba histolytica
NLRSKNQLEIFLRYLKFSNFAESED

SEQ ID NO: 2597149 - protein, 20 aa, Entamoeba histolytica
NLRVLLKQLVNNRHITDTNL

SEQ ID NO: 2597150 - protein, 32 aa, Entamoeba histolytica
NLSGRLRWMIELFAYWNQLQFSPSPSYATYSL

SEQ ID NO: 2597151 - protein, 33 aa, Entamoeba histolytica
NLSIAFFERFHRYFLTHYPSIQTALNTIFLQLL

SEQ ID NO: 2597152 - protein, 29 aa, Entamoeba histolytica
NLTKSFVSFPPLFWVVRDYALDERTESWF

SEQ ID NO: 2597153 - protein, 33 aa, Entamoeba histolytica
NLTLDLWNPIFIPYVILLCFISRAFNIFPITFI

SEQ ID NO: 2597154 - protein, 24 aa, Entamoeba histolytica
NLVCYPFFLIPDEVHWYSIYICSA

SEQ ID NO: 2597155 - protein, 18 aa, Entamoeba histolytica
NLYISTLCSLFKLGRIPA

SEQ ID NO: 2597156 - protein, 18 aa, Entamoeba histolytica
NMCKQYYSTTCLNGQCVV

SEQ ID NO: 2597157 - protein, 20 aa, Entamoeba histolytica
NMEMLKWLNVKIIKKNKILD

SEQ ID NO: 2597158 - protein, 17 aa, Entamoeba histolytica
NMIGYWILFVVSSVFIG

SEQ ID NO: 2597159 - protein, 29 aa, Entamoeba histolytica
NMKEYYIMIMIIICLIMGIISSELYKRWG

SEQ ID NO: 2597160 - protein, 25 aa, Entamoeba histolytica
NMLQRRILALIITLDGKSIEIASRL

SEQ ID NO: 2597161 - protein, 27 aa, Entamoeba histolytica
NMMNDETLIFVLLRALDKVINDSTNIK

SEQ ID NO: 2597162 - protein, 23 aa, Entamoeba histolytica
NMYHEWYIFPRKVSKIEWIDELD

SEQ ID NO: 2597163 - protein, 19 aa, Entamoeba histolytica
NMYVLCSPILRIIWDFSTI

SEQ ID NO: 2597164 - protein, 23 aa, Entamoeba histolytica
NNCKYVKMILGHISLLFSPENRC

SEQ ID NO: 2597165 - protein, 19 aa, Entamoeba histolytica
NNCLLRAFFYWSGCYFLRL

SEQ ID NO: 2597166 - protein, 35 aa, Entamoeba histolytica
NNCVAAKFNWWRITDLVDYFIIAVTIVVVAVPEGL

SEQ ID NO: 2597167 - protein, 25 aa, Entamoeba histolytica
NNCVEKLFNFLYKILSKDRLDKIIT

SEQ ID NO: 2597168 - protein, 24 aa, Entamoeba histolytica
NNCYSCHSSYYLLNGRCEKYTPHC

SEQ ID NO: 2597169 - protein, 23 aa, Entamoeba histolytica
NNDKKWFEYPQCPCLEQNCTILV

SEQ ID NO: 2597170 - protein, 30 aa, Entamoeba histolytica
NNDNKCKSLIITSDLIPSNINKAKCIEYKK

SEQ ID NO: 2597171 - protein, 23 aa, Entamoeba histolytica
NNDYNVIFGMFKDFVEKVVTSTG

SEQ ID NO: 2597172 - protein, 20 aa, Entamoeba histolytica
NNDYSYHFTYNFTYSLQKAM

SEQ ID NO: 2597173 - protein, 24 aa, Entamoeba histolytica
NNEENSFIIIKLISCLLSSLDIEY

SEQ ID NO: 2597174 - protein, 28 aa, Entamoeba histolytica
NNEFKYYFDSFYAVLPFSIDIINEGKDV

SEQ ID NO: 2597175 - protein, 22 aa, Entamoeba histolytica
NNFELFTSFILKWRYNKINEDY

SEQ ID NO: 2597176 - protein, 19 aa, Entamoeba histolytica
NNFIRYWNNIKFTGNGYRT

SEQ ID NO: 2597177 - protein, 18 aa, Entamoeba histolytica
NNGILYYAKHENSIPQTL

SEQ ID NO: 2597178 - protein, 43 aa, Entamoeba histolytica
NNGTKIGWIIFGVVLFLIFITIFAFIIGFIIYRKKRSNNGYHD

SEQ ID NO: 2597179 - protein, 25 aa, Entamoeba histolytica
NNHFYPLIISFLKYGVTTAQPTSIE

SEQ ID NO: 2597180 - protein, 25 aa, Entamoeba histolytica
NNHKNIDSALCTFIMLGIAVTFLFF

SEQ ID NO: 2597181 - protein, 25 aa, Entamoeba histolytica
NNHKNLDGATSSFLILCIIITFLFF

SEQ ID NO: 2597182 - protein, 31 aa, Entamoeba histolytica
NNIDLYLFISSIKIYYSIPSLSLLIHSYTNA

SEQ ID NO: 2597183 - protein, 27 aa, Entamoeba histolytica
NNIFKQYGYKLGLTVRETCRFNYNYNE

SEQ ID NO: 2597184 - protein, 29 aa, Entamoeba histolytica
NNIFLQNDFVWLLQSLYQAKFKRVHILCH

SEQ ID NO: 2597185 - protein, 21 aa, Entamoeba histolytica
NNIVTIQPRYPLLGGWSTSFS

SEQ ID NO: 2597186 - protein, 28 aa, Entamoeba histolytica
NNKWNYLNIVYWIKFEFALRRYQFNIMK

SEQ ID NO: 2597187 - protein, 22 aa, Entamoeba histolytica
NNLDGASSIFIVLSGIIALFFF

SEQ ID NO: 2597188 - protein, 22 aa, Entamoeba histolytica
NNLDGSSCLLITFFVTLISLFI

SEQ ID NO: 2597189 - protein, 22 aa, Entamoeba histolytica
NNLDGTSGMFMFLAFVIHLIFF

SEQ ID NO: 2597190 - protein, 31 aa, Entamoeba histolytica
NNLESFVVILFLLVFALIAAGYVFIDGINKG

SEQ ID NO: 2597191 - protein, 21 aa, Entamoeba histolytica
NNLLWTLFMKEIPGLSGVEAG

SEQ ID NO: 2597192 - protein, 27 aa, Entamoeba histolytica
NNMFLDKAIPLYPILHQVTLTIIKNTS

SEQ ID NO: 2597193 - protein, 40 aa, Entamoeba histolytica
NNNKIMIQIMSKIFPSHDFWRHVCIVWNKCYYSISDRQLT

SEQ ID NO: 2597194 - protein, 29 aa, Entamoeba histolytica
NNNKLRAKIWKLLLRYYRAEQKTWVSSEE

SEQ ID NO: 2597195 - protein, 24 aa, Entamoeba histolytica
NNNKYYIKYYIDSNCDKEEEPGKE

SEQ ID NO: 2597196 - protein, 45 aa, Entamoeba histolytica
NNNNKITIILIVILLVLIIFIIFILIIVILVIVIPKRKKSTKFRI

SEQ ID NO: 2597197 - protein, 38 aa, Entamoeba histolytica
NNPEVIHTHMYSNKHKIMYNKYNIHLKSEQHQVNKEEK

SEQ ID NO: 2597198 - protein, 18 aa, Entamoeba histolytica
NNPFFTYEYVFASSLFVF

SEQ ID NO: 2597199 - protein, 24 aa, Entamoeba histolytica
NNPVERYIWVCTEYSLYKIHAVKP

SEQ ID NO: 2597200 - protein, 25 aa, Entamoeba histolytica
NNQKNIDGTSCVFVILSILIIFLLI

SEQ ID NO: 2597201 - protein, 17 aa, Entamoeba histolytica
NNQQQILSCDGKMLFTS

SEQ ID NO: 2597202 - protein, 22 aa, Entamoeba histolytica
NNQQQILSCDGKMLFTSKLSDE

SEQ ID NO: 2597203 - protein, 39 aa, Entamoeba histolytica
NNSTTPIGWIIFGVLFYVLFVIVLIITIIAIKMKRKNSG

SEQ ID NO: 2597204 - protein, 34 aa, Entamoeba histolytica
NNTMVMLFYLIIVVVLYFIPKLYLPSQYSDKEFP

SEQ ID NO: 2597205 - protein, 38 aa, Entamoeba histolytica
NNTTRILANRYPYFLVRNKYIPLFLQNYLLKTNREEGK

SEQ ID NO: 2597206 - protein, 19 aa, Entamoeba histolytica
NNVLQLIKPLISTGGQLTI

SEQ ID NO: 2597207 - protein, 18 aa, Entamoeba histolytica
NNVMTCGNRFVPKGSFFM

SEQ ID NO: 2597208 - protein, 20 aa, Entamoeba histolytica
NNVVKRWYQLEKSFIYPCVN

SEQ ID NO: 2597209 - protein, 18 aa, Entamoeba histolytica
NNWFFYTIFVIYAVIFFL

SEQ ID NO: 2597210 - protein, 24 aa, Entamoeba histolytica
NNWQKFPLVIIVKTALWVKEKIQQ

SEQ ID NO: 2597211 - protein, 26 aa, Entamoeba histolytica
NNYGVYEYLPTINLLKNFNITKINGN

SEQ ID NO: 2597212 - protein, 22 aa, Entamoeba histolytica
NNYIEHSPIGHSFIIVSIDTNK

SEQ ID NO: 2597213 - protein, 23 aa, Entamoeba histolytica
NNYPITIILPLNGGGYTDLESNF

SEQ ID NO: 2597214 - protein, 25 aa, Entamoeba histolytica
NNYRITIFCLIILCSILFDIYSLWQ

SEQ ID NO: 2597215 - protein, 24 aa, Entamoeba histolytica
NNYYTSLRNFYRVEKKEFIVFETV

SEQ ID NO: 2597216 - protein, 19 aa, Entamoeba histolytica
NPAFTLNASPIDSSIPIYI

SEQ ID NO: 2597217 - protein, 23 aa, Entamoeba histolytica
NPANMYLIGCGESIYYYKDKKSD

SEQ ID NO: 2597218 - protein, 37 aa, Entamoeba histolytica
NPCFENYILFPLLSFFSILLCLYYWKTPSLKEIKSKT

SEQ ID NO: 2597219 - protein, 25 aa, Entamoeba histolytica
NPDDTFTIPLFSHAINIYLISFDSE

SEQ ID NO: 2597220 - protein, 29 aa, Entamoeba histolytica
NPDLYGPLWIPLTVVFLAFFSGSLSSIIE

SEQ ID NO: 2597221 - protein, 27 aa, Entamoeba histolytica
NPEDTLWIFTYFMKDLNLYGLFCDGLP

SEQ ID NO: 2597222 - protein, 20 aa, Entamoeba histolytica
NPFCLAHFFLRGISYNNRVK

SEQ ID NO: 2597223 - protein, 19 aa, Entamoeba histolytica
NPFNWKWVTSYGYPLKITL

SEQ ID NO: 2597224 - protein, 22 aa, Entamoeba histolytica
NPISPIRWALYQGISLKYNHSL

SEQ ID NO: 2597225 - protein, 26 aa, Entamoeba histolytica
NPLIDFEPFRWLFTLPLSGVTTTLSP

SEQ ID NO: 2597226 - protein, 20 aa, Entamoeba histolytica
NPPCLVELSLFLYQCDQIDI

SEQ ID NO: 2597227 - protein, 24 aa, Entamoeba histolytica
NPRFKPIQFKWSKFIKKLDPDNEA

SEQ ID NO: 2597228 - protein, 22 aa, Entamoeba histolytica
NPRSDHIFVFVIGGISLGEISM

SEQ ID NO: 2597229 - protein, 29 aa, Entamoeba histolytica
NPSKFDKLIPFVPILLRKGDSISSLDKTT

SEQ ID NO: 2597230 - protein, 34 aa, Entamoeba histolytica
NPSYNKYIICLFIYVILILKFLIEVIILVFNETI

SEQ ID NO: 2597231 - protein, 26 aa, Entamoeba histolytica
NQDYLLDLYYMLLTLVPSTLNEQEEI

SEQ ID NO: 2597232 - protein, 22 aa, Entamoeba histolytica
NQEKIFIDISINDVFTLYGSSV

SEQ ID NO: 2597233 - protein, 21 aa, Entamoeba histolytica
NQFCRIFNPPTCNCNLLPVDE

SEQ ID NO: 2597234 - protein, 41 aa, Entamoeba histolytica
NQFEFNNHLIKFFYYHCYSKRFIEFLPFQVYGLASVYSYLQ

SEQ ID NO: 2597235 - protein, 25 aa, Entamoeba histolytica
NQFVFGIFCFKIVIVIVATIAGSLF

SEQ ID NO: 2597236 - protein, 20 aa, Entamoeba histolytica
NQGFLKYWRVKEIPNFLLCA

SEQ ID NO: 2597237 - protein, 25 aa, Entamoeba histolytica
NQITDFIVMILIVGTIVSLCIEEWI

SEQ ID NO: 2597238 - protein, 34 aa, Entamoeba histolytica
NQKKNFVIIYFILGSLLHFLYAVSSLLYSKPSKQ

SEQ ID NO: 2597239 - protein, 25 aa, Entamoeba histolytica
NQKNKKIIKLLLLSLFNQFNSIEEL

SEQ ID NO: 2597240 - protein, 23 aa, Entamoeba histolytica
NQKPIFISSPLILTNLSSITFAH

SEQ ID NO: 2597241 - protein, 37 aa, Entamoeba histolytica
NQKRRQVFTTLFFLRYLFLPLISYPSLLKTLQKAISE

SEQ ID NO: 2597242 - protein, 25 aa, Entamoeba histolytica
NQKSVYFTYLPLDSGVLLINSCDKI

SEQ ID NO: 2597243 - protein, 21 aa, Entamoeba histolytica
NQLLLPILLATVVTISLSRFF

SEQ ID NO: 2597244 - protein, 19 aa, Entamoeba histolytica
NQLPIIMFITDFDLYRYST

SEQ ID NO: 2597245 - protein, 44 aa, Entamoeba histolytica
NQNNSNTIWLIMIPSVICIILIIIVIVLLTIYLHKLFIKRRRFE

SEQ ID NO: 2597246 - protein, 24 aa, Entamoeba histolytica
NQPQLIIWNSNWIHLYKTTTTPTY

SEQ ID NO: 2597247 - protein, 18 aa, Entamoeba histolytica
NQRLDDYPKLKLIRYPRK

SEQ ID NO: 2597248 - protein, 33 aa, Entamoeba histolytica
NQSLIVYFDLFMKYLQFIQPLLLNKSTTNKQLI

SEQ ID NO: 2597249 - protein, 20 aa, Entamoeba histolytica
NQTFNYLLEIIRAILTVHRP

SEQ ID NO: 2597250 - protein, 18 aa, Entamoeba histolytica
NQTYFNDFVPFYTKAINQ

SEQ ID NO: 2597251 - protein, 37 aa, Entamoeba histolytica
NQTYNRLTNTIQNIYINIHLIAETLSESVPANSQSAS

SEQ ID NO: 2597252 - protein, 22 aa, Entamoeba histolytica
NRCVSEFFLIGKTCKTCFQIDP

SEQ ID NO: 2597253 - protein, 21 aa, Entamoeba histolytica
NREFIGCATSGWFDHYKKCER

SEQ ID NO: 2597254 - protein, 23 aa, Entamoeba histolytica
NRFKQFLINGLLETLPGFTQIDV

SEQ ID NO: 2597255 - protein, 26 aa, Entamoeba histolytica
NRISNNIIIMIQIMSKIFPSHDFLKH

SEQ ID NO: 2597256 - protein, 25 aa, Entamoeba histolytica
NRKRRNLFLSPCYLVSFIATEMNSI

SEQ ID NO: 2597257 - protein, 21 aa, Entamoeba histolytica
NRLIIWLLYLIAISLCSLHAL

SEQ ID NO: 2597258 - protein, 18 aa, Entamoeba histolytica
NRMRFGALYIDSLEQIND

SEQ ID NO: 2597259 - protein, 31 aa, Entamoeba histolytica
NRNIISLDKSKCIEYRKGRALKIYNKEIDNN

SEQ ID NO: 2597260 - protein, 17 aa, Entamoeba histolytica
NRNIYFLNSCGIDYYNK

SEQ ID NO: 2597261 - protein, 21 aa, Entamoeba histolytica
NRPLDFIYFTDVGVYKFYCMP

SEQ ID NO: 2597262 - protein, 28 aa, Entamoeba histolytica
NRQFRRRFFILRPFFRRRRFTLSPILWK

SEQ ID NO: 2597263 - protein, 30 aa, Entamoeba histolytica
NRSVIPSHYYLFSLIGWIANQLMIQPIPNE

SEQ ID NO: 2597264 - protein, 17 aa, Entamoeba histolytica
NRTHAVFYNLTYDVSVQ

SEQ ID NO: 2597265 - protein, 33 aa, Entamoeba histolytica
NRWILDSLKILIGFVIILLCCVLIWKSHTEMIV

SEQ ID NO: 2597266 - protein, 26 aa, Entamoeba histolytica
NRYFDTILYFPNEPGKYIRAHSFILA

SEQ ID NO: 2597267 - protein, 31 aa, Entamoeba histolytica
NRYVPWISLARIFYLSLMTLYPSKIYFSVKT

SEQ ID NO: 2597268 - protein, 21 aa, Entamoeba histolytica
NSCMMVNVLYFIFFHITTPSK

SEQ ID NO: 2597269 - protein, 26 aa, Entamoeba histolytica
NSEFRRFRYFLPFTINIDNDKKMYLN

SEQ ID NO: 2597270 - protein, 35 aa, Entamoeba histolytica
NSEIIKICFYKNASFFLILLWYSFISNFTCQVVFD

SEQ ID NO: 2597271 - protein, 18 aa, Entamoeba histolytica
NSEKICAFKMKYSNLHFS

SEQ ID NO: 2597272 - protein, 35 aa, Entamoeba histolytica; identical to SEQ ID NO: 2400434

SEQ ID NO: 2597273 - protein, 23 aa, Entamoeba histolytica
NSFLALIFLYIFITLSLLLNALL

SEQ ID NO: 2597274 - protein, 25 aa, Entamoeba histolytica
NSFPSTYKWACLDSILILSTQTFNE

SEQ ID NO: 2597275 - protein, 25 aa, Entamoeba histolytica
NSFYKVIIWVIYTIVLVTMAFLWTK

SEQ ID NO: 2597276 - protein, 24 aa, Entamoeba histolytica
NSHCHTFLQIFPFELTKSEDLIKH

SEQ ID NO: 2597277 - protein, 29 aa, Entamoeba histolytica
NSIHCGYYFQPYSTIRFLVSDYKAWGYES

SEQ ID NO: 2597278 - protein, 21 aa, Entamoeba histolytica
NSIKEICFYSYFPCFIQPICR

SEQ ID NO: 2597279 - protein, 26 aa, Entamoeba histolytica
NSIVLSFILKQLPSLFKKRLPGIEVL

SEQ ID NO: 2597280 - protein, 22 aa, Entamoeba histolytica
NSIYMIDIIARSLTIKKGMINF

SEQ ID NO: 2597281 - protein, 18 aa, Entamoeba histolytica
NSLAIRLCSLMFYHYFSC

SEQ ID NO: 2597282 - protein, 17 aa, Entamoeba histolytica
NSLFYLTILQHQVTISF

SEQ ID NO: 2597283 - protein, 24 aa, Entamoeba histolytica
NSLKPILINIAVHLIFCVLDGAQS

SEQ ID NO: 2597284 - protein, 24 aa, Entamoeba histolytica
NSLLNVLSIVCTTLYVIEMDPNKK

SEQ ID NO: 2597285 - protein, 23 aa, Entamoeba histolytica
NSLSFHSIFLLNGELRITEPIIV

SEQ ID NO: 2597286 - protein, 27 aa, Entamoeba histolytica
NSMESPYFHLKWYNTIYMKQKELENYM

SEQ ID NO: 2597287 - protein, 21 aa, Entamoeba histolytica
NSMLDILKNQFGFVFDQVVKK

SEQ ID NO: 2597288 - protein, 24 aa, Entamoeba histolytica
NSNEIILKLPFKLKIKIMKDIAKG

SEQ ID NO: 2597289 - protein, 25 aa, Entamoeba histolytica
NSNKNIDGASCLFIILGVIITLLFF

SEQ ID NO: 2597290 - protein, 24 aa, Entamoeba histolytica
NSNTFILFIGLLNGVNYTISFNAK

SEQ ID NO: 2597291 - protein, 20 aa, Entamoeba histolytica
NSQAHQKHHNQKIQTKQQQK

SEQ ID NO: 2597292 - protein, 26 aa, Entamoeba histolytica
NSRAMWNIVQIFDWTVYNDSYNLDWS

SEQ ID NO: 2597293 - protein, 27 aa, Entamoeba histolytica
NSSETLLRIFSSRLIYLTLKSEFVFSN

SEQ ID NO: 2597294 - protein, 24 aa, Entamoeba histolytica
NSSIIFPPPILPQITDPPASFSRC

SEQ ID NO: 2597295 - protein, 23 aa, Entamoeba histolytica
NSSIILLIVLIVIVIITIFVIVG

SEQ ID NO: 2597296 - protein, 25 aa, Entamoeba histolytica
NSSIPLLTVLIPDSIYLLSLIKMVV

SEQ ID NO: 2597297 - protein, 25 aa, Entamoeba histolytica
NSSKYMLLIFHTPNNPKYVFHFMPQ

SEQ ID NO: 2597298 - protein, 26 aa, Entamoeba histolytica
NSSTNIYKIIYYNNPIDPIDKVFVFK

SEQ ID NO: 2597299 - protein, 22 aa, Entamoeba histolytica
NSTFSLLIKQKIKHFNDLTTDP

SEQ ID NO: 2597300 - protein, 17 aa, Entamoeba histolytica
NSTIWFISSVNTIQFNA

SEQ ID NO: 2597301 - protein, 39 aa, Entamoeba histolytica
NSTNTRRMYILAGCYYLITKGWSFLISKEQRRAEKLHHF

SEQ ID NO: 2597302 - protein, 40 aa, Entamoeba histolytica
NSTNTRRMYILAGCYYLITKGWSFLISKEQRRAEKLHHFF

SEQ ID NO: 2597303 - protein, 27 aa, Entamoeba histolytica
NSTYYFITVFIVFFFSFSMNIFLTNVI

SEQ ID NO: 2597304 - protein, 22 aa, Entamoeba histolytica
NSVFNRALLLFLRFYNHQSCDP

SEQ ID NO: 2597305 - protein, 20 aa, Entamoeba histolytica
NSVLIWILRATGLLAYFVFF

SEQ ID NO: 2597306 - protein, 39 aa, Entamoeba histolytica
NSVLSTIILSPGGKFLDIIFSLLLMSFLGIGYLEQELLR

SEQ ID NO: 2597307 - protein, 39 aa, Entamoeba histolytica
NSVSSLLCFISIFSLFMKYHFPIYFSIEPSSISLLLHSL

SEQ ID NO: 2597308 - protein, 26 aa, Entamoeba histolytica
NSVVKFFRTLFFRTSMPQLLKGRKGN

SEQ ID NO: 2597309 - protein, 26 aa, Entamoeba histolytica
NSVVKQYCMLLLPKDFDSYEIEKLEK

SEQ ID NO: 2597310 - protein, 18 aa, Entamoeba histolytica
NSVVVLQQKSMACIWFLI

SEQ ID NO: 2597311 - protein, 24 aa, Entamoeba histolytica
NSWVFSWLMFISYIFVCLSCGGIY

SEQ ID NO: 2597312 - protein, 17 aa, Entamoeba histolytica
NSYLLIIAFITISTIAI

SEQ ID NO: 2597313 - protein, 24 aa, Entamoeba histolytica
NSYQGLPFTIPKEIYRLVDKLLSL

SEQ ID NO: 2597314 - protein, 17 aa, Entamoeba histolytica
NTCKVLYIGKPFGHILS

SEQ ID NO: 2597315 - protein, 24 aa, Entamoeba histolytica
NTDINVPKLVLKSAIITANKDIKI

SEQ ID NO: 2597316 - protein, 22 aa, Entamoeba histolytica
NTECFICNDGFYLTSDGTKCKP

SEQ ID NO: 2597317 - protein, 25 aa, Entamoeba histolytica
NTEKQFFQVLPPLLIPNNGKAHDGR

SEQ ID NO: 2597318 - protein, 24 aa, Entamoeba histolytica
NTFTLYLVAFIAFGVFILIPRYNK

SEQ ID NO: 2597319 - protein, 21 aa, Entamoeba histolytica
NTFYCCIAFLSKQSIHYSNKK

SEQ ID NO: 2597320 - protein, 18 aa, Entamoeba histolytica
NTGISIVFFLRRGQTFWQ

SEQ ID NO: 2597321 - protein, 36 aa, Entamoeba histolytica
NTIETFCTLWMILSMITFVLFGIVLTCCMFLSTRLE

SEQ ID NO: 2597322 - protein, 18 aa, Entamoeba histolytica
NTIILSFLGSILLYIILY

SEQ ID NO: 2597323 - protein, 22 aa, Entamoeba histolytica
NTKWMMIIFHTTNTPKFIIHFN

SEQ ID NO: 2597324 - protein, 29 aa, Entamoeba histolytica
NTLIDPSYYLFRWLTLLGASELPMDVTIK

SEQ ID NO: 2597325 - protein, 24 aa, Entamoeba histolytica
NTLLIFFTLMIYVVLYLVCIMFNF

SEQ ID NO: 2597326 - protein, 19 aa, Entamoeba histolytica
NTLLIPGIILRYLPNDRLT

SEQ ID NO: 2597327 - protein, 27 aa, Entamoeba histolytica
NTLMTFERFVFIAGVTGILIFERGRMK

SEQ ID NO: 2597328 - protein, 25 aa, Entamoeba histolytica
NTLSLKWLRMCIIKNCFIQPSLEDY

SEQ ID NO: 2597329 - protein, 17 aa, Entamoeba histolytica
NTLYSHNTTFYVFNLDS

SEQ ID NO: 2597330 - protein, 26 aa, Entamoeba histolytica
NTMAICFVFILALVLFVYCISIILAH

SEQ ID NO: 2597331 - protein, 26 aa, Entamoeba histolytica
NTMKAIRYFINLLKAKWYCVVFVIVF

SEQ ID NO: 2597332 - protein, 26 aa, Entamoeba histolytica
NTNAIIEIILIFKSFPTLFSQLSMND

SEQ ID NO: 2597333 - protein, 22 aa, Entamoeba histolytica
NTNLVLYSFFGTSGVFTFLICG

SEQ ID NO: 2597334 - protein, 23 aa, Entamoeba histolytica
NTNPIIVILPMNGGGYADLEANF

SEQ ID NO: 2597335 - protein, 24 aa, Entamoeba histolytica
NTPQYGSWFLIRGIEQSISISTCN

SEQ ID NO: 2597336 - protein, 23 aa, Entamoeba histolytica
NTQTCFLCNVSFPHCSSCSQTDK

SEQ ID NO: 2597337 - protein, 24 aa, Entamoeba histolytica
NTQYPTTIYLYKKVTTSNGCMGDA

SEQ ID NO: 2597338 - protein, 23 aa, Entamoeba histolytica
NTSLLIPLVNFITYLVGSNRATF

SEQ ID NO: 2597339 - protein, 34 aa, Entamoeba histolytica
NTSRGFSYITFIFLFLCFIAYTLIATLVLDRTEN

SEQ ID NO: 2597340 - protein, 25 aa, Entamoeba histolytica
NTTSQINFLLTTRLPWNCINPSLIT

SEQ ID NO: 2597341 - protein, 25 aa, Entamoeba histolytica
NTTTWSDFLIPQRMDSLVFNLTAEG

SEQ ID NO: 2597342 - protein, 25 aa, Entamoeba histolytica
NTTTWSDFLIPQRMESLTLVITANG

SEQ ID NO: 2597343 - protein, 25 aa, Entamoeba histolytica
NTTYNTLYYIFISSVHKSIGSYFLQ

SEQ ID NO: 2597344 - protein, 29 aa, Entamoeba histolytica
NTVIPLSVVLFIFLLITFSVISNRKRRDD

SEQ ID NO: 2597345 - protein, 17 aa, Entamoeba histolytica
NVCVNNKIFVNTQFGVA

SEQ ID NO: 2597346 - protein, 27 aa, Entamoeba histolytica
NVFDEQLTNPPPPPPPLMQGKGPINVE

SEQ ID NO: 2597347 - protein, 18 aa, Entamoeba histolytica
NVFIIYFALFLFTKKEIF

SEQ ID NO: 2597348 - protein, 28 aa, Entamoeba histolytica
NVFSNLFTNFIFLTIIGVTIIIQTIIVQ

SEQ ID NO: 2597349 - protein, 19 aa, Entamoeba histolytica
NVFYLLMEMNIFITIFVGF

SEQ ID NO: 2597350 - protein, 31 aa, Entamoeba histolytica
NVFYSCLLLYKHFYIIQSPQLFHPRFIMIAC

SEQ ID NO: 2597351 - protein, 29 aa, Entamoeba histolytica
NVIAPKYAYNFWICCLHFIGTPLISNNAS

SEQ ID NO: 2597352 - protein, 18 aa, Entamoeba histolytica
NVIFPPPEVFFICDNCTD

SEQ ID NO: 2597353 - protein, 29 aa, Entamoeba histolytica
NVIICFFLGFILFIPFLIAYIIGKKSESK

SEQ ID NO: 2597354 - protein, 19 aa, Entamoeba histolytica
NVILLDENFYFKIGNRFNS

SEQ ID NO: 2597355 - protein, 34 aa, Entamoeba histolytica
NVIPDIEQELKDVGLYDLFSKKDSNSELDENSNN

SEQ ID NO: 2597356 - protein, 34 aa, Entamoeba histolytica
NVIPDIEQELKDVGLYDLFSKKESIHENDIENEE

SEQ ID NO: 2597357 - protein, 19 aa, Entamoeba histolytica
NVIYSQWIEKILSAYDDVD

SEQ ID NO: 2597358 - protein, 30 aa, Entamoeba histolytica; identical to SEQ ID NO: 2400495

SEQ ID NO: 2597359 - protein, 21 aa, Entamoeba histolytica
NVLYKLFFLFLFHCLKLFKTI

SEQ ID NO: 2597360 - protein, 24 aa, Entamoeba histolytica
NVNKFVSEGLKLVNKYLIECDVNS

SEQ ID NO: 2597361 - protein, 26 aa, Entamoeba histolytica
NVPIDILYFLSFPYYSKRLSKLLGGT

SEQ ID NO: 2597362 - protein, 17 aa, Entamoeba histolytica
NVPYGLFIKDQSKWNTE

SEQ ID NO: 2597363 - protein, 24 aa, Entamoeba histolytica
NVQTFIIYHFWVDVIVRAGIASIP

SEQ ID NO: 2597364 - protein, 20 aa, Entamoeba histolytica
NVTKVFLLIGKPPTITFLEE

SEQ ID NO: 2597365 - protein, 26 aa, Entamoeba histolytica
NVVLPSAPLFISGTIYFVGGITIQRT

SEQ ID NO: 2597366 - protein, 17 aa, Entamoeba histolytica
NVVRLIMKFINNNTVLL

SEQ ID NO: 2597367 - protein, 19 aa, Entamoeba histolytica
NVYVCDYLKRILLSNNAQQ

SEQ ID NO: 2597368 - protein, 17 aa, Entamoeba histolytica
NWLVCCAVYFSASAKDL

SEQ ID NO: 2597369 - protein, 18 aa, Entamoeba histolytica
NWNTKMIFVWVKASFTNK

SEQ ID NO: 2597370 - protein, 17 aa, Entamoeba histolytica
NWRYCPKYKEEEGFDAD

SEQ ID NO: 2597371 - protein, 17 aa, Entamoeba histolytica
NWSLLISVLFWNINGVD

SEQ ID NO: 2597372 - protein, 19 aa, Entamoeba histolytica
NWVGKITLRLLWDLICLST

SEQ ID NO: 2597373 - protein, 26 aa, Entamoeba histolytica
NYCCIMTFLSLLYWRNYPASIIGMMI

SEQ ID NO: 2597374 - protein, 26 aa, Entamoeba histolytica
NYCFTFIRTILHWYFGTDKSLKWRFI

SEQ ID NO: 2597375 - protein, 25 aa, Entamoeba histolytica
NYCQKLWPIVIIYTLLIVLMEMIVQ

SEQ ID NO: 2597376 - protein, 23 aa, Entamoeba histolytica
NYDITRSLPLYLSIFIFGESSNE

SEQ ID NO: 2597377 - protein, 17 aa, Entamoeba histolytica
NYFYYLKQQIESFSYET

SEQ ID NO: 2597378 - protein, 24 aa, Entamoeba histolytica
NYHEKIYWNLWLEKDGNGDIGIID

SEQ ID NO: 2597379 - protein, 23 aa, Entamoeba histolytica
NYHRGLWMTMDGYNLMIYIDACP

SEQ ID NO: 2597380 - protein, 38 aa, Entamoeba histolytica; identical to SEQ ID NO: 2400526

SEQ ID NO: 2597381 - protein, 17 aa, Entamoeba histolytica
NYIVFVVDNLVLLTNRK

SEQ ID NO: 2597382 - protein, 30 aa, Entamoeba histolytica
NYKEVIMPNFLFLIKICLRIKDIYKVLDYE

SEQ ID NO: 2597383 - protein, 20 aa, Entamoeba histolytica
NYKEVLYFTFHCGEYPKYDI

SEQ ID NO: 2597384 - protein, 25 aa, Entamoeba histolytica
NYKHEYIFCTLGLIGGIGAGAAFPF

SEQ ID NO: 2597385 - protein, 25 aa, Entamoeba histolytica
NYPSIIIMWIFLLVLMVVIAFIPHQ

SEQ ID NO: 2597386 - protein, 27 aa, Entamoeba histolytica
NYQNKKIFFFFFENQPNYCYPPNKIID

SEQ ID NO: 2597387 - protein, 36 aa, Entamoeba histolytica; identical to SEQ ID NO: 2400537

SEQ ID NO: 2597388 - protein, 29 aa, Entamoeba histolytica
NYSLSQYFIIPRFSPTCWVKLPYKRSFYM

SEQ ID NO: 2597389 - protein, 25 aa, Entamoeba histolytica
NYSSIHLLYLITSYRPELFSRQNAN

SEQ ID NO: 2597390 - protein, 24 aa, Entamoeba histolytica
NYTTWQFMERLFTPKDLSNFLNTE

SEQ ID NO: 2597391 - protein, 28 aa, Entamoeba histolytica
NYVLDINSIFPILLLSLNGYKTTDSDSF

SEQ ID NO: 2597392 - protein, 17 aa, Entamoeba histolytica
NYVYCFKCSPGCINSCI

SEQ ID NO: 2597393 - protein, 18 aa, Entamoeba histolytica
NYYYYIYGSNKAGPSKEN

SEQ ID NO: 2597394 - protein, 36 aa, Entamoeba histolytica
PAFLAVFFGMLFLFVKPLYNFFFTGPLRIVGNTMKV

SEQ ID NO: 2597395 - protein, 25 aa, Entamoeba histolytica
PAFMAPEILLLQKYKKPADIYAFAI

SEQ ID NO: 2597396 - protein, 28 aa, Entamoeba histolytica
PAHYVFTMYEILGRVVRLMILFGKNTIN

SEQ ID NO: 2597397 - protein, 17 aa, Entamoeba histolytica
PAIKYFNTMFSTSSRRI

SEQ ID NO: 2597398 - protein, 19 aa, Entamoeba histolytica
PALICITIAYVFSILAFNV

SEQ ID NO: 2597399 - protein, 23 aa, Entamoeba histolytica
PALKQNLFFGCMKLKNLLYVSYQ

SEQ ID NO: 2597400 - protein, 17 aa, Entamoeba histolytica
PALLYLVPSMVIPFLIY

SEQ ID NO: 2597401 - protein, 22 aa, Entamoeba histolytica
PALQLIMMNLIGVFFVLVMATI

SEQ ID NO: 2597402 - protein, 17 aa, Entamoeba histolytica
PATLPLLLPLLPSLSPT

SEQ ID NO: 2597403 - protein, 23 aa, Entamoeba histolytica
PATLRLTLFDFLSKCLAYKPEDR

SEQ ID NO: 2597404 - protein, 23 aa, Entamoeba histolytica
PATTLYPIGWKQTTTYNLGLCYL

SEQ ID NO: 2597405 - protein, 25 aa, Entamoeba histolytica
PCFNTLPYLIQQTKGYYYVLYSENN

SEQ ID NO: 2597406 - protein, 22 aa, Entamoeba histolytica
PCGRLLYNYTVNSTIPSPDYSV

SEQ ID NO: 2597407 - protein, 32 aa, Entamoeba histolytica
PCHDLGHYVARLRTIIYPNFLNYYLMHFLFFT

SEQ ID NO: 2597408 - protein, 17 aa, Entamoeba histolytica
PCILSVLVAALDGLLKS

SEQ ID NO: 2597409 - protein, 18 aa, Entamoeba histolytica
PCNEIIFQKPFTFEEVEE

SEQ ID NO: 2597410 - protein, 18 aa, Entamoeba histolytica
PCPYTGIDWGVMDTLLVG

SEQ ID NO: 2597411 - protein, 21 aa, Entamoeba histolytica
PCVSYFYLGNFSSSLIKIQIV

SEQ ID NO: 2597412 - protein, 19 aa, Entamoeba histolytica
PCYIGFFFLVISYARFRLY

SEQ ID NO: 2597413 - protein, 20 aa, Entamoeba histolytica
PDCLYNNSLFYLTILQHQVT

SEQ ID NO: 2597414 - protein, 20 aa, Entamoeba histolytica
PDFINWMRPAVSSTFRKLTG

SEQ ID NO: 2597415 - protein, 24 aa, Entamoeba histolytica
PDFSMPYNVLALSLAIFALGIGNS

SEQ ID NO: 2597416 - protein, 20 aa, Entamoeba histolytica
PDHPLYSSLFQLVKNYKSSF

SEQ ID NO: 2597417 - protein, 21 aa, Entamoeba histolytica
PDIFYFFVEQVKSYALPLVIS

SEQ ID NO: 2597418 - protein, 21 aa, Entamoeba histolytica
PDNECYILWTQVQPVYDNGDF

SEQ ID NO: 2597419 - protein, 24 aa, Entamoeba histolytica
PDNKQFIQLLLSLLEIFITNGHYD

SEQ ID NO: 2597420 - protein, 20 aa, Entamoeba histolytica
PDNPWYISCGLCDDGYYLSG

SEQ ID NO: 2597421 - protein, 33 aa, Entamoeba histolytica
PDTNKFTFYSYPQTKIILPKAKQKIILFFTAHC

SEQ ID NO: 2597422 - protein, 24 aa, Entamoeba histolytica
PEAKAAMIWIIGEYSDRITNVADL

SEQ ID NO: 2597423 - protein, 23 aa, Entamoeba histolytica
PEDNIALSPAPFAHWCIKEITEQ

SEQ ID NO: 2597424 - protein, 29 aa, Entamoeba histolytica
PEIAKARLFLFYCARIVLGNGLRLLGLEP

SEQ ID NO: 2597425 - protein, 22 aa, Entamoeba histolytica
PEIRDWVLIPLLIVTVCSNYLR

SEQ ID NO: 2597426 - protein, 33 aa, Entamoeba histolytica
PEISGNYLQILYLLFFWVFKNLSHQTLSDLIRK

SEQ ID NO: 2597427 - protein, 35 aa, Entamoeba histolytica; identical to SEQ ID NO: 2400570

SEQ ID NO: 2597428 - protein, 24 aa, Entamoeba histolytica
PEKQASVFLILIPTTFDLIASTLM

SEQ ID NO: 2597429 - protein, 18 aa, Entamoeba histolytica
PELSPYDPPLLSSYNYFN

SEQ ID NO: 2597430 - protein, 20 aa, Entamoeba histolytica
PELSVLLRKSLLTEYITNFQ

SEQ ID NO: 2597431 - protein, 26 aa, Entamoeba histolytica
PENFRIYFIRLCQLLSFHGPKVAPTM

SEQ ID NO: 2597432 - protein, 31 aa, Entamoeba histolytica; identical to SEQ ID NO: 2400576

SEQ ID NO: 2597433 - protein, 29 aa, Entamoeba histolytica
PERDFNKYFILYLACVLMLIQTNPNQFEF

SEQ ID NO: 2597434 - protein, 19 aa, Entamoeba histolytica
PETLLKRLALAKNLPTKIA

SEQ ID NO: 2597435 - protein, 25 aa, Entamoeba histolytica
PFCWRSDTPLIYRAIPSWFVNVESF

SEQ ID NO: 2597436 - protein, 20 aa, Entamoeba histolytica
PFDIIRKFGKKYIGFNSPHA

SEQ ID NO: 2597437 - protein, 18 aa, Entamoeba histolytica
PFEIQIPLVFQKCPVHCS

SEQ ID NO: 2597438 - protein, 29 aa, Entamoeba histolytica
PFFGIFLAIIRWVFILNFFISIIYAFVYN

SEQ ID NO: 2597439 - protein, 18 aa, Entamoeba histolytica
PFKMSWRIAATFLVSLFD

SEQ ID NO: 2597440 - protein, 18 aa, Entamoeba histolytica
PFLLLGNLIVIISIGIQV

SEQ ID NO: 2597441 - protein, 19 aa, Entamoeba histolytica
PFNFIRKFGKKYVGLKCPH

SEQ ID NO: 2597442 - protein, 27 aa, Entamoeba histolytica
PFNKKLFLFTIIFPCIGYYGIFHLNNS

SEQ ID NO: 2597443 - protein, 23 aa, Entamoeba histolytica
PFNSSPYGICWCSQMSMANNCII

SEQ ID NO: 2597444 - protein, 17 aa, Entamoeba histolytica
PFPLKNLIQLCWKQIYT

SEQ ID NO: 2597445 - protein, 21 aa, Entamoeba histolytica
PFQFCVFIFTLGDYLILPLLS

SEQ ID NO: 2597446 - protein, 20 aa, Entamoeba histolytica
PFRVLPLRKEAEKYIQAIMG

SEQ ID NO: 2597447 - protein, 24 aa, Entamoeba histolytica
PFSNIVGIKYYKYSGSVLEACVSS

SEQ ID NO: 2597448 - protein, 23 aa, Entamoeba histolytica
PFVTRLVIHMLKYIRMNPRFKRE

SEQ ID NO: 2597449 - protein, 23 aa, Entamoeba histolytica
PGAIVFFLWTFANLMPRARSVHL

SEQ ID NO: 2597450 - protein, 23 aa, Entamoeba histolytica
PGIRQLTSLILINSYFLNTDGDL

SEQ ID NO: 2597451 - protein, 30 aa, Entamoeba histolytica
PGISLTQWGVCILLGLVSLPLGLLNGFFKE

SEQ ID NO: 2597452 - protein, 19 aa, Entamoeba histolytica
PGLLRISSFIKMGSILKRF

SEQ ID NO: 2597453 - protein, 21 aa, Entamoeba histolytica
PGLYAVLTQVKILSAAILSVL

SEQ ID NO: 2597454 - protein, 26 aa, Entamoeba histolytica
PGNVPLLILLGIICLLFAGFTTLFII

SEQ ID NO: 2597455 - protein, 26 aa, Entamoeba histolytica
PGTAIPVTFKIKILCTCTISDNIGIS

SEQ ID NO: 2597456 - protein, 21 aa, Entamoeba histolytica
PHAVAYNFFRIKEYSSPIEMN

SEQ ID NO: 2597457 - protein, 39 aa, Entamoeba histolytica
PHEELLRHSIPIIIRLYQNKLLPNNFLKKLYQNAERLSG

SEQ ID NO: 2597458 - protein, 24 aa, Entamoeba histolytica
PHFVKLLCTCYGYFFADIFMLIPE

SEQ ID NO: 2597459 - protein, 18 aa, Entamoeba histolytica
PHHLFLVVISFSLFLLYH

SEQ ID NO: 2597460 - protein, 17 aa, Entamoeba histolytica
PHISNGLPFYIISGNKS

SEQ ID NO: 2597461 - protein, 17 aa, Entamoeba histolytica
PHIYLITLGFYTLIYLD

SEQ ID NO: 2597462 - protein, 25 aa, Entamoeba histolytica
PICDYYQLLLYNNTIIQCLCDGCGI

SEQ ID NO: 2597463 - protein, 19 aa, Entamoeba histolytica
PICSTTILQQIRFSVYNFK

SEQ ID NO: 2597464 - protein, 17 aa, Entamoeba histolytica
PICVWTFCHFAKETAFM

SEQ ID NO: 2597465 - protein, 21 aa, Entamoeba histolytica
PIDSSIPIYISSGFGYVKVIG

SEQ ID NO: 2597466 - protein, 22 aa, Entamoeba histolytica
PIEGKYSPIIYGFKLYNGEINE

SEQ ID NO: 2597467 - protein, 39 aa, Entamoeba histolytica
PIEQQHHPIFWFIVVITHLLICGCMAFLYFHHRSKVSYK

SEQ ID NO: 2597468 - protein, 29 aa, Entamoeba histolytica
PIFEEFYYQLFQFLVLIASVIQTFIKRTL

SEQ ID NO: 2597469 - protein, 18 aa, Entamoeba histolytica
PIFIHFDQTLLGLATIRT

SEQ ID NO: 2597470 - protein, 18 aa, Entamoeba histolytica
PIFIHFDQTLLGLATVRT

SEQ ID NO: 2597471 - protein, 25 aa, Entamoeba histolytica
PIFQSIVMFFSMSLCFFIEKLIELF

SEQ ID NO: 2597472 - protein, 20 aa, Entamoeba histolytica
PIGILYPFHLLIESDVKTMD

SEQ ID NO: 2597473 - protein, 31 aa, Entamoeba histolytica
PIICIGIHFTLWWYNIIPSDPMYFFVVCIES

SEQ ID NO: 2597474 - protein, 37 aa, Entamoeba histolytica
PIIFSSISIPLLPLLLPLFKILPIQSFAILLQVISTI

SEQ ID NO: 2597475 - protein, 20 aa, Entamoeba histolytica
PIIGLFLNKKWFPIADICRI

SEQ ID NO: 2597476 - protein, 20 aa, Entamoeba histolytica
PIIIESIPFTKMVALPFEIE

SEQ ID NO: 2597477 - protein, 17 aa, Entamoeba histolytica
PIIIHFPKIPRVVYLNN

SEQ ID NO: 2597478 - protein, 19 aa, Entamoeba histolytica
PIILFILISIIPESICYIF

SEQ ID NO: 2597479 - protein, 23 aa, Entamoeba histolytica
PIIPIGLFILNLWYVMCFATNQN

SEQ ID NO: 2597480 - protein, 31 aa, Entamoeba histolytica
PIIRKGIFFSVKTVPYHTLILDTKLSSSFHY

SEQ ID NO: 2597481 - protein, 27 aa, Entamoeba histolytica
PIIVMFVGFYHKKYVKRMLRFLHKSSI

SEQ ID NO: 2597482 - protein, 19 aa, Entamoeba histolytica
PIKILSLLNIFLELEQLII

SEQ ID NO: 2597483 - protein, 25 aa, Entamoeba histolytica
PIKVNIINSYLLPSLLRFSKSLEEK

SEQ ID NO: 2597484 - protein, 18 aa, Entamoeba histolytica
PILHWYYTRSVLFTLCLC

SEQ ID NO: 2597485 - protein, 25 aa, Entamoeba histolytica
PILLAHISFYYHLISNYAGAAVGDN

SEQ ID NO: 2597486 - protein, 17 aa, Entamoeba histolytica
PIMTVNLVMIILGIITL

SEQ ID NO: 2597487 - protein, 20 aa, Entamoeba histolytica
PINEFPYPWSISKFVCIGRR

SEQ ID NO: 2597488 - protein, 25 aa, Entamoeba histolytica
PINGDDWFFVLKLAKQITVSRDFKY

SEQ ID NO: 2597489 - protein, 18 aa, Entamoeba histolytica
PINRFFDFQFTSLPHYEH

SEQ ID NO: 2597490 - protein, 18 aa, Entamoeba histolytica
PIRVDGYISFNILVLSNV

SEQ ID NO: 2597491 - protein, 36 aa, Entamoeba histolytica
PITGLILCIVLFVLIGFYIIITVILNIFVFHKKGLE

SEQ ID NO: 2597492 - protein, 38 aa, Entamoeba histolytica
PIVKQTFIHCLSSIPLKLLYRLIPLIQPNTSLSYPTTI

SEQ ID NO: 2597493 - protein, 24 aa, Entamoeba histolytica
PIVLLLFYFILYITFVVYSQSVGL

SEQ ID NO: 2597494 - protein, 19 aa, Entamoeba histolytica
PIYVNYFNYMISSYSSFWY

SEQ ID NO: 2597495 - protein, 21 aa, Entamoeba histolytica
PKALNIFLTQAIDWEDPHEAA

SEQ ID NO: 2597496 - protein, 33 aa, Entamoeba histolytica; identical to SEQ ID NO: 2400649

SEQ ID NO: 2597497 - protein, 23 aa, Entamoeba histolytica
PKEYSVITFPPTEPLLSKIGVID

SEQ ID NO: 2597498 - protein, 17 aa, Entamoeba histolytica
PKGSYFVNNKCLLCEEG

SEQ ID NO: 2597499 - protein, 20 aa, Entamoeba histolytica
PKIMLIVAAVGLFINLAAML

SEQ ID NO: 2597500 - protein, 18 aa, Entamoeba histolytica
PKKAVVFTIFIKPLICCC

SEQ ID NO: 2597501 - protein, 21 aa, Entamoeba histolytica
PKKYLLILPGETSTSFCVCIV

SEQ ID NO: 2597502 - protein, 23 aa, Entamoeba histolytica
PKLSDTQRIFYIAKIKLNEDNNT

SEQ ID NO: 2597503 - protein, 33 aa, Entamoeba histolytica
PKLSYNDWYFVFYKIFFRVLEPIGYYHLKSENI

SEQ ID NO: 2597504 - protein, 23 aa, Entamoeba histolytica
PKMTSFLNDDSWKKRIDMEWKRK

SEQ ID NO: 2597505 - protein, 24 aa, Entamoeba histolytica
PKNKDTYFLPQYNKEIPADGLSCF

SEQ ID NO: 2597506 - protein, 23 aa, Entamoeba histolytica
PKNPPEVYFFTPNGRFAINTKIC

SEQ ID NO: 2597507 - protein, 24 aa, Entamoeba histolytica
PKQFFLTSFVMFNLLGINLSGIDL

SEQ ID NO: 2597508 - protein, 23 aa, Entamoeba histolytica
PKRLTIVMEFAPYKSLKSMISNE

SEQ ID NO: 2597509 - protein, 21 aa, Entamoeba histolytica
PKSIPFLYSLTNKWNQMDFIY

SEQ ID NO: 2597510 - protein, 27 aa, Entamoeba histolytica
PKSSTLYLPPRYPLLGGWKTSFEVIYN

SEQ ID NO: 2597511 - protein, 22 aa, Entamoeba histolytica
PKTGNALWWRRPSESSLDTQSL

SEQ ID NO: 2597512 - protein, 20 aa, Entamoeba histolytica
PKTIYTIYLKEFIKIIISNN

SEQ ID NO: 2597513 - protein, 39 aa, Entamoeba histolytica
PKTKQLKNYIIKKSMKFLIFMIIFVVSKGLEPIEVATEE

SEQ ID NO: 2597514 - protein, 20 aa, Entamoeba histolytica
PKTPVYFEYGKVIFEGTIYF

SEQ ID NO: 2597515 - protein, 24 aa, Entamoeba histolytica
PKTTKFIRPYLDQLKQFHSQLTNG

SEQ ID NO: 2597516 - protein, 25 aa, Entamoeba histolytica
PKVKINIDLTKPIKSYIPHHLKEIK

SEQ ID NO: 2597517 - protein, 17 aa, Entamoeba histolytica
PLAGMPIIDVYKAKVCV

SEQ ID NO: 2597518 - protein, 18 aa, Entamoeba histolytica
PLAGMPIIDVYKAKVCVV

SEQ ID NO: 2597519 - protein, 26 aa, Entamoeba histolytica
PLCCSLLIPFILQITISWGMKAALPI

SEQ ID NO: 2597520 - protein, 32 aa, Entamoeba histolytica; identical to SEQ ID NO: 2400673

SEQ ID NO: 2597521 - protein, 27 aa, Entamoeba histolytica
PLCVIRNIHIIIITSLLILIQYENISQ

SEQ ID NO: 2597522 - protein, 27 aa, Entamoeba histolytica
PLCYKQAYPTLWYKIKGDGRYLVVNTC

SEQ ID NO: 2597523 - protein, 18 aa, Entamoeba histolytica
PLCYSGCSTIIKGLKEWG

SEQ ID NO: 2597524 - protein, 18 aa, Entamoeba histolytica
PLFFNSLMFFSMALCTFP

SEQ ID NO: 2597525 - protein, 29 aa, Entamoeba histolytica
PLFGKHYLFALFLLFIARFTITAMSISMP

SEQ ID NO: 2597526 - protein, 19 aa, Entamoeba histolytica
PLFIPYVLVLCFVSRAFNV

SEQ ID NO: 2597527 - protein, 22 aa, Entamoeba histolytica
PLHPHFNPIFSKKIPPLSYLSC

SEQ ID NO: 2597528 - protein, 18 aa, Entamoeba histolytica
PLIFLLIDCFFFKQGNTR

SEQ ID NO: 2597529 - protein, 23 aa, Entamoeba histolytica
PLINAFFAFKTYQPLFQKLSISM

SEQ ID NO: 2597530 - protein, 23 aa, Entamoeba histolytica
PLKDDYLIVLQRLLPAGATGQKM

SEQ ID NO: 2597531 - protein, 18 aa, Entamoeba histolytica
PLKSLLEIPPKPINSCIL

SEQ ID NO: 2597532 - protein, 18 aa, Entamoeba histolytica
PLLLLKCFILGFSVSGIG

SEQ ID NO: 2597533 - protein, 21 aa, Entamoeba histolytica
PLLLPDVINLITLLILTTNEA

SEQ ID NO: 2597534 - protein, 18 aa, Entamoeba histolytica
PLLSYLWNGMISLVIIYF

SEQ ID NO: 2597535 - protein, 26 aa, Entamoeba histolytica
PLMLPIFFMIHVVILILMPRCKEYNP

SEQ ID NO: 2597536 - protein, 23 aa, Entamoeba histolytica
PLNELKIIIKLLTRMLLSCIIRN

SEQ ID NO: 2597537 - protein, 28 aa, Entamoeba histolytica
PLNIRKSFRFILPRALLLLTLFMLVFTE

SEQ ID NO: 2597538 - protein, 28 aa, Entamoeba histolytica
PLPADKLVSFMFISLPIASSIICLKKAP

SEQ ID NO: 2597539 - protein, 27 aa, Entamoeba histolytica
PLQDKLLKCISYFLPFISDKNILKDKQ

SEQ ID NO: 2597540 - protein, 23 aa, Entamoeba histolytica
PLQEFIPHEYLWNSLSTEGVETQ

SEQ ID NO: 2597541 - protein, 30 aa, Entamoeba histolytica
PLSLQYFYRTVFPLVPFYLTIVYIFIIIVI

SEQ ID NO: 2597542 - protein, 34 aa, Entamoeba histolytica
PLSQRTFKFFYFPRFLIVLLIGSFLVNLYLYNAE

SEQ ID NO: 2597543 - protein, 45 aa, Entamoeba histolytica
PLVITGSCAPVLFLIVCIILLCIITYWAFIPIGVCLVFVSVNTIS

SEQ ID NO: 2597544 - protein, 24 aa, Entamoeba histolytica
PLVLLSIMFFYDIFWVFGSANLSL

SEQ ID NO: 2597545 - protein, 17 aa, Entamoeba histolytica
PLVLTTNSDDKINVQGF

SEQ ID NO: 2597546 - protein, 19 aa, Entamoeba histolytica
PMIILSGLQLFDMLQIIPE

SEQ ID NO: 2597547 - protein, 17 aa, Entamoeba histolytica
PMQIFWYIVYYGMIVFA

SEQ ID NO: 2597548 - protein, 29 aa, Entamoeba histolytica
PMVISIIIALLLYLSTCHWYWIPEIFEGM

SEQ ID NO: 2597549 - protein, 34 aa, Entamoeba histolytica
PMYSDRFIMDPISLAGILIFIFIGGEGMERISGL

SEQ ID NO: 2597550 - protein, 26 aa, Entamoeba histolytica
PNAFDILILDFSLFHRMEDPQTTFLF

SEQ ID NO: 2597551 - protein, 23 aa, Entamoeba histolytica
PNALPFKINATPFIPKRKRIEST

SEQ ID NO: 2597552 - protein, 21 aa, Entamoeba histolytica
PNDICIRLRLIAEAMSLGMII

SEQ ID NO: 2597553 - protein, 20 aa, Entamoeba histolytica
PNDNLPTEPLFGVFSIYNAD

SEQ ID NO: 2597554 - protein, 24 aa, Entamoeba histolytica
PNDPVYWIDLLTHEQFEEGFGSHT

SEQ ID NO: 2597555 - protein, 26 aa, Entamoeba histolytica
PNEEGNCYFYYPNSGIFISITLVAIF

SEQ ID NO: 2597556 - protein, 27 aa, Entamoeba histolytica
PNFLNYYLMHFLFFTALCFVGAIIMIL

SEQ ID NO: 2597557 - protein, 19 aa, Entamoeba histolytica
PNIAFFIGMILFVVLEKLI

SEQ ID NO: 2597558 - protein, 24 aa, Entamoeba histolytica
PNLHDQIFYYDIALDILNGLKYLH

SEQ ID NO: 2597559 - protein, 23 aa, Entamoeba histolytica
PNNIDGTSLVFMFLTFVIHLFFF

SEQ ID NO: 2597560 - protein, 34 aa, Entamoeba histolytica
PNNSSHPIIFLLILIVIVIILIVLIVLMLMSNAN

SEQ ID NO: 2597561 - protein, 27 aa, Entamoeba histolytica
PNNYWFGIGLFYLTLVYIPLLSFAVCN

SEQ ID NO: 2597562 - protein, 29 aa, Entamoeba histolytica
PNNYWFGIGLFYLTLVYIPLLSFAVCNAC

SEQ ID NO: 2597563 - protein, 26 aa, Entamoeba histolytica
PNQIKIRRFLPLKERLTLGRILNDIN

SEQ ID NO: 2597564 - protein, 17 aa, Entamoeba histolytica
PNSEYSHIIYPYIFLSP

SEQ ID NO: 2597565 - protein, 27 aa, Entamoeba histolytica
PNTIAKFFRTLFFRQTMPQLLKGRKGN

SEQ ID NO: 2597566 - protein, 17 aa, Entamoeba histolytica
PNVDYHVFFGFSSKFEA

SEQ ID NO: 2597567 - protein, 17 aa, Entamoeba histolytica
PNVLLKFNQQHQLIAVL

SEQ ID NO: 2597568 - protein, 30 aa, Entamoeba histolytica
PPHKEYLPVKLLKDIIFKCQLRVESPLTLK

SEQ ID NO: 2597569 - protein, 22 aa, Entamoeba histolytica
PPKFECWWLTRIIPYIFLIFVS

SEQ ID NO: 2597570 - protein, 33 aa, Entamoeba histolytica
PPLFPSDFRCVMDRWLRLRILGSKIPTQIIIQH

SEQ ID NO: 2597571 - protein, 20 aa, Entamoeba histolytica
PPVFISFFDSDLSWKEIKEH

SEQ ID NO: 2597572 - protein, 33 aa, Entamoeba histolytica; identical to SEQ ID NO: 2400710

SEQ ID NO: 2597573 - protein, 17 aa, Entamoeba histolytica
PQCNYPCLIIPPCGHPP

SEQ ID NO: 2597574 - protein, 18 aa, Entamoeba histolytica
PQEAMPTDPNWFKIVRLP

SEQ ID NO: 2597575 - protein, 21 aa, Entamoeba histolytica
PQENVIPPILPETKEIPKTNA

SEQ ID NO: 2597576 - protein, 31 aa, Entamoeba histolytica
PQEYFIFFHINLILTIIFFFIASVSNPGYIN

SEQ ID NO: 2597577 - protein, 28 aa, Entamoeba histolytica
PQFMPYYYIILIFPLLGARYFIYKKNGW

SEQ ID NO: 2597578 - protein, 27 aa, Entamoeba histolytica
PQFVCDLMIMRYSLLKTNEILCKELND

SEQ ID NO: 2597579 - protein, 17 aa, Entamoeba histolytica
PQFYVPNSNIHIPSINE

SEQ ID NO: 2597580 - protein, 23 aa, Entamoeba histolytica
PQIKKWWYVISIVLMPVLMTFGS

SEQ ID NO: 2597581 - protein, 18 aa, Entamoeba histolytica
PQKYIWPSAIRLFPFVMA

SEQ ID NO: 2597582 - protein, 19 aa, Entamoeba histolytica
PQLAQFIPTTIKLALDVCN

SEQ ID NO: 2597583 - protein, 23 aa, Entamoeba histolytica
PQLHFTWMCELSHKLKIAELNIE

SEQ ID NO: 2597584 - protein, 23 aa, Entamoeba histolytica
PQLIEIVTMYFIQIRKLIPSDCI

SEQ ID NO: 2597585 - protein, 20 aa, Entamoeba histolytica
PQSFMSFFTMAPFISANFQV

SEQ ID NO: 2597586 - protein, 24 aa, Entamoeba histolytica
PQSIVLLQPNLFIDFINYTKDKNP

SEQ ID NO: 2597587 - protein, 23 aa, Entamoeba histolytica
PQSKQLLYIVAEPAGYYPYYYNP

SEQ ID NO: 2597588 - protein, 23 aa, Entamoeba histolytica
PRHAYRLLSVFLLKAVSIMNKQP

SEQ ID NO: 2597589 - protein, 26 aa, Entamoeba histolytica
PRKEDIIDDWLFDLIEHCWNQNPKER

SEQ ID NO: 2597590 - protein, 35 aa, Entamoeba histolytica
PRSEYNTWRYGNIGRAFSFPVIVRVYSIAGTYVTI

SEQ ID NO: 2597591 - protein, 20 aa, Entamoeba histolytica
PRSSIYLYSGRSPSLQTPQT

SEQ ID NO: 2597592 - protein, 42 aa, Entamoeba histolytica
PRTVSIIFTCLLVISFVVALLLIITYFTFVVISGKVGKKYIE

SEQ ID NO: 2597593 - protein, 27 aa, Entamoeba histolytica
PSAQWVMYALLMDIIKGYKLIMKHIEE

SEQ ID NO: 2597594 - protein, 28 aa, Entamoeba histolytica
PSCVPTQFLLVPLVLVQAIGIASLVLSM

SEQ ID NO: 2597595 - protein, 21 aa, Entamoeba histolytica
PSDLPYFPFGQDIQSLPISVF

SEQ ID NO: 2597596 - protein, 24 aa, Entamoeba histolytica
PSDPISTCFLYTTPLRLNQDFKEL

SEQ ID NO: 2597597 - protein, 23 aa, Entamoeba histolytica
PSDQLTLVLSFLFQDIIIDNDPL

SEQ ID NO: 2597598 - protein, 24 aa, Entamoeba histolytica
PSGEYLFGILPNQPTLLTSALLFD

SEQ ID NO: 2597599 - protein, 17 aa, Entamoeba histolytica
PSIEVFPKMKLMKHPRK

SEQ ID NO: 2597600 - protein, 21 aa, Entamoeba histolytica
PSIEVFPKMKLMKHPRNPTEI

SEQ ID NO: 2597601 - protein, 30 aa, Entamoeba histolytica
PSIQTALNTIFLQLLLFHCPSLAIKLESKR

SEQ ID NO: 2597602 - protein, 28 aa, Entamoeba histolytica
PSKLTKLKMLLLFIAIMAFASIFIIFLS

SEQ ID NO: 2597603 - protein, 25 aa, Entamoeba histolytica
PSKTTLYLLLLQLIILICHLTRDIL

SEQ ID NO: 2597604 - protein, 30 aa, Entamoeba histolytica
PSKVIWKIILWYCFILVFIRMLLELPGFCL

SEQ ID NO: 2597605 - protein, 20 aa, Entamoeba histolytica
PSLEAFIHLIFRIPQKQSNP

SEQ ID NO: 2597606 - protein, 38 aa, Entamoeba histolytica
PSLEKCCSLFYRLYLNYIPLIPLIINKIQQFYNYTKTQ

SEQ ID NO: 2597607 - protein, 26 aa, Entamoeba histolytica
PSLIGIVGMISVFHMFARSQIQPSEL

SEQ ID NO: 2597608 - protein, 22 aa, Entamoeba histolytica
PSLLEFIGYFYFFPSIFSGPCI

SEQ ID NO: 2597609 - protein, 20 aa, Entamoeba histolytica
PSLLRLLCALLSSIQLLYIL

SEQ ID NO: 2597610 - protein, 26 aa, Entamoeba histolytica
PSLNHPQLIIWNSNRIHLYKPTRSST

SEQ ID NO: 2597611 - protein, 24 aa, Entamoeba histolytica
PSLNPAKLIPLRRLTIDSSQISTP

SEQ ID NO: 2597612 - protein, 25 aa, Entamoeba histolytica
PSLNQPQLIIWNSNRIHLYKPTTTS

SEQ ID NO: 2597613 - protein, 25 aa, Entamoeba histolytica
PSLNQPQLIIWNSNWIHLYKTTTTY

SEQ ID NO: 2597614 - protein, 20 aa, Entamoeba histolytica
PSLRLVILNIIRNLAVDEGL

SEQ ID NO: 2597615 - protein, 26 aa, Entamoeba histolytica
PSLSTPFFPFFTKKTLIKISKFLSYF

SEQ ID NO: 2597616 - protein, 32 aa, Entamoeba histolytica
PSLYEFIRSMITTYRDFIFKRPNSLALNLLKN

SEQ ID NO: 2597617 - protein, 26 aa, Entamoeba histolytica
PSNILELIFCVIMLYMKGNKKLINTS

SEQ ID NO: 2597618 - protein, 19 aa, Entamoeba histolytica
PSNYIIYAGNCILDRNCAS

SEQ ID NO: 2597619 - protein, 32 aa, Entamoeba histolytica
PSPTLVGIFYMYFYTLNIPLLPINDLELINNF

SEQ ID NO: 2597620 - protein, 28 aa, Entamoeba histolytica
PSQNSSWIILLWVVVGCIICAGLVMVIV

SEQ ID NO: 2597621 - protein, 31 aa, Entamoeba histolytica
PSQSFIVIKMIWFIILKRLQDWIVNKPSQFN

SEQ ID NO: 2597622 - protein, 24 aa, Entamoeba histolytica
PSSESIPILILQSPTIINGALNKF

SEQ ID NO: 2597623 - protein, 22 aa, Entamoeba histolytica
PSSNYLTKYIGKVLLKNTHLII

SEQ ID NO: 2597624 - protein, 25 aa, Entamoeba histolytica
PSSYNFLFEKVLFNTNLKFIEDQPE

SEQ ID NO: 2597625 - protein, 33 aa, Entamoeba histolytica
PSVKHCIFPIKDGKFLFLGPLQMTPKPYNQHPS

SEQ ID NO: 2597626 - protein, 27 aa, Entamoeba histolytica
PSVLTYMGYWYLLLGLICIGGIFIIIS

SEQ ID NO: 2597627 - protein, 23 aa, Entamoeba histolytica
PSYIYTLFYVPVYFNFLGNIIPM

SEQ ID NO: 2597628 - protein, 29 aa, Entamoeba histolytica
PTADQIMALPLFWDFNKKLNFIKSASDLF

SEQ ID NO: 2597629 - protein, 24 aa, Entamoeba histolytica
PTDPQVFLRVCQLIYVCLTTQPID

SEQ ID NO: 2597630 - protein, 27 aa, Entamoeba histolytica
PTEFVFPIAIFFTIISGILSFDGRFPF

SEQ ID NO: 2597631 - protein, 28 aa, Entamoeba histolytica
PTFKDINILLEFLLRKIQPKTPTPQIIN

SEQ ID NO: 2597632 - protein, 27 aa, Entamoeba histolytica
PTIAREIMVMWFNLPDRLIWKQCQEEY

SEQ ID NO: 2597633 - protein, 19 aa, Entamoeba histolytica
PTIIFPVLLFYLGMNNGLS

SEQ ID NO: 2597634 - protein, 25 aa, Entamoeba histolytica
PTKKTYFFELLLGASHRYELSVEPM

SEQ ID NO: 2597635 - protein, 29 aa, Entamoeba histolytica
PTMETFLQTSRVFCKYAFPDNLARVLSRI

SEQ ID NO: 2597636 - protein, 20 aa, Entamoeba histolytica
PTPEQVFLNGLRNYFYTPLV

SEQ ID NO: 2597637 - protein, 24 aa, Entamoeba histolytica
PTQSLYSYLLNHKIQFIKSDFDNF

SEQ ID NO: 2597638 - protein, 25 aa, Entamoeba histolytica
PTSDPRFVYPWRIAEFVINGKRLEK

SEQ ID NO: 2597639 - protein, 29 aa, Entamoeba histolytica
PTSMPFHYFMLFVRLLISLTNSIILIVSL

SEQ ID NO: 2597640 - protein, 20 aa, Entamoeba histolytica
PTTIILNLINNLFGRFEFDL

SEQ ID NO: 2597641 - protein, 26 aa, Entamoeba histolytica
PTTIYLVIFYFILSTTLYIPYLFLFG

SEQ ID NO: 2597642 - protein, 28 aa, Entamoeba histolytica
PTVIGYIIRYAILIFPIVNILNEYPLVC

SEQ ID NO: 2597643 - protein, 27 aa, Entamoeba histolytica
PTYTPYYFMMYYFNNLVIHFTVYGTIA

SEQ ID NO: 2597644 - protein, 17 aa, Entamoeba histolytica
PVGGLCYYLTAPNSLFE

SEQ ID NO: 2597645 - protein, 25 aa, Entamoeba histolytica
PVGLYTFIVSIILPCATIIGCLKLK

SEQ ID NO: 2597646 - protein, 25 aa, Entamoeba histolytica
PVIPDYLICPSLPTLQWTMIITYSL

SEQ ID NO: 2597647 - protein, 29 aa, Entamoeba histolytica
PVIVDLFGLLLVSIILTSSIFLVIKTMKF

SEQ ID NO: 2597648 - protein, 24 aa, Entamoeba histolytica
PVLPHIWMGVYGYNLRISVGERYR

SEQ ID NO: 2597649 - protein, 24 aa, Entamoeba histolytica
PVLSHIWMGVYGYNLRISFGEKYR

SEQ ID NO: 2597650 - protein, 26 aa, Entamoeba histolytica
PVNRYTIPLIFYLTTSNNDFLQYNEI

SEQ ID NO: 2597651 - protein, 19 aa, Entamoeba histolytica
PVNYGIFRRKIKILTSIVA

SEQ ID NO: 2597652 - protein, 27 aa, Entamoeba histolytica
PVQRTMRYPLLLETIKKHTPPMHPDYE

SEQ ID NO: 2597653 - protein, 28 aa, Entamoeba histolytica
PVSDLFKLRVFYQSYIIYKKIGDKSKCN

SEQ ID NO: 2597654 - protein, 25 aa, Entamoeba histolytica
PVVEIILLILVIINSVWTIPLEPLD

SEQ ID NO: 2597655 - protein, 20 aa, Entamoeba histolytica
PVVYLHQMTMNILSGIFVTT

SEQ ID NO: 2597656 - protein, 30 aa, Entamoeba histolytica
PYDIDRIRLILPEVQFITKHKLHAGMILGA

SEQ ID NO: 2597657 - protein, 29 aa, Entamoeba histolytica
PYHTTVERLLWFNSHGFLHLVMKCISITQ

SEQ ID NO: 2597658 - protein, 35 aa, Entamoeba histolytica
PYISVFVFEILLLMTSLFLIVILLPREGVFTHIHL

SEQ ID NO: 2597659 - protein, 20 aa, Entamoeba histolytica
PYQVLTFPTLSPTQIIQYIH

SEQ ID NO: 2597660 - protein, 37 aa, Entamoeba histolytica
PYRVITKIIPIIKLLLVILLIINSIWTIPLTGGPIKN

SEQ ID NO: 2597661 - protein, 18 aa, Entamoeba histolytica
PYSKLTPYQIMLSVSQKG

SEQ ID NO: 2597662 - protein, 30 aa, Entamoeba histolytica
PYSNKVLFPNSWSVPMFVQSGKRLPQVEPI

SEQ ID NO: 2597663 - protein, 17 aa, Entamoeba histolytica
PYTYGVWFKLTSTINTF

SEQ ID NO: 2597664 - protein, 19 aa, Entamoeba histolytica
PYTYGVWIELIHEKEAKVA

SEQ ID NO: 2597665 - protein, 19 aa, Entamoeba histolytica
PYVSHHCYFFKTDTLKEME

SEQ ID NO: 2597666 - protein, 26 aa, Entamoeba histolytica
PYYIFPVVLLLWLLLWVFSGCFVCDH

SEQ ID NO: 2597667 - protein, 17 aa, Entamoeba histolytica
PYYYNPITVEAGVSGIF

SEQ ID NO: 2597668 - protein, 18 aa, Entamoeba histolytica
QAFCKFALIYIRANSKNE

SEQ ID NO: 2597669 - protein, 20 aa, Entamoeba histolytica
QALIIACDIYVKAGLHPHHI

SEQ ID NO: 2597670 - protein, 21 aa, Entamoeba histolytica
QALRKAILLKQIQLPIECIAL

SEQ ID NO: 2597671 - protein, 20 aa, Entamoeba histolytica
QAMLILIHGFCTYAGVMKRM

SEQ ID NO: 2597672 - protein, 18 aa, Entamoeba histolytica
QARTCDFLSFFIDSASTA

SEQ ID NO: 2597673 - protein, 32 aa, Entamoeba histolytica
QCIITIQTFLIYIVFIFISILVNLPKEAPLRV

SEQ ID NO: 2597674 - protein, 27 aa, Entamoeba histolytica
QCLLTNLLFFLFSFFIEKIKKFNIIHF

SEQ ID NO: 2597675 - protein, 18 aa, Entamoeba histolytica
QCPIGTSPYKGFCYDCKK

SEQ ID NO: 2597676 - protein, 18 aa, Entamoeba histolytica
QCTSCISNLYYLNNDKMC

SEQ ID NO: 2597677 - protein, 23 aa, Entamoeba histolytica
QDEYYIWGTINYYKDILINGIDT

SEQ ID NO: 2597678 - protein, 25 aa, Entamoeba histolytica
QDFNTLQFYFFFEGENNTNFTVLLS

SEQ ID NO: 2597679 - protein, 24 aa, Entamoeba histolytica
QDFTWTYFILKIPTLIIFVSILIS

SEQ ID NO: 2597680 - protein, 23 aa, Entamoeba histolytica
QDKKRLVLLLKKQGEVVAVTGDG

SEQ ID NO: 2597681 - protein, 17 aa, Entamoeba histolytica
QDKLLWMSIIQHHKTWS

SEQ ID NO: 2597682 - protein, 25 aa, Entamoeba histolytica
QDKSQDSLPLPTPQDTQPSGTNPST

SEQ ID NO: 2597683 - protein, 19 aa, Entamoeba histolytica
QDLIPNELYYIVVSPTGGV

SEQ ID NO: 2597684 - protein, 23 aa, Entamoeba histolytica
QDLRLWLCSLVENSFYKVIIWVI

SEQ ID NO: 2597685 - protein, 22 aa, Entamoeba histolytica
QDNLIFILLVYVSGIIGDLIAS

SEQ ID NO: 2597686 - protein, 23 aa, Entamoeba histolytica
QDSNTIFDIKYSNSLWTKAGNSD

SEQ ID NO: 2597687 - protein, 26 aa, Entamoeba histolytica
QDVIDFLCYKGFRDILPVLMACFVGS

SEQ ID NO: 2597688 - protein, 23 aa, Entamoeba histolytica
QDYSYLRIKALCGFSPFVISSYT

SEQ ID NO: 2597689 - protein, 19 aa, Entamoeba histolytica
QEDAVIKAGLRKQKSDSQK

SEQ ID NO: 2597690 - protein, 32 aa, Entamoeba histolytica; identical to SEQ ID NO: 2400801

SEQ ID NO: 2597691 - protein, 25 aa, Entamoeba histolytica
QEIEQFYFIFKTYIPNTSILTELKV

SEQ ID NO: 2597692 - protein, 19 aa, Entamoeba histolytica
QEIFIFLEKYKNELLFISF

SEQ ID NO: 2597693 - protein, 26 aa, Entamoeba histolytica
QEKIFSAWGFIISYVVYKGGCVTIIP

SEQ ID NO: 2597694 - protein, 24 aa, Entamoeba histolytica
QEKKKFTIAGSYFQELKYSDEECK

SEQ ID NO: 2597695 - protein, 20 aa, Entamoeba histolytica
QEKLKVIFEYKMKMIEEVPK

SEQ ID NO: 2597696 - protein, 18 aa, Entamoeba histolytica
QENAVIKAGLRKQNSDSQ

SEQ ID NO: 2597697 - protein, 29 aa, Entamoeba histolytica
QENTYYFIRYFLVICIFFILACIGIICAV

SEQ ID NO: 2597698 - protein, 24 aa, Entamoeba histolytica
QENVEVIILPPLLVPNQEIAHDGR

SEQ ID NO: 2597699 - protein, 25 aa, Entamoeba histolytica
QEPTSYLNCKIPKQPNGKYNMGLLV

SEQ ID NO: 2597700 - protein, 24 aa, Entamoeba histolytica
QESESPILYLFLSLNEMSDVSLEI

SEQ ID NO: 2597701 - protein, 18 aa, Entamoeba histolytica
QESKFRVVVFTTLQGMFS

SEQ ID NO: 2597702 - protein, 17 aa, Entamoeba histolytica
QEVLIMLLNNLKVLDRQ

SEQ ID NO: 2597703 - protein, 23 aa, Entamoeba histolytica
QFAPFSVIVYLFFKKAYGLYTIK

SEQ ID NO: 2597704 - protein, 25 aa, Entamoeba histolytica
QFDSRLTYFWITHIGSRRFNNNNEN

SEQ ID NO: 2597705 - protein, 17 aa, Entamoeba histolytica
QFIFRFACRALKEKKVL

SEQ ID NO: 2597706 - protein, 38 aa, Entamoeba histolytica
QFKVKYYLKVVIGVSLFVSIFFLIMRTITIKKSYVCSK

SEQ ID NO: 2597707 - protein, 25 aa, Entamoeba histolytica
QFLMMLYCVIVFALMLITCFVRLGF

SEQ ID NO: 2597708 - protein, 25 aa, Entamoeba histolytica
QFNTQKPLPPPPAKPSLSLSSQQEF

SEQ ID NO: 2597709 - protein, 25 aa, Entamoeba histolytica
QFNYYFFFVTNILFFIVCLGQGLYY

SEQ ID NO: 2597710 - protein, 25 aa, Entamoeba histolytica
QFPSSLLIKRKLVLIAFQCLQSKVI

SEQ ID NO: 2597711 - protein, 20 aa, Entamoeba histolytica
QFQLLFFTNVILLGIFILFF

SEQ ID NO: 2597712 - protein, 18 aa, Entamoeba histolytica
QFSFLFFNGYSGTSLFEN

SEQ ID NO: 2597713 - protein, 26 aa, Entamoeba histolytica
QFVLSTVFFQLILCSIMAGFASWKYK

SEQ ID NO: 2597714 - protein, 20 aa, Entamoeba histolytica
QFWCCFIVLFYYYINQQPKL

SEQ ID NO: 2597715 - protein, 17 aa, Entamoeba histolytica
QFYPLRLVRDYIATLID

SEQ ID NO: 2597716 - protein, 22 aa, Entamoeba histolytica
QGCTLLSNNKLLRYCPTSNTED

SEQ ID NO: 2597717 - protein, 19 aa, Entamoeba histolytica
QGEIACSFILKGIQQKIYQ

SEQ ID NO: 2597718 - protein, 21 aa, Entamoeba histolytica
QGELLIGTWIDGVPVGPFEST

SEQ ID NO: 2597719 - protein, 30 aa, Entamoeba histolytica
QGFLQLFMAFYRIIMFSILLITITIQLFHG

SEQ ID NO: 2597720 - protein, 20 aa, Entamoeba histolytica
QGGIFKFPSTCNINKMGIDH

SEQ ID NO: 2597721 - protein, 21 aa, Entamoeba histolytica
QGILIAILSSYGYSFDLKRPE

SEQ ID NO: 2597722 - protein, 26 aa, Entamoeba histolytica
QGKMMKLLEIPLSCEVTPFAKMFEGE

SEQ ID NO: 2597723 - protein, 25 aa, Entamoeba histolytica
QGNPKLLNAYIYGLGVVLLLGVEVV

SEQ ID NO: 2597724 - protein, 35 aa, Entamoeba histolytica
QGQYGLSWQGWVLSLLLSCMTLVIGQISFFIPVPT

SEQ ID NO: 2597725 - protein, 26 aa, Entamoeba histolytica
QGSVLFYSWCFDIVVVIVHAKMKIIE

SEQ ID NO: 2597726 - protein, 27 aa, Entamoeba histolytica
QGTLKRGIFFILLTVVFQLISCFTQEF

SEQ ID NO: 2597727 - protein, 23 aa, Entamoeba histolytica
QGVIWFFVLFIAAFPFYLTCIAF

SEQ ID NO: 2597728 - protein, 21 aa, Entamoeba histolytica
QHELITLIFIFINECIEDKKC

SEQ ID NO: 2597729 - protein, 24 aa, Entamoeba histolytica
QHFSEIYLTLEYKGIQNFLMTNIA

SEQ ID NO: 2597730 - protein, 29 aa, Entamoeba histolytica
QHIDSFIDYYFEILPLFKEIPKPIQRLIN

SEQ ID NO: 2597731 - protein, 32 aa, Entamoeba histolytica
QHKPITLVIKRILFIKGCIVSCLFPIFNNIID

SEQ ID NO: 2597732 - protein, 18 aa, Entamoeba histolytica
QHLESDVFPLIQFPELSV

SEQ ID NO: 2597733 - protein, 23 aa, Entamoeba histolytica
QHPIYYPEYLGIFTFVNNDLRVA

SEQ ID NO: 2597734 - protein, 18 aa, Entamoeba histolytica
QHVYIPVLPLSLLKYCAA

SEQ ID NO: 2597735 - protein, 18 aa, Entamoeba histolytica
QIDLFKEGFYSIIPFEMI

SEQ ID NO: 2597736 - protein, 26 aa, Entamoeba histolytica
QIDNDLFVLLIKTLFDEFKRIKDFPK

SEQ ID NO: 2597737 - protein, 27 aa, Entamoeba histolytica
QIENNPFKELLPLKIRTSFSNYIIKAK

SEQ ID NO: 2597738 - protein, 18 aa, Entamoeba histolytica
QIEQITFIVLPLEIDDSL

SEQ ID NO: 2597739 - protein, 21 aa, Entamoeba histolytica
QIFSFIISHTPVVFPSAKRCF

SEQ ID NO: 2597740 - protein, 21 aa, Entamoeba histolytica
QIFWYIVYYGMIVFAAIILPF

SEQ ID NO: 2597741 - protein, 25 aa, Entamoeba histolytica
QIGLSQILFRFLKNDKLLQSLTTTY

SEQ ID NO: 2597742 - protein, 33 aa, Entamoeba histolytica
QIHQHAPMCLIWTALILIQLLTGYVILKTNVGV

SEQ ID NO: 2597743 - protein, 18 aa, Entamoeba histolytica
QIICLARALLKKSKILIM

SEQ ID NO: 2597744 - protein, 17 aa, Entamoeba histolytica
QIIFIGICNGSLIRLKE

SEQ ID NO: 2597745 - protein, 24 aa, Entamoeba histolytica
QIIIVQFLGILFDGVPFNPSQGQY

SEQ ID NO: 2597746 - protein, 18 aa, Entamoeba histolytica
QIIKLLLQILKDNNKPTS

SEQ ID NO: 2597747 - protein, 25 aa, Entamoeba histolytica
QIISPIFIVILMIFTGFFIQKDNII

SEQ ID NO: 2597748 - protein, 23 aa, Entamoeba histolytica
QILDRIIYYLLPTTRQEYVFPSA

SEQ ID NO: 2597749 - protein, 18 aa, Entamoeba histolytica
QILPLLMSITLEQQERHI

SEQ ID NO: 2597750 - protein, 17 aa, Entamoeba histolytica
QILRMKLSYYTKDLYRM

SEQ ID NO: 2597751 - protein, 18 aa, Entamoeba histolytica
QILSCDGKMLFTSKLSDE

SEQ ID NO: 2597752 - protein, 27 aa, Entamoeba histolytica
QILTFTLMYILLLFNNPLALIEYQAHH

SEQ ID NO: 2597753 - protein, 27 aa, Entamoeba histolytica
QINETTFILILSLITVVLGLIVVVMIV

SEQ ID NO: 2597754 - protein, 23 aa, Entamoeba histolytica
QIQSIFIMIKPILIEALTDVGHD

SEQ ID NO: 2597755 - protein, 21 aa, Entamoeba histolytica
QITFPTFENVVIVATKIISKI

SEQ ID NO: 2597756 - protein, 23 aa, Entamoeba histolytica
QITLFTSELFRKIKLVEFFKSTS

SEQ ID NO: 2597757 - protein, 36 aa, Entamoeba histolytica
QITTLIKFCFYKNAAFFLMDIWFATISNFTCQIIYD

SEQ ID NO: 2597758 - protein, 20 aa, Entamoeba histolytica
QIVSFFDSILFLFGQHQHFT

SEQ ID NO: 2597759 - protein, 22 aa, Entamoeba histolytica
QIYPGDILVLPNNSRIPADGIP

SEQ ID NO: 2597760 - protein, 18 aa, Entamoeba histolytica
QIYRLKLMWCEIEPFTCF

SEQ ID NO: 2597761 - protein, 20 aa, Entamoeba histolytica
QIYTKKYKGWGLLQNNNFCF

SEQ ID NO: 2597762 - protein, 24 aa, Entamoeba histolytica
QKDLLEIICYILPNINELSIRDYL

SEQ ID NO: 2597763 - protein, 32 aa, Entamoeba histolytica
QKELFYLITQCNGLIYLLIYFSEKEFQEIPEE

SEQ ID NO: 2597764 - protein, 23 aa, Entamoeba histolytica
QKGILFHIMRVLKILVSGLCLII

SEQ ID NO: 2597765 - protein, 20 aa, Entamoeba histolytica
QKKIPFLRKKPEQPRTIIIP

SEQ ID NO: 2597766 - protein, 34 aa, Entamoeba histolytica
QKLITAFIISLFLFFFLIFFITFISVMGNMFFLM

SEQ ID NO: 2597767 - protein, 30 aa, Entamoeba histolytica
QKNDFELLFSFINFILPFAPHQISLSFFVW

SEQ ID NO: 2597768 - protein, 23 aa, Entamoeba histolytica
QKNIDGTSCVFVILSILIIFLLI

SEQ ID NO: 2597769 - protein, 23 aa, Entamoeba histolytica
QKNVDGTLCVYVILSILITVLFF

SEQ ID NO: 2597770 - protein, 22 aa, Entamoeba histolytica
QKSRRPTYVLKKLKQAGVSSES

SEQ ID NO: 2597771 - protein, 21 aa, Entamoeba histolytica
QKSTWVNQLVIFEKNKNTFKD

SEQ ID NO: 2597772 - protein, 22 aa, Entamoeba histolytica
QKYRGFFDVIHFDITWDDRSYL

SEQ ID NO: 2597773 - protein, 28 aa, Entamoeba histolytica
QLEIDQHFNGLLKVSLLSAQSLIDGNKE

SEQ ID NO: 2597774 - protein, 18 aa, Entamoeba histolytica
QLFIYRPTVKLFGPLWTN

SEQ ID NO: 2597775 - protein, 28 aa, Entamoeba histolytica
QLGGFEFYKRLYKYWNWSLESVPTNGIT

SEQ ID NO: 2597776 - protein, 27 aa, Entamoeba histolytica
QLGPSKNIYLIPFLKSFLNFEPTQPPI

SEQ ID NO: 2597777 - protein, 26 aa, Entamoeba histolytica
QLGSKELFIFLINLKIPLSMKVYEKL

SEQ ID NO: 2597778 - protein, 24 aa, Entamoeba histolytica
QLIGLFLALLINKRIILTSKCTTT

SEQ ID NO: 2597779 - protein, 24 aa, Entamoeba histolytica
QLIPFNSTFIFPISLALESISVRN

SEQ ID NO: 2597780 - protein, 25 aa, Entamoeba histolytica
QLIVILLISIISFSGTLYWSHGLST

SEQ ID NO: 2597781 - protein, 17 aa, Entamoeba histolytica
QLKSITINLFRLNEFYT

SEQ ID NO: 2597782 - protein, 25 aa, Entamoeba histolytica
QLLIIKCITLLKRIDLISATITIND

SEQ ID NO: 2597783 - protein, 25 aa, Entamoeba histolytica
QLNDKIVDLYIKLGKYLPECETLPE

SEQ ID NO: 2597784 - protein, 19 aa, Entamoeba histolytica
QLNLWKNYLMYFPANMEID

SEQ ID NO: 2597785 - protein, 24 aa, Entamoeba histolytica
QLPDTYSDYYFKSGTITNIVGGLS

SEQ ID NO: 2597786 - protein, 17 aa, Entamoeba histolytica
QLPIECIALIPKEPNHP

SEQ ID NO: 2597787 - protein, 21 aa, Entamoeba histolytica
QLPLIMPIHHICNTTLMLLLR

SEQ ID NO: 2597788 - protein, 30 aa, Entamoeba histolytica
QLPVQCSHLRFPNLHSFPAIILKYEQPEDT

SEQ ID NO: 2597789 - protein, 24 aa, Entamoeba histolytica
QLPYRFVYLLEYIGPLVLYFIPFF

SEQ ID NO: 2597790 - protein, 31 aa, Entamoeba histolytica
QLQQRHTLMFIILRQYFQLILNPDKTISTMA

SEQ ID NO: 2597791 - protein, 28 aa, Entamoeba histolytica
QLQQRHTLMFIILRQYFQLILTHDKTIS

SEQ ID NO: 2597792 - protein, 20 aa, Entamoeba histolytica
QLQYSTYFYILLDTKHYINF

SEQ ID NO: 2597793 - protein, 20 aa, Entamoeba histolytica
QLREILFSCFKRDPNQRASS

SEQ ID NO: 2597794 - protein, 18 aa, Entamoeba histolytica
QLRQNCVVELIGAVYTEG

SEQ ID NO: 2597795 - protein, 26 aa, Entamoeba histolytica
QLSGSSVFFFFKNEASIILGTSKGQT

SEQ ID NO: 2597796 - protein, 18 aa, Entamoeba histolytica
QLSIGFIMEVPTNGFRCI

SEQ ID NO: 2597797 - protein, 26 aa, Entamoeba histolytica
QLSILCFFLSLILFSLVIIFVVIGIN

SEQ ID NO: 2597798 - protein, 23 aa, Entamoeba histolytica
QLTRLPIFRFLRNSNELFMQMLS

SEQ ID NO: 2597799 - protein, 34 aa, Entamoeba histolytica
QLVAFFILGFFKAWQFKITLNIISLLISMICLTG

SEQ ID NO: 2597800 - protein, 30 aa, Entamoeba histolytica
QLVFIPLYIFLFIAFLFPVFTFIFFCSLCL

SEQ ID NO: 2597801 - protein, 22 aa, Entamoeba histolytica
QLVLQFVDLLPNSLPILLHCSS

SEQ ID NO: 2597802 - protein, 19 aa, Entamoeba histolytica
QLVLYWHRENSLSTYIFMF

SEQ ID NO: 2597803 - protein, 21 aa, Entamoeba histolytica
QLYFTNFIFNDPSFLKTENTT

SEQ ID NO: 2597804 - protein, 24 aa, Entamoeba histolytica
QMAILMFYKNYISSYLWDESKNYR

SEQ ID NO: 2597805 - protein, 28 aa, Entamoeba histolytica
QMASGLSIFGWLLAAVFIIAAAVTYPMD

SEQ ID NO: 2597806 - protein, 19 aa, Entamoeba histolytica
QMFFNLFPKHYALNHLNYL

SEQ ID NO: 2597807 - protein, 19 aa, Entamoeba histolytica
QMIDLRYDLSFMSKVLVAI

SEQ ID NO: 2597808 - protein, 17 aa, Entamoeba histolytica
QMILKTNNIFFYEDKYG

SEQ ID NO: 2597809 - protein, 20 aa, Entamoeba histolytica
QMIVTAVGLNSLWGKTKESL

SEQ ID NO: 2597810 - protein, 27 aa, Entamoeba histolytica
QMIYRRGHWLFIDFNKINTITKVIMFN

SEQ ID NO: 2597811 - protein, 24 aa, Entamoeba histolytica
QMKEKIIPQLLLKDILKKYDGKTD

SEQ ID NO: 2597812 - protein, 24 aa, Entamoeba histolytica
QMKKMDTFGINILLLCWKKMIRLI

SEQ ID NO: 2597813 - protein, 26 aa, Entamoeba histolytica
QMLDLFNYFGLRTGLMYIHCFMRRDF

SEQ ID NO: 2597814 - protein, 38 aa, Entamoeba histolytica
QMLIKIAIQVTYQLGILLTILFFGSTFKFISAPCGYIS

SEQ ID NO: 2597815 - protein, 25 aa, Entamoeba histolytica
QMLQHPLSFLPLLVLGLTEAKVAIE

SEQ ID NO: 2597816 - protein, 17 aa, Entamoeba histolytica
QMTYYVFLISDTEIQVD

SEQ ID NO: 2597817 - protein, 24 aa, Entamoeba histolytica
QNELKLQRMLNKKAKEFAVQRNEL

SEQ ID NO: 2597818 - protein, 17 aa, Entamoeba histolytica
QNGILHRDIKPDNFLVV

SEQ ID NO: 2597819 - protein, 23 aa, Entamoeba histolytica
QNGLFEHKVFFTPKVIGEHLIIV

SEQ ID NO: 2597820 - protein, 36 aa, Entamoeba histolytica
QNHFLSIVIVILIGCTFLLGIAYFLTRNHHQAQYIP

SEQ ID NO: 2597821 - protein, 24 aa, Entamoeba histolytica
QNHINPYWFHYLMDIGTSTIPEAI

SEQ ID NO: 2597822 - protein, 31 aa, Entamoeba histolytica
QNIILVFVALFVCKEWYLDSLLNPSQSTIKQ

SEQ ID NO: 2597823 - protein, 29 aa, Entamoeba histolytica
QNILFSGIGLYLPPSPFTSSLLKAQDSAS

SEQ ID NO: 2597824 - protein, 28 aa, Entamoeba histolytica
QNILFSGIGLYLPPSPFTSSLLKAQNSA

SEQ ID NO: 2597825 - protein, 34 aa, Entamoeba histolytica
QNIQSTPTFIYIIAFLLQILTGYFIYIIISKRKI

SEQ ID NO: 2597826 - protein, 28 aa, Entamoeba histolytica
QNKLHGGWKYLFIVLSRFEQMNLIEHPT

SEQ ID NO: 2597827 - protein, 29 aa, Entamoeba histolytica
QNKSILWLSLCMLFIPLISAFVRQRNIYL

SEQ ID NO: 2597828 - protein, 25 aa, Entamoeba histolytica
QNLALYLWFGIMTLNIIISLIFVPF

SEQ ID NO: 2597829 - protein, 26 aa, Entamoeba histolytica
QNLETLFRVVSLLIGWLILHVLGDFT

SEQ ID NO: 2597830 - protein, 19 aa, Entamoeba histolytica
QNLILIYDPSFIFYVSSSD

SEQ ID NO: 2597831 - protein, 23 aa, Entamoeba histolytica
QNNERNIKFFKSPSSSLFSNKKQ

SEQ ID NO: 2597832 - protein, 24 aa, Entamoeba histolytica
QNNERNIKFFKSPSSSLFSNTKIT

SEQ ID NO: 2597833 - protein, 23 aa, Entamoeba histolytica
QNNYPIQQPYYRQPSQGYPPQQI

SEQ ID NO: 2597834 - protein, 22 aa, Entamoeba histolytica
QNQHPFNEHQLLSDQTPEKQYH

SEQ ID NO: 2597835 - protein, 17 aa, Entamoeba histolytica
QNQLLVEILLDKLIDTI

SEQ ID NO: 2597836 - protein, 29 aa, Entamoeba histolytica
QNRMIMLFISLILILLEHLLQLPLIIISS

SEQ ID NO: 2597837 - protein, 47 aa, Entamoeba histolytica
QNVGQWLYKNLFFTVGIIIFLIFLVLLFGFIITKRIIYRRAKQVARN

SEQ ID NO: 2597838 - protein, 22 aa, Entamoeba histolytica
QNVKLIITQPMTITALPKKISE

SEQ ID NO: 2597839 - protein, 27 aa, Entamoeba histolytica
QNVMSVFIPLFFQVLFESFNQYNEENE

SEQ ID NO: 2597840 - protein, 26 aa, Entamoeba histolytica
QPFEQYGFFLVYIIGLLYSGYGFYIV

SEQ ID NO: 2597841 - protein, 21 aa, Entamoeba histolytica
QPFLIAKPINIFIPRPLDIQK

SEQ ID NO: 2597842 - protein, 28 aa, Entamoeba histolytica
QPFMADIIHIVITFIIRGISQSSSVAVL

SEQ ID NO: 2597843 - protein, 17 aa, Entamoeba histolytica
QPGVFIYYDVSPMVLEV

SEQ ID NO: 2597844 - protein, 18 aa, Entamoeba histolytica
QPLLIYQKVSQTHLNWIN

SEQ ID NO: 2597845 - protein, 17 aa, Entamoeba histolytica
QPLLLLTVDFHELIQHQ

SEQ ID NO: 2597846 - protein, 29 aa, Entamoeba histolytica
QPPPAPQPNPFLPFFPGGVGGNIATFAIG

SEQ ID NO: 2597847 - protein, 20 aa, Entamoeba histolytica
QPQPGTWFFLKGADETIMVS

SEQ ID NO: 2597848 - protein, 22 aa, Entamoeba histolytica
QPSIEVFPKMKLMKHPRKPTEI

SEQ ID NO: 2597849 - protein, 18 aa, Entamoeba histolytica
QPSLVILDGGYACEFEIF

SEQ ID NO: 2597850 - protein, 50 aa, Entamoeba histolytica
QPSNDGMYCQRSPVWWVIILVILVILSITIIILIIIGWCSRTYYRYKIQK

SEQ ID NO: 2597851 - protein, 19 aa, Entamoeba histolytica
QPTLLTSALLFDYLCEHPK

SEQ ID NO: 2597852 - protein, 21 aa, Entamoeba histolytica
QPTSLLLSLNLYETYFRKISD

SEQ ID NO: 2597853 - protein, 30 aa, Entamoeba histolytica
QPYKNQLIHSFPLLMKLMLQLFNNEISNVE

SEQ ID NO: 2597854 - protein, 23 aa, Entamoeba histolytica
QPYVNWFLAFLGGLAGGFAYQTS

SEQ ID NO: 2597855 - protein, 22 aa, Entamoeba histolytica
QPYYHLCYYFIHNQSLPSYTSL

SEQ ID NO: 2597856 - protein, 32 aa, Entamoeba histolytica
QQAYSWSSYLFVLQAILILGMSLVQTYFIKKY

SEQ ID NO: 2597857 - protein, 42 aa, Entamoeba histolytica
QQEMKSCVPLYRPLTVILFFLITGIIFIPIGIAVFVVTNNCQ

SEQ ID NO: 2597858 - protein, 35 aa, Entamoeba histolytica
QQFDFTFMLGPLKITLPLVIITLLSTLSTILLFPE

SEQ ID NO: 2597859 - protein, 21 aa, Entamoeba histolytica
QQFYRIAEISTLMLMDISLIS

SEQ ID NO: 2597860 - protein, 39 aa, Entamoeba histolytica
QQHTLVNTIIWIMGIALAGLISHYFYIGLFLSSGEHLIG

SEQ ID NO: 2597861 - protein, 48 aa, Entamoeba histolytica
QQKSMACIWFLIMGSLIITILLFCTIEIGWYIYIFIHQKVSFSSFIFS

SEQ ID NO: 2597862 - protein, 21 aa, Entamoeba histolytica
QQLPPELLVNVKLFEISYIQK

SEQ ID NO: 2597863 - protein, 24 aa, Entamoeba histolytica
QQNEEIVPILYKNNGPHANDPKYK

SEQ ID NO: 2597864 - protein, 17 aa, Entamoeba histolytica
QQQILSCDGKMLFTSKL

SEQ ID NO: 2597865 - protein, 23 aa, Entamoeba histolytica
QQQKDLLIPIAQKLIEFHIEHNA

SEQ ID NO: 2597866 - protein, 22 aa, Entamoeba histolytica
QQRRSKWTSIIPIINSFPLGDW

SEQ ID NO: 2597867 - protein, 32 aa, Entamoeba histolytica
QQRRSKWTSIIPIINSFPLGGWYSNPNIIKYG

SEQ ID NO: 2597868 - protein, 21 aa, Entamoeba histolytica
QQRVSLLRCFLASLPEPLIPE

SEQ ID NO: 2597869 - protein, 25 aa, Entamoeba histolytica
QQSQLKWYFSIFTKILEKVSECIIS

SEQ ID NO: 2597870 - protein, 25 aa, Entamoeba histolytica
QQSYSLYHPRCLLQLLFAGSFKQVE

SEQ ID NO: 2597871 - protein, 24 aa, Entamoeba histolytica
QQTCIECPQLYWSNSNSISCTACD

SEQ ID NO: 2597872 - protein, 21 aa, Entamoeba histolytica
QQTFGYFLPVTKNSKTNVLEF

SEQ ID NO: 2597873 - protein, 26 aa, Entamoeba histolytica
QQTQPFVIILLVYLFISFGSHIFKDI

SEQ ID NO: 2597874 - protein, 27 aa, Entamoeba histolytica
QRDTLLNILWDCYPKFNTNSTLLSMIS

SEQ ID NO: 2597875 - protein, 29 aa, Entamoeba histolytica
QREGIKPRRLYFKSLLRQDAILYDFQESG

SEQ ID NO: 2597876 - protein, 26 aa, Entamoeba histolytica
QRELLKKKLTYLIKKRFYAKTIIDKE

SEQ ID NO: 2597877 - protein, 26 aa, Entamoeba histolytica
QRIAEKLHHFFPIQKIWNENGVIIFD

SEQ ID NO: 2597878 - protein, 26 aa, Entamoeba histolytica
QRIRRPVVLPLLVSLFIELLSSFMLP

SEQ ID NO: 2597879 - protein, 27 aa, Entamoeba histolytica
QRISIVFPLIIILQLTLIQSSWNNNPC

SEQ ID NO: 2597880 - protein, 22 aa, Entamoeba histolytica
QRITEFPYFTPMLNVNEFTQTK

SEQ ID NO: 2597881 - protein, 28 aa, Entamoeba histolytica
QRIVYVFNWPLLVILAYTIPDVKIKTCA

SEQ ID NO: 2597882 - protein, 24 aa, Entamoeba histolytica
QRKINLMLLIFMGQLEKQLQKNIL

SEQ ID NO: 2597883 - protein, 23 aa, Entamoeba histolytica
QRKKSWLCIFPGCKEPVKTHYNC

SEQ ID NO: 2597884 - protein, 20 aa, Entamoeba histolytica
QRLEIFNNPYFSFSDSIISF

SEQ ID NO: 2597885 - protein, 26 aa, Entamoeba histolytica
QRLTRIWVFFIFPVVVNAYRCNPTIQ

SEQ ID NO: 2597886 - protein, 17 aa, Entamoeba histolytica
QRPFVCMIAGTFKTKPN

SEQ ID NO: 2597887 - protein, 24 aa, Entamoeba histolytica
QRRSKWISKIPIINSFPLGDWYSN

SEQ ID NO: 2597888 - protein, 20 aa, Entamoeba histolytica
QRRSKWTSIIPIINSFPLGD

SEQ ID NO: 2597889 - protein, 21 aa, Entamoeba histolytica
QRRSKWTSIIPIINSFPLGGW

SEQ ID NO: 2597890 - protein, 25 aa, Entamoeba histolytica
QRSERYFERFIGWVQLICVIQNIDY

SEQ ID NO: 2597891 - protein, 19 aa, Entamoeba histolytica
QRSLPLCCLKKGLISPIDI

SEQ ID NO: 2597892 - protein, 33 aa, Entamoeba histolytica
QRSVKKTLFYIIIATVVFIPICVSFNIATRPHS

SEQ ID NO: 2597893 - protein, 31 aa, Entamoeba histolytica; identical to SEQ ID NO: 2400999

SEQ ID NO: 2597894 - protein, 40 aa, Entamoeba histolytica
QRYTHLKHFYLSLPALLLTYIDFIIAAKERLLRNSTNLDV

SEQ ID NO: 2597895 - protein, 20 aa, Entamoeba histolytica
QSFFEIWQDALGDQTLLILI

SEQ ID NO: 2597896 - protein, 24 aa, Entamoeba histolytica
QSIAEMFFCVVLYLVEQEKMPTAI

SEQ ID NO: 2597897 - protein, 31 aa, Entamoeba histolytica
QSIITFICNLFIFVFIIFTVKMYYLMMYGFQ

SEQ ID NO: 2597898 - protein, 26 aa, Entamoeba histolytica
QSIKKYQYYLYKTSTNQIWVILGDHI

SEQ ID NO: 2597899 - protein, 18 aa, Entamoeba histolytica
QSILMAFRVIFTTALTLA

SEQ ID NO: 2597900 - protein, 54 aa, Entamoeba histolytica
QSKRPSLFLVIFKLEWKMFLLCYITMVIYELIALAFPLMLQYVIKWINNPQGTL

SEQ ID NO: 2597901 - protein, 36 aa, Entamoeba histolytica
QSKWFQFTLTFFLFGFCFIFFWLASFVISRKSSQPF

SEQ ID NO: 2597902 - protein, 20 aa, Entamoeba histolytica
QSLGFLFATLIDHLKPMYSN

SEQ ID NO: 2597903 - protein, 21 aa, Entamoeba histolytica
QSLLTKCPLLVNSITAIPEAT

SEQ ID NO: 2597904 - protein, 21 aa, Entamoeba histolytica
QSLRKCFIIYSFIVSYRSTQL

SEQ ID NO: 2597905 - protein, 29 aa, Entamoeba histolytica
QSNQSFWFVVIIIFLLTVILFLIASILLH

SEQ ID NO: 2597906 - protein, 26 aa, Entamoeba histolytica
QSNTLKCIMTQYPSFWYSIQLSESLD

SEQ ID NO: 2597907 - protein, 27 aa, Entamoeba histolytica
QSPQLFHPRFIMIACFCFGKKLEEFRF

SEQ ID NO: 2597908 - protein, 20 aa, Entamoeba histolytica
QSPVIQWFWEIFNEMEQRQK

SEQ ID NO: 2597909 - protein, 24 aa, Entamoeba histolytica
QSQLKTLLLRSEDKVRWSLICCLC

SEQ ID NO: 2597910 - protein, 29 aa, Entamoeba histolytica
QSRIQELLILCLYLLLSNIVICINCKSGC

SEQ ID NO: 2597911 - protein, 28 aa, Entamoeba histolytica
QSSHIFWISFCCCWILFNIKVFEELIYS

SEQ ID NO: 2597912 - protein, 42 aa, Entamoeba histolytica
QSVLSNYFINPIVILLCCFLIGTIILFFIKSRRKQNEVELED

SEQ ID NO: 2597913 - protein, 31 aa, Entamoeba histolytica
QTALQVLGFLLLTFGLFIYTGVIKLNFFGTE

SEQ ID NO: 2597914 - protein, 29 aa, Entamoeba histolytica
QTDDRKWALWFGLILQCVGIVLCIITQAI

SEQ ID NO: 2597915 - protein, 30 aa, Entamoeba histolytica
QTDDRKWALWFGLILQCVGIVLCIITQAIT

SEQ ID NO: 2597916 - protein, 17 aa, Entamoeba histolytica
QTEMMFIGMFGCLFVFE

SEQ ID NO: 2597917 - protein, 23 aa, Entamoeba histolytica
QTHQLLQQLILSFKLGLAPISNQ

SEQ ID NO: 2597918 - protein, 18 aa, Entamoeba histolytica
QTIFSKKKLCFPDNGRWL

SEQ ID NO: 2597919 - protein, 20 aa, Entamoeba histolytica
QTIINFLLPEVVSFKIISQL

SEQ ID NO: 2597920 - protein, 26 aa, Entamoeba histolytica
QTIIVQFLGILFDGVPFIPSQGQYGL

SEQ ID NO: 2597921 - protein, 17 aa, Entamoeba histolytica
QTIPLTFTVLYGGLLTS

SEQ ID NO: 2597922 - protein, 20 aa, Entamoeba histolytica
QTIQFIRWLRKSYVTGIVIV

SEQ ID NO: 2597923 - protein, 20 aa, Entamoeba histolytica
QTIVLQINPLIQLLLHSFKS

SEQ ID NO: 2597924 - protein, 38 aa, Entamoeba histolytica
QTKKKYLLFNIAGVIICIILSILFSISFLVITNKRIEK

SEQ ID NO: 2597925 - protein, 29 aa, Entamoeba histolytica
QTLFRYTIALILIRFFISLITVVIVILAL

SEQ ID NO: 2597926 - protein, 17 aa, Entamoeba histolytica
QTLLILIASAVVSLILA

SEQ ID NO: 2597927 - protein, 24 aa, Entamoeba histolytica
QTLLTIIRIFRYSSFYISFMVNKR

SEQ ID NO: 2597928 - protein, 17 aa, Entamoeba histolytica
QTLSVLLIVAIIVGLIV

SEQ ID NO: 2597929 - protein, 24 aa, Entamoeba histolytica
QTLVFNIFVFCQVFNEFNSRKVNG

SEQ ID NO: 2597930 - protein, 22 aa, Entamoeba histolytica
QTLVFNTFVFCQVFNMFNSRKV

SEQ ID NO: 2597931 - protein, 25 aa, Entamoeba histolytica
QTLYISIIYQLLNSLSWKYITQLLN

SEQ ID NO: 2597932 - protein, 27 aa, Entamoeba histolytica
QTMIKMICKIFPISDFWEHVCIVWTKC

SEQ ID NO: 2597933 - protein, 19 aa, Entamoeba histolytica
QTNHLIFVLKNVRISKLKS

SEQ ID NO: 2597934 - protein, 21 aa, Entamoeba histolytica
QTNHLIFVLKNVRISKLKSNQ

SEQ ID NO: 2597935 - protein, 30 aa, Entamoeba histolytica
QTNPRLIKLFLSFFLINSTRFAYLAKVDGF

SEQ ID NO: 2597936 - protein, 22 aa, Entamoeba histolytica
QTPKLLFFTCVALYASFVASLF

SEQ ID NO: 2597937 - protein, 21 aa, Entamoeba histolytica
QTQLPFGRDPQQAFCPRCNMT

SEQ ID NO: 2597938 - protein, 25 aa, Entamoeba histolytica
QTRGWFYSLIVISTALFGKAPFKNC

SEQ ID NO: 2597939 - protein, 29 aa, Entamoeba histolytica
QTSHTVFIIYYYLEVLPLIKLKIFMLETS

SEQ ID NO: 2597940 - protein, 17 aa, Entamoeba histolytica
QTTFNLYIRRIHHPCSY

SEQ ID NO: 2597941 - protein, 23 aa, Entamoeba histolytica
QTTYIYFTLSGIVSYYFILQNQI

SEQ ID NO: 2597942 - protein, 23 aa, Entamoeba histolytica
QTWDCLHFLLFITTMICLLSKKG

SEQ ID NO: 2597943 - protein, 28 aa, Entamoeba histolytica
QTYFCFHLIALVLFIWLTVAPPKIPKEE

SEQ ID NO: 2597944 - protein, 19 aa, Entamoeba histolytica
QTYPILPTIVCETTIIEFN

SEQ ID NO: 2597945 - protein, 17 aa, Entamoeba histolytica
QVCGKLIGWELPYHLFP

SEQ ID NO: 2597946 - protein, 29 aa, Entamoeba histolytica
QVCKMRGYDQYEQYLNAFKASDNTYYCPL

SEQ ID NO: 2597947 - protein, 30 aa, Entamoeba histolytica
QVCKMRGYDQYEQYLNAFKASDNTYYCPLK

SEQ ID NO: 2597948 - protein, 24 aa, Entamoeba histolytica
QVFPINYPLFKETILLYLGYIKGI

SEQ ID NO: 2597949 - protein, 31 aa, Entamoeba histolytica
QVIKTINDVFFKIKDIWKHVCIVWNKCYNYT

SEQ ID NO: 2597950 - protein, 24 aa, Entamoeba histolytica
QVRFVDRGLLLKSKVPASKPLCYK

SEQ ID NO: 2597951 - protein, 40 aa, Entamoeba histolytica
QVTYFITIVAIPLLHHIMLLILWVVPITRKIQNIIFQFCE

SEQ ID NO: 2597952 - protein, 20 aa, Entamoeba histolytica
QVVLLRPRGFKTITCFMTLF

SEQ ID NO: 2597953 - protein, 23 aa, Entamoeba histolytica
QWETIMIPTIPRRSSIQFSYHNL

SEQ ID NO: 2597954 - protein, 22 aa, Entamoeba histolytica
QWFAHQMCCFLLPYYDCSSNII

SEQ ID NO: 2597955 - protein, 18 aa, Entamoeba histolytica
QWYIVTRLLHLPSPPLYI

SEQ ID NO: 2597956 - protein, 27 aa, Entamoeba histolytica
QYCKPKYLLVPLILMFGLCFLYVSMLT

SEQ ID NO: 2597957 - protein, 21 aa, Entamoeba histolytica
QYGAFHFYAQYPASLQQYSSF

SEQ ID NO: 2597958 - protein, 25 aa, Entamoeba histolytica
QYGLLVLFAFWFFHGIVDSLIGSSL

SEQ ID NO: 2597959 - protein, 24 aa, Entamoeba histolytica
QYGLSWQGWVLSIASTILTIVVGQ

SEQ ID NO: 2597960 - protein, 18 aa, Entamoeba histolytica
QYIPKNITGFAPNAKGQC

SEQ ID NO: 2597961 - protein, 20 aa, Entamoeba histolytica
QYIPQWHLYHLTNLTFLDIS

SEQ ID NO: 2597962 - protein, 26 aa, Entamoeba histolytica
QYKGLLLLIFFVCLFLIMGTGSTIIS

SEQ ID NO: 2597963 - protein, 41 aa, Entamoeba histolytica
QYKIKSFVEWYLYGGLQSILFFVIFYFIIAPSDVTSFDGKV

SEQ ID NO: 2597964 - protein, 17 aa, Entamoeba histolytica
QYKQKYRFGKWFKINLN

SEQ ID NO: 2597965 - protein, 22 aa, Entamoeba histolytica
QYLYANLSYYYNVGNQSNIVIK

SEQ ID NO: 2597966 - protein, 21 aa, Entamoeba histolytica
QYSPFILKLFEFKNIDIIKIL

SEQ ID NO: 2597967 - protein, 20 aa, Entamoeba histolytica
QYTSQFIISLPPSSLRLDAE

SEQ ID NO: 2597968 - protein, 17 aa, Entamoeba histolytica
RAALFVVVVFIGALIML

SEQ ID NO: 2597969 - protein, 21 aa, Entamoeba histolytica
RAFNEFLMYWSDSLYTIEDLI

SEQ ID NO: 2597970 - protein, 19 aa, Entamoeba histolytica
RAIFTCVPLYALVFGYICG

SEQ ID NO: 2597971 - protein, 33 aa, Entamoeba histolytica
RAKILQFLVLAKKSFLRFILKSKSKMVSKNLKI

SEQ ID NO: 2597972 - protein, 21 aa, Entamoeba histolytica
RAKYYRVEIPKGKKIRVNTCN

SEQ ID NO: 2597973 - protein, 20 aa, Entamoeba histolytica
RAVFMLVFVVFFTLNIRSEF

SEQ ID NO: 2597974 - protein, 29 aa, Entamoeba histolytica
RAYSCASRKWLIIGIVVGILVVVVIIAII

SEQ ID NO: 2597975 - protein, 39 aa, Entamoeba histolytica
RCGQKIPYQIFFRDVVNQRLPIFSNLTIIESLRSDHKFG

SEQ ID NO: 2597976 - protein, 19 aa, Entamoeba histolytica
RCILFFTGNPSLLAFYIDF

SEQ ID NO: 2597977 - protein, 25 aa, Entamoeba histolytica
RCKIERLPIILPLVQEDVLSMQIDD

SEQ ID NO: 2597978 - protein, 17 aa, Entamoeba histolytica
RCPYIINFIGSVTSSDT

SEQ ID NO: 2597979 - protein, 32 aa, Entamoeba histolytica
RCQNLISLCRTTLMHWTQFKDLPTSNIILFEI

SEQ ID NO: 2597980 - protein, 20 aa, Entamoeba histolytica
RCTTFVMQWWSNALINNEKA

SEQ ID NO: 2597981 - protein, 17 aa, Entamoeba histolytica
RCVLRGLEYLKEIWTEN

SEQ ID NO: 2597982 - protein, 22 aa, Entamoeba histolytica
RCYKIIIRPDLFLKIPSVINND

SEQ ID NO: 2597983 - protein, 24 aa, Entamoeba histolytica
RDANLFFAEFIRDLAIMWRHDEMA

SEQ ID NO: 2597984 - protein, 18 aa, Entamoeba histolytica
RDCTGCQPGYMWFGEGNC

SEQ ID NO: 2597985 - protein, 19 aa, Entamoeba histolytica
RDIFRRYPNRYEKVIGTLC

SEQ ID NO: 2597986 - protein, 17 aa, Entamoeba histolytica
RDIKPDNLLIFSLDQDI

SEQ ID NO: 2597987 - protein, 19 aa, Entamoeba histolytica
RDILRSFAILLPKTGYCQG

SEQ ID NO: 2597988 - protein, 26 aa, Entamoeba histolytica
RDIPKLYNMKFLIALLTPIVLICFCS

SEQ ID NO: 2597989 - protein, 21 aa, Entamoeba histolytica
RDLLIYGVYFSNKGSWLNQRQ

SEQ ID NO: 2597990 - protein, 19 aa, Entamoeba histolytica
RDLRRFLYSLRNTKIKKIH

SEQ ID NO: 2597991 - protein, 17 aa, Entamoeba histolytica
RDRLECTKVNLALILPL

SEQ ID NO: 2597992 - protein, 28 aa, Entamoeba histolytica
RDVIINKPYFFVIIGEEQYPLFFGKVSH

SEQ ID NO: 2597993 - protein, 18 aa, Entamoeba histolytica
RDVKSPNVLLKFNQQHQL

SEQ ID NO: 2597994 - protein, 33 aa, Entamoeba histolytica
RECFPTFVHLFALPFVSVIPYTVLSLRLPILTV

SEQ ID NO: 2597995 - protein, 19 aa, Entamoeba histolytica
REEFKVLWKQYIDDYDFHT

SEQ ID NO: 2597996 - protein, 18 aa, Entamoeba histolytica
REEKLLGIKPDRNEKKEI

SEQ ID NO: 2597997 - protein, 29 aa, Entamoeba histolytica
REEMKMFRLYTIITPLVDLLVTLSNWYIR

SEQ ID NO: 2597998 - protein, 17 aa, Entamoeba histolytica
REKTTIFKITQSNIKFI

SEQ ID NO: 2597999 - protein, 26 aa, Entamoeba histolytica
RELKKNIFTLIPFLANSVFNVFYNIP

SEQ ID NO: 2598000 - protein, 23 aa, Entamoeba histolytica
REMKQLDMVYLMKVALHVKDMND

SEQ ID NO: 2598001 - protein, 18 aa, Entamoeba histolytica
RENKNIILIYEREIPIKQ

SEQ ID NO: 2598002 - protein, 37 aa, Entamoeba histolytica
RENMSYFSLWRALQMPYFYLSSLLAIILAITPNILKS

SEQ ID NO: 2598003 - protein, 18 aa, Entamoeba histolytica
REQSSFFKWIFNQVNMDY

SEQ ID NO: 2598004 - protein, 18 aa, Entamoeba histolytica
RESFVFLEAIKKAFISQF

SEQ ID NO: 2598005 - protein, 36 aa, Entamoeba histolytica
RETPPLISLLALAEGLVFVVPRWVYVSRKAGVIKSI

SEQ ID NO: 2598006 - protein, 33 aa, Entamoeba histolytica; identical to SEQ ID NO: 2401095

SEQ ID NO: 2598007 - protein, 31 aa, Entamoeba histolytica
REVVVLNPHFPLLEYIFSSFGVPYFHETREI

SEQ ID NO: 2598008 - protein, 21 aa, Entamoeba histolytica
REYMTLPHFSSITTAQFIGMA

SEQ ID NO: 2598009 - protein, 26 aa, Entamoeba histolytica
RFDPYVFLLIFISFLSFSFSLGISLF

SEQ ID NO: 2598010 - protein, 24 aa, Entamoeba histolytica
RFGLTFFKFLYYLGVAPFGVYLFR

SEQ ID NO: 2598011 - protein, 39 aa, Entamoeba histolytica
RFHISTLHIILTIICLVSFIFCIKIFNTPLTPNSYQYQP

SEQ ID NO: 2598012 - protein, 18 aa, Entamoeba histolytica
RFLFLPIEDVSYSLFSKI

SEQ ID NO: 2598013 - protein, 20 aa, Entamoeba histolytica
RFLSIYLPHISIICAIVFAA

SEQ ID NO: 2598014 - protein, 24 aa, Entamoeba histolytica
RFNEIFVLLRESFNIITCFRGNGK

SEQ ID NO: 2598015 - protein, 29 aa, Entamoeba histolytica
RFPFNFLAHFSFILYLILFVLSPIVLNYI

SEQ ID NO: 2598016 - protein, 20 aa, Entamoeba histolytica
RFQSFLYHCCEVLYAWSCID

SEQ ID NO: 2598017 - protein, 26 aa, Entamoeba histolytica
RFRNKYYPFWLTIYPEGTRVKPQKLI

SEQ ID NO: 2598018 - protein, 24 aa, Entamoeba histolytica
RFVAIALTFDFIVILASTVCYFTY

SEQ ID NO: 2598019 - protein, 17 aa, Entamoeba histolytica
RFVTILRINGSSSYTYF

SEQ ID NO: 2598020 - protein, 20 aa, Entamoeba histolytica
RGEFIPLTFPVHTYTTDNTV

SEQ ID NO: 2598021 - protein, 24 aa, Entamoeba histolytica
RGIKNFIFFSCGTLVLFFGLICII

SEQ ID NO: 2598022 - protein, 22 aa, Entamoeba histolytica
RGLYVLICVVIAVLIRLYSVLR

SEQ ID NO: 2598023 - protein, 17 aa, Entamoeba histolytica
RGNELSELVWYNKKLYG

SEQ ID NO: 2598024 - protein, 18 aa, Entamoeba histolytica
RGNLLSYIGWFIYGTYQS

SEQ ID NO: 2598025 - protein, 53 aa, Entamoeba histolytica
RGQLERIEECDWRKVFMPSNARFIEKWAYPLCSQVYYDPIKTLVIEFDNEPLK

SEQ ID NO: 2598026 - protein, 25 aa, Entamoeba histolytica
RGRFITEFIGAIFQLNKLAIVTEYA

SEQ ID NO: 2598027 - protein, 20 aa, Entamoeba histolytica
RGSYNPIWKGSDSSFLIQRN

SEQ ID NO: 2598028 - protein, 27 aa, Entamoeba histolytica
RGTLIFSFIFGTIGYLLFALQVSFRFS

SEQ ID NO: 2598029 - protein, 17 aa, Entamoeba histolytica
RGWKNFLLFGCGTVTLI

SEQ ID NO: 2598030 - protein, 25 aa, Entamoeba histolytica
RHKLSYFDFFNLFAYNAFGWLVRPK

SEQ ID NO: 2598031 - protein, 17 aa, Entamoeba histolytica
RHNLSVYWYYLSLSFDF

SEQ ID NO: 2598032 - protein, 24 aa, Entamoeba histolytica
RHPSYFGWFWWSVTTQIVMLNPLS

SEQ ID NO: 2598033 - protein, 21 aa, Entamoeba histolytica
RHSSYFIIPSSFTPYDIDRIR

SEQ ID NO: 2598034 - protein, 25 aa, Entamoeba histolytica
RIAEKLHHFFPIQKIWNENKVIIFD

SEQ ID NO: 2598035 - protein, 17 aa, Entamoeba histolytica
RIAIARALIRNPSILLL

SEQ ID NO: 2598036 - protein, 25 aa, Entamoeba histolytica
RIAKKLHHFFPIQKIWNENGVIIFD

SEQ ID NO: 2598037 - protein, 20 aa, Entamoeba histolytica
RIASMVGIKVFVTGGLGGVH

SEQ ID NO: 2598038 - protein, 19 aa, Entamoeba histolytica
RICLKCQRGFNLASNQTKC

SEQ ID NO: 2598039 - protein, 26 aa, Entamoeba histolytica
RIDSKHLYFLFLQINEEYAASINLTI

SEQ ID NO: 2598040 - protein, 18 aa, Entamoeba histolytica
RIFELFMIDILYAFYAFN

SEQ ID NO: 2598041 - protein, 33 aa, Entamoeba histolytica
RIFEQKGMLQLLMFSAALIKFKPKYDPFKLVKP

SEQ ID NO: 2598042 - protein, 24 aa, Entamoeba histolytica
RIINLLFNYGLIPKVQIILEEERY

SEQ ID NO: 2598043 - protein, 25 aa, Entamoeba histolytica
RIIQALMCFVPFYGQLKYINEILFK

SEQ ID NO: 2598044 - protein, 19 aa, Entamoeba histolytica
RIKAIFYVLPNSLINRFID

SEQ ID NO: 2598045 - protein, 20 aa, Entamoeba histolytica
RIKTILSILLNFIENHYLNV

SEQ ID NO: 2598046 - protein, 19 aa, Entamoeba histolytica
RILIMMLNCDSSIALDFCA

SEQ ID NO: 2598047 - protein, 26 aa, Entamoeba histolytica
RINTLVDWWYLPISAILINGLAFPSI

SEQ ID NO: 2598048 - protein, 27 aa, Entamoeba histolytica
RINYMRKLFKMFQNIPPKLTAKGIVGL

SEQ ID NO: 2598049 - protein, 22 aa, Entamoeba histolytica
RIPNLLTFKTLIAKVIGLVFVL

SEQ ID NO: 2598050 - protein, 19 aa, Entamoeba histolytica
RIRCPYIVNFIGSVTTPDT

SEQ ID NO: 2598051 - protein, 19 aa, Entamoeba histolytica
RIRCPYIVNFIGSVVTYDT

SEQ ID NO: 2598052 - protein, 17 aa, Entamoeba histolytica
RIRFIQEVDYNDINICK

SEQ ID NO: 2598053 - protein, 23 aa, Entamoeba histolytica
RIRKFHLYLPLQAESTLSTKLDY

SEQ ID NO: 2598054 - protein, 17 aa, Entamoeba histolytica
RIRSRFKYNSETNTLEI

SEQ ID NO: 2598055 - protein, 19 aa, Entamoeba histolytica
RISNACVIGLFVVLGNSVT

SEQ ID NO: 2598056 - protein, 27 aa, Entamoeba histolytica
RITEFPYFTPILNVSLFTRKLDFCNKK

SEQ ID NO: 2598057 - protein, 26 aa, Entamoeba histolytica
RITIEEVLSHPLFWSCKKRLEFIQKV

SEQ ID NO: 2598058 - protein, 30 aa, Entamoeba histolytica
RITIVIRAIIPLIIFLNIALFITSNTGTGA

SEQ ID NO: 2598059 - protein, 17 aa, Entamoeba histolytica
RIWGSMCCILYAIVFLI

SEQ ID NO: 2598060 - protein, 20 aa, Entamoeba histolytica
RIYITNFRVWWVPNDEECFQ

SEQ ID NO: 2598061 - protein, 24 aa, Entamoeba histolytica
RKDLSLLWYFLPYTPSIKYNMTID

SEQ ID NO: 2598062 - protein, 26 aa, Entamoeba histolytica
RKDNENFIKLPYKLKVKMLFDTARGM

SEQ ID NO: 2598063 - protein, 28 aa, Entamoeba histolytica
RKDNENFIRFPFKLKIKILFDTARGMQF

SEQ ID NO: 2598064 - protein, 39 aa, Entamoeba histolytica
RKEQPNVILSIIMYTLIPLIILLGCGIMFLLSCWVDKKE

SEQ ID NO: 2598065 - protein, 23 aa, Entamoeba histolytica
RKFLSNVLAFLSSCIWSININSR

SEQ ID NO: 2598066 - protein, 28 aa, Entamoeba histolytica
RKFSVLMEMLNTDKYLLKTKEKEHWGYN

SEQ ID NO: 2598067 - protein, 27 aa, Entamoeba histolytica
RKHSALTHIFLIMFDQFTVRWVHYKLI

SEQ ID NO: 2598068 - protein, 21 aa, Entamoeba histolytica
RKIVLILYYRSFIPNFSFVPS

SEQ ID NO: 2598069 - protein, 20 aa, Entamoeba histolytica
RKKQQAYLLINMLRVDPQAF

SEQ ID NO: 2598070 - protein, 26 aa, Entamoeba histolytica
RKKVNIIFYTVLIVGFLVLGVYATCK

SEQ ID NO: 2598071 - protein, 26 aa, Entamoeba histolytica
RKLANIYFLIISIFQVIPGLSPTGRF

SEQ ID NO: 2598072 - protein, 21 aa, Entamoeba histolytica
RKLILYWNKENTLFTYVLLFI

SEQ ID NO: 2598073 - protein, 25 aa, Entamoeba histolytica
RKLKKLIFITLLSATIIYITLGVIG

SEQ ID NO: 2598074 - protein, 36 aa, Entamoeba histolytica
RKNGYVLVELILKYLLFYWNFFTISPVLSYFDITPN

SEQ ID NO: 2598075 - protein, 17 aa, Entamoeba histolytica
RKNITEYKPLMYCLLIV

SEQ ID NO: 2598076 - protein, 27 aa, Entamoeba histolytica
RKNKPNYLRLPYKLKIRMLFDTARGME

SEQ ID NO: 2598077 - protein, 23 aa, Entamoeba histolytica
RKNLSNVYLLLFSEKHEYCQRIL

SEQ ID NO: 2598078 - protein, 17 aa, Entamoeba histolytica
RKNRMRFGALYIDSLEQ

SEQ ID NO: 2598079 - protein, 24 aa, Entamoeba histolytica
RKQIINFFNYYPTNITFIVRAMSN

SEQ ID NO: 2598080 - protein, 55 aa, Entamoeba histolytica
RKQLKDFFVFRIMKLRWLKSQFFVWFSILTLIHVSLLISILLGYGGLIMTAVYII

SEQ ID NO: 2598081 - protein, 26 aa, Entamoeba histolytica
RKSAPYFIQWIVNILQTYGTLKRLAL

SEQ ID NO: 2598082 - protein, 24 aa, Entamoeba histolytica
RKSKYLFEYYNPKLSEIDLLYSAN

SEQ ID NO: 2598083 - protein, 34 aa, Entamoeba histolytica
RKTLKRYWNKLKLLLRSIQLFDYMSPSIGKILSQ

SEQ ID NO: 2598084 - protein, 22 aa, Entamoeba histolytica
RKTMKEVIRLAEDLRAYHDNDV

SEQ ID NO: 2598085 - protein, 25 aa, Entamoeba histolytica
RKYIPELFKILKGKDSIIVKICTGY

SEQ ID NO: 2598086 - protein, 20 aa, Entamoeba histolytica
RKYYLHVFGQYGLVPTTDLK

SEQ ID NO: 2598087 - protein, 17 aa, Entamoeba histolytica
RLCFIISLIIVIGYIAL

SEQ ID NO: 2598088 - protein, 48 aa, Entamoeba histolytica
RLECTKVNLALILPLCIGACLILIVIILIIIFLLWRRRRAAEKQRETE

SEQ ID NO: 2598089 - protein, 33 aa, Entamoeba histolytica
RLEQERDLMFKKQLRRMLLKRKKDYDKYSREAE

SEQ ID NO: 2598090 - protein, 20 aa, Entamoeba histolytica
RLEQPPIIPESLYTIITHSW

SEQ ID NO: 2598091 - protein, 20 aa, Entamoeba histolytica
RLEVRYGLFGRVFGQRAVAW

SEQ ID NO: 2598092 - protein, 17 aa, Entamoeba histolytica
RLHVFGEIFAENGFLQR

SEQ ID NO: 2598093 - protein, 39 aa, Entamoeba histolytica; identical to SEQ ID NO: 2401196

SEQ ID NO: 2598094 - protein, 19 aa, Entamoeba histolytica
RLIGIITQLVHRIFREYPV

SEQ ID NO: 2598095 - protein, 17 aa, Entamoeba histolytica
RLKFMIDSAKGIEYLHS

SEQ ID NO: 2598096 - protein, 51 aa, Entamoeba histolytica
RLLCKKVRLGLIISLIVIGLLFIVIIICFIIFLIWRRRRKIIKEREKEIKP

SEQ ID NO: 2598097 - protein, 31 aa, Entamoeba histolytica
RLLFKTESIRLKKFPDYYPLYQDALLEQTAS

SEQ ID NO: 2598098 - protein, 22 aa, Entamoeba histolytica
RLMISIIIIFVFSFAPGIDYSA

SEQ ID NO: 2598099 - protein, 23 aa, Entamoeba histolytica
RLNRFALSSSLRFLSKHREFLPF

SEQ ID NO: 2598100 - protein, 34 aa, Entamoeba histolytica
RLNRLQVASLFALSFLGLFRLPLKFQDAKQFPRC

SEQ ID NO: 2598101 - protein, 17 aa, Entamoeba histolytica
RLRCFHFSLKEMRINDF

SEQ ID NO: 2598102 - protein, 24 aa, Entamoeba histolytica
RLRNPYIIGYIGSVTYIPEISLIM

SEQ ID NO: 2598103 - protein, 35 aa, Entamoeba histolytica
RLSFVMVMNFCYFLFELIIGLYLNSLILTVDSFNM

SEQ ID NO: 2598104 - protein, 24 aa, Entamoeba histolytica
RLSKLPLSFIDLKTPLKLITNNGT

SEQ ID NO: 2598105 - protein, 18 aa, Entamoeba histolytica
RLSNACVIGLFVVLGNSV

SEQ ID NO: 2598106 - protein, 23 aa, Entamoeba histolytica
RLSRTQLRWSEMTSILGLSKTVM

SEQ ID NO: 2598107 - protein, 24 aa, Entamoeba histolytica
RLSSYKYCYSCESGYYLFDGQCIR

SEQ ID NO: 2598108 - protein, 22 aa, Entamoeba histolytica
RLSVLVIRICLLCLTTLAASFI

SEQ ID NO: 2598109 - protein, 24 aa, Entamoeba histolytica
RLTGTFMLDLPRISNLNLPSKTQL

SEQ ID NO: 2598110 - protein, 31 aa, Entamoeba histolytica
RLTNTIQNIYNNIHLIAETLSEPALANSQSA

SEQ ID NO: 2598111 - protein, 35 aa, Entamoeba histolytica
RLTVTIVCVILLFSYIFTYVLLKTTPDTKEIKKIL

SEQ ID NO: 2598112 - protein, 18 aa, Entamoeba histolytica
RLVIPLKVDFKGIVSNEE

SEQ ID NO: 2598113 - protein, 19 aa, Entamoeba histolytica
RMFAVLSMVFFIVSTVIIV

SEQ ID NO: 2598114 - protein, 19 aa, Entamoeba histolytica
RMRGRLLASYIKAAGQVIS

SEQ ID NO: 2598115 - protein, 19 aa, Entamoeba histolytica
RMRIELISELLRIIEIAFI

SEQ ID NO: 2598116 - protein, 18 aa, Entamoeba histolytica
RMTCLLIAIIFEIPDIDK

SEQ ID NO: 2598117 - protein, 20 aa, Entamoeba histolytica
RMTFRLITDKFVQIGIIALL

SEQ ID NO: 2598118 - protein, 23 aa, Entamoeba histolytica
RMTLIKLIMWIITIGCFILYIAN

SEQ ID NO: 2598119 - protein, 19 aa, Entamoeba histolytica
RNDVFQYLLKKMKKYGSIR

SEQ ID NO: 2598120 - protein, 31 aa, Entamoeba histolytica; identical to SEQ ID NO: 2401217

SEQ ID NO: 2598121 - protein, 19 aa, Entamoeba histolytica
RNGWVLCVLAIPIGIISGY

SEQ ID NO: 2598122 - protein, 21 aa, Entamoeba histolytica
RNKKMYLIPITEIGGFKIKYP

SEQ ID NO: 2598123 - protein, 17 aa, Entamoeba histolytica
RNKYMMIIVHTPDNPKY

SEQ ID NO: 2598124 - protein, 22 aa, Entamoeba histolytica
RNLDGTSSIFIILCVTIIFLFF

SEQ ID NO: 2598125 - protein, 17 aa, Entamoeba histolytica
RNLEWTTIDSNFPTKDQ

SEQ ID NO: 2598126 - protein, 25 aa, Entamoeba histolytica
RNLHKKLIHKLLKAKLGFFDVTPMG

SEQ ID NO: 2598127 - protein, 18 aa, Entamoeba histolytica
RNNINICFLINNKQMKFI

SEQ ID NO: 2598128 - protein, 25 aa, Entamoeba histolytica
RNNYKFFILFLYYIVISIFFGIIIL

SEQ ID NO: 2598129 - protein, 34 aa, Entamoeba histolytica
RNNYRGYLCILFVAFSHFVYVLDILKLKESFETT

SEQ ID NO: 2598130 - protein, 23 aa, Entamoeba histolytica
RNPYIAWDFFQLNSDLSVVVINA

SEQ ID NO: 2598131 - protein, 37 aa, Entamoeba histolytica
RNREVIHTHKYANQLKRIYNLYKTHLKSEEPEKVTST

SEQ ID NO: 2598132 - protein, 21 aa, Entamoeba histolytica
RNSSISHLFFIELLMIIILLF

SEQ ID NO: 2598133 - protein, 21 aa, Entamoeba histolytica
RNTERLLLFIVYCGFDTKLAK

SEQ ID NO: 2598134 - protein, 41 aa, Entamoeba histolytica
RNTTPIYIIAIIIILLIVIISVIAFFWFTRKPRSSHSQNRD

SEQ ID NO: 2598135 - protein, 21 aa, Entamoeba histolytica
RNWNDVRFELVSDIPWNCFNP

SEQ ID NO: 2598136 - protein, 19 aa, Entamoeba histolytica
RNYNGKLMWNIWMEKDDNG

SEQ ID NO: 2598137 - protein, 20 aa, Entamoeba histolytica
RPFENIISYGQIIVVGTPGY

SEQ ID NO: 2598138 - protein, 17 aa, Entamoeba histolytica
RPHFVELISFEDQNISA

SEQ ID NO: 2598139 - protein, 28 aa, Entamoeba histolytica
RPKSSTLYLPPRYPLLGGWKTSFEVNYN

SEQ ID NO: 2598140 - protein, 25 aa, Entamoeba histolytica
RPLCPRYMLLLNEIVRLSLLIEFDK

SEQ ID NO: 2598141 - protein, 28 aa, Entamoeba histolytica
RPYQLDGISWLLFLHKYCINGILCDDMG

SEQ ID NO: 2598142 - protein, 22 aa, Entamoeba histolytica
RQAATSVLYLFAKTNYQVNGDT

SEQ ID NO: 2598143 - protein, 17 aa, Entamoeba histolytica
RQAIRMLRYALSPEIYE

SEQ ID NO: 2598144 - protein, 32 aa, Entamoeba histolytica
RQELEAYLLSIIYIIFVCCVSLLIAFVIIIIL

SEQ ID NO: 2598145 - protein, 27 aa, Entamoeba histolytica
RQFFGYYFFGVFLFLLLAFYVMVPFSY

SEQ ID NO: 2598146 - protein, 19 aa, Entamoeba histolytica
RQGMLEITALLLLNKFYDT

SEQ ID NO: 2598147 - protein, 20 aa, Entamoeba histolytica
RQGMLEITALLLLNKFYDTK

SEQ ID NO: 2598148 - protein, 25 aa, Entamoeba histolytica
RQHMDSLWMIIIAQSPRVSLNNDNK

SEQ ID NO: 2598149 - protein, 24 aa, Entamoeba histolytica
RQIEYNKCIPGKLIISCLNGKIYL

SEQ ID NO: 2598150 - protein, 24 aa, Entamoeba histolytica
RQKKQSIRNLPYPQIISLKFDDEE

SEQ ID NO: 2598151 - protein, 17 aa, Entamoeba histolytica
RQKYLNCMLEHLSLIFT

SEQ ID NO: 2598152 - protein, 20 aa, Entamoeba histolytica
RQNEMNIYYPPTDEGICMSY

SEQ ID NO: 2598153 - protein, 25 aa, Entamoeba histolytica
RRAEKLHHFFPIQKIWNENGVIIFD

SEQ ID NO: 2598154 - protein, 21 aa, Entamoeba histolytica
RRFADLFVPLKCPHARFTNAQ

SEQ ID NO: 2598155 - protein, 28 aa, Entamoeba histolytica
RRFDKNRFIFLSNLLLDIATELGYFFET

SEQ ID NO: 2598156 - protein, 42 aa, Entamoeba histolytica
RRGDKIFNFLFRYIHKLRFVIVIFWILAVIGFAYPALKFLGA

SEQ ID NO: 2598157 - protein, 26 aa, Entamoeba histolytica
RRKANFIFGNAFYYKSYSSQYTLFDG

SEQ ID NO: 2598158 - protein, 27 aa, Entamoeba histolytica
RRLVLPDFFFKVLPYFKQSWVCDIYIG

SEQ ID NO: 2598159 - protein, 19 aa, Entamoeba histolytica
RRNRAFNIQPILPSDLGLT

SEQ ID NO: 2598160 - protein, 26 aa, Entamoeba histolytica
RRNYRIFYQFLILSFVYLLYVEISSL

SEQ ID NO: 2598161 - protein, 19 aa, Entamoeba histolytica
RRRFTLSPILWKRRNQKRQ

SEQ ID NO: 2598162 - protein, 23 aa, Entamoeba histolytica
RRRFYYSIMHQNVSWFDRRENMV

SEQ ID NO: 2598163 - protein, 35 aa, Entamoeba histolytica
RRVRTCFVKIILQLSLPLTIIIISLNNIFGKQLVS

SEQ ID NO: 2598164 - protein, 28 aa, Entamoeba histolytica
RSACSRMLYLRLPTLLLQTPSTKSLNLL

SEQ ID NO: 2598165 - protein, 22 aa, Entamoeba histolytica
RSDYIVYFYGSVLSTNKFCIVT

SEQ ID NO: 2598166 - protein, 21 aa, Entamoeba histolytica
RSELIPQYYTTPAFLTNLNNY

SEQ ID NO: 2598167 - protein, 19 aa, Entamoeba histolytica
RSEPQLAFIKPGNAVEFNL

SEQ ID NO: 2598168 - protein, 21 aa, Entamoeba histolytica
RSEYIVHFYGAVLIPTKVCMV

SEQ ID NO: 2598169 - protein, 22 aa, Entamoeba histolytica
RSFDIDYQLLSFKSPDPPNAGC

SEQ ID NO: 2598170 - protein, 21 aa, Entamoeba histolytica
RSFLHFIPFVLLSTLILFCLY

SEQ ID NO: 2598171 - protein, 24 aa, Entamoeba histolytica
RSFLLSIKILIILLKNTPTSEDSI

SEQ ID NO: 2598172 - protein, 17 aa, Entamoeba histolytica
RSGAIVVCAPIAPYREI

SEQ ID NO: 2598173 - protein, 22 aa, Entamoeba histolytica
RSGYLFLIGIFLMIPYLHRKFH

SEQ ID NO: 2598174 - protein, 33 aa, Entamoeba histolytica
RSHQEYIFGQWGLLIQYIILIGGNVVISYPKRK

SEQ ID NO: 2598175 - protein, 32 aa, Entamoeba histolytica
RSINAIAYWIATTCSILIHIKYYVTSINEKTK

SEQ ID NO: 2598176 - protein, 29 aa, Entamoeba histolytica
RSIYPLYEALDRIILLLFDRRIDSELEST

SEQ ID NO: 2598177 - protein, 20 aa, Entamoeba histolytica
RSKIAWIEFPYECGLIQCEQ

SEQ ID NO: 2598178 - protein, 21 aa, Entamoeba histolytica
RSLAFVIQFLECVEPPCCEVE

SEQ ID NO: 2598179 - protein, 20 aa, Entamoeba histolytica
RSLCLLAQAIFLVFSLLLVV

SEQ ID NO: 2598180 - protein, 21 aa, Entamoeba histolytica
RSLKPYWYPMFDNEENEILPY

SEQ ID NO: 2598181 - protein, 18 aa, Entamoeba histolytica
RSMPTFILFKNGQEYDRF

SEQ ID NO: 2598182 - protein, 32 aa, Entamoeba histolytica
RSNFLFVLGIFFPLLQWINWMCIFRKPRSDRV

SEQ ID NO: 2598183 - protein, 23 aa, Entamoeba histolytica
RSNSFLFNPFYKTIEILNDTICE

SEQ ID NO: 2598184 - protein, 17 aa, Entamoeba histolytica
RSPIFIHFDQTLLGLAT

SEQ ID NO: 2598185 - protein, 20 aa, Entamoeba histolytica
RSQFIINFIGSVITPDKLCL

SEQ ID NO: 2598186 - protein, 17 aa, Entamoeba histolytica
RSRFKYNSETNTLEIDG

SEQ ID NO: 2598187 - protein, 18 aa, Entamoeba histolytica
RTAISFSWLLQYAEQNGV

SEQ ID NO: 2598188 - protein, 35 aa, Entamoeba histolytica
RTFDGFVHLFLKNFVWNKFPFLETPERDFNKYFIL

SEQ ID NO: 2598189 - protein, 28 aa, Entamoeba histolytica
RTFEGIITHQIFYDIWPPLIEKTTEIIQ

SEQ ID NO: 2598190 - protein, 21 aa, Entamoeba histolytica
RTFSLFVVSQREGIKPRRLYF

SEQ ID NO: 2598191 - protein, 26 aa, Entamoeba histolytica
RTFVKTVISAYLWDGLYISLDKVTMR

SEQ ID NO: 2598192 - protein, 20 aa, Entamoeba histolytica
RTHQFDCLFPILSNAPNLFF

SEQ ID NO: 2598193 - protein, 21 aa, Entamoeba histolytica
RTIYVLQNGLIAVILVCDIRF

SEQ ID NO: 2598194 - protein, 27 aa, Entamoeba histolytica
RTKILDIIIKYILPLISNIPDIQKAFI

SEQ ID NO: 2598195 - protein, 29 aa, Entamoeba histolytica
RTNFIICLIFIMYSFYQIGILLAWIFRVN

SEQ ID NO: 2598196 - protein, 24 aa, Entamoeba histolytica
RTNPQLITLKKGKAVEFEIFIKPL

SEQ ID NO: 2598197 - protein, 42 aa, Entamoeba histolytica
RTPDAVIVPFWKIWFEALQDKTLIILIIAAIVSLILAFAVPN

SEQ ID NO: 2598198 - protein, 29 aa, Entamoeba histolytica
RTRHCFGGFLTIICVVIIIVLSIAEFAFY

SEQ ID NO: 2598199 - protein, 17 aa, Entamoeba histolytica
RTTSAIVSIKHSPSDLY

SEQ ID NO: 2598200 - protein, 18 aa, Entamoeba histolytica
RTTTLPQFYVPNSNIHIP

SEQ ID NO: 2598201 - protein, 30 aa, Entamoeba histolytica
RTYCFTTTYPYFLALFPLLHYIAEHSYRNK

SEQ ID NO: 2598202 - protein, 32 aa, Entamoeba histolytica
RTYLIIQSFLIKILYKGIYPFNSFQFDYLILS

SEQ ID NO: 2598203 - protein, 19 aa, Entamoeba histolytica
RVALVFALILFILKFIISL

SEQ ID NO: 2598204 - protein, 25 aa, Entamoeba histolytica
RVALVLGIIFNFFEDSKTSESLLFD

SEQ ID NO: 2598205 - protein, 29 aa, Entamoeba histolytica
RVFITTVVSTYLWDGLYISLAKVTMRESN

SEQ ID NO: 2598206 - protein, 17 aa, Entamoeba histolytica
RVFIYKFLNTIVDDLFA

SEQ ID NO: 2598207 - protein, 22 aa, Entamoeba histolytica
RVFVADLRDVFFFADGFATFSD

SEQ ID NO: 2598208 - protein, 24 aa, Entamoeba histolytica
RVGGVKIFFDKYLTSTGSGRFALV

SEQ ID NO: 2598209 - protein, 27 aa, Entamoeba histolytica
RVHAFNVICWLLPIKFGLSDVFDQNLY

SEQ ID NO: 2598210 - protein, 25 aa, Entamoeba histolytica
RVIDPYWFHYFEDWSYDRLPEDIKS

SEQ ID NO: 2598211 - protein, 19 aa, Entamoeba histolytica
RVILPTFIIYNYLISYTSI

SEQ ID NO: 2598212 - protein, 27 aa, Entamoeba histolytica
RVLSRPELFFFAFPKKPELVVPICIIA

SEQ ID NO: 2598213 - protein, 23 aa, Entamoeba histolytica
RVLTLMSLNFKILSCVLAMVALK

SEQ ID NO: 2598214 - protein, 29 aa, Entamoeba histolytica
RVNIVIRVIMPFLILLNIALFITSNTGTG

SEQ ID NO: 2598215 - protein, 19 aa, Entamoeba histolytica
RVRILKIPSSTLWFSFHEL

SEQ ID NO: 2598216 - protein, 24 aa, Entamoeba histolytica
RVSDLELIFKYKYSGNPTSELNAV

SEQ ID NO: 2598217 - protein, 26 aa, Entamoeba histolytica
RVSGKIRLFIVSRYQSNYVGHVLTTT

SEQ ID NO: 2598218 - protein, 23 aa, Entamoeba histolytica
RVTGICILLLFIVVLVMTICTTI

SEQ ID NO: 2598219 - protein, 18 aa, Entamoeba histolytica
RVWWVPNDEECFQRNTRL

SEQ ID NO: 2598220 - protein, 19 aa, Entamoeba histolytica
RVYEGLYLVTFNRDYAKAS

SEQ ID NO: 2598221 - protein, 19 aa, Entamoeba histolytica
RVYQKTWVAPFLYRNKRNQ

SEQ ID NO: 2598222 - protein, 19 aa, Entamoeba histolytica
RWRSVLSHWKYYLQRVLPN

SEQ ID NO: 2598223 - protein, 30 aa, Entamoeba histolytica
RYCYRQIGITLFYLIYKNVILLMCEFIYNM

SEQ ID NO: 2598224 - protein, 19 aa, Entamoeba histolytica
RYFAKEKGLYLSQEDIKKI

SEQ ID NO: 2598225 - protein, 26 aa, Entamoeba histolytica
RYIPKKWKIYQLWNGRVIIFIIRCSI

SEQ ID NO: 2598226 - protein, 26 aa, Entamoeba histolytica
RYIPKQWKFMTIWNGRLSVLVIRICL

SEQ ID NO: 2598227 - protein, 27 aa, Entamoeba histolytica
RYNKDTDIYLPYKLKIKMLFDTARGMQ

SEQ ID NO: 2598228 - protein, 37 aa, Entamoeba histolytica
RYSFYSFKLFGLAVPYPLLWCRYSFFIVLYPMGVSGE

SEQ ID NO: 2598229 - protein, 17 aa, Entamoeba histolytica
RYSILKLPTPTLHDMVQ

SEQ ID NO: 2598230 - protein, 51 aa, Entamoeba histolytica
RYSTKLIALTIFLPGLGIYICFALVLLIINSIKYSLLIDRIKFELNQQNII

SEQ ID NO: 2598231 - protein, 18 aa, Entamoeba histolytica
RYYCQYQRAFEIVKKLLP

SEQ ID NO: 2598232 - protein, 24 aa, Entamoeba histolytica
SCHFYLVISLFLVIYLFILFYNIL

SEQ ID NO: 2598233 - protein, 27 aa, Entamoeba histolytica
SAALCFMILHYFTSFEPPLFPSDFRCV

SEQ ID NO: 2598234 - protein, 18 aa, Entamoeba histolytica
SAAVFCALFLLGGSFEKG

SEQ ID NO: 2598235 - protein, 21 aa, Entamoeba histolytica
SACIFLVFSIILILTCLKLWG

SEQ ID NO: 2598236 - protein, 29 aa, Entamoeba histolytica
SADIFSFSILMYETFKWDRPYPENVFKYP

SEQ ID NO: 2598237 - protein, 18 aa, Entamoeba histolytica
SAHFLRFAPCALVMLFFQ

SEQ ID NO: 2598238 - protein, 17 aa, Entamoeba histolytica
SAISLRIPLILKDIFES

SEQ ID NO: 2598239 - protein, 23 aa, Entamoeba histolytica
SAKSFPGVWFKFTSTKNGYYSIS

SEQ ID NO: 2598240 - protein, 33 aa, Entamoeba histolytica
SAKTAIFLFVFIIMMFILLLEIWHAGIVLMTGV

SEQ ID NO: 2598241 - protein, 21 aa, Entamoeba histolytica
SAKYIHQVLDGLAFIHDQGIV

SEQ ID NO: 2598242 - protein, 23 aa, Entamoeba histolytica
SALTRRVNFYLLGLNAKDQDIEK

SEQ ID NO: 2598243 - protein, 24 aa, Entamoeba histolytica
SALYFFFPLFMYSAFSTSCRVIPI

SEQ ID NO: 2598244 - protein, 21 aa, Entamoeba histolytica
SAQSILLLLNGKRNGIVIQYP

SEQ ID NO: 2598245 - protein, 26 aa, Entamoeba histolytica
SASISLIKLLPPFIDSKWIIDGRNIN

SEQ ID NO: 2598246 - protein, 25 aa, Entamoeba histolytica
SASKFLHMDLIKRIFKTKLGFFDVT

SEQ ID NO: 2598247 - protein, 28 aa, Entamoeba histolytica
SASNLPYIEDILPFGLYIKIDDQQIELF

SEQ ID NO: 2598248 - protein, 17 aa, Entamoeba histolytica
SASSMMIGILSVIALFF

SEQ ID NO: 2598249 - protein, 30 aa, Entamoeba histolytica
SASSSSLWMRIPLYLLQDYPRQSRKLSSLS

SEQ ID NO: 2598250 - protein, 20 aa, Entamoeba histolytica
SATACIICEDTNLVLAASGS

SEQ ID NO: 2598251 - protein, 22 aa, Entamoeba histolytica
SATACITCEDINLILTGEKPCT

SEQ ID NO: 2598252 - protein, 22 aa, Entamoeba histolytica
SATKLRCYMAYFSTIGIAIINK

SEQ ID NO: 2598253 - protein, 24 aa, Entamoeba histolytica
SATVSFILLMTISLVINSIEKQPH

SEQ ID NO: 2598254 - protein, 18 aa, Entamoeba histolytica
SAVLKKEYIANLCQVFVV

SEQ ID NO: 2598255 - protein, 25 aa, Entamoeba histolytica
SAVQYYVPLRMKFPYRDVPNGWRVD

SEQ ID NO: 2598256 - protein, 23 aa, Entamoeba histolytica
SAYIYFDNLLSGYSPRFELLESY

SEQ ID NO: 2598257 - protein, 46 aa, Entamoeba histolytica
SCDEKSKWWISLISVGILLILFLSAIISILAIINFLRNRKKKREQE

SEQ ID NO: 2598258 - protein, 17 aa, Entamoeba histolytica
SCDPYFLDFIQCSFNVE

SEQ ID NO: 2598259 - protein, 25 aa, Entamoeba histolytica
SCELKYKLIYNLDAYEVFCPFPQFC

SEQ ID NO: 2598260 - protein, 25 aa, Entamoeba histolytica
SCGEPMKFIFLIDVSKDSLTRVFDS

SEQ ID NO: 2598261 - protein, 17 aa, Entamoeba histolytica
SCGLCDDGYYLSGNTCV

SEQ ID NO: 2598262 - protein, 49 aa, Entamoeba histolytica
SCKEKRFPVWAYVLIVLFSFAILFIIISSLIIFIVFIMNYKQIDTNTFK

SEQ ID NO: 2598263 - protein, 47 aa, Entamoeba histolytica
SCKETGILWWHILLIIIGSVWIIFILMIGIFLIVNAFRKRKGFDPKV

SEQ ID NO: 2598264 - protein, 20 aa, Entamoeba histolytica
SCLFNLIIPKSFTSGTLKLY

SEQ ID NO: 2598265 - protein, 22 aa, Entamoeba histolytica
SCLIGFIPFFVMTRFPLVNNIK

SEQ ID NO: 2598266 - protein, 48 aa, Entamoeba histolytica
SCSKTNLGLIIPLIVIAVIIIIIIIMVIIGIIWLRRRKSVKAESTAIK

SEQ ID NO: 2598267 - protein, 17 aa, Entamoeba histolytica
SCTPKEINLIPLAQEDI

SEQ ID NO: 2598268 - protein, 23 aa, Entamoeba histolytica
SCVYCGLKTYSLKGAVSCIECDS

SEQ ID NO: 2598269 - protein, 23 aa, Entamoeba histolytica
SCVYPKYWTAYRGGILRGLKCEK

SEQ ID NO: 2598270 - protein, 17 aa, Entamoeba histolytica
SCYLLLIEFIEALIMNE

SEQ ID NO: 2598271 - protein, 20 aa, Entamoeba histolytica
SCYQVFHDEIYMAMGTCVYY

SEQ ID NO: 2598272 - protein, 21 aa, Entamoeba histolytica
SDDGFLIGVAYILSILNQREL

SEQ ID NO: 2598273 - protein, 17 aa, Entamoeba histolytica
SDDLFWVIVGCVGGFIV

SEQ ID NO: 2598274 - protein, 23 aa, Entamoeba histolytica
SDDRNVYFIFPKNGGGNAIYSQW

SEQ ID NO: 2598275 - protein, 25 aa, Entamoeba histolytica
SDESWKIIQLLKIDFIRDLHQFVYF

SEQ ID NO: 2598276 - protein, 21 aa, Entamoeba histolytica
SDFEIHWKTFINLKDITFDLS

SEQ ID NO: 2598277 - protein, 20 aa, Entamoeba histolytica
SDFFIIFDILHICKSSLMTN

SEQ ID NO: 2598278 - protein, 19 aa, Entamoeba histolytica
SDGLFLFKGIQVPYVSGGQ

SEQ ID NO: 2598279 - protein, 22 aa, Entamoeba histolytica
SDIILLLPIISISLYFLITLQN

SEQ ID NO: 2598280 - protein, 40 aa, Entamoeba histolytica; identical to SEQ ID NO: 2401375

SEQ ID NO: 2598281 - protein, 25 aa, Entamoeba histolytica
SDKSKLMFFTLFRSGGAAILLTNKK

SEQ ID NO: 2598282 - protein, 27 aa, Entamoeba histolytica
SDLIPNPLILLWSFIPFVLIYALRVLC

SEQ ID NO: 2598283 - protein, 32 aa, Entamoeba histolytica
SDLQKKWLVTYSIYWLPYVNLAQDYTPKECNK

SEQ ID NO: 2598284 - protein, 31 aa, Entamoeba histolytica
SDLYSLGIVLYYLIYLQFPFKINSLNELKER

SEQ ID NO: 2598285 - protein, 27 aa, Entamoeba histolytica
SDNGDHFMLLSLYLAFKKVGVNRRKRW

SEQ ID NO: 2598286 - protein, 23 aa, Entamoeba histolytica
SDNLITIPIPLKKVSLSTELSCD

SEQ ID NO: 2598287 - protein, 29 aa, Entamoeba histolytica
SDNLQQLFQILLPQIIRLKLTTKLTTVLL

SEQ ID NO: 2598288 - protein, 26 aa, Entamoeba histolytica
SDNYDNLDAASSPFIVLFAIIVVILF

SEQ ID NO: 2598289 - protein, 22 aa, Entamoeba histolytica
SDPIIIVGLNRIIDKYPIDTID

SEQ ID NO: 2598290 - protein, 31 aa, Entamoeba histolytica
SDRDWLIIVCRMLMIILVLMSYPALTFSTCA

SEQ ID NO: 2598291 - protein, 25 aa, Entamoeba histolytica
SDSRFDLTILKFTNVPKYLTFENIN

SEQ ID NO: 2598292 - protein, 25 aa, Entamoeba histolytica
SDSYALICLTISMIYQVIPILPCEL

SEQ ID NO: 2598293 - protein, 27 aa, Entamoeba histolytica
SDVIGSLFFGLLLGVSILLTGKFRFGY

SEQ ID NO: 2598294 - protein, 20 aa, Entamoeba histolytica
SDVLFNILFIGVCILSVLLL

SEQ ID NO: 2598295 - protein, 22 aa, Entamoeba histolytica
SDVMYNWMKDSIIPFNIESVPK

SEQ ID NO: 2598296 - protein, 35 aa, Entamoeba histolytica
SDYDGNNFLVDSFYFILPFDIVILNDKSVKFVLKS

SEQ ID NO: 2598297 - protein, 40 aa, Entamoeba histolytica
SDYQFLTYYLILPLLYHPLSSPLLYLLNKHNKRFKLALYE

SEQ ID NO: 2598298 - protein, 35 aa, Entamoeba histolytica
SEAEKYMKILLSLIHLLLMIEFVFINPTKTQEGRC

SEQ ID NO: 2598299 - protein, 24 aa, Entamoeba histolytica
SEALCFLFLIIFQGTFTNIQGSFI

SEQ ID NO: 2598300 - protein, 31 aa, Entamoeba histolytica
SEDSYYFQSFLITLYIKLSYYESIYSKTCYF

SEQ ID NO: 2598301 - protein, 37 aa, Entamoeba histolytica; identical to SEQ ID NO: 2401401

SEQ ID NO: 2598302 - protein, 31 aa, Entamoeba histolytica
SEESQTKLISFLMYVLCSLGYTFVVRKPTKV

SEQ ID NO: 2598303 - protein, 24 aa, Entamoeba histolytica
SEFFMYKKWFFETLGKMMRKVQRI

SEQ ID NO: 2598304 - protein, 18 aa, Entamoeba histolytica
SEFPLFSTYVALFRCGQK

SEQ ID NO: 2598305 - protein, 24 aa, Entamoeba histolytica
SEFQLPMGFPLFQPVTYGYAHKNA

SEQ ID NO: 2598306 - protein, 22 aa, Entamoeba histolytica
SEGIFKYYIIPFSSERKRMSVV

SEQ ID NO: 2598307 - protein, 30 aa, Entamoeba histolytica
SEIKYQIPLYLIVLVVFFGFDEFIAILTNP

SEQ ID NO: 2598308 - protein, 17 aa, Entamoeba histolytica
SEINYFVFLKRGKWGLL

SEQ ID NO: 2598309 - protein, 24 aa, Entamoeba histolytica
SEIPPLRNLLINDIKLLLPLSSFI

SEQ ID NO: 2598310 - protein, 22 aa, Entamoeba histolytica
SEKYKFLFTTHLCPLSDHIKCT

SEQ ID NO: 2598311 - protein, 23 aa, Entamoeba histolytica
SEKYKFLFTTHLCPLSDHIKCTT

SEQ ID NO: 2598312 - protein, 22 aa, Entamoeba histolytica
SELCNIFRYFEIPKENDSKMIN

SEQ ID NO: 2598313 - protein, 22 aa, Entamoeba histolytica
SELFYQSLFDIFQPMPISLIEA

SEQ ID NO: 2598314 - protein, 20 aa, Entamoeba histolytica
SELIKFPSFSFLTKLEYLDI

SEQ ID NO: 2598315 - protein, 30 aa, Entamoeba histolytica
SELKTLFALPSLPLVIPYLTLLILSHMNVI

SEQ ID NO: 2598316 - protein, 19 aa, Entamoeba histolytica
SELLRIIEIAFISTPIFYS

SEQ ID NO: 2598317 - protein, 18 aa, Entamoeba histolytica
SELPFITKIYLPSPKEEG

SEQ ID NO: 2598318 - protein, 25 aa, Entamoeba histolytica
SELTLQQRIILLRKFNYEDPEICEL

SEQ ID NO: 2598319 - protein, 17 aa, Entamoeba histolytica
SELVWYNKKLYGFDDKT

SEQ ID NO: 2598320 - protein, 24 aa, Entamoeba histolytica
SENGWLFEVFGYKTLKQLAKKVIK

SEQ ID NO: 2598321 - protein, 18 aa, Entamoeba histolytica
SENRYLCFIISKTPEENL

SEQ ID NO: 2598322 - protein, 29 aa, Entamoeba histolytica
SEQFVTGLLMLFTIPLLSELLKEVGCVKT

SEQ ID NO: 2598323 - protein, 24 aa, Entamoeba histolytica
SEQLPLYLIGFSIGGLIVSRIASD

SEQ ID NO: 2598324 - protein, 27 aa, Entamoeba histolytica
SESITTFFLFIGIHFFFLSGHAFQFSD

SEQ ID NO: 2598325 - protein, 23 aa, Entamoeba histolytica
SESLIMAIALITFLQTFPVTDNH

SEQ ID NO: 2598326 - protein, 24 aa, Entamoeba histolytica
SESNQLLPLFIDKFFNQFNKGTVL

SEQ ID NO: 2598327 - protein, 22 aa, Entamoeba histolytica
SETKYWPNMGYYISLFGFEYRT

SEQ ID NO: 2598328 - protein, 29 aa, Entamoeba histolytica
SEVAWKKYTYPIMFTPTSIVYFTQNNGYL

SEQ ID NO: 2598329 - protein, 18 aa, Entamoeba histolytica
SEVDLLCSTASFVRSHTP

SEQ ID NO: 2598330 - protein, 21 aa, Entamoeba histolytica
SEVLLYYYNYVLFSNTTSLAK

SEQ ID NO: 2598331 - protein, 32 aa, Entamoeba histolytica
SEVLYSCGFLLLRVMLLKCSFNKLKKKMPTIL

SEQ ID NO: 2598332 - protein, 25 aa, Entamoeba histolytica
SEYDVIFKQAILSNGFTVSAPYKLT

SEQ ID NO: 2598333 - protein, 21 aa, Entamoeba histolytica
SEYLFLMDDIVQRMKKIKIED

SEQ ID NO: 2598334 - protein, 18 aa, Entamoeba histolytica
SFAICMLEIWLGRDPYNP

SEQ ID NO: 2598335 - protein, 22 aa, Entamoeba histolytica
SFASIVFGDLQKVSFINGFEEN

SEQ ID NO: 2598336 - protein, 21 aa, Entamoeba histolytica
SFAVCMLEIWLGKPPYSSDEF

SEQ ID NO: 2598337 - protein, 21 aa, Entamoeba histolytica
SFCCLACWVVFMFQPTFSCSV

SEQ ID NO: 2598338 - protein, 21 aa, Entamoeba histolytica
SFCGMILLLVIVVGIIYLIFF

SEQ ID NO: 2598339 - protein, 18 aa, Entamoeba histolytica
SFCSFIINGQIKYDFYYI

SEQ ID NO: 2598340 - protein, 25 aa, Entamoeba histolytica
SFCYYRQKYRLGKWFRLDMKDIHTD

SEQ ID NO: 2598341 - protein, 22 aa, Entamoeba histolytica
SFDLSLKDWPFTSFQSWAVDRM

SEQ ID NO: 2598342 - protein, 19 aa, Entamoeba histolytica
SFDNRIRFIQEVDYNDINI

SEQ ID NO: 2598343 - protein, 24 aa, Entamoeba histolytica
SFDPLFKEGFCKHLIPAALHRYEE

SEQ ID NO: 2598344 - protein, 24 aa, Entamoeba histolytica
SFEWQIPKQVILGQLLIIKCITLL

SEQ ID NO: 2598345 - protein, 17 aa, Entamoeba histolytica
SFFIGLLLIGLLVLQTY

SEQ ID NO: 2598346 - protein, 18 aa, Entamoeba histolytica
SFFIGWHMVMAIGGADMP

SEQ ID NO: 2598347 - protein, 23 aa, Entamoeba histolytica
SFFLKIPFIYRSVVNFILYTSCY

SEQ ID NO: 2598348 - protein, 22 aa, Entamoeba histolytica
SFFNISYCNIVFMSLPYNNQIM

SEQ ID NO: 2598349 - protein, 25 aa, Entamoeba histolytica
SFGIITFFLVFSPLFSWLYCSCIKT

SEQ ID NO: 2598350 - protein, 39 aa, Entamoeba histolytica
SFGITMYETFHWGECYPKLLFKFPWAIADFINKGQRRER

SEQ ID NO: 2598351 - protein, 18 aa, Entamoeba histolytica
SFGMDYTVYKPNLILKVL

SEQ ID NO: 2598352 - protein, 20 aa, Entamoeba histolytica
SFGMILFNDPFVALGFYANY

SEQ ID NO: 2598353 - protein, 25 aa, Entamoeba histolytica
SFGMVMAFVLLRKPLQTILGRDVEI

SEQ ID NO: 2598354 - protein, 39 aa, Entamoeba histolytica
SFGPIPVTIYFAIILTFMSLILPFTYRYQYIIWGYFIVT

SEQ ID NO: 2598355 - protein, 20 aa, Entamoeba histolytica
SFGYEFCCKWIFTLSMRVRN

SEQ ID NO: 2598356 - protein, 25 aa, Entamoeba histolytica
SFIDSFSIPFHVIPTAISEPFEIQI

SEQ ID NO: 2598357 - protein, 26 aa, Entamoeba histolytica
SFIEQFMLFINPLINNNIQLNGLLTI

SEQ ID NO: 2598358 - protein, 23 aa, Entamoeba histolytica
SFIIAFSLLFITTLLMSTVTFIA

SEQ ID NO: 2598359 - protein, 19 aa, Entamoeba histolytica
SFIRFLVMFTYYIAQFLLG

SEQ ID NO: 2598360 - protein, 17 aa, Entamoeba histolytica
SFKINVINKFLLEPISQ

SEQ ID NO: 2598361 - protein, 28 aa, Entamoeba histolytica
SFKLGVLLVFFFFGIHFFFLSGHAFQFS

SEQ ID NO: 2598362 - protein, 22 aa, Entamoeba histolytica
SFKQEFIVKMLWSLLVISEAGL

SEQ ID NO: 2598363 - protein, 22 aa, Entamoeba histolytica
SFKVYWEYIKAGLVFLGAACIV

SEQ ID NO: 2598364 - protein, 29 aa, Entamoeba histolytica
SFLDSYVMILMIMAFYFDVPLPIRHPNSV

SEQ ID NO: 2598365 - protein, 17 aa, Entamoeba histolytica
SFLGWKYVDFNNSKFNP

SEQ ID NO: 2598366 - protein, 23 aa, Entamoeba histolytica
SFLPQIFCLIAIGFRYCKKDIIF

SEQ ID NO: 2598367 - protein, 20 aa, Entamoeba histolytica
SFLYFMIFSVYDVKYIFTIW

SEQ ID NO: 2598368 - protein, 32 aa, Entamoeba histolytica; identical to SEQ ID NO: 2401481

SEQ ID NO: 2598369 - protein, 27 aa, Entamoeba histolytica
SFNIIISVLVLFFLGVVVIIGVSFLIQ

SEQ ID NO: 2598370 - protein, 17 aa, Entamoeba histolytica
SFNLFFYIMALNVAINS

SEQ ID NO: 2598371 - protein, 25 aa, Entamoeba histolytica
SFNLKVRLAYFKFLTKLLEGYDEFI

SEQ ID NO: 2598372 - protein, 25 aa, Entamoeba histolytica
SFNTPYNTIFFYPISQGTINNPIKV

SEQ ID NO: 2598373 - protein, 31 aa, Entamoeba histolytica
SFNYALVVFILPLVILFISLLFFCNVNGLFS

SEQ ID NO: 2598374 - protein, 19 aa, Entamoeba histolytica
SFPAIILKYEQPEDTTYVV

SEQ ID NO: 2598375 - protein, 29 aa, Entamoeba histolytica
SFPSKFVINNFLTLTFPDIVYFVETPCFN

SEQ ID NO: 2598376 - protein, 24 aa, Entamoeba histolytica
SFQLSPFLYFQPDVFVLAFDVSNI

SEQ ID NO: 2598377 - protein, 17 aa, Entamoeba histolytica
SFRRKFGQLLKYDKSIF

SEQ ID NO: 2598378 - protein, 19 aa, Entamoeba histolytica
SFSNFILPALISLCDVFEN

SEQ ID NO: 2598379 - protein, 28 aa, Entamoeba histolytica
SFSSQVICLCLIAVWFSQHRKCISGREQ

SEQ ID NO: 2598380 - protein, 34 aa, Entamoeba histolytica
SFTIGSCTKLTLTGKRTIKKLKLSNSCPLIIETE

SEQ ID NO: 2598381 - protein, 19 aa, Entamoeba histolytica
SFTIGSCTKLTLTGTRTIK

SEQ ID NO: 2598382 - protein, 22 aa, Entamoeba histolytica
SFTIVVVVRFMILFSSIIPISI

SEQ ID NO: 2598383 - protein, 23 aa, Entamoeba histolytica
SFTNVLYIILCGYHSYCILRNNH

SEQ ID NO: 2598384 - protein, 26 aa, Entamoeba histolytica
SFTQGKLLLLPLSKEYLRIPLTIQWE

SEQ ID NO: 2598385 - protein, 31 aa, Entamoeba histolytica
SFVAFLSYPISGYAMKMPLFGSTFKSVQIES

SEQ ID NO: 2598386 - protein, 33 aa, Entamoeba histolytica
SFVKRMRWFPSFFFGYDQALMNVLYYSKEFGVE

SEQ ID NO: 2598387 - protein, 21 aa, Entamoeba histolytica
SFVLYFDGLIKLFSSINTSCV

SEQ ID NO: 2598388 - protein, 25 aa, Entamoeba histolytica
SFVMTRLLLGPILVEAIRIIKNYKE

SEQ ID NO: 2598389 - protein, 25 aa, Entamoeba histolytica
SFVQIFIRVFLPCFIWGVGTAFGEI

SEQ ID NO: 2598390 - protein, 17 aa, Entamoeba histolytica
SFVRQRLLLKLQQKTKN

SEQ ID NO: 2598391 - protein, 17 aa, Entamoeba histolytica
SFVSILIALVCIAPLCV

SEQ ID NO: 2598392 - protein, 20 aa, Entamoeba histolytica
SFWTYFLYYNPKILSFILHF

SEQ ID NO: 2598393 - protein, 28 aa, Entamoeba histolytica
SFYKNVAFILMQFWFGIQNAFSGQSLYE

SEQ ID NO: 2598394 - protein, 20 aa, Entamoeba histolytica
SGCYVMMIGFMYLSSYPITV

SEQ ID NO: 2598395 - protein, 24 aa, Entamoeba histolytica
SGFHDLYISLVLLSLKKSDKMKKE

SEQ ID NO: 2598396 - protein, 26 aa, Entamoeba histolytica
SGFIPLLIKILFLQIPLQKLVIQILG

SEQ ID NO: 2598397 - protein, 31 aa, Entamoeba histolytica
SGFREDIIPILRYILAPTPYSGLLTTTQVFL

SEQ ID NO: 2598398 - protein, 27 aa, Entamoeba histolytica
SGFYEYYVLVFLFSFLLMISMHYSNSI

SEQ ID NO: 2598399 - protein, 23 aa, Entamoeba histolytica
SGGEINWFYSFPGLYNQILPDSV

SEQ ID NO: 2598400 - protein, 24 aa, Entamoeba histolytica
SGIGYFVLKLLKLLFSHLPSLLDW

SEQ ID NO: 2598401 - protein, 25 aa, Entamoeba histolytica
SGIISIFVFWFVKDKTIKKLSIFNS

SEQ ID NO: 2598402 - protein, 23 aa, Entamoeba histolytica
SGIVLFALIVIPLSLMGVAEQAI

SEQ ID NO: 2598403 - protein, 20 aa, Entamoeba histolytica
SGKRMLYQFGGGAYAFHLKS

SEQ ID NO: 2598404 - protein, 25 aa, Entamoeba histolytica
SGLTRRVHFYLLGLNAKDQDIEKEQ

SEQ ID NO: 2598405 - protein, 26 aa, Entamoeba histolytica
SGNGFEYWIRFITSHPGEYVINTCSS

SEQ ID NO: 2598406 - protein, 25 aa, Entamoeba histolytica
SGNKYMLIIFHTPNNPKFVFNFEKQ

SEQ ID NO: 2598407 - protein, 24 aa, Entamoeba histolytica
SGNKYMMVIFHTPNNPKFVFHFEP

SEQ ID NO: 2598408 - protein, 35 aa, Entamoeba histolytica
SGQKCDLVPVWWNFVVVIIIIDIIIKICVIMGTAL

SEQ ID NO: 2598409 - protein, 20 aa, Entamoeba histolytica
SGSILLAYFGIEDPLRVEVP

SEQ ID NO: 2598410 - protein, 27 aa, Entamoeba histolytica
SGSPTRLCYWLSTILRLYAMIHLARFD

SEQ ID NO: 2598411 - protein, 26 aa, Entamoeba histolytica
SGTTSDIFFIIYNLRKGFPVANHITP

SEQ ID NO: 2598412 - protein, 52 aa, Entamoeba histolytica
SGTYCQKQPVVWFIVLICILGSIIVILIIAGIVSLSWYFIKKTNQNKRPANV

SEQ ID NO: 2598413 - protein, 18 aa, Entamoeba histolytica
SGVNPRFIPLPDPNGKST

SEQ ID NO: 2598414 - protein, 27 aa, Entamoeba histolytica
SHAFGIFLVLCYIIVFTATLMTWIGAA

SEQ ID NO: 2598415 - protein, 27 aa, Entamoeba histolytica
SHCFGPTYFVIFMSILFSISALIVPLI

SEQ ID NO: 2598416 - protein, 20 aa, Entamoeba histolytica
SHCYKIIFAFWKELNKAISF

SEQ ID NO: 2598417 - protein, 23 aa, Entamoeba histolytica
SHFYYVFIVLLVLFFGNMTFALT

SEQ ID NO: 2598418 - protein, 25 aa, Entamoeba histolytica
SHGLFFLPILLSLIPSVSLSHITDP

SEQ ID NO: 2598419 - protein, 38 aa, Entamoeba histolytica
SHGYWIVACFFLISIFLLIFFIILIKLLERNEWRDWIY

SEQ ID NO: 2598420 - protein, 33 aa, Entamoeba histolytica
SHHSTPVGWIVFGVLVYVLFAGILAGCVIAIIL

SEQ ID NO: 2598421 - protein, 21 aa, Entamoeba histolytica
SHILHNIILSLLQLNDQLINV

SEQ ID NO: 2598422 - protein, 25 aa, Entamoeba histolytica
SHLFENRYFPVEIINPITQQSIQGS

SEQ ID NO: 2598423 - protein, 24 aa, Entamoeba histolytica
SHLFYDLIIPYDKTYCYPITLRNE

SEQ ID NO: 2598424 - protein, 29 aa, Entamoeba histolytica
SHLVDSLYFSFLTYPITWAAVPGFVEITN

SEQ ID NO: 2598425 - protein, 24 aa, Entamoeba histolytica
SHMMLERKFLFVSDYLMTLSNTIS

SEQ ID NO: 2598426 - protein, 32 aa, Entamoeba histolytica
SHPSVYAFMSFIFLAVRFLTLGWDKIDDNYFA

SEQ ID NO: 2598427 - protein, 25 aa, Entamoeba histolytica
SHQKKYLFLTVFGCIYQLNDIHLKI

SEQ ID NO: 2598428 - protein, 20 aa, Entamoeba histolytica
SHRIFLSVLFAYCNTFFSGI

SEQ ID NO: 2598429 - protein, 40 aa, Entamoeba histolytica
SHSFSWIKLKLYPFTLNFFSYDGFLLGCVFSFNLFGCSSF

SEQ ID NO: 2598430 - protein, 27 aa, Entamoeba histolytica
SHTLYRSILLFITQFYFAFFSGFSGTS

SEQ ID NO: 2598431 - protein, 21 aa, Entamoeba histolytica
SHTPFLRKAIKERFYLFVEIE

SEQ ID NO: 2598432 - protein, 21 aa, Entamoeba histolytica
SHTPLTVFRYISGSVSFSYNF

SEQ ID NO: 2598433 - protein, 19 aa, Entamoeba histolytica
SIAEFAFYLQREVVPQLLV

SEQ ID NO: 2598434 - protein, 17 aa, Entamoeba histolytica
SIAFLIIYSEVPVTVVD

SEQ ID NO: 2598435 - protein, 25 aa, Entamoeba histolytica
SIAHPNCLFAMKNGSPLLIGIGDKR

SEQ ID NO: 2598436 - protein, 29 aa, Entamoeba histolytica
SIALDFCAILTWIFKRYRDTFIGLIEQEN

SEQ ID NO: 2598437 - protein, 19 aa, Entamoeba histolytica
SICYCSYDPYVDQSCILSC

SEQ ID NO: 2598438 - protein, 23 aa, Entamoeba histolytica
SIDPLALLPFIVESLKQLSFQLN

SEQ ID NO: 2598439 - protein, 26 aa, Entamoeba histolytica
SIEQQTFTYPLLIADSFINENIIVNE

SEQ ID NO: 2598440 - protein, 52 aa, Entamoeba histolytica
SIETKEFPMYMIAVIVVFVLVLVVVAVVFIVYIIHVYIVRKRNLKVFEEGEE

SEQ ID NO: 2598441 - protein, 26 aa, Entamoeba histolytica
SIEYERYIIFIIFSLSKQCSEFELYE

SEQ ID NO: 2598442 - protein, 27 aa, Entamoeba histolytica
SIEYPHLYLLMEFMPKHSLFNVLHSNL

SEQ ID NO: 2598443 - protein, 18 aa, Entamoeba histolytica
SIFGFIEILLSIRLQKIF

SEQ ID NO: 2598444 - protein, 19 aa, Entamoeba histolytica
SIFLNYFFDTTIVHMAPLN

SEQ ID NO: 2598445 - protein, 38 aa, Entamoeba histolytica
SIFSFLTQIIADPYYRTLKGFLILFQKEFIGFDAFISS

SEQ ID NO: 2598446 - protein, 20 aa, Entamoeba histolytica
SIFYSLIQLFPKTSIQEILK

SEQ ID NO: 2598447 - protein, 23 aa, Entamoeba histolytica
SIGSLFFLIIIHLLLSLNNTNVA

SEQ ID NO: 2598448 - protein, 34 aa, Entamoeba histolytica
SIHYRFYWQIITVDLLFVAPYWRSYLTGLSRGYI

SEQ ID NO: 2598449 - protein, 30 aa, Entamoeba histolytica
SIIAICVIVTLIVLVIGLVVFCVKKKHNKS

SEQ ID NO: 2598450 - protein, 27 aa, Entamoeba histolytica
SIIHSIIFILIYILYVCFIGYITKNKP

SEQ ID NO: 2598451 - protein, 22 aa, Entamoeba histolytica
SIIIVILIRKQIHQRRLRVINE

SEQ ID NO: 2598452 - protein, 20 aa, Entamoeba histolytica
SIILLILTPLSYKRIRIIPS

SEQ ID NO: 2598453 - protein, 18 aa, Entamoeba histolytica
SIIPFISLHWRPSLYKLG

SEQ ID NO: 2598454 - protein, 24 aa, Entamoeba histolytica
SIIQLILFINFVNRINGFDICYIK

SEQ ID NO: 2598455 - protein, 45 aa, Entamoeba histolytica
SIITLILIYLLIQQKNTFRILYIQTFVISVLILSVLIIGCIIITK

SEQ ID NO: 2598456 - protein, 20 aa, Entamoeba histolytica
SIKHLFVRPAWGKGKYTQFN

SEQ ID NO: 2598457 - protein, 27 aa, Entamoeba histolytica
SIKKFFGYFNLISYTIPISVGVTIEVC

SEQ ID NO: 2598458 - protein, 30 aa, Entamoeba histolytica
SIKQQTKFVFLLLFYKVLLCSLLSYHLVSA

SEQ ID NO: 2598459 - protein, 23 aa, Entamoeba histolytica
SIKSHVLAGYRLPFPDFISPKMK

SEQ ID NO: 2598460 - protein, 19 aa, Entamoeba histolytica
SIKSLFSYKTLLLWVIEAL

SEQ ID NO: 2598461 - protein, 23 aa, Entamoeba histolytica
SIKYFEIVTLIYQHIILPGVEGE

SEQ ID NO: 2598462 - protein, 23 aa, Entamoeba histolytica
SILDSFIFDSIQKLIIKGTVILN

SEQ ID NO: 2598463 - protein, 18 aa, Entamoeba histolytica
SILIYVGVSITILISILI

SEQ ID NO: 2598464 - protein, 32 aa, Entamoeba histolytica
SILKNMCELYKLLYTIPQFQKGFELHTNAPLL

SEQ ID NO: 2598465 - protein, 17 aa, Entamoeba histolytica
SILKVLASNDPGCYYHT

SEQ ID NO: 2598466 - protein, 41 aa, Entamoeba histolytica
SILMIMPDLIQHPNWFILVSLTRFMILFSSIIPISMRVNLD

SEQ ID NO: 2598467 - protein, 25 aa, Entamoeba histolytica
SILPFIQCVLPLINQSPACCLGYAP

SEQ ID NO: 2598468 - protein, 19 aa, Entamoeba histolytica
SILQFFGYTFFFPAFFSGP

SEQ ID NO: 2598469 - protein, 28 aa, Entamoeba histolytica
SILSTIIFFFVSLITKPIFSIPITFLPS

SEQ ID NO: 2598470 - protein, 20 aa, Entamoeba histolytica
SILTIICFFVSITSLTLAIE

SEQ ID NO: 2598471 - protein, 17 aa, Entamoeba histolytica
SILVCVYKIYQRRIQRR

SEQ ID NO: 2598472 - protein, 20 aa, Entamoeba histolytica
SILVMLFFSYQLLSIMIFTY

SEQ ID NO: 2598473 - protein, 21 aa, Entamoeba histolytica
SILYIPYVFTPLVLLICLLSC

SEQ ID NO: 2598474 - protein, 23 aa, Entamoeba histolytica
SILYIPYVFTPLVLLICLLSCII

SEQ ID NO: 2598475 - protein, 32 aa, Entamoeba histolytica
SIMIIIMVILPFILFIFTAIPFMNWRNLSTYL

SEQ ID NO: 2598476 - protein, 27 aa, Entamoeba histolytica
SINGFFIKIFFWFIIIRIIYSSNDNIN

SEQ ID NO: 2598477 - protein, 31 aa, Entamoeba histolytica
SINKNSELTLFYYFLPFSINIENDKKMYLIP

SEQ ID NO: 2598478 - protein, 39 aa, Entamoeba histolytica
SINNTKVIHTQIYSKQHKRLFNLHNIHLKGETGVDEKLT

SEQ ID NO: 2598479 - protein, 39 aa, Entamoeba histolytica
SINPPYWINVWYVYIFYYFALVFAFFFPSFTVHYINESL

SEQ ID NO: 2598480 - protein, 24 aa, Entamoeba histolytica
SINVYFTITLLCTCKEYEAIQLIT

SEQ ID NO: 2598481 - protein, 24 aa, Entamoeba histolytica
SIPFLPWKYTFYFIRYLVNSLDEI

SEQ ID NO: 2598482 - protein, 17 aa, Entamoeba histolytica
SIPFPLKNLIQLCWKQI

SEQ ID NO: 2598483 - protein, 20 aa, Entamoeba histolytica
SIPINVIVSVGLLIDKWEII

SEQ ID NO: 2598484 - protein, 26 aa, Entamoeba histolytica
SIPLENYTCLKYLVALLYELSKNAKS

SEQ ID NO: 2598485 - protein, 25 aa, Entamoeba histolytica
SIPLQTLLFLLIVAIIIVFGVYKFK

SEQ ID NO: 2598486 - protein, 20 aa, Entamoeba histolytica
SIQFQFIDSLIQILLEAFEF

SEQ ID NO: 2598487 - protein, 30 aa, Entamoeba histolytica
SIQILITYAFFSLLLLHPDWNRSLFKIDTE

SEQ ID NO: 2598488 - protein, 26 aa, Entamoeba histolytica
SIQRDVLPLLYLFIGNGNASSVLHYI

SEQ ID NO: 2598489 - protein, 30 aa, Entamoeba histolytica; identical to SEQ ID NO: 2401602

SEQ ID NO: 2598490 - protein, 26 aa, Entamoeba histolytica
SIQTLLFGIVVFPIKVIMVIDALVFL

SEQ ID NO: 2598491 - protein, 26 aa, Entamoeba histolytica
SIRGEAFIYNILFDDTYSNYFISING

SEQ ID NO: 2598492 - protein, 31 aa, Entamoeba histolytica
SIRLQKLFEKMKAFTLFLPHVNKDNLKELKI

SEQ ID NO: 2598493 - protein, 18 aa, Entamoeba histolytica
SIRSVYNFAPYIKNYYIV

SEQ ID NO: 2598494 - protein, 21 aa, Entamoeba histolytica
SISGTPLFLRNVGTHFVLAMQ

SEQ ID NO: 2598495 - protein, 27 aa, Entamoeba histolytica
SISLKNLFIHFLHFYISFDYSQLISIN

SEQ ID NO: 2598496 - protein, 25 aa, Entamoeba histolytica
SISLLLLFCYLFQKLSLSQFIIQII

SEQ ID NO: 2598497 - protein, 18 aa, Entamoeba histolytica
SISLPFTRAQNVPSAWPL

SEQ ID NO: 2598498 - protein, 20 aa, Entamoeba histolytica
SISYFKMIMIHSLGHSFSIH

SEQ ID NO: 2598499 - protein, 26 aa, Entamoeba histolytica
SITQAIYIVLYILFYSRSSVYTWEHV

SEQ ID NO: 2598500 - protein, 31 aa, Entamoeba histolytica
SITSILFILICLILVTIICVLCLIKKKSKYT

SEQ ID NO: 2598501 - protein, 25 aa, Entamoeba histolytica
SIVAYLHHEFLLKFIPTIPKNHILF

SEQ ID NO: 2598502 - protein, 17 aa, Entamoeba histolytica
SIVFRYFATWKMAECMG

SEQ ID NO: 2598503 - protein, 24 aa, Entamoeba histolytica
SIVGGIFTTFQLFDAIVFESIHTL

SEQ ID NO: 2598504 - protein, 25 aa, Entamoeba histolytica
SIVLNYLKHFSVIVKFILINKKCWD

SEQ ID NO: 2598505 - protein, 20 aa, Entamoeba histolytica
SIVLQPILMISLFSLKLASG

SEQ ID NO: 2598506 - protein, 19 aa, Entamoeba histolytica
SIVLSFLRTFSLFVVSQRE

SEQ ID NO: 2598507 - protein, 17 aa, Entamoeba histolytica
SIYSQWIEKILSPYDDV

SEQ ID NO: 2598508 - protein, 19 aa, Entamoeba histolytica
SIYSQWIEKILSPYDDVNY

SEQ ID NO: 2598509 - protein, 28 aa, Entamoeba histolytica
SKAHRNINILRIGFVASLLARSGAIVVC

SEQ ID NO: 2598510 - protein, 19 aa, Entamoeba histolytica
SKCIDLFDSNDYPIQVVFS

SEQ ID NO: 2598511 - protein, 21 aa, Entamoeba histolytica
SKCNIILTEKLFRICPSTNEK

SEQ ID NO: 2598512 - protein, 29 aa, Entamoeba histolytica
SKDKLLEYRRLLPILLNYGTGATPSIIKC

SEQ ID NO: 2598513 - protein, 26 aa, Entamoeba histolytica
SKDQLLDILSLLQLIQLSFSQQWETI

SEQ ID NO: 2598514 - protein, 33 aa, Entamoeba histolytica
SKEFFSRPIYAVICMFLRIVVSEVQLQISSHNA

SEQ ID NO: 2598515 - protein, 17 aa, Entamoeba histolytica
SKENILINSFKLIIEDF

SEQ ID NO: 2598516 - protein, 32 aa, Entamoeba histolytica; identical to SEQ ID NO: 2401626

SEQ ID NO: 2598517 - protein, 26 aa, Entamoeba histolytica
SKEVARFHFKLAKRTTAVKTLKLKIY

SEQ ID NO: 2598518 - protein, 24 aa, Entamoeba histolytica
SKFDDFFVNIVFTFTPDCVDYNQH

SEQ ID NO: 2598519 - protein, 44 aa, Entamoeba histolytica
SKHPSLFLTIFKKEWYHFLFSYILVSIYELFSLAFPLECQYIVK

SEQ ID NO: 2598520 - protein, 17 aa, Entamoeba histolytica
SKIDKPVAIPLPIEGKI

SEQ ID NO: 2598521 - protein, 26 aa, Entamoeba histolytica
SKIGFFLLFIVFAVLVVIALFVSLNA

SEQ ID NO: 2598522 - protein, 30 aa, Entamoeba histolytica
SKIIWLLYGFLFITFFLIYSSKPKEFTKSY

SEQ ID NO: 2598523 - protein, 39 aa, Entamoeba histolytica
SKISKYIILYFVIVLTMSVLYLTWLCVLSNKLDEYQIKL

SEQ ID NO: 2598524 - protein, 22 aa, Entamoeba histolytica
SKITCLLYHDYYSVCTDKEDEC

SEQ ID NO: 2598525 - protein, 24 aa, Entamoeba histolytica
SKIWGKHELSFELKIKILDDLAIA

SEQ ID NO: 2598526 - protein, 17 aa, Entamoeba histolytica
SKKIVLLCNNPSKLYQC

SEQ ID NO: 2598527 - protein, 28 aa, Entamoeba histolytica
SKKSFLIYIFALLLLIIENLLRFIVHLY

SEQ ID NO: 2598528 - protein, 18 aa, Entamoeba histolytica
SKLAIVVFSVLCGTLGLS

SEQ ID NO: 2598529 - protein, 23 aa, Entamoeba histolytica
SKLRNPFIVNYIGSVTYIPEICM

SEQ ID NO: 2598530 - protein, 19 aa, Entamoeba histolytica
SKLVVISFLVLTFASLEFE

SEQ ID NO: 2598531 - protein, 19 aa, Entamoeba histolytica
SKMLKKFNYVVVVIYILIQ

SEQ ID NO: 2598532 - protein, 25 aa, Entamoeba histolytica
SKNKIFIQFTYIETQYPKYSLRIVP

SEQ ID NO: 2598533 - protein, 24 aa, Entamoeba histolytica
SKNNKFYIKVFSIILENMQDLLAG

SEQ ID NO: 2598534 - protein, 21 aa, Entamoeba histolytica
SKQLYGLYDLSFPIFSQQNAK

SEQ ID NO: 2598535 - protein, 23 aa, Entamoeba histolytica
SKRKDMMIIFHTPNNPKYVFHFN

SEQ ID NO: 2598536 - protein, 24 aa, Entamoeba histolytica
SKRNISHFPPYQSLTLLLKDVLSI

SEQ ID NO: 2598537 - protein, 25 aa, Entamoeba histolytica
SKRYKRSVWYKVFVPRRGTISVNTC

SEQ ID NO: 2598538 - protein, 24 aa, Entamoeba histolytica
SKSDTPCVLVIKPSYDTNTNKVHI

SEQ ID NO: 2598539 - protein, 26 aa, Entamoeba histolytica
SKSGQPFLFLFYVSSLFHSMSDYLPI

SEQ ID NO: 2598540 - protein, 24 aa, Entamoeba histolytica
SKTDVQILFRRWGDVFTLGHEGFN

SEQ ID NO: 2598541 - protein, 25 aa, Entamoeba histolytica
SKTLHKTICLIALINALKQTDIAQN

SEQ ID NO: 2598542 - protein, 25 aa, Entamoeba histolytica
SKTLTFMRMNVLIKFYGETLACLIY

SEQ ID NO: 2598543 - protein, 24 aa, Entamoeba histolytica
SKTVFMLIMISLAVLFMVAGGMMI

SEQ ID NO: 2598544 - protein, 31 aa, Entamoeba histolytica
SKVIFKTCGTIKTLKFLLSDVTLTKPNGQSS

SEQ ID NO: 2598545 - protein, 28 aa, Entamoeba histolytica
SKYELTQVCRIYVALVPKGYTITECPKD

SEQ ID NO: 2598546 - protein, 29 aa, Entamoeba histolytica
SKYELTQVCRIYVALVPKGYTITECPKDP

SEQ ID NO: 2598547 - protein, 21 aa, Entamoeba histolytica
SKYWDFFTLYIFVAVVAILVI

SEQ ID NO: 2598548 - protein, 25 aa, Entamoeba histolytica
SLAFRFSILLSFLYFMIFSVYDVKY

SEQ ID NO: 2598549 - protein, 28 aa, Entamoeba histolytica
SLATIVYFIYTWYYYNRAIYLTGAGTMG

SEQ ID NO: 2598550 - protein, 28 aa, Entamoeba histolytica
SLAVQLVFLCYIIFSAFPKFLFGSILQK

SEQ ID NO: 2598551 - protein, 21 aa, Entamoeba histolytica
SLCLIMEYFPLGSIRKFYTEH

SEQ ID NO: 2598552 - protein, 24 aa, Entamoeba histolytica
SLDETFFLEDPPIYSVVDALKELY

SEQ ID NO: 2598553 - protein, 32 aa, Entamoeba histolytica
SLDNLYCRMSFYDKDYIKLTSNFYFVITAEKL

SEQ ID NO: 2598554 - protein, 24 aa, Entamoeba histolytica
SLEDAQYISDFWLKAISISNYAVT

SEQ ID NO: 2598555 - protein, 26 aa, Entamoeba histolytica
SLEKVLKLVLLTLYHRKKYSITSTDF

SEQ ID NO: 2598556 - protein, 25 aa, Entamoeba histolytica
SLEVIISIVWLFCVVQWSAFAGLVI

SEQ ID NO: 2598557 - protein, 19 aa, Entamoeba histolytica
SLFCLQCAENFYFVSSNTC

SEQ ID NO: 2598558 - protein, 29 aa, Entamoeba histolytica
SLFEAYIWNTPYPIEKFKYPWDIAQFIGS

SEQ ID NO: 2598559 - protein, 22 aa, Entamoeba histolytica
SLFFSHIIWFYTATLIVMAFYC

SEQ ID NO: 2598560 - protein, 25 aa, Entamoeba histolytica
SLFIVHALSIYPHFINLLVKYDITV

SEQ ID NO: 2598561 - protein, 18 aa, Entamoeba histolytica
SLFLFSYALYDTCQTAHE

SEQ ID NO: 2598562 - protein, 24 aa, Entamoeba histolytica
SLFMQWDYWILPETKIEFIGERRA

SEQ ID NO: 2598563 - protein, 32 aa, Entamoeba histolytica
SLFTSFPDGFYLYFYKRFPGLLILVYNVVKKH

SEQ ID NO: 2598564 - protein, 19 aa, Entamoeba histolytica
SLGCLYYLHNSYGCAICKN

SEQ ID NO: 2598565 - protein, 19 aa, Entamoeba histolytica
SLGKLFYIEALSLSLSTET

SEQ ID NO: 2598566 - protein, 24 aa, Entamoeba histolytica
SLGTRFFLQSFSMLKELFAPTEEF

SEQ ID NO: 2598567 - protein, 36 aa, Entamoeba histolytica
SLGVIVGALLLFIIIIFMVFLRRRKIQQEKEMRVFL

SEQ ID NO: 2598568 - protein, 33 aa, Entamoeba histolytica
SLGYMSIIFLLLILFIESLLFCLYWITKSNKAH

SEQ ID NO: 2598569 - protein, 20 aa, Entamoeba histolytica
SLHFVLHLMHSLHVILLVDD

SEQ ID NO: 2598570 - protein, 23 aa, Entamoeba histolytica
SLILFVIHYFRRSIIFPLRMSKG

SEQ ID NO: 2598571 - protein, 18 aa, Entamoeba histolytica
SLILHLTIEENVKRDINV

SEQ ID NO: 2598572 - protein, 23 aa, Entamoeba histolytica
SLILYHVLIFIIYPSILQTKTRL

SEQ ID NO: 2598573 - protein, 17 aa, Entamoeba histolytica
SLINRYNVLDRWKTFSF

SEQ ID NO: 2598574 - protein, 26 aa, Entamoeba histolytica
SLISFKMLRSILFQAAYQLIITLTIV

SEQ ID NO: 2598575 - protein, 27 aa, Entamoeba histolytica
SLISIHINLLPYLLPFINKIDSENSAI

SEQ ID NO: 2598576 - protein, 18 aa, Entamoeba histolytica
SLITMLFWYDTPVGIISI

SEQ ID NO: 2598577 - protein, 26 aa, Entamoeba histolytica
SLITTLFFYLMSIVTAIWVLENMARS

SEQ ID NO: 2598578 - protein, 29 aa, Entamoeba histolytica
SLKDKKARLLWFRNYFIGVLISIITNVDL

SEQ ID NO: 2598579 - protein, 25 aa, Entamoeba histolytica
SLKLFLNLILLLKRLCNTIKETIIA

SEQ ID NO: 2598580 - protein, 24 aa, Entamoeba histolytica
SLKTKPIRKYWLLTDVFLHEHGCN

SEQ ID NO: 2598581 - protein, 17 aa, Entamoeba histolytica
SLKWRFIDISHNAIKLC

SEQ ID NO: 2598582 - protein, 18 aa, Entamoeba histolytica
SLLEFFGYTFFFPGIFSG

SEQ ID NO: 2598583 - protein, 30 aa, Entamoeba histolytica
SLLETFTFNGFFCFPFVDYSFLSDTTKVSG

SEQ ID NO: 2598584 - protein, 29 aa, Entamoeba histolytica
SLLGFVMCLCFMMIGISYIKGIFKQAFFN

SEQ ID NO: 2598585 - protein, 26 aa, Entamoeba histolytica
SLLISSLFDLHVILLPNAPEAQRVKD

SEQ ID NO: 2598586 - protein, 20 aa, Entamoeba histolytica
SLLLPVFLMVFIPSNFLIFQ

SEQ ID NO: 2598587 - protein, 20 aa, Entamoeba histolytica
SLLLSFNRFLLDYVTREFEI

SEQ ID NO: 2598588 - protein, 20 aa, Entamoeba histolytica
SLLNHMYFAGYFNSLNVTMA

SEQ ID NO: 2598589 - protein, 38 aa, Entamoeba histolytica
SLLSIKIPHLFPYLSMVFNYLFEFIPTSIYNSLVITYF

SEQ ID NO: 2598590 - protein, 31 aa, Entamoeba histolytica
SLLSPKMIRSILSQTLWQYACCLTIVFAGRY

SEQ ID NO: 2598591 - protein, 18 aa, Entamoeba histolytica
SLLSVKISVALPANFREM

SEQ ID NO: 2598592 - protein, 19 aa, Entamoeba histolytica
SLLSVKISVALPANFREML

SEQ ID NO: 2598593 - protein, 19 aa, Entamoeba histolytica
SLMFFSMALCTFPYLLLKY

SEQ ID NO: 2598594 - protein, 19 aa, Entamoeba histolytica
SLMFHLYLPARNDFYETLL

SEQ ID NO: 2598595 - protein, 17 aa, Entamoeba histolytica
SLMVFKISNQNHYTIRT

SEQ ID NO: 2598596 - protein, 32 aa, Entamoeba histolytica
SLNLKKPYKNIFKWGLILALVNAITNLSNFIV

SEQ ID NO: 2598597 - protein, 32 aa, Entamoeba histolytica
SLNLKKPYKSIFKWGLILALVNAITNLSNFIV

SEQ ID NO: 2598598 - protein, 31 aa, Entamoeba histolytica
SLNSEHRNTLSRYLFLMNIIAVNQRLNRMGE

SEQ ID NO: 2598599 - protein, 27 aa, Entamoeba histolytica
SLPEDWFEFGLILSKTPMFCQYLYKNN

SEQ ID NO: 2598600 - protein, 18 aa, Entamoeba histolytica
SLPHTFYFDDITLVKDEN

SEQ ID NO: 2598601 - protein, 18 aa, Entamoeba histolytica
SLPSFSFKVYGGLNITGE

SEQ ID NO: 2598602 - protein, 21 aa, Entamoeba histolytica
SLPSLPFISSSFSLSLFPLFN

SEQ ID NO: 2598603 - protein, 27 aa, Entamoeba histolytica
SLQIPYLTYIALLFFGTSYAFFLYKTF

SEQ ID NO: 2598604 - protein, 38 aa, Entamoeba histolytica
SLQKCILGLVALLIIFQAFVLIFIFTSGYVTLDNYKLS

SEQ ID NO: 2598605 - protein, 44 aa, Entamoeba histolytica
SLRGKVINFILWFFYGIYQSLIFFFVFFWFISPSDITGKDGLNG

SEQ ID NO: 2598606 - protein, 21 aa, Entamoeba histolytica
SLRIQYGEFVYFTGGDLDGSQ

SEQ ID NO: 2598607 - protein, 17 aa, Entamoeba histolytica
SLSDLRWIKSNLITASS

SEQ ID NO: 2598608 - protein, 21 aa, Entamoeba histolytica
SLSGIDLVIFSYTRGNKMYCG

SEQ ID NO: 2598609 - protein, 24 aa, Entamoeba histolytica
SLSIFIDFDIFNITQFPFLKFEST

SEQ ID NO: 2598610 - protein, 23 aa, Entamoeba histolytica
SLSLCCMPFIYKRSILSRYGCCY

SEQ ID NO: 2598611 - protein, 28 aa, Entamoeba histolytica
SLSLFPLFNLDFFISPKLHYLMFSNHSI

SEQ ID NO: 2598612 - protein, 23 aa, Entamoeba histolytica
SLSLTIILVFISTITFIILFVIA

SEQ ID NO: 2598613 - protein, 23 aa, Entamoeba histolytica
SLSLYPKLKMLVITSNKAYPIKY

SEQ ID NO: 2598614 - protein, 25 aa, Entamoeba histolytica
SLSTFNFYLLFHTASWIGLNCNNII

SEQ ID NO: 2598615 - protein, 20 aa, Entamoeba histolytica
SLSYLPLTKEYLNTPISITW

SEQ ID NO: 2598616 - protein, 23 aa, Entamoeba histolytica
SLTLQYDLPRMIGIGLFTDVSTS

SEQ ID NO: 2598617 - protein, 28 aa, Entamoeba histolytica
SLTTTYLSLFEFFLQILPVVNVENIDLY

SEQ ID NO: 2598618 - protein, 40 aa, Entamoeba histolytica
SLVAYHFELLPSIEFLPICISFIVLMISYNIYLVVINYYK

SEQ ID NO: 2598619 - protein, 26 aa, Entamoeba histolytica
SLVFLPAWYVFGFYIIVTQLTVFITE

SEQ ID NO: 2598620 - protein, 18 aa, Entamoeba histolytica
SLVFLQIFIIVIQKRYGA

SEQ ID NO: 2598621 - protein, 20 aa, Entamoeba histolytica
SLVFPYPVKVSKHYSYLYSD

SEQ ID NO: 2598622 - protein, 25 aa, Entamoeba histolytica
SLVIIRLFIHFVLSSDDYFQCFIPF

SEQ ID NO: 2598623 - protein, 21 aa, Entamoeba histolytica
SLVLLVMTSSSVFKLFQVVEF

SEQ ID NO: 2598624 - protein, 18 aa, Entamoeba histolytica
SLVPPKSYLFTNVINLLK

SEQ ID NO: 2598625 - protein, 25 aa, Entamoeba histolytica
SLVTFVWIVYFFLIRNWLSLHILIP

SEQ ID NO: 2598626 - protein, 28 aa, Entamoeba histolytica
SLWKKEQGPIILLPFLVKYSKQRQFTEE

SEQ ID NO: 2598627 - protein, 19 aa, Entamoeba histolytica
SLWTMLLSPEEMSPKHVLA

SEQ ID NO: 2598628 - protein, 20 aa, Entamoeba histolytica
SLYIPPCRPLINLTYFIALM

SEQ ID NO: 2598629 - protein, 28 aa, Entamoeba histolytica
SLYSCYLLPFLFFLGFVYSLGSLYINGI

SEQ ID NO: 2598630 - protein, 22 aa, Entamoeba histolytica
SMALCTFPYLLLKYVFSDKMSK

SEQ ID NO: 2598631 - protein, 29 aa, Entamoeba histolytica
SMCLTMRFFIMLRIYLSKHIKELPIFDTE

SEQ ID NO: 2598632 - protein, 28 aa, Entamoeba histolytica
SMFLLLLCFLSDLFLCEAQKQEWPLFHS

SEQ ID NO: 2598633 - protein, 22 aa, Entamoeba histolytica
SMFNADYLLFMPTDDGHFQPNP

SEQ ID NO: 2598634 - protein, 32 aa, Entamoeba histolytica
SMIRLMFQDLPTNIIWFAFVTEPVVNLDIEIP

SEQ ID NO: 2598635 - protein, 25 aa, Entamoeba histolytica
SMKAIEIFFRFCELDLFKESKEILK

SEQ ID NO: 2598636 - protein, 17 aa, Entamoeba histolytica
SMKCDIEPYIRPVVFVN

SEQ ID NO: 2598637 - protein, 22 aa, Entamoeba histolytica
SMKDYIFEELFDKCKKLYIDEC

SEQ ID NO: 2598638 - protein, 17 aa, Entamoeba histolytica
SMKESPKQLIWRCLLNA

SEQ ID NO: 2598639 - protein, 17 aa, Entamoeba histolytica
SMKLFKLDGIELQEIEA

SEQ ID NO: 2598640 - protein, 23 aa, Entamoeba histolytica
SMKSQIMFIGMGGITFGYCKNDY

SEQ ID NO: 2598641 - protein, 22 aa, Entamoeba histolytica
SMLLSFFLFHIVSFIISLIIFF

SEQ ID NO: 2598642 - protein, 28 aa, Entamoeba histolytica
SMNLHNNIIILLLQLLRSSFLINVDKTI

SEQ ID NO: 2598643 - protein, 23 aa, Entamoeba histolytica
SMNVPSVLLPYPTKQHSIDYTIE

SEQ ID NO: 2598644 - protein, 21 aa, Entamoeba histolytica
SMPVFLQRIVGVVLALIAGIF

SEQ ID NO: 2598645 - protein, 18 aa, Entamoeba histolytica
SMYKVLDQILLFQDDFIG

SEQ ID NO: 2598646 - protein, 19 aa, Entamoeba histolytica
SNCIDLFDSNNYPIQVIFP

SEQ ID NO: 2598647 - protein, 24 aa, Entamoeba histolytica
SNCNWLLCILSYIAGLSSGFANQT

SEQ ID NO: 2598648 - protein, 24 aa, Entamoeba histolytica
SNDEPFSVFLNSNTFILFIGLLNG

SEQ ID NO: 2598649 - protein, 25 aa, Entamoeba histolytica
SNEKQTWLPKLKTVAVIGTIIIGTI

SEQ ID NO: 2598650 - protein, 31 aa, Entamoeba histolytica
SNEVKAYLVIFYALLIYFPQLPSTTIETYLN

SEQ ID NO: 2598651 - protein, 17 aa, Entamoeba histolytica
SNFHFYFYVILAGMYVL

SEQ ID NO: 2598652 - protein, 23 aa, Entamoeba histolytica
SNGNLLGYWILSIITLIGQLAPI

SEQ ID NO: 2598653 - protein, 26 aa, Entamoeba histolytica
SNGNPITFIKFEFGKCYYMGSAEGVT

SEQ ID NO: 2598654 - protein, 20 aa, Entamoeba histolytica
SNGYIRFYGFTKYDNYDNYL

SEQ ID NO: 2598655 - protein, 34 aa, Entamoeba histolytica
SNHILPCYFSNLQDFLFYLISLPLDSKFFTVFEE

SEQ ID NO: 2598656 - protein, 23 aa, Entamoeba histolytica
SNIFQFLTLYSCLSNILITGISP

SEQ ID NO: 2598657 - protein, 21 aa, Entamoeba histolytica
SNIIRISIIAIILSVICFYNF

SEQ ID NO: 2598658 - protein, 24 aa, Entamoeba histolytica
SNIITVISLILFTSAFQKYPLFLL

SEQ ID NO: 2598659 - protein, 20 aa, Entamoeba histolytica
SNIKPIFYLKPSSFCDKLKL

SEQ ID NO: 2598660 - protein, 59 aa, Entamoeba histolytica
SNITSPFIYNLFISLFNDLNALWKLWDYLLLSEDPCFFVFILTALFLLKEHTLGDSTED

SEQ ID NO: 2598661 - protein, 18 aa, Entamoeba histolytica
SNIYDDYIWILRSQELSN

SEQ ID NO: 2598662 - protein, 26 aa, Entamoeba histolytica
SNKDKLIYHYILKSIPSFIEHFNCDN

SEQ ID NO: 2598663 - protein, 20 aa, Entamoeba histolytica
SNKKAWKYALISILSIVDMD

SEQ ID NO: 2598664 - protein, 17 aa, Entamoeba histolytica
SNLIFGPNIKSIYINKL

SEQ ID NO: 2598665 - protein, 22 aa, Entamoeba histolytica
SNLISLLSFISTGVTIGGLTFD

SEQ ID NO: 2598666 - protein, 25 aa, Entamoeba histolytica
SNLPRWLKWIYTISYYRITRNICLC

SEQ ID NO: 2598667 - protein, 26 aa, Entamoeba histolytica
SNLSIISPFLPFLNLTRRFDSQLIQL

SEQ ID NO: 2598668 - protein, 23 aa, Entamoeba histolytica
SNNLSILEIPLITNSFPIGVLNY

SEQ ID NO: 2598669 - protein, 24 aa, Entamoeba histolytica
SNNRVKHWIGGLLSIVCIITMIWM

SEQ ID NO: 2598670 - protein, 25 aa, Entamoeba histolytica
SNPAWSLWSLLVIAVLWALPQSMTM

SEQ ID NO: 2598671 - protein, 24 aa, Entamoeba histolytica
SNPRININFIKGKVYYILLSMKDG

SEQ ID NO: 2598672 - protein, 26 aa, Entamoeba histolytica
SNPSKLFSIPMLYQEYIRCLESIMFY

SEQ ID NO: 2598673 - protein, 24 aa, Entamoeba histolytica
SNQIEHLILFTPLPLKSQLNEYFS

SEQ ID NO: 2598674 - protein, 24 aa, Entamoeba histolytica
SNRGYGWKLIWDGTIDWIIFTGEC

SEQ ID NO: 2598675 - protein, 21 aa, Entamoeba histolytica
SNSFEPILWISFDNILNDFDI

SEQ ID NO: 2598676 - protein, 31 aa, Entamoeba histolytica
SNSKRALIVIFVVLVLLACVVVGFVYFRRNK

SEQ ID NO: 2598677 - protein, 23 aa, Entamoeba histolytica
SNSLAISTLILTKAILNNVTLSE

SEQ ID NO: 2598678 - protein, 25 aa, Entamoeba histolytica
SNSYKGCLIGYFEEHKFSCITCSDG

SEQ ID NO: 2598679 - protein, 27 aa, Entamoeba histolytica
SNTIVFLLSLLYFSASIFHLLEGFNPS

SEQ ID NO: 2598680 - protein, 26 aa, Entamoeba histolytica
SNTLLGRLLQIFFLEKLDGYGDPLKD

SEQ ID NO: 2598681 - protein, 23 aa, Entamoeba histolytica
SNTLMTMYWLFKNQPQMCDTQTW

SEQ ID NO: 2598682 - protein, 26 aa, Entamoeba histolytica
SNTLYSLLFPFVCFYLCCVLLNYVKQ

SEQ ID NO: 2598683 - protein, 20 aa, Entamoeba histolytica
SNVMFKQVPNSPICISKTVL

SEQ ID NO: 2598684 - protein, 26 aa, Entamoeba histolytica
SNWFFTLWYFILSCLTFFITGVLGLV

SEQ ID NO: 2598685 - protein, 17 aa, Entamoeba histolytica
SNYLFEDLYIHAHYLQT

SEQ ID NO: 2598686 - protein, 22 aa, Entamoeba histolytica
SNYNIIFNFLKSELPKAKNRDS

SEQ ID NO: 2598687 - protein, 23 aa, Entamoeba histolytica
SNYSQWIEKILSPYDDVNYIVSL

SEQ ID NO: 2598688 - protein, 23 aa, Entamoeba histolytica
SNYSQWIEKILSPYDDVNYIVSW

SEQ ID NO: 2598689 - protein, 23 aa, Entamoeba histolytica
SPALYIMAFFITSSILTKVGMNK

SEQ ID NO: 2598690 - protein, 21 aa, Entamoeba histolytica
SPALYLQTFPLLKNAFETFEQ

SEQ ID NO: 2598691 - protein, 24 aa, Entamoeba histolytica
SPASLIKGFFNYFKNYNWNEPITI

SEQ ID NO: 2598692 - protein, 23 aa, Entamoeba histolytica
SPDFSYIFNVIKKEVMKKWPENA

SEQ ID NO: 2598693 - protein, 33 aa, Entamoeba histolytica
SPDIFLPIHQPIRNVLLKLLPSLISYIGIEPIH

SEQ ID NO: 2598694 - protein, 20 aa, Entamoeba histolytica
SPFILKFKELNENISNIEEV

SEQ ID NO: 2598695 - protein, 26 aa, Entamoeba histolytica
SPKITWRHQIMLWYAGLRGAIAVLLS

SEQ ID NO: 2598696 - protein, 24 aa, Entamoeba histolytica
SPKLQLHLLSLVKLLMKVSDITHP

SEQ ID NO: 2598697 - protein, 23 aa, Entamoeba histolytica
SPLKLMNTLLLLPEEYQKDVIFQ

SEQ ID NO: 2598698 - protein, 20 aa, Entamoeba histolytica
SPLTEILMYDLKLPSEIIKN

SEQ ID NO: 2598699 - protein, 23 aa, Entamoeba histolytica
SPSPFVTCICRCGGIALLLSLIE

SEQ ID NO: 2598700 - protein, 18 aa, Entamoeba histolytica
SPVALINAPYIYGKWFKL

SEQ ID NO: 2598701 - protein, 26 aa, Entamoeba histolytica
SPVFPFPIINYILPPVVDFIPYAIGT

SEQ ID NO: 2598702 - protein, 41 aa, Entamoeba histolytica; identical to SEQ ID NO: 2401813

SEQ ID NO: 2598703 - protein, 26 aa, Entamoeba histolytica
SQCPSPYQIPKYPFKEEFTFDANSKH

SEQ ID NO: 2598704 - protein, 24 aa, Entamoeba histolytica
SQDYVPYQAFLFDAMLVASHGIQS

SEQ ID NO: 2598705 - protein, 23 aa, Entamoeba histolytica
SQEYVFRYFLFNELLQSLHPLFS

SEQ ID NO: 2598706 - protein, 24 aa, Entamoeba histolytica
SQGGIIPILFFLASIVLIISPRII

SEQ ID NO: 2598707 - protein, 18 aa, Entamoeba histolytica
SQGKPLQLCLCPLCINGI

SEQ ID NO: 2598708 - protein, 24 aa, Entamoeba histolytica
SQIAALMFPLISYAIEEKSYFENS

SEQ ID NO: 2598709 - protein, 20 aa, Entamoeba histolytica
SQILFFIVWVTRYLDIFYNF

SEQ ID NO: 2598710 - protein, 26 aa, Entamoeba histolytica
SQLPLKYFIIPFILSIGIILIIHFTE

SEQ ID NO: 2598711 - protein, 19 aa, Entamoeba histolytica
SQLQIENYQWSWSSWLIGG

SEQ ID NO: 2598712 - protein, 24 aa, Entamoeba histolytica
SQMGNNYIVCSPNWAYIGDESKYT

SEQ ID NO: 2598713 - protein, 30 aa, Entamoeba histolytica
SQPDNLLTKLIYWLAGMSFTPMVALEVIPF

SEQ ID NO: 2598714 - protein, 18 aa, Entamoeba histolytica
SQPTTFIDFIWKIQNVFS

SEQ ID NO: 2598715 - protein, 30 aa, Entamoeba histolytica
SQQKIEQVPNIILLFYKSLEEWYIHNDIPN

SEQ ID NO: 2598716 - protein, 31 aa, Entamoeba histolytica
SQREGIKPRRLYFKSLLRQDATWYDFQESGE

SEQ ID NO: 2598717 - protein, 37 aa, Entamoeba histolytica
SQRSAMLLYLRLYATLFILFILSVFSLHYFLIVCFSL

SEQ ID NO: 2598718 - protein, 25 aa, Entamoeba histolytica
SQTEKLFKETLFFFTADENASNIYT

SEQ ID NO: 2598719 - protein, 24 aa, Entamoeba histolytica
SQTNYLIFMNLLNSGSLTLLVLIQ

SEQ ID NO: 2598720 - protein, 32 aa, Entamoeba histolytica
SQVKPHFVTLSFYKIFGFPMGIGALLMRKDVV

SEQ ID NO: 2598721 - protein, 23 aa, Entamoeba histolytica
SQYDIFFLFCDIPNYIKMNYKAH

SEQ ID NO: 2598722 - protein, 20 aa, Entamoeba histolytica
SRCLFFRVVSLSNLLTLISA

SEQ ID NO: 2598723 - protein, 25 aa, Entamoeba histolytica
SRCYSILLTIAYVKILLAYINDIAS

SEQ ID NO: 2598724 - protein, 20 aa, Entamoeba histolytica
SRDLLKHKWFITNGIKIEES

SEQ ID NO: 2598725 - protein, 19 aa, Entamoeba histolytica
SRFIVRLYQFLFKQNTVQE

SEQ ID NO: 2598726 - protein, 28 aa, Entamoeba histolytica
SRIASILTLINRYFIQELPFNKPQEDFN

SEQ ID NO: 2598727 - protein, 27 aa, Entamoeba histolytica
SRIIDVFGILLILIIICLINGVPISSY

SEQ ID NO: 2598728 - protein, 27 aa, Entamoeba histolytica
SRIQLFIFIIFFFYLCSSLINSGFWIT

SEQ ID NO: 2598729 - protein, 29 aa, Entamoeba histolytica
SRKAVERMVILMYFGVAIPDILVYLGVTR

SEQ ID NO: 2598730 - protein, 23 aa, Entamoeba histolytica
SRKLSSLSFLPLGHVFAIVMEFI

SEQ ID NO: 2598731 - protein, 23 aa, Entamoeba histolytica
SRKPLLTYMLLKLDCPIKEEQLA

SEQ ID NO: 2598732 - protein, 35 aa, Entamoeba histolytica
SRKRVVFDLLLEQYFRYFFMHWCDSVQFAFQTILL

SEQ ID NO: 2598733 - protein, 24 aa, Entamoeba histolytica
SRSYLTVIVVVIFGILLVGVVIGF

SEQ ID NO: 2598734 - protein, 21 aa, Entamoeba histolytica
SRVPSVHLSWYKTLSEKQGER

SEQ ID NO: 2598735 - protein, 20 aa, Entamoeba histolytica
SRYLFILMSSKIPDSLLNIN

SEQ ID NO: 2598736 - protein, 47 aa, Entamoeba histolytica; identical to SEQ ID NO: 2401847

SEQ ID NO: 2598737 - protein, 22 aa, Entamoeba histolytica
SSAVMELLFVLASLRQISVPNA

SEQ ID NO: 2598738 - protein, 18 aa, Entamoeba histolytica
SSCISCEDNFFLYNGRQC

SEQ ID NO: 2598739 - protein, 24 aa, Entamoeba histolytica
SSDDWFDIRVLLLSIAANALYELK

SEQ ID NO: 2598740 - protein, 28 aa, Entamoeba histolytica
SSDDYFQCFIPFISILIGNIFPSLIPLL

SEQ ID NO: 2598741 - protein, 26 aa, Entamoeba histolytica
SSELLLPFNLPILSPLYYIIQSIESS

SEQ ID NO: 2598742 - protein, 20 aa, Entamoeba histolytica
SSELWRLYNTKLIVTSILID

SEQ ID NO: 2598743 - protein, 25 aa, Entamoeba histolytica
SSEMETRMYVKKPVILLYDDTTKEK

SEQ ID NO: 2598744 - protein, 22 aa, Entamoeba histolytica
SSEPRYLFPEKIQYVPTIIQRL

SEQ ID NO: 2598745 - protein, 20 aa, Entamoeba histolytica
SSFMLPCAVVMLFIQIFADC

SEQ ID NO: 2598746 - protein, 17 aa, Entamoeba histolytica
SSFSFATTFFFLVFSHL

SEQ ID NO: 2598747 - protein, 29 aa, Entamoeba histolytica
SSGKSTLLNYLFNTKFRILNEVMGRSRTT

SEQ ID NO: 2598748 - protein, 28 aa, Entamoeba histolytica
SSHDFLKHVCIVWNKCYYYISDRQLTNQ

SEQ ID NO: 2598749 - protein, 24 aa, Entamoeba histolytica
SSIGFFIVGLIFQLLAETSMFVDA

SEQ ID NO: 2598750 - protein, 24 aa, Entamoeba histolytica
SSIINIPTLLFSLGQLIIGGVSRG

SEQ ID NO: 2598751 - protein, 24 aa, Entamoeba histolytica
SSIKDICWIIMKIEKLAQLERINQ

SEQ ID NO: 2598752 - protein, 29 aa, Entamoeba histolytica
SSILSSILYLLHLYLSYNPSKFDKLIPFV

SEQ ID NO: 2598753 - protein, 18 aa, Entamoeba histolytica
SSIPFVFTLLVELTDNMS

SEQ ID NO: 2598754 - protein, 27 aa, Entamoeba histolytica
SSIVYIPLTIWYVFSWGLTPAYIFMSV

SEQ ID NO: 2598755 - protein, 19 aa, Entamoeba histolytica
SSKGFKWLLKAATKGYAKA

SEQ ID NO: 2598756 - protein, 25 aa, Entamoeba histolytica
SSKIIAIKDIAFTLPPLFSNDHAKT

SEQ ID NO: 2598757 - protein, 24 aa, Entamoeba histolytica
SSKKDYFIFVSYQTSSFAMINFSV

SEQ ID NO: 2598758 - protein, 32 aa, Entamoeba histolytica
SSKKKNFYFDSFKAILPFKFIIDQSTVKTQIV

SEQ ID NO: 2598759 - protein, 22 aa, Entamoeba histolytica
SSKVVLLYYQKKEFRIPISIFI

SEQ ID NO: 2598760 - protein, 36 aa, Entamoeba histolytica
SSKWMTIIFHTPKTPKYVFYFEPQILTIKGKHKKTE

SEQ ID NO: 2598761 - protein, 51 aa, Entamoeba histolytica; identical to SEQ ID NO: 2401871

SEQ ID NO: 2598762 - protein, 20 aa, Entamoeba histolytica
SSLFVFWKIIITSIFCVFVV

SEQ ID NO: 2598763 - protein, 24 aa, Entamoeba histolytica
SSLIQFITDKYYWTYNGFVELIFV

SEQ ID NO: 2598764 - protein, 25 aa, Entamoeba histolytica
SSLKKCIIEFPKPVYHLHLTTPTQT

SEQ ID NO: 2598765 - protein, 25 aa, Entamoeba histolytica
SSLLFLWCICIFPKFYFILEYISYK

SEQ ID NO: 2598766 - protein, 34 aa, Entamoeba histolytica
SSLMKAIFVCYFPRLLMTVPYFIIMIGTETILPV

SEQ ID NO: 2598767 - protein, 20 aa, Entamoeba histolytica
SSLPLFLVTPQRLSHLYDLA

SEQ ID NO: 2598768 - protein, 26 aa, Entamoeba histolytica
SSLSLFFLHFWRSCLIFIVLPSFYIF

SEQ ID NO: 2598769 - protein, 26 aa, Entamoeba histolytica
SSLTVLIDYFILAVTIIVAAVPEGLP

SEQ ID NO: 2598770 - protein, 31 aa, Entamoeba histolytica
SSNSLILRSLALVWLLFQECNYVIIIDKQKR

SEQ ID NO: 2598771 - protein, 18 aa, Entamoeba histolytica
SSPALQPLLLLTVDFHEL

SEQ ID NO: 2598772 - protein, 19 aa, Entamoeba histolytica
SSPMTKFQIFFTKVKHPCS

SEQ ID NO: 2598773 - protein, 43 aa, Entamoeba histolytica
SSPNAILLFRAIVSTIKIIIPLLPLLPEKLFDNSIPRIFTIFN

SEQ ID NO: 2598774 - protein, 21 aa, Entamoeba histolytica
SSPNWLGWKNGYGLKEDKTWV

SEQ ID NO: 2598775 - protein, 31 aa, Entamoeba histolytica
SSQDFLKHICIVWNKCYYYISDRQLTNQKEI

SEQ ID NO: 2598776 - protein, 33 aa, Entamoeba histolytica
SSRIIRSFTKGIYYIFVFTPYNKGFSFDTTVYL

SEQ ID NO: 2598777 - protein, 44 aa, Entamoeba histolytica
SSRISIYILFGIILIVSLFSIFYYFYTLLKNKLLILFGNTMENK

SEQ ID NO: 2598778 - protein, 29 aa, Entamoeba histolytica
SSRMKPLLTFFLSLYPYWNPYDPQHNTII

SEQ ID NO: 2598779 - protein, 25 aa, Entamoeba histolytica
SSSITNPMILFYTRARRVNVDKQCD

SEQ ID NO: 2598780 - protein, 18 aa, Entamoeba histolytica
SSSLLFIPGIYGDKNYIF

SEQ ID NO: 2598781 - protein, 23 aa, Entamoeba histolytica
SSSLPWLVFIYLIKPVMSISSTF

SEQ ID NO: 2598782 - protein, 23 aa, Entamoeba histolytica
SSSSLIYFELANVLYNVAVSHIL

SEQ ID NO: 2598783 - protein, 25 aa, Entamoeba histolytica
SSSYIDLKRMDLVFNKDPSITSGLE

SEQ ID NO: 2598784 - protein, 27 aa, Entamoeba histolytica
SSSYWAWPILIIAIICFSFALVQFVAD

SEQ ID NO: 2598785 - protein, 26 aa, Entamoeba histolytica
SSTEMIYLGKLLYRLGYKGKEIYDLF

SEQ ID NO: 2598786 - protein, 21 aa, Entamoeba histolytica
SSTFLIMFALCAIVVLVSTIP

SEQ ID NO: 2598787 - protein, 28 aa, Entamoeba histolytica
SSTMEYLRTIPFFTPLIDKVWPKDDNNT

SEQ ID NO: 2598788 - protein, 27 aa, Entamoeba histolytica
SSTPRKPIFLPLFTSSLSKQMTYYVFL

SEQ ID NO: 2598789 - protein, 25 aa, Entamoeba histolytica
SSTSLFHPISLPQQPQFLSSLGVLN

SEQ ID NO: 2598790 - protein, 25 aa, Entamoeba histolytica
SSTSYSIRFFLSTYLSPLHIDWLEK

SEQ ID NO: 2598791 - protein, 23 aa, Entamoeba histolytica
SSTYLIWYEYDYIKPNYESNKHN

SEQ ID NO: 2598792 - protein, 21 aa, Entamoeba histolytica
SSVTVSFIKVTGVSGTCDSNS

SEQ ID NO: 2598793 - protein, 22 aa, Entamoeba histolytica
SSVTVSFIKVTGVSGTCGSNSV

SEQ ID NO: 2598794 - protein, 20 aa, Entamoeba histolytica
SSVYLLDKYIPIAASFGGMC

SEQ ID NO: 2598795 - protein, 37 aa, Entamoeba histolytica
SSVYTWEHVLIIIPPIFVLFILVPLSLSSMTLIRYVD

SEQ ID NO: 2598796 - protein, 19 aa, Entamoeba histolytica
SSWFIRKIWKIISYFIFIV

SEQ ID NO: 2598797 - protein, 19 aa, Entamoeba histolytica
SSYFIYQFINVSNPPESIL

SEQ ID NO: 2598798 - protein, 23 aa, Entamoeba histolytica
SSYHAWRYIALTGNASLIPAIDT

SEQ ID NO: 2598799 - protein, 17 aa, Entamoeba histolytica
SSYSYLISLSTNNYIII

SEQ ID NO: 2598800 - protein, 30 aa, Entamoeba histolytica
STDLKRTMWWKNMKLWLIIGGVVAVIVIVI

SEQ ID NO: 2598801 - protein, 25 aa, Entamoeba histolytica
STDQNTIVIIYYDTPHLFGEMYSEF

SEQ ID NO: 2598802 - protein, 24 aa, Entamoeba histolytica
STEPLMNVILYNSSIFRIKSSSSL

SEQ ID NO: 2598803 - protein, 26 aa, Entamoeba histolytica
STFGQWDCLLYSPYLCLIINSESIYE

SEQ ID NO: 2598804 - protein, 27 aa, Entamoeba histolytica
STFKDQFIPHLFIPSSFDFPSTTSAFD

SEQ ID NO: 2598805 - protein, 27 aa, Entamoeba histolytica
STFLYQLFILIPFKFQSLLNSLFLIIV

SEQ ID NO: 2598806 - protein, 27 aa, Entamoeba histolytica
STFPLFYNWFNFLIAIIMTYLASSLKS

SEQ ID NO: 2598807 - protein, 29 aa, Entamoeba histolytica
STFYTIFELFWRLIFILFSCLCTCIYLWA

SEQ ID NO: 2598808 - protein, 24 aa, Entamoeba histolytica
STGYFFGFINIVCALLLGITQGYL

SEQ ID NO: 2598809 - protein, 26 aa, Entamoeba histolytica
STHIKKLIYLFIQLTDNEKLLRLTLD

SEQ ID NO: 2598810 - protein, 24 aa, Entamoeba histolytica
STHPSPIFALHWSNPITLTLTQNN

SEQ ID NO: 2598811 - protein, 17 aa, Entamoeba histolytica
STICFAFGFALYYDWKL

SEQ ID NO: 2598812 - protein, 19 aa, Entamoeba histolytica
STIFPLFSNIFTENPHITK

SEQ ID NO: 2598813 - protein, 22 aa, Entamoeba histolytica
STIIDQYNFLLKGIFTHEDLDV

SEQ ID NO: 2598814 - protein, 32 aa, Entamoeba histolytica
STILCVILVFGFIAIGIMYVIQPSYQPTIVDH

SEQ ID NO: 2598815 - protein, 22 aa, Entamoeba histolytica
STILIIIAFQIKRLSFKHTIFT

SEQ ID NO: 2598816 - protein, 31 aa, Entamoeba histolytica
STIPIHCFELLWKIFIVLKYGLLNKLILTNN

SEQ ID NO: 2598817 - protein, 22 aa, Entamoeba histolytica
STKDRFKLIYSLVSNSSYDYMG

SEQ ID NO: 2598818 - protein, 25 aa, Entamoeba histolytica
STLCSFVVYLLIGLFGYFSLTPNIT

SEQ ID NO: 2598819 - protein, 17 aa, Entamoeba histolytica
STLLLMIAIPTIALIYS

SEQ ID NO: 2598820 - protein, 26 aa, Entamoeba histolytica
STLMILIASAFVSLFLALVMPKSQTC

SEQ ID NO: 2598821 - protein, 37 aa, Entamoeba histolytica
STLSGLVIFILPKLPGVWFYCWGITCALWFSTFQNKN

SEQ ID NO: 2598822 - protein, 28 aa, Entamoeba histolytica
STLSTILLFPELPFIISSQLITAVLGVI

SEQ ID NO: 2598823 - protein, 21 aa, Entamoeba histolytica
STLWFSFHELPKIGISYYLRI

SEQ ID NO: 2598824 - protein, 26 aa, Entamoeba histolytica
STLYFIIYIIIFRNKPFIFKQTILPG

SEQ ID NO: 2598825 - protein, 29 aa, Entamoeba histolytica
STMKVFYYKIFAYLYYLVGNLASLVFVNG

SEQ ID NO: 2598826 - protein, 25 aa, Entamoeba histolytica
STNGNKILKLTYNPSALTFVSPYNK

SEQ ID NO: 2598827 - protein, 39 aa, Entamoeba histolytica
STNSRRMYILAGCYYLVTKGWSFLFSKEQRRAEKLHHFF

SEQ ID NO: 2598828 - protein, 37 aa, Entamoeba histolytica
STNTRRMYMLAGCYYLITKGWSFLISKEQRIAEKLHH

SEQ ID NO: 2598829 - protein, 22 aa, Entamoeba histolytica
STPRFKSPRFFGKRGTLFESSR

SEQ ID NO: 2598830 - protein, 18 aa, Entamoeba histolytica
STPSFPLELSKNTLLFGG

SEQ ID NO: 2598831 - protein, 68 aa, Entamoeba histolytica
STRLMAINIILICMYFFQLGVIGFLDYSFFNYISIYIHLMIYVLEFLLLFILMFVCEKSNRLFKKEFK

SEQ ID NO: 2598832 - protein, 26 aa, Entamoeba histolytica
STSLMNTLLMIIPDKGFKYTQERAIE

SEQ ID NO: 2598833 - protein, 20 aa, Entamoeba histolytica
STTKWFYPCGKFGILLGIFL

SEQ ID NO: 2598834 - protein, 23 aa, Entamoeba histolytica
STTLYIPYLFLFGWNIVSIEDHY

SEQ ID NO: 2598835 - protein, 25 aa, Entamoeba histolytica
STVAFLIIRNYLCSFDEIISETSFG

SEQ ID NO: 2598836 - protein, 26 aa, Entamoeba histolytica
SVANLPWRVFIYKFLNTIVDDLFAFI

SEQ ID NO: 2598837 - protein, 28 aa, Entamoeba histolytica
SVDDDPAMFIAFDFGLCYYIDETESVEF

SEQ ID NO: 2598838 - protein, 24 aa, Entamoeba histolytica
SVERGYFRFVIFSVIMEAANMMML

SEQ ID NO: 2598839 - protein, 17 aa, Entamoeba histolytica
SVFEMFWRMAFILFSSF

SEQ ID NO: 2598840 - protein, 27 aa, Entamoeba histolytica
SVFIISALIYGVLLLLNAIVKPKNGWD

SEQ ID NO: 2598841 - protein, 24 aa, Entamoeba histolytica
SVFIMLNILSVRLLNCPQSLFQAV

SEQ ID NO: 2598842 - protein, 17 aa, Entamoeba histolytica
SVFPLIINAAIGTGIFG

SEQ ID NO: 2598843 - protein, 20 aa, Entamoeba histolytica
SVFSLHYFLIVCFSLWMPQI

SEQ ID NO: 2598844 - protein, 28 aa, Entamoeba histolytica
SVFSSKIYLIYFWSLCKGLIVILTIILC

SEQ ID NO: 2598845 - protein, 29 aa, Entamoeba histolytica
SVFSSKIYLIYFWSLCKGLIVILTIILCL

SEQ ID NO: 2598846 - protein, 28 aa, Entamoeba histolytica
SVGGVLILLLLIIVVVSVIIYRKRHSGS

SEQ ID NO: 2598847 - protein, 26 aa, Entamoeba histolytica
SVGPVFYLIYYFYKDVSILFCVPTIA

SEQ ID NO: 2598848 - protein, 17 aa, Entamoeba histolytica
SVIFIIMIVIVTFVFVL

SEQ ID NO: 2598849 - protein, 27 aa, Entamoeba histolytica
SVIKLFKYSDWIDVILVLVGLISSLGN

SEQ ID NO: 2598850 - protein, 36 aa, Entamoeba histolytica
SVIKTKFIKIIRGMVFYFNKLISVILDGARFTKHSI

SEQ ID NO: 2598851 - protein, 28 aa, Entamoeba histolytica
SVILSVLNLLFYLMNICCMSARTIILKI

SEQ ID NO: 2598852 - protein, 25 aa, Entamoeba histolytica
SVIQRSFVYEIFLGSLPLPSLKNQA

SEQ ID NO: 2598853 - protein, 21 aa, Entamoeba histolytica
SVKIGRMKFRPSRPHFVELIS

SEQ ID NO: 2598854 - protein, 23 aa, Entamoeba histolytica
SVKIPRQYIIKVDLLFQSCCNKE

SEQ ID NO: 2598855 - protein, 49 aa, Entamoeba histolytica
SVKTTKYYWWSFIPVFLFNQFKYFINLFFLIVAILSCIPQLSAASPVAS

SEQ ID NO: 2598856 - protein, 28 aa, Entamoeba histolytica
SVKTWKKRWFVLKDNRLWYFASKTAEEA

SEQ ID NO: 2598857 - protein, 21 aa, Entamoeba histolytica
SVLCFAVYFFALIGAITVTLI

SEQ ID NO: 2598858 - protein, 22 aa, Entamoeba histolytica
SVLFPLLQIIALFAKSNLISLD

SEQ ID NO: 2598859 - protein, 19 aa, Entamoeba histolytica
SVLHKQLMFSLKSKFIDKQ

SEQ ID NO: 2598860 - protein, 17 aa, Entamoeba histolytica
SVLILNALFARYIPLIV

SEQ ID NO: 2598861 - protein, 21 aa, Entamoeba histolytica
SVLMYLISIIVLRPTFEPSFV

SEQ ID NO: 2598862 - protein, 23 aa, Entamoeba histolytica
SVLQITYLPLFGNSIQIIMLAHF

SEQ ID NO: 2598863 - protein, 37 aa, Entamoeba histolytica
SVLYSISIAIIFLVYLMLQIFLFKRHNKFIVEYLLEA

SEQ ID NO: 2598864 - protein, 25 aa, Entamoeba histolytica
SVMKLFHPIFIAVMTRIQIVSFKDS

SEQ ID NO: 2598865 - protein, 36 aa, Entamoeba histolytica
SVNEHFFLIWYVIMPIIILIIVVFVALIIAIPDIKT

SEQ ID NO: 2598866 - protein, 27 aa, Entamoeba histolytica
SVNKCLYLFTQFKLLNIPIVLTPSCIH

SEQ ID NO: 2598867 - protein, 31 aa, Entamoeba histolytica
SVNKKYSVFYYLTMQPWRNLEWTTIDSNFPT

SEQ ID NO: 2598868 - protein, 18 aa, Entamoeba histolytica
SVPFIPLILENGVVCLVW

SEQ ID NO: 2598869 - protein, 19 aa, Entamoeba histolytica
SVPHRILLSTYITLLRSFN

SEQ ID NO: 2598870 - protein, 21 aa, Entamoeba histolytica
SVPIVLICFLGTVVVICICCI

SEQ ID NO: 2598871 - protein, 25 aa, Entamoeba histolytica
SVPLLPHIWMEVYGYNLGISVGETY

SEQ ID NO: 2598872 - protein, 24 aa, Entamoeba histolytica
SVPLLPHIWMEVYGYNLRISVGEK

SEQ ID NO: 2598873 - protein, 28 aa, Entamoeba histolytica
SVQFAFQTILLYRITLARFSKLDCLHPK

SEQ ID NO: 2598874 - protein, 38 aa, Entamoeba histolytica
SVRNISYWGWLFTLKQPLFYLMIIISMVITVFPQIVSI

SEQ ID NO: 2598875 - protein, 21 aa, Entamoeba histolytica
SVRRKLIDRKCWTIIYSHGNS

SEQ ID NO: 2598876 - protein, 37 aa, Entamoeba histolytica
SVSIFMMFKYATWIEIIFNIIGVLISLCDGVLYPLIA

SEQ ID NO: 2598877 - protein, 27 aa, Entamoeba histolytica
SVSLAFIMFIYLIILSLWNVFSFVSNE

SEQ ID NO: 2598878 - protein, 24 aa, Entamoeba histolytica
SVSSSRYIILQKNSKITITDITGS

SEQ ID NO: 2598879 - protein, 24 aa, Entamoeba histolytica
SVSSSRYIILQKNSKITVTDITGS

SEQ ID NO: 2598880 - protein, 23 aa, Entamoeba histolytica
SVTILSYLFLFIATQGCGALFQT

SEQ ID NO: 2598881 - protein, 24 aa, Entamoeba histolytica
SVTYIPQICMVTVFFELGSLNNYI

SEQ ID NO: 2598882 - protein, 18 aa, Entamoeba histolytica
SVVIVSYSLFITQPGYDC

SEQ ID NO: 2598883 - protein, 20 aa, Entamoeba histolytica
SVVKILTSILTTVPVQNATV

SEQ ID NO: 2598884 - protein, 36 aa, Entamoeba histolytica
SVVNAPRVYFSLKKDIYWWIVDHWYCFGSLQQCLLK

SEQ ID NO: 2598885 - protein, 18 aa, Entamoeba histolytica
SVYLTIPTLCSLYLSLLV

SEQ ID NO: 2598886 - protein, 19 aa, Entamoeba histolytica
SVYQRFKIIKELNTFSFGL

SEQ ID NO: 2598887 - protein, 23 aa, Entamoeba histolytica
SVYWSLPIILILVSLKYGSNSIV

SEQ ID NO: 2598888 - protein, 21 aa, Entamoeba histolytica
SVYYFLKRIISYNCLPSFLTT

SEQ ID NO: 2598889 - protein, 21 aa, Entamoeba histolytica
SWGLRIIHWVTIALSFVVLIL

SEQ ID NO: 2598890 - protein, 23 aa, Entamoeba histolytica
SWIFPTLFVVIFGPLLTAIPMWN

SEQ ID NO: 2598891 - protein, 17 aa, Entamoeba histolytica
SWIWRIIVIIAFEFLEM

SEQ ID NO: 2598892 - protein, 19 aa, Entamoeba histolytica
SWKKRIDMEWKRKISQKFQ

SEQ ID NO: 2598893 - protein, 30 aa, Entamoeba histolytica
SWKMNEAMKKLYDRGLFSYLVIDEAHCISQ

SEQ ID NO: 2598894 - protein, 21 aa, Entamoeba histolytica
SWVSTIFVPLIVFNTYIQLRI

SEQ ID NO: 2598895 - protein, 17 aa, Entamoeba histolytica
SWVSYLISYFGSNAFTK

SEQ ID NO: 2598896 - protein, 38 aa, Entamoeba histolytica
SWYHSYTHQYDVFYYLAMQPWRHFVWTTCETTKGNKEC

SEQ ID NO: 2598897 - protein, 19 aa, Entamoeba histolytica
SYCYSACSLVTKGLKEWGG

SEQ ID NO: 2598898 - protein, 22 aa, Entamoeba histolytica
SYDKLVQFDLIPSGSASIIQSS

SEQ ID NO: 2598899 - protein, 20 aa, Entamoeba histolytica
SYFCDIIFLILLVLRLDRVF

SEQ ID NO: 2598900 - protein, 20 aa, Entamoeba histolytica
SYFEWQALVTGTYKFQFANT

SEQ ID NO: 2598901 - protein, 17 aa, Entamoeba histolytica
SYFLLPSSFSKQIKVSW

SEQ ID NO: 2598902 - protein, 24 aa, Entamoeba histolytica
SYGPAFIVLLLFIGLSLAAGLYVF

SEQ ID NO: 2598903 - protein, 26 aa, Entamoeba histolytica
SYHDLSHYPIFPWIIQDYTSISLDLS

SEQ ID NO: 2598904 - protein, 26 aa, Entamoeba histolytica
SYHVGFLRQFLVPHPFQLVDIRAIVK

SEQ ID NO: 2598905 - protein, 30 aa, Entamoeba histolytica
SYIEKYLPLVLFIAGFFIPLCWFINICLCC

SEQ ID NO: 2598906 - protein, 35 aa, Entamoeba histolytica
SYIGWFIYGTYQSMIYFYLMIIFTSNDVMTLNGKT

SEQ ID NO: 2598907 - protein, 25 aa, Entamoeba histolytica
SYIIWALILYYIPGLYMLYKYMLSQ

SEQ ID NO: 2598908 - protein, 30 aa, Entamoeba histolytica
SYITNLRVAPKTYFSIRKLNLHITKIYGTE

SEQ ID NO: 2598909 - protein, 18 aa, Entamoeba histolytica
SYIVIYPITWLYVFERCL

SEQ ID NO: 2598910 - protein, 27 aa, Entamoeba histolytica
SYKEMIKFIIFFIKQKLGKIDSKEIFM

SEQ ID NO: 2598911 - protein, 21 aa, Entamoeba histolytica
SYLDLFRMLITFIGNSIGFVR

SEQ ID NO: 2598912 - protein, 22 aa, Entamoeba histolytica
SYLFQTQMTLAINYIKTMLTTS

SEQ ID NO: 2598913 - protein, 20 aa, Entamoeba histolytica
SYLLLLSMFVINIYLNYFHH

SEQ ID NO: 2598914 - protein, 31 aa, Entamoeba histolytica
SYLVIGSLVLFVLLFFKIMYDLITQIIKIRN

SEQ ID NO: 2598915 - protein, 26 aa, Entamoeba histolytica
SYNDLLQVIFQLLWSLSIAEKSFGYS

SEQ ID NO: 2598916 - protein, 19 aa, Entamoeba histolytica
SYNIPIINLFFINNYSSLT

SEQ ID NO: 2598917 - protein, 30 aa, Entamoeba histolytica
SYSLVIKKYPFLTLFFQAIGSMICCFDALI

SEQ ID NO: 2598918 - protein, 26 aa, Entamoeba histolytica
SYSVCCLILLLIFKKKTRTNIFQIRH

SEQ ID NO: 2598919 - protein, 46 aa, Entamoeba histolytica
SYTTSIIIISVIGGIFLIIVFIVVIIIIILLLRRRKIKQEKEMEED

SEQ ID NO: 2598920 - protein, 32 aa, Entamoeba histolytica
SYVIDFLITFLVDYQRYVLKIFMLFSSQRSAC

SEQ ID NO: 2598921 - protein, 27 aa, Entamoeba histolytica
SYVSSMSWYILIFAGGRYIIRLFDLND

SEQ ID NO: 2598922 - protein, 22 aa, Entamoeba histolytica
SYYDFYINMYIFKDYKNLNNII

SEQ ID NO: 2598923 - protein, 25 aa, Entamoeba histolytica
TAALFFCAMFWYHYIEKAPLINFKW

SEQ ID NO: 2598924 - protein, 29 aa, Entamoeba histolytica
TADSDGIIQLLWLLIQYHDPQLSNHLKSL

SEQ ID NO: 2598925 - protein, 19 aa, Entamoeba histolytica
TADYWNPLFIPYVLVLCFV

SEQ ID NO: 2598926 - protein, 27 aa, Entamoeba histolytica
TAEKHFPRLFSWRSFHNYIKELSIDEQ

SEQ ID NO: 2598927 - protein, 24 aa, Entamoeba histolytica
TAFCLFSIIIYYAGKMYAHRSSTE

SEQ ID NO: 2598928 - protein, 19 aa, Entamoeba histolytica
TAHQNICYPLFAVSQETTD

SEQ ID NO: 2598929 - protein, 24 aa, Entamoeba histolytica
TAIEFDMCYYYKNNISVYFTHDGD

SEQ ID NO: 2598930 - protein, 23 aa, Entamoeba histolytica
TAIKKIYSFLYTLNQINIPSISN

SEQ ID NO: 2598931 - protein, 21 aa, Entamoeba histolytica
TAKLALYWTTALLIALCSFIT

SEQ ID NO: 2598932 - protein, 21 aa, Entamoeba histolytica
TALMLTVVISFILFAGAVFSL

SEQ ID NO: 2598933 - protein, 32 aa, Entamoeba histolytica
TAMTEYSMNFYLYPKDLIFKEKRKTCLYLEFV

SEQ ID NO: 2598934 - protein, 17 aa, Entamoeba histolytica
TAPIILFILISIIPESI

SEQ ID NO: 2598935 - protein, 25 aa, Entamoeba histolytica
TASGDYYYPYWTCFSPDTESTCGFG

SEQ ID NO: 2598936 - protein, 29 aa, Entamoeba histolytica
TASQYIKFFEWFFFDYYENVLFAGVDANG

SEQ ID NO: 2598937 - protein, 36 aa, Entamoeba histolytica
TATLSILFVVFILLVLLWFVMHFMLAVQSIGPAVFA

SEQ ID NO: 2598938 - protein, 20 aa, Entamoeba histolytica
TCCLCPLFAGLIATQTDDRK

SEQ ID NO: 2598939 - protein, 24 aa, Entamoeba histolytica
TCEGITDVLFSKVQKISLLFGSIK

SEQ ID NO: 2598940 - protein, 18 aa, Entamoeba histolytica
TCFISLSYMFNPTCSFIT

SEQ ID NO: 2598941 - protein, 18 aa, Entamoeba histolytica
TCMCHYGYIPMLINGTTK

SEQ ID NO: 2598942 - protein, 33 aa, Entamoeba histolytica; identical to SEQ ID NO: 2402055

SEQ ID NO: 2598943 - protein, 19 aa, Entamoeba histolytica
TCNEGYYIQDNSCVRCNIQ

SEQ ID NO: 2598944 - protein, 36 aa, Entamoeba histolytica
TCQQRRSKWTSIIPIINSFPLGGWYSNPNIIKYGDV

SEQ ID NO: 2598945 - protein, 23 aa, Entamoeba histolytica
TCQWIELFSHRNVLYELSKPSEM

SEQ ID NO: 2598946 - protein, 29 aa, Entamoeba histolytica
TCTILSIHIVFILLLLTKNYLLRVKQLHR

SEQ ID NO: 2598947 - protein, 29 aa, Entamoeba histolytica
TCVNYVYQYLLKQFTLLSEFLFDDQIKGI

SEQ ID NO: 2598948 - protein, 23 aa, Entamoeba histolytica
TCYSCIEGYYYENGKCNPCSNIP

SEQ ID NO: 2598949 - protein, 24 aa, Entamoeba histolytica
TDDNIFLVQIGVINIFVLMIQEMI

SEQ ID NO: 2598950 - protein, 24 aa, Entamoeba histolytica
TDFVSLIFYCFFKILFYSLICDVL

SEQ ID NO: 2598951 - protein, 18 aa, Entamoeba histolytica
TDGLLFFRAFSGYKGILV

SEQ ID NO: 2598952 - protein, 25 aa, Entamoeba histolytica
TDKGCLFDLLQGPKLNWEIICGIAI

SEQ ID NO: 2598953 - protein, 36 aa, Entamoeba histolytica
TDKRELMKYKVLMKFLLFTLLTFLVSADVVSLNPTN

SEQ ID NO: 2598954 - protein, 24 aa, Entamoeba histolytica
TDLINPYLLFRIADLFFIGCVVLT

SEQ ID NO: 2598955 - protein, 34 aa, Entamoeba histolytica
TDMKSFEILLPTFIQILLLMFPNTAPEITNKLKV

SEQ ID NO: 2598956 - protein, 31 aa, Entamoeba histolytica
TDNIFAFFIFIYSLLYFLIYQNTILNGISQL

SEQ ID NO: 2598957 - protein, 25 aa, Entamoeba histolytica
TDPVYRYFMKSLLPSQKQPNGRYFD

SEQ ID NO: 2598958 - protein, 21 aa, Entamoeba histolytica
TDSLLRYVGGIYKSESCTGKI

SEQ ID NO: 2598959 - protein, 25 aa, Entamoeba histolytica
TDVRPVYLSFVGYGKPVVISTCKSV

SEQ ID NO: 2598960 - protein, 18 aa, Entamoeba histolytica
TDYPSVFSIPSFFNNKQL

SEQ ID NO: 2598961 - protein, 25 aa, Entamoeba histolytica
TDYYNYLNLLVHRIDLNSNPLQITF

SEQ ID NO: 2598962 - protein, 24 aa, Entamoeba histolytica
TEAKFWIHSFASDSIRIIFKQPNK

SEQ ID NO: 2598963 - protein, 24 aa, Entamoeba histolytica
TECANGYYLFGGLCLQCSSFYEHC

SEQ ID NO: 2598964 - protein, 19 aa, Entamoeba histolytica
TECLTSQTPVPGKLNLRSA

SEQ ID NO: 2598965 - protein, 21 aa, Entamoeba histolytica
TEDSSISIFFTFIGVIVFLLF

SEQ ID NO: 2598966 - protein, 24 aa, Entamoeba histolytica
TEEGKSIIWDLLKQLRPGMDLGRI

SEQ ID NO: 2598967 - protein, 23 aa, Entamoeba histolytica
TEEHPEFILITKFLKNVNGIKEV

SEQ ID NO: 2598968 - protein, 24 aa, Entamoeba histolytica
TEEKKYFDIFHFKPTGFIGQIEVF

SEQ ID NO: 2598969 - protein, 19 aa, Entamoeba histolytica
TEELGFGAQMYKCGMCVPQ

SEQ ID NO: 2598970 - protein, 32 aa, Entamoeba histolytica
TEELWGDIYEANKMLFIAPSTTLEIKLRSFHK

SEQ ID NO: 2598971 - protein, 19 aa, Entamoeba histolytica
TEIRPFRVSSDVELALLSA

SEQ ID NO: 2598972 - protein, 33 aa, Entamoeba histolytica
TEKEIIYGLFNTKLIFFIVKVLLRCDSLDKELK

SEQ ID NO: 2598973 - protein, 23 aa, Entamoeba histolytica
TEKLSWRVFGPQGALIQNMVDFF

SEQ ID NO: 2598974 - protein, 31 aa, Entamoeba histolytica; identical to SEQ ID NO: 2402086

SEQ ID NO: 2598975 - protein, 20 aa, Entamoeba histolytica
TELKPIMPPIGEGAFGMVFR

SEQ ID NO: 2598976 - protein, 19 aa, Entamoeba histolytica
TENNGVIGYFPMGIERNGW

SEQ ID NO: 2598977 - protein, 24 aa, Entamoeba histolytica
TENQTFFSFFQSIFLTFQTTFDPS

SEQ ID NO: 2598978 - protein, 22 aa, Entamoeba histolytica
TEQIGLWYFLQGADRNVLISTC

SEQ ID NO: 2598979 - protein, 18 aa, Entamoeba histolytica
TETGNPTCLTCFGGYYLI

SEQ ID NO: 2598980 - protein, 38 aa, Entamoeba histolytica
TETIKTISLFKIIGTPLALYHCFLQLGTFSQIYFDCIT

SEQ ID NO: 2598981 - protein, 17 aa, Entamoeba histolytica
TEWNIDSFDPLFKEGFC

SEQ ID NO: 2598982 - protein, 23 aa, Entamoeba histolytica
TFAILMTYIFMKIIPFPQAHYIN

SEQ ID NO: 2598983 - protein, 23 aa, Entamoeba histolytica
TFAPMMLLFYCFYKYLFYEETPK

SEQ ID NO: 2598984 - protein, 18 aa, Entamoeba histolytica
TFCFFVMSERQGIKIRML

SEQ ID NO: 2598985 - protein, 19 aa, Entamoeba histolytica
TFCFNYRSLLQTLATSMLQ

SEQ ID NO: 2598986 - protein, 21 aa, Entamoeba histolytica
TFDGKWWPQSFMSFFTMAPFI

SEQ ID NO: 2598987 - protein, 18 aa, Entamoeba histolytica
TFDILCHLKYLNISNRPL

SEQ ID NO: 2598988 - protein, 21 aa, Entamoeba histolytica
TFDSKRILYLEFYVSVIVSQT

SEQ ID NO: 2598989 - protein, 30 aa, Entamoeba histolytica
TFEPSFVFSLGFWWRVAVITLINSFPFILK

SEQ ID NO: 2598990 - protein, 35 aa, Entamoeba histolytica
TFFYIKQSYNKLLVYLIFLVKPYVNWSRMYLEINE

SEQ ID NO: 2598991 - protein, 18 aa, Entamoeba histolytica
TFGIKWLRLLFSREFPLD

SEQ ID NO: 2598992 - protein, 19 aa, Entamoeba histolytica
TFGSIGRTPLPKSYLNTKF

SEQ ID NO: 2598993 - protein, 26 aa, Entamoeba histolytica
TFIQSFLFFMTYPIYLPLLAIFQHLV

SEQ ID NO: 2598994 - protein, 24 aa, Entamoeba histolytica
TFIVFGCYVLLFFLGFFLFIKYSA

SEQ ID NO: 2598995 - protein, 17 aa, Entamoeba histolytica
TFKRMFKFFNKKNFWSI

SEQ ID NO: 2598996 - protein, 24 aa, Entamoeba histolytica
TFKSPILRTFKPIPQTHNLINENN

SEQ ID NO: 2598997 - protein, 17 aa, Entamoeba histolytica
TFLLFIGFFLVMLRCFS

SEQ ID NO: 2598998 - protein, 26 aa, Entamoeba histolytica
TFLSCLLPTIFPFVSFVAVLQNSFIE

SEQ ID NO: 2598999 - protein, 27 aa, Entamoeba histolytica
TFLVPIISIIFPLYSVLHRTLTTRPST

SEQ ID NO: 2599000 - protein, 28 aa, Entamoeba histolytica
TFMEKVWGVVKVLGFISLGVGVAIGVIG

SEQ ID NO: 2599001 - protein, 17 aa, Entamoeba histolytica
TFNLYIRRIHHPCSYVN

SEQ ID NO: 2599002 - protein, 27 aa, Entamoeba histolytica
TFPKENIALHKLTLPRGATISGTGSLS

SEQ ID NO: 2599003 - protein, 24 aa, Entamoeba histolytica
TFPSAFLEVTGYPWVFVSSYDQNH

SEQ ID NO: 2599004 - protein, 19 aa, Entamoeba histolytica
TFSINAYGYYLGICFMKKT

SEQ ID NO: 2599005 - protein, 18 aa, Entamoeba histolytica
TFSLFVVSQREGIKPRRL

SEQ ID NO: 2599006 - protein, 19 aa, Entamoeba histolytica
TFSLKQYTPALKAITIIIL

SEQ ID NO: 2599007 - protein, 27 aa, Entamoeba histolytica
TFSNLLFQLLFFVFYLIEVIGELNQLR

SEQ ID NO: 2599008 - protein, 17 aa, Entamoeba histolytica
TFTSTNAYRFIVPNRAQ

SEQ ID NO: 2599009 - protein, 24 aa, Entamoeba histolytica
TFVISLIFALCFFISPLIIFFSRS

SEQ ID NO: 2599010 - protein, 25 aa, Entamoeba histolytica
TFVQIFILGQMFIHLLFIGTVTSSD

SEQ ID NO: 2599011 - protein, 35 aa, Entamoeba histolytica
TFYSFPFKFMLEQLMRFSNIFFIVNTILTCIPQVS

SEQ ID NO: 2599012 - protein, 18 aa, Entamoeba histolytica
TGAKLDLLNSLRDLAMAK

SEQ ID NO: 2599013 - protein, 25 aa, Entamoeba histolytica
TGAVFIISLLLFITAVVFIIKELVT

SEQ ID NO: 2599014 - protein, 26 aa, Entamoeba histolytica
TGCEIAFIVIICLADTTLLIVLIVFG

SEQ ID NO: 2599015 - protein, 23 aa, Entamoeba histolytica
TGFGFVYTFQLPIGQTMVQILSH

SEQ ID NO: 2599016 - protein, 17 aa, Entamoeba histolytica
TGFILLNRNLPFVVIVE

SEQ ID NO: 2599017 - protein, 19 aa, Entamoeba histolytica
TGFVYPLIFYISWQVIYVI

SEQ ID NO: 2599018 - protein, 27 aa, Entamoeba histolytica
TGGQLTIRAWQISALLTLATGYEKRFI

SEQ ID NO: 2599019 - protein, 29 aa, Entamoeba histolytica
TGGVFVIIAILLFILTRVSPRKFADKRFL

SEQ ID NO: 2599020 - protein, 24 aa, Entamoeba histolytica
TGIFGFVLILILPSMFQIFSKKTY

SEQ ID NO: 2599021 - protein, 41 aa, Entamoeba histolytica
TGIIVGCVLACIVIMLIIVTIISLILFIRIERNIRKRNSEK

SEQ ID NO: 2599022 - protein, 32 aa, Entamoeba histolytica
TGKTSIIYLLIGYLGFLIPAACIGIFIASRVE

SEQ ID NO: 2599023 - protein, 25 aa, Entamoeba histolytica
TGNINILFVMYQLASVFLSTFMVKI

SEQ ID NO: 2599024 - protein, 22 aa, Entamoeba histolytica
TGPFFILTWKFYPNTSLSCYIA

SEQ ID NO: 2599025 - protein, 17 aa, Entamoeba histolytica
TGPFLNFAINKSALTKM

SEQ ID NO: 2599026 - protein, 23 aa, Entamoeba histolytica
TGSEHITFPMFFVDSNPCTGQDN

SEQ ID NO: 2599027 - protein, 25 aa, Entamoeba histolytica
TGSKKLVIVKLYSFILHFASNDCSG

SEQ ID NO: 2599028 - protein, 24 aa, Entamoeba histolytica
TGTYLYTVYCPSAINIKIGMESKT

SEQ ID NO: 2599029 - protein, 18 aa, Entamoeba histolytica
TGYLITFCGIIMAVAFSG

SEQ ID NO: 2599030 - protein, 30 aa, Entamoeba histolytica
THGYALHFIVIIILWTFLWTVCHSNRLNIH

SEQ ID NO: 2599031 - protein, 25 aa, Entamoeba histolytica
THIRKALLLFSRYPNTFIPNTSKTY

SEQ ID NO: 2599032 - protein, 28 aa, Entamoeba histolytica
THIRKALLLFSRYPYGFIPNSAAIYSKE

SEQ ID NO: 2599033 - protein, 25 aa, Entamoeba histolytica
THKLNSISFILPFDSKIITYNPLST

SEQ ID NO: 2599034 - protein, 21 aa, Entamoeba histolytica
THLFIVLDYMEGGELYDLIHT

SEQ ID NO: 2599035 - protein, 31 aa, Entamoeba histolytica
THMKNAMWWKNFKLWLIIGTVVAIIILVIII

SEQ ID NO: 2599036 - protein, 26 aa, Entamoeba histolytica
THNAIFEYPFHAPYVFFKLDATLCNG

SEQ ID NO: 2599037 - protein, 42 aa, Entamoeba histolytica
THSHTFVWPFYISMILSILLFFGWYVFYGFVGGFKFISMGES

SEQ ID NO: 2599038 - protein, 29 aa, Entamoeba histolytica
THYASIFWYFILILLFIGLKLDNIVHWYW

SEQ ID NO: 2599039 - protein, 17 aa, Entamoeba histolytica
TIAFGLFRKIIGGVFVE

SEQ ID NO: 2599040 - protein, 22 aa, Entamoeba histolytica
TIAFLVLLSFVTPKYPYFSFSC

SEQ ID NO: 2599041 - protein, 24 aa, Entamoeba histolytica
TICKTMLFFSFYSKLNIPSIPIFS

SEQ ID NO: 2599042 - protein, 23 aa, Entamoeba histolytica
TIDENIILIDPFPNCIILTGKSN

SEQ ID NO: 2599043 - protein, 23 aa, Entamoeba histolytica
TIDFFIPLICIILLCLKNHYISG

SEQ ID NO: 2599044 - protein, 28 aa, Entamoeba histolytica
TIDMYENSMFWLYGLSQMSLDNLTLHNH

SEQ ID NO: 2599045 - protein, 22 aa, Entamoeba histolytica
TIEDIDIPPFYLGISATNGGSG

SEQ ID NO: 2599046 - protein, 19 aa, Entamoeba histolytica
TIEFKSSLTYIIVNSAYSS

SEQ ID NO: 2599047 - protein, 17 aa, Entamoeba histolytica
TIFMIAVVLCFSLIKIQ

SEQ ID NO: 2599048 - protein, 23 aa, Entamoeba histolytica
TIFSKKKLCFPDNGRWWNFTIVN

SEQ ID NO: 2599049 - protein, 19 aa, Entamoeba histolytica
TIFYLPHWVQHQTGWMIFG

SEQ ID NO: 2599050 - protein, 17 aa, Entamoeba histolytica
TIHRFHKSANDLFMLVF

SEQ ID NO: 2599051 - protein, 20 aa, Entamoeba histolytica
TIHYPFLLLKAFCIGFVISG

SEQ ID NO: 2599052 - protein, 25 aa, Entamoeba histolytica
TIIGVILMLLKWVRDPLFIRTDWSI

SEQ ID NO: 2599053 - protein, 31 aa, Entamoeba histolytica
TIIISLIGTILYWLIYDMQFSFLDFILPGKQ

SEQ ID NO: 2599054 - protein, 31 aa, Entamoeba histolytica
TIILIAIGVGIVIYYGYIHFAQKKETTNIKH

SEQ ID NO: 2599055 - protein, 25 aa, Entamoeba histolytica
TIKDLPFFRYITIPHYINETKDSCS

SEQ ID NO: 2599056 - protein, 22 aa, Entamoeba histolytica
TIKDPILICVLSCVVGAFMARR

SEQ ID NO: 2599057 - protein, 20 aa, Entamoeba histolytica
TIKLLFFAIVGLSQSQLLII

SEQ ID NO: 2599058 - protein, 19 aa, Entamoeba histolytica
TILCLIFVGVMITLILSNL

SEQ ID NO: 2599059 - protein, 17 aa, Entamoeba histolytica
TILISLLYIGVFAFVGV

SEQ ID NO: 2599060 - protein, 37 aa, Entamoeba histolytica; identical to SEQ ID NO: 2402204

SEQ ID NO: 2599061 - protein, 39 aa, Entamoeba histolytica; identical to SEQ ID NO: 2402205

SEQ ID NO: 2599062 - protein, 35 aa, Entamoeba histolytica
TILTTMALSIKSWNIFLVLGFFVSFILSLVCILLV

SEQ ID NO: 2599063 - protein, 22 aa, Entamoeba histolytica
TILYQQYMALFLWVVHYLKRIL

SEQ ID NO: 2599064 - protein, 19 aa, Entamoeba histolytica
TIMHDPHLRNFLLNVEEVR

SEQ ID NO: 2599065 - protein, 19 aa, Entamoeba histolytica
TIMRVIRFSIWYEGDFSIV

SEQ ID NO: 2599066 - protein, 24 aa, Entamoeba histolytica
TINDLVLKMIYFAIGTTVGMFLMH

SEQ ID NO: 2599067 - protein, 28 aa, Entamoeba histolytica
TINDVFKIKDIWKHVCIVWNKCYNSLFQ

SEQ ID NO: 2599068 - protein, 37 aa, Entamoeba histolytica
TINDVFKIKDIWKHVCIVWTMCYNYIPPKKIDEGKKE

SEQ ID NO: 2599069 - protein, 18 aa, Entamoeba histolytica
TIQELYNYTLALASTNPS

SEQ ID NO: 2599070 - protein, 22 aa, Entamoeba histolytica
TISFGIFLCLWFDGLEAQPQDM

SEQ ID NO: 2599071 - protein, 27 aa, Entamoeba histolytica
TISFIYFFLGIINFFEFIWSVIVQFLA

SEQ ID NO: 2599072 - protein, 22 aa, Entamoeba histolytica
TISIYHQWLFGDHIPKAIQDNR

SEQ ID NO: 2599073 - protein, 29 aa, Entamoeba histolytica
TISLCLMIIILSLNWYLPPLKATKPNPVD

SEQ ID NO: 2599074 - protein, 17 aa, Entamoeba histolytica
TISLLFTTIIVLMDNIK

SEQ ID NO: 2599075 - protein, 35 aa, Entamoeba histolytica; identical to SEQ ID NO: 2402218

SEQ ID NO: 2599076 - protein, 17 aa, Entamoeba histolytica
TITALFKGIRANLTERC

SEQ ID NO: 2599077 - protein, 23 aa, Entamoeba histolytica
TITAQLMIFCTTNLKERIHVTLR

SEQ ID NO: 2599078 - protein, 24 aa, Entamoeba histolytica
TITPSLLLIFPRFFRIKGLIPCNK

SEQ ID NO: 2599079 - protein, 25 aa, Entamoeba histolytica
TITTKMYIPEIIYLLNLIGSVFTTI

SEQ ID NO: 2599080 - protein, 17 aa, Entamoeba histolytica
TITVQSKPEWLTLCRKS

SEQ ID NO: 2599081 - protein, 18 aa, Entamoeba histolytica
TIVLIVMVVYVSLFVLIG

SEQ ID NO: 2599082 - protein, 18 aa, Entamoeba histolytica
TIWLLHDQELYLYSLVSE

SEQ ID NO: 2599083 - protein, 29 aa, Entamoeba histolytica
TIYMPAQYGYFLFWALKSKENIGKYPSNP

SEQ ID NO: 2599084 - protein, 38 aa, Entamoeba histolytica
TKALDYIVKLICFIILYFVLRMMYNLFYFVMKQTSINP

SEQ ID NO: 2599085 - protein, 22 aa, Entamoeba histolytica
TKCKDGYFIKDKMCSPCLSGCQ

SEQ ID NO: 2599086 - protein, 53 aa, Entamoeba histolytica
TKDDVPTWVIVILVIVGIIIVIIIILFIVFIVVARMFLLRRKNNKVFDDDDNI

SEQ ID NO: 2599087 - protein, 25 aa, Entamoeba histolytica
TKDMPDWYFRIVSMGWDQQPLNRPK

SEQ ID NO: 2599088 - protein, 23 aa, Entamoeba histolytica
TKDTFSFILQPQKTNYIALVVNG

SEQ ID NO: 2599089 - protein, 20 aa, Entamoeba histolytica
TKECIICQPGFVLLNGQCYK

SEQ ID NO: 2599090 - protein, 19 aa, Entamoeba histolytica
TKEDVQCKCYYDNLLPDCE

SEQ ID NO: 2599091 - protein, 20 aa, Entamoeba histolytica
TKELLKRKPFGKYNSLLSPK

SEQ ID NO: 2599092 - protein, 23 aa, Entamoeba histolytica
TKESLQIIWLWEIINEMENSLKG

SEQ ID NO: 2599093 - protein, 22 aa, Entamoeba histolytica
TKETIILLIKEFDVLNKLKSCN

SEQ ID NO: 2599094 - protein, 48 aa, Entamoeba histolytica
TKEVPTWAIAVIVIVGVIIVIALILLVAFILYAKLVLLKNRKNNKVFD

SEQ ID NO: 2599095 - protein, 17 aa, Entamoeba histolytica
TKFKLNAKPFTRKNKTK

SEQ ID NO: 2599096 - protein, 38 aa, Entamoeba histolytica
TKFYEHIPEMIIIPFFILCLSVIYLLKEYWKIQEENEE

SEQ ID NO: 2599097 - protein, 18 aa, Entamoeba histolytica
TKIAIYGSFIVNLCLCIV

SEQ ID NO: 2599098 - protein, 25 aa, Entamoeba histolytica
TKIKFDLSLKLLLYSLRKSEDLFEE

SEQ ID NO: 2599099 - protein, 17 aa, Entamoeba histolytica
TKIPVRCTIIGTFTGTN

SEQ ID NO: 2599100 - protein, 27 aa, Entamoeba histolytica
TKLPSNVYFACQDTMYVYIAESSYYTC

SEQ ID NO: 2599101 - protein, 21 aa, Entamoeba histolytica
TKLQLQFIASPLSRPEKLEQL

SEQ ID NO: 2599102 - protein, 24 aa, Entamoeba histolytica
TKLVMLLVVWMIPSSIIKPSVRGI

SEQ ID NO: 2599103 - protein, 18 aa, Entamoeba histolytica
TKLYLWKDEFYHPLQHIL

SEQ ID NO: 2599104 - protein, 27 aa, Entamoeba histolytica
TKNSTLLFPFITKKFFIEEYNLRVFDL

SEQ ID NO: 2599105 - protein, 24 aa, Entamoeba histolytica
TKPKLLRVMFKLNGKAMLIAIIPR

SEQ ID NO: 2599106 - protein, 26 aa, Entamoeba histolytica
TKPLNELKIIIKLLTRMLLSCIIENG

SEQ ID NO: 2599107 - protein, 30 aa, Entamoeba histolytica
TKQAITMNFILLNIFLVCVSASFLMGTALQ

SEQ ID NO: 2599108 - protein, 27 aa, Entamoeba histolytica
TKQLSTEIIPFYSLWATIFGGFSDIIL

SEQ ID NO: 2599109 - protein, 34 aa, Entamoeba histolytica; identical to SEQ ID NO: 2402255

SEQ ID NO: 2599110 - protein, 24 aa, Entamoeba histolytica
TKTALLTAFVIGVLNWVGCTIIIH

SEQ ID NO: 2599111 - protein, 25 aa, Entamoeba histolytica
TKTGRVYIECFGKWIMYKLSSDSYV

SEQ ID NO: 2599112 - protein, 17 aa, Entamoeba histolytica
TKTKTIPPIFKIQNIKF

SEQ ID NO: 2599113 - protein, 25 aa, Entamoeba histolytica
TKTMRIFYNILLLGIILTIVSSSIE

SEQ ID NO: 2599114 - protein, 36 aa, Entamoeba histolytica
TKTSILLLAVIWLYNIIVQIIGFLLLLIAFAKDKDK

SEQ ID NO: 2599115 - protein, 24 aa, Entamoeba histolytica
TKTTHMYDFYSEIYKLLVLTRDSH

SEQ ID NO: 2599116 - protein, 26 aa, Entamoeba histolytica
TKVDDNIYITFRYGKLHAILMDLNQK

SEQ ID NO: 2599117 - protein, 26 aa, Entamoeba histolytica
TKWYVTFFVFLGWGMSFAIPILLPID

SEQ ID NO: 2599118 - protein, 17 aa, Entamoeba histolytica
TKYEIMCKPFTGTIRPG

SEQ ID NO: 2599119 - protein, 25 aa, Entamoeba histolytica
TKYMTELHLFKFSPEIIYQLSIDSI

SEQ ID NO: 2599120 - protein, 28 aa, Entamoeba histolytica
TKYSIISFLPLFLYNQFKHVTNIYFLLV

SEQ ID NO: 2599121 - protein, 33 aa, Entamoeba histolytica; identical to SEQ ID NO: 2402265

SEQ ID NO: 2599122 - protein, 26 aa, Entamoeba histolytica
TLCIGIAFFLFSLHVTIFHVQYNSLP

SEQ ID NO: 2599123 - protein, 18 aa, Entamoeba histolytica
TLCRSQIPSSLRSSIYKL

SEQ ID NO: 2599124 - protein, 33 aa, Entamoeba histolytica
TLDNTLIYLPDPLFDKYYILKADEFPPLDTVKT

SEQ ID NO: 2599125 - protein, 34 aa, Entamoeba histolytica; identical to SEQ ID NO: 2402269

SEQ ID NO: 2599126 - protein, 17 aa, Entamoeba histolytica
TLEDVHLFEFELVNKKQ

SEQ ID NO: 2599127 - protein, 17 aa, Entamoeba histolytica
TLEIVQVGKFVFTDSTI

SEQ ID NO: 2599128 - protein, 23 aa, Entamoeba histolytica
TLFKTMYYFIITPLGIYLFRHED

SEQ ID NO: 2599129 - protein, 22 aa, Entamoeba histolytica
TLFTIGFYIFIALVIIACIVLY

SEQ ID NO: 2599130 - protein, 22 aa, Entamoeba histolytica
TLFVEYFGCEIIYNPESKLCEK

SEQ ID NO: 2599131 - protein, 31 aa, Entamoeba histolytica
TLGGYPMISLDQLTWYYYVQGDDTPYLVNGS

SEQ ID NO: 2599132 - protein, 29 aa, Entamoeba histolytica
TLGSIPWIELLPLFFPLSFVYSIPQKLFQ

SEQ ID NO: 2599133 - protein, 17 aa, Entamoeba histolytica
TLHLYLKDTIESKYLNI

SEQ ID NO: 2599134 - protein, 18 aa, Entamoeba histolytica
TLIALVKSYYGLWYENNF

SEQ ID NO: 2599135 - protein, 18 aa, Entamoeba histolytica
TLIIFILGMLRKIKDSST

SEQ ID NO: 2599136 - protein, 17 aa, Entamoeba histolytica
TLIINNPIFNSPQYKFT

SEQ ID NO: 2599137 - protein, 29 aa, Entamoeba histolytica
TLIMLLIIFFILFWFFKGDELITSGQEYF

SEQ ID NO: 2599138 - protein, 23 aa, Entamoeba histolytica
TLISILSFVIFFVSVISLFYTTD

SEQ ID NO: 2599139 - protein, 25 aa, Entamoeba histolytica
TLIVDIICFMLYLSLSLMNTEFSKK

SEQ ID NO: 2599140 - protein, 21 aa, Entamoeba histolytica
TLIVKLSFYKNVAFILMQFWF

SEQ ID NO: 2599141 - protein, 17 aa, Entamoeba histolytica
TLIVMMLYLQNKENVSK

SEQ ID NO: 2599142 - protein, 17 aa, Entamoeba histolytica
TLIVVFAGPIFSVTPFP

SEQ ID NO: 2599143 - protein, 31 aa, Entamoeba histolytica; identical to SEQ ID NO: 2402292

SEQ ID NO: 2599144 - protein, 36 aa, Entamoeba histolytica
TLKIWGLFITFSIISFVFYLYLFGWNIISIEDTIRF

SEQ ID NO: 2599145 - protein, 21 aa, Entamoeba histolytica
TLKRMLYRAITNKIFLIIMAI

SEQ ID NO: 2599146 - protein, 24 aa, Entamoeba histolytica
TLKTKPRYIVDMDSLYPFTKFVTS

SEQ ID NO: 2599147 - protein, 20 aa, Entamoeba histolytica
TLKTLFTYGILLSDSWNVLM

SEQ ID NO: 2599148 - protein, 32 aa, Entamoeba histolytica
TLKYLWESYFILFIPLIIILLGTRFTSVCWFG

SEQ ID NO: 2599149 - protein, 17 aa, Entamoeba histolytica
TLLEIIHIVILLIGTCI

SEQ ID NO: 2599150 - protein, 17 aa, Entamoeba histolytica
TLLTALLKVCCKIESLS

SEQ ID NO: 2599151 - protein, 20 aa, Entamoeba histolytica
TLLTFDIFGPPIVVLLMGIM

SEQ ID NO: 2599152 - protein, 23 aa, Entamoeba histolytica
TLMFKIVDIIYKLSKYYPENDGH

SEQ ID NO: 2599153 - protein, 18 aa, Entamoeba histolytica
TLNLNGVPFGKHIELSLG

SEQ ID NO: 2599154 - protein, 26 aa, Entamoeba histolytica
TLNTSFLNFFIVSFSFCCLACWVVFM

SEQ ID NO: 2599155 - protein, 17 aa, Entamoeba histolytica
TLPQFYVPNSNIHIPSI

SEQ ID NO: 2599156 - protein, 19 aa, Entamoeba histolytica
TLQFDIILSQNIKFVTGGN

SEQ ID NO: 2599157 - protein, 17 aa, Entamoeba histolytica
TLQLLYEYNFDQTAHLG

SEQ ID NO: 2599158 - protein, 26 aa, Entamoeba histolytica
TLQTIIFNTFVFCQIFNEVNSRRVNG

SEQ ID NO: 2599159 - protein, 24 aa, Entamoeba histolytica
TLSELLLELFPQFPPKVLHSREIS

SEQ ID NO: 2599160 - protein, 20 aa, Entamoeba histolytica
TLSFPAAYFTFKGTGTGVSI

SEQ ID NO: 2599161 - protein, 21 aa, Entamoeba histolytica
TLSIYNVLFTLLPIIVFGIFD

SEQ ID NO: 2599162 - protein, 17 aa, Entamoeba histolytica
TLSKKKCDYYRAYKNGH

SEQ ID NO: 2599163 - protein, 25 aa, Entamoeba histolytica
TLSVLLMLYLIFFLSHWEEYHTGVL

SEQ ID NO: 2599164 - protein, 28 aa, Entamoeba histolytica
TLSYGNLFIWLLSIFYIPKPTRPIWDKA

SEQ ID NO: 2599165 - protein, 28 aa, Entamoeba histolytica
TLTEPKFLYFTPLYQQYTLRSLDKSIFE

SEQ ID NO: 2599166 - protein, 19 aa, Entamoeba histolytica
TLTFMALTYYFAQNEAILT

SEQ ID NO: 2599167 - protein, 20 aa, Entamoeba histolytica
TLTHYKISYASFYVKSDITA

SEQ ID NO: 2599168 - protein, 20 aa, Entamoeba histolytica
TLTLPLMNLFIKINLNKQNV

SEQ ID NO: 2599169 - protein, 19 aa, Entamoeba histolytica
TLTMFVSEFTRLGGIGLIL

SEQ ID NO: 2599170 - protein, 21 aa, Entamoeba histolytica
TLTVLILVILKCWFNVDTGMA

SEQ ID NO: 2599171 - protein, 23 aa, Entamoeba histolytica
TLVLLLSFIYYGGSVSYFTILLL

SEQ ID NO: 2599172 - protein, 26 aa, Entamoeba histolytica
TLVNTIIWVMGIAFAGLLSTYCYIGI

SEQ ID NO: 2599173 - protein, 29 aa, Entamoeba histolytica
TLVSPFFGFIPFPIIRKFGSAFSPYVVIP

SEQ ID NO: 2599174 - protein, 33 aa, Entamoeba histolytica
  misc_feature (33)..(33): Xaa can be any naturally occurring amino acid
TLVTLMLELSPFMAFVLYLVYIQIDYHLEVGKX

SEQ ID NO: 2599175 - protein, 39 aa, Entamoeba histolytica
TLYLSGFAMTLFTLLLFGPLFYRLIKVILMPKTTVPQTI

SEQ ID NO: 2599176 - protein, 18 aa, Entamoeba histolytica
TLYTMFFDGPRDIGPNVP

SEQ ID NO: 2599177 - protein, 18 aa, Entamoeba histolytica
TMDGFLMNYFAYNIDRTR

SEQ ID NO: 2599178 - protein, 23 aa, Entamoeba histolytica
TMELIRSSIYFEKGQWNYEATTL

SEQ ID NO: 2599179 - protein, 18 aa, Entamoeba histolytica
TMILGRRVILSPSILEKE

SEQ ID NO: 2599180 - protein, 20 aa, Entamoeba histolytica
TMKIIDVLDIFYKDLDRFDM

SEQ ID NO: 2599181 - protein, 33 aa, Entamoeba histolytica
TMLSSLFNIVVIFPFVLCFYPDCIRIYNFFTGQ

SEQ ID NO: 2599182 - protein, 25 aa, Entamoeba histolytica
TMNQFLLFLLIYVSIPLAIFLILLS

SEQ ID NO: 2599183 - protein, 18 aa, Entamoeba histolytica
TMPLAFVVILAMAKDAYD

SEQ ID NO: 2599184 - protein, 17 aa, Entamoeba histolytica
TNCLLYKYGRCVACENH

SEQ ID NO: 2599185 - protein, 33 aa, Entamoeba histolytica
TNDKLSYFWIFFTFIILYNNLVPISLYVCLEII

SEQ ID NO: 2599186 - protein, 28 aa, Entamoeba histolytica
TNDKTMLYIIIGCSVGGVLILLLLIIVV

SEQ ID NO: 2599187 - protein, 25 aa, Entamoeba histolytica
TNECLDIPMYFIDSEPCKGYDNSRS

SEQ ID NO: 2599188 - protein, 49 aa, Entamoeba histolytica
TNGEVPAWAIAVIVIVGVIIVIALILLVAFILYAKLVLLKNRKNNKVFD

SEQ ID NO: 2599189 - protein, 18 aa, Entamoeba histolytica
TNGKIRIINPFSGSICCG

SEQ ID NO: 2599190 - protein, 24 aa, Entamoeba histolytica
TNHNHRLTLPLQLQLHSHKISKIQ

SEQ ID NO: 2599191 - protein, 19 aa, Entamoeba histolytica
TNHRLNILKLYSLRNNELT

SEQ ID NO: 2599192 - protein, 22 aa, Entamoeba histolytica
TNIDFPVFYLSTSFRNSIVLWN

SEQ ID NO: 2599193 - protein, 17 aa, Entamoeba histolytica
TNIDSFTIGSCTKLTLT

SEQ ID NO: 2599194 - protein, 31 aa, Entamoeba histolytica
TNIKSRLRVSLLYTWCVILILNNVRIQDQRE

SEQ ID NO: 2599195 - protein, 19 aa, Entamoeba histolytica
TNIVGGLSPLFIGGSENIY

SEQ ID NO: 2599196 - protein, 28 aa, Entamoeba histolytica
TNKHLLYLFFPALLAFSATYLQNIGLVY

SEQ ID NO: 2599197 - protein, 17 aa, Entamoeba histolytica
TNLFKIIIPLLCLLIPC

SEQ ID NO: 2599198 - protein, 22 aa, Entamoeba histolytica
TNLNGISCTFIILSIGITFILF

SEQ ID NO: 2599199 - protein, 19 aa, Entamoeba histolytica
TNNKKYVWWNVFTIRKNST

SEQ ID NO: 2599200 - protein, 23 aa, Entamoeba histolytica
TNPSIFHGIASPLLKPSIDQLKS

SEQ ID NO: 2599201 - protein, 29 aa, Entamoeba histolytica
TNSIDLLIEYFFVILKKNKKNYDWMILIL

SEQ ID NO: 2599202 - protein, 17 aa, Entamoeba histolytica
TNSLSLISIHQIMRFLL

SEQ ID NO: 2599203 - protein, 26 aa, Entamoeba histolytica
TNSMTLWMMILVICAVIGSTLYQLRS

SEQ ID NO: 2599204 - protein, 38 aa, Entamoeba histolytica
TNSRRMYILAGCYYLITKGWSFLFSKEQRIAKKLHHFF

SEQ ID NO: 2599205 - protein, 25 aa, Entamoeba histolytica
TNSVSLNILFINYGTLSITKGIGTI

SEQ ID NO: 2599206 - protein, 27 aa, Entamoeba histolytica
TNWQKFSAHFLVFGRVFRLNLKEIPWM

SEQ ID NO: 2599207 - protein, 18 aa, Entamoeba histolytica
TNYFEFSKSTFFIVKSVI

SEQ ID NO: 2599208 - protein, 18 aa, Entamoeba histolytica
TNYYLFIASLEHGYDGMI

SEQ ID NO: 2599209 - protein, 23 aa, Entamoeba histolytica
TPALKAITIIILIIDSIMRNDTQ

SEQ ID NO: 2599210 - protein, 24 aa, Entamoeba histolytica
TPESPLFFLKWLNRRRNDLGESKI

SEQ ID NO: 2599211 - protein, 31 aa, Entamoeba histolytica
TPIDIFSFSIVLYEIWKWDKAYPVEEFKFPW

SEQ ID NO: 2599212 - protein, 39 aa, Entamoeba histolytica
TPIISKLQSLLTRGLMIKYLHLLITLVTLTPEVATKHFT

SEQ ID NO: 2599213 - protein, 23 aa, Entamoeba histolytica
TPLNNGPILPTGPILMYETQHFI

SEQ ID NO: 2599214 - protein, 32 aa, Entamoeba histolytica
TPMFYTLACIFLSFFFVLFFGLFPLSLLELLQ

SEQ ID NO: 2599215 - protein, 23 aa, Entamoeba histolytica
TPNKLPIVGDSFYLISCDSQPFP

SEQ ID NO: 2599216 - protein, 25 aa, Entamoeba histolytica
TPNNPKYVFYFDPQVKFVSSKSTKK

SEQ ID NO: 2599217 - protein, 24 aa, Entamoeba histolytica
TPNNPKYVFYFEPQILIIRPHTTP

SEQ ID NO: 2599218 - protein, 25 aa, Entamoeba histolytica
TPNNPKYVFYFEPQVLFIRPHSTPK

SEQ ID NO: 2599219 - protein, 26 aa, Entamoeba histolytica
TPPFSAMMILWANLVVDIPPSICLGL

SEQ ID NO: 2599220 - protein, 20 aa, Entamoeba histolytica
TPRMTINIFLIIIGIITLIL

SEQ ID NO: 2599221 - protein, 24 aa, Entamoeba histolytica
TPSLLGIFPNFFSKRGFIPCIKRC

SEQ ID NO: 2599222 - protein, 26 aa, Entamoeba histolytica
TPSLNHPQLIIWNSNRIHLYKPTTTS

SEQ ID NO: 2599223 - protein, 24 aa, Entamoeba histolytica
TPSQKLTRFALFKKNCANIRKWNA

SEQ ID NO: 2599224 - protein, 22 aa, Entamoeba histolytica
TQATIGLLFPHYELKLRDVPEL

SEQ ID NO: 2599225 - protein, 18 aa, Entamoeba histolytica
TQEANFGKSMIKCGVCSP

SEQ ID NO: 2599226 - protein, 24 aa, Entamoeba histolytica
TQEMSKLYIFAFLEDNASASVSIS

SEQ ID NO: 2599227 - protein, 34 aa, Entamoeba histolytica
TQHQTYNRLTNTIQYIHNNIHLIAETTTSSQGAK

SEQ ID NO: 2599228 - protein, 39 aa, Entamoeba histolytica
TQIESNQNKMMDILYKIHLKSEGIKEERTDEVKVKTQIT

SEQ ID NO: 2599229 - protein, 19 aa, Entamoeba histolytica
TQKILIDNSIINDSIRETT

SEQ ID NO: 2599230 - protein, 26 aa, Entamoeba histolytica
TQLDGSRLLWRYLTSWELFAMKNPMS

SEQ ID NO: 2599231 - protein, 18 aa, Entamoeba histolytica
TQLKLGAGVYRLSLLVHE

SEQ ID NO: 2599232 - protein, 24 aa, Entamoeba histolytica
TQLKTIQFVLYYESTNTSEIPIII

SEQ ID NO: 2599233 - protein, 17 aa, Entamoeba histolytica
TQLRHICVVELIGAVYT

SEQ ID NO: 2599234 - protein, 28 aa, Entamoeba histolytica
TQMNSMFQYYLTIIPIKNNFINGTSTFY

SEQ ID NO: 2599235 - protein, 26 aa, Entamoeba histolytica
TQNNQLELFYYLRSIPIRYHSNLIIK

SEQ ID NO: 2599236 - protein, 30 aa, Entamoeba histolytica
TQPSKIIYQTLLINYLAVAIKFAIKGNNNK

SEQ ID NO: 2599237 - protein, 22 aa, Entamoeba histolytica
TQPYTYGIWIKLISLKEQYVSI

SEQ ID NO: 2599238 - protein, 29 aa, Entamoeba histolytica
TQQTLHFKQLFKILELLGYSWAKECYHIS

SEQ ID NO: 2599239 - protein, 28 aa, Entamoeba histolytica
TQSCVDFWVGDWWGIWSTSAYLEQGLRV

SEQ ID NO: 2599240 - protein, 31 aa, Entamoeba histolytica; identical to SEQ ID NO: 2402409

SEQ ID NO: 2599241 - protein, 19 aa, Entamoeba histolytica
TQYPVMPWVISDYSSQELD

SEQ ID NO: 2599242 - protein, 25 aa, Entamoeba histolytica
TRAQIQQFYQLKKSALIIGSIRNYL

SEQ ID NO: 2599243 - protein, 30 aa, Entamoeba histolytica
TRCVSKKLKWYYHLVILIAGVVGVMLIIIC

SEQ ID NO: 2599244 - protein, 27 aa, Entamoeba histolytica
TRDDLPVVSILFYVLGKSLFNTCMTNT

SEQ ID NO: 2599245 - protein, 21 aa, Entamoeba histolytica
TRDIILKYFNAQDDYIIIFTS

SEQ ID NO: 2599246 - protein, 24 aa, Entamoeba histolytica
TRESSIFFSFHDETIFRLGNTDNT

SEQ ID NO: 2599247 - protein, 27 aa, Entamoeba histolytica
TRIIPYIFLIFVSLFLCLLRGSEVIKG

SEQ ID NO: 2599248 - protein, 24 aa, Entamoeba histolytica
TRLNLTFQLFVNSLFYAIPSLITG

SEQ ID NO: 2599249 - protein, 50 aa, Entamoeba histolytica
TRLSKAMKNFLFWGIGACVYLFIYIVGFIICLLLFFRLTKKIKQEIEDEK

SEQ ID NO: 2599250 - protein, 24 aa, Entamoeba histolytica
TRNTKLFDIISFNPLIQTKEIKEI

SEQ ID NO: 2599251 - protein, 27 aa, Entamoeba histolytica
TRQLVLCIIILYIRFYDNIIERWGLGE

SEQ ID NO: 2599252 - protein, 44 aa, Entamoeba histolytica
TRTKMLLEMLPKQFAAFMFFDCHNKFYQEILALARSIDFRRERD

SEQ ID NO: 2599253 - protein, 37 aa, Entamoeba histolytica; identical to SEQ ID NO: 2402425

SEQ ID NO: 2599254 - protein, 36 aa, Entamoeba histolytica
TRVIIYIEVFVFITSYIICYLLIQVSKRSGLIGKPL

SEQ ID NO: 2599255 - protein, 30 aa, Entamoeba histolytica
TRWYVVLCSFVGWYLAFLSPLLMPLDIVST

SEQ ID NO: 2599256 - protein, 17 aa, Entamoeba histolytica
TRYWLDKCPETCNPTVI

SEQ ID NO: 2599257 - protein, 28 aa, Entamoeba histolytica
TSAFIFKFLAYFNLIIDVRLICVCMGPI

SEQ ID NO: 2599258 - protein, 23 aa, Entamoeba histolytica
TSAKGFIEPLYGYFAVYDYNEHE

SEQ ID NO: 2599259 - protein, 41 aa, Entamoeba histolytica
TSCDKHAVWWIILIIVILLLILFVIITLLIVYTVYYILEKR

SEQ ID NO: 2599260 - protein, 30 aa, Entamoeba histolytica; identical to SEQ ID NO: 2402429

SEQ ID NO: 2599261 - protein, 27 aa, Entamoeba histolytica
TSCYFPIPLFYQFFQRREFPRCGTCIK

SEQ ID NO: 2599262 - protein, 28 aa, Entamoeba histolytica
TSDISWDRWFCAFRLKNCFIDLMYAVLS

SEQ ID NO: 2599263 - protein, 19 aa, Entamoeba histolytica
TSEIAMLLDITRIGLFSKM

SEQ ID NO: 2599264 - protein, 24 aa, Entamoeba histolytica
TSENWLITYPTTISGELIVNGTVD

SEQ ID NO: 2599265 - protein, 40 aa, Entamoeba histolytica
TSESLLFDSFYILRQSWYLSLFLTPLGIKVCIKLLQVSTL

SEQ ID NO: 2599266 - protein, 22 aa, Entamoeba histolytica
TSESQYLMKYICSLYNVGTQRG

SEQ ID NO: 2599267 - protein, 32 aa, Entamoeba histolytica
TSGFIMVIVLLAILWFPLLFMSSAAPNFTQPK

SEQ ID NO: 2599268 - protein, 37 aa, Entamoeba histolytica
TSIDNLISLLYPFPPTQKVFAILPYKNLNVLSGSDTF

SEQ ID NO: 2599269 - protein, 24 aa, Entamoeba histolytica
TSIIPIINSFPLGGWYSKPNIIKY

SEQ ID NO: 2599270 - protein, 25 aa, Entamoeba histolytica
TSIIYYLYFTFVLMIVQLFKKILSV

SEQ ID NO: 2599271 - protein, 24 aa, Entamoeba histolytica
TSINNVMFILQTNLYSLTLSGNNS

SEQ ID NO: 2599272 - protein, 21 aa, Entamoeba histolytica
TSIRFYLPRGLLCGLLFSLIL

SEQ ID NO: 2599273 - protein, 20 aa, Entamoeba histolytica
TSKIGFYFSAAFWAFSALTF

SEQ ID NO: 2599274 - protein, 28 aa, Entamoeba histolytica
TSKPEIHRLIFTILKNLIKYHSSIPKSD

SEQ ID NO: 2599275 - protein, 24 aa, Entamoeba histolytica
TSKQYIVMILTYYEKYDTSENLDE

SEQ ID NO: 2599276 - protein, 18 aa, Entamoeba histolytica
TSLFHAIGIFLFCYGSDL

SEQ ID NO: 2599277 - protein, 35 aa, Entamoeba histolytica
TSLGRIYCTLYILAFFFIFPMRLGQIITALNQRSQ

SEQ ID NO: 2599278 - protein, 24 aa, Entamoeba histolytica
TSLILPMYGIITLKGTFVNKKRIP

SEQ ID NO: 2599279 - protein, 24 aa, Entamoeba histolytica
TSLIPFIVLLYKPSFSKFGKVICL

SEQ ID NO: 2599280 - protein, 24 aa, Entamoeba histolytica
TSLLKMWLHFIHFCGNVANITNPD

SEQ ID NO: 2599281 - protein, 26 aa, Entamoeba histolytica
TSLLPILVIIPLWYISLPTNNDMQLF

SEQ ID NO: 2599282 - protein, 25 aa, Entamoeba histolytica
TSLPGFVLLLFLFSIDLSILVYVPT

SEQ ID NO: 2599283 - protein, 18 aa, Entamoeba histolytica
TSLQFFPVLIASYIIRIP

SEQ ID NO: 2599284 - protein, 25 aa, Entamoeba histolytica
TSNKSYYFEILTNPSHRYSLEVNPV

SEQ ID NO: 2599285 - protein, 27 aa, Entamoeba histolytica
TSNLAFDFVYLLPFTINIDNDKKMYLN

SEQ ID NO: 2599286 - protein, 26 aa, Entamoeba histolytica
TSPEFFEFFSFIDNLLMNEAVALNIV

SEQ ID NO: 2599287 - protein, 23 aa, Entamoeba histolytica
TSPIICCFIFMILCGLLNGLSIS

SEQ ID NO: 2599288 - protein, 23 aa, Entamoeba histolytica
TSPLSKIIIGILSGIFVIAFCII

SEQ ID NO: 2599289 - protein, 23 aa, Entamoeba histolytica
TSQPEYVLLKYNKVITPFVKVTG

SEQ ID NO: 2599290 - protein, 23 aa, Entamoeba histolytica
TSQTNIITLILKSGSSLHSTKQM

SEQ ID NO: 2599291 - protein, 22 aa, Entamoeba histolytica
TSRKISFLFIFSLGGYLLGLVI

SEQ ID NO: 2599292 - protein, 25 aa, Entamoeba histolytica
TSSEYIKFWYNEDIKWLFVMSQNTD

SEQ ID NO: 2599293 - protein, 17 aa, Entamoeba histolytica
TSSSILSSILYLLHLYL

SEQ ID NO: 2599294 - protein, 25 aa, Entamoeba histolytica
TSSTIFQFIIIGILSYVFIHNIIKI

SEQ ID NO: 2599295 - protein, 23 aa, Entamoeba histolytica
TSTLSIIFRISGGILAILFSLSY

SEQ ID NO: 2599296 - protein, 23 aa, Entamoeba histolytica
TSTSCVLCSPGYWFNGNSCVKCN

SEQ ID NO: 2599297 - protein, 24 aa, Entamoeba histolytica
TSTSLPLGWYYPVIYHYGQKELYG

SEQ ID NO: 2599298 - protein, 29 aa, Entamoeba histolytica
TSTTLSFILFLDFLHLYINMVRLNLFSGF

SEQ ID NO: 2599299 - protein, 19 aa, Entamoeba histolytica
TSVILRNSITLKTNEIRNT

SEQ ID NO: 2599300 - protein, 25 aa, Entamoeba histolytica
TSYLALYYNIFLSKSIRSPKNSISI

SEQ ID NO: 2599301 - protein, 17 aa, Entamoeba histolytica
TTAIFLRWVNRVDELMV

SEQ ID NO: 2599302 - protein, 30 aa, Entamoeba histolytica
TTCIALIISLYIFFFQFTFALDKDLINNTT

SEQ ID NO: 2599303 - protein, 19 aa, Entamoeba histolytica
TTDLLKRKPFKRTDSLLSK

SEQ ID NO: 2599304 - protein, 32 aa, Entamoeba histolytica
TTDNLYCRMSLYDKNYIKLTSDFYFTLTSDVL

SEQ ID NO: 2599305 - protein, 25 aa, Entamoeba histolytica
TTEDELSMFFYYGTLHQMSASYQEL

SEQ ID NO: 2599306 - protein, 18 aa, Entamoeba histolytica
TTESIMTLLLFSGVDPTK

SEQ ID NO: 2599307 - protein, 25 aa, Entamoeba histolytica
TTGGDTNQVLPKPEKPQPTETNAQT

SEQ ID NO: 2599308 - protein, 34 aa, Entamoeba histolytica
TTGYGIARILLSLSLCFIGLFIGLSQLFISILPI

SEQ ID NO: 2599309 - protein, 27 aa, Entamoeba histolytica
TTHIMYSIIFFVLAAISIVLVPIISNT

SEQ ID NO: 2599310 - protein, 19 aa, Entamoeba histolytica
TTIFDIRTTKEIKINFCNE

SEQ ID NO: 2599311 - protein, 26 aa, Entamoeba histolytica
TTIKKQPFILLSPAILVAVTGGCATF

SEQ ID NO: 2599312 - protein, 24 aa, Entamoeba histolytica
TTILLSIYLLCWTLFTIYAWTAHE

SEQ ID NO: 2599313 - protein, 27 aa, Entamoeba histolytica
TTILYSIPLIILYISYKTWYSFLDVSN

SEQ ID NO: 2599314 - protein, 23 aa, Entamoeba histolytica
TTIPVISWFFPFIGHTAICDMEG

SEQ ID NO: 2599315 - protein, 32 aa, Entamoeba histolytica
TTIQQWLVSDFLPSLLNSLLTHIRKALLLFSR

SEQ ID NO: 2599316 - protein, 24 aa, Entamoeba histolytica
TTKLFSIISYVIIGLLILSETYNF

SEQ ID NO: 2599317 - protein, 19 aa, Entamoeba histolytica
TTLLLWKYIFPKYGTCSAN

SEQ ID NO: 2599318 - protein, 30 aa, Entamoeba histolytica
TTLLTICVLLNWTFKPPITRAFVSFLPKIM

SEQ ID NO: 2599319 - protein, 17 aa, Entamoeba histolytica
TTLPEIISLFPSSAPIT

SEQ ID NO: 2599320 - protein, 19 aa, Entamoeba histolytica
TTLPYNLLNIIKTFGSKEK

SEQ ID NO: 2599321 - protein, 20 aa, Entamoeba histolytica
TTLPYNLLNIIKTFGSKEKN

SEQ ID NO: 2599322 - protein, 22 aa, Entamoeba histolytica
TTMLIYVFSYWRGIVSSLKLFL

SEQ ID NO: 2599323 - protein, 35 aa, Entamoeba histolytica
TTNCVAAKFNWWRITDLVDYFIIAVTIVVVAVPEG

SEQ ID NO: 2599324 - protein, 26 aa, Entamoeba histolytica
TTNFIIKYILWWFGLGVLSSVGLGTG

SEQ ID NO: 2599325 - protein, 26 aa, Entamoeba histolytica
TTNNDDIYLIYTVPQGIFIDKYQMQE

SEQ ID NO: 2599326 - protein, 30 aa, Entamoeba histolytica
TTNNTACLWCLLFLTLLSVSVSLVMGVVGV

SEQ ID NO: 2599327 - protein, 34 aa, Entamoeba histolytica
TTNYIIFYGIALLYFLLVIFSLYLSFSSPSSQSN

SEQ ID NO: 2599328 - protein, 22 aa, Entamoeba histolytica
TTQIKSFRLSPSGEYLFGILPN

SEQ ID NO: 2599329 - protein, 35 aa, Entamoeba histolytica
TTSSIQFKSISPSTLPLIISDILTFTTMDITTTNS

SEQ ID NO: 2599330 - protein, 24 aa, Entamoeba histolytica
TTSTFPQQLFSIKLRYLDLSCDKI

SEQ ID NO: 2599331 - protein, 25 aa, Entamoeba histolytica
TTTGLVYKIIGGIGMFALVVVALVE

SEQ ID NO: 2599332 - protein, 23 aa, Entamoeba histolytica
TTTIPFVFSIIIDKTILNIKDLA

SEQ ID NO: 2599333 - protein, 18 aa, Entamoeba histolytica
TTVNFYNITISNTILHID

SEQ ID NO: 2599334 - protein, 26 aa, Entamoeba histolytica
TTWGTLSILWLLFKDAKYVSNKAILF

SEQ ID NO: 2599335 - protein, 20 aa, Entamoeba histolytica
TTYNCPPIRCSYKQENKLPT

SEQ ID NO: 2599336 - protein, 21 aa, Entamoeba histolytica
TTYNCPPIRCSYKQENKLPTG

SEQ ID NO: 2599337 - protein, 24 aa, Entamoeba histolytica
TVAQFKFMYFNRGLMYFFMTVSII

SEQ ID NO: 2599338 - protein, 25 aa, Entamoeba histolytica
TVCYFTYSYIYRKGEKWYLPDTDNV

SEQ ID NO: 2599339 - protein, 20 aa, Entamoeba histolytica
TVDNMVILSFIELPFKNISG

SEQ ID NO: 2599340 - protein, 18 aa, Entamoeba histolytica
TVDPFIALLGRMIPSPHL

SEQ ID NO: 2599341 - protein, 23 aa, Entamoeba histolytica
TVENPFFSFLSPNIEFGKEVPLD

SEQ ID NO: 2599342 - protein, 27 aa, Entamoeba histolytica
TVFQMIHKILLLIQTPETLCVLLPNKS

SEQ ID NO: 2599343 - protein, 25 aa, Entamoeba histolytica
TVGFKIFIGMFIGIAVVIVAIIVIG

SEQ ID NO: 2599344 - protein, 17 aa, Entamoeba histolytica
TVHRPECAIPFKYSLPI

SEQ ID NO: 2599345 - protein, 42 aa, Entamoeba histolytica
TVLERFGAKGIMISLLVVAVCGLLLIFGMIIVKFAKRNNNEY

SEQ ID NO: 2599346 - protein, 19 aa, Entamoeba histolytica
TVLFLNEYLGKSSDPFIGY

SEQ ID NO: 2599347 - protein, 17 aa, Entamoeba histolytica
TVLFVMTTVYFSGVMSR

SEQ ID NO: 2599348 - protein, 22 aa, Entamoeba histolytica
TVLRQLLLGLSFNINIVGYLYH

SEQ ID NO: 2599349 - protein, 17 aa, Entamoeba histolytica
TVLSLRLPILTVVSHDD

SEQ ID NO: 2599350 - protein, 18 aa, Entamoeba histolytica
TVLVILGALFHNPQIKKS

SEQ ID NO: 2599351 - protein, 25 aa, Entamoeba histolytica
TVMNTLMFLVLFAKLYNFIDRKTGG

SEQ ID NO: 2599352 - protein, 40 aa, Entamoeba histolytica
TVQKYIHCIPTQEIYYWSIILIKLLMFILKNKRKDYRKEI

SEQ ID NO: 2599353 - protein, 30 aa, Entamoeba histolytica
TVRQLYRYANWLDLILLAVGIFGSIGCGVL

SEQ ID NO: 2599354 - protein, 19 aa, Entamoeba histolytica
TVSAPYKLTINKLGSDSSE

SEQ ID NO: 2599355 - protein, 28 aa, Entamoeba histolytica
TVVIFLVIMILIFIHKVKNLSFCFVSTI

SEQ ID NO: 2599356 - protein, 27 aa, Entamoeba histolytica
TVVTNKFLVILRYLFAVIVIGVIVGAI

SEQ ID NO: 2599357 - protein, 26 aa, Entamoeba histolytica
TVVTPPTRLPWHIRMLKKASESGEDF

SEQ ID NO: 2599358 - protein, 26 aa, Entamoeba histolytica
TVVVDCLFVVWIYWNKSNIEEWKELQ

SEQ ID NO: 2599359 - protein, 20 aa, Entamoeba histolytica
TVVVICICCILLLVVHPHRD

SEQ ID NO: 2599360 - protein, 29 aa, Entamoeba histolytica
TVYKPNLILKVLGSFLPFSIYINDEKKMY

SEQ ID NO: 2599361 - protein, 19 aa, Entamoeba histolytica
TVYLLLLFSYIVIKLFFVV

SEQ ID NO: 2599362 - protein, 25 aa, Entamoeba histolytica
TVYSLFYVFLLFYVLITFEFYRYGK

SEQ ID NO: 2599363 - protein, 19 aa, Entamoeba histolytica
TWEDPFPKTQFKFAWDIAD

SEQ ID NO: 2599364 - protein, 20 aa, Entamoeba histolytica
TWEVQMPSRISPELAYVGFF

SEQ ID NO: 2599365 - protein, 17 aa, Entamoeba histolytica
TWLVSLLIIVTYHIAQI

SEQ ID NO: 2599366 - protein, 41 aa, Entamoeba histolytica
TYCEIAPVWWVITLIILVLIMLLISIVILTGCIARMVLKKV

SEQ ID NO: 2599367 - protein, 46 aa, Entamoeba histolytica
TYCNYKLNYFLVVGLPVIIITFILLIILLSIIVSSIIIYKCSKSKK

SEQ ID NO: 2599368 - protein, 35 aa, Entamoeba histolytica
TYCSLFLGIVYFSQSFCFWVLGQFSYWQYKQTLNI

SEQ ID NO: 2599369 - protein, 45 aa, Entamoeba histolytica
TYCSSYIEWWLIILMILFILCLFVLILIVFYCIINRYQHFLVQHH

SEQ ID NO: 2599370 - protein, 17 aa, Entamoeba histolytica
TYEYVFASSLFVFWKII

SEQ ID NO: 2599371 - protein, 28 aa, Entamoeba histolytica
TYFLGYLIPLILYLWLTYYPPHLTQEKI

SEQ ID NO: 2599372 - protein, 20 aa, Entamoeba histolytica
TYFMMYAIIFRNQPFIYNQT

SEQ ID NO: 2599373 - protein, 20 aa, Entamoeba histolytica
TYHYGVWLRYSHDPSFKYTA

SEQ ID NO: 2599374 - protein, 18 aa, Entamoeba histolytica
TYIDEHLITWKDGKKFFP

SEQ ID NO: 2599375 - protein, 22 aa, Entamoeba histolytica
TYIKGKLFITNYRVLFIPSQFI

SEQ ID NO: 2599376 - protein, 27 aa, Entamoeba histolytica
TYIKIYIFIYFIIFIPSLFIGSWKFFI

SEQ ID NO: 2599377 - protein, 25 aa, Entamoeba histolytica
TYIPEICMVTIYMPLGSLSNYIRKD

SEQ ID NO: 2599378 - protein, 32 aa, Entamoeba histolytica
TYIRQIALLMILSHMGCFIPAKAASIRPLTNI

SEQ ID NO: 2599379 - protein, 26 aa, Entamoeba histolytica
TYKRTLFLIAMAVFTLFLILLTVVFN

SEQ ID NO: 2599380 - protein, 42 aa, Entamoeba histolytica
TYLHVGIGLLCGLIVIIFIVIIIGIILYRKIKRIDIRIFKLQ

SEQ ID NO: 2599381 - protein, 23 aa, Entamoeba histolytica
TYLKYYIVIIFILLLPSEFLSFK

SEQ ID NO: 2599382 - protein, 31 aa, Entamoeba histolytica
TYMTLVVIFICELIALVLYLKRKKLLVLVAL

SEQ ID NO: 2599383 - protein, 27 aa, Entamoeba histolytica
TYNFNKPQLFITTIIVLVVTVVLSFIT

SEQ ID NO: 2599384 - protein, 34 aa, Entamoeba histolytica
TYNRLTNTIQNIYNNIHLIAEAPSESVPQALKDN

SEQ ID NO: 2599385 - protein, 36 aa, Entamoeba histolytica
TYNRLTNTIQNIYNNIHLIAETLSEPALANSQSASQ

SEQ ID NO: 2599386 - protein, 21 aa, Entamoeba histolytica
TYRVRKLSFYAICRQDIGWFD

SEQ ID NO: 2599387 - protein, 29 aa, Entamoeba histolytica
TYRYQYIIWGYFIVTTLCVYLSLIHERKE

SEQ ID NO: 2599388 - protein, 27 aa, Entamoeba histolytica
TYSGDVPNKFYLACYGRALIYNIDTKY

SEQ ID NO: 2599389 - protein, 23 aa, Entamoeba histolytica
TYSVPLAIIMFSAMFRELREDIR

SEQ ID NO: 2599390 - protein, 21 aa, Entamoeba histolytica
TYVLIMTLIIFLLPKVYGDSS

SEQ ID NO: 2599391 - protein, 24 aa, Entamoeba histolytica
VAEWISIIMFFFALSQRKQGSIKI

SEQ ID NO: 2599392 - protein, 23 aa, Entamoeba histolytica
VAFIIRSLLFKLGRMYVPDEFPY

SEQ ID NO: 2599393 - protein, 25 aa, Entamoeba histolytica
VAIGCSGILLFIYPYCLPPEVRERE

SEQ ID NO: 2599394 - protein, 24 aa, Entamoeba histolytica
VAIGLLFHLHFLSLQRWLDEDQRE

SEQ ID NO: 2599395 - protein, 24 aa, Entamoeba histolytica
VAIHYGGFNIMWKIVKERAKDRDE

SEQ ID NO: 2599396 - protein, 29 aa, Entamoeba histolytica
VAKEIFKLLILKFPTLPPIEIPSVTFIEM

SEQ ID NO: 2599397 - protein, 34 aa, Entamoeba histolytica
VANGIFLIMYLKPVWWVCILITIYVIIVALSRIY

SEQ ID NO: 2599398 - protein, 33 aa, Entamoeba histolytica; identical to SEQ ID NO: 2402551

SEQ ID NO: 2599399 - protein, 17 aa, Entamoeba histolytica
VARTIMFYIQDEVLKIK

SEQ ID NO: 2599400 - protein, 34 aa, Entamoeba histolytica
VASLVAGLVYFVWSFASYKPVYLLDFAVAELPEE

SEQ ID NO: 2599401 - protein, 37 aa, Entamoeba histolytica
VATFLSYYPVKIIGLFFFIAFFIFSLNYVPKTMLGLP

SEQ ID NO: 2599402 - protein, 33 aa, Entamoeba histolytica
VATSNFRKVLFGILFLLHYLCLKKIITIHFTFD

SEQ ID NO: 2599403 - protein, 30 aa, Entamoeba histolytica
VAVAIILIWPNTFFVLYISVAIWPFCTAFF

SEQ ID NO: 2599404 - protein, 25 aa, Entamoeba histolytica
VAVALCVWFIDGDWKYYLDPSLSVI

SEQ ID NO: 2599405 - protein, 17 aa, Entamoeba histolytica
VAVTFLIGSLLQVFLCV

SEQ ID NO: 2599406 - protein, 22 aa, Entamoeba histolytica
VAYIYPTFYSACDYVFHFLVRV

SEQ ID NO: 2599407 - protein, 18 aa, Entamoeba histolytica
VCFLFVSLLSTLLFFVDK

SEQ ID NO: 2599408 - protein, 19 aa, Entamoeba histolytica
VCGSKKSWYARHTGLKCIQ

SEQ ID NO: 2599409 - protein, 17 aa, Entamoeba histolytica
VCIAGVVLIPLGIYVTY

SEQ ID NO: 2599410 - protein, 26 aa, Entamoeba histolytica
VCLFCREFHFHLTLALWDNFMLDNGF

SEQ ID NO: 2599411 - protein, 21 aa, Entamoeba histolytica
VCLNFPLIIPKSVKFLNRIST

SEQ ID NO: 2599412 - protein, 17 aa, Entamoeba histolytica
VCRSCIDGYYNNQIKCL

SEQ ID NO: 2599413 - protein, 19 aa, Entamoeba histolytica
VCSKAGGPILYYPDPNKIS

SEQ ID NO: 2599414 - protein, 18 aa, Entamoeba histolytica
VCSSGISMVSMVFVFIIF

SEQ ID NO: 2599415 - protein, 25 aa, Entamoeba histolytica
VCTAPKIISLPFTTVGFIDTTQSNT

SEQ ID NO: 2599416 - protein, 24 aa, Entamoeba histolytica
VCTIFLFINPYFALLYGFILGVTS

SEQ ID NO: 2599417 - protein, 25 aa, Entamoeba histolytica
VCVILPFVILFFIATPKLDLSQLVN

SEQ ID NO: 2599418 - protein, 20 aa, Entamoeba histolytica
VCVVWTKCMCFYPQAVLEES

SEQ ID NO: 2599419 - protein, 18 aa, Entamoeba histolytica
VDAVPFWDAIRNCLDSDA

SEQ ID NO: 2599420 - protein, 23 aa, Entamoeba histolytica
VDDRFNIFQWRNGTRLISVSHDI

SEQ ID NO: 2599421 - protein, 25 aa, Entamoeba histolytica
VDERINLYKFFDNKLGQFIAKAKDI

SEQ ID NO: 2599422 - protein, 27 aa, Entamoeba histolytica
VDFLKSVSCKMLVIGLGLLHLCCGESA

SEQ ID NO: 2599423 - protein, 20 aa, Entamoeba histolytica
VDFLNVFRDSSILFRANSVE

SEQ ID NO: 2599424 - protein, 26 aa, Entamoeba histolytica
VDGDAAMFIAIDFGLCYYIDETESTE

SEQ ID NO: 2599425 - protein, 27 aa, Entamoeba histolytica
VDGSKHVFVKFFAPWCGHCKKLAPEYI

SEQ ID NO: 2599426 - protein, 25 aa, Entamoeba histolytica
VDGYVNLFQLLKDAGKPKKAEEVFK

SEQ ID NO: 2599427 - protein, 18 aa, Entamoeba histolytica
VDIFTSLPTRVTFDNPVS

SEQ ID NO: 2599428 - protein, 17 aa, Entamoeba histolytica
VDILTIIESWGEDIRYA

SEQ ID NO: 2599429 - protein, 26 aa, Entamoeba histolytica
VDKSLYIIYSIYLMIAFRPKKIISSS

SEQ ID NO: 2599430 - protein, 19 aa, Entamoeba histolytica
VDLKLLIALTIHLCKNNQT

SEQ ID NO: 2599431 - protein, 18 aa, Entamoeba histolytica
VDMLLSILIDLQGLLTVA

SEQ ID NO: 2599432 - protein, 27 aa, Entamoeba histolytica
VDMMKPYTYGYWFNITFEKASKVMIEV

SEQ ID NO: 2599433 - protein, 24 aa, Entamoeba histolytica
VDQISLSQFIFLKNLFKFNDRYNN

SEQ ID NO: 2599434 - protein, 28 aa, Entamoeba histolytica
VDSYYQVFIKIILLTSLLVIITLINYLT

SEQ ID NO: 2599435 - protein, 19 aa, Entamoeba histolytica
VDVLGVIPFLVESLKQLNS

SEQ ID NO: 2599436 - protein, 18 aa, Entamoeba histolytica
VDVLNIIMECNTLHFAST

SEQ ID NO: 2599437 - protein, 17 aa, Entamoeba histolytica
VDVYAYGIVLYETFIEK

SEQ ID NO: 2599438 - protein, 17 aa, Entamoeba histolytica
VDYLPADKQFLITRNIR

SEQ ID NO: 2599439 - protein, 26 aa, Entamoeba histolytica
VECFLRLVLMLLLSILLKTRDYVFKP

SEQ ID NO: 2599440 - protein, 20 aa, Entamoeba histolytica
VEFFLRNSELYYRSIEFLKQ

SEQ ID NO: 2599441 - protein, 20 aa, Entamoeba histolytica
VEFNLFVKPYCTCKVDDPIL

SEQ ID NO: 2599442 - protein, 17 aa, Entamoeba histolytica
VEGGLSYLPLTKEYLNT

SEQ ID NO: 2599443 - protein, 18 aa, Entamoeba histolytica
VEGNYFIYSLETSPKTEN

SEQ ID NO: 2599444 - protein, 37 aa, Entamoeba histolytica
VEKYGYIFVFVLFFILLLPFLVIPVVIWMNKMGCRKK

SEQ ID NO: 2599445 - protein, 20 aa, Entamoeba histolytica
VELLEKIRCPYIINFIGSVT

SEQ ID NO: 2599446 - protein, 33 aa, Entamoeba histolytica
VELPGSEILIPQFFKMFLAFKKVGLDGNNEMKM

SEQ ID NO: 2599447 - protein, 24 aa, Entamoeba histolytica
VELSFQYFVTNNLLNRLAVCIGKK

SEQ ID NO: 2599448 - protein, 25 aa, Entamoeba histolytica
VELSSNQLVIFDPIVWQCENGATNI

SEQ ID NO: 2599449 - protein, 28 aa, Entamoeba histolytica
VENKLTFLLLFVLILFNNPFFTYEYVFA

SEQ ID NO: 2599450 - protein, 29 aa, Entamoeba histolytica
VESQTFGCMFLLIDLMRNWFLSSNDNLPN

SEQ ID NO: 2599451 - protein, 29 aa, Entamoeba histolytica
VESVQQYFKLVVGTLYLNKDIDVGKYCEL

SEQ ID NO: 2599452 - protein, 18 aa, Entamoeba histolytica
VETPYPMRKSMFKSFMNI

SEQ ID NO: 2599453 - protein, 19 aa, Entamoeba histolytica
VEYFFAPYLSMKGFDVLSD

SEQ ID NO: 2599454 - protein, 19 aa, Entamoeba histolytica
VEYIKRGALHISYYDLNVY

SEQ ID NO: 2599455 - protein, 23 aa, Entamoeba histolytica
VEYLIRLPKNSVMPELFIVIVKI

SEQ ID NO: 2599456 - protein, 17 aa, Entamoeba histolytica
VEYLLPLRLKHQYHDGY

SEQ ID NO: 2599457 - protein, 20 aa, Entamoeba histolytica
VFCFYYLIEYLYFNSNQFYS

SEQ ID NO: 2599458 - protein, 22 aa, Entamoeba histolytica
VFCIEWWLVMPGIIIFVILISV

SEQ ID NO: 2599459 - protein, 22 aa, Entamoeba histolytica
VFCSPHILTDKPVIEFYGDDEL

SEQ ID NO: 2599460 - protein, 24 aa, Entamoeba histolytica
VFDSFKKVIIYAQPKKSGGVHISV

SEQ ID NO: 2599461 - protein, 26 aa, Entamoeba histolytica
VFEQKGYLQLLMFSAKLINFQASYSN

SEQ ID NO: 2599462 - protein, 37 aa, Entamoeba histolytica
VFFGFDEFIAILTNPLLFILTLIIGGGVYIGYKLNLG

SEQ ID NO: 2599463 - protein, 23 aa, Entamoeba histolytica
VFFSPFIIIQLYFTVKKLLSSNT

SEQ ID NO: 2599464 - protein, 23 aa, Entamoeba histolytica
VFFYDQRTIFYFFKKNFENKACV

SEQ ID NO: 2599465 - protein, 17 aa, Entamoeba histolytica
VFGLTIILSFEIIPELN

SEQ ID NO: 2599466 - protein, 32 aa, Entamoeba histolytica
VFGPFYSMLLMFCIGIFWIIVGTLILISSESE

SEQ ID NO: 2599467 - protein, 32 aa, Entamoeba histolytica
VFGPHQFPEKLIPKFITLLDRGKNCPIHGSGE

SEQ ID NO: 2599468 - protein, 32 aa, Entamoeba histolytica
VFGPHQFPEKLIPKFITLLDRGKNCPLHGCGE

SEQ ID NO: 2599469 - protein, 22 aa, Entamoeba histolytica
VFGPLIVLIIILLCCAFHSNDI

SEQ ID NO: 2599470 - protein, 19 aa, Entamoeba histolytica
VFHMTFGVILSLFNHLHEK

SEQ ID NO: 2599471 - protein, 22 aa, Entamoeba histolytica
VFIAYFWFFLTLLEAVGLFLLI

SEQ ID NO: 2599472 - protein, 34 aa, Entamoeba histolytica; identical to SEQ ID NO: 2402620

SEQ ID NO: 2599473 - protein, 17 aa, Entamoeba histolytica
VFILHSKKQLISHGVLQ

SEQ ID NO: 2599474 - protein, 36 aa, Entamoeba histolytica
VFKESTWNIIRKIVMLLLSCILLIASCFFAFFESRR

SEQ ID NO: 2599475 - protein, 36 aa, Entamoeba histolytica
VFKKRGIAVIPNYVFWLSLPMLIKDGCKFIFCCKKP

SEQ ID NO: 2599476 - protein, 17 aa, Entamoeba histolytica
VFKNIYFFITAPLGICL

SEQ ID NO: 2599477 - protein, 27 aa, Entamoeba histolytica
VFKSYSVLLKWFNTTSICGFYRVLQNK

SEQ ID NO: 2599478 - protein, 27 aa, Entamoeba histolytica
VFLFTLLCHIIVRLIPWLHILSESIVS

SEQ ID NO: 2599479 - protein, 17 aa, Entamoeba histolytica
VFMCYWMGNVVNGIFTV

SEQ ID NO: 2599480 - protein, 23 aa, Entamoeba histolytica
VFNECLYFKGEFPSILLERCKTF

SEQ ID NO: 2599481 - protein, 24 aa, Entamoeba histolytica
VFPIVLFFTMLSWLTLVVNITGFT

SEQ ID NO: 2599482 - protein, 24 aa, Entamoeba histolytica
VFPLWFHYIFYWVSVIGASLFILY

SEQ ID NO: 2599483 - protein, 17 aa, Entamoeba histolytica
VFQMLQHPLSFLPLLVL

SEQ ID NO: 2599484 - protein, 24 aa, Entamoeba histolytica
VFRDILMRFVVYFSTRAETKSEFV

SEQ ID NO: 2599485 - protein, 20 aa, Entamoeba histolytica
VFSDYLFYPIIEIATCKFSD

SEQ ID NO: 2599486 - protein, 22 aa, Entamoeba histolytica
VFSFAICMLEIWLGKEPYDPMK

SEQ ID NO: 2599487 - protein, 19 aa, Entamoeba histolytica
VFSFAITAWELFYAKEPYS

SEQ ID NO: 2599488 - protein, 17 aa, Entamoeba histolytica
VFSIPSFFNNKQLDILY

SEQ ID NO: 2599489 - protein, 24 aa, Entamoeba histolytica
VFSYAICLLEIWLGRSPYNPVKFP

SEQ ID NO: 2599490 - protein, 18 aa, Entamoeba histolytica
VFTIFIKPLICCCITHTL

SEQ ID NO: 2599491 - protein, 23 aa, Entamoeba histolytica
VFTRYEIFGILACSFFGIERSKI

SEQ ID NO: 2599492 - protein, 31 aa, Entamoeba histolytica
VFTSIIVSLTLLRFRILKKNKLKYTLENMPK

SEQ ID NO: 2599493 - protein, 29 aa, Entamoeba histolytica
VFVCFQFIYMLAFIFFTFMNIKKDAYVLK

SEQ ID NO: 2599494 - protein, 23 aa, Entamoeba histolytica
VFVNAITMIKRLVPLFQMIGCSV

SEQ ID NO: 2599495 - protein, 23 aa, Entamoeba histolytica
VFYKHYILCHTLRLRFSLNSVNI

SEQ ID NO: 2599496 - protein, 35 aa, Entamoeba histolytica
VGALYFIFPKLIKHWLFWYIFSMIIFVFSVGGLVY

SEQ ID NO: 2599497 - protein, 32 aa, Entamoeba histolytica
VGGVLVYHPFVLHSLIRLIRFALNVKQQQLVL

SEQ ID NO: 2599498 - protein, 21 aa, Entamoeba histolytica
VGHAALALGLIFQGTMDGDIA

SEQ ID NO: 2599499 - protein, 22 aa, Entamoeba histolytica
VGIAFLILFIGTFIAHFAGYSL

SEQ ID NO: 2599500 - protein, 17 aa, Entamoeba histolytica
VGLGLGAVMFFIMGAFS

SEQ ID NO: 2599501 - protein, 17 aa, Entamoeba histolytica
VGLIINIIALPILYYQA

SEQ ID NO: 2599502 - protein, 17 aa, Entamoeba histolytica
VGLLLVYGIVHNKKAIL

SEQ ID NO: 2599503 - protein, 19 aa, Entamoeba histolytica
VGLNCRLFISGQKMIYFNH

SEQ ID NO: 2599504 - protein, 19 aa, Entamoeba histolytica
VGLTFFDITKKLAGYLMIF

SEQ ID NO: 2599505 - protein, 22 aa, Entamoeba histolytica
VGLYIILFCLVLFKKFGVSLIP

SEQ ID NO: 2599506 - protein, 27 aa, Entamoeba histolytica
VGMGILILNIWFIGIVIAAFIALFIEG

SEQ ID NO: 2599507 - protein, 17 aa, Entamoeba histolytica
VGNTIILSFLGSILLYI

SEQ ID NO: 2599508 - protein, 25 aa, Entamoeba histolytica
VGPLALYVLIYLISLLAGYPSLLQN

SEQ ID NO: 2599509 - protein, 21 aa, Entamoeba histolytica
VGPMLNVQYISLGSLGLFIKL

SEQ ID NO: 2599510 - protein, 26 aa, Entamoeba histolytica
VGQNKFMNFVIFFHSVLQPNNEIKEH

SEQ ID NO: 2599511 - protein, 26 aa, Entamoeba histolytica
VGRRTWILLIFAFISLAINIVGMILW

SEQ ID NO: 2599512 - protein, 17 aa, Entamoeba histolytica
VGSKQLYGLYDLSFPIF

SEQ ID NO: 2599513 - protein, 25 aa, Entamoeba histolytica
VGSLFLIFVFFYPSTAKYFIYASVF

SEQ ID NO: 2599514 - protein, 24 aa, Entamoeba histolytica
VGTEDGLILIFKYSQDEAIQQTAI

SEQ ID NO: 2599515 - protein, 26 aa, Entamoeba histolytica
VGTKDHWFFIDFYSFIDPIQIESIQK

SEQ ID NO: 2599516 - protein, 26 aa, Entamoeba histolytica
VGVLFLNFVYLFLRMPFHSFMFHLHL

SEQ ID NO: 2599517 - protein, 24 aa, Entamoeba histolytica
VGVYIAFVPTAWWLHPSEDSIYIS

SEQ ID NO: 2599518 - protein, 17 aa, Entamoeba histolytica
VGYLFQHVVPLVFVLTV

SEQ ID NO: 2599519 - protein, 18 aa, Entamoeba histolytica
VGYLSLLNSMGYTIILKR

SEQ ID NO: 2599520 - protein, 17 aa, Entamoeba histolytica
VHGLISRGGFSSVYTAH

SEQ ID NO: 2599521 - protein, 20 aa, Entamoeba histolytica
VHHIIQIIALLICIILISTN

SEQ ID NO: 2599522 - protein, 17 aa, Entamoeba histolytica
VHIIFKTVLSTKLDYND

SEQ ID NO: 2599523 - protein, 20 aa, Entamoeba histolytica
VHLLLFVLMSLSSAIIGITQ

SEQ ID NO: 2599524 - protein, 21 aa, Entamoeba histolytica
VHNDIQFCFYGMHPQTKKAVK

SEQ ID NO: 2599525 - protein, 18 aa, Entamoeba histolytica
VHYMIVFSVLICYAVQDK

SEQ ID NO: 2599526 - protein, 33 aa, Entamoeba histolytica
VIADFIGRILIPYWIFLILIGCISGIVHWKVTS

SEQ ID NO: 2599527 - protein, 25 aa, Entamoeba histolytica
VIAFLGIFLIYLDYSTFIGFPLKPI

SEQ ID NO: 2599528 - protein, 34 aa, Entamoeba histolytica; identical to SEQ ID NO: 2402667

SEQ ID NO: 2599529 - protein, 20 aa, Entamoeba histolytica
VIALFKQIHFILDKVYCIYS

SEQ ID NO: 2599530 - protein, 25 aa, Entamoeba histolytica
VIALVVLLCYLIRLNYSYIKRQAES

SEQ ID NO: 2599531 - protein, 19 aa, Entamoeba histolytica
VICLFISIILLILTPLSYK

SEQ ID NO: 2599532 - protein, 19 aa, Entamoeba histolytica
VICLKELLLLLRYTPRYEQ

SEQ ID NO: 2599533 - protein, 18 aa, Entamoeba histolytica
VICSFSLKVIPKLEYLKG

SEQ ID NO: 2599534 - protein, 30 aa, Entamoeba histolytica
VIDENVKILFPKYLPLFSKIAYSVKKFFAK

SEQ ID NO: 2599535 - protein, 27 aa, Entamoeba histolytica
VIDSIDIKFIPPTFFIITNKSENELKV

SEQ ID NO: 2599536 - protein, 22 aa, Entamoeba histolytica
VIEDYPELNYNAKVAQYFSFTS

SEQ ID NO: 2599537 - protein, 18 aa, Entamoeba histolytica
VIEICSCIWYIASYIPYA

SEQ ID NO: 2599538 - protein, 32 aa, Entamoeba histolytica
VIELGLYVWYISLLLLILFIPLYILGTTSYNR

SEQ ID NO: 2599539 - protein, 28 aa, Entamoeba histolytica
VIEVITWIIPWFVGGILGVSLSLISERF

SEQ ID NO: 2599540 - protein, 20 aa, Entamoeba histolytica
VIFSSRYIGYVSGHSLIYVR

SEQ ID NO: 2599541 - protein, 29 aa, Entamoeba histolytica
VIGCFILIICTIVLIIKIRNKKKNFFTPF

SEQ ID NO: 2599542 - protein, 27 aa, Entamoeba histolytica
VIGSFVIFMSWIYHKIWKYYERFGYQN

SEQ ID NO: 2599543 - protein, 23 aa, Entamoeba histolytica
VIGYIALIIFISYFGFIQSLFLK

SEQ ID NO: 2599544 - protein, 25 aa, Entamoeba histolytica
VIGYIIRYAILIFPIVNILNEYPLV

SEQ ID NO: 2599545 - protein, 24 aa, Entamoeba histolytica
VIHALPYLGYFLSDVTFINDGNIS

SEQ ID NO: 2599546 - protein, 20 aa, Entamoeba histolytica
VIIFIYIAIVRIMAFCLGYF

SEQ ID NO: 2599547 - protein, 19 aa, Entamoeba histolytica
VIIGCLFFDYFKSKKALRD

SEQ ID NO: 2599548 - protein, 33 aa, Entamoeba histolytica
VIIIEILCFIILIITFLLTFFLYRRSFKVTEVS

SEQ ID NO: 2599549 - protein, 17 aa, Entamoeba histolytica
VIIIILLFIGTLLFYRI

SEQ ID NO: 2599550 - protein, 18 aa, Entamoeba histolytica
VIIKRLNLKWNSNSYERF

SEQ ID NO: 2599551 - protein, 25 aa, Entamoeba histolytica
VIISLVICYFINKASYRFGLPYQYS

SEQ ID NO: 2599552 - protein, 27 aa, Entamoeba histolytica
VILIVFGSWCLVNFFIGKRGIAVLPLY

SEQ ID NO: 2599553 - protein, 18 aa, Entamoeba histolytica
VILLGIKSQRVYPCDDGY

SEQ ID NO: 2599554 - protein, 29 aa, Entamoeba histolytica
VILLSILCFIIYIPTYFVYGQSEPEVQIL

SEQ ID NO: 2599555 - protein, 24 aa, Entamoeba histolytica
VILNILLIIIFLLQTPSYFVTIYE

SEQ ID NO: 2599556 - protein, 19 aa, Entamoeba histolytica
VILNTFFFPGIVVLAIAGI

SEQ ID NO: 2599557 - protein, 20 aa, Entamoeba histolytica
VILNTFFFPSISIIFGLLII

SEQ ID NO: 2599558 - protein, 24 aa, Entamoeba histolytica
VILWKALCIFFFTEAPIVVILSGS

SEQ ID NO: 2599559 - protein, 23 aa, Entamoeba histolytica
VIMKKVIFEPPKPFESRYVNFDG

SEQ ID NO: 2599560 - protein, 21 aa, Entamoeba histolytica
VIMMLAMILFDSSFVHIVSIS

SEQ ID NO: 2599561 - protein, 22 aa, Entamoeba histolytica
VINAFIQYNILITKSIHTESNG

SEQ ID NO: 2599562 - protein, 17 aa, Entamoeba histolytica
VINIAQLVAFFILGFFK

SEQ ID NO: 2599563 - protein, 30 aa, Entamoeba histolytica
VIPFWILWSGLIVLNLFILVVTITSACLLG

SEQ ID NO: 2599564 - protein, 27 aa, Entamoeba histolytica
VIQKYSSNYCVFLFSFRILLYLLFICL

SEQ ID NO: 2599565 - protein, 17 aa, Entamoeba histolytica
VIQLFHSFISKSITGPT

SEQ ID NO: 2599566 - protein, 20 aa, Entamoeba histolytica
VISAIITLLLLLVKKAPKIN

SEQ ID NO: 2599567 - protein, 26 aa, Entamoeba histolytica
VISQEYMIMMLLIYNSFKEENKKKFI

SEQ ID NO: 2599568 - protein, 27 aa, Entamoeba histolytica
VISVFCFILSLIAFIYQFVFFGESDID

SEQ ID NO: 2599569 - protein, 38 aa, Entamoeba histolytica
VISYPALMFPTCAGILRYIPKKWKIVQLWNGRVIILMI

SEQ ID NO: 2599570 - protein, 25 aa, Entamoeba histolytica
VITDQFFFEWSLKLIIDRSSKEISE

SEQ ID NO: 2599571 - protein, 19 aa, Entamoeba histolytica
VITKFEVTGTALSILKSVP

SEQ ID NO: 2599572 - protein, 19 aa, Entamoeba histolytica
VITKKKLITKFLQHKFYQI

SEQ ID NO: 2599573 - protein, 21 aa, Entamoeba histolytica
VITLLTPLCYLFSYSKLLTLV

SEQ ID NO: 2599574 - protein, 25 aa, Entamoeba histolytica
VITRNRYIHIYTTDGNLVVLDDTYS

SEQ ID NO: 2599575 - protein, 20 aa, Entamoeba histolytica
VIVACVIICSGTPLVYSCVK

SEQ ID NO: 2599576 - protein, 25 aa, Entamoeba histolytica
VIVFSKKCFLLVQSIVKFITSALQA

SEQ ID NO: 2599577 - protein, 28 aa, Entamoeba histolytica
VIVGVLAFILIKLYIKARSRLNITGSGG

SEQ ID NO: 2599578 - protein, 20 aa, Entamoeba histolytica
VIVIPLIYKKVGYFNFNWTI

SEQ ID NO: 2599579 - protein, 17 aa, Entamoeba histolytica
VIVLNYNTNRISNNNKI

SEQ ID NO: 2599580 - protein, 27 aa, Entamoeba histolytica
VIVMEKLHRQVLPFILRRLKESVLQDL

SEQ ID NO: 2599581 - protein, 26 aa, Entamoeba histolytica
VIVSYKLLYLPIRFLSKRAQKALNLR

SEQ ID NO: 2599582 - protein, 20 aa, Entamoeba histolytica
VIVVIIIRRKSFSSNSYNYS

SEQ ID NO: 2599583 - protein, 34 aa, Entamoeba histolytica
VIVYGSLLFLKLIYYFILFSIKYLSRSYMYFFGD

SEQ ID NO: 2599584 - protein, 18 aa, Entamoeba histolytica
VIWITLLSCIQQPQLPKY

SEQ ID NO: 2599585 - protein, 32 aa, Entamoeba histolytica
VIYLLVTFLGVSFGLITLLYTYQRTLTQTSFL

SEQ ID NO: 2599586 - protein, 37 aa, Entamoeba histolytica
VKASGFKISYEGGPLPWYLNKGLYFTNITLRNRIADV

SEQ ID NO: 2599587 - protein, 19 aa, Entamoeba histolytica
VKDTSVFIDIPRLAPKVQV

SEQ ID NO: 2599588 - protein, 18 aa, Entamoeba histolytica
VKELYFPNVPITTKINNF

SEQ ID NO: 2599589 - protein, 26 aa, Entamoeba histolytica
VKERGIFITGGIIKIGEKGKIIMKGG

SEQ ID NO: 2599590 - protein, 19 aa, Entamoeba histolytica
VKFKFLCTCFVNEIVDVLA

SEQ ID NO: 2599591 - protein, 22 aa, Entamoeba histolytica
VKFLYIFIPFFFLELSIVFFSL

SEQ ID NO: 2599592 - protein, 25 aa, Entamoeba histolytica
VKGENLLVFSLNPRSPVCAKLTDFG

SEQ ID NO: 2599593 - protein, 18 aa, Entamoeba histolytica
VKGLNKLYVYLDLNLESA

SEQ ID NO: 2599594 - protein, 25 aa, Entamoeba histolytica
VKHYMIYGIFLSLLYVIGSALLSYF

SEQ ID NO: 2599595 - protein, 25 aa, Entamoeba histolytica
VKINLYVYPAYGFVTLMLGTIASLI

SEQ ID NO: 2599596 - protein, 21 aa, Entamoeba histolytica
VKIYESWFILQQYTPQPIVQK

SEQ ID NO: 2599597 - protein, 31 aa, Entamoeba histolytica
VKKKESIPKLSIRLRFLLDAAKGIQYLHNNN

SEQ ID NO: 2599598 - protein, 18 aa, Entamoeba histolytica
VKKLVLHDLPFDTARDFI

SEQ ID NO: 2599599 - protein, 24 aa, Entamoeba histolytica
VKKPTSYPPALPKTKQLKNYIIKK

SEQ ID NO: 2599600 - protein, 27 aa, Entamoeba histolytica
VKKQKELFIPAYYQFFNEMLGLNILQA

SEQ ID NO: 2599601 - protein, 25 aa, Entamoeba histolytica
VKLNSFDYYKGITLTFMALTYYFAQ

SEQ ID NO: 2599602 - protein, 41 aa, Entamoeba histolytica
VKLRQKYYLTTTKTIFLIFFLVVFVLFLIVWGHCGVTFEQC

SEQ ID NO: 2599603 - protein, 43 aa, Entamoeba histolytica
VKNTEFPKWTIGVMVIFVIALIVIVVVIIKEKKLKRVKKKVKK

SEQ ID NO: 2599604 - protein, 49 aa, Entamoeba histolytica
VKNTEFPKWTIGVMVIFVIALIVIVVVIIVYAVYVYLERRRNLKVFSEG

SEQ ID NO: 2599605 - protein, 21 aa, Entamoeba histolytica
VKQIISLHRLILTGTPIQNNV

SEQ ID NO: 2599606 - protein, 24 aa, Entamoeba histolytica
VKQNDLFHYYFYDPSVLTILKQEV

SEQ ID NO: 2599607 - protein, 20 aa, Entamoeba histolytica
VKRLIKFIHLISFVNKVIDK

SEQ ID NO: 2599608 - protein, 26 aa, Entamoeba histolytica
VKRWNGLIIFGFFVSVGSFFFTYFFL

SEQ ID NO: 2599609 - protein, 22 aa, Entamoeba histolytica
VKRYVPFALALTSIGKPKVGLL

SEQ ID NO: 2599610 - protein, 25 aa, Entamoeba histolytica
VKSNLPTILLVLRSIYYTLKNKKKE

SEQ ID NO: 2599611 - protein, 38 aa, Entamoeba histolytica; identical to SEQ ID NO: 2402741

SEQ ID NO: 2599612 - protein, 35 aa, Entamoeba histolytica
VKVGDYTFTIRIFPHKYCWREGDDLYINIKGCEFF

SEQ ID NO: 2599613 - protein, 20 aa, Entamoeba histolytica
VKYITKFPPLKPIFYEFNLS

SEQ ID NO: 2599614 - protein, 21 aa, Entamoeba histolytica
VKYLWVIIPCLLVITYVLCVY

SEQ ID NO: 2599615 - protein, 21 aa, Entamoeba histolytica
VLAHFLGIFLSSTFYFICYII

SEQ ID NO: 2599616 - protein, 17 aa, Entamoeba histolytica
VLCFSLPCIFHYLSRRK

SEQ ID NO: 2599617 - protein, 18 aa, Entamoeba histolytica
VLCIYLTFAQCYKDGTVT

SEQ ID NO: 2599618 - protein, 19 aa, Entamoeba histolytica
VLCYVLKFKVLWSTNSGEI

SEQ ID NO: 2599619 - protein, 25 aa, Entamoeba histolytica
VLDSSYYILIKLFRMGTKKQTKSLE

SEQ ID NO: 2599620 - protein, 32 aa, Entamoeba histolytica
VLEEPQLLFVIRWFFSFLLDPVNSVTLSKLNG

SEQ ID NO: 2599621 - protein, 26 aa, Entamoeba histolytica
VLEESTIIKVYPLAILTLETQVVENT

SEQ ID NO: 2599622 - protein, 18 aa, Entamoeba histolytica
VLELFVMLFERIGEDRLV

SEQ ID NO: 2599623 - protein, 17 aa, Entamoeba histolytica
VLFFKRTQTMLYVSLFG

SEQ ID NO: 2599624 - protein, 26 aa, Entamoeba histolytica
VLFQARWLMWIINKINPKALFYFPIK

SEQ ID NO: 2599625 - protein, 18 aa, Entamoeba histolytica
VLFSLHVYSQCYDECPYC

SEQ ID NO: 2599626 - protein, 18 aa, Entamoeba histolytica
VLFVFVHKHIKSQIKMFG

SEQ ID NO: 2599627 - protein, 24 aa, Entamoeba histolytica
VLGIFFEWHIPLKYLWPSVRVVLY

SEQ ID NO: 2599628 - protein, 17 aa, Entamoeba histolytica
VLGIREFAKLKKASFLS

SEQ ID NO: 2599629 - protein, 25 aa, Entamoeba histolytica
VLGSALFIFAFGHFLMIVTNQTSLE

SEQ ID NO: 2599630 - protein, 24 aa, Entamoeba histolytica
VLHCIGYFSLFICIIVTLKCRSVV

SEQ ID NO: 2599631 - protein, 25 aa, Entamoeba histolytica
VLHSKNYLHYNIKPANVLLITDDLN

SEQ ID NO: 2599632 - protein, 17 aa, Entamoeba histolytica
VLILFIVSLGFMTKDAK

SEQ ID NO: 2599633 - protein, 39 aa, Entamoeba histolytica
VLILHIILHIFSLSWWSIIPLICIPFQYVLRKKQTIPLS

SEQ ID NO: 2599634 - protein, 23 aa, Entamoeba histolytica
VLIMLLNNLKVLDRQLRVCTTIA

SEQ ID NO: 2599635 - protein, 18 aa, Entamoeba histolytica
VLIMVFSGIWHYAKLSML

SEQ ID NO: 2599636 - protein, 17 aa, Entamoeba histolytica
VLIPLGIYVTYQSIINR

SEQ ID NO: 2599637 - protein, 21 aa, Entamoeba histolytica
VLIVIWWIIYILQFGLCYLIF

SEQ ID NO: 2599638 - protein, 24 aa, Entamoeba histolytica
VLKRVLFFMRQKITLTMFVSEFTR

SEQ ID NO: 2599639 - protein, 17 aa, Entamoeba histolytica
VLLFRKYQQRILQIILR

SEQ ID NO: 2599640 - protein, 18 aa, Entamoeba histolytica
VLLILFKFTFIGLFIEFF

SEQ ID NO: 2599641 - protein, 17 aa, Entamoeba histolytica
VLLKYWLKTRNLNCPFK

SEQ ID NO: 2599642 - protein, 17 aa, Entamoeba histolytica
VLLLFTHQSFAQLYQGE

SEQ ID NO: 2599643 - protein, 18 aa, Entamoeba histolytica
VLLNKLRLELIKQKTLHF

SEQ ID NO: 2599644 - protein, 23 aa, Entamoeba histolytica
VLLSIFVRIFLLSALYFFFPLFM

SEQ ID NO: 2599645 - protein, 19 aa, Entamoeba histolytica
VLLTFLIWENNPLYPYEFL

SEQ ID NO: 2599646 - protein, 19 aa, Entamoeba histolytica
VLNFCICVCCCKLIVHDRK

SEQ ID NO: 2599647 - protein, 18 aa, Entamoeba histolytica
VLNWVGCTIIIHKRKRTA

SEQ ID NO: 2599648 - protein, 17 aa, Entamoeba histolytica
VLPNKPLSDILSIEILC

SEQ ID NO: 2599649 - protein, 17 aa, Entamoeba histolytica
VLPTIILFYPHPDYVMT

SEQ ID NO: 2599650 - protein, 20 aa, Entamoeba histolytica
VLQEIVKILIPFTSNFKMPN

SEQ ID NO: 2599651 - protein, 24 aa, Entamoeba histolytica
VLQHFYSLFIQFYDPIDTVLSLYD

SEQ ID NO: 2599652 - protein, 17 aa, Entamoeba histolytica
VLQKFITTFNPLIIEPL

SEQ ID NO: 2599653 - protein, 28 aa, Entamoeba histolytica
VLQKMSTYYLKDYLMWGKSMIVSAIKQI

SEQ ID NO: 2599654 - protein, 46 aa, Entamoeba histolytica
VLQLTENIPYYLFVHKPFGIHFTTNVPILFTPIVHPCSYVYSVVNW

SEQ ID NO: 2599655 - protein, 25 aa, Entamoeba histolytica
VLRLDRVFMFPGIIPFLFFSVSIIT

SEQ ID NO: 2599656 - protein, 19 aa, Entamoeba histolytica
VLRLLQIYTAQFDYQRVHI

SEQ ID NO: 2599657 - protein, 26 aa, Entamoeba histolytica
VLSLVLLFIFYLLTSCTALYVLEAIS

SEQ ID NO: 2599658 - protein, 26 aa, Entamoeba histolytica
VLSQAFIHFVVIQLALKWGKEAAGPD

SEQ ID NO: 2599659 - protein, 17 aa, Entamoeba histolytica
VLTLCVIIFLLSGTLTI

SEQ ID NO: 2599660 - protein, 22 aa, Entamoeba histolytica
VLTLFVLWNFKVGQPALLYLVP

SEQ ID NO: 2599661 - protein, 24 aa, Entamoeba histolytica
VLTNFFGILFPFIKAHFPFISRFI

SEQ ID NO: 2599662 - protein, 22 aa, Entamoeba histolytica
VLVIIPICNLIIILSTSFGTLY

SEQ ID NO: 2599663 - protein, 30 aa, Entamoeba histolytica
VLVQKISIIFILAYIAISFLLLIVGITDTV

SEQ ID NO: 2599664 - protein, 17 aa, Entamoeba histolytica
VLVQLIVILLISIISFS

SEQ ID NO: 2599665 - protein, 26 aa, Entamoeba histolytica
VLWVLHAYWFYLIIQIIVVAIKNKGR

SEQ ID NO: 2599666 - protein, 18 aa, Entamoeba histolytica
VLYVFGGSLDKTCACKCD

SEQ ID NO: 2599667 - protein, 24 aa, Entamoeba histolytica
VMCFFMTFLFSITVSRLVLLIPFV

SEQ ID NO: 2599668 - protein, 23 aa, Entamoeba histolytica
VMEDEFYIYLISTSKIVTIEKKN

SEQ ID NO: 2599669 - protein, 17 aa, Entamoeba histolytica
VMGNSRYYKFTENAIFT

SEQ ID NO: 2599670 - protein, 17 aa, Entamoeba histolytica
VMIIMMVNYIMKRKEKK

SEQ ID NO: 2599671 - protein, 17 aa, Entamoeba histolytica
VMKWEPMKLMRKPRKPT

SEQ ID NO: 2599672 - protein, 18 aa, Entamoeba histolytica
VMMIIQIVLMTWIGNMFD

SEQ ID NO: 2599673 - protein, 24 aa, Entamoeba histolytica
VMMYSIVLILISESSYRLLNETLQ

SEQ ID NO: 2599674 - protein, 23 aa, Entamoeba histolytica
VMPPIGEGAFGLVFRGTYRGQDV

SEQ ID NO: 2599675 - protein, 23 aa, Entamoeba histolytica
VMQPLMMLLMGDLVNSYIYTPGD

SEQ ID NO: 2599676 - protein, 30 aa, Entamoeba histolytica
VMSRIDYFSPNNFEIGWLSKKLGYKGGVCD

SEQ ID NO: 2599677 - protein, 42 aa, Entamoeba histolytica
VMSVMSFSTFWVYLRSLFLLFQFLYLMFLITLGLSAQPYVNW

SEQ ID NO: 2599678 - protein, 17 aa, Entamoeba histolytica
VMTDMFENIPKLKHINI

SEQ ID NO: 2599679 - protein, 25 aa, Entamoeba histolytica
VMTNYLLHLFSLFCYPGTCPLLKFI

SEQ ID NO: 2599680 - protein, 21 aa, Entamoeba histolytica
VMYAFSYVLFWIPIQTSISRE

SEQ ID NO: 2599681 - protein, 22 aa, Entamoeba histolytica
VNALDIFILLQDNPSFSLDMLS

SEQ ID NO: 2599682 - protein, 24 aa, Entamoeba histolytica
VNCECDVGYFYSTYMRQCYPQVGQ

SEQ ID NO: 2599683 - protein, 25 aa, Entamoeba histolytica
VNFMAKFFCNVPSTLCSYIVDTFTT

SEQ ID NO: 2599684 - protein, 34 aa, Entamoeba histolytica
VNFYNAPLIPFWRSIFYMIFRVPFKVMVHCAYLI

SEQ ID NO: 2599685 - protein, 29 aa, Entamoeba histolytica
VNGEENTYFLAWTTTPWTLPSNLALCVNP

SEQ ID NO: 2599686 - protein, 27 aa, Entamoeba histolytica
VNHKLVLAMYYAMGYISYWSGDYLLAK

SEQ ID NO: 2599687 - protein, 25 aa, Entamoeba histolytica
VNKLFSPSFILLNNTKIKLLNGSSF

SEQ ID NO: 2599688 - protein, 23 aa, Entamoeba histolytica
VNKPLGIYFTKYFVQTLRNYKEE

SEQ ID NO: 2599689 - protein, 24 aa, Entamoeba histolytica
VNLEAYIAARLFGSLFSKDQTLTR

SEQ ID NO: 2599690 - protein, 23 aa, Entamoeba histolytica
VNPGFLYIITFPFLFGVMFGDIG

SEQ ID NO: 2599691 - protein, 43 aa, Entamoeba histolytica
VNQEGFLNKIVWFFKSVICRFKLYPWYLKPKTIKYGDVEHIIT

SEQ ID NO: 2599692 - protein, 34 aa, Entamoeba histolytica
VNQRLRIIQSCPFFPLILKLILQESFALVLEEPQ

SEQ ID NO: 2599693 - protein, 24 aa, Entamoeba histolytica
VNQTIVPIALPLLPWNCYDPKFHY

SEQ ID NO: 2599694 - protein, 25 aa, Entamoeba histolytica
VNTIKGFKLTSFTLTKTGLHFINCE

SEQ ID NO: 2599695 - protein, 18 aa, Entamoeba histolytica
VNYINDYFMRITGEYTTP

SEQ ID NO: 2599696 - protein, 18 aa, Entamoeba histolytica
VNYKIYAMKYSWEQTFQE

SEQ ID NO: 2599697 - protein, 19 aa, Entamoeba histolytica
VPAIKYFNTMFSTSSRRIC

SEQ ID NO: 2599698 - protein, 23 aa, Entamoeba histolytica
VPETIEFLIRGGIKVWMITGDKV

SEQ ID NO: 2599699 - protein, 21 aa, Entamoeba histolytica
VPGIKYVIDQGLVKVLRSSNG

SEQ ID NO: 2599700 - protein, 46 aa, Entamoeba histolytica
VPKVMIFYCMLFTGILIVTILTIIPVKFFSFCLLIGLLTIPQALRN

SEQ ID NO: 2599701 - protein, 18 aa, Entamoeba histolytica
VPLFIYYYNVYTNPFLMF

SEQ ID NO: 2599702 - protein, 17 aa, Entamoeba histolytica
VPLGLFAFNFYLRPKLV

SEQ ID NO: 2599703 - protein, 34 aa, Entamoeba histolytica
VPLLYAVQKKRLDLVLLLLKFGARIYIANNAGNS

SEQ ID NO: 2599704 - protein, 24 aa, Entamoeba histolytica
VPMENYWYNAFLYEIPFNEVPNGF

SEQ ID NO: 2599705 - protein, 18 aa, Entamoeba histolytica
VPPKTVGGLAWYFVKLIE

SEQ ID NO: 2599706 - protein, 25 aa, Entamoeba histolytica
VPPVPLQYLTYDTALLWASENMSKN

SEQ ID NO: 2599707 - protein, 20 aa, Entamoeba histolytica
VPPYIIYKYPKLYKNKDYIS

SEQ ID NO: 2599708 - protein, 34 aa, Entamoeba histolytica
VPQTISWLFIFRIVPMVVIFMICLARAVIPLCYG

SEQ ID NO: 2599709 - protein, 23 aa, Entamoeba histolytica
VPVLPHIWMEVYGYNIRISVGET

SEQ ID NO: 2599710 - protein, 23 aa, Entamoeba histolytica
VPVLPHIWMEVYGYNLGISVGET

SEQ ID NO: 2599711 - protein, 17 aa, Entamoeba histolytica
VPYYVFIHSRYASMTIP

SEQ ID NO: 2599712 - protein, 34 aa, Entamoeba histolytica
VQDYFGELTYPILYSTLIFVSHACLLSLGANRFV

SEQ ID NO: 2599713 - protein, 17 aa, Entamoeba histolytica
VQEIFFTIFEQPPLNKI

SEQ ID NO: 2599714 - protein, 19 aa, Entamoeba histolytica
VQESFALAFFWSICEYLLS

SEQ ID NO: 2599715 - protein, 35 aa, Entamoeba histolytica
VQFNPMVIVKYSWFFFELIIRSLVYYLNDEINKGN

SEQ ID NO: 2599716 - protein, 25 aa, Entamoeba histolytica
VQIHPLFRLTSIQTFAILLKKITHT

SEQ ID NO: 2599717 - protein, 17 aa, Entamoeba histolytica
VQILIQLIIRHGSHMKS

SEQ ID NO: 2599718 - protein, 25 aa, Entamoeba histolytica
VQLHLILSDILYYGITDESIMFLVI

SEQ ID NO: 2599719 - protein, 19 aa, Entamoeba histolytica
VQMIALMDNLLKKDLMDLK

SEQ ID NO: 2599720 - protein, 21 aa, Entamoeba histolytica
VQMKMMIIVDLKKKLKCFHGH

SEQ ID NO: 2599721 - protein, 21 aa, Entamoeba histolytica
VQMVLACTLYRYLDNLFRYSY

SEQ ID NO: 2599722 - protein, 18 aa, Entamoeba histolytica
VQNEEPLYAVWLVAERGR

SEQ ID NO: 2599723 - protein, 37 aa, Entamoeba histolytica
VQPNAKFLICCEPIFVDYIQILIVYYLEKDANCSFGL

SEQ ID NO: 2599724 - protein, 25 aa, Entamoeba histolytica
VQRIVAQYWSLLTNKYDTLVSNICI

SEQ ID NO: 2599725 - protein, 23 aa, Entamoeba histolytica
VQSHLFLQFKPLINTTSNCQKAD

SEQ ID NO: 2599726 - protein, 26 aa, Entamoeba histolytica
VRAMMTTIVLFLSQNYYKFSNWREYI

SEQ ID NO: 2599727 - protein, 25 aa, Entamoeba histolytica
VRAQVLKFFQRLFLNYQKCFKEVKP

SEQ ID NO: 2599728 - protein, 17 aa, Entamoeba histolytica
VRCTIIMCSLGKVLEPS

SEQ ID NO: 2599729 - protein, 26 aa, Entamoeba histolytica
VRDEALFYILTYMKPGKTLVFVNAIT

SEQ ID NO: 2599730 - protein, 24 aa, Entamoeba histolytica
VRFTITFLCTCSCNDDDIIAFAIT

SEQ ID NO: 2599731 - protein, 23 aa, Entamoeba histolytica
VRGWKNFIFFGIGTFILIIGIVC

SEQ ID NO: 2599732 - protein, 24 aa, Entamoeba histolytica
VRKIPLPLIYIYDDKKNKKFPGNK

SEQ ID NO: 2599733 - protein, 41 aa, Entamoeba histolytica
VRKMAIYPFLYIVCWIVPFFNRLLPLFKITPPFWMEYVHCF

SEQ ID NO: 2599734 - protein, 18 aa, Entamoeba histolytica
VRLMILFGKNTINANFVI

SEQ ID NO: 2599735 - protein, 49 aa, Entamoeba histolytica
VRRSIVSLIIFVGGIIIWIIIWLLLLIGFVSRYIFLNKLIISEQQKDER

SEQ ID NO: 2599736 - protein, 18 aa, Entamoeba histolytica
VRVTSLLSLGILNVDGIK

SEQ ID NO: 2599737 - protein, 27 aa, Entamoeba histolytica
VSALLLELIIIFITRIFYRDTDFYNRV

SEQ ID NO: 2599738 - protein, 25 aa, Entamoeba histolytica
VSCKAVIMLILYSYSKQFDRTLPTI

SEQ ID NO: 2599739 - protein, 25 aa, Entamoeba histolytica
VSEVLLLVIIFSIQTILLFPFVQQR

SEQ ID NO: 2599740 - protein, 25 aa, Entamoeba histolytica
VSFILSLVCILLVSFVPQMSKRGLS

SEQ ID NO: 2599741 - protein, 27 aa, Entamoeba histolytica
VSGMTTLFLLLMTNLKIVIFSSHLSLL

SEQ ID NO: 2599742 - protein, 22 aa, Entamoeba histolytica
VSGNEFIFKSFKVTATDNNNSN

SEQ ID NO: 2599743 - protein, 24 aa, Entamoeba histolytica
VSGNEFIFKSFKVTTTTTTDNNNK

SEQ ID NO: 2599744 - protein, 33 aa, Entamoeba histolytica
VSIFMMFKYATWIEIIFNIIGVLISLCDGVLYP

SEQ ID NO: 2599745 - protein, 24 aa, Entamoeba histolytica
VSIIFIIPSFYLWPHKERYYFEQY

SEQ ID NO: 2599746 - protein, 20 aa, Entamoeba histolytica
VSIILTILFALSVISGLLLS

SEQ ID NO: 2599747 - protein, 23 aa, Entamoeba histolytica
VSILIVGVLLVALVIVIILAIVL

SEQ ID NO: 2599748 - protein, 26 aa, Entamoeba histolytica
VSILLTGKFRFGYVFGFTIIGSLAEY

SEQ ID NO: 2599749 - protein, 25 aa, Entamoeba histolytica
VSIQLLEDFLFEKGYRYTYSLFYRK

SEQ ID NO: 2599750 - protein, 23 aa, Entamoeba histolytica
VSISFTVLILIELLNIGFTIRRW

SEQ ID NO: 2599751 - protein, 19 aa, Entamoeba histolytica
VSITILISILIVSILLGIF

SEQ ID NO: 2599752 - protein, 21 aa, Entamoeba histolytica
VSKSLDKILLLLDKERLSGQE

SEQ ID NO: 2599753 - protein, 49 aa, Entamoeba histolytica
VSKSLTNFFFWGIGSIVYVLYYIFTFILFLLLYIRLTRKIKQEIDDENM

SEQ ID NO: 2599754 - protein, 50 aa, Entamoeba histolytica
VSKSLTNFFFWGIGSIVYVLYYIFTLILFLLLYIRLTRKIKQEIDDEKLI

SEQ ID NO: 2599755 - protein, 28 aa, Entamoeba histolytica
VSKYDNAIYFYVFPEELHILKYTKDFTH

SEQ ID NO: 2599756 - protein, 26 aa, Entamoeba histolytica
VSLGVLVLMQYVLQGLFHPARHVREP

SEQ ID NO: 2599757 - protein, 18 aa, Entamoeba histolytica
VSLNIFMFIFFKDTQKLT

SEQ ID NO: 2599758 - protein, 31 aa, Entamoeba histolytica
VSLTSFVAAFLFIDYIATPAPHLPPSFPLSV

SEQ ID NO: 2599759 - protein, 17 aa, Entamoeba histolytica
VSLYASSCQKPITIQEN

SEQ ID NO: 2599760 - protein, 23 aa, Entamoeba histolytica
VSNSFFYVFLDTLYIQYFVKQIN

SEQ ID NO: 2599761 - protein, 22 aa, Entamoeba histolytica
VSPLSPLLNFYCEVLLHLNKNN

SEQ ID NO: 2599762 - protein, 17 aa, Entamoeba histolytica
VSSFYHFNFFGVALFYY

SEQ ID NO: 2599763 - protein, 22 aa, Entamoeba histolytica
VSSILHNFILKSSIIPPLDVIS

SEQ ID NO: 2599764 - protein, 25 aa, Entamoeba histolytica
VSTKTFLFMFTFDVMLTLLLAEVMH

SEQ ID NO: 2599765 - protein, 20 aa, Entamoeba histolytica
VSVIKLFKYSDWIDMILILV

SEQ ID NO: 2599766 - protein, 31 aa, Entamoeba histolytica
VSVIKLFKYSDWIDMILVLVGLISSLGNGVM

SEQ ID NO: 2599767 - protein, 29 aa, Entamoeba histolytica
VSYSTITFLAFLLFLLSALIHTIFLCCKN

SEQ ID NO: 2599768 - protein, 19 aa, Entamoeba histolytica
VTEYAKYGSLKYLIKHKER

SEQ ID NO: 2599769 - protein, 17 aa, Entamoeba histolytica
VTEYAYYGSLRDLIEKR

SEQ ID NO: 2599770 - protein, 22 aa, Entamoeba histolytica
VTEYWIEYFFFPNLKTCPYIYI

SEQ ID NO: 2599771 - protein, 18 aa, Entamoeba histolytica
VTGIFTLVAAFGFCAFCC

SEQ ID NO: 2599772 - protein, 27 aa, Entamoeba histolytica
VTIKSGILYYINVIALNLILGNSNKDN

SEQ ID NO: 2599773 - protein, 24 aa, Entamoeba histolytica
VTINYNILYIPLETLSKEKQKRIN

SEQ ID NO: 2599774 - protein, 20 aa, Entamoeba histolytica
VTIPYKLLYKEVKGALKNSI

SEQ ID NO: 2599775 - protein, 27 aa, Entamoeba histolytica
VTKVFIYNVFLKQKSIIMNIKKLKIQM

SEQ ID NO: 2599776 - protein, 21 aa, Entamoeba histolytica
VTLHHLPSIAFLIIYSEVPVT

SEQ ID NO: 2599777 - protein, 19 aa, Entamoeba histolytica
VTMILWKYPLSKFGECSIV

SEQ ID NO: 2599778 - protein, 22 aa, Entamoeba histolytica
VTNISFILDPSKLIALSILFAK

SEQ ID NO: 2599779 - protein, 17 aa, Entamoeba histolytica
VTPFCTCTIENNITIVG

SEQ ID NO: 2599780 - protein, 23 aa, Entamoeba histolytica
VTQQNFVMIFSFNTKLEEKTMSF

SEQ ID NO: 2599781 - protein, 29 aa, Entamoeba histolytica
VTSTIPIPLIFICSIFIINICLFSVIHIL

SEQ ID NO: 2599782 - protein, 27 aa, Entamoeba histolytica
VTSVLPLYFILIIQSAGFALFWSPTES

SEQ ID NO: 2599783 - protein, 29 aa, Entamoeba histolytica
VTTILYSIPLIILYISYKTWYSFLDVSNG

SEQ ID NO: 2599784 - protein, 25 aa, Entamoeba histolytica
VTTRQCPLLLYNTLKFLVQFTNSTY

SEQ ID NO: 2599785 - protein, 32 aa, Entamoeba histolytica; identical to SEQ ID NO: 2395273

SEQ ID NO: 2599786 - protein, 25 aa, Entamoeba histolytica
VVCECLKMFLKQLPNSLINSELTNT

SEQ ID NO: 2599787 - protein, 17 aa, Entamoeba histolytica
VVECPYWLAPEVILNNH

SEQ ID NO: 2599788 - protein, 41 aa, Entamoeba histolytica
VVEPVLLVLVIISLLLMFIPKPIFLYIKLRKQQRTHPESRP

SEQ ID NO: 2599789 - protein, 23 aa, Entamoeba histolytica
VVFNPYVIFAMSFIAGLAAGFSY

SEQ ID NO: 2599790 - protein, 30 aa, Entamoeba histolytica
VVGFFSKRRLEWHYLFLACGYTGIVLVTLY

SEQ ID NO: 2599791 - protein, 31 aa, Entamoeba histolytica; identical to SEQ ID NO: 2402917

SEQ ID NO: 2599792 - protein, 24 aa, Entamoeba histolytica
VVIIVILYYIYMYCRGGVNINFPD

SEQ ID NO: 2599793 - protein, 24 aa, Entamoeba histolytica
VVIWLLFIVHFIEYSYSQPISISI

SEQ ID NO: 2599794 - protein, 17 aa, Entamoeba histolytica
VVIYHYCEKTVPLSVRE

SEQ ID NO: 2599795 - protein, 35 aa, Entamoeba histolytica
VVIYLFIFRSFIFKTWIFEVKWTFVLLIILVIQNN

SEQ ID NO: 2599796 - protein, 25 aa, Entamoeba histolytica
VVKRKKFEFILSKPKVQEMKHIEAK

SEQ ID NO: 2599797 - protein, 21 aa, Entamoeba histolytica
VVKSKFLFVGPIYGNYIVHLF

SEQ ID NO: 2599798 - protein, 20 aa, Entamoeba histolytica
VVKTAMAQILLKVLCDLLKR

SEQ ID NO: 2599799 - protein, 28 aa, Entamoeba histolytica
VVLAAVKLILVLLPHLSEQNASLYLKKI

SEQ ID NO: 2599800 - protein, 19 aa, Entamoeba histolytica
VVLKLKYLNISLDETFFLE

SEQ ID NO: 2599801 - protein, 30 aa, Entamoeba histolytica
VVLSPELLLQYYLHIIFPIKTLDSSTIICG

SEQ ID NO: 2599802 - protein, 19 aa, Entamoeba histolytica
VVLVPKKWNRNQSYLMMLM

SEQ ID NO: 2599803 - protein, 17 aa, Entamoeba histolytica
VVLYYFPINDPSVTQMI

SEQ ID NO: 2599804 - protein, 17 aa, Entamoeba histolytica
VVMILFEILYHILTYIN

SEQ ID NO: 2599805 - protein, 17 aa, Entamoeba histolytica
VVMSCIIVSFFVILLFN

SEQ ID NO: 2599806 - protein, 27 aa, Entamoeba histolytica
VVNDYKYAFPLFIQANVLLASSTKHTA

SEQ ID NO: 2599807 - protein, 25 aa, Entamoeba histolytica
VVPLQILAYELSIAKGINPDKPRNL

SEQ ID NO: 2599808 - protein, 30 aa, Entamoeba histolytica
VVPSVLGVLIIIIAIIAIVVGIIKYRTYKG

SEQ ID NO: 2599809 - protein, 24 aa, Entamoeba histolytica
VVQEDIFLVLSLLSLSSSSYVKQS

SEQ ID NO: 2599810 - protein, 25 aa, Entamoeba histolytica
VVQKNGMLFFKDNITTGLKFVNDNS

SEQ ID NO: 2599811 - protein, 36 aa, Entamoeba histolytica
VVQSRFLDFLLSWKIFGLLYVFSMAVGLNLLVDCIW

SEQ ID NO: 2599812 - protein, 26 aa, Entamoeba histolytica
VVRDYLQFYYVRLFGKVFGPELNRCS

SEQ ID NO: 2599813 - protein, 20 aa, Entamoeba histolytica
VVRFLVHIFDLIDIPVSLII

SEQ ID NO: 2599814 - protein, 29 aa, Entamoeba histolytica
VVRYHRLYHAYFRFLSRYAAENPNLVGTI

SEQ ID NO: 2599815 - protein, 24 aa, Entamoeba histolytica
VVSILLCLYPIKKIRYIYALIFLI

SEQ ID NO: 2599816 - protein, 17 aa, Entamoeba histolytica
VVSIMIIIMVILPFILF

SEQ ID NO: 2599817 - protein, 20 aa, Entamoeba histolytica
VVSLILAFIVPHAKKECSSN

SEQ ID NO: 2599818 - protein, 19 aa, Entamoeba histolytica
VVSQCDGQWLVAVPKGTEA

SEQ ID NO: 2599819 - protein, 45 aa, Entamoeba histolytica
VVSSFIFFSFIIPLAFGYAIWRPMTLLWTFTLKQSSHIFWISFCC

SEQ ID NO: 2599820 - protein, 38 aa, Entamoeba histolytica
VVSVFNYLMYLLKEIFNFIVIVFAFMGGLLIYSLLITD

SEQ ID NO: 2599821 - protein, 18 aa, Entamoeba histolytica
VVTFAKDSLVFTELKNED

SEQ ID NO: 2599822 - protein, 17 aa, Entamoeba histolytica
VVTFAKESLVFTELKNE

SEQ ID NO: 2599823 - protein, 30 aa, Entamoeba histolytica
VVTIIFIIMIICYLLRKIYFPTEQQKFAWN

SEQ ID NO: 2599824 - protein, 30 aa, Entamoeba histolytica
VVTSTLIIGIFVLVLIFVILCIIKTKKKNI

SEQ ID NO: 2599825 - protein, 18 aa, Entamoeba histolytica
VVVRYSILKLPTPTLHDM

SEQ ID NO: 2599826 - protein, 20 aa, Entamoeba histolytica
VVYLISMLCAFLPSLSPVKN

SEQ ID NO: 2599827 - protein, 21 aa, Entamoeba histolytica
VWESLVLVIFIRPFDIGDRIQ

SEQ ID NO: 2599828 - protein, 36 aa, Entamoeba histolytica
VWEWKTYHFLTLSLFTFFFIISLSLTVIMGPASYQT

SEQ ID NO: 2599829 - protein, 32 aa, Entamoeba histolytica; identical to SEQ ID NO: 2402950

SEQ ID NO: 2599830 - protein, 19 aa, Entamoeba histolytica
VWPSLLLMVITVATLSIFI

SEQ ID NO: 2599831 - protein, 17 aa, Entamoeba histolytica
VWYHITAPEDKTLQALT

SEQ ID NO: 2599832 - protein, 25 aa, Entamoeba histolytica
VYAFALTMFAILTLNEPYPLNEYPY

SEQ ID NO: 2599833 - protein, 18 aa, Entamoeba histolytica
VYDFFLHLPLSISSFHFY

SEQ ID NO: 2599834 - protein, 38 aa, Entamoeba histolytica
VYEFSLMPREMYVKLLAYVSIYYKMIVVWKRGIICSER

SEQ ID NO: 2599835 - protein, 18 aa, Entamoeba histolytica
VYGSMIMIGVWTSGNGKG

SEQ ID NO: 2599836 - protein, 19 aa, Entamoeba histolytica
VYIGKFRGNKVAIKKMKEV

SEQ ID NO: 2599837 - protein, 17 aa, Entamoeba histolytica
VYKEPKLSDLVTLNENT

SEQ ID NO: 2599838 - protein, 28 aa, Entamoeba histolytica
VYLPQIFFYLLFYPNKKEFILFKLPLIC

SEQ ID NO: 2599839 - protein, 31 aa, Entamoeba histolytica
VYLSFFIFLMIIVLFIRLLISIPFSLNIPTL

SEQ ID NO: 2599840 - protein, 25 aa, Entamoeba histolytica
VYMMYFPLVFYYINGNRIYISGDKF

SEQ ID NO: 2599841 - protein, 21 aa, Entamoeba histolytica
VYNTIHLFHHFFLVLMFLFLL

SEQ ID NO: 2599842 - protein, 21 aa, Entamoeba histolytica
VYPLVIILTLIYLIVCYHYPK

SEQ ID NO: 2599843 - protein, 24 aa, Entamoeba histolytica
VYPSLMVLILFFIVNNITSGYVLE

SEQ ID NO: 2599844 - protein, 32 aa, Entamoeba histolytica
VYRTYFLGYLIPLILYLWLTYYPPHLTQEKIK

SEQ ID NO: 2599845 - protein, 21 aa, Entamoeba histolytica
VYSFAICMLEIWLGRDPYDPA

SEQ ID NO: 2599846 - protein, 26 aa, Entamoeba histolytica
VYSGLKYLMWMIGIGGGIIGVVIVIE

SEQ ID NO: 2599847 - protein, 26 aa, Entamoeba histolytica
VYSGWKYLMWMIGIGGGIIGVVIVIE

SEQ ID NO: 2599848 - protein, 22 aa, Entamoeba histolytica
VYSLCLPIVWVAQSAKLCLVKY

SEQ ID NO: 2599849 - protein, 23 aa, Entamoeba histolytica
VYSSTLYKLALQKKYDFINEYQC

SEQ ID NO: 2599850 - protein, 19 aa, Entamoeba histolytica
WAIANLILGIGFVFIAVVV

SEQ ID NO: 2599851 - protein, 18 aa, Entamoeba histolytica
WCHSPLYTGFETLINNLR

SEQ ID NO: 2599852 - protein, 25 aa, Entamoeba histolytica
WCLVPLGVMAIFLILNGMFGKGIGI

SEQ ID NO: 2599853 - protein, 35 aa, Entamoeba histolytica
WCQIIIIGCFIISIILILLLIMYNASIRAKINAVR

SEQ ID NO: 2599854 - protein, 17 aa, Entamoeba histolytica
WDGLFEYPWQIAEFVVS

SEQ ID NO: 2599855 - protein, 26 aa, Entamoeba histolytica
WDKQKISYQLKIKFLDDMAVALSYLH

SEQ ID NO: 2599856 - protein, 25 aa, Entamoeba histolytica
WDLWGPMLVCYILSLLLSINIMIRK

SEQ ID NO: 2599857 - protein, 31 aa, Entamoeba histolytica
WDVLISVLLCLFISFLIMKFTKMNFCKSLTL

SEQ ID NO: 2599858 - protein, 29 aa, Entamoeba histolytica
WDYSFIVWIFLCFLSYIHPIHSPLCIGSF

SEQ ID NO: 2599859 - protein, 22 aa, Entamoeba histolytica
WEFIMFAYLILCLIIKLVMIAS

SEQ ID NO: 2599860 - protein, 20 aa, Entamoeba histolytica
WEHGKLFLTNYRIKFVPDNC

SEQ ID NO: 2599861 - protein, 19 aa, Entamoeba histolytica
WEIIPIEEMLLVSCVVYNP

SEQ ID NO: 2599862 - protein, 18 aa, Entamoeba histolytica
WEKWQEGYMVRKGKWYKF

SEQ ID NO: 2599863 - protein, 22 aa, Entamoeba histolytica
WEVLFGQWKSILPKTTEIIQRI

SEQ ID NO: 2599864 - protein, 20 aa, Entamoeba histolytica
WFEILLGIAIIFFSFVCFVP

SEQ ID NO: 2599865 - protein, 21 aa, Entamoeba histolytica
WFIFAIGIVPLLFIVPSLLAM

SEQ ID NO: 2599866 - protein, 17 aa, Entamoeba histolytica
WFNLAIVVYFSIGGGPF

SEQ ID NO: 2599867 - protein, 19 aa, Entamoeba histolytica
WFTFIEVFGFIFLTGGFLL

SEQ ID NO: 2599868 - protein, 32 aa, Entamoeba histolytica
WFTNIFKTLLILIFWIFIIQPELTMIGKLKTI

SEQ ID NO: 2599869 - protein, 30 aa, Entamoeba histolytica
WGAYVFIINLIPLHAFLLLVFGRFSNRLYT

SEQ ID NO: 2599870 - protein, 20 aa, Entamoeba histolytica
WGFWCSFFSSLILLLAGFIN

SEQ ID NO: 2599871 - protein, 17 aa, Entamoeba histolytica
WGFYLIPTTSDTISLIS

SEQ ID NO: 2599872 - protein, 17 aa, Entamoeba histolytica
WGLLWLTEQKQFGIIRY

SEQ ID NO: 2599873 - protein, 23 aa, Entamoeba histolytica
WGQSFIEPILFIFTVLSVIAMMV

SEQ ID NO: 2599874 - protein, 17 aa, Entamoeba histolytica
WGYISQTVSDAAKKYEQ

SEQ ID NO: 2599875 - protein, 19 aa, Entamoeba histolytica
WHNVMFKSLQIILFYEQRC

SEQ ID NO: 2599876 - protein, 18 aa, Entamoeba histolytica
WHYFLLDFCYFTNCVLII

SEQ ID NO: 2599877 - protein, 17 aa, Entamoeba histolytica
WHYILLILVAVCLNFPF

SEQ ID NO: 2599878 - protein, 21 aa, Entamoeba histolytica
WIDKYERIHKLLNISYPGYIT

SEQ ID NO: 2599879 - protein, 17 aa, Entamoeba histolytica
WIDLLTPEQFEEGFGSH

SEQ ID NO: 2599880 - protein, 25 aa, Entamoeba histolytica
WIGIFVFILVFIYWTILKNYTILPE

SEQ ID NO: 2599881 - protein, 17 aa, Entamoeba histolytica
WIHRDPVKQLYSAITAY

SEQ ID NO: 2599882 - protein, 20 aa, Entamoeba histolytica
WIIMFLIRLDVPKTWYFACI

SEQ ID NO: 2599883 - protein, 19 aa, Entamoeba histolytica
WILSMFIFSLIGLSSSFFW

SEQ ID NO: 2599884 - protein, 19 aa, Entamoeba histolytica
WILVGFIILIFVSYSMDIT

SEQ ID NO: 2599885 - protein, 17 aa, Entamoeba histolytica
WISLILTLLFFLPGQIY

SEQ ID NO: 2599886 - protein, 18 aa, Entamoeba histolytica
WISLYYKNILMLVGPELI

SEQ ID NO: 2599887 - protein, 17 aa, Entamoeba histolytica
WIVMIFSVPMGIVAGYE

SEQ ID NO: 2599888 - protein, 25 aa, Entamoeba histolytica
WKDGKKFFPLGLYFDEIVDSDLELL

SEQ ID NO: 2599889 - protein, 45 aa, Entamoeba histolytica
WKGVVYLLVIAFMQILTSFCFQLSIKWIFVLSLRLRNGLISMIYE

SEQ ID NO: 2599890 - protein, 24 aa, Entamoeba histolytica
WKIISYFIFIVFTLIFCTILVVII

SEQ ID NO: 2599891 - protein, 25 aa, Entamoeba histolytica
WKINIIVIILLLNFFHILSLSIIDI

SEQ ID NO: 2599892 - protein, 18 aa, Entamoeba histolytica
WKLVLSCVLIITNVVPPE

SEQ ID NO: 2599893 - protein, 17 aa, Entamoeba histolytica
WKLYDEELTECWKNIVR

SEQ ID NO: 2599894 - protein, 17 aa, Entamoeba histolytica
WKMIPLETDYCGPIIKD

SEQ ID NO: 2599895 - protein, 19 aa, Entamoeba histolytica
WKNKKGFGLNFTRPSTLKT

SEQ ID NO: 2599896 - protein, 18 aa, Entamoeba histolytica
WKQQYIYSISKDGELTFE

SEQ ID NO: 2599897 - protein, 26 aa, Entamoeba histolytica
WKRFIYVIILIIYFQLFDLNSFFLKA

SEQ ID NO: 2599898 - protein, 17 aa, Entamoeba histolytica
WKRLRCFHFSLKEMRIN

SEQ ID NO: 2599899 - protein, 26 aa, Entamoeba histolytica
WKVRMYAVIALLRSLTLRMLIFIGNE

SEQ ID NO: 2599900 - protein, 18 aa, Entamoeba histolytica
WKYINPYCPYINSVNREV

SEQ ID NO: 2599901 - protein, 18 aa, Entamoeba histolytica
WLDVSFSSFFIASFILCC

SEQ ID NO: 2599902 - protein, 27 aa, Entamoeba histolytica
WLGQGIWQSLLLTFVFHFMLADVDVYS

SEQ ID NO: 2599903 - protein, 20 aa, Entamoeba histolytica
WLHRTWMIFVLLWASYNGAN

SEQ ID NO: 2599904 - protein, 18 aa, Entamoeba histolytica
WLISFYHILFMPGGSIIN

SEQ ID NO: 2599905 - protein, 17 aa, Entamoeba histolytica
WLVLQRSERYFERFIGW

SEQ ID NO: 2599906 - protein, 17 aa, Entamoeba histolytica
WMRPAVSSTFRKLTGII

SEQ ID NO: 2599907 - protein, 26 aa, Entamoeba histolytica
WNEPITIKYFRPPDELFIIPAVMTVL

SEQ ID NO: 2599908 - protein, 29 aa, Entamoeba histolytica
WNIFYPIIKLFKITIPFKLFKGSSLISLI

SEQ ID NO: 2599909 - protein, 27 aa, Entamoeba histolytica
WNLITELLVIFPNDLLTISLIGELCLT

SEQ ID NO: 2599910 - protein, 18 aa, Entamoeba histolytica
WNWYNRWLVLTKEQLYYY

SEQ ID NO: 2599911 - protein, 19 aa, Entamoeba histolytica
WPSAIRLFPFVMAVSLFLN

SEQ ID NO: 2599912 - protein, 27 aa, Entamoeba histolytica
WQYACCLTIVFAGRYIPFLEAPCGFAR

SEQ ID NO: 2599913 - protein, 23 aa, Entamoeba histolytica
WQYKQRFNLLALCTMLVVALGLL

SEQ ID NO: 2599914 - protein, 31 aa, Entamoeba histolytica
WRKNINFWIGRILFFCAFILVILITLLYNTT

SEQ ID NO: 2599915 - protein, 32 aa, Entamoeba histolytica; identical to SEQ ID NO: 2403031

SEQ ID NO: 2599916 - protein, 18 aa, Entamoeba histolytica
WSTIPILSWLVPCLGHTA

SEQ ID NO: 2599917 - protein, 34 aa, Entamoeba histolytica
WSVYGKYLRFGGILFFLICMIPFIMRTGALVCYN

SEQ ID NO: 2599918 - protein, 20 aa, Entamoeba histolytica
WTFILNIVLILFNNPFFFYE

SEQ ID NO: 2599919 - protein, 24 aa, Entamoeba histolytica
WTLNYHVMIITYGLKFYLYNLDGE

SEQ ID NO: 2599920 - protein, 19 aa, Entamoeba histolytica
WTSKIPIINSFPLGDWYSK

SEQ ID NO: 2599921 - protein, 18 aa, Entamoeba histolytica
WTYSFITPLLSLAQSRLL

SEQ ID NO: 2599922 - protein, 19 aa, Entamoeba histolytica
WTYSTLVASCYWISKKLCS

SEQ ID NO: 2599923 - protein, 17 aa, Entamoeba histolytica
WVGVLVSIFIRKLSPDN

SEQ ID NO: 2599924 - protein, 31 aa, Entamoeba histolytica
WVPVVIIILVFGFLFFVYGVFIMIIKQCEYN

SEQ ID NO: 2599925 - protein, 18 aa, Entamoeba histolytica
WVSTIFVPLIVFNTYIQL

SEQ ID NO: 2599926 - protein, 20 aa, Entamoeba histolytica
WVYLIIVCVGVLIAPLIIIV

SEQ ID NO: 2599927 - protein, 17 aa, Entamoeba histolytica
WYALAYDRKGCVRYTSG

SEQ ID NO: 2599928 - protein, 20 aa, Entamoeba histolytica
WYCVLFVLCFIAFSLVVYFT

SEQ ID NO: 2599929 - protein, 26 aa, Entamoeba histolytica
WYGVVVQWVILLFPAINLTSEYPLVC

SEQ ID NO: 2599930 - protein, 38 aa, Entamoeba histolytica
WYHSYEHQYDVFYYLAMQPWRHFVWTTCTTTDGNKECY

SEQ ID NO: 2599931 - protein, 21 aa, Entamoeba histolytica
WYVIVIALFVRMVIVPIICIG

SEQ ID NO: 2599932 - protein, 18 aa, Entamoeba histolytica
YAALPPEQQLLIFSPPPP

SEQ ID NO: 2599933 - protein, 17 aa, Entamoeba histolytica
YACDFLITDHPRFEFFD

SEQ ID NO: 2599934 - protein, 26 aa, Entamoeba histolytica
YACEFELFIIIKCTTKIKDKIMIISK

SEQ ID NO: 2599935 - protein, 26 aa, Entamoeba histolytica
YACEFELFIIIKCTTKINDKIIVIGE

SEQ ID NO: 2599936 - protein, 20 aa, Entamoeba histolytica
YAISALKKRFSLTAENKYCT

SEQ ID NO: 2599937 - protein, 21 aa, Entamoeba histolytica
YAKGKIWIEPTGETSLKILNE

SEQ ID NO: 2599938 - protein, 45 aa, Entamoeba histolytica
YAKQSSKLMCIILIVVAIIMVIVVAAILVPIILKATGVTDKDEDS

SEQ ID NO: 2599939 - protein, 20 aa, Entamoeba histolytica
YALNALLVLMSDETGFNAVI

SEQ ID NO: 2599940 - protein, 28 aa, Entamoeba histolytica
YALQSIFLFAVFFIVSLPFLILCLAVGH

SEQ ID NO: 2599941 - protein, 24 aa, Entamoeba histolytica
YAREFFKTTLFPPPFNKQNIKIIK

SEQ ID NO: 2599942 - protein, 29 aa, Entamoeba histolytica
YASEFILMYITITAMILFGASASKFLHMD

SEQ ID NO: 2599943 - protein, 19 aa, Entamoeba histolytica
YAVFIAFTLFCLISVVVGE

SEQ ID NO: 2599944 - protein, 20 aa, Entamoeba histolytica
YAVYPFMRFELIPSLIVVYR

SEQ ID NO: 2599945 - protein, 22 aa, Entamoeba histolytica
YAVYPFMRFELIPSLIVVYRTY

SEQ ID NO: 2599946 - protein, 19 aa, Entamoeba histolytica
YAYWLIFPHFEEAELSSNI

SEQ ID NO: 2599947 - protein, 18 aa, Entamoeba histolytica
YCALIPTAWWIHPSSESL

SEQ ID NO: 2599948 - protein, 27 aa, Entamoeba histolytica
YCAQCRLMKFLLFRMNFKGDYSILLDS

SEQ ID NO: 2599949 - protein, 20 aa, Entamoeba histolytica
YCDNGYFFDFYNKKCVIDVC

SEQ ID NO: 2599950 - protein, 44 aa, Entamoeba histolytica
YCEFHLNVLIVILPIIGFIIILIVILCMAIILINSITRYTANKQ

SEQ ID NO: 2599951 - protein, 18 aa, Entamoeba histolytica
YCERIKLSPVFFNVSYPE

SEQ ID NO: 2599952 - protein, 25 aa, Entamoeba histolytica
YCFSKYRFIWDSISLKNLFIHFLHF

SEQ ID NO: 2599953 - protein, 30 aa, Entamoeba histolytica
YCNVPLFKEMLLPALKYGCTLLLPHTISPS

SEQ ID NO: 2599954 - protein, 29 aa, Entamoeba histolytica
YCPNTRLERWWFIITDVRNQFVLNATHGY

SEQ ID NO: 2599955 - protein, 19 aa, Entamoeba histolytica
YCQTAIKLALPITITQDID

SEQ ID NO: 2599956 - protein, 24 aa, Entamoeba histolytica
YCRATKFIIKGKKTIKLLQHEVDF

SEQ ID NO: 2599957 - protein, 23 aa, Entamoeba histolytica
YCVKCYDGYYLKDNSCIRCTENC

SEQ ID NO: 2599958 - protein, 24 aa, Entamoeba histolytica
YDASCFFYWIVVPLLFNEQGATSV

SEQ ID NO: 2599959 - protein, 25 aa, Entamoeba histolytica
YDDTVDIPFVSLLFAIINGIVRLSS

SEQ ID NO: 2599960 - protein, 26 aa, Entamoeba histolytica
YDESGWYQLCGIVLFVFVHKHIKSQI

SEQ ID NO: 2599961 - protein, 29 aa, Entamoeba histolytica
YDGFTFTIFVSIFIVVTLKVFFITKRYTV

SEQ ID NO: 2599962 - protein, 24 aa, Entamoeba histolytica
YDGQQFLLLWQLLGLSLSVTFHIF

SEQ ID NO: 2599963 - protein, 17 aa, Entamoeba histolytica
YDLIRIFRNCYIPFYDG

SEQ ID NO: 2599964 - protein, 31 aa, Entamoeba histolytica
YDNGLITNIINYPPNFIFGGNQLNITQLIVS

SEQ ID NO: 2599965 - protein, 26 aa, Entamoeba histolytica
YDNIRKFLQFQLTVNISALALCVIGS

SEQ ID NO: 2599966 - protein, 27 aa, Entamoeba histolytica
YDNIRKFLQFQLTVNVVALALCIIGAI

SEQ ID NO: 2599967 - protein, 20 aa, Entamoeba histolytica
YDSAFQLLALRFVSQKHLET

SEQ ID NO: 2599968 - protein, 25 aa, Entamoeba histolytica
YDSNLYYLLIAQSVKIQLLLDVPKI

SEQ ID NO: 2599969 - protein, 26 aa, Entamoeba histolytica
YDVEYLVKWGLTICVIILVVLISHYN

SEQ ID NO: 2599970 - protein, 27 aa, Entamoeba histolytica
YDVMYDSILFFVYTPIVFSLSMPQWLY

SEQ ID NO: 2599971 - protein, 19 aa, Entamoeba histolytica
YDYFIFVSSTKRSLFQVEF

SEQ ID NO: 2599972 - protein, 19 aa, Entamoeba histolytica
YECINWCYAYPISMKTWNI

SEQ ID NO: 2599973 - protein, 31 aa, Entamoeba histolytica
YEEHTVPFGLILLCILIIGPPTGLNLRNLLW

SEQ ID NO: 2599974 - protein, 19 aa, Entamoeba histolytica
YEETILNCIDLFDSNNYPI

SEQ ID NO: 2599975 - protein, 18 aa, Entamoeba histolytica
YEETISKCIDLFDSNDYP

SEQ ID NO: 2599976 - protein, 17 aa, Entamoeba histolytica
YEFNTKNPYTKPLIPVD

SEQ ID NO: 2599977 - protein, 31 aa, Entamoeba histolytica
YEIGSIRVALLLWKHFFLSLPNPVIEEDVYN

SEQ ID NO: 2599978 - protein, 26 aa, Entamoeba histolytica
YELKRRIVELLYGFSLIGRPTPISVI

SEQ ID NO: 2599979 - protein, 30 aa, Entamoeba histolytica
YEMRTTISLPFYFYSVRFLGKIFKSRDNDT

SEQ ID NO: 2599980 - protein, 19 aa, Entamoeba histolytica
YENYLWCGIMFIGSLILYF

SEQ ID NO: 2599981 - protein, 36 aa, Entamoeba histolytica; identical to SEQ ID NO: 2403107

SEQ ID NO: 2599982 - protein, 26 aa, Entamoeba histolytica
YERWSLVMFNILFSILLPMVVATFDK

SEQ ID NO: 2599983 - protein, 27 aa, Entamoeba histolytica
YESDIRYYLYHNILSFIAGNDLNIDKT

SEQ ID NO: 2599984 - protein, 18 aa, Entamoeba histolytica
YEYLSFWNIMVNSLNPYF

SEQ ID NO: 2599985 - protein, 18 aa, Entamoeba histolytica
YFAYGFLMSIFIQITILL

SEQ ID NO: 2599986 - protein, 17 aa, Entamoeba histolytica
YFDFLYYVLVSDLVIGA

SEQ ID NO: 2599987 - protein, 17 aa, Entamoeba histolytica
YFFFVFYCIFSIGQGIM

SEQ ID NO: 2599988 - protein, 19 aa, Entamoeba histolytica
YFFLQGTIFLIRSFSIFFT

SEQ ID NO: 2599989 - protein, 17 aa, Entamoeba histolytica
YFGLSSPISEFTLEAPY

SEQ ID NO: 2599990 - protein, 17 aa, Entamoeba histolytica
YFIKKTNQNKRPANVHY

SEQ ID NO: 2599991 - protein, 32 aa, Entamoeba histolytica
YFKNQYKVKLLIKLVLLISIIVSIMFGIIRVI

SEQ ID NO: 2599992 - protein, 19 aa, Entamoeba histolytica
YFKSITLNSMLFSFVVTAN

SEQ ID NO: 2599993 - protein, 19 aa, Entamoeba histolytica
YFLDFIQCSFNVETIGRVV

SEQ ID NO: 2599994 - protein, 18 aa, Entamoeba histolytica
YFLIVCFSLWMPQIYQNI

SEQ ID NO: 2599995 - protein, 22 aa, Entamoeba histolytica
YFPSPFQLVLPLNVQLPQPMVI

SEQ ID NO: 2599996 - protein, 20 aa, Entamoeba histolytica
YFSCFGKILICGETVVREDQ

SEQ ID NO: 2599997 - protein, 20 aa, Entamoeba histolytica
YFSFMALNPEIREKLPLTQI

SEQ ID NO: 2599998 - protein, 18 aa, Entamoeba histolytica
YFSIVNAKLICGVKNTKG

SEQ ID NO: 2599999 - protein, 22 aa, Entamoeba histolytica
YFSLLLYHILIVIVYPSFVETK

SEQ ID NO: 2600000 - protein, 19 aa, Entamoeba histolytica
YFSNILLNDQWISFNDKLI

SEQ ID NO: 2600001 - protein, 30 aa, Entamoeba histolytica
YFSTISMVPALFGLTFYIIIQKFSLSFFIS

SEQ ID NO: 2600002 - protein, 20 aa, Entamoeba histolytica
YFTIIYFFGIFLYLLSSIPH

SEQ ID NO: 2600003 - protein, 18 aa, Entamoeba histolytica
YFVKDSFLGWKYVDFNNS

SEQ ID NO: 2600004 - protein, 20 aa, Entamoeba histolytica
YFVKDSFLGWKYVDFNNSKF

SEQ ID NO: 2600005 - protein, 19 aa, Entamoeba histolytica
YFYIDPPINGFYERLVVSS

SEQ ID NO: 2600006 - protein, 18 aa, Entamoeba histolytica
YFYIIFQCGYDRYIIPIF

SEQ ID NO: 2600007 - protein, 26 aa, Entamoeba histolytica
YGAIVCFVYFPFSQIASFLIIDNTKR

SEQ ID NO: 2600008 - protein, 27 aa, Entamoeba histolytica
YGAPLNSCLTYYRFLSNGNSYYVKFSN

SEQ ID NO: 2600009 - protein, 20 aa, Entamoeba histolytica
YGCTLLLPHTISPSIEFYLT

SEQ ID NO: 2600010 - protein, 39 aa, Entamoeba histolytica
YGEWLKQVLEYFLSLKSNLFVISPTTLPYNLLNIIKTFG

SEQ ID NO: 2600011 - protein, 38 aa, Entamoeba histolytica
YGEWLKQVLEYFWSLKSHLFVISPTTLPYNLLNIIKTF

SEQ ID NO: 2600012 - protein, 17 aa, Entamoeba histolytica
YGFIPNSAAIYSKELIQ

SEQ ID NO: 2600013 - protein, 23 aa, Entamoeba histolytica
YGGFTICVIILYLCLLIAANFMG

SEQ ID NO: 2600014 - protein, 25 aa, Entamoeba histolytica
YGGKQLYMVLCVLLLINLVDVLHVK

SEQ ID NO: 2600015 - protein, 24 aa, Entamoeba histolytica
YGIFTIFILLFYVSLLLSVFFMGY

SEQ ID NO: 2600016 - protein, 19 aa, Entamoeba histolytica
YGIIGIWIIIALCCSYFAL

SEQ ID NO: 2600017 - protein, 19 aa, Entamoeba histolytica
YGIIGLFICVPITLVIASY

SEQ ID NO: 2600018 - protein, 23 aa, Entamoeba histolytica
YGILSIIKILRKCCEIDLFQFHV

SEQ ID NO: 2600019 - protein, 28 aa, Entamoeba histolytica
YGKFTFVTFMRYVILAAPMIPISLRINL

SEQ ID NO: 2600020 - protein, 17 aa, Entamoeba histolytica
YGKYFHYTIPKSTTTQN

SEQ ID NO: 2600021 - protein, 24 aa, Entamoeba histolytica
YGLKKFFGYFTLISYIIPISCQVS

SEQ ID NO: 2600022 - protein, 18 aa, Entamoeba histolytica
YGLLDIFFEYLTNNPEIL

SEQ ID NO: 2600023 - protein, 27 aa, Entamoeba histolytica
YGMHFMENALFPLYSHSLVSSLNILFH

SEQ ID NO: 2600024 - protein, 17 aa, Entamoeba histolytica
YGNDYYCQIYLGKIFIT

SEQ ID NO: 2600025 - protein, 17 aa, Entamoeba histolytica
YGNILLLSKEKFLDQAI

SEQ ID NO: 2600026 - protein, 25 aa, Entamoeba histolytica
YGPLVFYFCPLSLVFYLLTGGISYA

SEQ ID NO: 2600027 - protein, 29 aa, Entamoeba histolytica
YGSCLIRFFGFYLATLLLFWGCTIKYCND

SEQ ID NO: 2600028 - protein, 26 aa, Entamoeba histolytica
YGSILFYALLVVPLSFLKLSSQTFVQ

SEQ ID NO: 2600029 - protein, 37 aa, Entamoeba histolytica
YGTFPDGFYKYFHFKFPSLFTVLYSFVKEFYSHSDVL

SEQ ID NO: 2600030 - protein, 31 aa, Entamoeba histolytica
YGVTKILKYIFPIKRVIFILRKELKTLINSF

SEQ ID NO: 2600031 - protein, 19 aa, Entamoeba histolytica
YGYLPWKKCTPTKLTLVSL

SEQ ID NO: 2600032 - protein, 20 aa, Entamoeba histolytica
YGYSLKISLLERYKHNYNYN

SEQ ID NO: 2600033 - protein, 24 aa, Entamoeba histolytica
YHCTKCNLGYWLRKYSSEVSLCEK

SEQ ID NO: 2600034 - protein, 26 aa, Entamoeba histolytica
YHCTKCNLGYWLRKYSSKVSLCEKCP

SEQ ID NO: 2600035 - protein, 20 aa, Entamoeba histolytica
YHDPFISFISFEASLMIEAN

SEQ ID NO: 2600036 - protein, 19 aa, Entamoeba histolytica
YHEALIGIFDYIHSDGIII

SEQ ID NO: 2600037 - protein, 22 aa, Entamoeba histolytica
YHFVDWRTITVQSKPEWLTLCR

SEQ ID NO: 2600038 - protein, 18 aa, Entamoeba histolytica
YHKIWKYYERFGYQNSEE

SEQ ID NO: 2600039 - protein, 26 aa, Entamoeba histolytica
YHLSDKVIIFYLPSSLFCIICCFHQH

SEQ ID NO: 2600040 - protein, 28 aa, Entamoeba histolytica
YHNYRYFFLFQFYLWVALLLADVHLYKI

SEQ ID NO: 2600041 - protein, 22 aa, Entamoeba histolytica
YHPFNFCIFLHMINCIMYSYPT

SEQ ID NO: 2600042 - protein, 18 aa, Entamoeba histolytica
YHSDICIDSIKYQWDKGN

SEQ ID NO: 2600043 - protein, 17 aa, Entamoeba histolytica
YHTKIVHLIDSGFIQEC

SEQ ID NO: 2600044 - protein, 18 aa, Entamoeba histolytica
YHVFFGFSSKFEAGTLPI

SEQ ID NO: 2600045 - protein, 27 aa, Entamoeba histolytica
YHYSAFAILLFFTAWLPQAAIAMHGSQ

SEQ ID NO: 2600046 - protein, 26 aa, Entamoeba histolytica
YIDDERFIQPWTIPQFVIEGHRLEKP

SEQ ID NO: 2600047 - protein, 19 aa, Entamoeba histolytica
YIDYYFEKPNKGSKPIFSA

SEQ ID NO: 2600048 - protein, 27 aa, Entamoeba histolytica
YIEEDHCYLLFIPFEYNGHTCYSYKIV

SEQ ID NO: 2600049 - protein, 19 aa, Entamoeba histolytica
YIETQYPKYSLRIVPQTIC

SEQ ID NO: 2600050 - protein, 23 aa, Entamoeba histolytica
YIGFVFSLFLFKLYHNYILFCST

SEQ ID NO: 2600051 - protein, 20 aa, Entamoeba histolytica
YIHIICLLLVFLLSISILCN

SEQ ID NO: 2600052 - protein, 18 aa, Entamoeba histolytica
YIIIDGTCYYFRAINKCE

SEQ ID NO: 2600053 - protein, 19 aa, Entamoeba histolytica
YIIIQKFSLSFFISMKFIP

SEQ ID NO: 2600054 - protein, 19 aa, Entamoeba histolytica
YIILAVIRFILGLGIGGEY

SEQ ID NO: 2600055 - protein, 32 aa, Entamoeba histolytica
YIISGILLYMIYFIFMIIFNFIRCLVNIKKEG

SEQ ID NO: 2600056 - protein, 25 aa, Entamoeba histolytica
YIIVLIMWMIWIPLHFISSIKFDIF

SEQ ID NO: 2600057 - protein, 18 aa, Entamoeba histolytica
YILIFVCVSSQIIKEVKE

SEQ ID NO: 2600058 - protein, 18 aa, Entamoeba histolytica
YILIPIFSSLFVEGALNK

SEQ ID NO: 2600059 - protein, 18 aa, Entamoeba histolytica
YILIRIAMCFFVVAVAII

SEQ ID NO: 2600060 - protein, 19 aa, Entamoeba histolytica
YILLFSKSQGFHCSPGCTS

SEQ ID NO: 2600061 - protein, 17 aa, Entamoeba histolytica
YILSRYPLDRTIDHIKQ

SEQ ID NO: 2600062 - protein, 52 aa, Entamoeba histolytica
YILSTICFAFGFALYYDWKLALCVIAVFPIHTLILFFDFKLNSMQSSPAEKA

SEQ ID NO: 2600063 - protein, 20 aa, Entamoeba histolytica
YILVCYFVCVIGGFIPFFIK

SEQ ID NO: 2600064 - protein, 18 aa, Entamoeba histolytica
YILVGMIFFISLLLIFHS

SEQ ID NO: 2600065 - protein, 17 aa, Entamoeba histolytica
YILWKDKTFQRRTVYLQ

SEQ ID NO: 2600066 - protein, 23 aa, Entamoeba histolytica
YINFPIIILLILAITAPIILFIL

SEQ ID NO: 2600067 - protein, 35 aa, Entamoeba histolytica
YINQNVLIVIWWIIYILQFGLCYLIFPIVQTYSIV

SEQ ID NO: 2600068 - protein, 24 aa, Entamoeba histolytica
YIPPQELFLQHLFSHPSELTLQQR

SEQ ID NO: 2600069 - protein, 20 aa, Entamoeba histolytica
YIPVFIYYYEVYDNPFVMFA

SEQ ID NO: 2600070 - protein, 22 aa, Entamoeba histolytica
YIPVFLFYNYRWLHRTWMIFVL

SEQ ID NO: 2600071 - protein, 19 aa, Entamoeba histolytica
YIQTLILINMYSPTQIIIS

SEQ ID NO: 2600072 - protein, 26 aa, Entamoeba histolytica
YISDYPELFRTYLKPEMEFDKRSDEV

SEQ ID NO: 2600073 - protein, 26 aa, Entamoeba histolytica
YISELDIPEGFYDLAMILYDSLKQSH

SEQ ID NO: 2600074 - protein, 26 aa, Entamoeba histolytica
YISLFSSMNWIIHDSIIISILNFIES

SEQ ID NO: 2600075 - protein, 18 aa, Entamoeba histolytica
YISSKQFPLMLFIGSSDN

SEQ ID NO: 2600076 - protein, 20 aa, Entamoeba histolytica
YISSLLKLLRFQIVQLQVAT

SEQ ID NO: 2600077 - protein, 28 aa, Entamoeba histolytica
YISTHLFMFSLLFWILGYIYINLNKTND

SEQ ID NO: 2600078 - protein, 28 aa, Entamoeba histolytica
YITTFITFVILYNNLVPISLYISLEIVR

SEQ ID NO: 2600079 - protein, 19 aa, Entamoeba histolytica
YITYRFIHQYGFDLNSGMI

SEQ ID NO: 2600080 - protein, 28 aa, Entamoeba histolytica
YIVGMMLFSFIVLINIVYMLANQSNESI

SEQ ID NO: 2600081 - protein, 33 aa, Entamoeba histolytica; identical to SEQ ID NO: 2403201

SEQ ID NO: 2600082 - protein, 17 aa, Entamoeba histolytica
YIVQFYGACFIPTKTCM

SEQ ID NO: 2600083 - protein, 17 aa, Entamoeba histolytica
YIYIPALIICVIGQVIR

SEQ ID NO: 2600084 - protein, 26 aa, Entamoeba histolytica
YKAGQYFFDTILMNLRVPFLKDASME

SEQ ID NO: 2600085 - protein, 19 aa, Entamoeba histolytica
YKAGYMIFGAGLAVGFCNL

SEQ ID NO: 2600086 - protein, 27 aa, Entamoeba histolytica
YKCEKNVLFYIMISVSLVISMIVIVVV

SEQ ID NO: 2600087 - protein, 26 aa, Entamoeba histolytica
YKDLDRFDMVLYNKLFDILKESTNCC

SEQ ID NO: 2600088 - protein, 18 aa, Entamoeba histolytica
YKFSNWREYIKPKYHCII

SEQ ID NO: 2600089 - protein, 29 aa, Entamoeba histolytica
YKGTLIHVVAFYLFLLGVVSAVIGVSMDI

SEQ ID NO: 2600090 - protein, 44 aa, Entamoeba histolytica
YKKSQRWVQSIAGLLRLFCLGINLHFFHYYPVNYGIFRRKIKIL

SEQ ID NO: 2600091 - protein, 19 aa, Entamoeba histolytica
YKLGRIPYLYLVIVALFTG

SEQ ID NO: 2600092 - protein, 31 aa, Entamoeba histolytica
YKMEYITLFFVIIYFVYFFIGKSSNTSVVTE

SEQ ID NO: 2600093 - protein, 24 aa, Entamoeba histolytica
YKMGIVGFVLWSLATIVYFIYTWY

SEQ ID NO: 2600094 - protein, 21 aa, Entamoeba histolytica
YKMIIFVIISFIIISVLYRFN

SEQ ID NO: 2600095 - protein, 21 aa, Entamoeba histolytica
YKMYLSQWFSLMTLLSSIANA

SEQ ID NO: 2600096 - protein, 18 aa, Entamoeba histolytica
YKQLSASILIHVVDPFSS

SEQ ID NO: 2600097 - protein, 26 aa, Entamoeba histolytica
YKSRLYMLLWGIWFYCSEQTEVFIQI

SEQ ID NO: 2600098 - protein, 25 aa, Entamoeba histolytica
YKSYSLFGFLRYFKSLKLQPNSSNE

SEQ ID NO: 2600099 - protein, 26 aa, Entamoeba histolytica
YKYKGRIYMLFWGLCFYFGQQTEVLV

SEQ ID NO: 2600100 - protein, 18 aa, Entamoeba histolytica
YKYSRLFPSLLDFKYSSI

SEQ ID NO: 2600101 - protein, 17 aa, Entamoeba histolytica
YKYVIPNCQIYSGECVL

SEQ ID NO: 2600102 - protein, 18 aa, Entamoeba histolytica
YLACVLISYVYLYIVVYF

SEQ ID NO: 2600103 - protein, 18 aa, Entamoeba histolytica
YLDGRVVSKPFSWPTTDF

SEQ ID NO: 2600104 - protein, 17 aa, Entamoeba histolytica
YLEKTHNLTLPDFIVKQ

SEQ ID NO: 2600105 - protein, 24 aa, Entamoeba histolytica
YLEPILCVFSLPFFLFVVNLLCMH

SEQ ID NO: 2600106 - protein, 19 aa, Entamoeba histolytica
YLFEDLYIHAHYLQTFIVA

SEQ ID NO: 2600107 - protein, 34 aa, Entamoeba histolytica
YLFGKIYIDHTLATKFLQYLSFVLYQCSVRNSIT

SEQ ID NO: 2600108 - protein, 26 aa, Entamoeba histolytica
YLFGTAGCWFFFDIAFYGNSMFNSTV

SEQ ID NO: 2600109 - protein, 19 aa, Entamoeba histolytica
YLFSVNVFYPPLNKSKVVS

SEQ ID NO: 2600110 - protein, 19 aa, Entamoeba histolytica
YLFVVLFAIGMTLAVCIFY

SEQ ID NO: 2600111 - protein, 26 aa, Entamoeba histolytica
YLGIIYYPTFFPLLSQFKLFIKQKLT

SEQ ID NO: 2600112 - protein, 17 aa, Entamoeba histolytica
YLHCSFVIPDSLTASSK

SEQ ID NO: 2600113 - protein, 18 aa, Entamoeba histolytica
YLIGIYPVHRYIASRFIW

SEQ ID NO: 2600114 - protein, 17 aa, Entamoeba histolytica
YLIIFKTTDGSIYGTYN

SEQ ID NO: 2600115 - protein, 24 aa, Entamoeba histolytica
YLIPANLMFYIFRSLNFNIIKMTK

SEQ ID NO: 2600116 - protein, 24 aa, Entamoeba histolytica
YLIVSCCFVLFALGLVGSLYIPVV

SEQ ID NO: 2600117 - protein, 18 aa, Entamoeba histolytica
YLIVSKFINYVSSTSSDS

SEQ ID NO: 2600118 - protein, 24 aa, Entamoeba histolytica
YLKLIKRICLFQVFGYKGTLIHVV

SEQ ID NO: 2600119 - protein, 18 aa, Entamoeba histolytica
YLKPVEVPIFIYTEDGWL

SEQ ID NO: 2600120 - protein, 21 aa, Entamoeba histolytica
YLLFFSIIISGITIFTIKPES

SEQ ID NO: 2600121 - protein, 18 aa, Entamoeba histolytica
YLLIFTHFAYNLFPMIFF

SEQ ID NO: 2600122 - protein, 17 aa, Entamoeba histolytica
YLLIIAFITISTIAING

SEQ ID NO: 2600123 - protein, 17 aa, Entamoeba histolytica
YLLISQLLEKTIKSIVG

SEQ ID NO: 2600124 - protein, 19 aa, Entamoeba histolytica
YLLSFLTYHTFSHRFSTIS

SEQ ID NO: 2600125 - protein, 26 aa, Entamoeba histolytica
YLPQIFFYLLFYPNKKEFILFKLPLI

SEQ ID NO: 2600126 - protein, 36 aa, Entamoeba histolytica
YLQVSQVTFLNIWTRKLWRSACSLLDYIKGIMRKPT

SEQ ID NO: 2600127 - protein, 17 aa, Entamoeba histolytica
YLRDILDDTLRLLEKLQ

SEQ ID NO: 2600128 - protein, 27 aa, Entamoeba histolytica
YLRHPSYFGWFYWSIFTQFVLINPICI

SEQ ID NO: 2600129 - protein, 19 aa, Entamoeba histolytica
YLSFLFQINNQLWFLLSWT

SEQ ID NO: 2600130 - protein, 19 aa, Entamoeba histolytica
YLSFMALDPSIKKKMPLTQ

SEQ ID NO: 2600131 - protein, 21 aa, Entamoeba histolytica
YLSYLLIPLQVIVTSILITLN

SEQ ID NO: 2600132 - protein, 17 aa, Entamoeba histolytica
YLTDPIHMTIFDTLFVA

SEQ ID NO: 2600133 - protein, 19 aa, Entamoeba histolytica
YLTELTELPTTRLYVIGKI

SEQ ID NO: 2600134 - protein, 26 aa, Entamoeba histolytica
YLTIVYIFIIIVIISMVFRFISALVC

SEQ ID NO: 2600135 - protein, 25 aa, Entamoeba histolytica
YLTNNPEILYPLFKELLSYICSDYC

SEQ ID NO: 2600136 - protein, 18 aa, Entamoeba histolytica
YLTYLAKICIAYSDSYSF

SEQ ID NO: 2600137 - protein, 20 aa, Entamoeba histolytica
YLVHRIFFTFYDNNSFLSLI

SEQ ID NO: 2600138 - protein, 17 aa, Entamoeba histolytica
YLVLHSINYTPKLYSIF

SEQ ID NO: 2600139 - protein, 18 aa, Entamoeba histolytica
YLVYKNPLLLNAINHFIP

SEQ ID NO: 2600140 - protein, 17 aa, Entamoeba histolytica
YLYIMNYAKTQQDNATR

SEQ ID NO: 2600141 - protein, 24 aa, Entamoeba histolytica
YMAAVFICLAIVFQLIVCFSQEFG

SEQ ID NO: 2600142 - protein, 30 aa, Entamoeba histolytica
YMFGYLPIAPSWFFILLLLPSCCGVAITME

SEQ ID NO: 2600143 - protein, 24 aa, Entamoeba histolytica
YMISSYSSFWYSQNSTYLKVINPI

SEQ ID NO: 2600144 - protein, 18 aa, Entamoeba histolytica
YMKYIYAAILDIGLDQSE

SEQ ID NO: 2600145 - protein, 29 aa, Entamoeba histolytica
YMTCNLLVGFFLAEYWKFGFIIIICSPWL

SEQ ID NO: 2600146 - protein, 19 aa, Entamoeba histolytica
YMWLAVCMIPTIAFYLIDT

SEQ ID NO: 2600147 - protein, 17 aa, Entamoeba histolytica
YMYFCIPLTKELYSQSN

SEQ ID NO: 2600148 - protein, 19 aa, Entamoeba histolytica
YNCHFLLDFIPTTSVLRQG

SEQ ID NO: 2600149 - protein, 28 aa, Entamoeba histolytica
YNDETYFWARYFKLLFLKSNKLGEYSTF

SEQ ID NO: 2600150 - protein, 18 aa, Entamoeba histolytica
YNDMFKMFVYIVLSIENN

SEQ ID NO: 2600151 - protein, 20 aa, Entamoeba histolytica
YNDPLYIKIEKLEIIVALAN

SEQ ID NO: 2600152 - protein, 29 aa, Entamoeba histolytica
YNELKPSIISILIKILLRNIEIIEISKNH

SEQ ID NO: 2600153 - protein, 17 aa, Entamoeba histolytica
YNFVQLLDQLQLDLDQC

SEQ ID NO: 2600154 - protein, 23 aa, Entamoeba histolytica
YNGYLTLLKYFSSFTSLFVFTSS

SEQ ID NO: 2600155 - protein, 35 aa, Entamoeba histolytica
YNISYFAFQWLGVAVFFLYLSSLILYVPPITSVSH

SEQ ID NO: 2600156 - protein, 22 aa, Entamoeba histolytica
YNNFLYQNYCYECSKYKPNCLV

SEQ ID NO: 2600157 - protein, 21 aa, Entamoeba histolytica
YNQFLYHKVSEGDLPLYLVCL

SEQ ID NO: 2600158 - protein, 29 aa, Entamoeba histolytica
YNRDELFAHGLFYFIGVDSFLFQKSPNAF

SEQ ID NO: 2600159 - protein, 34 aa, Entamoeba histolytica
YNRLTNTIQNIYNNIHLIAETLSEPAPANSQSAS

SEQ ID NO: 2600160 - protein, 25 aa, Entamoeba histolytica
YNSLFIFSLIIIIPLIFGLSYLIHF

SEQ ID NO: 2600161 - protein, 25 aa, Entamoeba histolytica
YNTSCYFYWIVVPLLFNEQGASAIQ

SEQ ID NO: 2600162 - protein, 18 aa, Entamoeba histolytica
YNVALKQYLFWDKKNTQE

SEQ ID NO: 2600163 - protein, 30 aa, Entamoeba histolytica
YNVAVSHILLCISLFKIQIQPAINHLKSAA

SEQ ID NO: 2600164 - protein, 17 aa, Entamoeba histolytica
YNVLDRWKTFSFGGEED

SEQ ID NO: 2600165 - protein, 37 aa, Entamoeba histolytica
YNVPPCIHYLYPYGTLLLWIIFGFYSASLQTVMQFAL

SEQ ID NO: 2600166 - protein, 17 aa, Entamoeba histolytica
YPALKFLGATSLFIEPP

SEQ ID NO: 2600167 - protein, 27 aa, Entamoeba histolytica
YPCGKFGILLGIFLPTLILAQPLANTM

SEQ ID NO: 2600168 - protein, 21 aa, Entamoeba histolytica
YPDCHYLSYLYDFSLNIENIY

SEQ ID NO: 2600169 - protein, 26 aa, Entamoeba histolytica
YPDDILSFLFTIFAHSQLIPLTKETI

SEQ ID NO: 2600170 - protein, 19 aa, Entamoeba histolytica
YPENVFKYPWNIAEYVMQG

SEQ ID NO: 2600171 - protein, 17 aa, Entamoeba histolytica
YPFGVDPIWKSSNNELY

SEQ ID NO: 2600172 - protein, 30 aa, Entamoeba histolytica
YPFVDFQPSFWRFLKYWFMSLLTSQINVTM

SEQ ID NO: 2600173 - protein, 20 aa, Entamoeba histolytica
YPIQIILPLNGGGYVTYAQN

SEQ ID NO: 2600174 - protein, 19 aa, Entamoeba histolytica
YPIQVIFPKNGGGLVKLAQ

SEQ ID NO: 2600175 - protein, 29 aa, Entamoeba histolytica
YPIQVPNELIIFLTRVWINRITNKKEGDK

SEQ ID NO: 2600176 - protein, 17 aa, Entamoeba histolytica
YPLIFYISWQVIYVIIT

SEQ ID NO: 2600177 - protein, 26 aa, Entamoeba histolytica
YPRKATIWLVIVFLMITFSEFIIQMS

SEQ ID NO: 2600178 - protein, 20 aa, Entamoeba histolytica
YPSFWYSIQLSESLDVIATT

SEQ ID NO: 2600179 - protein, 18 aa, Entamoeba histolytica
YPTTKPIVLQKFITTFNP

SEQ ID NO: 2600180 - protein, 25 aa, Entamoeba histolytica
YQDKSRFRYPWDIATFVTKGLRLEQ

SEQ ID NO: 2600181 - protein, 27 aa, Entamoeba histolytica
YQECREIMDFLYKRLCEDGKNWREIYK

SEQ ID NO: 2600182 - protein, 19 aa, Entamoeba histolytica
YQEKEACKFAFEIGIKYTK

SEQ ID NO: 2600183 - protein, 25 aa, Entamoeba histolytica
YQGHTLFIKWWRGSKSKSGVLKRSL

SEQ ID NO: 2600184 - protein, 20 aa, Entamoeba histolytica
YQIFDSFIKYDILKTVIDEV

SEQ ID NO: 2600185 - protein, 25 aa, Entamoeba histolytica
YQIYRLFTSLFLSPSLFGLIVEIIF

SEQ ID NO: 2600186 - protein, 18 aa, Entamoeba histolytica
YQLLSWNDPYPNDKFKYP

SEQ ID NO: 2600187 - protein, 35 aa, Entamoeba histolytica
YQMRRSLYEWAHLRTYFIIERIKKVMKIFIHFIIK

SEQ ID NO: 2600188 - protein, 17 aa, Entamoeba histolytica
YQPLIPTLILPSNDTEP

SEQ ID NO: 2600189 - protein, 20 aa, Entamoeba histolytica
YQRIALSLVLLVMTSSSVFK

SEQ ID NO: 2600190 - protein, 27 aa, Entamoeba histolytica
YQVICHLFATMLTFILSIVSFVFGSVL

SEQ ID NO: 2600191 - protein, 29 aa, Entamoeba histolytica
YRFGLPYQYSFIVLVIFQAICIAVIILCT

SEQ ID NO: 2600192 - protein, 38 aa, Entamoeba histolytica
YRNTSLIKLIFFKNAAFFLHLLWFACICMFTSQRLYDD

SEQ ID NO: 2600193 - protein, 20 aa, Entamoeba histolytica
YRNYFGISIKRLLEEENRMN

SEQ ID NO: 2600194 - protein, 39 aa, Entamoeba histolytica
YRRIRKLFIILLFIETIIILPLVILSWVGGAFEVIDVEN

SEQ ID NO: 2600195 - protein, 17 aa, Entamoeba histolytica
YRTYFLGYLIPLILYLW

SEQ ID NO: 2600196 - protein, 20 aa, Entamoeba histolytica
YRVRKLSFYAICRQDIGWFD

SEQ ID NO: 2600197 - protein, 19 aa, Entamoeba histolytica
YSCIIVVIYLFIFRSFIFK

SEQ ID NO: 2600198 - protein, 18 aa, Entamoeba histolytica
YSCLKCEKGYYLDNGKCN

SEQ ID NO: 2600199 - protein, 43 aa, Entamoeba histolytica
YSDLLSLLMSMIILIVPPIPKKPLPFGLLVLRFDKPDIQIYLL

SEQ ID NO: 2600200 - protein, 26 aa, Entamoeba histolytica
YSFGIIMWEFLTRDIPYKNIPLKSIS

SEQ ID NO: 2600201 - protein, 23 aa, Entamoeba histolytica
YSFGKIKFVFYIGNSPTKITDDI

SEQ ID NO: 2600202 - protein, 20 aa, Entamoeba histolytica
YSFIFALIFLVVAAVFCVIF

SEQ ID NO: 2600203 - protein, 21 aa, Entamoeba histolytica
YSFIFALIFLVVAAVFCVIFY

SEQ ID NO: 2600204 - protein, 17 aa, Entamoeba histolytica
YSFILLALTIAFFFIIP

SEQ ID NO: 2600205 - protein, 23 aa, Entamoeba histolytica
YSFQFTLRNTYKKVLLYTFHGKE

SEQ ID NO: 2600206 - protein, 25 aa, Entamoeba histolytica
YSFSISLYQIIIYHDPYKGICEYPW

SEQ ID NO: 2600207 - protein, 37 aa, Entamoeba histolytica
YSFSITMLQIIIWQDPFPKTLYPHPWDIADTITIGKR

SEQ ID NO: 2600208 - protein, 33 aa, Entamoeba histolytica
YSFSITMLQIITWQDPFPKEIYKYPWDIADTIT

SEQ ID NO: 2600209 - protein, 25 aa, Entamoeba histolytica
YSFSITMLQIITWQDPFPKSEFKFP

SEQ ID NO: 2600210 - protein, 25 aa, Entamoeba histolytica
YSFSITMLQIITWQDPFPKSEYPHP

SEQ ID NO: 2600211 - protein, 26 aa, Entamoeba histolytica
YSFSITMLQIITWQDPFPKSEYPHPW

SEQ ID NO: 2600212 - protein, 34 aa, Entamoeba histolytica
YSFSITMLQIITWQDPFPKTLYPHPWDIADTITT

SEQ ID NO: 2600213 - protein, 39 aa, Entamoeba histolytica
YSFSITMLQIITWQDPFPKTLYPHPWLIADTITTGKRPN

SEQ ID NO: 2600214 - protein, 40 aa, Entamoeba histolytica
YSFSITMLQIITWQDPFPKTLYPHPWLIADTITTGNRPVI

SEQ ID NO: 2600215 - protein, 36 aa, Entamoeba histolytica
YSFSITMLQIITWQDPFPKTLYPHPWSIADTITIGK

SEQ ID NO: 2600216 - protein, 28 aa, Entamoeba histolytica
YSFTISISIFFFSPLTYLQLVLLCIANY

SEQ ID NO: 2600217 - protein, 27 aa, Entamoeba histolytica
YSGNYHGLLRGMWFKFNATQNTHVIDT

SEQ ID NO: 2600218 - protein, 20 aa, Entamoeba histolytica
YSHEDLISLFITYQLNKKRS

SEQ ID NO: 2600219 - protein, 26 aa, Entamoeba histolytica
YSIFCSLRILLLDVLTQILKSIPEEK

SEQ ID NO: 2600220 - protein, 26 aa, Entamoeba histolytica
YSITSTDFFYLIQPIVAHIFEEKTEL

SEQ ID NO: 2600221 - protein, 33 aa, Entamoeba histolytica
YSKLVIQFILPIYSIIFFVVLLVRYVSQFRPDS

SEQ ID NO: 2600222 - protein, 25 aa, Entamoeba histolytica
YSKNKYMMIIFHTPNNPKFVFHFEP

SEQ ID NO: 2600223 - protein, 23 aa, Entamoeba histolytica
YSKNKYMMVIVHTPNNPKYVFHF

SEQ ID NO: 2600224 - protein, 28 aa, Entamoeba histolytica
YSLCFFRVLYLDCLLSEALVYFWVGENQ

SEQ ID NO: 2600225 - protein, 21 aa, Entamoeba histolytica
YSLTLLAIIGTPSITFVLLFL

SEQ ID NO: 2600226 - protein, 17 aa, Entamoeba histolytica
YSMLYKPLVSLTKKQQE

SEQ ID NO: 2600227 - protein, 26 aa, Entamoeba histolytica
YSNKTRYICYLPLAHIFELTIEFCNL

SEQ ID NO: 2600228 - protein, 25 aa, Entamoeba histolytica
YSNNKWLLVIFHTPNNPKYVFHFEP

SEQ ID NO: 2600229 - protein, 25 aa, Entamoeba histolytica
YSQMFDIWHIIPAYVTMAEIQFLRD

SEQ ID NO: 2600230 - protein, 18 aa, Entamoeba histolytica
YSQRLDWLGVGLAIITVM

SEQ ID NO: 2600231 - protein, 17 aa, Entamoeba histolytica
YSQWIEKILSPYDDVNY

SEQ ID NO: 2600232 - protein, 26 aa, Entamoeba histolytica
YSRNKWLMIIFHTPNNPKYVFYFEPQ

SEQ ID NO: 2600233 - protein, 23 aa, Entamoeba histolytica
YSSMISLFFWAIVTILCFYDVQE

SEQ ID NO: 2600234 - protein, 27 aa, Entamoeba histolytica
YSSSFYILRFIAPMPFYLVTGSSLQLA

SEQ ID NO: 2600235 - protein, 17 aa, Entamoeba histolytica
YSTFMLFSNFYLVNISN

SEQ ID NO: 2600236 - protein, 31 aa, Entamoeba histolytica
YSTIPILLFPLFFFFALLGECTIAFICFNFL

SEQ ID NO: 2600237 - protein, 25 aa, Entamoeba histolytica
YSVFNVVFICYLFFMLDSFMKQNGT

SEQ ID NO: 2600238 - protein, 24 aa, Entamoeba histolytica
YSVHHVLLKPKETIMFFVTTTEEE

SEQ ID NO: 2600239 - protein, 24 aa, Entamoeba histolytica
YSVLNWSEPFPKQSFKFAWDVAEF

SEQ ID NO: 2600240 - protein, 27 aa, Entamoeba histolytica
YSVVIFKLLKLLPHYKLKIPLRSFFVV

SEQ ID NO: 2600241 - protein, 24 aa, Entamoeba histolytica
YSWSELNFLSKQKVWIGTDTALIL

SEQ ID NO: 2600242 - protein, 26 aa, Entamoeba histolytica
YSYAIVYFFLIFIRLLNSNDLYPQAT

SEQ ID NO: 2600243 - protein, 30 aa, Entamoeba histolytica
YSYLVDEILFLFLNVFYFKAKSMTNNISSY

SEQ ID NO: 2600244 - protein, 27 aa, Entamoeba histolytica
YTCKMAKYWYLQRMDWIGAAISIITVI

SEQ ID NO: 2600245 - protein, 34 aa, Entamoeba histolytica
YTFPTLLLIIVVISAILFALISTVLPLIPVLKKQ

SEQ ID NO: 2600246 - protein, 34 aa, Entamoeba histolytica
YTIYSFIPYFLYEQFRKLANVYFLFISCLQLIPG

SEQ ID NO: 2600247 - protein, 17 aa, Entamoeba histolytica
YTKIGCVRSLSLNKCEN

SEQ ID NO: 2600248 - protein, 19 aa, Entamoeba histolytica
YTKRPFLYTLIVDIICFML

SEQ ID NO: 2600249 - protein, 24 aa, Entamoeba histolytica
YTLQMAKIWYSQRLEWMGFTISTL

SEQ ID NO: 2600250 - protein, 25 aa, Entamoeba histolytica
YTNPFLMFFIMLIFSTTHGYFASHA

SEQ ID NO: 2600251 - protein, 24 aa, Entamoeba histolytica
YTNTLSILLPIVTPLSLINEDLLN

SEQ ID NO: 2600252 - protein, 46 aa, Entamoeba histolytica
YTPKGKYCAKKNLWYVWVIIVVVIILIISFIILGIVYKRIHHKIKK

SEQ ID NO: 2600253 - protein, 26 aa, Entamoeba histolytica
YTRNGTLIKIIPLNCEMNYFGIGLRE

SEQ ID NO: 2600254 - protein, 18 aa, Entamoeba histolytica
YTSAFIFDSIKNHSLLVS

SEQ ID NO: 2600255 - protein, 24 aa, Entamoeba histolytica
YTSFPTTIYLFKYDQKLINLQYIG

SEQ ID NO: 2600256 - protein, 41 aa, Entamoeba histolytica
YTSGWSVALIIIGITLFIGLVILIIIIIIINYNKYEEKIKM

SEQ ID NO: 2600257 - protein, 26 aa, Entamoeba histolytica
YTTFNYSLLILIVSFIGFGIAQSKTD

SEQ ID NO: 2600258 - protein, 17 aa, Entamoeba histolytica
YTTYDWIDFYHSITDFE

SEQ ID NO: 2600259 - protein, 34 aa, Entamoeba histolytica
YTVYKPNLILKVLGSFLPFSIYINDDKKMYLLQR

SEQ ID NO: 2600260 - protein, 28 aa, Entamoeba histolytica
YVAAVLPLFIFIIFPRKPRYKNDETNPK

SEQ ID NO: 2600261 - protein, 24 aa, Entamoeba histolytica
YVDCRHYFPDLSDYYFDLGDKNVM

SEQ ID NO: 2600262 - protein, 18 aa, Entamoeba histolytica
YVFHFNPQVTILSPKSHR

SEQ ID NO: 2600263 - protein, 26 aa, Entamoeba histolytica
YVFITFILCLFTNKLFIWLLFTIAVS

SEQ ID NO: 2600264 - protein, 26 aa, Entamoeba histolytica
YVFPSALRFLPFVMILSLFLNNTPVV

SEQ ID NO: 2600265 - protein, 18 aa, Entamoeba histolytica
YVFQMLEFLFITLQANPS

SEQ ID NO: 2600266 - protein, 17 aa, Entamoeba histolytica
YVFVKTLNGLESISVVK

SEQ ID NO: 2600267 - protein, 24 aa, Entamoeba histolytica
YVGFFIQAVILYTDIFGQKKIKIF

SEQ ID NO: 2600268 - protein, 17 aa, Entamoeba histolytica
YVHVFCTKGFYSIFKKM

SEQ ID NO: 2600269 - protein, 37 aa, Entamoeba histolytica
YVINNNIVYYLYYLFIIIIFFFPSLMVPTNPADEIFT

SEQ ID NO: 2600270 - protein, 23 aa, Entamoeba histolytica
YVIPIFFGVLMMTFYFMQKKTLK

SEQ ID NO: 2600271 - protein, 24 aa, Entamoeba histolytica
YVIQITILMFPLVNLTSEYPLVSA

SEQ ID NO: 2600272 - protein, 21 aa, Entamoeba histolytica
YVKRMLRFLHKSSIYNIQFNG

SEQ ID NO: 2600273 - protein, 26 aa, Entamoeba histolytica
YVLFYLIFKIFLIVIALLRARSEVFF

SEQ ID NO: 2600274 - protein, 24 aa, Entamoeba histolytica
YVLTTYIFIIIWNVFIIYFALFLF

SEQ ID NO: 2600275 - protein, 18 aa, Entamoeba histolytica
YVLVIFEALRKPISWRKN

SEQ ID NO: 2600276 - protein, 20 aa, Entamoeba histolytica
YVMVLIIVAFFIDIPLPIRH

SEQ ID NO: 2600277 - protein, 18 aa, Entamoeba histolytica
YVNWIHLPEKIYVIVQDE

SEQ ID NO: 2600278 - protein, 18 aa, Entamoeba histolytica
YVPIVEKTPFFKTLVKFY

SEQ ID NO: 2600279 - protein, 17 aa, Entamoeba histolytica
YVSHHCYFFKTDTLKEM

SEQ ID NO: 2600280 - protein, 17 aa, Entamoeba histolytica
YVSIKYPMLINSITQKL

SEQ ID NO: 2600281 - protein, 27 aa, Entamoeba histolytica
YVTATYHYSSLFNLTSYKLHLPQSEEF

SEQ ID NO: 2600282 - protein, 25 aa, Entamoeba histolytica
YVVISALCPPFFFYIQRIYSKSEDP

SEQ ID NO: 2600283 - protein, 28 aa, Entamoeba histolytica
YVVKVHRIHAIELLPLYSSNGLSVGETM

SEQ ID NO: 2600284 - protein, 21 aa, Entamoeba histolytica
YVVLTFYFLLLSSCGEAPCLT

SEQ ID NO: 2600285 - protein, 19 aa, Entamoeba histolytica
YVWWNVFTIRKNSTRILLR

SEQ ID NO: 2600286 - protein, 38 aa, Entamoeba histolytica
YVYQSNNLIRIFPIQFTRIKIYPGTCGVVLILTISDKI

SEQ ID NO: 2600287 - protein, 18 aa, Entamoeba histolytica
YVYYFGVDPIWKSSNNEL

SEQ ID NO: 2600288 - protein, 25 aa, Entamoeba histolytica
YWKFGFIIIICSPWLFNDKKTNKTR

SEQ ID NO: 2600289 - protein, 23 aa, Entamoeba histolytica
YWSGCYFLRLNLMKKAEFMFRQC

SEQ ID NO: 2600290 - protein, 24 aa, Entamoeba histolytica
YWTCAFIPILIVLALIHGFAIVAP

SEQ ID NO: 2600291 - protein, 35 aa, Entamoeba histolytica
YYCAYILHSIPFLIFYPTLYLAIAYPMLNLRSGFV

SEQ ID NO: 2600292 - protein, 19 aa, Entamoeba histolytica
YYCQIYLGKIFITEKGWEY

SEQ ID NO: 2600293 - protein, 26 aa, Entamoeba histolytica
YYDIEQWYHFLPKSTIPLLAINSIDD

SEQ ID NO: 2600294 - protein, 18 aa, Entamoeba histolytica
YYDLNPTAALYKIVNDDY

SEQ ID NO: 2600295 - protein, 17 aa, Entamoeba histolytica
YYDWKVALCVMAIAPVL

SEQ ID NO: 2600296 - protein, 24 aa, Entamoeba histolytica
YYEKSNIVLPYKLKLKIMRDVECG

SEQ ID NO: 2600297 - protein, 19 aa, Entamoeba histolytica
YYFKRDFTYSLTKPMECKS

SEQ ID NO: 2600298 - protein, 17 aa, Entamoeba histolytica
YYGRPYKIPYGRTRLNF

SEQ ID NO: 2600299 - protein, 27 aa, Entamoeba histolytica
YYHNCPDAMFITLPFTAIHSFDNSAAQ

SEQ ID NO: 2600300 - protein, 32 aa, Entamoeba histolytica
YYKHQRKIISLLWNKIPPLKSNKDKLIYHYIL

SEQ ID NO: 2600301 - protein, 17 aa, Entamoeba histolytica
YYLPLLRMFNECCFPTG

SEQ ID NO: 2600302 - protein, 26 aa, Entamoeba histolytica
YYLQKSCDFFISTYWPSYILNELDNN

SEQ ID NO: 2600303 - protein, 20 aa, Entamoeba histolytica
YYQLIQLVGLLYYAGDVIGR

SEQ ID NO: 2600304 - protein, 30 aa, Entamoeba histolytica
YYSNKMLFFYKQIIIFYYFVKNQTNDENQI

SEQ ID NO: 2600305 - protein, 17 aa, Entamoeba histolytica
YYTLFMKADDLGRLLLN

SEQ ID NO: 2600306 - protein, 22 aa, Entamoeba histolytica
YYTVALLFLAPIPFGLISKFIK

SEQ ID NO: 2600307 - protein, 24 aa, Entamoeba histolytica
YYYDLTFFKIILTINWPWLCICMV

SEQ ID NO: 2600308 - protein, 19 aa, Entamoeba histolytica
YYYSSLSSAKPSGSANIVQ

SEQ ID NO: 2600309 - protein, 25 aa, Entamoeba histolytica
KEVVWWMIMIIVIIIVIIIIITIVM

SEQ ID NO: 2600310 - protein, 17 aa, Entamoeba histolytica
CYYLITKGWSFLISKEQ

SEQ ID NO: 2600311 - protein, 24 aa, Entamoeba histolytica
EQELKDVGLYDLFSKKESIHENDI

SEQ ID NO: 2600312 - protein, 25 aa, Entamoeba histolytica
FLPITLFGYFYIFFATIRALYLSII

SEQ ID NO: 2600313 - protein, 25 aa, Entamoeba histolytica
GCIILLVIFMLFMPEMFVTAFMSFV

SEQ ID NO: 2600314 - protein, 18 aa, Entamoeba histolytica
HDFLKHICIVWNKCYYYI

SEQ ID NO: 2600315 - protein, 18 aa, Entamoeba histolytica
HICIVWNKCYYYISDRQL

SEQ ID NO: 2600316 - protein, 17 aa, Entamoeba histolytica
ILPFLLINKIQIYGEDP

SEQ ID NO: 2600317 - protein, 22 aa, Entamoeba histolytica
IMKYFYIFLGISGAMFISTYLH

SEQ ID NO: 2600318 - protein, 24 aa, Entamoeba histolytica
KEVVWWMIMIIVIIIVIIIMITIV

SEQ ID NO: 2600319 - protein, 24 aa, Entamoeba histolytica
MITFVLFIVLATSTETFLSKGQSI

SEQ ID NO: 2600320 - protein, 20 aa, Entamoeba histolytica
NVKVYFFSKCQEKKKFTIAG

SEQ ID NO: 2600321 - protein, 23 aa, Entamoeba histolytica
QELKDVGLYDLFSKKESIHENDI

SEQ ID NO: 2600322 - protein, 20 aa, Entamoeba histolytica
SKIYLIYFWSLCKGLIVILT

SEQ ID NO: 2600323 - protein, 23 aa, Entamoeba histolytica
SRNKWLMIIFHTPNNPKYVFYFE

SEQ ID NO: 2600324 - protein, 25 aa, Entamoeba histolytica
TERDKFFNMIFPFVLFILDDSEKIN

SEQ ID NO: 2600325 - protein, 31 aa, Entamoeba histolytica
VGVIIVIALILLVAFILYAKLVLLKNRKNNK

SEQ ID NO: 2600326 - protein, 21 aa, Entamoeba histolytica
YDVFYYLAMQPWRHFVWTTCD

SEQ ID NO: 2600327 - protein, 22 aa, Entamoeba histolytica
CHFYLVISLFLVIYLFILFYNI

SEQ ID NO: 2600328 - protein, 21 aa, Entamoeba histolytica
QHLIQLVLMMDVVLELILKII

SEQ ID NO: 2600329 - protein, 21 aa, Entamoeba histolytica
AAFFLMDIWFATISNFTCQII

SEQ ID NO: 2600330 - protein, 17 aa, Entamoeba histolytica
ACIFLSFFFVLFFGLFP

SEQ ID NO: 2600331 - protein, 25 aa, Entamoeba histolytica
ACLFSTFFIIVIPIIFRSFYFLISF

SEQ ID NO: 2600332 - protein, 23 aa, Entamoeba histolytica
AENNYLFLKLTTTATLPTFPTAF

SEQ ID NO: 2600333 - protein, 28 aa, Entamoeba histolytica
AFLVFPLFFILLAILILTLFPFLKTYFI

SEQ ID NO: 2600334 - protein, 19 aa, Entamoeba histolytica
AFMMLIMLFIFEGMTTFTR

SEQ ID NO: 2600335 - protein, 17 aa, Entamoeba histolytica
AFPLFIQANVLLASSTK

SEQ ID NO: 2600336 - protein, 19 aa, Entamoeba histolytica
AFQTILLYRITLARFSKLD

SEQ ID NO: 2600337 - protein, 25 aa, Entamoeba histolytica
AGAVFPFYMIQFIGLLMTLMGMSPD

SEQ ID NO: 2600338 - protein, 24 aa, Entamoeba histolytica
AGCDAMFAFPWYITWFLHSVENIE

SEQ ID NO: 2600339 - protein, 25 aa, Entamoeba histolytica
AKSVILLGELLYLAGLLLPQRHLSL

SEQ ID NO: 2600340 - protein, 17 aa, Entamoeba histolytica
ALIVIVVVIIKEKKLKR

SEQ ID NO: 2600341 - protein, 23 aa, Entamoeba histolytica
ALLIIFQAFVLIFIFTSGYVTLD

SEQ ID NO: 2600342 - protein, 22 aa, Entamoeba histolytica
ALLLFIIIIFMVFLRRRKIQQE

SEQ ID NO: 2600343 - protein, 30 aa, Entamoeba histolytica
ALLRAMFDFTFYWYNFMPLSRGTAATGFVF

SEQ ID NO: 2600344 - protein, 19 aa, Entamoeba histolytica
ALPSLPLVIPYLTLLILSH

SEQ ID NO: 2600345 - protein, 23 aa, Entamoeba histolytica
AMKKLYPLFLWILSGLFPQFANI

SEQ ID NO: 2600346 - protein, 24 aa, Entamoeba histolytica
ANFIRDLMRFWKLAYVVGLIDMVM

SEQ ID NO: 2600347 - protein, 22 aa, Entamoeba histolytica
ANKKYFLLLLFYVTLMILFVLL

SEQ ID NO: 2600348 - protein, 23 aa, Entamoeba histolytica
AQCRLMKFLLFRMNFKGDYSILL

SEQ ID NO: 2600349 - protein, 22 aa, Entamoeba histolytica
ASFLFIFFYIIVLLLALPATPL

SEQ ID NO: 2600350 - protein, 20 aa, Entamoeba histolytica
ASMILLVIIYRGWALASPAI

SEQ ID NO: 2600351 - protein, 27 aa, Entamoeba histolytica
ASTHTFFWICFFLMQFCTVVLVLNLLK

SEQ ID NO: 2600352 - protein, 17 aa, Entamoeba histolytica
ATFILGEYYFNSLWMIM

SEQ ID NO: 2600353 - protein, 24 aa, Entamoeba histolytica
ATPLLITLFIIVLIVSILTVMVKI

SEQ ID NO: 2600354 - protein, 25 aa, Entamoeba histolytica
AVIIIIVLVVIFLIFIIQTRRKKKE

SEQ ID NO: 2600355 - protein, 18 aa, Entamoeba histolytica
AVLPLFIFIIFPRKPRYK

SEQ ID NO: 2600356 - protein, 23 aa, Entamoeba histolytica
AVQLVFLCYIIFSAFPKFLFGSI

SEQ ID NO: 2600357 - protein, 20 aa, Entamoeba histolytica
AYLFTITFFICSWYYQPGYY

SEQ ID NO: 2600358 - protein, 26 aa, Entamoeba histolytica
AYMAENLFFYFKFPNLISLPLNFSAE

SEQ ID NO: 2600359 - protein, 26 aa, Entamoeba histolytica
CAAIVFIVLTLWWFYKAITFTGYVQP

SEQ ID NO: 2600360 - protein, 26 aa, Entamoeba histolytica
CAAVVFIVLTLWWFYKAITFTGYVQP

SEQ ID NO: 2600361 - protein, 19 aa, Entamoeba histolytica
CAFIVIFIVFVITKLVVQK

SEQ ID NO: 2600362 - protein, 26 aa, Entamoeba histolytica
CCGGLLLLIFIAYIALIVIGLVKGWL

SEQ ID NO: 2600363 - protein, 24 aa, Entamoeba histolytica
CCILYLFVFLIFGMGWIKGPIADF

SEQ ID NO: 2600364 - protein, 22 aa, Entamoeba histolytica
CCSLFYRLYLNYIPLIPLIINK

SEQ ID NO: 2600365 - protein, 34 aa, Entamoeba histolytica
CEIAPVWWVITLIILVLIMLLISIVILTGCIARM

SEQ ID NO: 2600366 - protein, 19 aa, Entamoeba histolytica
CFQLSIKWIFVLSLRLRNG

SEQ ID NO: 2600367 - protein, 18 aa, Entamoeba histolytica
CGFLLLRVMLLKCSFNKL

SEQ ID NO: 2600368 - protein, 18 aa, Entamoeba histolytica
CGGILLYFLLRTTKFDIN

SEQ ID NO: 2600369 - protein, 18 aa, Entamoeba histolytica
CGSSLLTVLFISAIVLML

SEQ ID NO: 2600370 - protein, 25 aa, Entamoeba histolytica
CIIVSFFVILLFNIVFFVIKNCFLN

SEQ ID NO: 2600371 - protein, 22 aa, Entamoeba histolytica
CKMAKLWYLQRMDWIGAFIIVI

SEQ ID NO: 2600372 - protein, 22 aa, Entamoeba histolytica
CKMAKYWYLQRMDWIGAAISII

SEQ ID NO: 2600373 - protein, 18 aa, Entamoeba histolytica
CKSLIITSDLIPSNINKA

SEQ ID NO: 2600374 - protein, 17 aa, Entamoeba histolytica
CLMIIILSLNWYLPPLK

SEQ ID NO: 2600375 - protein, 19 aa, Entamoeba histolytica
CLWCLLFLTLLSVSVSLVM

SEQ ID NO: 2600376 - protein, 26 aa, Entamoeba histolytica
CPIPHSFLIFIRIISLFVMTIPSAFE

SEQ ID NO: 2600377 - protein, 19 aa, Entamoeba histolytica
CQLLPLIVIILCGIIVLIM

SEQ ID NO: 2600378 - protein, 25 aa, Entamoeba histolytica
CQRSPVWWVIILVILVILSITIIIL

SEQ ID NO: 2600379 - protein, 41 aa, Entamoeba histolytica
CRKIPVWLYWVLYVLTIFILYWIFLIITGLFIGLLYRRLNK

SEQ ID NO: 2600380 - protein, 28 aa, Entamoeba histolytica
CRSKPIGWWVWLLIALGIVFIFICSIVI

SEQ ID NO: 2600381 - protein, 22 aa, Entamoeba histolytica
CSAILFWCYMFAILNIIFGVVL

SEQ ID NO: 2600382 - protein, 35 aa, Entamoeba histolytica
CSSYIEWWLIILMILFILCLFVLILIVFYCIINRY

SEQ ID NO: 2600383 - protein, 28 aa, Entamoeba histolytica
CVPLYRPLTVILFFLITGIIFIPIGIAV

SEQ ID NO: 2600384 - protein, 17 aa, Entamoeba histolytica
CVSVIVGILLILAIVLL

SEQ ID NO: 2600385 - protein, 17 aa, Entamoeba histolytica
CYLYPLHPFTKPPQYIY

SEQ ID NO: 2600386 - protein, 19 aa, Entamoeba histolytica
CYPFYLAFFGMLISTILFV

SEQ ID NO: 2600387 - protein, 23 aa, Entamoeba histolytica
DDDPAMFIAFDFGLCYYIDETES

SEQ ID NO: 2600388 - protein, 20 aa, Entamoeba histolytica
DDFLYFIKVLYGVSPKITVT

SEQ ID NO: 2600389 - protein, 24 aa, Entamoeba histolytica
DDVPTWVIVILVIVGIIIVIIIIL

SEQ ID NO: 2600390 - protein, 25 aa, Entamoeba histolytica
DEIYYALNILYFVSLVLDPYIPEFG

SEQ ID NO: 2600391 - protein, 34 aa, Entamoeba histolytica
DEKSKWWISLISVGILLILFLSAIISILAIINFL

SEQ ID NO: 2600392 - protein, 25 aa, Entamoeba histolytica
DFIGRILIPYWIFLILIGCISGIVH

SEQ ID NO: 2600393 - protein, 18 aa, Entamoeba histolytica
DFLLSWKIFGLLYVFSMA

SEQ ID NO: 2600394 - protein, 19 aa, Entamoeba histolytica
DFNMLFLIIYSVSVFYFSC

SEQ ID NO: 2600395 - protein, 27 aa, Entamoeba histolytica
DFWMRHSLIALFSWYVIILLDEQNPTH

SEQ ID NO: 2600396 - protein, 17 aa, Entamoeba histolytica
DFWVGDWWGIWSTSAYL

SEQ ID NO: 2600397 - protein, 24 aa, Entamoeba histolytica
DGRPKFDIILLNNLGLMTSVSNNG

SEQ ID NO: 2600398 - protein, 20 aa, Entamoeba histolytica
DINILLEFLLRKIQPKTPTP

SEQ ID NO: 2600399 - protein, 25 aa, Entamoeba histolytica
DISGPYLFVIYLINFIIFLNLIVGE

SEQ ID NO: 2600400 - protein, 24 aa, Entamoeba histolytica
DKHAVWWIILIIVILLLILFVIIT

SEQ ID NO: 2600401 - protein, 21 aa, Entamoeba histolytica
DKNRFIFLSNLLLDIATELGY

SEQ ID NO: 2600402 - protein, 17 aa, Entamoeba histolytica
DLIYDSIFFIPLNRRIN

SEQ ID NO: 2600403 - protein, 25 aa, Entamoeba histolytica
DLRDRGLFYWRLLAHDPELAKEMVC

SEQ ID NO: 2600404 - protein, 21 aa, Entamoeba histolytica
DLSHYPIFPWIIQDYTSISLD

SEQ ID NO: 2600405 - protein, 24 aa, Entamoeba histolytica
DLVPVWWNFVVVIIIIDIIIKICV

SEQ ID NO: 2600406 - protein, 17 aa, Entamoeba histolytica
DLWNPIFIPYVILLCFI

SEQ ID NO: 2600407 - protein, 20 aa, Entamoeba histolytica
DMFGLIYQLILTPSFYLLIL

SEQ ID NO: 2600408 - protein, 23 aa, Entamoeba histolytica
DNENFIRFPFKLKIKILFDTARG

SEQ ID NO: 2600409 - protein, 23 aa, Entamoeba histolytica
DNIIGFWLWAYYLSYLRYAFELV

SEQ ID NO: 2600410 - protein, 29 aa, Entamoeba histolytica
DNKGFVNLPYLLRFDFLNILRDFDYLYEK

SEQ ID NO: 2600411 - protein, 24 aa, Entamoeba histolytica
DNPSLVWFFVILSLCLVWMIVGVI

SEQ ID NO: 2600412 - protein, 29 aa, Entamoeba histolytica
DNWNKDLLYFYYFLPFNITIDRNKKMYLI

SEQ ID NO: 2600413 - protein, 24 aa, Entamoeba histolytica
DPIDPLLHFQLPIVNGLLFVISII

SEQ ID NO: 2600414 - protein, 22 aa, Entamoeba histolytica
DPSYYLFRWLTLLGASELPMDV

SEQ ID NO: 2600415 - protein, 19 aa, Entamoeba histolytica
DQHFNGLLKVSLLSAQSLI

SEQ ID NO: 2600416 - protein, 22 aa, Entamoeba histolytica
DQPFYPFYRKLNKLLFDLHDLH

SEQ ID NO: 2600417 - protein, 25 aa, Entamoeba histolytica
DSDGIIQLLWLLIQYHDPQLSNHLK

SEQ ID NO: 2600418 - protein, 18 aa, Entamoeba histolytica
DSIFFIPLNRRINVVVKE

SEQ ID NO: 2600419 - protein, 22 aa, Entamoeba histolytica
DSVIPTILLLKSALWKEEWNSK

SEQ ID NO: 2600420 - protein, 27 aa, Entamoeba histolytica
DTEIEDFFIIFIWILKNINKNMLQYYI

SEQ ID NO: 2600421 - protein, 27 aa, Entamoeba histolytica
DVIIEGYFYLFPAFCLPWFVKQKKNIP

SEQ ID NO: 2600422 - protein, 23 aa, Entamoeba histolytica
DVSELLEILFWKYLKEEPGTSAE

SEQ ID NO: 2600423 - protein, 24 aa, Entamoeba histolytica
DVSYQMLYIPFYSLSKKAQSIVNR

SEQ ID NO: 2600424 - protein, 17 aa, Entamoeba histolytica
DYKYAFPLFIQANVLLA

SEQ ID NO: 2600425 - protein, 19 aa, Entamoeba histolytica
EAPPLFLFFKCSDNIALDE

SEQ ID NO: 2600426 - protein, 21 aa, Entamoeba histolytica
EAYLVKWKLFRSLALEDLKKT

SEQ ID NO: 2600427 - protein, 32 aa, Entamoeba histolytica; identical to SEQ ID NO: 2403602

SEQ ID NO: 2600428 - protein, 19 aa, Entamoeba histolytica
EEWDLESFYPFFKEGFCKH

SEQ ID NO: 2600429 - protein, 29 aa, Entamoeba histolytica
EFIAILTNPLLFILTLIIGGGVYIGYKLN

SEQ ID NO: 2600430 - protein, 34 aa, Entamoeba histolytica
EFPKWTIGVMVIFVIALIVIVVVIIVYAVYVYLE

SEQ ID NO: 2600431 - protein, 29 aa, Entamoeba histolytica
EGVLLNCFLMILPVLKPHRRLAIALAIEY

SEQ ID NO: 2600432 - protein, 30 aa, Entamoeba histolytica
EIFGIIVAVLFLVVILLVIGLFVGYIGYKK

SEQ ID NO: 2600433 - protein, 17 aa, Entamoeba histolytica
EIIVFLIKEFQHLFPEN

SEQ ID NO: 2600434 - protein, 22 aa, Entamoeba histolytica
EILIPQFFKMFLAFKKVGLDGN

SEQ ID NO: 2600435 - protein, 25 aa, Entamoeba histolytica
EINDFIVYWIVKLNKKYYKVTICDS

SEQ ID NO: 2600436 - protein, 19 aa, Entamoeba histolytica
EINSSMPVFILLLGIIFLF

SEQ ID NO: 2600437 - protein, 30 aa, Entamoeba histolytica
EIYRYFKVILITMQIILLSPLIYNELKKKI

SEQ ID NO: 2600438 - protein, 22 aa, Entamoeba histolytica
EKDLLLFLPLYTTVLARGSTQP

SEQ ID NO: 2600439 - protein, 23 aa, Entamoeba histolytica
EKKWLNIFFNWIPEMVFMICSFG

SEQ ID NO: 2600440 - protein, 25 aa, Entamoeba histolytica
EKLTYISFNVYISINYCVITNATES

SEQ ID NO: 2600441 - protein, 25 aa, Entamoeba histolytica
EKVWGVVKVLGFISLGVGVGVAIGV

SEQ ID NO: 2600442 - protein, 20 aa, Entamoeba histolytica
EKYHFVMLYFIMNFPNDVKN

SEQ ID NO: 2600443 - protein, 18 aa, Entamoeba histolytica
ELIFCVIMLYMKGNKKLI

SEQ ID NO: 2600444 - protein, 30 aa, Entamoeba histolytica
ELMKYKVLMKFLLFTLLTFLVSADVVSLNP

SEQ ID NO: 2600445 - protein, 24 aa, Entamoeba histolytica
ELYDHLYLLLQLYQVFIIPKNQSF

SEQ ID NO: 2600446 - protein, 23 aa, Entamoeba histolytica
ELYFLDLNLMFWIAISMTIALII

SEQ ID NO: 2600447 - protein, 17 aa, Entamoeba histolytica
EMIKFIIFFIKQKLGKI

SEQ ID NO: 2600448 - protein, 18 aa, Entamoeba histolytica
ENIPYYLFVHKPFGIHFT

SEQ ID NO: 2600449 - protein, 24 aa, Entamoeba histolytica
ENLLPFTFPVKYFFVFYKQRKLFV

SEQ ID NO: 2600450 - protein, 22 aa, Entamoeba histolytica
ENRWFIPIAIVGVILIVSIVLF

SEQ ID NO: 2600451 - protein, 26 aa, Entamoeba histolytica
ENSELTLFYYFLPFSINIENDKKMYL

SEQ ID NO: 2600452 - protein, 18 aa, Entamoeba histolytica
ENTLFTYVLLFIGLLTVG

SEQ ID NO: 2600453 - protein, 23 aa, Entamoeba histolytica
ENVYFILLSFIISLIPITTIQYI

SEQ ID NO: 2600454 - protein, 19 aa, Entamoeba histolytica
ENYILFPLLSFFSILLCLY

SEQ ID NO: 2600455 - protein, 17 aa, Entamoeba histolytica
EPALSTAFIYYDSTNKK

SEQ ID NO: 2600456 - protein, 26 aa, Entamoeba histolytica
EPLQRRLFIVILMNVALIGMLIYLLL

SEQ ID NO: 2600457 - protein, 17 aa, Entamoeba histolytica
EQEVRMYKIYSSKTKRM

SEQ ID NO: 2600458 - protein, 22 aa, Entamoeba histolytica
ERLFTNWYFLVICGGICICQII

SEQ ID NO: 2600459 - protein, 20 aa, Entamoeba histolytica
ESFYPFFKEGFCKHLIPAAL

SEQ ID NO: 2600460 - protein, 23 aa, Entamoeba histolytica
ETWDFLHFLLFVSTLIALLMKKG

SEQ ID NO: 2600461 - protein, 23 aa, Entamoeba histolytica
EVKAYLVIFYALLIYFPQLPSTT

SEQ ID NO: 2600462 - protein, 23 aa, Entamoeba histolytica
EVVWWMIMIIIIIIIIIIIITIV

SEQ ID NO: 2600463 - protein, 24 aa, Entamoeba histolytica
EYIFGQWGLLIQYIILIGGNVVIS

SEQ ID NO: 2600464 - protein, 25 aa, Entamoeba histolytica
EYITLFFVIIYFVYFFIGKSSNTSV

SEQ ID NO: 2600465 - protein, 18 aa, Entamoeba histolytica
EYKPLMYCLLIVFGLTII

SEQ ID NO: 2600466 - protein, 20 aa, Entamoeba histolytica
EYMEGLIAPIPLQQPVYKEP

SEQ ID NO: 2600467 - protein, 20 aa, Entamoeba histolytica
EYQRKFFPYRKAHKRVRGWV

SEQ ID NO: 2600468 - protein, 20 aa, Entamoeba histolytica
FAHKLIWFFIISILTMLFLY

SEQ ID NO: 2600469 - protein, 23 aa, Entamoeba histolytica
FAIALCYFIIPYFSANHDFRKLA

SEQ ID NO: 2600470 - protein, 25 aa, Entamoeba histolytica
FALSIYWFFYVFNWYMTYAKQLLRL

SEQ ID NO: 2600471 - protein, 28 aa, Entamoeba histolytica
FAMTLFTLLLFGPLFYRLIKVILMPKTT

SEQ ID NO: 2600472 - protein, 17 aa, Entamoeba histolytica
FAYIIKYLILFFPVFNL

SEQ ID NO: 2600473 - protein, 22 aa, Entamoeba histolytica
FCFQLSIKWIFVLSLRLRNGLI

SEQ ID NO: 2600474 - protein, 23 aa, Entamoeba histolytica
FEHSGYIYLLKQLPRYSTLKLLH

SEQ ID NO: 2600475 - protein, 23 aa, Entamoeba histolytica
FENKVFYVWFDAPIGYLSITANY

SEQ ID NO: 2600476 - protein, 22 aa, Entamoeba histolytica
FETFMYWDFFFIDLHEFVLLKV

SEQ ID NO: 2600477 - protein, 19 aa, Entamoeba histolytica
FFAKYWVWILIGVVALYFF

SEQ ID NO: 2600478 - protein, 18 aa, Entamoeba histolytica
FFGFIPFPIIRKFGSAFS

SEQ ID NO: 2600479 - protein, 19 aa, Entamoeba histolytica
FFIISLVLIIVIWGYPITL

SEQ ID NO: 2600480 - protein, 19 aa, Entamoeba histolytica
FFIKYIRYLSYLNPYTYCH

SEQ ID NO: 2600481 - protein, 17 aa, Entamoeba histolytica
FFLAILYTKLQYGFFNP

SEQ ID NO: 2600482 - protein, 20 aa, Entamoeba histolytica
FFLFGFCFIFFWLASFVISR

SEQ ID NO: 2600483 - protein, 17 aa, Entamoeba histolytica
FFLFYKTSSRICTVMTC

SEQ ID NO: 2600484 - protein, 21 aa, Entamoeba histolytica
FFPSLVYILIKANIPFFASNI

SEQ ID NO: 2600485 - protein, 17 aa, Entamoeba histolytica
FFVFYKQRKLFVPTILR

SEQ ID NO: 2600486 - protein, 18 aa, Entamoeba histolytica
FFYLIQPIVAHIFEEKTE

SEQ ID NO: 2600487 - protein, 20 aa, Entamoeba histolytica
FGCMFLLIDLMRNWFLSSND

SEQ ID NO: 2600488 - protein, 22 aa, Entamoeba histolytica
FGMMGVIFYWIITQKNYIIKEE

SEQ ID NO: 2600489 - protein, 18 aa, Entamoeba histolytica
FHIILYRSLFIKSTHLLS

SEQ ID NO: 2600490 - protein, 23 aa, Entamoeba histolytica
FHLNVLIVILPIIGFIIILIVIL

SEQ ID NO: 2600491 - protein, 18 aa, Entamoeba histolytica
FIAFRWFMAQLLINAKSC

SEQ ID NO: 2600492 - protein, 20 aa, Entamoeba histolytica
FIAGLVLIVLGIVLNFCICV

SEQ ID NO: 2600493 - protein, 17 aa, Entamoeba histolytica
FIAKFFYQLIFPPKYMT

SEQ ID NO: 2600494 - protein, 22 aa, Entamoeba histolytica
FIFEWHYLWYVHAFNFEISLRV

SEQ ID NO: 2600495 - protein, 20 aa, Entamoeba histolytica
FIFKLVFQILFLFSAICLFV

SEQ ID NO: 2600496 - protein, 26 aa, Entamoeba histolytica
FIISLFLFFFLIFFITFISVMGNMFF

SEQ ID NO: 2600497 - protein, 20 aa, Entamoeba histolytica
FIIVICTILFFLRKKPLPKE

SEQ ID NO: 2600498 - protein, 17 aa, Entamoeba histolytica
FIIYYYLEVLPLIKLKI

SEQ ID NO: 2600499 - protein, 22 aa, Entamoeba histolytica
FILGEYYFNSLWMIMCLLPPPQ

SEQ ID NO: 2600500 - protein, 20 aa, Entamoeba histolytica
FILICLILVTIICVLCLIKK

SEQ ID NO: 2600501 - protein, 17 aa, Entamoeba histolytica
FIPPYYSKKMWPLVIVF

SEQ ID NO: 2600502 - protein, 17 aa, Entamoeba histolytica
FIRYFLVICIFFILACI

SEQ ID NO: 2600503 - protein, 17 aa, Entamoeba histolytica
FISFAFSKDLIATITKD

SEQ ID NO: 2600504 - protein, 17 aa, Entamoeba histolytica
FISFVFSKDLIATFTKD

SEQ ID NO: 2600505 - protein, 17 aa, Entamoeba histolytica
FISIYLFLLLAAIGITV

SEQ ID NO: 2600506 - protein, 19 aa, Entamoeba histolytica
FISLINILFIVIYWIEVVA

SEQ ID NO: 2600507 - protein, 20 aa, Entamoeba histolytica
FIWGAPYPKETFPFPWNIAE

SEQ ID NO: 2600508 - protein, 19 aa, Entamoeba histolytica
FIYICYLPLLFIAFKTHPL

SEQ ID NO: 2600509 - protein, 18 aa, Entamoeba histolytica
FKDQFIPHLFIPSSFDFP

SEQ ID NO: 2600510 - protein, 20 aa, Entamoeba histolytica
FKLDSLVRPFTAKLLVVITP

SEQ ID NO: 2600511 - protein, 17 aa, Entamoeba histolytica
FKQLFKILELLGYSWAK

SEQ ID NO: 2600512 - protein, 19 aa, Entamoeba histolytica
FLCVYSAIMVILWGARKWL

SEQ ID NO: 2600513 - protein, 17 aa, Entamoeba histolytica
FLFYCYSEKIDLKKNRL

SEQ ID NO: 2600514 - protein, 17 aa, Entamoeba histolytica
FLFYLISLPLDSKFFTV

SEQ ID NO: 2600515 - protein, 24 aa, Entamoeba histolytica
FLGSILLYIILYTIIMFVPGMSVR

SEQ ID NO: 2600516 - protein, 17 aa, Entamoeba histolytica
FLIFYWVGLFFIICFWI

SEQ ID NO: 2600517 - protein, 19 aa, Entamoeba histolytica
FLIILAIVFLIIIGVVIYL

SEQ ID NO: 2600518 - protein, 18 aa, Entamoeba histolytica
FLLIFTIFICSSTSYECS

SEQ ID NO: 2600519 - protein, 17 aa, Entamoeba histolytica
FLLLMTNLKIVIFSSHL

SEQ ID NO: 2600520 - protein, 17 aa, Entamoeba histolytica
FLLVIFSLYLSFSSPSS

SEQ ID NO: 2600521 - protein, 21 aa, Entamoeba histolytica
FLNKIVWFFKSVICRFKLYPW

SEQ ID NO: 2600522 - protein, 18 aa, Entamoeba histolytica
FLRFIRRLLTSRGNYIFK

SEQ ID NO: 2600523 - protein, 20 aa, Entamoeba histolytica
FLSLFLYFYFKKSNIHLNSL

SEQ ID NO: 2600524 - protein, 26 aa, Entamoeba histolytica
FLTYYLILPLLYHPLSSPLLYLLNKH

SEQ ID NO: 2600525 - protein, 17 aa, Entamoeba histolytica
FLVIFKLEWKMFLLCYI

SEQ ID NO: 2600526 - protein, 22 aa, Entamoeba histolytica
FLVVVYLYLLLYHPNEIPFKYE

SEQ ID NO: 2600527 - protein, 27 aa, Entamoeba histolytica
FNDLHRYFRLFPRMYLLVNSFYSIFDD

SEQ ID NO: 2600528 - protein, 21 aa, Entamoeba histolytica
FNIVVIFPFVLCFYPDCIRIY

SEQ ID NO: 2600529 - protein, 17 aa, Entamoeba histolytica
FPIHTLILFFDFKLNSM

SEQ ID NO: 2600530 - protein, 17 aa, Entamoeba histolytica
FPLFIQTNVLLASSTKH

SEQ ID NO: 2600531 - protein, 21 aa, Entamoeba histolytica
FPMYMIAVIVVFVLVLVVVAV

SEQ ID NO: 2600532 - protein, 18 aa, Entamoeba histolytica
FPVWAYVLIVLFSFAILF

SEQ ID NO: 2600533 - protein, 23 aa, Entamoeba histolytica
FQKYLILAFALLPLVIRIIAFLF

SEQ ID NO: 2600534 - protein, 18 aa, Entamoeba histolytica
FSFSIVFWELFYGIHAFS

SEQ ID NO: 2600535 - protein, 21 aa, Entamoeba histolytica
FSIILPFILPYCYFSFIIVLV

SEQ ID NO: 2600536 - protein, 24 aa, Entamoeba histolytica
FSITMLQIIIWQDPFPKTLYPHPW

SEQ ID NO: 2600537 - protein, 21 aa, Entamoeba histolytica
FSLLLLLILISLCSSYFIRMN

SEQ ID NO: 2600538 - protein, 22 aa, Entamoeba histolytica
FSVIHILMMILSLPFNLFKKKN

SEQ ID NO: 2600539 - protein, 24 aa, Entamoeba histolytica
FSVYFYWLVLPVLLKKLQAGPILI

SEQ ID NO: 2600540 - protein, 21 aa, Entamoeba histolytica
FTRFFIVKLLMILLLCISCGL

SEQ ID NO: 2600541 - protein, 25 aa, Entamoeba histolytica
FTSFPDGFYLYFYKRFPGLLILVYN

SEQ ID NO: 2600542 - protein, 24 aa, Entamoeba histolytica
FTTTYPYFLALFPLLHYIAEHSYR

SEQ ID NO: 2600543 - protein, 17 aa, Entamoeba histolytica
FVFISNALIPLSTCLEG

SEQ ID NO: 2600544 - protein, 31 aa, Entamoeba histolytica
FVGGIIIWIIIWLLLLIGFVSRYIFLNKLII

SEQ ID NO: 2600545 - protein, 18 aa, Entamoeba histolytica
FVIVIFWILAVIGFAYPA

SEQ ID NO: 2600546 - protein, 26 aa, Entamoeba histolytica
FVLGLLGVIGYIFYFSLQPTKSHSFN

SEQ ID NO: 2600547 - protein, 18 aa, Entamoeba histolytica
FVLVFKYHTQIVVIVITV

SEQ ID NO: 2600548 - protein, 24 aa, Entamoeba histolytica
FVVILFLLVFALIAAGYVFIDGIN

SEQ ID NO: 2600549 - protein, 19 aa, Entamoeba histolytica
FVWSFASYKPVYLLDFAVA

SEQ ID NO: 2600550 - protein, 21 aa, Entamoeba histolytica
FWLFFFILLCHLVGIYLYGTG

SEQ ID NO: 2600551 - protein, 30 aa, Entamoeba histolytica
FWSIFEGIVFLLWIISLLLLIIIKKVRKNV

SEQ ID NO: 2600552 - protein, 25 aa, Entamoeba histolytica
FYFDSFKAILPFKFIIDQSTVKTQI

SEQ ID NO: 2600553 - protein, 20 aa, Entamoeba histolytica
FYIMLNWFMTLLEYLSIMSG

SEQ ID NO: 2600554 - protein, 24 aa, Entamoeba histolytica
FYISMILSILLFFGWYVFYGFVGG

SEQ ID NO: 2600555 - protein, 17 aa, Entamoeba histolytica
FYKIFGFPMGIGALLMR

SEQ ID NO: 2600556 - protein, 18 aa, Entamoeba histolytica
FYLIFKIFLIVIALLRAR

SEQ ID NO: 2600557 - protein, 18 aa, Entamoeba histolytica
FYRIIMFSILLITITIQL

SEQ ID NO: 2600558 - protein, 20 aa, Entamoeba histolytica
FYYQLFQFLVLIASVIQTFI

SEQ ID NO: 2600559 - protein, 18 aa, Entamoeba histolytica
GFIIILIVILCMAIILIN

SEQ ID NO: 2600560 - protein, 18 aa, Entamoeba histolytica
GFLFLRFINPAIVSPHRF

SEQ ID NO: 2600561 - protein, 29 aa, Entamoeba histolytica
GGIILVVIFIIILLVFIRTVMTKITKYSQ

SEQ ID NO: 2600562 - protein, 26 aa, Entamoeba histolytica
GGWVYFTLVMLFFFISSFLLIGSNFW

SEQ ID NO: 2600563 - protein, 26 aa, Entamoeba histolytica
GIAIIIILTIIIISYILFALHKKKKL

SEQ ID NO: 2600564 - protein, 26 aa, Entamoeba histolytica
GIILIIVIIIIIIGIVWWRRKKTAKD

SEQ ID NO: 2600565 - protein, 18 aa, Entamoeba histolytica
GIITFIWIIEQFIEKTII

SEQ ID NO: 2600566 - protein, 24 aa, Entamoeba histolytica
GIKRIYIPTFLIYPIQRLPRYLLL

SEQ ID NO: 2600567 - protein, 19 aa, Entamoeba histolytica
GIMISLLVVAVCGLLLIFG

SEQ ID NO: 2600568 - protein, 44 aa, Entamoeba histolytica
GITNFLFWGIGSIIYIIFYILLLLLILFIYYHLIKQIKQEINDE

SEQ ID NO: 2600569 - protein, 29 aa, Entamoeba histolytica
GKTPRVDLYLMIFLKFLATVIPTMEYDYG

SEQ ID NO: 2600570 - protein, 24 aa, Entamoeba histolytica
GLFNTKLIFFIVKVLLRCDSLDKE

SEQ ID NO: 2600571 - protein, 17 aa, Entamoeba histolytica
GLFYIGCYCTTLKETVV

SEQ ID NO: 2600572 - protein, 17 aa, Entamoeba histolytica
GLIIVITFLILITVWGS

SEQ ID NO: 2600573 - protein, 21 aa, Entamoeba histolytica
GLPIFLWVFICGALLPYLFFE

SEQ ID NO: 2600574 - protein, 22 aa, Entamoeba histolytica
GLVIFILPKLPGVWFYCWGITC

SEQ ID NO: 2600575 - protein, 27 aa, Entamoeba histolytica
GMACLMCCIFTLLGFCCCGLIFCCMRN

SEQ ID NO: 2600576 - protein, 25 aa, Entamoeba histolytica
GNFPFIWGFFMLCSLSYWVSFQMAP

SEQ ID NO: 2600577 - protein, 25 aa, Entamoeba histolytica
GNIGWYWLIFIFSFISGFIPSIREL

SEQ ID NO: 2600578 - protein, 27 aa, Entamoeba histolytica
GNNFLVDSFYFILPFDIVILNDKSVKF

SEQ ID NO: 2600579 - protein, 24 aa, Entamoeba histolytica
GPFYSMLLMFCIGIFWIIVGTLIL

SEQ ID NO: 2600580 - protein, 23 aa, Entamoeba histolytica
GPSKNIYLIPFLKSFLNFEPTQP

SEQ ID NO: 2600581 - protein, 17 aa, Entamoeba histolytica
GQWDCLLYSPYLCLIIN

SEQ ID NO: 2600582 - protein, 39 aa, Entamoeba histolytica
GQWLYKNLFFTVGIIIFLIFLVLLFGFIITKRIIYRRAK

SEQ ID NO: 2600583 - protein, 34 aa, Entamoeba histolytica
GSIVYVLYYIFTLILFLLLYIRLTRKIKQEIDDE

SEQ ID NO: 2600584 - protein, 24 aa, Entamoeba histolytica
GTKIGWIIFGVVLFLIFITIFAFI

SEQ ID NO: 2600585 - protein, 22 aa, Entamoeba histolytica
GTLLLPIFFILILQSFALAFFW

SEQ ID NO: 2600586 - protein, 24 aa, Entamoeba histolytica
GTLSIIVFLLFNLIRFTPFDINQK

SEQ ID NO: 2600587 - protein, 25 aa, Entamoeba histolytica
GVSGLLVVLFIIYSLIKASHISNLK

SEQ ID NO: 2600588 - protein, 30 aa, Entamoeba histolytica
GYIFVFVLFFILLLPFLVIPVVIWMNKMGC

SEQ ID NO: 2600589 - protein, 17 aa, Entamoeba histolytica
GYWQIFGYVVVAILIVL

SEQ ID NO: 2600590 - protein, 17 aa, Entamoeba histolytica
HDFLKHICIVWNKCYYS

SEQ ID NO: 2600591 - protein, 24 aa, Entamoeba histolytica
HEDWQLWMWFGIVTVVIMAIIVLM

SEQ ID NO: 2600592 - protein, 23 aa, Entamoeba histolytica
HETLILLNILFKNPIIFSSISIP

SEQ ID NO: 2600593 - protein, 25 aa, Entamoeba histolytica
HFLTLSLFTFFFIISLSLTVIMGPA

SEQ ID NO: 2600594 - protein, 17 aa, Entamoeba histolytica
HPRFIMIACFCFGKKLE

SEQ ID NO: 2600595 - protein, 29 aa, Entamoeba histolytica
HPSVYAFMSFIFLAVRFLTLGWDKIDDNY

SEQ ID NO: 2600596 - protein, 26 aa, Entamoeba histolytica
HQNLFFIRFLFILLLTFHCSFTVFLG

SEQ ID NO: 2600597 - protein, 18 aa, Entamoeba histolytica
HRVSVFNWFWNRQSYIPN

SEQ ID NO: 2600598 - protein, 24 aa, Entamoeba histolytica
HSKKKWLMIIFHTPNNPKYVFYFD

SEQ ID NO: 2600599 - protein, 28 aa, Entamoeba histolytica
HTHMYSNKHKIMYNKYNIHLKSEQHQVN

SEQ ID NO: 2600600 - protein, 19 aa, Entamoeba histolytica
HTKPFLFGVKHYKDFYAIQ

SEQ ID NO: 2600601 - protein, 18 aa, Entamoeba histolytica
HWKFTFTVSLFILSFILT

SEQ ID NO: 2600602 - protein, 17 aa, Entamoeba histolytica
HYYLFSLIGWIANQLMI

SEQ ID NO: 2600603 - protein, 18 aa, Entamoeba histolytica
IAIGYILYVFIRQSNNTQ

SEQ ID NO: 2600604 - protein, 18 aa, Entamoeba histolytica
IAIIMKFAIIPQLQRKLK

SEQ ID NO: 2600605 - protein, 17 aa, Entamoeba histolytica
IAVIVIVGVIIVIALIL

SEQ ID NO: 2600606 - protein, 25 aa, Entamoeba histolytica
ICILFIILIFVVIIAYYYFKKSMKI

SEQ ID NO: 2600607 - protein, 19 aa, Entamoeba histolytica
ICNLFIFVFIIFTVKMYYL

SEQ ID NO: 2600608 - protein, 24 aa, Entamoeba histolytica
ICRFKLYPWYLKPKTIKYGDVEHI

SEQ ID NO: 2600609 - protein, 18 aa, Entamoeba histolytica
IDILIFTLLVSIGLPGGF

SEQ ID NO: 2600610 - protein, 22 aa, Entamoeba histolytica
IDSNIHKRMYKKYKKHIKCEVS

SEQ ID NO: 2600611 - protein, 19 aa, Entamoeba histolytica
IEHKIACLLPLFGPVLLLL

SEQ ID NO: 2600612 - protein, 18 aa, Entamoeba histolytica
IEKTLYWYKIKEKEGAEE

SEQ ID NO: 2600613 - protein, 26 aa, Entamoeba histolytica
IEKWAYPLCSQVYYDPIKTLVIEFDN

SEQ ID NO: 2600614 - protein, 22 aa, Entamoeba histolytica
IEKYLPLVLFIAGFFIPLCWFI

SEQ ID NO: 2600615 - protein, 33 aa, Entamoeba histolytica
IENAENYFYYTNTKRMFNLYNIHLKSETVHKES

SEQ ID NO: 2600616 - protein, 28 aa, Entamoeba histolytica
IEQELKDVGLYDLFSKKDSNSELDENSN

SEQ ID NO: 2600617 - protein, 27 aa, Entamoeba histolytica
IEQELKDVGLYDLFSKKESIHENDIEN

SEQ ID NO: 2600618 - protein, 32 aa, Entamoeba histolytica
IESNQNKMMDILYKIHLKSEGIKEERTDEVKV

SEQ ID NO: 2600619 - protein, 23 aa, Entamoeba histolytica
IETPQLLTYLYFTSLKDFDNTVW

SEQ ID NO: 2600620 - protein, 19 aa, Entamoeba histolytica
IEWALKVISIPIPTYLTPI

SEQ ID NO: 2600621 - protein, 21 aa, Entamoeba histolytica
IFALLAWWQYKNLKSFFRHIK

SEQ ID NO: 2600622 - protein, 19 aa, Entamoeba histolytica
IFFTFIILYNNLVPISLYV

SEQ ID NO: 2600623 - protein, 21 aa, Entamoeba histolytica
IFFYMYFICFFIVPPILHKWG

SEQ ID NO: 2600624 - protein, 21 aa, Entamoeba histolytica
IFICSIVIIFLLIRFTKGHKI

SEQ ID NO: 2600625 - protein, 24 aa, Entamoeba histolytica
IFINNIICYLYYSYSFIKPDITPV

SEQ ID NO: 2600626 - protein, 31 aa, Entamoeba histolytica
IFIPSAFFLSKLFWVILGYFIIALAILTGVL

SEQ ID NO: 2600627 - protein, 19 aa, Entamoeba histolytica
IFIVIIIGIILYRKIKRID

SEQ ID NO: 2600628 - protein, 17 aa, Entamoeba histolytica
IFLIFVSLFLCLLRGSE

SEQ ID NO: 2600629 - protein, 19 aa, Entamoeba histolytica
IFLILFFLFTIILGIFGPS

SEQ ID NO: 2600630 - protein, 18 aa, Entamoeba histolytica
IFLIYLYQRWIYPVDKNR

SEQ ID NO: 2600631 - protein, 18 aa, Entamoeba histolytica
IGFSRILFYLFSDYFKEL

SEQ ID NO: 2600632 - protein, 17 aa, Entamoeba histolytica
IGGFLFLRFINPAIVSP

SEQ ID NO: 2600633 - protein, 31 aa, Entamoeba histolytica
IGGIFLIIVFIVVIIIIILLLRRRKIKQEKE

SEQ ID NO: 2600634 - protein, 25 aa, Entamoeba histolytica
IGSVWIIFILMIGIFLIVNAFRKRK

SEQ ID NO: 2600635 - protein, 18 aa, Entamoeba histolytica
IHKLYSPLFFYTQTLFSK

SEQ ID NO: 2600636 - protein, 18 aa, Entamoeba histolytica
IHSFLFYIYIQCTNAFVE

SEQ ID NO: 2600637 - protein, 25 aa, Entamoeba histolytica
IIANTFPIIGFWKHVCVVWTKCMCF

SEQ ID NO: 2600638 - protein, 26 aa, Entamoeba histolytica
IIASFSLFFFIGIFIIHLTLVPTKGS

SEQ ID NO: 2600639 - protein, 19 aa, Entamoeba histolytica
IICFLIILVVIFILLRKKI

SEQ ID NO: 2600640 - protein, 30 aa, Entamoeba histolytica
IIEQYPLKWLDWLLILIAVLVHFVICESVK

SEQ ID NO: 2600641 - protein, 17 aa, Entamoeba histolytica
IIFFSYIVFADQYTMVG

SEQ ID NO: 2600642 - protein, 22 aa, Entamoeba histolytica
IIFIIMIICYLLRKIYFPTEQQ

SEQ ID NO: 2600643 - protein, 20 aa, Entamoeba histolytica
IIFLIIMTFLTWFFVSRCWK

SEQ ID NO: 2600644 - protein, 19 aa, Entamoeba histolytica
IIFLLIRFTKGHKIDLNVF

SEQ ID NO: 2600645 - protein, 19 aa, Entamoeba histolytica
IIFLPITFLTLAGGFIFGY

SEQ ID NO: 2600646 - protein, 29 aa, Entamoeba histolytica
IIFSVYLFTLLLLWLYFNTQRISIVFPLI

SEQ ID NO: 2600647 - protein, 18 aa, Entamoeba histolytica
IIFVIIVIIVIIFSCTRC

SEQ ID NO: 2600648 - protein, 26 aa, Entamoeba histolytica
IIGHILFFLLLVYYKFEPNQLVISEQ

SEQ ID NO: 2600649 - protein, 22 aa, Entamoeba histolytica
IIGLFFFIAFFIFSLNYVPKTM

SEQ ID NO: 2600650 - protein, 18 aa, Entamoeba histolytica
IIGVWIWYLRRPYPVYLV

SEQ ID NO: 2600651 - protein, 24 aa, Entamoeba histolytica
IIIAVICIFILILIIALISVLYKK

SEQ ID NO: 2600652 - protein, 18 aa, Entamoeba histolytica
IIIIILLFIYISNGSLCG

SEQ ID NO: 2600653 - protein, 17 aa, Entamoeba histolytica
IIIIILYIILINICLKR

SEQ ID NO: 2600654 - protein, 19 aa, Entamoeba histolytica
IIIIMVIIGIIWLRRRKSV

SEQ ID NO: 2600655 - protein, 20 aa, Entamoeba histolytica
IIILIMLISIFYFVFRTKKR

SEQ ID NO: 2600656 - protein, 22 aa, Entamoeba histolytica
IIILSALLVYYFINLHFIHYFN

SEQ ID NO: 2600657 - protein, 18 aa, Entamoeba histolytica
IIIYILLMLSWIAYYPAS

SEQ ID NO: 2600658 - protein, 17 aa, Entamoeba histolytica
IIKNWIYIKSILTIICF

SEQ ID NO: 2600659 - protein, 22 aa, Entamoeba histolytica
IILFLFFIYSINGKIHCNNGIK

SEQ ID NO: 2600660 - protein, 17 aa, Entamoeba histolytica
IILIMWMNLFSYDINPI

SEQ ID NO: 2600661 - protein, 18 aa, Entamoeba histolytica
IILLFIMFIIIVILLSHY

SEQ ID NO: 2600662 - protein, 17 aa, Entamoeba histolytica
IILLFIYISNGSLCGVG

SEQ ID NO: 2600663 - protein, 24 aa, Entamoeba histolytica
IILLLAIIIILCSILILVFARNSY

SEQ ID NO: 2600664 - protein, 19 aa, Entamoeba histolytica
IIPLLPLLPEKLFDNSIPR

SEQ ID NO: 2600665 - protein, 20 aa, Entamoeba histolytica
IIQALMCFVPFYGQLKYINE

SEQ ID NO: 2600666 - protein, 17 aa, Entamoeba histolytica
IIRWVFILNFFISIIYA

SEQ ID NO: 2600667 - protein, 38 aa, Entamoeba histolytica
IISLIVIGLLFIVIIICFIIFLIWRRRRKIIKEREKEI

SEQ ID NO: 2600668 - protein, 27 aa, Entamoeba histolytica
IISLLLILYLFKILLAIALRYLAFTEV

SEQ ID NO: 2600669 - protein, 27 aa, Entamoeba histolytica
IIVILLLVLIGIIWWRRSRSVKAETAA

SEQ ID NO: 2600670 - protein, 17 aa, Entamoeba histolytica
IIVYFFFCYKTIPHFHS

SEQ ID NO: 2600671 - protein, 34 aa, Entamoeba histolytica
IKERRTLWILWAFWWFVYALVCVMAFGALKYFGS

SEQ ID NO: 2600672 - protein, 25 aa, Entamoeba histolytica
IKGTFPFIWIFLVFASICYWASNQF

SEQ ID NO: 2600673 - protein, 36 aa, Entamoeba histolytica
IKIQILLIFHMIKLMLVLMIFLIIIITLMEHQVCLC

SEQ ID NO: 2600674 - protein, 20 aa, Entamoeba histolytica
IKLIFFKNAAFFLHLLWFAC

SEQ ID NO: 2600675 - protein, 19 aa, Entamoeba histolytica
ILFDMLIDILFEYGFIIFT

SEQ ID NO: 2600676 - protein, 19 aa, Entamoeba histolytica
ILGLILIAIIMKFAIIPQL

SEQ ID NO: 2600677 - protein, 18 aa, Entamoeba histolytica
ILIIIILSALLVYYFINL

SEQ ID NO: 2600678 - protein, 24 aa, Entamoeba histolytica
ILIYLFTLLYIFIYCYTLISNILI

SEQ ID NO: 2600679 - protein, 17 aa, Entamoeba histolytica
ILLITFINEIIASDIVE

SEQ ID NO: 2600680 - protein, 25 aa, Entamoeba histolytica
ILLSILCFIIYIPTYFVYGQSEPEV

SEQ ID NO: 2600681 - protein, 27 aa, Entamoeba histolytica
ILLVLIIFIIFILIIVILVIVIPKRKK

SEQ ID NO: 2600682 - protein, 23 aa, Entamoeba histolytica
ILQWILRSILFILYLSALLLYFF

SEQ ID NO: 2600683 - protein, 21 aa, Entamoeba histolytica
ILRSLALVWLLFQECNYVIII

SEQ ID NO: 2600684 - protein, 17 aa, Entamoeba histolytica
ILTLFILIGFIIGEVYN

SEQ ID NO: 2600685 - protein, 17 aa, Entamoeba histolytica
IMHKLLFGSSLVFKTRK

SEQ ID NO: 2600686 - protein, 19 aa, Entamoeba histolytica
IMIQILLYCWLCYNSKNEK

SEQ ID NO: 2600687 - protein, 19 aa, Entamoeba histolytica
IMYSIIFFVLAAISIVLVP

SEQ ID NO: 2600688 - protein, 25 aa, Entamoeba histolytica
INIKWWIIVIIIIMILIGMIIIIII

SEQ ID NO: 2600689 - protein, 20 aa, Entamoeba histolytica
INILFIVIYWIEVVASLILS

SEQ ID NO: 2600690 - protein, 19 aa, Entamoeba histolytica
INKPYFFVIIGEEQYPLFF

SEQ ID NO: 2600691 - protein, 27 aa, Entamoeba histolytica
INPIVILLCCFLIGTIILFFIKSRRKQ

SEQ ID NO: 2600692 - protein, 20 aa, Entamoeba histolytica
INSLIIYYLKMNLDFDFFLS

SEQ ID NO: 2600693 - protein, 25 aa, Entamoeba histolytica
IPGIIFLWKVIIKPLLFPTNTKKYK

SEQ ID NO: 2600694 - protein, 20 aa, Entamoeba histolytica
IPHLFPYLSMVFNYLFEFIP

SEQ ID NO: 2600695 - protein, 19 aa, Entamoeba histolytica
IPKKPLPFGLLVLRFDKPD

SEQ ID NO: 2600696 - protein, 23 aa, Entamoeba histolytica
IPLRTIVWILFYAPLKFFYLAIQ

SEQ ID NO: 2600697 - protein, 25 aa, Entamoeba histolytica
IPLVILWIILIVIEIGIFAVSMTSY

SEQ ID NO: 2600698 - protein, 20 aa, Entamoeba histolytica
IPPIFVLFILVPLSLSSMTL

SEQ ID NO: 2600699 - protein, 17 aa, Entamoeba histolytica
IPWISLVRIFYLSLMSL

SEQ ID NO: 2600700 - protein, 18 aa, Entamoeba histolytica
IQKYILVSLKYQTTIPFD

SEQ ID NO: 2600701 - protein, 17 aa, Entamoeba histolytica
IQVLPLYAALPPEQQLL

SEQ ID NO: 2600702 - protein, 19 aa, Entamoeba histolytica
IRNGLLYLLFFLQQKETPL

SEQ ID NO: 2600703 - protein, 26 aa, Entamoeba histolytica
IRNYIAYFYYFLPFNIMIDKEKHMYL

SEQ ID NO: 2600704 - protein, 18 aa, Entamoeba histolytica
IRTAFFHIILYRSLFIKS

SEQ ID NO: 2600705 - protein, 29 aa, Entamoeba histolytica
IRWLGAFRFILWTLWYCVTLMTTKAKIKT

SEQ ID NO: 2600706 - protein, 22 aa, Entamoeba histolytica
ISDMRFFRWKLYTKINGLINKL

SEQ ID NO: 2600707 - protein, 18 aa, Entamoeba histolytica
ISFFLFYILIIFDSLRKP

SEQ ID NO: 2600708 - protein, 17 aa, Entamoeba histolytica
ISFLWIFNCVKAQDETG

SEQ ID NO: 2600709 - protein, 30 aa, Entamoeba histolytica; identical to SEQ ID NO: 2403941

SEQ ID NO: 2600710 - protein, 34 aa, Entamoeba histolytica
ISGWGVWGILLYAVYFVIIIVALIIIIIIYKKKN

SEQ ID NO: 2600711 - protein, 24 aa, Entamoeba histolytica
ISIAIIFLVYLMLQIFLFKRHNKF

SEQ ID NO: 2600712 - protein, 20 aa, Entamoeba histolytica
ISIILILLLIMYNASIRAKI

SEQ ID NO: 2600713 - protein, 27 aa, Entamoeba histolytica
ISILFLEHPFVSIILLTVTLILIGLIM

SEQ ID NO: 2600714 - protein, 28 aa, Entamoeba histolytica
ISILFLEHPFVSIILLTVTLILIGLIMM

SEQ ID NO: 2600715 - protein, 34 aa, Entamoeba histolytica; identical to SEQ ID NO: 2403950

SEQ ID NO: 2600716 - protein, 23 aa, Entamoeba histolytica
ISIYILFGIILIVSLFSIFYYFY

SEQ ID NO: 2600717 - protein, 24 aa, Entamoeba histolytica
ISKIIYDMFLFLKLFKTFNIKRGN

SEQ ID NO: 2600718 - protein, 26 aa, Entamoeba histolytica
ISLILVIGLPLFGIAIIIILTIIIIS

SEQ ID NO: 2600719 - protein, 26 aa, Entamoeba histolytica
ISLTLFFLWKVILMAIFFILQVSYGY

SEQ ID NO: 2600720 - protein, 24 aa, Entamoeba histolytica
ISMYYPLLTFLVYAISLTDSPFET

SEQ ID NO: 2600721 - protein, 22 aa, Entamoeba histolytica
ISNNIIIMIQIMSKIFPSHDFL

SEQ ID NO: 2600722 - protein, 26 aa, Entamoeba histolytica
ITANYDLIILPLYSALPLYKQKRVFF

SEQ ID NO: 2600723 - protein, 21 aa, Entamoeba histolytica
ITLFFLIFYWAGVFFVVCFWI

SEQ ID NO: 2600724 - protein, 24 aa, Entamoeba histolytica
ITMIGIIVFIINYTILRVLVTLDN

SEQ ID NO: 2600725 - protein, 19 aa, Entamoeba histolytica
ITSAFYWGALLLPLGLALF

SEQ ID NO: 2600726 - protein, 22 aa, Entamoeba histolytica
ITSILHLWLMVSIPKFDITKSF

SEQ ID NO: 2600727 - protein, 30 aa, Entamoeba histolytica
ITYSLIKRLMLIGILFFPFHLVVCYLFRNS

SEQ ID NO: 2600728 - protein, 20 aa, Entamoeba histolytica
IVGIIFLLILFSGICLYLVI

SEQ ID NO: 2600729 - protein, 18 aa, Entamoeba histolytica
IVIISVIAFFWFTRKPRS

SEQ ID NO: 2600730 - protein, 25 aa, Entamoeba histolytica
IVILIIAGIVSLSWYFIKKTNQNKR

SEQ ID NO: 2600731 - protein, 23 aa, Entamoeba histolytica
IVILLLILFVIITLLIVYTVYYI

SEQ ID NO: 2600732 - protein, 24 aa, Entamoeba histolytica
IVIMLIIVTIISLILFIRIERNIR

SEQ ID NO: 2600733 - protein, 25 aa, Entamoeba histolytica
IVIPFFVPYLFFTLGVLVVVTIVLW

SEQ ID NO: 2600734 - protein, 25 aa, Entamoeba histolytica
IVIVFSLLIIIFIISYVISLKREKL

SEQ ID NO: 2600735 - protein, 17 aa, Entamoeba histolytica
IVKNIKFILIGGLMIML

SEQ ID NO: 2600736 - protein, 18 aa, Entamoeba histolytica
IVPFWKIWFEALQDKTLI

SEQ ID NO: 2600737 - protein, 20 aa, Entamoeba histolytica
IVPIFLFISFVLLVVGMFLI

SEQ ID NO: 2600738 - protein, 17 aa, Entamoeba histolytica
IVTIISLILFIRIERNI

SEQ ID NO: 2600739 - protein, 25 aa, Entamoeba histolytica
IVWITLFGIILYLFYPTLPPEIYPT

SEQ ID NO: 2600740 - protein, 26 aa, Entamoeba histolytica
IVYELMLIILLIIFLIQYHILNDKII

SEQ ID NO: 2600741 - protein, 35 aa, Entamoeba histolytica
IVYSKNQWILYVLSFLIFAIVLIMFCLMLAFHISN

SEQ ID NO: 2600742 - protein, 32 aa, Entamoeba histolytica
IVYVLYYIFTFILFLLLYIRLTRKIKQEIDDE

SEQ ID NO: 2600743 - protein, 18 aa, Entamoeba histolytica
IWRIIFIISPIALILLIL

SEQ ID NO: 2600744 - protein, 19 aa, Entamoeba histolytica
IWVYKFFVQLIQKLNTKNK

SEQ ID NO: 2600745 - protein, 17 aa, Entamoeba histolytica
IYCINLPGLSKSVGLNH

SEQ ID NO: 2600746 - protein, 19 aa, Entamoeba histolytica
IYFIIFVIILQLSAIYLYG

SEQ ID NO: 2600747 - protein, 23 aa, Entamoeba histolytica
IYGALFPIFAYFLAEAICMLVTV

SEQ ID NO: 2600748 - protein, 47 aa, Entamoeba histolytica
IYHLNLFIIIGIPIIIIFLFIIIFMFSCFLIILIIRKQQQKKIKEAT

SEQ ID NO: 2600749 - protein, 33 aa, Entamoeba histolytica
IYLSSIIIFYIFFWTALLFIHLFIYTKLNKIIT

SEQ ID NO: 2600750 - protein, 18 aa, Entamoeba histolytica
IYPIQRLPRYLLLLETLS

SEQ ID NO: 2600751 - protein, 19 aa, Entamoeba histolytica
IYYLKMNLDFDFFLSVLEF

SEQ ID NO: 2600752 - protein, 22 aa, Entamoeba histolytica
KAKWWAIIIKYMILLFPIVNLT

SEQ ID NO: 2600753 - protein, 25 aa, Entamoeba histolytica
KALNNFFFWGIGSIVYILYFIFVMI

SEQ ID NO: 2600754 - protein, 23 aa, Entamoeba histolytica
KANLFCLFIVMWTFTFSLTCFAY

SEQ ID NO: 2600755 - protein, 19 aa, Entamoeba histolytica
KARLLWFRNYFIGVLISII

SEQ ID NO: 2600756 - protein, 29 aa, Entamoeba histolytica
KASKKLWIILCVAGGIVIVLGAIVTLVCI

SEQ ID NO: 2600757 - protein, 18 aa, Entamoeba histolytica
KCIEPLIVLLTFSSSLDL

SEQ ID NO: 2600758 - protein, 24 aa, Entamoeba histolytica
KCPTLLIPLLYKHIERYLSLRLLS

SEQ ID NO: 2600759 - protein, 28 aa, Entamoeba histolytica
KEINTFTIWIPLEESFLGTKKRIQLNHG

SEQ ID NO: 2600760 - protein, 20 aa, Entamoeba histolytica
KELFIPAYYQFFNEMLGLNI

SEQ ID NO: 2600761 - protein, 25 aa, Entamoeba histolytica
KELISTIFLPWFNTLRYLKQSFKPE

SEQ ID NO: 2600762 - protein, 25 aa, Entamoeba histolytica
KERLKYVWIIFALIIKSMVGYYEDK

SEQ ID NO: 2600763 - protein, 33 aa, Entamoeba histolytica
KERRTLWYVWALWWFIYAVVCVATFTVLKLFIK

SEQ ID NO: 2600764 - protein, 25 aa, Entamoeba histolytica
KEVVWWMIIVIIIIIIIIITIVMII

SEQ ID NO: 2600765 - protein, 24 aa, Entamoeba histolytica
KEVVWWMIMIIVIIIIIIIIITIV

SEQ ID NO: 2600766 - protein, 25 aa, Entamoeba histolytica
KEVVWWMIMIIVIIIIIIIIITIVM

SEQ ID NO: 2600767 - protein, 26 aa, Entamoeba histolytica
KFGYNPWFCFFIPGLVVIVVVYFFTH

SEQ ID NO: 2600768 - protein, 22 aa, Entamoeba histolytica
KGILMTRISLLLPLLLEFIKQN

SEQ ID NO: 2600769 - protein, 22 aa, Entamoeba histolytica
KGIYYIFVFTPYNKGFSFDTTV

SEQ ID NO: 2600770 - protein, 23 aa, Entamoeba histolytica
KGTILFFVIFTILLHYLYFLDWY

SEQ ID NO: 2600771 - protein, 21 aa, Entamoeba histolytica
KHFYLSLPALLLTYIDFIIAA

SEQ ID NO: 2600772 - protein, 20 aa, Entamoeba histolytica
KHICIVWNKCYYYISDRQLT

SEQ ID NO: 2600773 - protein, 24 aa, Entamoeba histolytica
KHLNFFLKIIIKSLLFWMQKEDLF

SEQ ID NO: 2600774 - protein, 20 aa, Entamoeba histolytica
KHQRKIISLLWNKIPPLKSN

SEQ ID NO: 2600775 - protein, 22 aa, Entamoeba histolytica
KIDKMLFFNFSFGPAIVTLFAS

SEQ ID NO: 2600776 - protein, 26 aa, Entamoeba histolytica
KIEQVPNIILLFYKSLEEWYIHNDIP

SEQ ID NO: 2600777 - protein, 25 aa, Entamoeba histolytica
KINCYLFILFILFTKSRLVNESEFY

SEQ ID NO: 2600778 - protein, 22 aa, Entamoeba histolytica
KIPYQIFFRDVVNQRLPIFSNL

SEQ ID NO: 2600779 - protein, 24 aa, Entamoeba histolytica
KIQHYVVWFILFSLFLDCAISNMV

SEQ ID NO: 2600780 - protein, 20 aa, Entamoeba histolytica
KISIIFILAYIAISFLLLIV

SEQ ID NO: 2600781 - protein, 20 aa, Entamoeba histolytica
KITWRLQIMLWYAGLRGAIA

SEQ ID NO: 2600782 - protein, 33 aa, Entamoeba histolytica
KKKLIIKIIIFTIFIMIILVLILCIIGIIVGVY

SEQ ID NO: 2600783 - protein, 25 aa, Entamoeba histolytica
KKKSYWYIYMIIGICILFIILIFVV

SEQ ID NO: 2600784 - protein, 24 aa, Entamoeba histolytica
KKRLIILLILVIVVTFLIFIIWYK

SEQ ID NO: 2600785 - protein, 30 aa, Entamoeba histolytica
KKSMKWIYSIIVIPVIIAIGYILYVFIRQS

SEQ ID NO: 2600786 - protein, 20 aa, Entamoeba histolytica
KKYQYYLYKTSTNQIWVILG

SEQ ID NO: 2600787 - protein, 18 aa, Entamoeba histolytica
KLANLGKWLVLLAGILCF

SEQ ID NO: 2600788 - protein, 25 aa, Entamoeba histolytica
KLDILFICFLLVLLSFLAGLCLLSQ

SEQ ID NO: 2600789 - protein, 26 aa, Entamoeba histolytica
KLELTYFYYFLPFVINIERNKKMYLI

SEQ ID NO: 2600790 - protein, 26 aa, Entamoeba histolytica
KLIITTWWRWLIFSINGIMVVIMNIK

SEQ ID NO: 2600791 - protein, 17 aa, Entamoeba histolytica
KLIPKFITLLDRGKNCP

SEQ ID NO: 2600792 - protein, 17 aa, Entamoeba histolytica
KLKNWLLLLFDASYYKI

SEQ ID NO: 2600793 - protein, 26 aa, Entamoeba histolytica
KLSYNDWYFVFYKIFFRVLEPIGYYH

SEQ ID NO: 2600794 - protein, 19 aa, Entamoeba histolytica
KLYRKLFDILASPLNFILP

SEQ ID NO: 2600795 - protein, 18 aa, Entamoeba histolytica
KMFRLYTIITPLVDLLVT

SEQ ID NO: 2600796 - protein, 32 aa, Entamoeba histolytica; identical to SEQ ID NO: 2404037

SEQ ID NO: 2600797 - protein, 18 aa, Entamoeba histolytica
KNAILVTPYLPFTTDYNI

SEQ ID NO: 2600798 - protein, 23 aa, Entamoeba histolytica
KNASFFLILLWYSFISNFTCQVV

SEQ ID NO: 2600799 - protein, 24 aa, Entamoeba histolytica
KNHKYFIQFLWYTLFILILGFLWH

SEQ ID NO: 2600800 - protein, 22 aa, Entamoeba histolytica
KNIQIRLFMKIKILIDAAKGIS

SEQ ID NO: 2600801 - protein, 26 aa, Entamoeba histolytica
KNSELTLFYYFLPFSINIENDKKMYL

SEQ ID NO: 2600802 - protein, 26 aa, Entamoeba histolytica
KNSELTLFYYFLPFTINIENDKKMYL

SEQ ID NO: 2600803 - protein, 22 aa, Entamoeba histolytica
KPNALFFDFYYSLPFKVAISNT

SEQ ID NO: 2600804 - protein, 21 aa, Entamoeba histolytica
KQFHWLYLHILFKMVHHSLLS

SEQ ID NO: 2600805 - protein, 22 aa, Entamoeba histolytica
KQIIINYMYWKNFIQAHYPEVT

SEQ ID NO: 2600806 - protein, 25 aa, Entamoeba histolytica
KQLKKFIVILLSINIVLIALVLKLL

SEQ ID NO: 2600807 - protein, 25 aa, Entamoeba histolytica
KQPVVWFIVLICILGSIIVILIIAG

SEQ ID NO: 2600808 - protein, 25 aa, Entamoeba histolytica
KQQTKFVFLLLFYKVLLCSLLSYHL

SEQ ID NO: 2600809 - protein, 21 aa, Entamoeba histolytica
KQVLEYFWSLKSHLFVISPTT

SEQ ID NO: 2600810 - protein, 19 aa, Entamoeba histolytica
KRFNGLRRAWLLSYSFAIV

SEQ ID NO: 2600811 - protein, 23 aa, Entamoeba histolytica
KRLWELFFVFLVGFFRCSFFTLT

SEQ ID NO: 2600812 - protein, 24 aa, Entamoeba histolytica
KRVLKYLVYWLLNGTVCIANFFAT

SEQ ID NO: 2600813 - protein, 22 aa, Entamoeba histolytica
KSFVSFPPLFWVVRDYALDERT

SEQ ID NO: 2600814 - protein, 18 aa, Entamoeba histolytica
KSGILYYINVIALNLILG

SEQ ID NO: 2600815 - protein, 24 aa, Entamoeba histolytica
KSLTNFFFWGIGSIVYVLYYIFTF

SEQ ID NO: 2600816 - protein, 24 aa, Entamoeba histolytica
KSLTNFFFWGIGSIVYVLYYIFTL

SEQ ID NO: 2600817 - protein, 25 aa, Entamoeba histolytica
KSSKDFLILPYNLKLRMLYDTARGM

SEQ ID NO: 2600818 - protein, 26 aa, Entamoeba histolytica
KSSKKLKIILLVSVIIVLALILIIGI

SEQ ID NO: 2600819 - protein, 39 aa, Entamoeba histolytica
KSSPVWWVIVLVIIGGIIFFIIFIVLIIFIVRKTIKRIS

SEQ ID NO: 2600820 - protein, 23 aa, Entamoeba histolytica
KSSPVWWVIVLVVIGGIILVVIF

SEQ ID NO: 2600821 - protein, 30 aa, Entamoeba histolytica
KTNWALIIPLVIVAVIIIVILLLVLIGIIW

SEQ ID NO: 2600822 - protein, 21 aa, Entamoeba histolytica
KTYVPLFPYFKDLKGCFRVVA

SEQ ID NO: 2600823 - protein, 19 aa, Entamoeba histolytica
KVFVLGKRLILEGSSIKLS

SEQ ID NO: 2600824 - protein, 17 aa, Entamoeba histolytica
KVGMTFTYFAPLVFVVC

SEQ ID NO: 2600825 - protein, 21 aa, Entamoeba histolytica
KVNLALILPLCIGACLILIVI

SEQ ID NO: 2600826 - protein, 19 aa, Entamoeba histolytica
KWALWFGLILQCVGIVLCI

SEQ ID NO: 2600827 - protein, 20 aa, Entamoeba histolytica
KWALWFGLILQCVGIVLCII

SEQ ID NO: 2600828 - protein, 17 aa, Entamoeba histolytica
KWIEKTLYWYKIKEKEG

SEQ ID NO: 2600829 - protein, 17 aa, Entamoeba histolytica
KWIFVLSLRLRNGLISM

SEQ ID NO: 2600830 - protein, 17 aa, Entamoeba histolytica
KWKLWIIIGVIAAIIII

SEQ ID NO: 2600831 - protein, 19 aa, Entamoeba histolytica
KWYEKIPALKWYKQFHKPR

SEQ ID NO: 2600832 - protein, 22 aa, Entamoeba histolytica
KYAYNFWICCLHFIGTPLISNN

SEQ ID NO: 2600833 - protein, 29 aa, Entamoeba histolytica
KYCAKKNLWYVWVIIVVVIILIISFIILG

SEQ ID NO: 2600834 - protein, 31 aa, Entamoeba histolytica
KYIILYFVIVLTMSVLYLTWLCVLSNKLDEY

SEQ ID NO: 2600835 - protein, 27 aa, Entamoeba histolytica
LATDKIIMVLIIVCVLVIIGCSVLYIF

SEQ ID NO: 2600836 - protein, 21 aa, Entamoeba histolytica
LAYIYIVILGLFPPLFFGTSM

SEQ ID NO: 2600837 - protein, 17 aa, Entamoeba histolytica
LCFTRFFIVKLLMILLL

SEQ ID NO: 2600838 - protein, 18 aa, Entamoeba histolytica
LCIITYWAFIPIGVCLVF

SEQ ID NO: 2600839 - protein, 20 aa, Entamoeba histolytica
LCLISYFFVMILYPEKNEKV

SEQ ID NO: 2600840 - protein, 17 aa, Entamoeba histolytica
LCRSLIYNPEPYYSKHN

SEQ ID NO: 2600841 - protein, 18 aa, Entamoeba histolytica
LCRTTLMHWTQFKDLPTS

SEQ ID NO: 2600842 - protein, 24 aa, Entamoeba histolytica
LDIILLFLTLLFSVLIIISHWKKP

SEQ ID NO: 2600843 - protein, 24 aa, Entamoeba histolytica
LDMDFTFLLIFYSLKSRKPTNYIK

SEQ ID NO: 2600844 - protein, 24 aa, Entamoeba histolytica
LEWKMFLLCYITMVIYELIALAFP

SEQ ID NO: 2600845 - protein, 18 aa, Entamoeba histolytica
LEYRRLLPILLNYGTGAT

SEQ ID NO: 2600846 - protein, 22 aa, Entamoeba histolytica
LFAFIQIIIFALLAWWQYKNLK

SEQ ID NO: 2600847 - protein, 24 aa, Entamoeba histolytica
LFFFTSLCWIILSLLLMFLDYQYH

SEQ ID NO: 2600848 - protein, 22 aa, Entamoeba histolytica
LFHIGLLYLFIYCSNADEGIVC

SEQ ID NO: 2600849 - protein, 27 aa, Entamoeba histolytica
LFIIILIIIIFIIYKFSHSIQLLLNDD

SEQ ID NO: 2600850 - protein, 20 aa, Entamoeba histolytica
LFIKFIPFINAYLFPLTTDI

SEQ ID NO: 2600851 - protein, 18 aa, Entamoeba histolytica
LFILIFLSLFRYFLTKDV

SEQ ID NO: 2600852 - protein, 17 aa, Entamoeba histolytica
LFINLVSSQFLSIKSHI

SEQ ID NO: 2600853 - protein, 19 aa, Entamoeba histolytica
LFLLFTIFCDAFCLQEAMI

SEQ ID NO: 2600854 - protein, 19 aa, Entamoeba histolytica
LFLLLICFVYGGITEEVYN

SEQ ID NO: 2600855 - protein, 18 aa, Entamoeba histolytica
LFLSLIKLLEGYLANSLV

SEQ ID NO: 2600856 - protein, 20 aa, Entamoeba histolytica
LFSIPMLYQEYIRCLESIMF

SEQ ID NO: 2600857 - protein, 17 aa, Entamoeba histolytica
LFTLIIATPISCNSYQS

SEQ ID NO: 2600858 - protein, 24 aa, Entamoeba histolytica
LFTYLPFLFILFTFILFTTFFIVV

SEQ ID NO: 2600859 - protein, 19 aa, Entamoeba histolytica
LFVIRWFFSFLLDPVNSVT

SEQ ID NO: 2600860 - protein, 39 aa, Entamoeba histolytica
LFWGIGACVYLFIYIVGFIICLLLFFRLTKKIKQEIEDE

SEQ ID NO: 2600861 - protein, 18 aa, Entamoeba histolytica
LFYYPLYFTCTILSIHIV

SEQ ID NO: 2600862 - protein, 24 aa, Entamoeba histolytica
LGVIFYMWIYPLLYKLVSSLLKSR

SEQ ID NO: 2600863 - protein, 22 aa, Entamoeba histolytica
LGWVHAFIFWKYSVLMYVAGQE

SEQ ID NO: 2600864 - protein, 21 aa, Entamoeba histolytica
LIAYFFCFILYFFMNILHHSS

SEQ ID NO: 2600865 - protein, 26 aa, Entamoeba histolytica
LICFITITFFLLFKYSPKVPPPIPIT

SEQ ID NO: 2600866 - protein, 24 aa, Entamoeba histolytica
LIDGLLLFFFYLGILIFTIINNCW

SEQ ID NO: 2600867 - protein, 19 aa, Entamoeba histolytica
LIDILFEYGFIIFTSKMRN

SEQ ID NO: 2600868 - protein, 18 aa, Entamoeba histolytica
LIFCFAGWYYLVHHQRVS

SEQ ID NO: 2600869 - protein, 17 aa, Entamoeba histolytica
LIFFQPYFNIKQQKLLI

SEQ ID NO: 2600870 - protein, 17 aa, Entamoeba histolytica
LIFIIFSVLVVVSVCMV

SEQ ID NO: 2600871 - protein, 19 aa, Entamoeba histolytica
LIHLLLMIEFVFINPTKTQ

SEQ ID NO: 2600872 - protein, 20 aa, Entamoeba histolytica
LIIFFYFAWSYAFTQNFKFI

SEQ ID NO: 2600873 - protein, 17 aa, Entamoeba histolytica
LIIIRYYCLLLKYNYIN

SEQ ID NO: 2600874 - protein, 18 aa, Entamoeba histolytica
LIILYFTLPYMNNVDKTL

SEQ ID NO: 2600875 - protein, 19 aa, Entamoeba histolytica
LILCCCGGLLLLIFIAYIA

SEQ ID NO: 2600876 - protein, 18 aa, Entamoeba histolytica
LILCFVGWYFLTKTQSIS

SEQ ID NO: 2600877 - protein, 27 aa, Entamoeba histolytica
LILIVIILIIIFLLWRRRRAAEKQRET

SEQ ID NO: 2600878 - protein, 19 aa, Entamoeba histolytica
LILLLLLLTYSDTLRWKLL

SEQ ID NO: 2600879 - protein, 25 aa, Entamoeba histolytica
LILTPSFYLLILLPPLLLGAKEMVV

SEQ ID NO: 2600880 - protein, 18 aa, Entamoeba histolytica
LINIFFFICLTNGCQCII

SEQ ID NO: 2600881 - protein, 19 aa, Entamoeba histolytica
LIPLILFSKDFLWRHLKRK

SEQ ID NO: 2600882 - protein, 19 aa, Entamoeba histolytica
LIRAVIKREWWPFLLSFIA

SEQ ID NO: 2600883 - protein, 18 aa, Entamoeba histolytica
LIRYMMIILLFSFSSRFS

SEQ ID NO: 2600884 - protein, 22 aa, Entamoeba histolytica
LISIFLLIFFIILIKLLERNEW

SEQ ID NO: 2600885 - protein, 23 aa, Entamoeba histolytica
LISWIYIIRIILFSLTKLYPQTE

SEQ ID NO: 2600886 - protein, 25 aa, Entamoeba histolytica
LITIIFFIFLIWYFKKYSFKLGVLL

SEQ ID NO: 2600887 - protein, 18 aa, Entamoeba histolytica
LIVIFVVLVLLACVVVGF

SEQ ID NO: 2600888 - protein, 18 aa, Entamoeba histolytica
LIVILCMAIILINSITRY

SEQ ID NO: 2600889 - protein, 20 aa, Entamoeba histolytica
LIVLIVFGTLALLPMIKRKL

SEQ ID NO: 2600890 - protein, 19 aa, Entamoeba histolytica
LIWYCVAIPSIKLIENFPY

SEQ ID NO: 2600891 - protein, 23 aa, Entamoeba histolytica
LKNSWFFYELIVKSLTLEMDSSG

SEQ ID NO: 2600892 - protein, 22 aa, Entamoeba histolytica
LKYSWVIYSLLIKSIIGYLKDY

SEQ ID NO: 2600893 - protein, 20 aa, Entamoeba histolytica
LLALTLIIIGIIYSLNKIGY

SEQ ID NO: 2600894 - protein, 20 aa, Entamoeba histolytica
LLCLFISFLIMKFTKMNFCK

SEQ ID NO: 2600895 - protein, 19 aa, Entamoeba histolytica
LLCLIVSIIFYFIPIIIGY

SEQ ID NO: 2600896 - protein, 25 aa, Entamoeba histolytica
LLFDSFYILRQSWYLSLFLTPLGIK

SEQ ID NO: 2600897 - protein, 20 aa, Entamoeba histolytica
LLFFFVFCAFWIGYIYVIQL

SEQ ID NO: 2600898 - protein, 19 aa, Entamoeba histolytica
LLFLLIVNLLFFLCELITG

SEQ ID NO: 2600899 - protein, 19 aa, Entamoeba histolytica
LLFQFFYLMFLITLGLSAQ

SEQ ID NO: 2600900 - protein, 19 aa, Entamoeba histolytica
LLFQLLFFVFYLIEVIGEL

SEQ ID NO: 2600901 - protein, 20 aa, Entamoeba histolytica
LLFTLQSFVLCFMFVMKNLK

SEQ ID NO: 2600902 - protein, 20 aa, Entamoeba histolytica
LLHHIMLLILWVVPITRKIQ

SEQ ID NO: 2600903 - protein, 20 aa, Entamoeba histolytica
LLIVLIIIIIVIAVLVYFFV

SEQ ID NO: 2600904 - protein, 19 aa, Entamoeba histolytica
LLLFIYLSSATLTDISYDS

SEQ ID NO: 2600905 - protein, 18 aa, Entamoeba histolytica
LLLLVLFFLAIEELINQN

SEQ ID NO: 2600906 - protein, 26 aa, Entamoeba histolytica
LLLNSIVFFYILSPLPLYSYKQIVIS

SEQ ID NO: 2600907 - protein, 24 aa, Entamoeba histolytica
LLPIIILILLILRFKYQKKRTIAF

SEQ ID NO: 2600908 - protein, 18 aa, Entamoeba histolytica
LLSFFSILLCLYYWKTPS

SEQ ID NO: 2600909 - protein, 18 aa, Entamoeba histolytica
LLSIIYIIFVCCVSLLIA

SEQ ID NO: 2600910 - protein, 21 aa, Entamoeba histolytica
LLTKLIYWLAGMSFTPMVALE

SEQ ID NO: 2600911 - protein, 20 aa, Entamoeba histolytica
LLVLIFCIIIILVSFNLSLS

SEQ ID NO: 2600912 - protein, 20 aa, Entamoeba histolytica
LMFLLVYRFILFSVSYISSS

SEQ ID NO: 2600913 - protein, 23 aa, Entamoeba histolytica
LMKYKNFIIIYTTSIFGLVILAA

SEQ ID NO: 2600914 - protein, 25 aa, Entamoeba histolytica
LMSPFVWQHVLIPLLPKSLVTYCAA

SEQ ID NO: 2600915 - protein, 17 aa, Entamoeba histolytica
LMYMQLIGYLLLIGMEL

SEQ ID NO: 2600916 - protein, 17 aa, Entamoeba histolytica
LNDLTLNGLFTITKIPL

SEQ ID NO: 2600917 - protein, 18 aa, Entamoeba histolytica
LNLLFYLMNICCMSARTI

SEQ ID NO: 2600918 - protein, 22 aa, Entamoeba histolytica
LNNFRHEWLLSFLGLIGGIGAG

SEQ ID NO: 2600919 - protein, 23 aa, Entamoeba histolytica
LNTSFLNFFIVSFSFCCLACWVV

SEQ ID NO: 2600920 - protein, 19 aa, Entamoeba histolytica
LPCLFIFMSLYRFNGFTLF

SEQ ID NO: 2600921 - protein, 27 aa, Entamoeba histolytica
LPIQTLRFIFFYFDVVYLRLPRQPLTS

SEQ ID NO: 2600922 - protein, 28 aa, Entamoeba histolytica
LPIVDFLYMIIILHFPLIIKSEELSQCI

SEQ ID NO: 2600923 - protein, 18 aa, Entamoeba histolytica
LPIYVVVLLIILGGIKLI

SEQ ID NO: 2600924 - protein, 18 aa, Entamoeba histolytica
LQDFLFYLISLPLDSKFF

SEQ ID NO: 2600925 - protein, 17 aa, Entamoeba histolytica
LQIITWQDPFPKSEFRF

SEQ ID NO: 2600926 - protein, 23 aa, Entamoeba histolytica
LQKKWLVTYSIYWLPYVNLAQDY

SEQ ID NO: 2600927 - protein, 25 aa, Entamoeba histolytica
LQQKLKTPLLLLPKEKRPTANMFMS

SEQ ID NO: 2600928 - protein, 26 aa, Entamoeba histolytica
LQQRHTLMFIILRQYFQLILNPDKTI

SEQ ID NO: 2600929 - protein, 25 aa, Entamoeba histolytica
LQQRHTLMFIILRQYFQLILTHDKT

SEQ ID NO: 2600930 - protein, 18 aa, Entamoeba histolytica
LQWFYGINYLVHRIFFTF

SEQ ID NO: 2600931 - protein, 25 aa, Entamoeba histolytica
LSEDPCFFVFILTALFLLKEHTLGD

SEQ ID NO: 2600932 - protein, 18 aa, Entamoeba histolytica
LSFYVVLMKFINYKLYTN

SEQ ID NO: 2600933 - protein, 22 aa, Entamoeba histolytica
LSILYPLIFFPTHLKMVFKYIF

SEQ ID NO: 2600934 - protein, 27 aa, Entamoeba histolytica
LSILYPSLPFIWGYFALLSVGLWYSSR

SEQ ID NO: 2600935 - protein, 18 aa, Entamoeba histolytica
LSLPFISVLIVSVTFICA

SEQ ID NO: 2600936 - protein, 20 aa, Entamoeba histolytica
LSQYPIFPWILNDYTSKTID

SEQ ID NO: 2600937 - protein, 24 aa, Entamoeba histolytica
LSRPIQLIFLLRPNSFDTLVLALT

SEQ ID NO: 2600938 - protein, 27 aa, Entamoeba histolytica
LSTFILKFIFFIIFALTIGGVIFFIFG

SEQ ID NO: 2600939 - protein, 18 aa, Entamoeba histolytica
LTGVLFGILYWFNNRHKI

SEQ ID NO: 2600940 - protein, 18 aa, Entamoeba histolytica
LTITFAILGIFMSPLFIL

SEQ ID NO: 2600941 - protein, 23 aa, Entamoeba histolytica
LTIWDYLLFLNGIVLASVLVYIT

SEQ ID NO: 2600942 - protein, 24 aa, Entamoeba histolytica
LTMRFFIMLRIYLSKHIKELPIFD

SEQ ID NO: 2600943 - protein, 21 aa, Entamoeba histolytica
LTMTLVMLVLIFIGFLIIKKV

SEQ ID NO: 2600944 - protein, 29 aa, Entamoeba histolytica
LTNTIQNIYINIHLIAETLSESVPANSQS

SEQ ID NO: 2600945 - protein, 31 aa, Entamoeba histolytica
LTTTKTIFLIFFLVVFVLFLIVWGHCGVTFE

SEQ ID NO: 2600946 - protein, 27 aa, Entamoeba histolytica
LVELILKYLLFYWNFFTISPVLSYFDI

SEQ ID NO: 2600947 - protein, 34 aa, Entamoeba histolytica
LVIILSILSILIFLGIIVALILIFLVYKKNKKRS

SEQ ID NO: 2600948 - protein, 23 aa, Entamoeba histolytica
LVLIALPRYPLLTGWKTEFMIGY

SEQ ID NO: 2600949 - protein, 32 aa, Entamoeba histolytica
LVNLQFILFLQLPYTFSFPWLNAIIIYVISIV

SEQ ID NO: 2600950 - protein, 18 aa, Entamoeba histolytica
LVVAVCGLLLIFGMIIVK

SEQ ID NO: 2600951 - protein, 33 aa, Entamoeba histolytica; identical to SEQ ID NO: 2546364

SEQ ID NO: 2600952 - protein, 25 aa, Entamoeba histolytica
LWFSIIIIVVVILLTLWQVRSLKAF

SEQ ID NO: 2600953 - protein, 17 aa, Entamoeba histolytica
LWIFTYFMKDLNLYGLF

SEQ ID NO: 2600954 - protein, 17 aa, Entamoeba histolytica
LWKLYFPMNLKLKASGE

SEQ ID NO: 2600955 - protein, 26 aa, Entamoeba histolytica
LWTLWIILWSFQFLVFAVVVCSLIML

SEQ ID NO: 2600956 - protein, 24 aa, Entamoeba histolytica
LYILAFFFIFPMRLGQIITALNQR

SEQ ID NO: 2600957 - protein, 23 aa, Entamoeba histolytica
LYLNYIPLIPLIINKIQQFYNYT

SEQ ID NO: 2600958 - protein, 21 aa, Entamoeba histolytica
LYMFILFVWIFFHVDHLKLLA

SEQ ID NO: 2600959 - protein, 23 aa, Entamoeba histolytica
LYMIYFIFMIIFNFIRCLVNIKK

SEQ ID NO: 2600960 - protein, 18 aa, Entamoeba histolytica
LYRFVQTLGMLPFSLLST

SEQ ID NO: 2600961 - protein, 18 aa, Entamoeba histolytica
LYRMIRFMIINDIPFIEI

SEQ ID NO: 2600962 - protein, 20 aa, Entamoeba histolytica
LYRYANWLDLILLAVGIFGS

SEQ ID NO: 2600963 - protein, 24 aa, Entamoeba histolytica
LYSCYLLPFLFFLGFVYSLGSLYI

SEQ ID NO: 2600964 - protein, 27 aa, Entamoeba histolytica
LYVFNRYICFWPQLLKFNADVWKFEDI

SEQ ID NO: 2600965 - protein, 17 aa, Entamoeba histolytica
LYYHFFPLKAHIIQAPF

SEQ ID NO: 2600966 - protein, 24 aa, Entamoeba histolytica
MAINIILICMYFFQLGVIGFLDYS

SEQ ID NO: 2600967 - protein, 22 aa, Entamoeba histolytica
MATYFCWLIIPLLMKENGASSF

SEQ ID NO: 2600968 - protein, 17 aa, Entamoeba histolytica
MCFVPFYGQLKYINEIL

SEQ ID NO: 2600969 - protein, 25 aa, Entamoeba histolytica
MCMSIVGYYYFWWLDAVGGIVLSFY

SEQ ID NO: 2600970 - protein, 17 aa, Entamoeba histolytica
MFIAIDFGLCYYIDETE

SEQ ID NO: 2600971 - protein, 19 aa, Entamoeba histolytica
MIKYLHLLITLVTLTPEVA

SEQ ID NO: 2600972 - protein, 21 aa, Entamoeba histolytica
MILTTLMIIGLMYLINVESSY

SEQ ID NO: 2600973 - protein, 18 aa, Entamoeba histolytica
MIRFMIINDIPFIEILDT

SEQ ID NO: 2600974 - protein, 24 aa, Entamoeba histolytica
MIYGALFPIFAYFLAEAICMLVTV

SEQ ID NO: 2600975 - protein, 20 aa, Entamoeba histolytica
MKFIYTIILFLFSKTPLQGA

SEQ ID NO: 2600976 - protein, 19 aa, Entamoeba histolytica
MKRFAIITTLFTPLTFLST

SEQ ID NO: 2600977 - protein, 22 aa, Entamoeba histolytica
MLFFYKQIIIFYYFVKNQTNDE

SEQ ID NO: 2600978 - protein, 18 aa, Entamoeba histolytica
MLLFFMMGSLALGSWYGS

SEQ ID NO: 2600979 - protein, 18 aa, Entamoeba histolytica
MMKIVLYPIYITIPMIRS

SEQ ID NO: 2600980 - protein, 17 aa, Entamoeba histolytica
MMKLPFLKQVKDLVDHF

SEQ ID NO: 2600981 - protein, 19 aa, Entamoeba histolytica
MNFILLNIFLVCVSASFLM

SEQ ID NO: 2600982 - protein, 24 aa, Entamoeba histolytica
MSIIFLLLILFIESLLFCLYWITK

SEQ ID NO: 2600983 - protein, 22 aa, Entamoeba histolytica
MSTYFCWLIIPLLMKENGATPF

SEQ ID NO: 2600984 - protein, 23 aa, Entamoeba histolytica
MSVVGYYYFWWLDAVGGIVLSFY

SEQ ID NO: 2600985 - protein, 23 aa, Entamoeba histolytica
MTEYSMNFYLYPKDLIFKEKRKT

SEQ ID NO: 2600986 - protein, 25 aa, Entamoeba histolytica
MTIWSILILVNIIVFLLSLHSSVFF

SEQ ID NO: 2600987 - protein, 22 aa, Entamoeba histolytica
MVILPFILFIFTAIPFMNWRNL

SEQ ID NO: 2600988 - protein, 18 aa, Entamoeba histolytica
MVIPKYIIISFISSQILI

SEQ ID NO: 2600989 - protein, 25 aa, Entamoeba histolytica
MVMLFYLIIVVVLYFIPKLYLPSQY

SEQ ID NO: 2600990 - protein, 20 aa, Entamoeba histolytica
NAFLLTLFFIITYGLVGYSM

SEQ ID NO: 2600991 - protein, 27 aa, Entamoeba histolytica
NAFVLLKLFFLFLPSPIIPFCFLDFIK

SEQ ID NO: 2600992 - protein, 18 aa, Entamoeba histolytica
NCRLSLYLPLFLKQFIPI

SEQ ID NO: 2600993 - protein, 18 aa, Entamoeba histolytica
NDFDIYLPFYLQDTKPLL

SEQ ID NO: 2600994 - protein, 26 aa, Entamoeba histolytica
NDSHKIFDLFWFFLGLVEKSIVAYLQ

SEQ ID NO: 2600995 - protein, 20 aa, Entamoeba histolytica
NEFPFLIILYFTLPYMNNVD

SEQ ID NO: 2600996 - protein, 24 aa, Entamoeba histolytica
NEILYLLVGYLSCLIPAACIGIFI

SEQ ID NO: 2600997 - protein, 19 aa, Entamoeba histolytica
NEVFLQLKLLWPSFNIINT

SEQ ID NO: 2600998 - protein, 21 aa, Entamoeba histolytica
NFCYFLFELIIGLYLNSLILT

SEQ ID NO: 2600999 - protein, 23 aa, Entamoeba histolytica
NGDHFMLLSLYLAFKKVGVNRRK

SEQ ID NO: 2601000 - protein, 19 aa, Entamoeba histolytica
NGMYLYFMVNWTTTVNGKH

SEQ ID NO: 2601001 - protein, 19 aa, Entamoeba histolytica
NHLIKFFYYHCYSKRFIEF

SEQ ID NO: 2601002 - protein, 27 aa, Entamoeba histolytica
NIILILPLLLFIWRFIIRRIIHPNPIQ

SEQ ID NO: 2601003 - protein, 21 aa, Entamoeba histolytica
NIILYLSIFLVILMVLNLLKI

SEQ ID NO: 2601004 - protein, 19 aa, Entamoeba histolytica
NILCLLFGVFFFVLVSIYE

SEQ ID NO: 2601005 - protein, 17 aa, Entamoeba histolytica
NILRIGFVASLLARSGA

SEQ ID NO: 2601006 - protein, 23 aa, Entamoeba histolytica
NIRLYIIVGMIVCLIIFIGIWSY

SEQ ID NO: 2601007 - protein, 29 aa, Entamoeba histolytica
NIVYYLYYLFIIIIFFFPSLMVPTNPADE

SEQ ID NO: 2601008 - protein, 22 aa, Entamoeba histolytica
NKCIWILLFGLAVFVTTYMYLG

SEQ ID NO: 2601009 - protein, 23 aa, Entamoeba histolytica
NKDKLIYHYILKSIPSFIEHFNC

SEQ ID NO: 2601010 - protein, 27 aa, Entamoeba histolytica
NKEVVWWMIMIIIIIIIIIIIITIVMI

SEQ ID NO: 2601011 - protein, 28 aa, Entamoeba histolytica
NKEVVWWMIMIIIIIIIIIIIITIVMII

SEQ ID NO: 2601012 - protein, 33 aa, Entamoeba histolytica
NKEVVWWMIMIIIIIIIIIIIITIVMIIMMVNY

SEQ ID NO: 2601013 - protein, 27 aa, Entamoeba histolytica
NKEVVWWMIMIIIIIIVIIIIITIVMI

SEQ ID NO: 2601014 - protein, 27 aa, Entamoeba histolytica
NKEVVWWMIMIIVIIIVIIIIITIVMI

SEQ ID NO: 2601015 - protein, 25 aa, Entamoeba histolytica
NKKEWIIIIIFIIAVIVIGIIIIGI

SEQ ID NO: 2601016 - protein, 22 aa, Entamoeba histolytica
NKLKWIIVVFWIIVALGMVYCV

SEQ ID NO: 2601017 - protein, 17 aa, Entamoeba histolytica
NKPNYLRLPYKLKIRML

SEQ ID NO: 2601018 - protein, 20 aa, Entamoeba histolytica
NKRIFVHNFLFDLALEFGFF

SEQ ID NO: 2601019 - protein, 25 aa, Entamoeba histolytica
NKWNQMDFIYFYQLMIKFFTQIHVN

SEQ ID NO: 2601020 - protein, 28 aa, Entamoeba histolytica
NKYIICLFIYVILILKFLIEVIILVFNE

SEQ ID NO: 2601021 - protein, 23 aa, Entamoeba histolytica
NKYQNIVLVSKINRNIISLDKSK

SEQ ID NO: 2601022 - protein, 24 aa, Entamoeba histolytica
NLCSLPRFWIVLLYIICVPLVKPT

SEQ ID NO: 2601023 - protein, 29 aa, Entamoeba histolytica
NLDGTSSVFMFFAFVIQKYSSNYCVFLFS

SEQ ID NO: 2601024 - protein, 19 aa, Entamoeba histolytica
NNFKIFCDCLYDKKMKEFM

SEQ ID NO: 2601025 - protein, 18 aa, Entamoeba histolytica
NNIFFTIKTKVSGSAGII

SEQ ID NO: 2601026 - protein, 23 aa, Entamoeba histolytica
NNKYQWWNFIPLAYLRQFKYTYN

SEQ ID NO: 2601027 - protein, 33 aa, Entamoeba histolytica
NNTKVIHTQIYSKQHKRLFNLHNIHLKGETGVD

SEQ ID NO: 2601028 - protein, 20 aa, Entamoeba histolytica
NPIFIPYVILLCFISRAFNI

SEQ ID NO: 2601029 - protein, 21 aa, Entamoeba histolytica
NPIPLLYYFILQLISVIFTLL

SEQ ID NO: 2601030 - protein, 19 aa, Entamoeba histolytica
NPITFIKFEFGKCYYMGSA

SEQ ID NO: 2601031 - protein, 17 aa, Entamoeba histolytica
NRLTNTIQYIHNNIHLI

SEQ ID NO: 2601032 - protein, 25 aa, Entamoeba histolytica
NSELTLFYYFLPFSINIENDKKMYL

SEQ ID NO: 2601033 - protein, 25 aa, Entamoeba histolytica
NSGLTLFYYFLPFSINIENDKKMYL

SEQ ID NO: 2601034 - protein, 17 aa, Entamoeba histolytica
NSIPFIYLYFSIDGINS

SEQ ID NO: 2601035 - protein, 27 aa, Entamoeba histolytica
NSSHPIIFLLILIVIVIILIVLIVLML

SEQ ID NO: 2601036 - protein, 35 aa, Entamoeba histolytica
NSTTPIGWIIFGVLFYVLFVIVLIITIIAIKMKRK

SEQ ID NO: 2601037 - protein, 20 aa, Entamoeba histolytica
NTHLFFLKPLIPIQLTEIFI

SEQ ID NO: 2601038 - protein, 26 aa, Entamoeba histolytica
NTTNYIFILRFLWILIVHRRARGITT

SEQ ID NO: 2601039 - protein, 19 aa, Entamoeba histolytica
NTYFLAWTTTPWTLPSNLA

SEQ ID NO: 2601040 - protein, 23 aa, Entamoeba histolytica
NTYYPLFLSYIRFIIREKTEFLF

SEQ ID NO: 2601041 - protein, 32 aa, Entamoeba histolytica
NVILSIIMYTLIPLIILLGCGIMFLLSCWVDK

SEQ ID NO: 2601042 - protein, 19 aa, Entamoeba histolytica
NVVWWIVLLEIITAILILI

SEQ ID NO: 2601043 - protein, 24 aa, Entamoeba histolytica
NWIKQNWLVLILVTGVFLLILMAL

SEQ ID NO: 2601044 - protein, 19 aa, Entamoeba histolytica
NWLLLLFDASYYKIIIWIL

SEQ ID NO: 2601045 - protein, 27 aa, Entamoeba histolytica
NYISIYIHLMIYVLEFLLLFILMFVCE

SEQ ID NO: 2601046 - protein, 17 aa, Entamoeba histolytica
PCYLMYMQLIGYLLLIG

SEQ ID NO: 2601047 - protein, 25 aa, Entamoeba histolytica
PDGFYKYFHFKFPSLFTVLYSFVKE

SEQ ID NO: 2601048 - protein, 19 aa, Entamoeba histolytica
PDLQLFDYLFQPLLNNSDS

SEQ ID NO: 2601049 - protein, 17 aa, Entamoeba histolytica
PDLYIYLIIACCGLVIF

SEQ ID NO: 2601050 - protein, 24 aa, Entamoeba histolytica
PDPVLIPFWKIWFDALKDKTLIIL

SEQ ID NO: 2601051 - protein, 23 aa, Entamoeba histolytica
PEKRYFFFFTFHDDNLLINFNIK

SEQ ID NO: 2601052 - protein, 26 aa, Entamoeba histolytica
PESSNFLILLFFPSVLSLLIPYIHRP

SEQ ID NO: 2601053 - protein, 19 aa, Entamoeba histolytica
PFFPLILKLILQESFALVL

SEQ ID NO: 2601054 - protein, 17 aa, Entamoeba histolytica
PFHLVVCYLFRNSNDKR

SEQ ID NO: 2601055 - protein, 18 aa, Entamoeba histolytica
PFINFLLLLLIPKSINYP

SEQ ID NO: 2601056 - protein, 19 aa, Entamoeba histolytica
PFMLITVLFLGFFATKFTA

SEQ ID NO: 2601057 - protein, 25 aa, Entamoeba histolytica
PGGKFLDIIFSLLLMSFLGIGYLEQ

SEQ ID NO: 2601058 - protein, 25 aa, Entamoeba histolytica
PIIERLLLYLFYFWDTAGLSLTIKN

SEQ ID NO: 2601059 - protein, 25 aa, Entamoeba histolytica
PIIFRSFYFLISFFGTLTIVLWFAV

SEQ ID NO: 2601060 - protein, 29 aa, Entamoeba histolytica
PIVIAILSIILASLVFFLCQRRTDNGPAQ

SEQ ID NO: 2601061 - protein, 20 aa, Entamoeba histolytica
PKIGIYKWAPLLSIFMCLTT

SEQ ID NO: 2601062 - protein, 19 aa, Entamoeba histolytica
PKKIIWWVAIIFTILSIIE

SEQ ID NO: 2601063 - protein, 31 aa, Entamoeba histolytica
PKNDSRVVIIFLSVLVVIALMFVIISMLRNK

SEQ ID NO: 2601064 - protein, 42 aa, Entamoeba histolytica
PKWSIYPLAFIPGVVLYLLVWVILFIIFLRKHIRLTKMIEIE

SEQ ID NO: 2601065 - protein, 19 aa, Entamoeba histolytica
PLFIFIIFPRKPRYKNDET

SEQ ID NO: 2601066 - protein, 17 aa, Entamoeba histolytica
PLKLFYDFLITKVLHEK

SEQ ID NO: 2601067 - protein, 27 aa, Entamoeba histolytica
PLLKEYFYPFITKFLPFLLQRCKIQIP

SEQ ID NO: 2601068 - protein, 20 aa, Entamoeba histolytica
PLMYCLLIVFGLTIILSFEI

SEQ ID NO: 2601069 - protein, 20 aa, Entamoeba histolytica
PLPILFCLLLLPLPKNNISL

SEQ ID NO: 2601070 - protein, 22 aa, Entamoeba histolytica
PLSVVLFIFLLITFSVISNRKR

SEQ ID NO: 2601071 - protein, 17 aa, Entamoeba histolytica
PLVFNWPSSQNAACYYC

SEQ ID NO: 2601072 - protein, 17 aa, Entamoeba histolytica
PLYFIYRPIYQWIFQRV

SEQ ID NO: 2601073 - protein, 21 aa, Entamoeba histolytica
PLYIFLFIAFLFPVFTFIFFC

SEQ ID NO: 2601074 - protein, 21 aa, Entamoeba histolytica
PNGVFLDTLFSLLLTSFIGIG

SEQ ID NO: 2601075 - protein, 29 aa, Entamoeba histolytica
PPQHNIIRIPWRRILFTPNPKKPTIWDDI

SEQ ID NO: 2601076 - protein, 19 aa, Entamoeba histolytica
PPVYTYFYLCVIVSSEGFV

SEQ ID NO: 2601077 - protein, 19 aa, Entamoeba histolytica
PQHILPLVFNWPSSQNAAC

SEQ ID NO: 2601078 - protein, 24 aa, Entamoeba histolytica
PQSYNIWLLICTAIFGALIIITAT

SEQ ID NO: 2601079 - protein, 23 aa, Entamoeba histolytica
PQTISWLFIFRIVPMVVIFMICL

SEQ ID NO: 2601080 - protein, 17 aa, Entamoeba histolytica
PRLYYHFFPLKAHIIQA

SEQ ID NO: 2601081 - protein, 21 aa, Entamoeba histolytica
PSLSTLLFFTILKLSPVCLTQ

SEQ ID NO: 2601082 - protein, 23 aa, Entamoeba histolytica
PSTYLFILLYVILAITPLLLRNF

SEQ ID NO: 2601083 - protein, 20 aa, Entamoeba histolytica
PTSYLNCKIPKQPNGKYNMG

SEQ ID NO: 2601084 - protein, 29 aa, Entamoeba histolytica
PVFLFNQFKYFINLFFLIVAILSCIPQLS

SEQ ID NO: 2601085 - protein, 25 aa, Entamoeba histolytica
PVIIITFILLIILLSIIVSSIIIYK

SEQ ID NO: 2601086 - protein, 24 aa, Entamoeba histolytica
PVKQKWLWSLYTILTVMSLITLAL

SEQ ID NO: 2601087 - protein, 30 aa, Entamoeba histolytica
PVLFLIVCIILLCIITYWAFIPIGVCLVFV

SEQ ID NO: 2601088 - protein, 19 aa, Entamoeba histolytica
PVVSILFYVLGKSLFNTCM

SEQ ID NO: 2601089 - protein, 23 aa, Entamoeba histolytica
PYSKYVICWFGLDTLQLLNFSIK

SEQ ID NO: 2601090 - protein, 18 aa, Entamoeba histolytica
PYTYGYWFNITFEKASKV

SEQ ID NO: 2601091 - protein, 18 aa, Entamoeba histolytica
QDFLKHICIVWNKCYYYI

SEQ ID NO: 2601092 - protein, 20 aa, Entamoeba histolytica
QENILFRFYLKFIGSPIATK

SEQ ID NO: 2601093 - protein, 24 aa, Entamoeba histolytica
QFKYFYNLYFLITALSQFVPILQV

SEQ ID NO: 2601094 - protein, 23 aa, Entamoeba histolytica
QHHPIFWFIVVITHLLICGCMAF

SEQ ID NO: 2601095 - protein, 19 aa, Entamoeba histolytica
QHKRIYNEYKVHLKGEGEV

SEQ ID NO: 2601096 - protein, 20 aa, Entamoeba histolytica
QHLYLFVFFLIFGLYVSLYF

SEQ ID NO: 2601097 - protein, 25 aa, Entamoeba histolytica
QIHKKFYYFIILYEMIHEKNILQII

SEQ ID NO: 2601098 - protein, 18 aa, Entamoeba histolytica
QIKPLYTLLLQVLIPQLP

SEQ ID NO: 2601099 - protein, 20 aa, Entamoeba histolytica
QIPLYLIVLVVFFGFDEFIA

SEQ ID NO: 2601100 - protein, 28 aa, Entamoeba histolytica
QIQSKQHKIMYNLYKAELKGEVTTQITD

SEQ ID NO: 2601101 - protein, 23 aa, Entamoeba histolytica
QISLSFFVWYIYSIYSFFTNAPP

SEQ ID NO: 2601102 - protein, 25 aa, Entamoeba histolytica
QKKRLDLVLLLLKFGARIYIANNAG

SEQ ID NO: 2601103 - protein, 18 aa, Entamoeba histolytica
QLFCDFIYASWKLIQQKG

SEQ ID NO: 2601104 - protein, 34 aa, Entamoeba histolytica
QLKNYIIKKSMKFLIFMIIFVVSKGLEPIEVATE

SEQ ID NO: 2601105 - protein, 18 aa, Entamoeba histolytica
QLPPLLRSRIILDAAKGI

SEQ ID NO: 2601106 - protein, 32 aa, Entamoeba histolytica; identical to SEQ ID NO: 2404369

SEQ ID NO: 2601107 - protein, 22 aa, Entamoeba histolytica
QLYRYANWLDLILLAVGIFGSI

SEQ ID NO: 2601108 - protein, 24 aa, Entamoeba histolytica
QNMIISFFLCWFVIGIGAACGFRL

SEQ ID NO: 2601109 - protein, 37 aa, Entamoeba histolytica
QNNSNTIWLIMIPSVICIILIIIVIVLLTIYLHKLFI

SEQ ID NO: 2601110 - protein, 24 aa, Entamoeba histolytica
QNSSWIILLWVVVGCIICAGLVMV

SEQ ID NO: 2601111 - protein, 21 aa, Entamoeba histolytica
QQFYYYVSPYYFQPILLDLTL

SEQ ID NO: 2601112 - protein, 20 aa, Entamoeba histolytica
QQLFQILLPQIIRLKLTTKL

SEQ ID NO: 2601113 - protein, 26 aa, Entamoeba histolytica
QRTFKFFYFPRFLIVLLIGSFLVNLY

SEQ ID NO: 2601114 - protein, 23 aa, Entamoeba histolytica
QRTPILLIPLLRLLGDIASSKNF

SEQ ID NO: 2601115 - protein, 21 aa, Entamoeba histolytica
QSILFFVIFYFIIAPSDVTSF

SEQ ID NO: 2601116 - protein, 33 aa, Entamoeba histolytica
QSMIPIILIYPNPFMFIVWFIPQWIKSLKMIGV

SEQ ID NO: 2601117 - protein, 24 aa, Entamoeba histolytica
QSMKFIPIILLRPLFRIPLKQNDL

SEQ ID NO: 2601118 - protein, 21 aa, Entamoeba histolytica
QSPFIYFLRFHDEPTIVECLE

SEQ ID NO: 2601119 - protein, 23 aa, Entamoeba histolytica
QSSKLMCIILIVVAIIMVIVVAA

SEQ ID NO: 2601120 - protein, 25 aa, Entamoeba histolytica
QSTPTFIYIIAFLLQILTGYFIYII

SEQ ID NO: 2601121 - protein, 24 aa, Entamoeba histolytica
QSYLMMLMFSFIGVSGLLVVLFII

SEQ ID NO: 2601122 - protein, 27 aa, Entamoeba histolytica
QSYNKLLVYLIFLVKPYVNWSRMYLEI

SEQ ID NO: 2601123 - protein, 25 aa, Entamoeba histolytica
QTFFPPMLPFLFRSLTQPKQPLPKK

SEQ ID NO: 2601124 - protein, 20 aa, Entamoeba histolytica
QTFLIYIVFIFISILVNLPK

SEQ ID NO: 2601125 - protein, 30 aa, Entamoeba histolytica
QTWKSGVVMLIIFIVLFTALSIWNDVLNEM

SEQ ID NO: 2601126 - protein, 18 aa, Entamoeba histolytica
QVFNFISLIFFPITFVVN

SEQ ID NO: 2601127 - protein, 28 aa, Entamoeba histolytica
QVFTTLFFLRYLFLPLISYPSLLKTLQK

SEQ ID NO: 2601128 - protein, 24 aa, Entamoeba histolytica
QYHSWDLFFLSSSVIFVLGLLGVI

SEQ ID NO: 2601129 - protein, 24 aa, Entamoeba histolytica
RADGFGMEILPLLKFIGSSQTYAE

SEQ ID NO: 2601130 - protein, 18 aa, Entamoeba histolytica
RAYVWYALLLRPSNPWEI

SEQ ID NO: 2601131 - protein, 20 aa, Entamoeba histolytica
RCLALFLEYAWMKGIDGFNN

SEQ ID NO: 2601132 - protein, 23 aa, Entamoeba histolytica
RDFNKYFILYLACVLMLIQTNPN

SEQ ID NO: 2601133 - protein, 21 aa, Entamoeba histolytica
RDMFRFVIFFIKQKLGKIDAK

SEQ ID NO: 2601134 - protein, 26 aa, Entamoeba histolytica
REDIIPILRYILAPTPYSGLLTTTQV

SEQ ID NO: 2601135 - protein, 18 aa, Entamoeba histolytica
REFIKFLIFFQPYFNIKQ

SEQ ID NO: 2601136 - protein, 18 aa, Entamoeba histolytica
RFKKWSIVICICLIIVIF

SEQ ID NO: 2601137 - protein, 28 aa, Entamoeba histolytica
RGPDKMLMTIMMICLLLGVVSIIAMIFL

SEQ ID NO: 2601138 - protein, 29 aa, Entamoeba histolytica
RGPDQLCCTITILFVIFGVVSVGAMILMK

SEQ ID NO: 2601139 - protein, 19 aa, Entamoeba histolytica
RILPILLYFSLLTLTILAI

SEQ ID NO: 2601140 - protein, 27 aa, Entamoeba histolytica
RILPNLGIVFWVICILVALGGVYLYQI

SEQ ID NO: 2601141 - protein, 39 aa, Entamoeba histolytica
RIPLIIRKVLYLIIGFITYIILYCILFIVVLYLHIGITK

SEQ ID NO: 2601142 - protein, 24 aa, Entamoeba histolytica
RIRKLFIILLFIETIIILPLVILS

SEQ ID NO: 2601143 - protein, 18 aa, Entamoeba histolytica
RIWVFFIFPVVVNAYRCN

SEQ ID NO: 2601144 - protein, 38 aa, Entamoeba histolytica
RKSMWWISLIVIPIFILIIVMIYFILTLISKKIIRLKQ

SEQ ID NO: 2601145 - protein, 22 aa, Entamoeba histolytica
RKYILKMLYIYILGYDVDFGIP

SEQ ID NO: 2601146 - protein, 18 aa, Entamoeba histolytica
RLFPFMQFFLLTGVLFLL

SEQ ID NO: 2601147 - protein, 20 aa, Entamoeba histolytica
RLIKLFLSFFLINSTRFAYL

SEQ ID NO: 2601148 - protein, 28 aa, Entamoeba histolytica
RLKRAMWWKNIKLYLIAGAILLIFLLVL

SEQ ID NO: 2601149 - protein, 18 aa, Entamoeba histolytica
RLLVYALQYVIVPLIRVH

SEQ ID NO: 2601150 - protein, 23 aa, Entamoeba histolytica
RLPFSYYYFVSFLEDLLLIFEYN

SEQ ID NO: 2601151 - protein, 17 aa, Entamoeba histolytica
RLPHFFQILSLTPIGRG

SEQ ID NO: 2601152 - protein, 20 aa, Entamoeba histolytica
RLRVSLLYTWCVILILNNVR

SEQ ID NO: 2601153 - protein, 20 aa, Entamoeba histolytica
RLYMLLWGIWFYCSEQTEVF

SEQ ID NO: 2601154 - protein, 17 aa, Entamoeba histolytica
RPSLFLVIFKLEWKMFL

SEQ ID NO: 2601155 - protein, 24 aa, Entamoeba histolytica
RPSLQWYFSILFWRDIKTLKSTFK

SEQ ID NO: 2601156 - protein, 18 aa, Entamoeba histolytica
RQINLYLLSLLSNKKQLV

SEQ ID NO: 2601157 - protein, 21 aa, Entamoeba histolytica
RTIFLISLICVLIIGTLLVIV

SEQ ID NO: 2601158 - protein, 20 aa, Entamoeba histolytica
RVDYPLWFLCLYDAAGRASK

SEQ ID NO: 2601159 - protein, 19 aa, Entamoeba histolytica
RWVQSIAGLLRLFCLGINL

SEQ ID NO: 2601160 - protein, 27 aa, Entamoeba histolytica
RYQKCYLYYLNIGLLILLSYAGNTFLP

SEQ ID NO: 2601161 - protein, 21 aa, Entamoeba histolytica
RYTIALILIRFFISLITVVIV

SEQ ID NO: 2601162 - protein, 28 aa, Entamoeba histolytica
SAPVIILWTTLFLVQILLAIIVILIAQT

SEQ ID NO: 2601163 - protein, 22 aa, Entamoeba histolytica
SCIACWIVFIFQPTFKPTVSTL

SEQ ID NO: 2601164 - protein, 25 aa, Entamoeba histolytica
SCTFGYLCFLILIKWMFFIEDAPMI

SEQ ID NO: 2601165 - protein, 26 aa, Entamoeba histolytica
SDASPVYLTFYYLVNILINGKIYKKT

SEQ ID NO: 2601166 - protein, 29 aa, Entamoeba histolytica
SDNTYYCPLKDLYLPYYFSVTKGSDNKIT

SEQ ID NO: 2601167 - protein, 29 aa, Entamoeba histolytica
SDNTYYCPLKDLYLPYYFSVTKGTSDNTI

SEQ ID NO: 2601168 - protein, 25 aa, Entamoeba histolytica
SDVYIRTLILFLPLLVVFNKERIDG

SEQ ID NO: 2601169 - protein, 21 aa, Entamoeba histolytica
SEKWGFWKTVVVIGLGAAGVV

SEQ ID NO: 2601170 - protein, 20 aa, Entamoeba histolytica
SELTLFSYFLPFTINIDNDK

SEQ ID NO: 2601171 - protein, 26 aa, Entamoeba histolytica
SFIVIKMIWFIILKRLQDWIVNKPSQ

SEQ ID NO: 2601172 - protein, 21 aa, Entamoeba histolytica
SFLSFFMYIGLFLSAGFKMIG

SEQ ID NO: 2601173 - protein, 22 aa, Entamoeba histolytica
SFLSFFMYIGLFLSAGFKMIGR

SEQ ID NO: 2601174 - protein, 24 aa, Entamoeba histolytica
SFVAAFLFIDYIATPAPHLPPSFP

SEQ ID NO: 2601175 - protein, 19 aa, Entamoeba histolytica
SFYIMINWFFTLMEYLSIM

SEQ ID NO: 2601176 - protein, 17 aa, Entamoeba histolytica
SGKIRLFIVSRYQSNYV

SEQ ID NO: 2601177 - protein, 18 aa, Entamoeba histolytica
SGKSTLLNYLFNTKFRIL

SEQ ID NO: 2601178 - protein, 20 aa, Entamoeba histolytica
SGLKYLMWMIGIGGGIIGVV

SEQ ID NO: 2601179 - protein, 29 aa, Entamoeba histolytica
SGVCLYILLWLSLLLIIMFRYKKLTLEIQ

SEQ ID NO: 2601180 - protein, 23 aa, Entamoeba histolytica
SGVFFILCITTLFILFILTSINL

SEQ ID NO: 2601181 - protein, 21 aa, Entamoeba histolytica
SGWKYLMWMIGIGGGIIGVVI

SEQ ID NO: 2601182 - protein, 24 aa, Entamoeba histolytica
SIAVFAIFLIPFLAIGFVGNSNMT

SEQ ID NO: 2601183 - protein, 21 aa, Entamoeba histolytica
SIFWYFILILLFIGLKLDNIV

SEQ ID NO: 2601184 - protein, 25 aa, Entamoeba histolytica
SIGMVFFILVIGFIFIMFRPNSLFR

SEQ ID NO: 2601185 - protein, 18 aa, Entamoeba histolytica
SILFILICLILVTIICVL

SEQ ID NO: 2601186 - protein, 24 aa, Entamoeba histolytica
SIPLLPLLLPLFKILPIQSFAILL

SEQ ID NO: 2601187 - protein, 23 aa, Entamoeba histolytica
SISLFFMTLYIKPLAEFGGYDMP

SEQ ID NO: 2601188 - protein, 29 aa, Entamoeba histolytica
SIVYILYFIFVMILFLILHIRLTRKIKQD

SEQ ID NO: 2601189 - protein, 20 aa, Entamoeba histolytica
SIYICSALCLFLLTVLVFAS

SEQ ID NO: 2601190 - protein, 26 aa, Entamoeba histolytica
SKIIWLLYGFLFITFFLIYSSKPKEF

SEQ ID NO: 2601191 - protein, 24 aa, Entamoeba histolytica
SLEYFIYILLFYTISFKLIGFIVI

SEQ ID NO: 2601192 - protein, 24 aa, Entamoeba histolytica
SLFLLFQFLYLMFLITLGLSAQPY

SEQ ID NO: 2601193 - protein, 20 aa, Entamoeba histolytica
SLFLLTFIYYFILFSIEYLS

SEQ ID NO: 2601194 - protein, 26 aa, Entamoeba histolytica
SLFSIFYYFYTLLKNKLLILFGNTME

SEQ ID NO: 2601195 - protein, 20 aa, Entamoeba histolytica
SLFTFHLILLSIFSITLFPE

SEQ ID NO: 2601196 - protein, 23 aa, Entamoeba histolytica
SLIKNPMIIMALVSLGLIGFSKL

SEQ ID NO: 2601197 - protein, 23 aa, Entamoeba histolytica
SLKILIGFVIILLCCVLIWKSHT

SEQ ID NO: 2601198 - protein, 20 aa, Entamoeba histolytica
SLKLVLFILFLVCLIFATVH

SEQ ID NO: 2601199 - protein, 25 aa, Entamoeba histolytica
SLLFLKLIYYFILFSIKYLSRSYMY

SEQ ID NO: 2601200 - protein, 20 aa, Entamoeba histolytica
SLLLMFIPKPIFLYIKLRKQ

SEQ ID NO: 2601201 - protein, 24 aa, Entamoeba histolytica
SLMKAIFVCYFPRLLMTVPYFIIM

SEQ ID NO: 2601202 - protein, 22 aa, Entamoeba histolytica
SLPLIFFFTLVFLSFTIFGTRS

SEQ ID NO: 2601203 - protein, 20 aa, Entamoeba histolytica
SLTLLRFRILKKNKLKYTLE

SEQ ID NO: 2601204 - protein, 22 aa, Entamoeba histolytica
SLVLFVLLFFKIMYDLITQIIK

SEQ ID NO: 2601205 - protein, 25 aa, Entamoeba histolytica
SMKFIPFMWIIYIIGSYFAVPLCNN

SEQ ID NO: 2601206 - protein, 24 aa, Entamoeba histolytica
SNKHNIIMLFVLIVFSCICSAYTY

SEQ ID NO: 2601207 - protein, 18 aa, Entamoeba histolytica
SPFLPITIFLYPATLPLL

SEQ ID NO: 2601208 - protein, 21 aa, Entamoeba histolytica
SPIFLIILILYSQTFLKLIQK

SEQ ID NO: 2601209 - protein, 28 aa, Entamoeba histolytica
SPLLLFKAWMLRWWKIMYLRLLDLQKWK

SEQ ID NO: 2601210 - protein, 23 aa, Entamoeba histolytica
SQAFIHFVVIQLALKWGKEAAGP

SEQ ID NO: 2601211 - protein, 23 aa, Entamoeba histolytica
SQNSFLRIYFPTVLNWMIGGVVG

SEQ ID NO: 2601212 - protein, 21 aa, Entamoeba histolytica
SQYFIIPRFSPTCWVKLPYKR

SEQ ID NO: 2601213 - protein, 18 aa, Entamoeba histolytica
SQYPIFPWILNDYTSKTI

SEQ ID NO: 2601214 - protein, 17 aa, Entamoeba histolytica
SRNGLFLPKLPPKIKEI

SEQ ID NO: 2601215 - protein, 22 aa, Entamoeba histolytica
SRYFFLVMVICLIVLVLQQIIF

SEQ ID NO: 2601216 - protein, 17 aa, Entamoeba histolytica
SRYFIAFRWFMAQLLIN

SEQ ID NO: 2601217 - protein, 18 aa, Entamoeba histolytica
SSKYKGVIMILFILLVLI

SEQ ID NO: 2601218 - protein, 18 aa, Entamoeba histolytica
SSLFNIVVIFPFVLCFYP

SEQ ID NO: 2601219 - protein, 17 aa, Entamoeba histolytica
SSLPWLVFIYLIKPVMS

SEQ ID NO: 2601220 - protein, 25 aa, Entamoeba histolytica
SSSSLWMRIPLYLLQDYPRQSRKLS

SEQ ID NO: 2601221 - protein, 23 aa, Entamoeba histolytica
SSTLYLPPRYPLLGGWKTSFEVN

SEQ ID NO: 2601222 - protein, 24 aa, Entamoeba histolytica
STESFIPCIFILEKQWKKLNKKPL

SEQ ID NO: 2601223 - protein, 22 aa, Entamoeba histolytica
STHSMFIAFSLLYIGAAAETKT

SEQ ID NO: 2601224 - protein, 26 aa, Entamoeba histolytica
STILILFVVIIVIIAWILSRRRTTRK

SEQ ID NO: 2601225 - protein, 25 aa, Entamoeba histolytica
STITFLAFLLFLLSALIHTIFLCCK

SEQ ID NO: 2601226 - protein, 23 aa, Entamoeba histolytica
STKLIALTIFLPGLGIYICFALV

SEQ ID NO: 2601227 - protein, 20 aa, Entamoeba histolytica
STLLNYLFNTKFRILNEVMG

SEQ ID NO: 2601228 - protein, 22 aa, Entamoeba histolytica
STLYLPPRYPLLGGWKTSFEVI

SEQ ID NO: 2601229 - protein, 25 aa, Entamoeba histolytica
STPVGWIVFGVLVYVLFAGILAGCV

SEQ ID NO: 2601230 - protein, 18 aa, Entamoeba histolytica
SVFNWFWNRQSYIPNEPY

SEQ ID NO: 2601231 - protein, 25 aa, Entamoeba histolytica
SVFPDSLLLLFYYSLCYVFAKEIKK

SEQ ID NO: 2601232 - protein, 20 aa, Entamoeba histolytica
SVFYYLTMQPWRNLEWTTID

SEQ ID NO: 2601233 - protein, 29 aa, Entamoeba histolytica
SVGLLFIMGLFILLFFVLLRYERADIEVF

SEQ ID NO: 2601234 - protein, 25 aa, Entamoeba histolytica
SVKKTLFYIIIATVVFIPICVSFNI

SEQ ID NO: 2601235 - protein, 25 aa, Entamoeba histolytica
SVLLGVYLLSKWLLKYLKVRDIEKQ

SEQ ID NO: 2601236 - protein, 23 aa, Entamoeba histolytica
SYDKEPYVILPNKDFRFSTEFEY

SEQ ID NO: 2601237 - protein, 23 aa, Entamoeba histolytica
SYEGGPLPWYLNKGLYFTNITLR

SEQ ID NO: 2601238 - protein, 26 aa, Entamoeba histolytica
SYITFIFLFLCFIAYTLIATLVLDRT

SEQ ID NO: 2601239 - protein, 18 aa, Entamoeba histolytica
SYVCCFILLYLKQLLINE

SEQ ID NO: 2601240 - protein, 21 aa, Entamoeba histolytica
SYVMILMIMAFYFDVPLPIRH

SEQ ID NO: 2601241 - protein, 23 aa, Entamoeba histolytica
TAKKFYQMMYWIIGIPAVAVEYN

SEQ ID NO: 2601242 - protein, 26 aa, Entamoeba histolytica
TDIVLYLLVLFFSWICERKLDKVILA

SEQ ID NO: 2601243 - protein, 28 aa, Entamoeba histolytica
TEFPKWTIGVMVIFVIALIVIVVVIIKE

SEQ ID NO: 2601244 - protein, 28 aa, Entamoeba histolytica
TFCTLWMILSMITFVLFGIVLTCCMFLS

SEQ ID NO: 2601245 - protein, 20 aa, Entamoeba histolytica
TFLNIWTRKLWRSACSLLDY

SEQ ID NO: 2601246 - protein, 17 aa, Entamoeba histolytica
TFSNYIQYWVLGSTPRM

SEQ ID NO: 2601247 - protein, 24 aa, Entamoeba histolytica
TGILWWHILLIIIGSVWIIFILMI

SEQ ID NO: 2601248 - protein, 19 aa, Entamoeba histolytica
TGINYEFVKNLFIKNGNDL

SEQ ID NO: 2601249 - protein, 17 aa, Entamoeba histolytica
TGLFIGLLYRRLNKIIK

SEQ ID NO: 2601250 - protein, 25 aa, Entamoeba histolytica
TGLLFFFVFCAFWIGYIYGAKKIQK

SEQ ID NO: 2601251 - protein, 22 aa, Entamoeba histolytica
TGLLMLFTIPLLSELLKEVGCV

SEQ ID NO: 2601252 - protein, 26 aa, Entamoeba histolytica
TGVFLLILMALLWYYWKNKQEFVHVK

SEQ ID NO: 2601253 - protein, 21 aa, Entamoeba histolytica
THLFMFSLLFWILGYIYINLN

SEQ ID NO: 2601254 - protein, 17 aa, Entamoeba histolytica
TIFLIIPIILLVSSRIS

SEQ ID NO: 2601255 - protein, 24 aa, Entamoeba histolytica
TIGTFIIVLIIVIIITIIITIFYL

SEQ ID NO: 2601256 - protein, 18 aa, Entamoeba histolytica
TIILIVILLVLIIFIIFI

SEQ ID NO: 2601257 - protein, 25 aa, Entamoeba histolytica
TIIVLIFIILLFILLSCFIKSKKVD

SEQ ID NO: 2601258 - protein, 33 aa, Entamoeba histolytica
TINDYFIFGFQLILFIAVLFYTVILYSNNFNRV

SEQ ID NO: 2601259 - protein, 21 aa, Entamoeba histolytica
TISLPFYFYSVRFLGKIFKSR

SEQ ID NO: 2601260 - protein, 23 aa, Entamoeba histolytica
TIVFLLSLLYFSASIFHLLEGFN

SEQ ID NO: 2601261 - protein, 29 aa, Entamoeba histolytica
TKIVYWIYYLLMILLFFFPKIFIPCPSNH

SEQ ID NO: 2601262 - protein, 18 aa, Entamoeba histolytica
TKLISFLMYVLCSLGYTF

SEQ ID NO: 2601263 - protein, 36 aa, Entamoeba histolytica
TKTQAMFYILLIIACIFFLFIIYWSLMLSRKCTNTL

SEQ ID NO: 2601264 - protein, 17 aa, Entamoeba histolytica
TLFFIITYGLVGYSMKK

SEQ ID NO: 2601265 - protein, 18 aa, Entamoeba histolytica
TLHKTICLIALINALKQT

SEQ ID NO: 2601266 - protein, 25 aa, Entamoeba histolytica
TLIGYPFFIVYIIAAGLGIFIEGRF

SEQ ID NO: 2601267 - protein, 21 aa, Entamoeba histolytica
TLIIGIFVLVLIFVILCIIKT

SEQ ID NO: 2601268 - protein, 19 aa, Entamoeba histolytica
TLLFFILLQVLSNVLYLVA

SEQ ID NO: 2601269 - protein, 19 aa, Entamoeba histolytica
TLLFFYKPLVRIFGLRLTY

SEQ ID NO: 2601270 - protein, 30 aa, Entamoeba histolytica
TLSILFVVFILLVLLWFVMHFMLAVQSIGP

SEQ ID NO: 2601271 - protein, 27 aa, Entamoeba histolytica
TLSPQYFLFNILIQILLMIVGREQNVI

SEQ ID NO: 2601272 - protein, 18 aa, Entamoeba histolytica
TLTLLLIPIPNILKKQIL

SEQ ID NO: 2601273 - protein, 24 aa, Entamoeba histolytica
TLVGIFYMYFYTLNIPLLPINDLE

SEQ ID NO: 2601274 - protein, 23 aa, Entamoeba histolytica
TLYRAWIKLLPQDKLLWMSIIQH

SEQ ID NO: 2601275 - protein, 23 aa, Entamoeba histolytica
TMATLLIPVFPLLITPFLGVMNS

SEQ ID NO: 2601276 - protein, 22 aa, Entamoeba histolytica
TMEEWFWELINLGWNQNPKERI

SEQ ID NO: 2601277 - protein, 29 aa, Entamoeba histolytica
TNQKQLWYLVLIPIFCILILFMISILVCV

SEQ ID NO: 2601278 - protein, 27 aa, Entamoeba histolytica
TNTIQNIYNNIHLIAEAPSESVPQALK

SEQ ID NO: 2601279 - protein, 26 aa, Entamoeba histolytica
TNTIQNIYNNIHLIAETLSEPALANS

SEQ ID NO: 2601280 - protein, 23 aa, Entamoeba histolytica
TNWALIIPLVIVGIILIIVIIII

SEQ ID NO: 2601281 - protein, 34 aa, Entamoeba histolytica
TNYIFIAVIPVWIIFFILLFGYYTLKVVVIRQAE

SEQ ID NO: 2601282 - protein, 23 aa, Entamoeba histolytica
TPNYVLYLPYYLLGSQVTLRIIT

SEQ ID NO: 2601283 - protein, 30 aa, Entamoeba histolytica
TPSITFVLLFLFALVIIVILILYAHRRDPK

SEQ ID NO: 2601284 - protein, 27 aa, Entamoeba histolytica
TQAIYQLFVLLFLLYCGRELTFLNAPC

SEQ ID NO: 2601285 - protein, 25 aa, Entamoeba histolytica
TQEIYYWSIILIKLLMFILKNKRKD

SEQ ID NO: 2601286 - protein, 17 aa, Entamoeba histolytica
TQETNIFYKGCSGLLIP

SEQ ID NO: 2601287 - protein, 19 aa, Entamoeba histolytica
TRHKWLFISLYFVGIMVCG

SEQ ID NO: 2601288 - protein, 26 aa, Entamoeba histolytica
TRNPTSFLFWFITLGVQGFTVFVLYF

SEQ ID NO: 2601289 - protein, 22 aa, Entamoeba histolytica
TSIIYLLIGYLGFLIPAACIGI

SEQ ID NO: 2601290 - protein, 19 aa, Entamoeba histolytica
TSTDFFYLIQPIVAHIFEE

SEQ ID NO: 2601291 - protein, 17 aa, Entamoeba histolytica
TTLIMMKLPFLKQVKDL

SEQ ID NO: 2601292 - protein, 17 aa, Entamoeba histolytica
TTLLIVLIVFGTLALLP

SEQ ID NO: 2601293 - protein, 23 aa, Entamoeba histolytica
TTLTFFGIFAEFITALTLAARVE

SEQ ID NO: 2601294 - protein, 20 aa, Entamoeba histolytica
TTMIFIQYKLIDGLLEFICQ

SEQ ID NO: 2601295 - protein, 29 aa, Entamoeba histolytica
TVGLILILIFFIVLLIFVLRYKKVDINIY

SEQ ID NO: 2601296 - protein, 18 aa, Entamoeba histolytica
TVKPIQVLPLYAALPPEQ

SEQ ID NO: 2601297 - protein, 18 aa, Entamoeba histolytica
TVLQILVVLPEKDLYVLP

SEQ ID NO: 2601298 - protein, 17 aa, Entamoeba histolytica
TVWLLLVLSFLGGLVAG

SEQ ID NO: 2601299 - protein, 18 aa, Entamoeba histolytica
TYLSKYYIFKARPLQEFI

SEQ ID NO: 2601300 - protein, 18 aa, Entamoeba histolytica
TYVLLFIGLLTVGMSIVM

SEQ ID NO: 2601301 - protein, 18 aa, Entamoeba histolytica
TYYLKDYLMWGKSMIVSA

SEQ ID NO: 2601302 - protein, 18 aa, Entamoeba histolytica
VALLLWKHFFLSLPNPVI

SEQ ID NO: 2601303 - protein, 24 aa, Entamoeba histolytica
VCCFLLFFIIIAIIGVLLAYYMKS

SEQ ID NO: 2601304 - protein, 20 aa, Entamoeba histolytica
VCICCWFLNLFQSKKTRIIY

SEQ ID NO: 2601305 - protein, 20 aa, Entamoeba histolytica
VCTLFLYFIPYIRCLAIFSP

SEQ ID NO: 2601306 - protein, 24 aa, Entamoeba histolytica
VDIYSWIFFLPYSPDDLIKSKFKP

SEQ ID NO: 2601307 - protein, 18 aa, Entamoeba histolytica
VERMVILMYFGVAIPDIL

SEQ ID NO: 2601308 - protein, 21 aa, Entamoeba histolytica
VFDYFYYYLPFNFNIERDKKV

SEQ ID NO: 2601309 - protein, 19 aa, Entamoeba histolytica
VFFFSYFWCFYFFNLWFIP

SEQ ID NO: 2601310 - protein, 26 aa, Entamoeba histolytica
VFGLLTLLYPFIWQGVLIPFVPVQLQ

SEQ ID NO: 2601311 - protein, 22 aa, Entamoeba histolytica
VFIDLIFIVPLVGVLLFFIGAV

SEQ ID NO: 2601312 - protein, 19 aa, Entamoeba histolytica
VFNYLMYLLKEIFNFIVIV

SEQ ID NO: 2601313 - protein, 18 aa, Entamoeba histolytica
VFPFCYFIYYLFSITNDA

SEQ ID NO: 2601314 - protein, 24 aa, Entamoeba histolytica
VFSWQFWWKLVVIILLTSIPFIAK

SEQ ID NO: 2601315 - protein, 20 aa, Entamoeba histolytica
VFVWKVFYTSLIWVLKNIDK

SEQ ID NO: 2601316 - protein, 21 aa, Entamoeba histolytica
VFYYKIFAYLYYLVGNLASLV

SEQ ID NO: 2601317 - protein, 19 aa, Entamoeba histolytica
VGCFLFAWLSFISIILFIF

SEQ ID NO: 2601318 - protein, 22 aa, Entamoeba histolytica
VGEIFCFLFFGFSLLPCFDKIL

SEQ ID NO: 2601319 - protein, 17 aa, Entamoeba histolytica
VGIGLLCGLIVIIFIVI

SEQ ID NO: 2601320 - protein, 31 aa, Entamoeba histolytica
VGIIIVIIIILFIVFIVVARMFLLRRKNNKV

SEQ ID NO: 2601321 - protein, 19 aa, Entamoeba histolytica
VGILINIILILPLLLFIWR

SEQ ID NO: 2601322 - protein, 25 aa, Entamoeba histolytica
VGILLILAIVLLAFIIYRKCTSKND

SEQ ID NO: 2601323 - protein, 20 aa, Entamoeba histolytica
VHFSLYILTLFILIGFIIGE

SEQ ID NO: 2601324 - protein, 17 aa, Entamoeba histolytica
VHNFLFDLALEFGFFFD

SEQ ID NO: 2601325 - protein, 25 aa, Entamoeba histolytica
VHSKTPMWLILLIAFLSFDNIVYVF

SEQ ID NO: 2601326 - protein, 19 aa, Entamoeba histolytica
VIEFYMFFINALLPLTQCF

SEQ ID NO: 2601327 - protein, 18 aa, Entamoeba histolytica
VIFFIVFFILFYIANRHS

SEQ ID NO: 2601328 - protein, 24 aa, Entamoeba histolytica
VIFSLPEFPFMWGYCWFTTILSYL

SEQ ID NO: 2601329 - protein, 17 aa, Entamoeba histolytica
VIHTHMYSNKHKIMYNK

SEQ ID NO: 2601330 - protein, 18 aa, Entamoeba histolytica
VIIAILLFILTRVSPRKF

SEQ ID NO: 2601331 - protein, 21 aa, Entamoeba histolytica
VIIITIIITIFYLQHKKEKKK

SEQ ID NO: 2601332 - protein, 24 aa, Entamoeba histolytica
VILIFLVLMLQFGIMLYFRFAPFI

SEQ ID NO: 2601333 - protein, 26 aa, Entamoeba histolytica
VINFILWFFYGIYQSLIFFFVFFWFI

SEQ ID NO: 2601334 - protein, 25 aa, Entamoeba histolytica
VIPFWILWSGLIVLNLFILVVTITS

SEQ ID NO: 2601335 - protein, 17 aa, Entamoeba histolytica
VITNATDIVLCMEHGIN

SEQ ID NO: 2601336 - protein, 17 aa, Entamoeba histolytica
VITSLLPVLFAKNENIC

SEQ ID NO: 2601337 - protein, 27 aa, Entamoeba histolytica
VIVKYSWFFFELIIRSLVYYLNDEINK

SEQ ID NO: 2601338 - protein, 18 aa, Entamoeba histolytica
VIYLLVTFLGVSFGLITL

SEQ ID NO: 2601339 - protein, 19 aa, Entamoeba histolytica
VKILFPKYLPLFSKIAYSV

SEQ ID NO: 2601340 - protein, 25 aa, Entamoeba histolytica
VKTWKKRWFVLKDNRLWYFASKTAE

SEQ ID NO: 2601341 - protein, 19 aa, Entamoeba histolytica
VLEFLLLFILMFVCEKSNR

SEQ ID NO: 2601342 - protein, 30 aa, Entamoeba histolytica
VLFGLWGIFLFLIIPSIIVFSVFYPSLKYP

SEQ ID NO: 2601343 - protein, 24 aa, Entamoeba histolytica
VLFLIVCIILLCIITYWAFIPIGV

SEQ ID NO: 2601344 - protein, 23 aa, Entamoeba histolytica
VLHYILDLPIIALLLTLIPPGTV

SEQ ID NO: 2601345 - protein, 25 aa, Entamoeba histolytica
VLIVLFSFAILFIIISSLIIFIVFI

SEQ ID NO: 2601346 - protein, 24 aa, Entamoeba histolytica
VLLCLFFWFLRLYSVFNWALEQHL

SEQ ID NO: 2601347 - protein, 20 aa, Entamoeba histolytica
VLLILIVFPFCYFIYYLFSI

SEQ ID NO: 2601348 - protein, 24 aa, Entamoeba histolytica
VLLNALMYVLYKRIIFSASLFISM

SEQ ID NO: 2601349 - protein, 17 aa, Entamoeba histolytica
VLSFYIMINWFFTLMEY

SEQ ID NO: 2601350 - protein, 18 aa, Entamoeba histolytica
VLTIATRTNKYLKSEIVS

SEQ ID NO: 2601351 - protein, 28 aa, Entamoeba histolytica
VLVLVVVAVVFIVYIIHVYIVRKRNLKV

SEQ ID NO: 2601352 - protein, 21 aa, Entamoeba histolytica
VLVLYWFAFPYNFMNYRVDGV

SEQ ID NO: 2601353 - protein, 17 aa, Entamoeba histolytica
VLVYVLFAGILAGCVIA

SEQ ID NO: 2601354 - protein, 24 aa, Entamoeba histolytica
VMIILIIILGIFIYFIMKHKTIDI

SEQ ID NO: 2601355 - protein, 29 aa, Entamoeba histolytica
VNAPRVYFSLKKDIYWWIVDHWYCFGSLQ

SEQ ID NO: 2601356 - protein, 25 aa, Entamoeba histolytica
VNVIIFLIIILIIAIVILALYIYSF

SEQ ID NO: 2601357 - protein, 20 aa, Entamoeba histolytica
VNYPLHKYLGFSLLKLHLPA

SEQ ID NO: 2601358 - protein, 22 aa, Entamoeba histolytica
VPAWAIAVIVIVGVIIVIALIL

SEQ ID NO: 2601359 - protein, 28 aa, Entamoeba histolytica
VQQSSWKIVWIVLLISLILAAYFAFKLS

SEQ ID NO: 2601360 - protein, 20 aa, Entamoeba histolytica
VQYPWNVINILKTSTLTLSK

SEQ ID NO: 2601361 - protein, 24 aa, Entamoeba histolytica
VSFIFICIGVWLFFKIKALQPTQP

SEQ ID NO: 2601362 - protein, 23 aa, Entamoeba histolytica
VSHILLCISLFKIQIQPAINHLK

SEQ ID NO: 2601363 - protein, 24 aa, Entamoeba histolytica
VSILFDYFPFFRRLLSLLLLSQVF

SEQ ID NO: 2601364 - protein, 24 aa, Entamoeba histolytica
VSSLFVSFLIVCAVILIIAVVIRK

SEQ ID NO: 2601365 - protein, 28 aa, Entamoeba histolytica
VTFFIIIFFFVFLILSFLNIIKWICCRT

SEQ ID NO: 2601366 - protein, 19 aa, Entamoeba histolytica
VTIYFAIILTFMSLILPFT

SEQ ID NO: 2601367 - protein, 17 aa, Entamoeba histolytica
VVFICYLFFMLDSFMKQ

SEQ ID NO: 2601368 - protein, 19 aa, Entamoeba histolytica
VVGLLVLWLFIKNGSMTWE

SEQ ID NO: 2601369 - protein, 17 aa, Entamoeba histolytica
VVILFFFFSHIFYTLFI

SEQ ID NO: 2601370 - protein, 21 aa, Entamoeba histolytica
VVIWLLFIVHFIEYSYSQPIS

SEQ ID NO: 2601371 - protein, 22 aa, Entamoeba histolytica
VVKQYCMLLLPKDFDSYEIEKL

SEQ ID NO: 2601372 - protein, 25 aa, Entamoeba histolytica
VVLFLIFITIFAFIIGFIIYRKKRS

SEQ ID NO: 2601373 - protein, 30 aa, Entamoeba histolytica
VVLLLIIIAIIIVFCIWFFKKPVEDKPQTY

SEQ ID NO: 2601374 - protein, 22 aa, Entamoeba histolytica
VVWWMIMIIVIIIVIIIIITIV

SEQ ID NO: 2601375 - protein, 36 aa, Entamoeba histolytica
WGTLVIVYWIFFFILLLILILLYIKLTKKIKQEIDD

SEQ ID NO: 2601376 - protein, 17 aa, Entamoeba histolytica
WIIIGVIAAIIIIVIIV

SEQ ID NO: 2601377 - protein, 18 aa, Entamoeba histolytica
WLCWLIVSIAVFAIFLIP

SEQ ID NO: 2601378 - protein, 20 aa, Entamoeba histolytica
WLFISLYFVGIMVCGILSPL

SEQ ID NO: 2601379 - protein, 22 aa, Entamoeba histolytica
WLKQVLEYFLSLKSNLFVISPT

SEQ ID NO: 2601380 - protein, 31 aa, Entamoeba histolytica
WQIFGYVVVAILIVLILYLSFFKSKKSTAIK

SEQ ID NO: 2601381 - protein, 17 aa, Entamoeba histolytica
WRITDLVDYFIIAVTIV

SEQ ID NO: 2601382 - protein, 24 aa, Entamoeba histolytica
WRKVFMPSNARFIEKWAYPLCSQV

SEQ ID NO: 2601383 - protein, 25 aa, Entamoeba histolytica
WSIVICICLIIVIFLVVVGSILLPI

SEQ ID NO: 2601384 - protein, 28 aa, Entamoeba histolytica
WSLSQFFLWIIVFLLLHISFTISLILGY

SEQ ID NO: 2601385 - protein, 23 aa, Entamoeba histolytica
WVYVPLIVFIAFLLLNIGFGFLN

SEQ ID NO: 2601386 - protein, 19 aa, Entamoeba histolytica
WWRITDLVDYFIIAVTIVV

SEQ ID NO: 2601387 - protein, 22 aa, Entamoeba histolytica
WYFIPFFFFTQVILLSLHSLCF

SEQ ID NO: 2601388 - protein, 24 aa, Entamoeba histolytica
YAKYGSLFHLIFKQGMKKLPKEAV

SEQ ID NO: 2601389 - protein, 25 aa, Entamoeba histolytica
YANQLKRIYNLYKTHLKSEEPEKVT

SEQ ID NO: 2601390 - protein, 18 aa, Entamoeba histolytica
YASMFGCSIMRKLKSFNT

SEQ ID NO: 2601391 - protein, 19 aa, Entamoeba histolytica
YCLYLFLLVALMFRFFQAF

SEQ ID NO: 2601392 - protein, 17 aa, Entamoeba histolytica
YCYFYLDNLKYNSLYLD

SEQ ID NO: 2601393 - protein, 17 aa, Entamoeba histolytica
YDFLITELNWEEFIDQL

SEQ ID NO: 2601394 - protein, 23 aa, Entamoeba histolytica
YDFLIVHIFPLITPLISVLQRTP

SEQ ID NO: 2601395 - protein, 24 aa, Entamoeba histolytica
YDIESLYVIFFFILKNLKEETVQQ

SEQ ID NO: 2601396 - protein, 26 aa, Entamoeba histolytica
YDIESLYVIFFFILKNLRETTIQQWL

SEQ ID NO: 2601397 - protein, 20 aa, Entamoeba histolytica
YDIFQIMHKLLFGSSLVFKT

SEQ ID NO: 2601398 - protein, 23 aa, Entamoeba histolytica
YDNAIYFYVFPEELHILKYTKDF

SEQ ID NO: 2601399 - protein, 23 aa, Entamoeba histolytica
YDVFYYLAMQPWRHFVWTTCETT

SEQ ID NO: 2601400 - protein, 22 aa, Entamoeba histolytica
YDVFYYLAMQPWRHFVWTTCTT

SEQ ID NO: 2601401 - protein, 25 aa, Entamoeba histolytica
YEFLAPFLPLISWQLAHVDLSWSLT

SEQ ID NO: 2601402 - protein, 33 aa, Entamoeba histolytica
YEHIPEMIIIPFFILCLSVIYLLKEYWKIQEEN

SEQ ID NO: 2601403 - protein, 18 aa, Entamoeba histolytica
YETFIWGAPYPKETFPFP

SEQ ID NO: 2601404 - protein, 17 aa, Entamoeba histolytica
YFFVIIGEEQYPLFFGK

SEQ ID NO: 2601405 - protein, 17 aa, Entamoeba histolytica
YFIYRPIYQWIFQRVTE

SEQ ID NO: 2601406 - protein, 17 aa, Entamoeba histolytica
YFKIYFFLISGILCCLN

SEQ ID NO: 2601407 - protein, 19 aa, Entamoeba histolytica
YFPYLIRKSWPYLPLIFKE

SEQ ID NO: 2601408 - protein, 25 aa, Entamoeba histolytica
YGNEGFLLMIFYYLGCTLTLRKIKK

SEQ ID NO: 2601409 - protein, 26 aa, Entamoeba histolytica
YGNEGFLLMILYYLGCYITLSKLQKD

SEQ ID NO: 2601410 - protein, 18 aa, Entamoeba histolytica
YHPFVLHSLIRLIRFALN

SEQ ID NO: 2601411 - protein, 18 aa, Entamoeba histolytica
YICFALVLLIINSIKYSL

SEQ ID NO: 2601412 - protein, 19 aa, Entamoeba histolytica
YIFVKPTTSLWWVSATTFI

SEQ ID NO: 2601413 - protein, 22 aa, Entamoeba histolytica
YIGIIFFFYFLAQTLVMVLMSL

SEQ ID NO: 2601414 - protein, 18 aa, Entamoeba histolytica
YIIAIIIILLIVIISVIA

SEQ ID NO: 2601415 - protein, 32 aa, Entamoeba histolytica
YIIGGVICGILLLLLIIIGVAIIVFFVTRKKK

SEQ ID NO: 2601416 - protein, 20 aa, Entamoeba histolytica
YIIPFPYSLFIPKSYKEIAA

SEQ ID NO: 2601417 - protein, 18 aa, Entamoeba histolytica
YIIWGYFIVTTLCVYLSL

SEQ ID NO: 2601418 - protein, 24 aa, Entamoeba histolytica
YILHSIPFLIFYPTLYLAIAYPML

SEQ ID NO: 2601419 - protein, 17 aa, Entamoeba histolytica
YILLFSKSQGFHCSPGC

SEQ ID NO: 2601420 - protein, 20 aa, Entamoeba histolytica
YIPHLCALSLLFYAPTTVHG

SEQ ID NO: 2601421 - protein, 17 aa, Entamoeba histolytica
YIQLFLPIILLMGKTAL

SEQ ID NO: 2601422 - protein, 25 aa, Entamoeba histolytica
YISSISFCWWLLNGILSSITIFFIS

SEQ ID NO: 2601423 - protein, 34 aa, Entamoeba histolytica
YIVFVLYCWYYSYSLILILLPLFIYLISFIIETD

SEQ ID NO: 2601424 - protein, 24 aa, Entamoeba histolytica
YIVKLICFIILYFVLRMMYNLFYF

SEQ ID NO: 2601425 - protein, 25 aa, Entamoeba histolytica
YKNASFFLILFWYSFFNGQSGMSMY

SEQ ID NO: 2601426 - protein, 23 aa, Entamoeba histolytica
YKNQLIHSFPLLMKLMLQLFNNE

SEQ ID NO: 2601427 - protein, 18 aa, Entamoeba histolytica
YKSIFKWGLILALVNAIT

SEQ ID NO: 2601428 - protein, 33 aa, Entamoeba histolytica
YKSWSLILLWSSLILFEFLLIVLSIISFFSLVG

SEQ ID NO: 2601429 - protein, 19 aa, Entamoeba histolytica
YKVKLLIKLVLLISIIVSI

SEQ ID NO: 2601430 - protein, 24 aa, Entamoeba histolytica
YKWKEMFLNFDLIQKLWKITGIIM

SEQ ID NO: 2601431 - protein, 25 aa, Entamoeba histolytica
YLKQYWPEILWRWYVKKGMYEEAIK

SEQ ID NO: 2601432 - protein, 18 aa, Entamoeba histolytica
YLLFFSIIISGITIFTIK

SEQ ID NO: 2601433 - protein, 25 aa, Entamoeba histolytica
YLLILLWISFFIYIMYIIALTMMSF

SEQ ID NO: 2601434 - protein, 34 aa, Entamoeba histolytica
YLNIKLFIIIPTHNDFLFISLLQNGTTTLDNTLI

SEQ ID NO: 2601435 - protein, 18 aa, Entamoeba histolytica
YLRLPYKLKIRMLFDTAR

SEQ ID NO: 2601436 - protein, 24 aa, Entamoeba histolytica
YLWESYFILFIPLIIILLGTRFTS

SEQ ID NO: 2601437 - protein, 18 aa, Entamoeba histolytica
YMQLIGYLLLIGMELYDK

SEQ ID NO: 2601438 - protein, 17 aa, Entamoeba histolytica
YNEQFIYMLLHSLIRNI

SEQ ID NO: 2601439 - protein, 20 aa, Entamoeba histolytica
YNILRFWGMYSLYPSFIPSS

SEQ ID NO: 2601440 - protein, 23 aa, Entamoeba histolytica
YNLFPMIFFGLILFVLNSFKAAN

SEQ ID NO: 2601441 - protein, 18 aa, Entamoeba histolytica
YQFLLHIALKQHKYSDAI

SEQ ID NO: 2601442 - protein, 32 aa, Entamoeba histolytica
YQKCYLFYTTIGLFLLFAYTGNILIPCDFISS

SEQ ID NO: 2601443 - protein, 25 aa, Entamoeba histolytica
YQLGILLTILFFGSTFKFISAPCGY

SEQ ID NO: 2601444 - protein, 26 aa, Entamoeba histolytica
YQLRPRYLFIPFIKLFDSLVFKKIKE

SEQ ID NO: 2601445 - protein, 24 aa, Entamoeba histolytica
YQSLIFFFVFFWFISPSDITGKDG

SEQ ID NO: 2601446 - protein, 20 aa, Entamoeba histolytica
YRGYLCILFVAFSHFVYVLD

SEQ ID NO: 2601447 - protein, 20 aa, Entamoeba histolytica
YRYFFLFLFYLWISMLIVDC

SEQ ID NO: 2601448 - protein, 24 aa, Entamoeba histolytica
YSGPFMFFLHYFLLLISCFLNFIW

SEQ ID NO: 2601449 - protein, 19 aa, Entamoeba histolytica
YSIPLIILYISYKTWYSFL

SEQ ID NO: 2601450 - protein, 22 aa, Entamoeba histolytica
YSWSSYLFVLQAILILGMSLVQ

SEQ ID NO: 2601451 - protein, 18 aa, Entamoeba histolytica
YTKFLWKFKWIILTVVIL

SEQ ID NO: 2601452 - protein, 22 aa, Entamoeba histolytica
YTYCLLHFFLYIGMMFCNYNYF

SEQ ID NO: 2601453 - protein, 19 aa, Entamoeba histolytica
YVFVLCFDYLYISNSTKLP

SEQ ID NO: 2601454 - protein, 24 aa, Entamoeba histolytica
YVGLICWVICVIVILVMSCVVIYL

SEQ ID NO: 2601455 - protein, 23 aa, Entamoeba histolytica
YVLPFFLGLFLTATAFFGAYTFA

SEQ ID NO: 2601456 - protein, 23 aa, Entamoeba histolytica
YVTYIIMGILLCVLIITSLFVAF

SEQ ID NO: 2601457 - protein, 20 aa, Entamoeba histolytica
YVYQYLLKQFTLLSEFLFDD

SEQ ID NO: 2601458 - protein, 23 aa, Entamoeba histolytica
YWGWLFTLKQPLFYLMIIISMVI

SEQ ID NO: 2601459 - protein, 17 aa, Entamoeba histolytica
YWHYFRAGGFIGLILCL

SEQ ID NO: 2601460 - protein, 24 aa, Entamoeba histolytica
YWINVWYVYIFYYFALVFAFFFPS

SEQ ID NO: 2601461 - protein, 21 aa, Entamoeba histolytica
YYFQSFLITLYIKLSYYESIY

SEQ ID NO: 2601462 - protein, 17 aa, Entamoeba histolytica
YYIVITTPYLLIFESEL

SEQ ID NO: 2601463 - protein, 37 aa, Entamoeba histolytica
YYNKKLIIFFLWFTFFFFLFIFYYKSILVFFFSYFWC

SEQ ID NO: 2601464 - protein, 26 aa, Entamoeba histolytica
YYSIEWIIILIILTITIIILLSIVTV

SEQ ID NO: 2601465 - protein, 20 aa, Entamoeba histolytica
YYWWSFIPVFLFNQFKYFIN

SEQ ID NO: 2601466 - protein, 20 aa, Entamoeba histolytica
YYYDFMYAVLPFIPDIVDNE

SEQ ID NO: 2601467 - protein, 5 aa, Entamoeba histolytica
EPTAA

SEQ ID NO: 2601468 - protein, 5 aa, Entamoeba histolytica
KKTKY

SEQ ID NO: 2601469 - protein, 8 aa, Entamoeba histolytica
KQGTGKTT

SEQ ID NO: 2601470 - protein, 8 aa, Entamoeba histolytica
NAGEDETF

SEQ ID NO: 2601471 - protein, 7 aa, Entamoeba histolytica
PTNMKSA

SEQ ID NO: 2601472 - protein, 10 aa, Entamoeba histolytica
SEIKEGNKIQ

SEQ ID NO: 2601473 - protein, 5 aa, Entamoeba histolytica
SEKEL

SEQ ID NO: 2601474 - protein, 10 aa, Entamoeba histolytica
ESQEKAFERK

SEQ ID NO: 2601475 - protein, 8 aa, Entamoeba histolytica
GPPGTGKT

SEQ ID NO: 2601476 - protein, 8 aa, Entamoeba histolytica
IKPTPEQL

SEQ ID NO: 2601477 - protein, 10 aa, Entamoeba histolytica
KRYPGSEVEM

SEQ ID NO: 2601478 - protein, 5 aa, Entamoeba histolytica
MNEEI

SEQ ID NO: 2601479 - protein, 6 aa, Entamoeba histolytica
NAATEV

SEQ ID NO: 2601480 - protein, 9 aa, Entamoeba histolytica
NERLRKELE

SEQ ID NO: 2601481 - protein, 4 aa, Entamoeba histolytica
SKEN

SEQ ID NO: 2601482 - protein, 10 aa, Entamoeba histolytica
TGTGGKATED

SEQ ID NO: 2601483 - protein, 6 aa, Entamoeba histolytica
AGQERF

SEQ ID NO: 2601484 - protein, 8 aa, Entamoeba histolytica
AKIDKSSI

SEQ ID NO: 2601485 - protein, 5 aa, Entamoeba histolytica
ASFKT

SEQ ID NO: 2601486 - protein, 13 aa, Entamoeba histolytica
ERAKRTLSSASVA

SEQ ID NO: 2601487 - protein, 17 aa, Entamoeba histolytica
GAPPGYVGYEEGGQLTE

SEQ ID NO: 2601488 - protein, 4 aa, Entamoeba histolytica
GAVG

SEQ ID NO: 2601489 - protein, 12 aa, Entamoeba histolytica
GRLTDGRGRTVD

SEQ ID NO: 2601490 - protein, 4 aa, Entamoeba histolytica
KAHP

SEQ ID NO: 2601491 - protein, 15 aa, Entamoeba histolytica
KATNGDTHLGGEDFD

SEQ ID NO: 2601492 - protein, 8 aa, Entamoeba histolytica
KQKTMGDT

SEQ ID NO: 2601493 - protein, 19 aa, Entamoeba histolytica
KSKIKIGYEDGKIEVKITD

SEQ ID NO: 2601494 - protein, 4 aa, Entamoeba histolytica
PTTQ

SEQ ID NO: 2601495 - protein, 4 aa, Entamoeba histolytica
QARE

SEQ ID NO: 2601496 - protein, 8 aa, Entamoeba histolytica
RTKRTPPI

SEQ ID NO: 2601497 - protein, 4 aa, Entamoeba histolytica
TAGG

SEQ ID NO: 2601498 - protein, 5 aa, Entamoeba histolytica
ADNQA

SEQ ID NO: 2601499 - protein, 9 aa, Entamoeba histolytica
DKKSSGEKK

SEQ ID NO: 2601500 - protein, 9 aa, Entamoeba histolytica
EKMKETNTY

SEQ ID NO: 2601501 - protein, 13 aa, Entamoeba histolytica
ERRVTRKNKKLGE

SEQ ID NO: 2601502 - protein, 9 aa, Entamoeba histolytica
IPPAKKGVA

SEQ ID NO: 2601503 - protein, 10 aa, Entamoeba histolytica
ITTNEEIDEM

SEQ ID NO: 2601504 - protein, 15 aa, Entamoeba histolytica
KGQSVETKEAESQYE

SEQ ID NO: 2601505 - protein, 17 aa, Entamoeba histolytica
KYGNDLTAQAESGKMDP

SEQ ID NO: 2601506 - protein, 15 aa, Entamoeba histolytica
NGKEPNKSINPDEAV

SEQ ID NO: 2601507 - protein, 11 aa, Entamoeba histolytica
NSTIPAKKSEI

SEQ ID NO: 2601508 - protein, 7 aa, Entamoeba histolytica
QDEAVTA

SEQ ID NO: 2601509 - protein, 6 aa, Entamoeba histolytica
SESQIQ

SEQ ID NO: 2601510 - protein, 12 aa, Entamoeba histolytica
SRGGLGNEKRPI

SEQ ID NO: 2601511 - protein, 4 aa, Entamoeba histolytica
STRI

SEQ ID NO: 2601512 - protein, 8 aa, Entamoeba histolytica
YGSEIQSG

SEQ ID NO: 2601513 - protein, 9 aa, Entamoeba histolytica
ADKSKGGVG

SEQ ID NO: 2601514 - protein, 14 aa, Entamoeba histolytica
DDVSQLSTLNTTNM

SEQ ID NO: 2601515 - protein, 10 aa, Entamoeba histolytica
DGIGRSTEET

SEQ ID NO: 2601516 - protein, 4 aa, Entamoeba histolytica
EASM

SEQ ID NO: 2601517 - protein, 5 aa, Entamoeba histolytica
EDYRG

SEQ ID NO: 2601518 - protein, 7 aa, Entamoeba histolytica
EKDPAFE

SEQ ID NO: 2601519 - protein, 11 aa, Entamoeba histolytica
EKEMSENKEKL

SEQ ID NO: 2601520 - protein, 10 aa, Entamoeba histolytica
ELKKQNKETT

SEQ ID NO: 2601521 - protein, 7 aa, Entamoeba histolytica
EPGVGKT

SEQ ID NO: 2601522 - protein, 7 aa, Entamoeba histolytica
ERRETQI

SEQ ID NO: 2601523 - protein, 11 aa, Entamoeba histolytica
EVKETDEEHKK

SEQ ID NO: 2601524 - protein, 31 aa, Entamoeba histolytica
GAPELPPCPTTPEPINEEIKPKKNKMNNKEK

SEQ ID NO: 2601525 - protein, 6 aa, Entamoeba histolytica
GDVPSN

SEQ ID NO: 2601526 - protein, 15 aa, Entamoeba histolytica
GTDSSKTFKNTSTDH

SEQ ID NO: 2601527 - protein, 10 aa, Entamoeba histolytica
HKAESTKDLE

SEQ ID NO: 2601528 - protein, 6 aa, Entamoeba histolytica
IPTSVS

SEQ ID NO: 2601529 - protein, 14 aa, Entamoeba histolytica
KEGEEHAAEDKRKE

SEQ ID NO: 2601530 - protein, 4 aa, Entamoeba histolytica
KYEN

SEQ ID NO: 2601531 - protein, 20 aa, Entamoeba histolytica
LGRTKRGKTTKQSSHNEPNA

SEQ ID NO: 2601532 - protein, 7 aa, Entamoeba histolytica
MNQSEKA

SEQ ID NO: 2601533 - protein, 11 aa, Entamoeba histolytica
NDQGNRTTPSY

SEQ ID NO: 2601534 - protein, 10 aa, Entamoeba histolytica
QKNSQPEEID

SEQ ID NO: 2601535 - protein, 6 aa, Entamoeba histolytica
SEPSVE

SEQ ID NO: 2601536 - protein, 12 aa, Entamoeba histolytica
YEKEKGGSEEMK

SEQ ID NO: 2601537 - protein, 11 aa, Entamoeba histolytica
YEKSKDEKLND

SEQ ID NO: 2601538 - protein, 25 aa, Entamoeba histolytica
AEDKSSGKKNKITITNDKGRLSKED

SEQ ID NO: 2601539 - protein, 20 aa, Entamoeba histolytica
AEKYKAEDEENKARIEAKNQ

SEQ ID NO: 2601540 - protein, 6 aa, Entamoeba histolytica
AEPTSE

SEQ ID NO: 2601541 - protein, 10 aa, Entamoeba histolytica
AGATGEGAMD

SEQ ID NO: 2601542 - protein, 8 aa, Entamoeba histolytica
APAPRGVP

SEQ ID NO: 2601543 - protein, 4 aa, Entamoeba histolytica
APEE

SEQ ID NO: 2601544 - protein, 12 aa, Entamoeba histolytica
APMNPKANREKM

SEQ ID NO: 2601545 - protein, 6 aa, Entamoeba histolytica
APPERK

SEQ ID NO: 2601546 - protein, 12 aa, Entamoeba histolytica
AQIGKEAPEFKA

SEQ ID NO: 2601547 - protein, 10 aa, Entamoeba histolytica
ASGENVVGAT

SEQ ID NO: 2601548 - protein, 7 aa, Entamoeba histolytica
ASGRTTG

SEQ ID NO: 2601549 - protein, 6 aa, Entamoeba histolytica
DGHDKP

SEQ ID NO: 2601550 - protein, 6 aa, Entamoeba histolytica
DSHHKI

SEQ ID NO: 2601551 - protein, 14 aa, Entamoeba histolytica
DSQRQATKDAGTIA

SEQ ID NO: 2601552 - protein, 15 aa, Entamoeba histolytica
EEYDESGPAIVHRKC

SEQ ID NO: 2601553 - protein, 6 aa, Entamoeba histolytica
ENYPKT

SEQ ID NO: 2601554 - protein, 11 aa, Entamoeba histolytica
ETTGQVDEQVK

SEQ ID NO: 2601555 - protein, 9 aa, Entamoeba histolytica
FAGDDAPRA

SEQ ID NO: 2601556 - protein, 7 aa, Entamoeba histolytica
FTTTAER

SEQ ID NO: 2601557 - protein, 8 aa, Entamoeba histolytica
GGTSMYPG

SEQ ID NO: 2601558 - protein, 8 aa, Entamoeba histolytica
GKPARSLK

SEQ ID NO: 2601559 - protein, 16 aa, Entamoeba histolytica
GQKDAYVGDEAQSKRG

SEQ ID NO: 2601560 - protein, 5 aa, Entamoeba histolytica
HETTY

SEQ ID NO: 2601561 - protein, 8 aa, Entamoeba histolytica
IDDNETRI

SEQ ID NO: 2601562 - protein, 20 aa, Entamoeba histolytica
IKEMGDKISEEDKKKAEEII

SEQ ID NO: 2601563 - protein, 15 aa, Entamoeba histolytica
ISETIRGEKGFGSTG

SEQ ID NO: 2601564 - protein, 7 aa, Entamoeba histolytica
KATSQQV

SEQ ID NO: 2601565 - protein, 9 aa, Entamoeba histolytica
KRYSSKDRF

SEQ ID NO: 2601566 - protein, 8 aa, Entamoeba histolytica
KTTDGITT

SEQ ID NO: 2601567 - protein, 11 aa, Entamoeba histolytica
KVITSEDENEI

SEQ ID NO: 2601568 - protein, 4 aa, Entamoeba histolytica
KVSL

SEQ ID NO: 2601569 - protein, 23 aa, Entamoeba histolytica
LDKGTGKKTGIQVKSNGGLNEEE

SEQ ID NO: 2601570 - protein, 13 aa, Entamoeba histolytica
LGEETSNSSAKLY

SEQ ID NO: 2601571 - protein, 22 aa, Entamoeba histolytica
NEEMQKAASSSELEKSYELPDG

SEQ ID NO: 2601572 - protein, 6 aa, Entamoeba histolytica
NEPTAA

SEQ ID NO: 2601573 - protein, 5 aa, Entamoeba histolytica
NGSGM

SEQ ID NO: 2601574 - protein, 4 aa, Entamoeba histolytica
PSGK

SEQ ID NO: 2601575 - protein, 9 aa, Entamoeba histolytica
PVQNPPPVE

SEQ ID NO: 2601576 - protein, 8 aa, Entamoeba histolytica
QLKNNKNK

SEQ ID NO: 2601577 - protein, 6 aa, Entamoeba histolytica
QYRGQF

SEQ ID NO: 2601578 - protein, 4 aa, Entamoeba histolytica
RNIP

SEQ ID NO: 2601579 - protein, 6 aa, Entamoeba histolytica
RTKNNP

SEQ ID NO: 2601580 - protein, 7 aa, Entamoeba histolytica
SAEDIQK

SEQ ID NO: 2601581 - protein, 8 aa, Entamoeba histolytica
SDKSYEEL

SEQ ID NO: 2601582 - protein, 4 aa, Entamoeba histolytica
SEIG

SEQ ID NO: 2601583 - protein, 7 aa, Entamoeba histolytica
SGDGVSH

SEQ ID NO: 2601584 - protein, 4 aa, Entamoeba histolytica
SIND

SEQ ID NO: 2601585 - protein, 10 aa, Entamoeba histolytica
SKMKKEIQEG

SEQ ID NO: 2601586 - protein, 6 aa, Entamoeba histolytica
SNPFST

SEQ ID NO: 2601587 - protein, 6 aa, Entamoeba histolytica
SRGGSI

SEQ ID NO: 2601588 - protein, 5 aa, Entamoeba histolytica
SVNEI

SEQ ID NO: 2601589 - protein, 9 aa, Entamoeba histolytica
TPGFGDTRG

SEQ ID NO: 2601590 - protein, 9 aa, Entamoeba histolytica
TSKENNEET

SEQ ID NO: 2601591 - protein, 21 aa, Entamoeba histolytica
TTIPTSVSKEFTTSMDNQQEV

SEQ ID NO: 2601592 - protein, 5 aa, Entamoeba histolytica
VKESK

SEQ ID NO: 2601593 - protein, 11 aa, Entamoeba histolytica
AIYDDNTEDEF

SEQ ID NO: 2601594 - protein, 6 aa, Entamoeba histolytica
APRSSL

SEQ ID NO: 2601595 - protein, 4 aa, Entamoeba histolytica
APSY

SEQ ID NO: 2601596 - protein, 12 aa, Entamoeba histolytica
ATNGDTMLGGED

SEQ ID NO: 2601597 - protein, 5 aa, Entamoeba histolytica
ATQLT

SEQ ID NO: 2601598 - protein, 8 aa, Entamoeba histolytica
DAAKNQIG

SEQ ID NO: 2601599 - protein, 4 aa, Entamoeba histolytica
DEIF

SEQ ID NO: 2601600 - protein, 8 aa, Entamoeba histolytica
DEKDRAER

SEQ ID NO: 2601601 - protein, 22 aa, Entamoeba histolytica
DNNQNGSKEEYEKKKEEVEKEI

SEQ ID NO: 2601602 - protein, 7 aa, Entamoeba histolytica
EAEKRLA

SEQ ID NO: 2601603 - protein, 7 aa, Entamoeba histolytica
EKEEMNE

SEQ ID NO: 2601604 - protein, 6 aa, Entamoeba histolytica
EKYPEL

SEQ ID NO: 2601605 - protein, 9 aa, Entamoeba histolytica
ETGSGKTTL

SEQ ID NO: 2601606 - protein, 5 aa, Entamoeba histolytica
EYSER

SEQ ID NO: 2601607 - protein, 7 aa, Entamoeba histolytica
GADRPFH

SEQ ID NO: 2601608 - protein, 4 aa, Entamoeba histolytica
GDIP

SEQ ID NO: 2601609 - protein, 5 aa, Entamoeba histolytica
IEGKK

SEQ ID NO: 2601610 - protein, 4 aa, Entamoeba histolytica
IPTS

SEQ ID NO: 2601611 - protein, 8 aa, Entamoeba histolytica
ISRNTTIK

SEQ ID NO: 2601612 - protein, 13 aa, Entamoeba histolytica
KEINEKKEEREKL

SEQ ID NO: 2601613 - protein, 6 aa, Entamoeba histolytica
KETAET

SEQ ID NO: 2601614 - protein, 7 aa, Entamoeba histolytica
KEYNVGD

SEQ ID NO: 2601615 - protein, 5 aa, Entamoeba histolytica
KGTEV

SEQ ID NO: 2601616 - protein, 6 aa, Entamoeba histolytica
KGYYSK

SEQ ID NO: 2601617 - protein, 12 aa, Entamoeba histolytica
KKDAEAKLGKRV

SEQ ID NO: 2601618 - protein, 5 aa, Entamoeba histolytica
KQQGF

SEQ ID NO: 2601619 - protein, 7 aa, Entamoeba histolytica
KRFTPEE

SEQ ID NO: 2601620 - protein, 6 aa, Entamoeba histolytica
KSTTSS

SEQ ID NO: 2601621 - protein, 8 aa, Entamoeba histolytica
KTYSPSEI

SEQ ID NO: 2601622 - protein, 6 aa, Entamoeba histolytica
LNGKGV

SEQ ID NO: 2601623 - protein, 20 aa, Entamoeba histolytica
LTSVTKTLKESNEENTKCVL

SEQ ID NO: 2601624 - protein, 9 aa, Entamoeba histolytica
NEENQKKRI

SEQ ID NO: 2601625 - protein, 13 aa, Entamoeba histolytica
NEIPNDITKTASK

SEQ ID NO: 2601626 - protein, 8 aa, Entamoeba histolytica
NKAQEETI

SEQ ID NO: 2601627 - protein, 13 aa, Entamoeba histolytica
NSIEDEEEEDEIG

SEQ ID NO: 2601628 - protein, 13 aa, Entamoeba histolytica
PGITARGNDYKKE

SEQ ID NO: 2601629 - protein, 19 aa, Entamoeba histolytica
PGKDTIEPTPDGIKKYLTA

SEQ ID NO: 2601630 - protein, 9 aa, Entamoeba histolytica
QTGSGKTTL

SEQ ID NO: 2601631 - protein, 13 aa, Entamoeba histolytica
RSGLTPKPTAKNF

SEQ ID NO: 2601632 - protein, 5 aa, Entamoeba histolytica
SDEIN

SEQ ID NO: 2601633 - protein, 8 aa, Entamoeba histolytica
SEEDGRCG

SEQ ID NO: 2601634 - protein, 9 aa, Entamoeba histolytica
SGAKFGGNV

SEQ ID NO: 2601635 - protein, 6 aa, Entamoeba histolytica
SGVGKT

SEQ ID NO: 2601636 - protein, 9 aa, Entamoeba histolytica
SGVGKTELA

SEQ ID NO: 2601637 - protein, 9 aa, Entamoeba histolytica
TAANSSGTV

SEQ ID NO: 2601638 - protein, 11 aa, Entamoeba histolytica
TMTEKEREEIT

SEQ ID NO: 2601639 - protein, 9 aa, Entamoeba histolytica
YDSYDYPHS

SEQ ID NO: 2601640 - protein, 11 aa, Entamoeba histolytica
YKKDISGNARA

SEQ ID NO: 2601641 - protein, 8 aa, Entamoeba histolytica
YKTTGNIT

SEQ ID NO: 2601642 - protein, 10 aa, Entamoeba histolytica
YSDGASAKGV

SEQ ID NO: 2601643 - protein, 7 aa, Entamoeba histolytica
ATPDGVA

SEQ ID NO: 2601644 - protein, 10 aa, Entamoeba histolytica
CFSGSNDLQE

SEQ ID NO: 2601645 - protein, 13 aa, Entamoeba histolytica
CQKGVEKDPDNSI

SEQ ID NO: 2601646 - protein, 14 aa, Entamoeba histolytica
DAQRQATKDAGTLA

SEQ ID NO: 2601647 - protein, 9 aa, Entamoeba histolytica
DDKSNVDEI

SEQ ID NO: 2601648 - protein, 9 aa, Entamoeba histolytica
DPEETDDLL

SEQ ID NO: 2601649 - protein, 6 aa, Entamoeba histolytica
DPTIQN

SEQ ID NO: 2601650 - protein, 5 aa, Entamoeba histolytica
DSSLN

SEQ ID NO: 2601651 - protein, 18 aa, Entamoeba histolytica
EEMKDEEFKEGVEDEANI

SEQ ID NO: 2601652 - protein, 7 aa, Entamoeba histolytica
EKGFNND

SEQ ID NO: 2601653 - protein, 7 aa, Entamoeba histolytica
EPPKSIP

SEQ ID NO: 2601654 - protein, 8 aa, Entamoeba histolytica
EQATTIGR

SEQ ID NO: 2601655 - protein, 5 aa, Entamoeba histolytica
ESIPR

SEQ ID NO: 2601656 - protein, 8 aa, Entamoeba histolytica
FQQRDSTQ

SEQ ID NO: 2601657 - protein, 13 aa, Entamoeba histolytica
GEPPFQSNSREEV

SEQ ID NO: 2601658 - protein, 13 aa, Entamoeba histolytica
GKKPSKNVNPDEA

SEQ ID NO: 2601659 - protein, 7 aa, Entamoeba histolytica
GNGIERN

SEQ ID NO: 2601660 - protein, 6 aa, Entamoeba histolytica
GNNTKE

SEQ ID NO: 2601661 - protein, 10 aa, Entamoeba histolytica
GPPGTGKTTV

SEQ ID NO: 2601662 - protein, 5 aa, Entamoeba histolytica
GPVKI

SEQ ID NO: 2601663 - protein, 8 aa, Entamoeba histolytica
GRFDERRA

SEQ ID NO: 2601664 - protein, 6 aa, Entamoeba histolytica
GTGKTT

SEQ ID NO: 2601665 - protein, 8 aa, Entamoeba histolytica
GVGKTTTI

SEQ ID NO: 2601666 - protein, 5 aa, Entamoeba histolytica
IDGEQ

SEQ ID NO: 2601667 - protein, 11 aa, Entamoeba histolytica
IDQDTADDKDI

SEQ ID NO: 2601668 - protein, 5 aa, Entamoeba histolytica
IEPKY

SEQ ID NO: 2601669 - protein, 9 aa, Entamoeba histolytica
IKGGTKEYD

SEQ ID NO: 2601670 - protein, 15 aa, Entamoeba histolytica
IKPGESTTVSTSNGE

SEQ ID NO: 2601671 - protein, 10 aa, Entamoeba histolytica
IPTRGTEQSV

SEQ ID NO: 2601672 - protein, 8 aa, Entamoeba histolytica
ITSSRGKT

SEQ ID NO: 2601673 - protein, 5 aa, Entamoeba histolytica
KATTE

SEQ ID NO: 2601674 - protein, 7 aa, Entamoeba histolytica
KECQEKE

SEQ ID NO: 2601675 - protein, 8 aa, Entamoeba histolytica
KKEEIKEG

SEQ ID NO: 2601676 - protein, 7 aa, Entamoeba histolytica
KLRKKDI

SEQ ID NO: 2601677 - protein, 17 aa, Entamoeba histolytica
KPEDVGEVEMKDEEETI

SEQ ID NO: 2601678 - protein, 8 aa, Entamoeba histolytica
KPLGQGKF

SEQ ID NO: 2601679 - protein, 7 aa, Entamoeba histolytica
KSIESEK

SEQ ID NO: 2601680 - protein, 4 aa, Entamoeba histolytica
KTVD

SEQ ID NO: 2601681 - protein, 8 aa, Entamoeba histolytica
NGRERKEL

SEQ ID NO: 2601682 - protein, 5 aa, Entamoeba histolytica
NITEI

SEQ ID NO: 2601683 - protein, 7 aa, Entamoeba histolytica
NSRLSRS

SEQ ID NO: 2601684 - protein, 6 aa, Entamoeba histolytica
PGGETI

SEQ ID NO: 2601685 - protein, 4 aa, Entamoeba histolytica
PGPY

SEQ ID NO: 2601686 - protein, 9 aa, Entamoeba histolytica
QNYYGPTRV

SEQ ID NO: 2601687 - protein, 13 aa, Entamoeba histolytica
RGSWNDNRNAGAK

SEQ ID NO: 2601688 - protein, 13 aa, Entamoeba histolytica
RKEQKRRNEEKDI

SEQ ID NO: 2601689 - protein, 7 aa, Entamoeba histolytica
RNGIDKA

SEQ ID NO: 2601690 - protein, 5 aa, Entamoeba histolytica
RQEKQ

SEQ ID NO: 2601691 - protein, 7 aa, Entamoeba histolytica
SKITDNM

SEQ ID NO: 2601692 - protein, 7 aa, Entamoeba histolytica
SPDDDKI

SEQ ID NO: 2601693 - protein, 5 aa, Entamoeba histolytica
SSNNA

SEQ ID NO: 2601694 - protein, 6 aa, Entamoeba histolytica
SYNEYD

SEQ ID NO: 2601695 - protein, 11 aa, Entamoeba histolytica
TGKSSSEKNQF

SEQ ID NO: 2601696 - protein, 4 aa, Entamoeba histolytica
VHPG

SEQ ID NO: 2601697 - protein, 24 aa, Entamoeba histolytica
VNSPLKKEIESKPKKDDEKKPTQL

SEQ ID NO: 2601698 - protein, 6 aa, Entamoeba histolytica
VPAPIN

SEQ ID NO: 2601699 - protein, 8 aa, Entamoeba histolytica
VQSSPNQS

SEQ ID NO: 2601700 - protein, 7 aa, Entamoeba histolytica
YDSPEND

SEQ ID NO: 2601701 - protein, 11 aa, Entamoeba histolytica
YEEQIEKKQNK

SEQ ID NO: 2601702 - protein, 4 aa, Entamoeba histolytica
YQEA

SEQ ID NO: 2601703 - protein, 11 aa, Entamoeba histolytica
YYDNPENEREV

SEQ ID NO: 2601704 - protein, 18 aa, Entamoeba histolytica
YYESREDNAKSRRHRNTQ

SEQ ID NO: 2601705 - protein, 9 aa, Entamoeba histolytica
AAQSLEPET

SEQ ID NO: 2601706 - protein, 7 aa, Entamoeba histolytica
AEGTGIT

SEQ ID NO: 2601707 - protein, 6 aa, Entamoeba histolytica
AERNGI

SEQ ID NO: 2601708 - protein, 8 aa, Entamoeba histolytica
AGQEEYDR

SEQ ID NO: 2601709 - protein, 13 aa, Entamoeba histolytica
AKIQEKEGIPPDQ

SEQ ID NO: 2601710 - protein, 7 aa, Entamoeba histolytica
AKTNENI

SEQ ID NO: 2601711 - protein, 12 aa, Entamoeba histolytica
ANHGDEKSLKKV

SEQ ID NO: 2601712 - protein, 7 aa, Entamoeba histolytica
ANSGVHD

SEQ ID NO: 2601713 - protein, 11 aa, Entamoeba histolytica
ATLPTGAGDIT

SEQ ID NO: 2601714 - protein, 8 aa, Entamoeba histolytica
DENSFKPY

SEQ ID NO: 2601715 - protein, 6 aa, Entamoeba histolytica
DKGNPF

SEQ ID NO: 2601716 - protein, 17 aa, Entamoeba histolytica
DLENERQVTKEDGIEYA

SEQ ID NO: 2601717 - protein, 11 aa, Entamoeba histolytica
DSPELQPFTNE

SEQ ID NO: 2601718 - protein, 7 aa, Entamoeba histolytica
DTIKEGE

SEQ ID NO: 2601719 - protein, 5 aa, Entamoeba histolytica
DVEKQ

SEQ ID NO: 2601720 - protein, 4 aa, Entamoeba histolytica
DVND

SEQ ID NO: 2601721 - protein, 4 aa, Entamoeba histolytica
EAET

SEQ ID NO: 2601722 - protein, 13 aa, Entamoeba histolytica
EDKKLTKKEMEKR

SEQ ID NO: 2601723 - protein, 18 aa, Entamoeba histolytica
EEKPIKHNASEKEEITRE

SEQ ID NO: 2601724 - protein, 8 aa, Entamoeba histolytica
EEREPANF

SEQ ID NO: 2601725 - protein, 5 aa, Entamoeba histolytica
EETGD

SEQ ID NO: 2601726 - protein, 7 aa, Entamoeba histolytica
EGLEGTL

SEQ ID NO: 2601727 - protein, 14 aa, Entamoeba histolytica
EIDEARKVGKTGIE

SEQ ID NO: 2601728 - protein, 10 aa, Entamoeba histolytica
EINRNEIKQR

SEQ ID NO: 2601729 - protein, 16 aa, Entamoeba histolytica
ETNGKALTEISEGKKI

SEQ ID NO: 2601730 - protein, 11 aa, Entamoeba histolytica
ETPNNNDNKSI

SEQ ID NO: 2601731 - protein, 4 aa, Entamoeba histolytica
EVGD

SEQ ID NO: 2601732 - protein, 7 aa, Entamoeba histolytica
FNPTRKR

SEQ ID NO: 2601733 - protein, 5 aa, Entamoeba histolytica
GEDLP

SEQ ID NO: 2601734 - protein, 7 aa, Entamoeba histolytica
GFQGNEK

SEQ ID NO: 2601735 - protein, 24 aa, Entamoeba histolytica
GGTHSTDPKIRNACGGTAYGKPIT

SEQ ID NO: 2601736 - protein, 9 aa, Entamoeba histolytica
GKIRTDTRY

SEQ ID NO: 2601737 - protein, 12 aa, Entamoeba histolytica
GKPCGYTRRYGK

SEQ ID NO: 2601738 - protein, 4 aa, Entamoeba histolytica
GTTN

SEQ ID NO: 2601739 - protein, 9 aa, Entamoeba histolytica
GVSSSEKMM

SEQ ID NO: 2601740 - protein, 10 aa, Entamoeba histolytica
GYQPNSESGA

SEQ ID NO: 2601741 - protein, 16 aa, Entamoeba histolytica
HSDNTNINLSSQSKIR

SEQ ID NO: 2601742 - protein, 10 aa, Entamoeba histolytica
IDSSDPPCPV

SEQ ID NO: 2601743 - protein, 4 aa, Entamoeba histolytica
IEGE

SEQ ID NO: 2601744 - protein, 10 aa, Entamoeba histolytica
IENYDGDFSI

SEQ ID NO: 2601745 - protein, 12 aa, Entamoeba histolytica
IKTAGKKIAGIG

SEQ ID NO: 2601746 - protein, 15 aa, Entamoeba histolytica
IQNNEEIDKTNDDYD

SEQ ID NO: 2601747 - protein, 7 aa, Entamoeba histolytica
ISPENLN

SEQ ID NO: 2601748 - protein, 9 aa, Entamoeba histolytica
KESQKSEFE

SEQ ID NO: 2601749 - protein, 17 aa, Entamoeba histolytica
KETKRKSIQPNNTIHPS

SEQ ID NO: 2601750 - protein, 5 aa, Entamoeba histolytica
KGSCK

SEQ ID NO: 2601751 - protein, 5 aa, Entamoeba histolytica
KHENC

SEQ ID NO: 2601752 - protein, 6 aa, Entamoeba histolytica
KIETRE

SEQ ID NO: 2601753 - protein, 10 aa, Entamoeba histolytica
KIGSGKTEEI

SEQ ID NO: 2601754 - protein, 8 aa, Entamoeba histolytica
KKEVEEEE

SEQ ID NO: 2601755 - protein, 6 aa, Entamoeba histolytica
KKQEGI

SEQ ID NO: 2601756 - protein, 9 aa, Entamoeba histolytica
KLEKKSEEW

SEQ ID NO: 2601757 - protein, 7 aa, Entamoeba histolytica
KLSTKTM

SEQ ID NO: 2601758 - protein, 7 aa, Entamoeba histolytica
KNNYRGK

SEQ ID NO: 2601759 - protein, 9 aa, Entamoeba histolytica
KQGSRLQNI

SEQ ID NO: 2601760 - protein, 21 aa, Entamoeba histolytica
KRNLQRNKKGISRIKEAAEKV

SEQ ID NO: 2601761 - protein, 4 aa, Entamoeba histolytica
KRSA

SEQ ID NO: 2601762 - protein, 21 aa, Entamoeba histolytica
KYGDESRQEHVRDIAKSFVST

SEQ ID NO: 2601763 - protein, 15 aa, Entamoeba histolytica
KYGQYPTEDENREVQ

SEQ ID NO: 2601764 - protein, 9 aa, Entamoeba histolytica
LNLDNNQDL

SEQ ID NO: 2601765 - protein, 5 aa, Entamoeba histolytica
LPGAS

SEQ ID NO: 2601766 - protein, 9 aa, Entamoeba histolytica
LPNTYNRND

SEQ ID NO: 2601767 - protein, 4 aa, Entamoeba histolytica
LPPN

SEQ ID NO: 2601768 - protein, 4 aa, Entamoeba histolytica
LPSS

SEQ ID NO: 2601769 - protein, 8 aa, Entamoeba histolytica
NIPNAQPP

SEQ ID NO: 2601770 - protein, 17 aa, Entamoeba histolytica
NLRKRTKELSKTPTKRL

SEQ ID NO: 2601771 - protein, 6 aa, Entamoeba histolytica
NNGKLE

SEQ ID NO: 2601772 - protein, 4 aa, Entamoeba histolytica
NNNG

SEQ ID NO: 2601773 - protein, 6 aa, Entamoeba histolytica
NNPKRH

SEQ ID NO: 2601774 - protein, 7 aa, Entamoeba histolytica
NNSLLSS

SEQ ID NO: 2601775 - protein, 6 aa, Entamoeba histolytica
NQTATC

SEQ ID NO: 2601776 - protein, 19 aa, Entamoeba histolytica
NREEEIKNTLSKAKTTLDK

SEQ ID NO: 2601777 - protein, 12 aa, Entamoeba histolytica
NSDDEMAQQEDS

SEQ ID NO: 2601778 - protein, 8 aa, Entamoeba histolytica
NTSYHGKD

SEQ ID NO: 2601779 - protein, 9 aa, Entamoeba histolytica
NVEQQRKPY

SEQ ID NO: 2601780 - protein, 7 aa, Entamoeba histolytica
PAPYDKM

SEQ ID NO: 2601781 - protein, 7 aa, Entamoeba histolytica
PDENHYG

SEQ ID NO: 2601782 - protein, 5 aa, Entamoeba histolytica
PEKEE

SEQ ID NO: 2601783 - protein, 8 aa, Entamoeba histolytica
PELQANDT

SEQ ID NO: 2601784 - protein, 7 aa, Entamoeba histolytica
PEPKIQT

SEQ ID NO: 2601785 - protein, 5 aa, Entamoeba histolytica
PHGNH

SEQ ID NO: 2601786 - protein, 5 aa, Entamoeba histolytica
PKAMG

SEQ ID NO: 2601787 - protein, 7 aa, Entamoeba histolytica
PPQRQRI

SEQ ID NO: 2601788 - protein, 5 aa, Entamoeba histolytica
PRTKE

SEQ ID NO: 2601789 - protein, 9 aa, Entamoeba histolytica
PTKTGKTEF

SEQ ID NO: 2601790 - protein, 25 aa, Entamoeba histolytica
PTPAANSLGYANTNAGTVASGTNNA

SEQ ID NO: 2601791 - protein, 14 aa, Entamoeba histolytica
PTSTRRNLRSTMAG

SEQ ID NO: 2601792 - protein, 7 aa, Entamoeba histolytica
PTTNTRD

SEQ ID NO: 2601793 - protein, 7 aa, Entamoeba histolytica
PTTTVSG

SEQ ID NO: 2601794 - protein, 5 aa, Entamoeba histolytica
QFENC

SEQ ID NO: 2601795 - protein, 17 aa, Entamoeba histolytica
QLEEGKTLSDYNIQKES

SEQ ID NO: 2601796 - protein, 11 aa, Entamoeba histolytica
QPFNQKDENDA

SEQ ID NO: 2601797 - protein, 5 aa, Entamoeba histolytica
QQDNL

SEQ ID NO: 2601798 - protein, 6 aa, Entamoeba histolytica
QRNQYP

SEQ ID NO: 2601799 - protein, 12 aa, Entamoeba histolytica
QTTSKENSNKKK

SEQ ID NO: 2601800 - protein, 16 aa, Entamoeba histolytica
QVSSYSSAVSRAYYPG

SEQ ID NO: 2601801 - protein, 4 aa, Entamoeba histolytica
RGGF

SEQ ID NO: 2601802 - protein, 6 aa, Entamoeba histolytica
RSGSTF

SEQ ID NO: 2601803 - protein, 5 aa, Entamoeba histolytica
RSPAD

SEQ ID NO: 2601804 - protein, 10 aa, Entamoeba histolytica
RVNTNPTRGA

SEQ ID NO: 2601805 - protein, 8 aa, Entamoeba histolytica
SDKIRENS

SEQ ID NO: 2601806 - protein, 10 aa, Entamoeba histolytica
SDYRQKTNDL

SEQ ID NO: 2601807 - protein, 5 aa, Entamoeba histolytica
SEQYN

SEQ ID NO: 2601808 - protein, 9 aa, Entamoeba histolytica
SEVKEDEDR

SEQ ID NO: 2601809 - protein, 4 aa, Entamoeba histolytica
SLQE

SEQ ID NO: 2601810 - protein, 5 aa, Entamoeba histolytica
SNQTL

SEQ ID NO: 2601811 - protein, 8 aa, Entamoeba histolytica
SRLAEQNR

SEQ ID NO: 2601812 - protein, 7 aa, Entamoeba histolytica
SRRTVPP

SEQ ID NO: 2601813 - protein, 7 aa, Entamoeba histolytica
SSEEEGV

SEQ ID NO: 2601814 - protein, 8 aa, Entamoeba histolytica
SSNLSSAP

SEQ ID NO: 2601815 - protein, 14 aa, Entamoeba histolytica
SSVSSYSSANEKTL

SEQ ID NO: 2601816 - protein, 10 aa, Entamoeba histolytica
STEAREAGFQ

SEQ ID NO: 2601817 - protein, 6 aa, Entamoeba histolytica
STHPLK

SEQ ID NO: 2601818 - protein, 5 aa, Entamoeba histolytica
STITS

SEQ ID NO: 2601819 - protein, 5 aa, Entamoeba histolytica
STVNP

SEQ ID NO: 2601820 - protein, 4 aa, Entamoeba histolytica
TDES

SEQ ID NO: 2601821 - protein, 8 aa, Entamoeba histolytica
TDVNPPLQ

SEQ ID NO: 2601822 - protein, 4 aa, Entamoeba histolytica
TEEL

SEQ ID NO: 2601823 - protein, 4 aa, Entamoeba histolytica
TKTG

SEQ ID NO: 2601824 - protein, 5 aa, Entamoeba histolytica
TNEEY

SEQ ID NO: 2601825 - protein, 8 aa, Entamoeba histolytica
TNIPEEKH

SEQ ID NO: 2601826 - protein, 6 aa, Entamoeba histolytica
TPENIK

SEQ ID NO: 2601827 - protein, 9 aa, Entamoeba histolytica
TPSPTGVSY

SEQ ID NO: 2601828 - protein, 4 aa, Entamoeba histolytica
TTIT

SEQ ID NO: 2601829 - protein, 13 aa, Entamoeba histolytica
TTLTPKSNNKQLE

SEQ ID NO: 2601830 - protein, 7 aa, Entamoeba histolytica
TTNKPFP

SEQ ID NO: 2601831 - protein, 4 aa, Entamoeba histolytica
VAGD

SEQ ID NO: 2601832 - protein, 12 aa, Entamoeba histolytica
VASQVTQEGQGV

SEQ ID NO: 2601833 - protein, 8 aa, Entamoeba histolytica
VEPNDSID

SEQ ID NO: 2601834 - protein, 8 aa, Entamoeba histolytica
VGANEGTM

SEQ ID NO: 2601835 - protein, 10 aa, Entamoeba histolytica
VKKGSNKPAI

SEQ ID NO: 2601836 - protein, 9 aa, Entamoeba histolytica
VNTKEDTPF

SEQ ID NO: 2601837 - protein, 9 aa, Entamoeba histolytica
WEGESKGKI

SEQ ID NO: 2601838 - protein, 5 aa, Entamoeba histolytica
YDDLN

SEQ ID NO: 2601839 - protein, 7 aa, Entamoeba histolytica
YDPSKRM

SEQ ID NO: 2601840 - protein, 9 aa, Entamoeba histolytica
YGSVDKGRS

SEQ ID NO: 2601841 - protein, 17 aa, Entamoeba histolytica
YHPDPLHDDTSKYLKIT

SEQ ID NO: 2601842 - protein, 9 aa, Entamoeba histolytica
YLSAGRDAL

SEQ ID NO: 2601843 - protein, 4 aa, Entamoeba histolytica
YQRI

SEQ ID NO: 2601844 - protein, 17 aa, Entamoeba histolytica
ADEKYKAKVAILKKFGY

SEQ ID NO: 2601845 - protein, 9 aa, Entamoeba histolytica
ADKKTGEFT

SEQ ID NO: 2601846 - protein, 5 aa, Entamoeba histolytica
AEADP

SEQ ID NO: 2601847 - protein, 10 aa, Entamoeba histolytica
AFGKTVEEDF

SEQ ID NO: 2601848 - protein, 6 aa, Entamoeba histolytica
AFRNSK

SEQ ID NO: 2601849 - protein, 6 aa, Entamoeba histolytica
AGQERY

SEQ ID NO: 2601850 - protein, 5 aa, Entamoeba histolytica
AHDND

SEQ ID NO: 2601851 - protein, 6 aa, Entamoeba histolytica
AKAAEI

SEQ ID NO: 2601852 - protein, 7 aa, Entamoeba histolytica
AKDPKRL

SEQ ID NO: 2601853 - protein, 27 aa, Entamoeba histolytica
AKELAEKTQKGEKATASKKTEKPATLS

SEQ ID NO: 2601854 - protein, 8 aa, Entamoeba histolytica
AKGNTFTT

SEQ ID NO: 2601855 - protein, 4 aa, Entamoeba histolytica
AKGY

SEQ ID NO: 2601856 - protein, 8 aa, Entamoeba histolytica
AKIAEKNK

SEQ ID NO: 2601857 - protein, 8 aa, Entamoeba histolytica
AKKQYEAK

SEQ ID NO: 2601858 - protein, 8 aa, Entamoeba histolytica
AKRNQRQE

SEQ ID NO: 2601859 - protein, 7 aa, Entamoeba histolytica
ANTNAHT

SEQ ID NO: 2601860 - protein, 5 aa, Entamoeba histolytica
APETV

SEQ ID NO: 2601861 - protein, 8 aa, Entamoeba histolytica
APNNTIEK

SEQ ID NO: 2601862 - protein, 4 aa, Entamoeba histolytica
ARTI

SEQ ID NO: 2601863 - protein, 13 aa, Entamoeba histolytica
ARTNRSDNKGTIF

SEQ ID NO: 2601864 - protein, 6 aa, Entamoeba histolytica
ASAPIN

SEQ ID NO: 2601865 - protein, 7 aa, Entamoeba histolytica
ASDNDFV

SEQ ID NO: 2601866 - protein, 10 aa, Entamoeba histolytica
ASERGSLKHT

SEQ ID NO: 2601867 - protein, 13 aa, Entamoeba histolytica
ASESTKIKDKREI

SEQ ID NO: 2601868 - protein, 22 aa, Entamoeba histolytica
ASPREDSTRVGTGGNAKRQAVD

SEQ ID NO: 2601869 - protein, 4 aa, Entamoeba histolytica
ATNN

SEQ ID NO: 2601870 - protein, 15 aa, Entamoeba histolytica
AYGNEKEVGDGIKSA

SEQ ID NO: 2601871 - protein, 5 aa, Entamoeba histolytica
CEETN

SEQ ID NO: 2601872 - protein, 5 aa, Entamoeba histolytica
DDDEH

SEQ ID NO: 2601873 - protein, 9 aa, Entamoeba histolytica
DDNNSKVEG

SEQ ID NO: 2601874 - protein, 4 aa, Entamoeba histolytica
DEDG

SEQ ID NO: 2601875 - protein, 5 aa, Entamoeba histolytica
DFGSA

SEQ ID NO: 2601876 - protein, 8 aa, Entamoeba histolytica
DIASTDYY

SEQ ID NO: 2601877 - protein, 5 aa, Entamoeba histolytica
DIEEN

SEQ ID NO: 2601878 - protein, 9 aa, Entamoeba histolytica
DISKGLSDQ

SEQ ID NO: 2601879 - protein, 8 aa, Entamoeba histolytica
DKAHNPNE

SEQ ID NO: 2601880 - protein, 9 aa, Entamoeba histolytica
DKIERNTEE

SEQ ID NO: 2601881 - protein, 5 aa, Entamoeba histolytica
DKSSI

SEQ ID NO: 2601882 - protein, 15 aa, Entamoeba histolytica
DLERQRAEKVEEGKK

SEQ ID NO: 2601883 - protein, 10 aa, Entamoeba histolytica
DLETKQPINT

SEQ ID NO: 2601884 - protein, 5 aa, Entamoeba histolytica
DLTES

SEQ ID NO: 2601885 - protein, 8 aa, Entamoeba histolytica
DNGSNWTD

SEQ ID NO: 2601886 - protein, 5 aa, Entamoeba histolytica
DNNTE

SEQ ID NO: 2601887 - protein, 6 aa, Entamoeba histolytica
DQNGNH

SEQ ID NO: 2601888 - protein, 9 aa, Entamoeba histolytica
DTDPPKKTK

SEQ ID NO: 2601889 - protein, 10 aa, Entamoeba histolytica
DTRKENEGKN

SEQ ID NO: 2601890 - protein, 13 aa, Entamoeba histolytica
DVPNQKKSRLNYS

SEQ ID NO: 2601891 - protein, 8 aa, Entamoeba histolytica
DVPPKTED

SEQ ID NO: 2601892 - protein, 14 aa, Entamoeba histolytica
DVSNDESDDELEES

SEQ ID NO: 2601893 - protein, 6 aa, Entamoeba histolytica
DYATPN

SEQ ID NO: 2601894 - protein, 8 aa, Entamoeba histolytica
EARGRIKE

SEQ ID NO: 2601895 - protein, 6 aa, Entamoeba histolytica
EASSTM

SEQ ID NO: 2601896 - protein, 15 aa, Entamoeba histolytica
ECSIPETKKNIKEDR

SEQ ID NO: 2601897 - protein, 20 aa, Entamoeba histolytica
EDENRDIDYETNDKYITQFI

SEQ ID NO: 2601898 - protein, 5 aa, Entamoeba histolytica
EDVNG

SEQ ID NO: 2601899 - protein, 4 aa, Entamoeba histolytica
EEEI

SEQ ID NO: 2601900 - protein, 5 aa, Entamoeba histolytica
EEEQT

SEQ ID NO: 2601901 - protein, 4 aa, Entamoeba histolytica
EEKK

SEQ ID NO: 2601902 - protein, 6 aa, Entamoeba histolytica
EELDYK

SEQ ID NO: 2601903 - protein, 4 aa, Entamoeba histolytica
EEMN

SEQ ID NO: 2601904 - protein, 9 aa, Entamoeba histolytica
EEYKKEEVE

SEQ ID NO: 2601905 - protein, 7 aa, Entamoeba histolytica
EGKNGEG

SEQ ID NO: 2601906 - protein, 20 aa, Entamoeba histolytica
EIIEGKEYQEETKKSGWSVG

SEQ ID NO: 2601907 - protein, 31 aa, Entamoeba histolytica
EIKEGQNIESEIKGRCGEKEVTYKNTKSINI

SEQ ID NO: 2601908 - protein, 6 aa, Entamoeba histolytica
EITPKE

SEQ ID NO: 2601909 - protein, 8 aa, Entamoeba histolytica
EKKEERSV

SEQ ID NO: 2601910 - protein, 6 aa, Entamoeba histolytica
EKSREV

SEQ ID NO: 2601911 - protein, 15 aa, Entamoeba histolytica
EKYNDVKAKSKRERQ

SEQ ID NO: 2601912 - protein, 14 aa, Entamoeba histolytica
ELKAPSPAKAGVIA

SEQ ID NO: 2601913 - protein, 9 aa, Entamoeba histolytica
ELSSSEESV

SEQ ID NO: 2601914 - protein, 5 aa, Entamoeba histolytica
ENIEN

SEQ ID NO: 2601915 - protein, 8 aa, Entamoeba histolytica
ENSTRNTY

SEQ ID NO: 2601916 - protein, 22 aa, Entamoeba histolytica
ENTQTITEIENKRREIQNKIKE

SEQ ID NO: 2601917 - protein, 7 aa, Entamoeba histolytica
EQEEEDL

SEQ ID NO: 2601918 - protein, 6 aa, Entamoeba histolytica
ERTNGP

SEQ ID NO: 2601919 - protein, 6 aa, Entamoeba histolytica
ERYGES

SEQ ID NO: 2601920 - protein, 8 aa, Entamoeba histolytica
ESATFKTE

SEQ ID NO: 2601921 - protein, 9 aa, Entamoeba histolytica
ESDEKQQIP

SEQ ID NO: 2601922 - protein, 7 aa, Entamoeba histolytica
ESGVGKS

SEQ ID NO: 2601923 - protein, 42 aa, Entamoeba histolytica; identical to SEQ ID NO: 2423927

SEQ ID NO: 2601924 - protein, 10 aa, Entamoeba histolytica
EYKRALNATK

SEQ ID NO: 2601925 - protein, 5 aa, Entamoeba histolytica
EYNED

SEQ ID NO: 2601926 - protein, 6 aa, Entamoeba histolytica
FNKEGT

SEQ ID NO: 2601927 - protein, 10 aa, Entamoeba histolytica
FPSTTRTAQE

SEQ ID NO: 2601928 - protein, 16 aa, Entamoeba histolytica
FQGSDAADVEAAYKQE

SEQ ID NO: 2601929 - protein, 9 aa, Entamoeba histolytica
FTEKKGINE

SEQ ID NO: 2601930 - protein, 4 aa, Entamoeba histolytica
FTNN

SEQ ID NO: 2601931 - protein, 7 aa, Entamoeba histolytica
GAVGKSA

SEQ ID NO: 2601932 - protein, 7 aa, Entamoeba histolytica
GDNVNEI

SEQ ID NO: 2601933 - protein, 6 aa, Entamoeba histolytica
GEGDRS

SEQ ID NO: 2601934 - protein, 6 aa, Entamoeba histolytica
GEKVGV

SEQ ID NO: 2601935 - protein, 8 aa, Entamoeba histolytica
GGCDKDGF

SEQ ID NO: 2601936 - protein, 7 aa, Entamoeba histolytica
GGDGLKK

SEQ ID NO: 2601937 - protein, 6 aa, Entamoeba histolytica
GGGTTD

SEQ ID NO: 2601938 - protein, 6 aa, Entamoeba histolytica
GGSIAE

SEQ ID NO: 2601939 - protein, 5 aa, Entamoeba histolytica
GHPDG

SEQ ID NO: 2601940 - protein, 8 aa, Entamoeba histolytica
GIKKEPSI

SEQ ID NO: 2601941 - protein, 11 aa, Entamoeba histolytica
GISDKKEIHNN

SEQ ID NO: 2601942 - protein, 9 aa, Entamoeba histolytica
GISQSETCK

SEQ ID NO: 2601943 - protein, 4 aa, Entamoeba histolytica
GKKI

SEQ ID NO: 2601944 - protein, 7 aa, Entamoeba histolytica
GKKQMGS

SEQ ID NO: 2601945 - protein, 8 aa, Entamoeba histolytica
GKNIEKKD

SEQ ID NO: 2601946 - protein, 7 aa, Entamoeba histolytica
GKNSGKK

SEQ ID NO: 2601947 - protein, 8 aa, Entamoeba histolytica
GLENTAQA

SEQ ID NO: 2601948 - protein, 5 aa, Entamoeba histolytica
GNRMP

SEQ ID NO: 2601949 - protein, 13 aa, Entamoeba histolytica
GRPYNPPLPDESL

SEQ ID NO: 2601950 - protein, 6 aa, Entamoeba histolytica
GRRGHA

SEQ ID NO: 2601951 - protein, 7 aa, Entamoeba histolytica
GSDEGNI

SEQ ID NO: 2601952 - protein, 6 aa, Entamoeba histolytica
GSMYGE

SEQ ID NO: 2601953 - protein, 8 aa, Entamoeba histolytica
GTADVGGS

SEQ ID NO: 2601954 - protein, 13 aa, Entamoeba histolytica
GTFAPKPSHGPHG

SEQ ID NO: 2601955 - protein, 10 aa, Entamoeba histolytica
GTLGAGVKGY

SEQ ID NO: 2601956 - protein, 7 aa, Entamoeba histolytica
GTTWGEN

SEQ ID NO: 2601957 - protein, 9 aa, Entamoeba histolytica
HEDPKGRNI

SEQ ID NO: 2601958 - protein, 4 aa, Entamoeba histolytica
HRGG

SEQ ID NO: 2601959 - protein, 5 aa, Entamoeba histolytica
HSKPS

SEQ ID NO: 2601960 - protein, 5 aa, Entamoeba histolytica
HYNEQ

SEQ ID NO: 2601961 - protein, 26 aa, Entamoeba histolytica
IEGETEISTRLDPDEIKEEKKIGEGS

SEQ ID NO: 2601962 - protein, 10 aa, Entamoeba histolytica
IETKQPNSGI

SEQ ID NO: 2601963 - protein, 20 aa, Entamoeba histolytica
IKADEKGEATRISSGKAFNE

SEQ ID NO: 2601964 - protein, 9 aa, Entamoeba histolytica
IKKEDKAAF

SEQ ID NO: 2601965 - protein, 16 aa, Entamoeba histolytica
INEQISTAGYEASGTS

SEQ ID NO: 2601966 - protein, 9 aa, Entamoeba histolytica
IPKTVSKLG

SEQ ID NO: 2601967 - protein, 5 aa, Entamoeba histolytica
IPTSV

SEQ ID NO: 2601968 - protein, 4 aa, Entamoeba histolytica
IQDQ

SEQ ID NO: 2601969 - protein, 19 aa, Entamoeba histolytica
IQEQKKKLRTRKGAKITAL

SEQ ID NO: 2601970 - protein, 6 aa, Entamoeba histolytica
ITDEIE

SEQ ID NO: 2601971 - protein, 26 aa, Entamoeba histolytica
ITQGGRGFTGTRNTEKENKGPRIEEV

SEQ ID NO: 2601972 - protein, 18 aa, Entamoeba histolytica
ITQNGNYTIQTPTDYDGI

SEQ ID NO: 2601973 - protein, 8 aa, Entamoeba histolytica
KAQKLEAK

SEQ ID NO: 2601974 - protein, 4 aa, Entamoeba histolytica
KARL

SEQ ID NO: 2601975 - protein, 7 aa, Entamoeba histolytica
KASDKPT

SEQ ID NO: 2601976 - protein, 6 aa, Entamoeba histolytica
KDEEKN

SEQ ID NO: 2601977 - protein, 7 aa, Entamoeba histolytica
KDKDENE

SEQ ID NO: 2601978 - protein, 8 aa, Entamoeba histolytica
KDLTEQNS

SEQ ID NO: 2601979 - protein, 4 aa, Entamoeba histolytica
KDNT

SEQ ID NO: 2601980 - protein, 7 aa, Entamoeba histolytica
KDSNHEL

SEQ ID NO: 2601981 - protein, 4 aa, Entamoeba histolytica
KEDI

SEQ ID NO: 2601982 - protein, 14 aa, Entamoeba histolytica
KEGKVTPIRDQAEC

SEQ ID NO: 2601983 - protein, 4 aa, Entamoeba histolytica
KERD

SEQ ID NO: 2601984 - protein, 4 aa, Entamoeba histolytica
KEVN

SEQ ID NO: 2601985 - protein, 4 aa, Entamoeba histolytica
KEVT

SEQ ID NO: 2601986 - protein, 5 aa, Entamoeba histolytica
KGDRV

SEQ ID NO: 2601987 - protein, 11 aa, Entamoeba histolytica
KGEGEIEGVTN

SEQ ID NO: 2601988 - protein, 6 aa, Entamoeba histolytica
KGHGYN

SEQ ID NO: 2601989 - protein, 7 aa, Entamoeba histolytica
KGITPMG

SEQ ID NO: 2601990 - protein, 5 aa, Entamoeba histolytica
KGTET

SEQ ID NO: 2601991 - protein, 4 aa, Entamoeba histolytica
KHED

SEQ ID NO: 2601992 - protein, 27 aa, Entamoeba histolytica
KHNEKQKKIQSKLNKDLADKAKQQAAL

SEQ ID NO: 2601993 - protein, 9 aa, Entamoeba histolytica
KITKGQIEI

SEQ ID NO: 2601994 - protein, 8 aa, Entamoeba histolytica
KKEALNQS

SEQ ID NO: 2601995 - protein, 12 aa, Entamoeba histolytica
KKEDMERVAKSN

SEQ ID NO: 2601996 - protein, 7 aa, Entamoeba histolytica
KKEGEIY

SEQ ID NO: 2601997 - protein, 18 aa, Entamoeba histolytica
KKHPKEGKSTKRSKAPKI

SEQ ID NO: 2601998 - protein, 10 aa, Entamoeba histolytica
KKMAQGKSGF

SEQ ID NO: 2601999 - protein, 7 aa, Entamoeba histolytica
KKNSLHG

SEQ ID NO: 2602000 - protein, 8 aa, Entamoeba histolytica
KKRAERAK

SEQ ID NO: 2602001 - protein, 8 aa, Entamoeba histolytica
KKTTTGLK

SEQ ID NO: 2602002 - protein, 8 aa, Entamoeba histolytica
KKYGPAKV

SEQ ID NO: 2602003 - protein, 9 aa, Entamoeba histolytica
KKYKQNAER

SEQ ID NO: 2602004 - protein, 14 aa, Entamoeba histolytica
KLESENKKEEAKKL

SEQ ID NO: 2602005 - protein, 6 aa, Entamoeba histolytica
KLHKEG

SEQ ID NO: 2602006 - protein, 10 aa, Entamoeba histolytica
KNQAETQPEL

SEQ ID NO: 2602007 - protein, 8 aa, Entamoeba histolytica
KPEERAAK

SEQ ID NO: 2602008 - protein, 13 aa, Entamoeba histolytica
KPKGRTGVSPKSA

SEQ ID NO: 2602009 - protein, 14 aa, Entamoeba histolytica
KPLRNGERRRKTVR

SEQ ID NO: 2602010 - protein, 4 aa, Entamoeba histolytica
KPSK

SEQ ID NO: 2602011 - protein, 10 aa, Entamoeba histolytica
KQINSPVKGN

SEQ ID NO: 2602012 - protein, 6 aa, Entamoeba histolytica
KQTNPL

SEQ ID NO: 2602013 - protein, 12 aa, Entamoeba histolytica
KRFGKTQKVDGK

SEQ ID NO: 2602014 - protein, 4 aa, Entamoeba histolytica
KSEY

SEQ ID NO: 2602015 - protein, 5 aa, Entamoeba histolytica
KSHQT

SEQ ID NO: 2602016 - protein, 12 aa, Entamoeba histolytica
KSKRSEEGKGKV

SEQ ID NO: 2602017 - protein, 6 aa, Entamoeba histolytica
KTPPAV

SEQ ID NO: 2602018 - protein, 4 aa, Entamoeba histolytica
KVKK

SEQ ID NO: 2602019 - protein, 6 aa, Entamoeba histolytica
KYKDMP

SEQ ID NO: 2602020 - protein, 26 aa, Entamoeba histolytica
KYPKKQAAPKKSKGNKKVVPGKKIGK

SEQ ID NO: 2602021 - protein, 8 aa, Entamoeba histolytica
LDKTNATQ

SEQ ID NO: 2602022 - protein, 14 aa, Entamoeba histolytica
LGEYLREEDTMMVQ

SEQ ID NO: 2602023 - protein, 6 aa, Entamoeba histolytica
LGKEQV

SEQ ID NO: 2602024 - protein, 10 aa, Entamoeba histolytica
LKNAKTEFDI

SEQ ID NO: 2602025 - protein, 5 aa, Entamoeba histolytica
LKQAN

SEQ ID NO: 2602026 - protein, 5 aa, Entamoeba histolytica
LNDYQ

SEQ ID NO: 2602027 - protein, 4 aa, Entamoeba histolytica
LPSL

SEQ ID NO: 2602028 - protein, 8 aa, Entamoeba histolytica
LSGEEEVN

SEQ ID NO: 2602029 - protein, 19 aa, Entamoeba histolytica
MPNKQGTSKAHGEPPGPEL

SEQ ID NO: 2602030 - protein, 10 aa, Entamoeba histolytica
NAEGKRTTPS

SEQ ID NO: 2602031 - protein, 6 aa, Entamoeba histolytica
NAGKTT

SEQ ID NO: 2602032 - protein, 16 aa, Entamoeba histolytica
NANTDGMTKKKEKRKD

SEQ ID NO: 2602033 - protein, 10 aa, Entamoeba histolytica
NASKSNTASF

SEQ ID NO: 2602034 - protein, 4 aa, Entamoeba histolytica
NDEL

SEQ ID NO: 2602035 - protein, 9 aa, Entamoeba histolytica
NDTNSTETK

SEQ ID NO: 2602036 - protein, 15 aa, Entamoeba histolytica
NEEGSGIRDTSGIKN

SEQ ID NO: 2602037 - protein, 11 aa, Entamoeba histolytica
NEKKDIEIETD

SEQ ID NO: 2602038 - protein, 7 aa, Entamoeba histolytica
NENGKDI

SEQ ID NO: 2602039 - protein, 7 aa, Entamoeba histolytica
NFSATGN

SEQ ID NO: 2602040 - protein, 6 aa, Entamoeba histolytica
NGEVGK

SEQ ID NO: 2602041 - protein, 7 aa, Entamoeba histolytica
NGNDSTM

SEQ ID NO: 2602042 - protein, 7 aa, Entamoeba histolytica
NGVSPKI

SEQ ID NO: 2602043 - protein, 8 aa, Entamoeba histolytica
NHEEENAT

SEQ ID NO: 2602044 - protein, 12 aa, Entamoeba histolytica
NHKEKQDIGYET

SEQ ID NO: 2602045 - protein, 5 aa, Entamoeba histolytica
NIENE

SEQ ID NO: 2602046 - protein, 6 aa, Entamoeba histolytica
NKKEIQ

SEQ ID NO: 2602047 - protein, 14 aa, Entamoeba histolytica
NKPYPDKPFSTVEK

SEQ ID NO: 2602048 - protein, 6 aa, Entamoeba histolytica
NLPTEA

SEQ ID NO: 2602049 - protein, 5 aa, Entamoeba histolytica
NNEND

SEQ ID NO: 2602050 - protein, 4 aa, Entamoeba histolytica
NNGG

SEQ ID NO: 2602051 - protein, 7 aa, Entamoeba histolytica
NNLEEQE

SEQ ID NO: 2602052 - protein, 8 aa, Entamoeba histolytica
NPAKVRRR

SEQ ID NO: 2602053 - protein, 16 aa, Entamoeba histolytica
NPQPEHLPEQNDEIPR

SEQ ID NO: 2602054 - protein, 13 aa, Entamoeba histolytica
NPRTNSERKSNHK

SEQ ID NO: 2602055 - protein, 5 aa, Entamoeba histolytica
NPTVV

SEQ ID NO: 2602056 - protein, 7 aa, Entamoeba histolytica
NSVTDYK

SEQ ID NO: 2602057 - protein, 4 aa, Entamoeba histolytica
NTIQ

SEQ ID NO: 2602058 - protein, 4 aa, Entamoeba histolytica
NTPL

SEQ ID NO: 2602059 - protein, 6 aa, Entamoeba histolytica
NTPLGR

SEQ ID NO: 2602060 - protein, 8 aa, Entamoeba histolytica
NVGSSQFQ

SEQ ID NO: 2602061 - protein, 13 aa, Entamoeba histolytica
PAGDTGLDPTQTN

SEQ ID NO: 2602062 - protein, 6 aa, Entamoeba histolytica
PEAETS

SEQ ID NO: 2602063 - protein, 4 aa, Entamoeba histolytica
PGHR

SEQ ID NO: 2602064 - protein, 4 aa, Entamoeba histolytica
PIVS

SEQ ID NO: 2602065 - protein, 11 aa, Entamoeba histolytica
PLGTASHAKGL

SEQ ID NO: 2602066 - protein, 11 aa, Entamoeba histolytica
PMRAGPKRASH

SEQ ID NO: 2602067 - protein, 13 aa, Entamoeba histolytica
PNIQRDDCPLNSD

SEQ ID NO: 2602068 - protein, 6 aa, Entamoeba histolytica
PPTPLT

SEQ ID NO: 2602069 - protein, 5 aa, Entamoeba histolytica
PRDGS

SEQ ID NO: 2602070 - protein, 5 aa, Entamoeba histolytica
PRDQN

SEQ ID NO: 2602071 - protein, 22 aa, Entamoeba histolytica
PRRCEAKKFGGPGARAKYQKSY

SEQ ID NO: 2602072 - protein, 10 aa, Entamoeba histolytica
PSKTMQKKYA

SEQ ID NO: 2602073 - protein, 4 aa, Entamoeba histolytica
PSLP

SEQ ID NO: 2602074 - protein, 4 aa, Entamoeba histolytica
PSSI

SEQ ID NO: 2602075 - protein, 4 aa, Entamoeba histolytica
PSSY

SEQ ID NO: 2602076 - protein, 7 aa, Entamoeba histolytica
PTNTEQV

SEQ ID NO: 2602077 - protein, 8 aa, Entamoeba histolytica
PYSEETTL

SEQ ID NO: 2602078 - protein, 21 aa, Entamoeba histolytica
QDSIDKKKKEINEKKEEREKL

SEQ ID NO: 2602079 - protein, 6 aa, Entamoeba histolytica
QEGEEI

SEQ ID NO: 2602080 - protein, 9 aa, Entamoeba histolytica
QEGVQAATA

SEQ ID NO: 2602081 - protein, 4 aa, Entamoeba histolytica
QELS

SEQ ID NO: 2602082 - protein, 11 aa, Entamoeba histolytica
QESEIPTSVSK

SEQ ID NO: 2602083 - protein, 18 aa, Entamoeba histolytica
QFPKEKTEKRVKNEYPTL

SEQ ID NO: 2602084 - protein, 11 aa, Entamoeba histolytica
QGGDANTLDLS

SEQ ID NO: 2602085 - protein, 5 aa, Entamoeba histolytica
QKHIN

SEQ ID NO: 2602086 - protein, 5 aa, Entamoeba histolytica
QKKAE

SEQ ID NO: 2602087 - protein, 8 aa, Entamoeba histolytica
QKKAKKEA

SEQ ID NO: 2602088 - protein, 7 aa, Entamoeba histolytica
QKQVDES

SEQ ID NO: 2602089 - protein, 13 aa, Entamoeba histolytica
QKVDVSKVDTTGV

SEQ ID NO: 2602090 - protein, 7 aa, Entamoeba histolytica
QLKDEKV

SEQ ID NO: 2602091 - protein, 10 aa, Entamoeba histolytica
QNAPEKENEV

SEQ ID NO: 2602092 - protein, 14 aa, Entamoeba histolytica
QNGQQTFLPEPNHT

SEQ ID NO: 2602093 - protein, 8 aa, Entamoeba histolytica
QNNSNEEV

SEQ ID NO: 2602094 - protein, 9 aa, Entamoeba histolytica
QQSDEYRES

SEQ ID NO: 2602095 - protein, 8 aa, Entamoeba histolytica
QRKTPKQM

SEQ ID NO: 2602096 - protein, 14 aa, Entamoeba histolytica
QRSMKEEDHPFAQA

SEQ ID NO: 2602097 - protein, 6 aa, Entamoeba histolytica
QTNSEI

SEQ ID NO: 2602098 - protein, 15 aa, Entamoeba histolytica
QTTGGQLSSSSNTWT

SEQ ID NO: 2602099 - protein, 14 aa, Entamoeba histolytica
QVEESEDKKKEFEK

SEQ ID NO: 2602100 - protein, 5 aa, Entamoeba histolytica
REIDG

SEQ ID NO: 2602101 - protein, 9 aa, Entamoeba histolytica
RGDGESWTD

SEQ ID NO: 2602102 - protein, 19 aa, Entamoeba histolytica
RISGSGSGRNGQGAFGNMT

SEQ ID NO: 2602103 - protein, 8 aa, Entamoeba histolytica
RKRMQDKI

SEQ ID NO: 2602104 - protein, 7 aa, Entamoeba histolytica
RKTHRGL

SEQ ID NO: 2602105 - protein, 5 aa, Entamoeba histolytica
RLSGY

SEQ ID NO: 2602106 - protein, 14 aa, Entamoeba histolytica
RRANKWADKEWKKG

SEQ ID NO: 2602107 - protein, 9 aa, Entamoeba histolytica
RRRTQGTGR

SEQ ID NO: 2602108 - protein, 4 aa, Entamoeba histolytica
RSSP

SEQ ID NO: 2602109 - protein, 6 aa, Entamoeba histolytica
RTGNEI

SEQ ID NO: 2602110 - protein, 6 aa, Entamoeba histolytica
RYGSYG

SEQ ID NO: 2602111 - protein, 10 aa, Entamoeba histolytica
SAISKNPNVL

SEQ ID NO: 2602112 - protein, 8 aa, Entamoeba histolytica
SCGYPDAK

SEQ ID NO: 2602113 - protein, 6 aa, Entamoeba histolytica
SDFERR

SEQ ID NO: 2602114 - protein, 8 aa, Entamoeba histolytica
SDKGKRIA

SEQ ID NO: 2602115 - protein, 7 aa, Entamoeba histolytica
SECKTNI

SEQ ID NO: 2602116 - protein, 8 aa, Entamoeba histolytica
SEIKTSQW

SEQ ID NO: 2602117 - protein, 18 aa, Entamoeba histolytica
SEKAQQKIKAVGGACELT

SEQ ID NO: 2602118 - protein, 10 aa, Entamoeba histolytica
SEMSNISSSE

SEQ ID NO: 2602119 - protein, 8 aa, Entamoeba histolytica
SEQNNERN

SEQ ID NO: 2602120 - protein, 9 aa, Entamoeba histolytica
SGAYTDKKC

SEQ ID NO: 2602121 - protein, 7 aa, Entamoeba histolytica
SGGYDGE

SEQ ID NO: 2602122 - protein, 7 aa, Entamoeba histolytica
SGVGKTS

SEQ ID NO: 2602123 - protein, 5 aa, Entamoeba histolytica
SKDKV

SEQ ID NO: 2602124 - protein, 5 aa, Entamoeba histolytica
SKGVS

SEQ ID NO: 2602125 - protein, 7 aa, Entamoeba histolytica
SKSCEEA

SEQ ID NO: 2602126 - protein, 9 aa, Entamoeba histolytica
SLPLNNTPL

SEQ ID NO: 2602127 - protein, 7 aa, Entamoeba histolytica
SNEVTCS

SEQ ID NO: 2602128 - protein, 8 aa, Entamoeba histolytica
SNVKLTAS

SEQ ID NO: 2602129 - protein, 5 aa, Entamoeba histolytica
SPSKE

SEQ ID NO: 2602130 - protein, 6 aa, Entamoeba histolytica
SQIERN

SEQ ID NO: 2602131 - protein, 6 aa, Entamoeba histolytica
SQKDDV

SEQ ID NO: 2602132 - protein, 9 aa, Entamoeba histolytica
SQKPLSNGL

SEQ ID NO: 2602133 - protein, 7 aa, Entamoeba histolytica
SQLPIEG

SEQ ID NO: 2602134 - protein, 8 aa, Entamoeba histolytica
SQSITKGT

SEQ ID NO: 2602135 - protein, 8 aa, Entamoeba histolytica
SQSKINKR

SEQ ID NO: 2602136 - protein, 8 aa, Entamoeba histolytica
SQYRTRQD

SEQ ID NO: 2602137 - protein, 10 aa, Entamoeba histolytica
SRPGQTGSVE

SEQ ID NO: 2602138 - protein, 9 aa, Entamoeba histolytica
SSENVRKGG

SEQ ID NO: 2602139 - protein, 4 aa, Entamoeba histolytica
SSEV

SEQ ID NO: 2602140 - protein, 7 aa, Entamoeba histolytica
SSGTEAF

SEQ ID NO: 2602141 - protein, 5 aa, Entamoeba histolytica
SSVGK

SEQ ID NO: 2602142 - protein, 10 aa, Entamoeba histolytica
STDKHKEDVR

SEQ ID NO: 2602143 - protein, 6 aa, Entamoeba histolytica
SVSTTK

SEQ ID NO: 2602144 - protein, 13 aa, Entamoeba histolytica
SWRNPTTGEVASH

SEQ ID NO: 2602145 - protein, 9 aa, Entamoeba histolytica
SYTSRTGDI

SEQ ID NO: 2602146 - protein, 9 aa, Entamoeba histolytica
TAGQEDYDR

SEQ ID NO: 2602147 - protein, 34 aa, Entamoeba histolytica
TAVATESKTEEKKEEAPAAKEEEEEEDFGGFGDL

SEQ ID NO: 2602148 - protein, 19 aa, Entamoeba histolytica
TAVEEKAAPVAEEKKADKT

SEQ ID NO: 2602149 - protein, 4 aa, Entamoeba histolytica
TEEN

SEQ ID NO: 2602150 - protein, 4 aa, Entamoeba histolytica
TESI

SEQ ID NO: 2602151 - protein, 6 aa, Entamoeba histolytica
TGSSTF

SEQ ID NO: 2602152 - protein, 5 aa, Entamoeba histolytica
TIDGN

SEQ ID NO: 2602153 - protein, 17 aa, Entamoeba histolytica
TIQENATATYTPDSNYY

SEQ ID NO: 2602154 - protein, 10 aa, Entamoeba histolytica
TITEKENETI

SEQ ID NO: 2602155 - protein, 17 aa, Entamoeba histolytica
TITENGSYTISPDDNLD

SEQ ID NO: 2602156 - protein, 7 aa, Entamoeba histolytica
TKDNAHV

SEQ ID NO: 2602157 - protein, 4 aa, Entamoeba histolytica
TKEL

SEQ ID NO: 2602158 - protein, 5 aa, Entamoeba histolytica
TKHYD

SEQ ID NO: 2602159 - protein, 6 aa, Entamoeba histolytica
TKQYKV

SEQ ID NO: 2602160 - protein, 9 aa, Entamoeba histolytica
TLTGQTPVL

SEQ ID NO: 2602161 - protein, 22 aa, Entamoeba histolytica
TNEEIKQRETLTYQAENNSAYE

SEQ ID NO: 2602162 - protein, 5 aa, Entamoeba histolytica
TNHPN

SEQ ID NO: 2602163 - protein, 9 aa, Entamoeba histolytica
TNTKRNTYC

SEQ ID NO: 2602164 - protein, 5 aa, Entamoeba histolytica
TPQAV

SEQ ID NO: 2602165 - protein, 23 aa, Entamoeba histolytica
TSSKYGHSRFQTTTEKKARMGPM

SEQ ID NO: 2602166 - protein, 4 aa, Entamoeba histolytica
TSVN

SEQ ID NO: 2602167 - protein, 5 aa, Entamoeba histolytica
TTPRI

SEQ ID NO: 2602168 - protein, 4 aa, Entamoeba histolytica
TTYS

SEQ ID NO: 2602169 - protein, 7 aa, Entamoeba histolytica
TVGGDGS

SEQ ID NO: 2602170 - protein, 9 aa, Entamoeba histolytica
VDETTKNEL

SEQ ID NO: 2602171 - protein, 9 aa, Entamoeba histolytica
VENSNTSQI

SEQ ID NO: 2602172 - protein, 12 aa, Entamoeba histolytica
VFGKGNVAHPRD

SEQ ID NO: 2602173 - protein, 8 aa, Entamoeba histolytica
VGDKAVKN

SEQ ID NO: 2602174 - protein, 10 aa, Entamoeba histolytica
VGESGDRLTR

SEQ ID NO: 2602175 - protein, 10 aa, Entamoeba histolytica
VKRTAKQDAY

SEQ ID NO: 2602176 - protein, 16 aa, Entamoeba histolytica
VKTHSVQNTTRKPTNV

SEQ ID NO: 2602177 - protein, 9 aa, Entamoeba histolytica
VPKRANPLK

SEQ ID NO: 2602178 - protein, 7 aa, Entamoeba histolytica
VQSSPNQ

SEQ ID NO: 2602179 - protein, 10 aa, Entamoeba histolytica
VRGGADSYVS

SEQ ID NO: 2602180 - protein, 4 aa, Entamoeba histolytica
VSKI

SEQ ID NO: 2602181 - protein, 8 aa, Entamoeba histolytica
VTGGGQVA

SEQ ID NO: 2602182 - protein, 6 aa, Entamoeba histolytica
VVGSGS

SEQ ID NO: 2602183 - protein, 5 aa, Entamoeba histolytica
WGTGR

SEQ ID NO: 2602184 - protein, 10 aa, Entamoeba histolytica
WNEQSKQTQV

SEQ ID NO: 2602185 - protein, 4 aa, Entamoeba histolytica
WTED

SEQ ID NO: 2602186 - protein, 5 aa, Entamoeba histolytica
YATPN

SEQ ID NO: 2602187 - protein, 5 aa, Entamoeba histolytica
YEEYG

SEQ ID NO: 2602188 - protein, 17 aa, Entamoeba histolytica
YETNGKALTEISEGKKI

SEQ ID NO: 2602189 - protein, 7 aa, Entamoeba histolytica
YKNTKNQ

SEQ ID NO: 2602190 - protein, 11 aa, Entamoeba histolytica
YKTPKVPYERE

SEQ ID NO: 2602191 - protein, 4 aa, Entamoeba histolytica
YRDV

SEQ ID NO: 2602192 - protein, 13 aa, Entamoeba histolytica
YSPTGREFATGSY

SEQ ID NO: 2602193 - protein, 5 aa, Entamoeba histolytica
YVNEN

SEQ ID NO: 2602194 - protein, 4 aa, Entamoeba histolytica
ADGN

SEQ ID NO: 2602195 - protein, 9 aa, Entamoeba histolytica
ADRLQTGMR

SEQ ID NO: 2602196 - protein, 5 aa, Entamoeba histolytica
ADRRN

SEQ ID NO: 2602197 - protein, 7 aa, Entamoeba histolytica
ADSIDSQ

SEQ ID NO: 2602198 - protein, 7 aa, Entamoeba histolytica
ADTEKYA

SEQ ID NO: 2602199 - protein, 6 aa, Entamoeba histolytica
AEAASL

SEQ ID NO: 2602200 - protein, 8 aa, Entamoeba histolytica
AEKYNIPN

SEQ ID NO: 2602201 - protein, 8 aa, Entamoeba histolytica
AERDPAQI

SEQ ID NO: 2602202 - protein, 5 aa, Entamoeba histolytica
AESGT

SEQ ID NO: 2602203 - protein, 12 aa, Entamoeba histolytica
AGDAKVPAYYPT

SEQ ID NO: 2602204 - protein, 4 aa, Entamoeba histolytica
AGKI

SEQ ID NO: 2602205 - protein, 7 aa, Entamoeba histolytica
AGQERFR

SEQ ID NO: 2602206 - protein, 7 aa, Entamoeba histolytica
AGRGRTG

SEQ ID NO: 2602207 - protein, 10 aa, Entamoeba histolytica
AIKEEGVDNT

SEQ ID NO: 2602208 - protein, 7 aa, Entamoeba histolytica
AIPPNKR

SEQ ID NO: 2602209 - protein, 8 aa, Entamoeba histolytica
AKEKQDIS

SEQ ID NO: 2602210 - protein, 7 aa, Entamoeba histolytica
AKEQGIR

SEQ ID NO: 2602211 - protein, 4 aa, Entamoeba histolytica
ANID

SEQ ID NO: 2602212 - protein, 4 aa, Entamoeba histolytica
ANSK

SEQ ID NO: 2602213 - protein, 6 aa, Entamoeba histolytica
APAFPE

SEQ ID NO: 2602214 - protein, 4 aa, Entamoeba histolytica
AQPK

SEQ ID NO: 2602215 - protein, 9 aa, Entamoeba histolytica
AQQSKSDLR

SEQ ID NO: 2602216 - protein, 7 aa, Entamoeba histolytica
ARKGEEY

SEQ ID NO: 2602217 - protein, 6 aa, Entamoeba histolytica
ASGNYA

SEQ ID NO: 2602218 - protein, 4 aa, Entamoeba histolytica
ASYR

SEQ ID NO: 2602219 - protein, 4 aa, Entamoeba histolytica
ATAY

SEQ ID NO: 2602220 - protein, 19 aa, Entamoeba histolytica
ATTATQKTVDGPSGKDWRA

SEQ ID NO: 2602221 - protein, 24 aa, Entamoeba histolytica
ATTCRKKKCGHSGDLRPKKKIQSK

SEQ ID NO: 2602222 - protein, 12 aa, Entamoeba histolytica
AVDNAKAKGLNT

SEQ ID NO: 2602223 - protein, 6 aa, Entamoeba histolytica
AVSAGQ

SEQ ID NO: 2602224 - protein, 4 aa, Entamoeba histolytica
AYNE

SEQ ID NO: 2602225 - protein, 19 aa, Entamoeba histolytica
AYSSGKPALGVGAGNVPTY

SEQ ID NO: 2602226 - protein, 13 aa, Entamoeba histolytica
AYTEEDRNTYGNT

SEQ ID NO: 2602227 - protein, 8 aa, Entamoeba histolytica
CATNGDGL

SEQ ID NO: 2602228 - protein, 7 aa, Entamoeba histolytica
CDNDKYT

SEQ ID NO: 2602229 - protein, 7 aa, Entamoeba histolytica
CENDDGI

SEQ ID NO: 2602230 - protein, 7 aa, Entamoeba histolytica
CKEPTRS

SEQ ID NO: 2602231 - protein, 8 aa, Entamoeba histolytica
CPKESQIA

SEQ ID NO: 2602232 - protein, 8 aa, Entamoeba histolytica
CQHQSTQD

SEQ ID NO: 2602233 - protein, 7 aa, Entamoeba histolytica
CRGVPDP

SEQ ID NO: 2602234 - protein, 13 aa, Entamoeba histolytica
DDEESELNIPPGK

SEQ ID NO: 2602235 - protein, 9 aa, Entamoeba histolytica
DDEQVQEDI

SEQ ID NO: 2602236 - protein, 6 aa, Entamoeba histolytica
DDESID

SEQ ID NO: 2602237 - protein, 10 aa, Entamoeba histolytica
DDMGDDTIDD

SEQ ID NO: 2602238 - protein, 14 aa, Entamoeba histolytica
DDNSKERRREGRGL

SEQ ID NO: 2602239 - protein, 7 aa, Entamoeba histolytica
DEAMSRT

SEQ ID NO: 2602240 - protein, 7 aa, Entamoeba histolytica
DEDTDEV

SEQ ID NO: 2602241 - protein, 7 aa, Entamoeba histolytica
DEEIRND

SEQ ID NO: 2602242 - protein, 6 aa, Entamoeba histolytica
DEFEKQ

SEQ ID NO: 2602243 - protein, 4 aa, Entamoeba histolytica
DEHT

SEQ ID NO: 2602244 - protein, 6 aa, Entamoeba histolytica
DEIEKE

SEQ ID NO: 2602245 - protein, 13 aa, Entamoeba histolytica
DEITERNDGSVVS

SEQ ID NO: 2602246 - protein, 5 aa, Entamoeba histolytica
DEKPF

SEQ ID NO: 2602247 - protein, 8 aa, Entamoeba histolytica
DELYNDGK

SEQ ID NO: 2602248 - protein, 8 aa, Entamoeba histolytica
DESAVTGY

SEQ ID NO: 2602249 - protein, 7 aa, Entamoeba histolytica
DETERRR

SEQ ID NO: 2602250 - protein, 4 aa, Entamoeba histolytica
DEVF

SEQ ID NO: 2602251 - protein, 5 aa, Entamoeba histolytica
DEVFK

SEQ ID NO: 2602252 - protein, 9 aa, Entamoeba histolytica
DGSFETSTI

SEQ ID NO: 2602253 - protein, 11 aa, Entamoeba histolytica
DGSGSDGGSCI

SEQ ID NO: 2602254 - protein, 6 aa, Entamoeba histolytica
DGTLTY

SEQ ID NO: 2602255 - protein, 10 aa, Entamoeba histolytica
DGTVEGACPP

SEQ ID NO: 2602256 - protein, 11 aa, Entamoeba histolytica
DHETGKKYPLA

SEQ ID NO: 2602257 - protein, 37 aa, Entamoeba histolytica
DHPHGGGNHQHVGHPTTLKRSSPPGQKAGKVAARRTG

SEQ ID NO: 2602258 - protein, 5 aa, Entamoeba histolytica
DKACQ

SEQ ID NO: 2602259 - protein, 6 aa, Entamoeba histolytica
DKAMEE

SEQ ID NO: 2602260 - protein, 8 aa, Entamoeba histolytica
DKCTKEVP

SEQ ID NO: 2602261 - protein, 13 aa, Entamoeba histolytica
DKEDIPADANGNG

SEQ ID NO: 2602262 - protein, 7 aa, Entamoeba histolytica
DKGIRKA

SEQ ID NO: 2602263 - protein, 9 aa, Entamoeba histolytica
DKKSETTNT

SEQ ID NO: 2602264 - protein, 16 aa, Entamoeba histolytica
DKKTKAPRKARKEHKK

SEQ ID NO: 2602265 - protein, 6 aa, Entamoeba histolytica
DLSPST

SEQ ID NO: 2602266 - protein, 5 aa, Entamoeba histolytica
DLTNQ

SEQ ID NO: 2602267 - protein, 11 aa, Entamoeba histolytica
DLVKSSDDEQF

SEQ ID NO: 2602268 - protein, 4 aa, Entamoeba histolytica
DNCG

SEQ ID NO: 2602269 - protein, 6 aa, Entamoeba histolytica
DNRVTE

SEQ ID NO: 2602270 - protein, 24 aa, Entamoeba histolytica
DNSRRVDSSKYKPFSTSKYDGGKI

SEQ ID NO: 2602271 - protein, 18 aa, Entamoeba histolytica
DNTEARAKHTGGRILGFF

SEQ ID NO: 2602272 - protein, 7 aa, Entamoeba histolytica
DPCSGDE

SEQ ID NO: 2602273 - protein, 4 aa, Entamoeba histolytica
DPID

SEQ ID NO: 2602274 - protein, 12 aa, Entamoeba histolytica
DPLDSSKQESFY

SEQ ID NO: 2602275 - protein, 9 aa, Entamoeba histolytica
DRDKNADLH

SEQ ID NO: 2602276 - protein, 9 aa, Entamoeba histolytica
DRENADEPV

SEQ ID NO: 2602277 - protein, 5 aa, Entamoeba histolytica
DRHSD

SEQ ID NO: 2602278 - protein, 7 aa, Entamoeba histolytica
DRTTYES

SEQ ID NO: 2602279 - protein, 9 aa, Entamoeba histolytica
DSEDLQSKV

SEQ ID NO: 2602280 - protein, 9 aa, Entamoeba histolytica
DSGKSTTTG

SEQ ID NO: 2602281 - protein, 11 aa, Entamoeba histolytica
DSKTPGHPEYG

SEQ ID NO: 2602282 - protein, 6 aa, Entamoeba histolytica
DSRYPV

SEQ ID NO: 2602283 - protein, 7 aa, Entamoeba histolytica
DTETDGV

SEQ ID NO: 2602284 - protein, 10 aa, Entamoeba histolytica
DTRKENERKN

SEQ ID NO: 2602285 - protein, 5 aa, Entamoeba histolytica
DTVTD

SEQ ID NO: 2602286 - protein, 6 aa, Entamoeba histolytica
DVEKGN

SEQ ID NO: 2602287 - protein, 7 aa, Entamoeba histolytica
DVKTTDG

SEQ ID NO: 2602288 - protein, 4 aa, Entamoeba histolytica
DVQG

SEQ ID NO: 2602289 - protein, 10 aa, Entamoeba histolytica
DVTDATSKVG

SEQ ID NO: 2602290 - protein, 6 aa, Entamoeba histolytica
DYEGNR

SEQ ID NO: 2602291 - protein, 10 aa, Entamoeba histolytica
EAEKPENEGK

SEQ ID NO: 2602292 - protein, 8 aa, Entamoeba histolytica
EAHIKGGA

SEQ ID NO: 2602293 - protein, 4 aa, Entamoeba histolytica
ECPS

SEQ ID NO: 2602294 - protein, 4 aa, Entamoeba histolytica
EDEN

SEQ ID NO: 2602295 - protein, 16 aa, Entamoeba histolytica
EDIEAGEIKPDTDFKE

SEQ ID NO: 2602296 - protein, 7 aa, Entamoeba histolytica
EDKATKN

SEQ ID NO: 2602297 - protein, 7 aa, Entamoeba histolytica
EDYGEYY

SEQ ID NO: 2602298 - protein, 4 aa, Entamoeba histolytica
EEDL

SEQ ID NO: 2602299 - protein, 4 aa, Entamoeba histolytica
EEEL

SEQ ID NO: 2602300 - protein, 5 aa, Entamoeba histolytica
EEGKT

SEQ ID NO: 2602301 - protein, 5 aa, Entamoeba histolytica
EEIGE

SEQ ID NO: 2602302 - protein, 5 aa, Entamoeba histolytica
EEKAK

SEQ ID NO: 2602303 - protein, 8 aa, Entamoeba histolytica
EEKEEGNI

SEQ ID NO: 2602304 - protein, 18 aa, Entamoeba histolytica
EENDYTPEEIEELKKKYA

SEQ ID NO: 2602305 - protein, 7 aa, Entamoeba histolytica
EEPEEAY

SEQ ID NO: 2602306 - protein, 21 aa, Entamoeba histolytica
EEQFYSDDPDMRQSKKAFENT

SEQ ID NO: 2602307 - protein, 6 aa, Entamoeba histolytica
EESGEH

SEQ ID NO: 2602308 - protein, 4 aa, Entamoeba histolytica
EESI

SEQ ID NO: 2602309 - protein, 8 aa, Entamoeba histolytica
EETTKSML

SEQ ID NO: 2602310 - protein, 5 aa, Entamoeba histolytica
EEVGE

SEQ ID NO: 2602311 - protein, 4 aa, Entamoeba histolytica
EEVK

SEQ ID NO: 2602312 - protein, 8 aa, Entamoeba histolytica
EEVPKIPD

SEQ ID NO: 2602313 - protein, 4 aa, Entamoeba histolytica
EFEE

SEQ ID NO: 2602314 - protein, 14 aa, Entamoeba histolytica
EFKSQEDDYDLGGI

SEQ ID NO: 2602315 - protein, 4 aa, Entamoeba histolytica
EGEI

SEQ ID NO: 2602316 - protein, 6 aa, Entamoeba histolytica
EGFEPE

SEQ ID NO: 2602317 - protein, 6 aa, Entamoeba histolytica
EGKEKL

SEQ ID NO: 2602318 - protein, 14 aa, Entamoeba histolytica
EGKEKSKKTYENSP

SEQ ID NO: 2602319 - protein, 6 aa, Entamoeba histolytica
EGRNGE

SEQ ID NO: 2602320 - protein, 5 aa, Entamoeba histolytica
EGVGK

SEQ ID NO: 2602321 - protein, 5 aa, Entamoeba histolytica
EGVNS

SEQ ID NO: 2602322 - protein, 11 aa, Entamoeba histolytica
EGYAVDKKYPE

SEQ ID NO: 2602323 - protein, 12 aa, Entamoeba histolytica
EGYKELKKTNEM

SEQ ID NO: 2602324 - protein, 9 aa, Entamoeba histolytica
EHDPGRGAP

SEQ ID NO: 2602325 - protein, 6 aa, Entamoeba histolytica
EHEEDK

SEQ ID NO: 2602326 - protein, 4 aa, Entamoeba histolytica
EHPK

SEQ ID NO: 2602327 - protein, 16 aa, Entamoeba histolytica
EIGRYEKRVSASKRNN

SEQ ID NO: 2602328 - protein, 9 aa, Entamoeba histolytica
EIKKGNECK

SEQ ID NO: 2602329 - protein, 6 aa, Entamoeba histolytica
EINKNT

SEQ ID NO: 2602330 - protein, 8 aa, Entamoeba histolytica
EITTPVSS

SEQ ID NO: 2602331 - protein, 8 aa, Entamoeba histolytica
EKEEMNEY

SEQ ID NO: 2602332 - protein, 12 aa, Entamoeba histolytica
EKEEREEAINET

SEQ ID NO: 2602333 - protein, 20 aa, Entamoeba histolytica
EKGFETLAPEDKPWETEGAN

SEQ ID NO: 2602334 - protein, 10 aa, Entamoeba histolytica
EKIKATKDGY

SEQ ID NO: 2602335 - protein, 8 aa, Entamoeba histolytica
EKKEMNEY

SEQ ID NO: 2602336 - protein, 6 aa, Entamoeba histolytica
EKNDQI

SEQ ID NO: 2602337 - protein, 12 aa, Entamoeba histolytica
ELEERRKKMDKI

SEQ ID NO: 2602338 - protein, 17 aa, Entamoeba histolytica
EMKGSAITGPVSKESAD

SEQ ID NO: 2602339 - protein, 6 aa, Entamoeba histolytica
ENEKQP

SEQ ID NO: 2602340 - protein, 4 aa, Entamoeba histolytica
ENIE

SEQ ID NO: 2602341 - protein, 8 aa, Entamoeba histolytica
ENKRLRKE

SEQ ID NO: 2602342 - protein, 10 aa, Entamoeba histolytica
ENTQDGIDKA

SEQ ID NO: 2602343 - protein, 7 aa, Entamoeba histolytica
EPSAAAY

SEQ ID NO: 2602344 - protein, 5 aa, Entamoeba histolytica
EPSCS

SEQ ID NO: 2602345 - protein, 8 aa, Entamoeba histolytica
EQQSQDIA

SEQ ID NO: 2602346 - protein, 4 aa, Entamoeba histolytica
ERED

SEQ ID NO: 2602347 - protein, 4 aa, Entamoeba histolytica
ERGD

SEQ ID NO: 2602348 - protein, 5 aa, Entamoeba histolytica
ERKDF

SEQ ID NO: 2602349 - protein, 7 aa, Entamoeba histolytica
ERPDPKS

SEQ ID NO: 2602350 - protein, 4 aa, Entamoeba histolytica
ERSL

SEQ ID NO: 2602351 - protein, 7 aa, Entamoeba histolytica
ESHENGK

SEQ ID NO: 2602352 - protein, 6 aa, Entamoeba histolytica
ESKMRR

SEQ ID NO: 2602353 - protein, 9 aa, Entamoeba histolytica
ESKPGDRGI

SEQ ID NO: 2602354 - protein, 5 aa, Entamoeba histolytica
ESSLN

SEQ ID NO: 2602355 - protein, 6 aa, Entamoeba histolytica
ETATKT

SEQ ID NO: 2602356 - protein, 4 aa, Entamoeba histolytica
ETKD

SEQ ID NO: 2602357 - protein, 10 aa, Entamoeba histolytica
ETKNPSDLPK

SEQ ID NO: 2602358 - protein, 13 aa, Entamoeba histolytica
ETKTTEGKSGINR

SEQ ID NO: 2602359 - protein, 5 aa, Entamoeba histolytica
EVRGE

SEQ ID NO: 2602360 - protein, 12 aa, Entamoeba histolytica
EVTGGPLGAGMS

SEQ ID NO: 2602361 - protein, 4 aa, Entamoeba histolytica
EYKE

SEQ ID NO: 2602362 - protein, 11 aa, Entamoeba histolytica
EYNGMTRESKE

SEQ ID NO: 2602363 - protein, 8 aa, Entamoeba histolytica
EYTDGLAR

SEQ ID NO: 2602364 - protein, 40 aa, Entamoeba histolytica
FAPSINPETVYDNANDAYSNGGAGKYVSRQYDKQPIDNEQ

SEQ ID NO: 2602365 - protein, 9 aa, Entamoeba histolytica
FEEEKNYRP

SEQ ID NO: 2602366 - protein, 5 aa, Entamoeba histolytica
FENGQ

SEQ ID NO: 2602367 - protein, 16 aa, Entamoeba histolytica
FKKDGIKLGGGSYGEV

SEQ ID NO: 2602368 - protein, 13 aa, Entamoeba histolytica
FKKNGTNVDDDVP

SEQ ID NO: 2602369 - protein, 6 aa, Entamoeba histolytica
FNEKSG

SEQ ID NO: 2602370 - protein, 14 aa, Entamoeba histolytica
FNKTNSLSDVRKEI

SEQ ID NO: 2602371 - protein, 4 aa, Entamoeba histolytica
FPNN

SEQ ID NO: 2602372 - protein, 5 aa, Entamoeba histolytica
FSPDG

SEQ ID NO: 2602373 - protein, 7 aa, Entamoeba histolytica
FSSDWKD

SEQ ID NO: 2602374 - protein, 4 aa, Entamoeba histolytica
FTPV

SEQ ID NO: 2602375 - protein, 9 aa, Entamoeba histolytica
GCPNELKKN

SEQ ID NO: 2602376 - protein, 32 aa, Entamoeba histolytica; identical to SEQ ID NO: 2405860

SEQ ID NO: 2602377 - protein, 4 aa, Entamoeba histolytica
GDDG

SEQ ID NO: 2602378 - protein, 6 aa, Entamoeba histolytica
GDGHDD

SEQ ID NO: 2602379 - protein, 4 aa, Entamoeba histolytica
GDSQ

SEQ ID NO: 2602380 - protein, 4 aa, Entamoeba histolytica
GEGM

SEQ ID NO: 2602381 - protein, 4 aa, Entamoeba histolytica
GELT

SEQ ID NO: 2602382 - protein, 4 aa, Entamoeba histolytica
GENK

SEQ ID NO: 2602383 - protein, 4 aa, Entamoeba histolytica
GGGL

SEQ ID NO: 2602384 - protein, 9 aa, Entamoeba histolytica
GGGRTEKPI

SEQ ID NO: 2602385 - protein, 7 aa, Entamoeba histolytica
GGHTPAR

SEQ ID NO: 2602386 - protein, 7 aa, Entamoeba histolytica
GGRDYSD

SEQ ID NO: 2602387 - protein, 7 aa, Entamoeba histolytica
GGSAMDA

SEQ ID NO: 2602388 - protein, 6 aa, Entamoeba histolytica
GGSWKS

SEQ ID NO: 2602389 - protein, 6 aa, Entamoeba histolytica
GIEDEY

SEQ ID NO: 2602390 - protein, 7 aa, Entamoeba histolytica
GIGTPKY

SEQ ID NO: 2602391 - protein, 18 aa, Entamoeba histolytica
GINPDNDEKQIQINEQPT

SEQ ID NO: 2602392 - protein, 7 aa, Entamoeba histolytica
GIPKPTA

SEQ ID NO: 2602393 - protein, 7 aa, Entamoeba histolytica
GIPQEEE

SEQ ID NO: 2602394 - protein, 4 aa, Entamoeba histolytica
GITG

SEQ ID NO: 2602395 - protein, 7 aa, Entamoeba histolytica
GKDEAKY

SEQ ID NO: 2602396 - protein, 16 aa, Entamoeba histolytica
GKDFTISEEAAKQSGL

SEQ ID NO: 2602397 - protein, 18 aa, Entamoeba histolytica
GKHRKQRGGRGNAGGQHH

SEQ ID NO: 2602398 - protein, 7 aa, Entamoeba histolytica
GKKPQVI

SEQ ID NO: 2602399 - protein, 10 aa, Entamoeba histolytica
GKNDKEVEEF

SEQ ID NO: 2602400 - protein, 9 aa, Entamoeba histolytica
GKPKIKKQF

SEQ ID NO: 2602401 - protein, 6 aa, Entamoeba histolytica
GKTPQV

SEQ ID NO: 2602402 - protein, 8 aa, Entamoeba histolytica
GLPPGLKA

SEQ ID NO: 2602403 - protein, 4 aa, Entamoeba histolytica
GNKT

SEQ ID NO: 2602404 - protein, 5 aa, Entamoeba histolytica
GNPAH

SEQ ID NO: 2602405 - protein, 6 aa, Entamoeba histolytica
GNRSEM

SEQ ID NO: 2602406 - protein, 16 aa, Entamoeba histolytica
GNVKKGSKRKIAEPFS

SEQ ID NO: 2602407 - protein, 5 aa, Entamoeba histolytica
GNYEK

SEQ ID NO: 2602408 - protein, 23 aa, Entamoeba histolytica
GPAKQPKGYPSGSFGPTTSARMD

SEQ ID NO: 2602409 - protein, 7 aa, Entamoeba histolytica
GPPGCGK

SEQ ID NO: 2602410 - protein, 9 aa, Entamoeba histolytica
GPQAITGVP

SEQ ID NO: 2602411 - protein, 5 aa, Entamoeba histolytica
GQAGE

SEQ ID NO: 2602412 - protein, 12 aa, Entamoeba histolytica
GQEVDASSLGDE

SEQ ID NO: 2602413 - protein, 21 aa, Entamoeba histolytica
GQHTKTTGRRGRTVGVSRTKG

SEQ ID NO: 2602414 - protein, 8 aa, Entamoeba histolytica
GQIRKGYT

SEQ ID NO: 2602415 - protein, 15 aa, Entamoeba histolytica
GQQQTSITKEDRERM

SEQ ID NO: 2602416 - protein, 15 aa, Entamoeba histolytica
GRGHSAAIHSNDKAV

SEQ ID NO: 2602417 - protein, 8 aa, Entamoeba histolytica
GRGPSSDA

SEQ ID NO: 2602418 - protein, 4 aa, Entamoeba histolytica
GSIS

SEQ ID NO: 2602419 - protein, 5 aa, Entamoeba histolytica
GSVGE

SEQ ID NO: 2602420 - protein, 11 aa, Entamoeba histolytica
GSYGGNSVSAN

SEQ ID NO: 2602421 - protein, 17 aa, Entamoeba histolytica
GTGEFEAGISKNGQTRE

SEQ ID NO: 2602422 - protein, 9 aa, Entamoeba histolytica
GTITDSDTA

SEQ ID NO: 2602423 - protein, 4 aa, Entamoeba histolytica
GTPD

SEQ ID NO: 2602424 - protein, 8 aa, Entamoeba histolytica
GTVEAGEN

SEQ ID NO: 2602425 - protein, 4 aa, Entamoeba histolytica
GVGK

SEQ ID NO: 2602426 - protein, 9 aa, Entamoeba histolytica
GVKRERTPF

SEQ ID NO: 2602427 - protein, 13 aa, Entamoeba histolytica
GVLSGEKQRIGRS

SEQ ID NO: 2602428 - protein, 15 aa, Entamoeba histolytica
GVSEKTAIRRYQNNK

SEQ ID NO: 2602429 - protein, 4 aa, Entamoeba histolytica
GVTK

SEQ ID NO: 2602430 - protein, 23 aa, Entamoeba histolytica
GWGAHGGGAFSGKDSSKVDRSGA

SEQ ID NO: 2602431 - protein, 10 aa, Entamoeba histolytica
GYGSAKATRN

SEQ ID NO: 2602432 - protein, 19 aa, Entamoeba histolytica
HADNVSNEEIAKGLEEEVT

SEQ ID NO: 2602433 - protein, 10 aa, Entamoeba histolytica
HAESLGAYKP

SEQ ID NO: 2602434 - protein, 8 aa, Entamoeba histolytica
HGDTNKRW

SEQ ID NO: 2602435 - protein, 8 aa, Entamoeba histolytica
HGKSTLTD

SEQ ID NO: 2602436 - protein, 5 aa, Entamoeba histolytica
HGKTG

SEQ ID NO: 2602437 - protein, 7 aa, Entamoeba histolytica
HGLSNTS

SEQ ID NO: 2602438 - protein, 10 aa, Entamoeba histolytica
HKEEPNLSEN

SEQ ID NO: 2602439 - protein, 16 aa, Entamoeba histolytica
HLGTHKRGLAKRDEIQ

SEQ ID NO: 2602440 - protein, 4 aa, Entamoeba histolytica
HNKM

SEQ ID NO: 2602441 - protein, 16 aa, Entamoeba histolytica
HNNKFKNQENTQRTNA

SEQ ID NO: 2602442 - protein, 11 aa, Entamoeba histolytica
HNPAKDKRTTV

SEQ ID NO: 2602443 - protein, 6 aa, Entamoeba histolytica
HPEETA

SEQ ID NO: 2602444 - protein, 15 aa, Entamoeba histolytica
HTSETTCAKYSPSGY

SEQ ID NO: 2602445 - protein, 5 aa, Entamoeba histolytica
HVKDK

SEQ ID NO: 2602446 - protein, 5 aa, Entamoeba histolytica
IDENT

SEQ ID NO: 2602447 - protein, 4 aa, Entamoeba histolytica
IDNG

SEQ ID NO: 2602448 - protein, 5 aa, Entamoeba histolytica
IDQRT

SEQ ID NO: 2602449 - protein, 23 aa, Entamoeba histolytica
IDRRTGKSMEGGEPEYIKNGDSA

SEQ ID NO: 2602450 - protein, 4 aa, Entamoeba histolytica
IDVN

SEQ ID NO: 2602451 - protein, 4 aa, Entamoeba histolytica
IEEE

SEQ ID NO: 2602452 - protein, 4 aa, Entamoeba histolytica
IEEG

SEQ ID NO: 2602453 - protein, 4 aa, Entamoeba histolytica
IEEL

SEQ ID NO: 2602454 - protein, 5 aa, Entamoeba histolytica
IEPST

SEQ ID NO: 2602455 - protein, 4 aa, Entamoeba histolytica
IETA

SEQ ID NO: 2602456 - protein, 10 aa, Entamoeba histolytica
IGEDDPVEGL

SEQ ID NO: 2602457 - protein, 7 aa, Entamoeba histolytica
IGKESSY

SEQ ID NO: 2602458 - protein, 4 aa, Entamoeba histolytica
IGSE

SEQ ID NO: 2602459 - protein, 12 aa, Entamoeba histolytica
IGYDDTNKGFDY

SEQ ID NO: 2602460 - protein, 16 aa, Entamoeba histolytica
IKDEGTKIQILDSLLN

SEQ ID NO: 2602461 - protein, 4 aa, Entamoeba histolytica
IKGN

SEQ ID NO: 2602462 - protein, 10 aa, Entamoeba histolytica
IKKASEGEMK

SEQ ID NO: 2602463 - protein, 7 aa, Entamoeba histolytica
IKKSNTI

SEQ ID NO: 2602464 - protein, 6 aa, Entamoeba histolytica
IKQAAN

SEQ ID NO: 2602465 - protein, 17 aa, Entamoeba histolytica
IKRGNVASDAKNQPAVG

SEQ ID NO: 2602466 - protein, 4 aa, Entamoeba histolytica
INDN

SEQ ID NO: 2602467 - protein, 8 aa, Entamoeba histolytica
INEEEENF

SEQ ID NO: 2602468 - protein, 8 aa, Entamoeba histolytica
INGDENRV

SEQ ID NO: 2602469 - protein, 8 aa, Entamoeba histolytica
INSFSSSP

SEQ ID NO: 2602470 - protein, 10 aa, Entamoeba histolytica
INSTKKIEIG

SEQ ID NO: 2602471 - protein, 10 aa, Entamoeba histolytica
IPGAVSEAQL

SEQ ID NO: 2602472 - protein, 5 aa, Entamoeba histolytica
IPSSI

SEQ ID NO: 2602473 - protein, 8 aa, Entamoeba histolytica
IPTNDKGR

SEQ ID NO: 2602474 - protein, 11 aa, Entamoeba histolytica
IPTSVSKLGDG

SEQ ID NO: 2602475 - protein, 11 aa, Entamoeba histolytica
IQYQGSIPDGV

SEQ ID NO: 2602476 - protein, 5 aa, Entamoeba histolytica
IRKEG

SEQ ID NO: 2602477 - protein, 7 aa, Entamoeba histolytica
IRKRTSK

SEQ ID NO: 2602478 - protein, 10 aa, Entamoeba histolytica
ISEEQRPGTP

SEQ ID NO: 2602479 - protein, 4 aa, Entamoeba histolytica
ISPD

SEQ ID NO: 2602480 - protein, 7 aa, Entamoeba histolytica
ISPTENN

SEQ ID NO: 2602481 - protein, 9 aa, Entamoeba histolytica
ISTHSSDDY

SEQ ID NO: 2602482 - protein, 9 aa, Entamoeba histolytica
ITDEIESCQ

SEQ ID NO: 2602483 - protein, 5 aa, Entamoeba histolytica
ITEIS

SEQ ID NO: 2602484 - protein, 6 aa, Entamoeba histolytica
ITGGNR

SEQ ID NO: 2602485 - protein, 13 aa, Entamoeba histolytica
ITIETTTNGITTF

SEQ ID NO: 2602486 - protein, 26 aa, Entamoeba histolytica
ITQGGRGFTGTRSTEKENKGPRIEEV

SEQ ID NO: 2602487 - protein, 4 aa, Entamoeba histolytica
ITSF

SEQ ID NO: 2602488 - protein, 4 aa, Entamoeba histolytica
IYQE

SEQ ID NO: 2602489 - protein, 8 aa, Entamoeba histolytica
KAERERGI

SEQ ID NO: 2602490 - protein, 16 aa, Entamoeba histolytica
KAKKWKKNGKGDHGEV

SEQ ID NO: 2602491 - protein, 12 aa, Entamoeba histolytica
KAKSGHPGVPTG

SEQ ID NO: 2602492 - protein, 5 aa, Entamoeba histolytica
KALKY

SEQ ID NO: 2602493 - protein, 7 aa, Entamoeba histolytica
KAPTGRK

SEQ ID NO: 2602494 - protein, 11 aa, Entamoeba histolytica
KATKEGEKPKL

SEQ ID NO: 2602495 - protein, 6 aa, Entamoeba histolytica
KCTTVN

SEQ ID NO: 2602496 - protein, 10 aa, Entamoeba histolytica
KDEKEPDRNI

SEQ ID NO: 2602497 - protein, 4 aa, Entamoeba histolytica
KDEL

SEQ ID NO: 2602498 - protein, 14 aa, Entamoeba histolytica
KDSQEGDISGFQTG

SEQ ID NO: 2602499 - protein, 8 aa, Entamoeba histolytica
KDTPSYSY

SEQ ID NO: 2602500 - protein, 8 aa, Entamoeba histolytica
KEAASREL

SEQ ID NO: 2602501 - protein, 16 aa, Entamoeba histolytica
KEEGNMEEKIQEGEEI

SEQ ID NO: 2602502 - protein, 4 aa, Entamoeba histolytica
KEKT

SEQ ID NO: 2602503 - protein, 6 aa, Entamoeba histolytica
KELPND

SEQ ID NO: 2602504 - protein, 17 aa, Entamoeba histolytica
KEPPKDRKKNKGIPTVH

SEQ ID NO: 2602505 - protein, 8 aa, Entamoeba histolytica
KEQQTAQE

SEQ ID NO: 2602506 - protein, 9 aa, Entamoeba histolytica
KETGDVPQY

SEQ ID NO: 2602507 - protein, 7 aa, Entamoeba histolytica
KETGKYL

SEQ ID NO: 2602508 - protein, 7 aa, Entamoeba histolytica
KETPSWS

SEQ ID NO: 2602509 - protein, 10 aa, Entamoeba histolytica
KEVQTKELST

SEQ ID NO: 2602510 - protein, 13 aa, Entamoeba histolytica
KFEKESAEMGKGS

SEQ ID NO: 2602511 - protein, 6 aa, Entamoeba histolytica
KFTESL

SEQ ID NO: 2602512 - protein, 4 aa, Entamoeba histolytica
KGDV

SEQ ID NO: 2602513 - protein, 4 aa, Entamoeba histolytica
KGES

SEQ ID NO: 2602514 - protein, 8 aa, Entamoeba histolytica
KGFEHEKA

SEQ ID NO: 2602515 - protein, 4 aa, Entamoeba histolytica
KGKG

SEQ ID NO: 2602516 - protein, 6 aa, Entamoeba histolytica
KGKSKE

SEQ ID NO: 2602517 - protein, 11 aa, Entamoeba histolytica
KGKSSSEKNQF

SEQ ID NO: 2602518 - protein, 7 aa, Entamoeba histolytica
KGLTEDT

SEQ ID NO: 2602519 - protein, 5 aa, Entamoeba histolytica
KGNDF

SEQ ID NO: 2602520 - protein, 6 aa, Entamoeba histolytica
KGPVRG

SEQ ID NO: 2602521 - protein, 4 aa, Entamoeba histolytica
KGVP

SEQ ID NO: 2602522 - protein, 4 aa, Entamoeba histolytica
KGYG

SEQ ID NO: 2602523 - protein, 5 aa, Entamoeba histolytica
KHGER

SEQ ID NO: 2602524 - protein, 19 aa, Entamoeba histolytica
KHTPHKVSQYKKGKDSLHV

SEQ ID NO: 2602525 - protein, 49 aa, Entamoeba histolytica
KIEKENTNEQQKDVKKENTNPPKTETNSKENKEIIQSSNTNKQNNSLPS

SEQ ID NO: 2602526 - protein, 7 aa, Entamoeba histolytica
KITGSNE

SEQ ID NO: 2602527 - protein, 8 aa, Entamoeba histolytica
KKAKTTKK

SEQ ID NO: 2602528 - protein, 7 aa, Entamoeba histolytica
KKANDKE

SEQ ID NO: 2602529 - protein, 10 aa, Entamoeba histolytica
KKDKTVKPRK

SEQ ID NO: 2602530 - protein, 4 aa, Entamoeba histolytica
KKEG

SEQ ID NO: 2602531 - protein, 5 aa, Entamoeba histolytica
KKGDR

SEQ ID NO: 2602532 - protein, 4 aa, Entamoeba histolytica
KKGE

SEQ ID NO: 2602533 - protein, 6 aa, Entamoeba histolytica
KKGEEF

SEQ ID NO: 2602534 - protein, 9 aa, Entamoeba histolytica
KKGKPEYRK

SEQ ID NO: 2602535 - protein, 9 aa, Entamoeba histolytica
KKGRGHTQN

SEQ ID NO: 2602536 - protein, 6 aa, Entamoeba histolytica
KKHSEK

SEQ ID NO: 2602537 - protein, 11 aa, Entamoeba histolytica
KKNKEDGKSNI

SEQ ID NO: 2602538 - protein, 13 aa, Entamoeba histolytica
KKNPAKQYKGKQT

SEQ ID NO: 2602539 - protein, 11 aa, Entamoeba histolytica
KKQEREEDNKD

SEQ ID NO: 2602540 - protein, 8 aa, Entamoeba histolytica
KKSSIPAA

SEQ ID NO: 2602541 - protein, 16 aa, Entamoeba histolytica
KKTNKQQAVKPSTEAV

SEQ ID NO: 2602542 - protein, 7 aa, Entamoeba histolytica
KKYGSRY

SEQ ID NO: 2602543 - protein, 10 aa, Entamoeba histolytica
KKYQQSKEEY

SEQ ID NO: 2602544 - protein, 5 aa, Entamoeba histolytica
KLPKE

SEQ ID NO: 2602545 - protein, 10 aa, Entamoeba histolytica
KLTSSTTPNN

SEQ ID NO: 2602546 - protein, 4 aa, Entamoeba histolytica
KNEV

SEQ ID NO: 2602547 - protein, 6 aa, Entamoeba histolytica
KNFKRR

SEQ ID NO: 2602548 - protein, 4 aa, Entamoeba histolytica
KNIS

SEQ ID NO: 2602549 - protein, 26 aa, Entamoeba histolytica
KNRDNSKRKHHLEDTNEYQEKRDFER

SEQ ID NO: 2602550 - protein, 10 aa, Entamoeba histolytica
KNRKREVDEL

SEQ ID NO: 2602551 - protein, 15 aa, Entamoeba histolytica
KNSTTKKSKEEINAE

SEQ ID NO: 2602552 - protein, 4 aa, Entamoeba histolytica
KNTG

SEQ ID NO: 2602553 - protein, 8 aa, Entamoeba histolytica
KPEHGAGY

SEQ ID NO: 2602554 - protein, 7 aa, Entamoeba histolytica
KPEYTQE

SEQ ID NO: 2602555 - protein, 15 aa, Entamoeba histolytica
KPIPNTGNVFSSKKK

SEQ ID NO: 2602556 - protein, 4 aa, Entamoeba histolytica
KPIT

SEQ ID NO: 2602557 - protein, 6 aa, Entamoeba histolytica
KPNQRV

SEQ ID NO: 2602558 - protein, 6 aa, Entamoeba histolytica
KPSFGN

SEQ ID NO: 2602559 - protein, 4 aa, Entamoeba histolytica
KPSN

SEQ ID NO: 2602560 - protein, 7 aa, Entamoeba histolytica
KPTRRSC

SEQ ID NO: 2602561 - protein, 5 aa, Entamoeba histolytica
KQDEL

SEQ ID NO: 2602562 - protein, 5 aa, Entamoeba histolytica
KQIKP

SEQ ID NO: 2602563 - protein, 5 aa, Entamoeba histolytica
KQPQE

SEQ ID NO: 2602564 - protein, 7 aa, Entamoeba histolytica
KQYGDLD

SEQ ID NO: 2602565 - protein, 7 aa, Entamoeba histolytica
KRHYGVT

SEQ ID NO: 2602566 - protein, 18 aa, Entamoeba histolytica
KRKGLPEGVPGLDKFYDK

SEQ ID NO: 2602567 - protein, 27 aa, Entamoeba histolytica
KRLGEEGSFYKENNKRQKKIDDDNKSL

SEQ ID NO: 2602568 - protein, 12 aa, Entamoeba histolytica
KRLPKQPRPAEL

SEQ ID NO: 2602569 - protein, 12 aa, Entamoeba histolytica
KRTNTKLPKDGV

SEQ ID NO: 2602570 - protein, 7 aa, Entamoeba histolytica
KRTTWPR

SEQ ID NO: 2602571 - protein, 10 aa, Entamoeba histolytica
KRYPASQNAE

SEQ ID NO: 2602572 - protein, 6 aa, Entamoeba histolytica
KSAISQ

SEQ ID NO: 2602573 - protein, 7 aa, Entamoeba histolytica
KSANNQN

SEQ ID NO: 2602574 - protein, 5 aa, Entamoeba histolytica
KSFTT

SEQ ID NO: 2602575 - protein, 7 aa, Entamoeba histolytica
KSGMGKT

SEQ ID NO: 2602576 - protein, 4 aa, Entamoeba histolytica
KSGS

SEQ ID NO: 2602577 - protein, 5 aa, Entamoeba histolytica
KSNIT

SEQ ID NO: 2602578 - protein, 7 aa, Entamoeba histolytica
KSQETIN

SEQ ID NO: 2602579 - protein, 4 aa, Entamoeba histolytica
KSTM

SEQ ID NO: 2602580 - protein, 8 aa, Entamoeba histolytica
KSTQEGKY

SEQ ID NO: 2602581 - protein, 25 aa, Entamoeba histolytica
KSTTKKSKDEIKAELKRRKTDLVNG

SEQ ID NO: 2602582 - protein, 13 aa, Entamoeba histolytica
KTAEAAITKAGGK

SEQ ID NO: 2602583 - protein, 6 aa, Entamoeba histolytica
KTDLAA

SEQ ID NO: 2602584 - protein, 4 aa, Entamoeba histolytica
KTEI

SEQ ID NO: 2602585 - protein, 8 aa, Entamoeba histolytica
KTGYNPDK

SEQ ID NO: 2602586 - protein, 12 aa, Entamoeba histolytica
KTINGKKIEKKD

SEQ ID NO: 2602587 - protein, 10 aa, Entamoeba histolytica
KTLDDLKSEK

SEQ ID NO: 2602588 - protein, 5 aa, Entamoeba histolytica
KTMAD

SEQ ID NO: 2602589 - protein, 4 aa, Entamoeba histolytica
KTPI

SEQ ID NO: 2602590 - protein, 4 aa, Entamoeba histolytica
KTQI

SEQ ID NO: 2602591 - protein, 7 aa, Entamoeba histolytica
KTTKKEV

SEQ ID NO: 2602592 - protein, 21 aa, Entamoeba histolytica
KTVRAGQGKMRGRKIKERKGP

SEQ ID NO: 2602593 - protein, 4 aa, Entamoeba histolytica
KTYE

SEQ ID NO: 2602594 - protein, 6 aa, Entamoeba histolytica
KVDNND

SEQ ID NO: 2602595 - protein, 13 aa, Entamoeba histolytica
KVSQHIPTQQPTM

SEQ ID NO: 2602596 - protein, 7 aa, Entamoeba histolytica
KVTSSNE

SEQ ID NO: 2602597 - protein, 5 aa, Entamoeba histolytica
KYAGK

SEQ ID NO: 2602598 - protein, 9 aa, Entamoeba histolytica
KYGGGKTSG

SEQ ID NO: 2602599 - protein, 12 aa, Entamoeba histolytica
KYKKDISGNARA

SEQ ID NO: 2602600 - protein, 9 aa, Entamoeba histolytica
KYPTNEEKW

SEQ ID NO: 2602601 - protein, 27 aa, Entamoeba histolytica
KYRTSNLYTGPMDDEAAKAMANCDEKG

SEQ ID NO: 2602602 - protein, 13 aa, Entamoeba histolytica
LDGETTLKKKKIE

SEQ ID NO: 2602603 - protein, 4 aa, Entamoeba histolytica
LDYP

SEQ ID NO: 2602604 - protein, 11 aa, Entamoeba histolytica
LEKEGSSPHID

SEQ ID NO: 2602605 - protein, 12 aa, Entamoeba histolytica
LENGVSSKDRFD

SEQ ID NO: 2602606 - protein, 4 aa, Entamoeba histolytica
LGDK

SEQ ID NO: 2602607 - protein, 4 aa, Entamoeba histolytica
LHPE

SEQ ID NO: 2602608 - protein, 5 aa, Entamoeba histolytica
LKNDR

SEQ ID NO: 2602609 - protein, 9 aa, Entamoeba histolytica
LKPKTKSKP

SEQ ID NO: 2602610 - protein, 4 aa, Entamoeba histolytica
LNED

SEQ ID NO: 2602611 - protein, 28 aa, Entamoeba histolytica
LNEKDQLKNESSGADEVISGNDGNNSVM

SEQ ID NO: 2602612 - protein, 22 aa, Entamoeba histolytica
LNGNESEMNNEEDYEDYDIEDY

SEQ ID NO: 2602613 - protein, 9 aa, Entamoeba histolytica
LNLGGNNFD

SEQ ID NO: 2602614 - protein, 5 aa, Entamoeba histolytica
LPPEL

SEQ ID NO: 2602615 - protein, 4 aa, Entamoeba histolytica
LPRS

SEQ ID NO: 2602616 - protein, 6 aa, Entamoeba histolytica
LPSEKE

SEQ ID NO: 2602617 - protein, 5 aa, Entamoeba histolytica
LPSSI

SEQ ID NO: 2602618 - protein, 13 aa, Entamoeba histolytica
LSALSPYEQEKLT

SEQ ID NO: 2602619 - protein, 4 aa, Entamoeba histolytica
LSPP

SEQ ID NO: 2602620 - protein, 5 aa, Entamoeba histolytica
LSRSD

SEQ ID NO: 2602621 - protein, 9 aa, Entamoeba histolytica
LSSYSPDNQ

SEQ ID NO: 2602622 - protein, 5 aa, Entamoeba histolytica
LSYPQ

SEQ ID NO: 2602623 - protein, 6 aa, Entamoeba histolytica
LTEELK

SEQ ID NO: 2602624 - protein, 9 aa, Entamoeba histolytica
MATAGKDGN

SEQ ID NO: 2602625 - protein, 9 aa, Entamoeba histolytica
MKKKKKKLA

SEQ ID NO: 2602626 - protein, 5 aa, Entamoeba histolytica
MKNNN

SEQ ID NO: 2602627 - protein, 8 aa, Entamoeba histolytica
MKTNEEIR

SEQ ID NO: 2602628 - protein, 8 aa, Entamoeba histolytica
MQQRDSTN

SEQ ID NO: 2602629 - protein, 5 aa, Entamoeba histolytica
MRPRS

SEQ ID NO: 2602630 - protein, 24 aa, Entamoeba histolytica
MTGASPSMFGAGSEGALTKGPFNS

SEQ ID NO: 2602631 - protein, 9 aa, Entamoeba histolytica
NADNETTRI

SEQ ID NO: 2602632 - protein, 16 aa, Entamoeba histolytica
NAGNPRLSKNDAALDP

SEQ ID NO: 2602633 - protein, 8 aa, Entamoeba histolytica
NAKGNKFV

SEQ ID NO: 2602634 - protein, 16 aa, Entamoeba histolytica
NANQQKNVNAKEEVVE

SEQ ID NO: 2602635 - protein, 15 aa, Entamoeba histolytica
NASTVNCADNTGAKT

SEQ ID NO: 2602636 - protein, 7 aa, Entamoeba histolytica
NDEESYT

SEQ ID NO: 2602637 - protein, 4 aa, Entamoeba histolytica
NDGG

SEQ ID NO: 2602638 - protein, 15 aa, Entamoeba histolytica
NDMNSYKKKGQIINA

SEQ ID NO: 2602639 - protein, 4 aa, Entamoeba histolytica
NDNE

SEQ ID NO: 2602640 - protein, 8 aa, Entamoeba histolytica
NDSNDDCN

SEQ ID NO: 2602641 - protein, 4 aa, Entamoeba histolytica
NEIT

SEQ ID NO: 2602642 - protein, 7 aa, Entamoeba histolytica
NENNEMK

SEQ ID NO: 2602643 - protein, 5 aa, Entamoeba histolytica
NEPTA

SEQ ID NO: 2602644 - protein, 4 aa, Entamoeba histolytica
NEQR

SEQ ID NO: 2602645 - protein, 10 aa, Entamoeba histolytica
NGGVGRKAQC

SEQ ID NO: 2602646 - protein, 5 aa, Entamoeba histolytica
NGHGS

SEQ ID NO: 2602647 - protein, 4 aa, Entamoeba histolytica
NGNI

SEQ ID NO: 2602648 - protein, 7 aa, Entamoeba histolytica
NGQKPRK

SEQ ID NO: 2602649 - protein, 10 aa, Entamoeba histolytica
NGTEIQNKTF

SEQ ID NO: 2602650 - protein, 8 aa, Entamoeba histolytica
NHNGKEES

SEQ ID NO: 2602651 - protein, 5 aa, Entamoeba histolytica
NIESI

SEQ ID NO: 2602652 - protein, 5 aa, Entamoeba histolytica
NIPST

SEQ ID NO: 2602653 - protein, 12 aa, Entamoeba histolytica
NIPTSTSKIGDN

SEQ ID NO: 2602654 - protein, 7 aa, Entamoeba histolytica
NKEKEGN

SEQ ID NO: 2602655 - protein, 4 aa, Entamoeba histolytica
NKEY

SEQ ID NO: 2602656 - protein, 4 aa, Entamoeba histolytica
NKRL

SEQ ID NO: 2602657 - protein, 9 aa, Entamoeba histolytica
NKTATGKAI

SEQ ID NO: 2602658 - protein, 7 aa, Entamoeba histolytica
NKTNEEF

SEQ ID NO: 2602659 - protein, 11 aa, Entamoeba histolytica
NLKEEKENIPE

SEQ ID NO: 2602660 - protein, 12 aa, Entamoeba histolytica
NNIATSVGSTSF

SEQ ID NO: 2602661 - protein, 6 aa, Entamoeba histolytica
NNPLDT

SEQ ID NO: 2602662 - protein, 6 aa, Entamoeba histolytica
NNTESM

SEQ ID NO: 2602663 - protein, 6 aa, Entamoeba histolytica
NPANTN

SEQ ID NO: 2602664 - protein, 5 aa, Entamoeba histolytica
NPEQY

SEQ ID NO: 2602665 - protein, 4 aa, Entamoeba histolytica
NPGR

SEQ ID NO: 2602666 - protein, 5 aa, Entamoeba histolytica
NPIPI

SEQ ID NO: 2602667 - protein, 13 aa, Entamoeba histolytica
NPRTKSERKSNHK

SEQ ID NO: 2602668 - protein, 11 aa, Entamoeba histolytica
NPRTNSERKTH

SEQ ID NO: 2602669 - protein, 7 aa, Entamoeba histolytica
NPSNESI

SEQ ID NO: 2602670 - protein, 5 aa, Entamoeba histolytica
NQARK

SEQ ID NO: 2602671 - protein, 6 aa, Entamoeba histolytica
NQNNTD

SEQ ID NO: 2602672 - protein, 24 aa, Entamoeba histolytica
NRKSKGSNSQPKVIQPQPNNNPLI

SEQ ID NO: 2602673 - protein, 6 aa, Entamoeba histolytica
NRTNPL

SEQ ID NO: 2602674 - protein, 9 aa, Entamoeba histolytica
NSEQPSSSK

SEQ ID NO: 2602675 - protein, 4 aa, Entamoeba histolytica
NSIS

SEQ ID NO: 2602676 - protein, 6 aa, Entamoeba histolytica
NSNRGT

SEQ ID NO: 2602677 - protein, 8 aa, Entamoeba histolytica
NSQTPLKT

SEQ ID NO: 2602678 - protein, 4 aa, Entamoeba histolytica
NSTQ

SEQ ID NO: 2602679 - protein, 4 aa, Entamoeba histolytica
NSVT

SEQ ID NO: 2602680 - protein, 15 aa, Entamoeba histolytica
NTHEGSAKKKSSNPL

SEQ ID NO: 2602681 - protein, 9 aa, Entamoeba histolytica
NTNVHPRNK

SEQ ID NO: 2602682 - protein, 5 aa, Entamoeba histolytica
NTPIK

SEQ ID NO: 2602683 - protein, 24 aa, Entamoeba histolytica
NTPLTNPEINGRRKRKNNHAGKED

SEQ ID NO: 2602684 - protein, 10 aa, Entamoeba histolytica
NTPSSQGGIG

SEQ ID NO: 2602685 - protein, 6 aa, Entamoeba histolytica
NVEEIS

SEQ ID NO: 2602686 - protein, 5 aa, Entamoeba histolytica
NVSKI

SEQ ID NO: 2602687 - protein, 4 aa, Entamoeba histolytica
NYAK

SEQ ID NO: 2602688 - protein, 8 aa, Entamoeba histolytica
NYGGTNMH

SEQ ID NO: 2602689 - protein, 9 aa, Entamoeba histolytica
NYVPGKKDD

SEQ ID NO: 2602690 - protein, 10 aa, Entamoeba histolytica
PANTNGATTV

SEQ ID NO: 2602691 - protein, 11 aa, Entamoeba histolytica
PANTNGATTVR

SEQ ID NO: 2602692 - protein, 10 aa, Entamoeba histolytica
PASTGAAKAV

SEQ ID NO: 2602693 - protein, 5 aa, Entamoeba histolytica
PCSAA

SEQ ID NO: 2602694 - protein, 8 aa, Entamoeba histolytica
PDPSIQTV

SEQ ID NO: 2602695 - protein, 9 aa, Entamoeba histolytica
PDSKSQVTL

SEQ ID NO: 2602696 - protein, 4 aa, Entamoeba histolytica
PEAT

SEQ ID NO: 2602697 - protein, 6 aa, Entamoeba histolytica
PENQNG

SEQ ID NO: 2602698 - protein, 13 aa, Entamoeba histolytica
PERFGESKKELDS

SEQ ID NO: 2602699 - protein, 4 aa, Entamoeba histolytica
PGHV

SEQ ID NO: 2602700 - protein, 4 aa, Entamoeba histolytica
PKDD

SEQ ID NO: 2602701 - protein, 8 aa, Entamoeba histolytica
PKDKAIKR

SEQ ID NO: 2602702 - protein, 7 aa, Entamoeba histolytica
PKQATVR

SEQ ID NO: 2602703 - protein, 5 aa, Entamoeba histolytica
PKRID

SEQ ID NO: 2602704 - protein, 8 aa, Entamoeba histolytica
PKTPDELY

SEQ ID NO: 2602705 - protein, 4 aa, Entamoeba histolytica
PKWI

SEQ ID NO: 2602706 - protein, 4 aa, Entamoeba histolytica
PLSS

SEQ ID NO: 2602707 - protein, 4 aa, Entamoeba histolytica
PLTT

SEQ ID NO: 2602708 - protein, 9 aa, Entamoeba histolytica
PMGDAGLTG

SEQ ID NO: 2602709 - protein, 12 aa, Entamoeba histolytica
PMTREEAKDFTK

SEQ ID NO: 2602710 - protein, 5 aa, Entamoeba histolytica
PNGEI

SEQ ID NO: 2602711 - protein, 4 aa, Entamoeba histolytica
PNHG

SEQ ID NO: 2602712 - protein, 13 aa, Entamoeba histolytica
PNTMSKEYKGSGL

SEQ ID NO: 2602713 - protein, 5 aa, Entamoeba histolytica
PPIPT

SEQ ID NO: 2602714 - protein, 8 aa, Entamoeba histolytica
PPKQFNTN

SEQ ID NO: 2602715 - protein, 6 aa, Entamoeba histolytica
PQQIAD

SEQ ID NO: 2602716 - protein, 5 aa, Entamoeba histolytica
PRAGC

SEQ ID NO: 2602717 - protein, 4 aa, Entamoeba histolytica
PRDN

SEQ ID NO: 2602718 - protein, 6 aa, Entamoeba histolytica
PSDESY

SEQ ID NO: 2602719 - protein, 9 aa, Entamoeba histolytica
PSGVSSECK

SEQ ID NO: 2602720 - protein, 6 aa, Entamoeba histolytica
PSLNGK

SEQ ID NO: 2602721 - protein, 4 aa, Entamoeba histolytica
PSPL

SEQ ID NO: 2602722 - protein, 4 aa, Entamoeba histolytica
PSPQ

SEQ ID NO: 2602723 - protein, 4 aa, Entamoeba histolytica
PSSL

SEQ ID NO: 2602724 - protein, 8 aa, Entamoeba histolytica
PSVTRGKP

SEQ ID NO: 2602725 - protein, 7 aa, Entamoeba histolytica
PSWSPEE

SEQ ID NO: 2602726 - protein, 8 aa, Entamoeba histolytica
PTKEGDGY

SEQ ID NO: 2602727 - protein, 12 aa, Entamoeba histolytica
PTLEEAEQESIH

SEQ ID NO: 2602728 - protein, 4 aa, Entamoeba histolytica
PTSI

SEQ ID NO: 2602729 - protein, 7 aa, Entamoeba histolytica
PTSVSKI

SEQ ID NO: 2602730 - protein, 10 aa, Entamoeba histolytica
PTSVSKIGDG

SEQ ID NO: 2602731 - protein, 9 aa, Entamoeba histolytica
PVTNPTSTA

SEQ ID NO: 2602732 - protein, 6 aa, Entamoeba histolytica
PYGTSY

SEQ ID NO: 2602733 - protein, 4 aa, Entamoeba histolytica
QAHG

SEQ ID NO: 2602734 - protein, 9 aa, Entamoeba histolytica
QATERQKRE

SEQ ID NO: 2602735 - protein, 4 aa, Entamoeba histolytica
QCPE

SEQ ID NO: 2602736 - protein, 9 aa, Entamoeba histolytica
QCSPANPRV

SEQ ID NO: 2602737 - protein, 7 aa, Entamoeba histolytica
QDPKSHV

SEQ ID NO: 2602738 - protein, 9 aa, Entamoeba histolytica
QEARSSRRR

SEQ ID NO: 2602739 - protein, 19 aa, Entamoeba histolytica
QEEERERRDNYVPEKSEVN

SEQ ID NO: 2602740 - protein, 7 aa, Entamoeba histolytica
QEKQTEK

SEQ ID NO: 2602741 - protein, 8 aa, Entamoeba histolytica
QENTEETK

SEQ ID NO: 2602742 - protein, 7 aa, Entamoeba histolytica
QERYEEI

SEQ ID NO: 2602743 - protein, 7 aa, Entamoeba histolytica
QFEQENY

SEQ ID NO: 2602744 - protein, 21 aa, Entamoeba histolytica
QGKRRYDRKQQGFGGQTKPVF

SEQ ID NO: 2602745 - protein, 6 aa, Entamoeba histolytica
QITTTY

SEQ ID NO: 2602746 - protein, 12 aa, Entamoeba histolytica
QKDNKDGKDSQL

SEQ ID NO: 2602747 - protein, 9 aa, Entamoeba histolytica
QKKAEHDPS

SEQ ID NO: 2602748 - protein, 10 aa, Entamoeba histolytica
QLKKEGKPLL

SEQ ID NO: 2602749 - protein, 17 aa, Entamoeba histolytica
QMNERGKRSIVCSIKYF

SEQ ID NO: 2602750 - protein, 9 aa, Entamoeba histolytica
QNAPEKENE

SEQ ID NO: 2602751 - protein, 9 aa, Entamoeba histolytica
QNAPENENE

SEQ ID NO: 2602752 - protein, 5 aa, Entamoeba histolytica
QPALQ

SEQ ID NO: 2602753 - protein, 13 aa, Entamoeba histolytica
QQLEKIKNDYESA

SEQ ID NO: 2602754 - protein, 6 aa, Entamoeba histolytica
QQTTIS

SEQ ID NO: 2602755 - protein, 8 aa, Entamoeba histolytica
QQYETTQE

SEQ ID NO: 2602756 - protein, 10 aa, Entamoeba histolytica
QSIDDTTKNY

SEQ ID NO: 2602757 - protein, 22 aa, Entamoeba histolytica
QSKNTRQPEGVSTEAGKQHSAI

SEQ ID NO: 2602758 - protein, 5 aa, Entamoeba histolytica
QSQVD

SEQ ID NO: 2602759 - protein, 8 aa, Entamoeba histolytica
QSTEQKKP

SEQ ID NO: 2602760 - protein, 12 aa, Entamoeba histolytica
QSTTEYTLGSDN

SEQ ID NO: 2602761 - protein, 5 aa, Entamoeba histolytica
QTIPN

SEQ ID NO: 2602762 - protein, 4 aa, Entamoeba histolytica
QTNK

SEQ ID NO: 2602763 - protein, 14 aa, Entamoeba histolytica
QVEENEDKKKEFEK

SEQ ID NO: 2602764 - protein, 10 aa, Entamoeba histolytica
QVSPGEGTVA

SEQ ID NO: 2602765 - protein, 6 aa, Entamoeba histolytica
QWKDSG

SEQ ID NO: 2602766 - protein, 4 aa, Entamoeba histolytica
QYKE

SEQ ID NO: 2602767 - protein, 6 aa, Entamoeba histolytica
RAIADT

SEQ ID NO: 2602768 - protein, 9 aa, Entamoeba histolytica
RANNTDDEI

SEQ ID NO: 2602769 - protein, 6 aa, Entamoeba histolytica
RAQKRD

SEQ ID NO: 2602770 - protein, 27 aa, Entamoeba histolytica
RATGGKKNSMQKKKKNTMGRQPANTRL

SEQ ID NO: 2602771 - protein, 4 aa, Entamoeba histolytica
RDET

SEQ ID NO: 2602772 - protein, 11 aa, Entamoeba histolytica
RDISDNSALTK

SEQ ID NO: 2602773 - protein, 13 aa, Entamoeba histolytica
RDVSTGATSANSG

SEQ ID NO: 2602774 - protein, 8 aa, Entamoeba histolytica
RDYSKGLT

SEQ ID NO: 2602775 - protein, 9 aa, Entamoeba histolytica
RFSDKKGIS

SEQ ID NO: 2602776 - protein, 4 aa, Entamoeba histolytica
RGGS

SEQ ID NO: 2602777 - protein, 4 aa, Entamoeba histolytica
RGSI

SEQ ID NO: 2602778 - protein, 12 aa, Entamoeba histolytica
RIDSGNSSTIKK

SEQ ID NO: 2602779 - protein, 7 aa, Entamoeba histolytica
RKADYEK

SEQ ID NO: 2602780 - protein, 13 aa, Entamoeba histolytica
RKEQERRRQRRRQ

SEQ ID NO: 2602781 - protein, 6 aa, Entamoeba histolytica
RKLKEV

SEQ ID NO: 2602782 - protein, 8 aa, Entamoeba histolytica
RKNDAKKH

SEQ ID NO: 2602783 - protein, 13 aa, Entamoeba histolytica
RLPSGAKKTLKSN

SEQ ID NO: 2602784 - protein, 4 aa, Entamoeba histolytica
RLSY

SEQ ID NO: 2602785 - protein, 4 aa, Entamoeba histolytica
RNEE

SEQ ID NO: 2602786 - protein, 6 aa, Entamoeba histolytica
RNKAVR

SEQ ID NO: 2602787 - protein, 6 aa, Entamoeba histolytica
RNNENI

SEQ ID NO: 2602788 - protein, 7 aa, Entamoeba histolytica
RNQLNDQ

SEQ ID NO: 2602789 - protein, 19 aa, Entamoeba histolytica
RNSNNEYQEEITELKVMKI

SEQ ID NO: 2602790 - protein, 4 aa, Entamoeba histolytica
RNTT

SEQ ID NO: 2602791 - protein, 5 aa, Entamoeba histolytica
RNVRE

SEQ ID NO: 2602792 - protein, 4 aa, Entamoeba histolytica
RPFG

SEQ ID NO: 2602793 - protein, 15 aa, Entamoeba histolytica
RQGYPEGFKWISQYM

SEQ ID NO: 2602794 - protein, 6 aa, Entamoeba histolytica
RQKVTD

SEQ ID NO: 2602795 - protein, 4 aa, Entamoeba histolytica
RQYG

SEQ ID NO: 2602796 - protein, 12 aa, Entamoeba histolytica
RRGYKKRTTLKR

SEQ ID NO: 2602797 - protein, 6 aa, Entamoeba histolytica
RRSNEV

SEQ ID NO: 2602798 - protein, 9 aa, Entamoeba histolytica
RSHTSGQAF

SEQ ID NO: 2602799 - protein, 14 aa, Entamoeba histolytica
RSRTDRRNRLPPKR

SEQ ID NO: 2602800 - protein, 6 aa, Entamoeba histolytica
RTQSKF

SEQ ID NO: 2602801 - protein, 10 aa, Entamoeba histolytica
RVARNNVKEL

SEQ ID NO: 2602802 - protein, 18 aa, Entamoeba histolytica
RVRNRREAVTKSREPEWQ

SEQ ID NO: 2602803 - protein, 7 aa, Entamoeba histolytica
RYKQGDL

SEQ ID NO: 2602804 - protein, 13 aa, Entamoeba histolytica
RYNEGKKGMASAE

SEQ ID NO: 2602805 - protein, 12 aa, Entamoeba histolytica
SADDKEKEGKEL

SEQ ID NO: 2602806 - protein, 14 aa, Entamoeba histolytica
SAFPKDNAAEKPHL

SEQ ID NO: 2602807 - protein, 7 aa, Entamoeba histolytica
SAIKSPE

SEQ ID NO: 2602808 - protein, 8 aa, Entamoeba histolytica
SAPSADAP

SEQ ID NO: 2602809 - protein, 12 aa, Entamoeba histolytica
SATKNGTSGNEV

SEQ ID NO: 2602810 - protein, 4 aa, Entamoeba histolytica
SCTT

SEQ ID NO: 2602811 - protein, 4 aa, Entamoeba histolytica
SDAI

SEQ ID NO: 2602812 - protein, 8 aa, Entamoeba histolytica
SDEEPLYT

SEQ ID NO: 2602813 - protein, 7 aa, Entamoeba histolytica
SDEFATK

SEQ ID NO: 2602814 - protein, 8 aa, Entamoeba histolytica
SDFTDGQP

SEQ ID NO: 2602815 - protein, 4 aa, Entamoeba histolytica
SDIN

SEQ ID NO: 2602816 - protein, 8 aa, Entamoeba histolytica
SDITIENS

SEQ ID NO: 2602817 - protein, 4 aa, Entamoeba histolytica
SDNE

SEQ ID NO: 2602818 - protein, 4 aa, Entamoeba histolytica
SDTY

SEQ ID NO: 2602819 - protein, 5 aa, Entamoeba histolytica
SEFEA

SEQ ID NO: 2602820 - protein, 9 aa, Entamoeba histolytica
SEGSGATPV

SEQ ID NO: 2602821 - protein, 4 aa, Entamoeba histolytica
SELE

SEQ ID NO: 2602822 - protein, 11 aa, Entamoeba histolytica
SENDEKKTGYK

SEQ ID NO: 2602823 - protein, 18 aa, Entamoeba histolytica
SEPIKQENDIQQREERSI

SEQ ID NO: 2602824 - protein, 7 aa, Entamoeba histolytica
SEYKEDV

SEQ ID NO: 2602825 - protein, 4 aa, Entamoeba histolytica
SGDV

SEQ ID NO: 2602826 - protein, 6 aa, Entamoeba histolytica
SGLNPK

SEQ ID NO: 2602827 - protein, 14 aa, Entamoeba histolytica
SGRRNNPPQVAKNG

SEQ ID NO: 2602828 - protein, 7 aa, Entamoeba histolytica
SIEPSIN

SEQ ID NO: 2602829 - protein, 12 aa, Entamoeba histolytica
SINKERKEYNQK

SEQ ID NO: 2602830 - protein, 5 aa, Entamoeba histolytica
SISEI

SEQ ID NO: 2602831 - protein, 13 aa, Entamoeba histolytica
SISNEKPSTGTYN

SEQ ID NO: 2602832 - protein, 5 aa, Entamoeba histolytica
SISPK

SEQ ID NO: 2602833 - protein, 12 aa, Entamoeba histolytica
SITNAEKQGKRQ

SEQ ID NO: 2602834 - protein, 4 aa, Entamoeba histolytica
SITS

SEQ ID NO: 2602835 - protein, 7 aa, Entamoeba histolytica
SKESFEE

SEQ ID NO: 2602836 - protein, 9 aa, Entamoeba histolytica
SKIGNNNFS

SEQ ID NO: 2602837 - protein, 11 aa, Entamoeba histolytica
SKMKKEIQEGM

SEQ ID NO: 2602838 - protein, 4 aa, Entamoeba histolytica
SKPI

SEQ ID NO: 2602839 - protein, 7 aa, Entamoeba histolytica
SKQQDTM

SEQ ID NO: 2602840 - protein, 9 aa, Entamoeba histolytica
SKSETYTTQ

SEQ ID NO: 2602841 - protein, 9 aa, Entamoeba histolytica
SKTARGNNA

SEQ ID NO: 2602842 - protein, 17 aa, Entamoeba histolytica
SLAEKEITTVDTTVKTK

SEQ ID NO: 2602843 - protein, 7 aa, Entamoeba histolytica
SLFDPSA

SEQ ID NO: 2602844 - protein, 5 aa, Entamoeba histolytica
SLGGG

SEQ ID NO: 2602845 - protein, 10 aa, Entamoeba histolytica
SLNPDSPSFA

SEQ ID NO: 2602846 - protein, 13 aa, Entamoeba histolytica
SMGKMSASDPNSA

SEQ ID NO: 2602847 - protein, 16 aa, Entamoeba histolytica
SNDDNDDDTDNTNEKI

SEQ ID NO: 2602848 - protein, 20 aa, Entamoeba histolytica
SNEKAGVARYTDTRPDEQER

SEQ ID NO: 2602849 - protein, 16 aa, Entamoeba histolytica
SNNDNNDNNDNTNEKI

SEQ ID NO: 2602850 - protein, 4 aa, Entamoeba histolytica
SNSN

SEQ ID NO: 2602851 - protein, 6 aa, Entamoeba histolytica
SNTKTI

SEQ ID NO: 2602852 - protein, 8 aa, Entamoeba histolytica
SPANPTCK

SEQ ID NO: 2602853 - protein, 4 aa, Entamoeba histolytica
SPEI

SEQ ID NO: 2602854 - protein, 8 aa, Entamoeba histolytica
SPEPIDKI

SEQ ID NO: 2602855 - protein, 5 aa, Entamoeba histolytica
SPPTI

SEQ ID NO: 2602856 - protein, 4 aa, Entamoeba histolytica
SPSI

SEQ ID NO: 2602857 - protein, 4 aa, Entamoeba histolytica
SPSV

SEQ ID NO: 2602858 - protein, 8 aa, Entamoeba histolytica
SREARNNF

SEQ ID NO: 2602859 - protein, 18 aa, Entamoeba histolytica
SRKSNQIKKTSYAKSAQI

SEQ ID NO: 2602860 - protein, 13 aa, Entamoeba histolytica
SRNKKTACEQTEA

SEQ ID NO: 2602861 - protein, 26 aa, Entamoeba histolytica
SSNDYLNAQESLKSSNKISTSESNNC

SEQ ID NO: 2602862 - protein, 8 aa, Entamoeba histolytica
SSNLTSAP

SEQ ID NO: 2602863 - protein, 12 aa, Entamoeba histolytica
SSVGEISGQTKT

SEQ ID NO: 2602864 - protein, 7 aa, Entamoeba histolytica
SSVGKTS

SEQ ID NO: 2602865 - protein, 13 aa, Entamoeba histolytica
SSYEKSKDEKLND

SEQ ID NO: 2602866 - protein, 9 aa, Entamoeba histolytica
STDYKTGKI

SEQ ID NO: 2602867 - protein, 15 aa, Entamoeba histolytica
STEDTDTNIKQIEEQ

SEQ ID NO: 2602868 - protein, 13 aa, Entamoeba histolytica
STEEDSKPAKVNA

SEQ ID NO: 2602869 - protein, 7 aa, Entamoeba histolytica
STTETPE

SEQ ID NO: 2602870 - protein, 10 aa, Entamoeba histolytica
STTPGIGPKV

SEQ ID NO: 2602871 - protein, 4 aa, Entamoeba histolytica
STVT

SEQ ID NO: 2602872 - protein, 4 aa, Entamoeba histolytica
SVAA

SEQ ID NO: 2602873 - protein, 12 aa, Entamoeba histolytica
SVGKTVKKEYTV

SEQ ID NO: 2602874 - protein, 9 aa, Entamoeba histolytica
SVKTDSHSE

SEQ ID NO: 2602875 - protein, 4 aa, Entamoeba histolytica
SVSE

SEQ ID NO: 2602876 - protein, 11 aa, Entamoeba histolytica
SVTPPERPVDK

SEQ ID NO: 2602877 - protein, 9 aa, Entamoeba histolytica
SYNTKSNGI

SEQ ID NO: 2602878 - protein, 5 aa, Entamoeba histolytica
TADPV

SEQ ID NO: 2602879 - protein, 9 aa, Entamoeba histolytica
TAGNSSGTV

SEQ ID NO: 2602880 - protein, 8 aa, Entamoeba histolytica
TAGQEKYR

SEQ ID NO: 2602881 - protein, 8 aa, Entamoeba histolytica
TAGQERYR

SEQ ID NO: 2602882 - protein, 7 aa, Entamoeba histolytica
TAGTEQF

SEQ ID NO: 2602883 - protein, 12 aa, Entamoeba histolytica
TAGTRIASEQLK

SEQ ID NO: 2602884 - protein, 5 aa, Entamoeba histolytica
TAKTI

SEQ ID NO: 2602885 - protein, 7 aa, Entamoeba histolytica
TDEEIPN

SEQ ID NO: 2602886 - protein, 7 aa, Entamoeba histolytica
TDESKEM

SEQ ID NO: 2602887 - protein, 8 aa, Entamoeba histolytica
TDGVTNKK

SEQ ID NO: 2602888 - protein, 4 aa, Entamoeba histolytica
TDKL

SEQ ID NO: 2602889 - protein, 4 aa, Entamoeba histolytica
TDVT

SEQ ID NO: 2602890 - protein, 6 aa, Entamoeba histolytica
TEAYKP

SEQ ID NO: 2602891 - protein, 4 aa, Entamoeba histolytica
TEEE

SEQ ID NO: 2602892 - protein, 16 aa, Entamoeba histolytica
TEHYGSSGTSYNNAGE

SEQ ID NO: 2602893 - protein, 7 aa, Entamoeba histolytica
TEPDHSG

SEQ ID NO: 2602894 - protein, 4 aa, Entamoeba histolytica
TFAG

SEQ ID NO: 2602895 - protein, 9 aa, Entamoeba histolytica
TFNTKDKKI

SEQ ID NO: 2602896 - protein, 5 aa, Entamoeba histolytica
TGEDN

SEQ ID NO: 2602897 - protein, 5 aa, Entamoeba histolytica
TGGNA

SEQ ID NO: 2602898 - protein, 4 aa, Entamoeba histolytica
TGKT

SEQ ID NO: 2602899 - protein, 6 aa, Entamoeba histolytica
TGTSQA

SEQ ID NO: 2602900 - protein, 5 aa, Entamoeba histolytica
THRSG

SEQ ID NO: 2602901 - protein, 11 aa, Entamoeba histolytica
THTTGKGNVTC

SEQ ID NO: 2602902 - protein, 9 aa, Entamoeba histolytica
THYETDGYT

SEQ ID NO: 2602903 - protein, 5 aa, Entamoeba histolytica
TIEET

SEQ ID NO: 2602904 - protein, 9 aa, Entamoeba histolytica
TIPTSVSEL

SEQ ID NO: 2602905 - protein, 10 aa, Entamoeba histolytica
TIRTGGKARI

SEQ ID NO: 2602906 - protein, 8 aa, Entamoeba histolytica
TISTDADT

SEQ ID NO: 2602907 - protein, 6 aa, Entamoeba histolytica
TITEPS

SEQ ID NO: 2602908 - protein, 4 aa, Entamoeba histolytica
TITS

SEQ ID NO: 2602909 - protein, 7 aa, Entamoeba histolytica
TKMGKTE

SEQ ID NO: 2602910 - protein, 5 aa, Entamoeba histolytica
TKNVP

SEQ ID NO: 2602911 - protein, 4 aa, Entamoeba histolytica
TLKG

SEQ ID NO: 2602912 - protein, 5 aa, Entamoeba histolytica
TLTSN

SEQ ID NO: 2602913 - protein, 22 aa, Entamoeba histolytica
TNPTIEEAAPKKTRNQKDKMNQ

SEQ ID NO: 2602914 - protein, 6 aa, Entamoeba histolytica
TNVSKI

SEQ ID NO: 2602915 - protein, 12 aa, Entamoeba histolytica
TPFDVWNDEEIK

SEQ ID NO: 2602916 - protein, 4 aa, Entamoeba histolytica
TPLT

SEQ ID NO: 2602917 - protein, 7 aa, Entamoeba histolytica
TPSYRPP

SEQ ID NO: 2602918 - protein, 37 aa, Entamoeba histolytica
TQIPDQQINTTTPTTCQEIQSNQSPTISIQNTMSHPS

SEQ ID NO: 2602919 - protein, 6 aa, Entamoeba histolytica
TQKEHP

SEQ ID NO: 2602920 - protein, 4 aa, Entamoeba histolytica
TQTI

SEQ ID NO: 2602921 - protein, 5 aa, Entamoeba histolytica
TRGMT

SEQ ID NO: 2602922 - protein, 15 aa, Entamoeba histolytica
TRRGTEDFCTGTSEG

SEQ ID NO: 2602923 - protein, 4 aa, Entamoeba histolytica
TSIE

SEQ ID NO: 2602924 - protein, 9 aa, Entamoeba histolytica
TSLNNGLSK

SEQ ID NO: 2602925 - protein, 7 aa, Entamoeba histolytica
TSTSKGY

SEQ ID NO: 2602926 - protein, 6 aa, Entamoeba histolytica
TSTSKT

SEQ ID NO: 2602927 - protein, 7 aa, Entamoeba histolytica
TSTTQTP

SEQ ID NO: 2602928 - protein, 4 aa, Entamoeba histolytica
TSVS

SEQ ID NO: 2602929 - protein, 6 aa, Entamoeba histolytica
TSVSEI

SEQ ID NO: 2602930 - protein, 9 aa, Entamoeba histolytica
TSVSELGDS

SEQ ID NO: 2602931 - protein, 10 aa, Entamoeba histolytica
TTFNEEDGAR

SEQ ID NO: 2602932 - protein, 10 aa, Entamoeba histolytica
TTGNDTNKIF

SEQ ID NO: 2602933 - protein, 5 aa, Entamoeba histolytica
TTKPT

SEQ ID NO: 2602934 - protein, 5 aa, Entamoeba histolytica
TTLNS

SEQ ID NO: 2602935 - protein, 10 aa, Entamoeba histolytica
TTSGTGSEVT

SEQ ID NO: 2602936 - protein, 15 aa, Entamoeba histolytica
TTTNNGGVVTTDNPI

SEQ ID NO: 2602937 - protein, 5 aa, Entamoeba histolytica
TTVNG

SEQ ID NO: 2602938 - protein, 5 aa, Entamoeba histolytica
TTVTD

SEQ ID NO: 2602939 - protein, 8 aa, Entamoeba histolytica
TVGNNAKV

SEQ ID NO: 2602940 - protein, 9 aa, Entamoeba histolytica
TVQSEEEDE

SEQ ID NO: 2602941 - protein, 5 aa, Entamoeba histolytica
TWSAY

SEQ ID NO: 2602942 - protein, 8 aa, Entamoeba histolytica
TYETADAI

SEQ ID NO: 2602943 - protein, 9 aa, Entamoeba histolytica
VDKKSPKQV

SEQ ID NO: 2602944 - protein, 8 aa, Entamoeba histolytica
VDNKTSTI

SEQ ID NO: 2602945 - protein, 6 aa, Entamoeba histolytica
VEEDVS

SEQ ID NO: 2602946 - protein, 13 aa, Entamoeba histolytica
VEKKEEDIGAGDQ

SEQ ID NO: 2602947 - protein, 5 aa, Entamoeba histolytica
VETIK

SEQ ID NO: 2602948 - protein, 4 aa, Entamoeba histolytica
VGDN

SEQ ID NO: 2602949 - protein, 11 aa, Entamoeba histolytica
VGPNEPLTREK

SEQ ID NO: 2602950 - protein, 4 aa, Entamoeba histolytica
VGSS

SEQ ID NO: 2602951 - protein, 10 aa, Entamoeba histolytica
VKAPGDKTAP

SEQ ID NO: 2602952 - protein, 7 aa, Entamoeba histolytica
VKTESIE

SEQ ID NO: 2602953 - protein, 7 aa, Entamoeba histolytica
VKTQISY

SEQ ID NO: 2602954 - protein, 6 aa, Entamoeba histolytica
VPDSTY

SEQ ID NO: 2602955 - protein, 4 aa, Entamoeba histolytica
VPGA

SEQ ID NO: 2602956 - protein, 4 aa, Entamoeba histolytica
VPSS

SEQ ID NO: 2602957 - protein, 7 aa, Entamoeba histolytica
VPVPADK

SEQ ID NO: 2602958 - protein, 8 aa, Entamoeba histolytica
VQNPPPVE

SEQ ID NO: 2602959 - protein, 9 aa, Entamoeba histolytica
VSAKKRQEI

SEQ ID NO: 2602960 - protein, 8 aa, Entamoeba histolytica
VSGGHPDK

SEQ ID NO: 2602961 - protein, 7 aa, Entamoeba histolytica
VSKRAND

SEQ ID NO: 2602962 - protein, 7 aa, Entamoeba histolytica
VSRTNKN

SEQ ID NO: 2602963 - protein, 13 aa, Entamoeba histolytica
VSSQEAQDLAKRE

SEQ ID NO: 2602964 - protein, 7 aa, Entamoeba histolytica
VSTDNNE

SEQ ID NO: 2602965 - protein, 4 aa, Entamoeba histolytica
VTGN

SEQ ID NO: 2602966 - protein, 19 aa, Entamoeba histolytica
VTHGRPGVGATHSSKFVPL

SEQ ID NO: 2602967 - protein, 14 aa, Entamoeba histolytica
VTPRAANASAAGKK

SEQ ID NO: 2602968 - protein, 5 aa, Entamoeba histolytica
WGSYG

SEQ ID NO: 2602969 - protein, 10 aa, Entamoeba histolytica
WNPQNDLQAQ

SEQ ID NO: 2602970 - protein, 5 aa, Entamoeba histolytica
WRRKD

SEQ ID NO: 2602971 - protein, 4 aa, Entamoeba histolytica
YAAE

SEQ ID NO: 2602972 - protein, 4 aa, Entamoeba histolytica
YCGP

SEQ ID NO: 2602973 - protein, 11 aa, Entamoeba histolytica
YDNTDKDTNGA

SEQ ID NO: 2602974 - protein, 5 aa, Entamoeba histolytica
YENEE

SEQ ID NO: 2602975 - protein, 4 aa, Entamoeba histolytica
YEQH

SEQ ID NO: 2602976 - protein, 4 aa, Entamoeba histolytica
YGAP

SEQ ID NO: 2602977 - protein, 9 aa, Entamoeba histolytica
YGEGTPTAA

SEQ ID NO: 2602978 - protein, 13 aa, Entamoeba histolytica
YKKKEMKKASRKK

SEQ ID NO: 2602979 - protein, 6 aa, Entamoeba histolytica
YNDSTK

SEQ ID NO: 2602980 - protein, 11 aa, Entamoeba histolytica
YNGDLEAREKM

SEQ ID NO: 2602981 - protein, 10 aa, Entamoeba histolytica
YNGKTYSGKR

SEQ ID NO: 2602982 - protein, 12 aa, Entamoeba histolytica
YNPQNESELKLE

SEQ ID NO: 2602983 - protein, 9 aa, Entamoeba histolytica
YPPNNGGKI

SEQ ID NO: 2602984 - protein, 7 aa, Entamoeba histolytica
YSHPSPS

SEQ ID NO: 2602985 - protein, 7 aa, Entamoeba histolytica
YSTGKTT

SEQ ID NO: 2602986 - protein, 5 aa, Entamoeba histolytica
YTYPQ

SEQ ID NO: 2602987 - protein, 4 aa, Entamoeba histolytica
YYAP

SEQ ID NO: 2602988 - protein, 8 aa, Entamoeba histolytica
AAAQTTSN

SEQ ID NO: 2602989 - protein, 7 aa, Entamoeba histolytica
AAGAPEN

SEQ ID NO: 2602990 - protein, 6 aa, Entamoeba histolytica
AAGKTS

SEQ ID NO: 2602991 - protein, 5 aa, Entamoeba histolytica
AAGQI

SEQ ID NO: 2602992 - protein, 17 aa, Entamoeba histolytica
AAIAEEKNSNTSGGQEF

SEQ ID NO: 2602993 - protein, 18 aa, Entamoeba histolytica
AAKKDYAKTKDAAKAKEL

SEQ ID NO: 2602994 - protein, 17 aa, Entamoeba histolytica
AAKLGEDYTPEEVDERR

SEQ ID NO: 2602995 - protein, 13 aa, Entamoeba histolytica
AAKRAEEDNKKEE

SEQ ID NO: 2602996 - protein, 6 aa, Entamoeba histolytica
AALGRA

SEQ ID NO: 2602997 - protein, 5 aa, Entamoeba histolytica
AAMHS

SEQ ID NO: 2602998 - protein, 36 aa, Entamoeba histolytica; identical to SEQ ID NO: 2406631

SEQ ID NO: 2602999 - protein, 6 aa, Entamoeba histolytica
AAQQSI

SEQ ID NO: 2603000 - protein, 6 aa, Entamoeba histolytica
AASTDF

SEQ ID NO: 2603001 - protein, 4 aa, Entamoeba histolytica
AATA

SEQ ID NO: 2603002 - protein, 14 aa, Entamoeba histolytica
AATAKEAIASGRPV

SEQ ID NO: 2603003 - protein, 5 aa, Entamoeba histolytica
AATEA

SEQ ID NO: 2603004 - protein, 5 aa, Entamoeba histolytica
AATQA

SEQ ID NO: 2603005 - protein, 6 aa, Entamoeba histolytica
ADAAIG

SEQ ID NO: 2603006 - protein, 5 aa, Entamoeba histolytica
ADDVA

SEQ ID NO: 2603007 - protein, 19 aa, Entamoeba histolytica
ADENQKPITTEEGEKLAKD

SEQ ID NO: 2603008 - protein, 7 aa, Entamoeba histolytica
ADKDNKQ

SEQ ID NO: 2603009 - protein, 7 aa, Entamoeba histolytica
ADKIATE

SEQ ID NO: 2603010 - protein, 10 aa, Entamoeba histolytica
ADKYTKKTKL

SEQ ID NO: 2603011 - protein, 6 aa, Entamoeba histolytica
ADNSYA

SEQ ID NO: 2603012 - protein, 14 aa, Entamoeba histolytica
ADNTKIISGGRDKT

SEQ ID NO: 2603013 - protein, 8 aa, Entamoeba histolytica
ADSEDDRE

SEQ ID NO: 2603014 - protein, 11 aa, Entamoeba histolytica
ADTVNNDPEVG

SEQ ID NO: 2603015 - protein, 6 aa, Entamoeba histolytica
AEDGSV

SEQ ID NO: 2603016 - protein, 6 aa, Entamoeba histolytica
AEDNKS

SEQ ID NO: 2603017 - protein, 9 aa, Entamoeba histolytica
AEDRVKEGR

SEQ ID NO: 2603018 - protein, 14 aa, Entamoeba histolytica
AEDSGQIELGDSQF

SEQ ID NO: 2603019 - protein, 11 aa, Entamoeba histolytica
AEEKKAQGNEM

SEQ ID NO: 2603020 - protein, 10 aa, Entamoeba histolytica
AEEREQAERI

SEQ ID NO: 2603021 - protein, 17 aa, Entamoeba histolytica
AEEYRKGKESWLFTKLR

SEQ ID NO: 2603022 - protein, 6 aa, Entamoeba histolytica
AEGPLK

SEQ ID NO: 2603023 - protein, 18 aa, Entamoeba histolytica
AEGQKKDFPNGIEECGTD

SEQ ID NO: 2603024 - protein, 15 aa, Entamoeba histolytica
AEKEKRLGEAERLAR

SEQ ID NO: 2603025 - protein, 9 aa, Entamoeba histolytica
AEKGETDKG

SEQ ID NO: 2603026 - protein, 10 aa, Entamoeba histolytica
AEKGKTDKGI

SEQ ID NO: 2603027 - protein, 11 aa, Entamoeba histolytica
AEKKQNQIDDI

SEQ ID NO: 2603028 - protein, 6 aa, Entamoeba histolytica
AEKTNP

SEQ ID NO: 2603029 - protein, 4 aa, Entamoeba histolytica
AENA

SEQ ID NO: 2603030 - protein, 8 aa, Entamoeba histolytica
AENIVDGN

SEQ ID NO: 2603031 - protein, 9 aa, Entamoeba histolytica
AEREQKNPT

SEQ ID NO: 2603032 - protein, 10 aa, Entamoeba histolytica
AERLKDPHYK

SEQ ID NO: 2603033 - protein, 5 aa, Entamoeba histolytica
AERSL

SEQ ID NO: 2603034 - protein, 9 aa, Entamoeba histolytica
AESDGSYED

SEQ ID NO: 2603035 - protein, 6 aa, Entamoeba histolytica
AETVST

SEQ ID NO: 2603036 - protein, 6 aa, Entamoeba histolytica
AEVSRP

SEQ ID NO: 2603037 - protein, 16 aa, Entamoeba histolytica
AEYDEFGASYINSKDK

SEQ ID NO: 2603038 - protein, 6 aa, Entamoeba histolytica
AFHQKE

SEQ ID NO: 2603039 - protein, 10 aa, Entamoeba histolytica
AFPSTNKNSF

SEQ ID NO: 2603040 - protein, 5 aa, Entamoeba histolytica
AFQED

SEQ ID NO: 2603041 - protein, 6 aa, Entamoeba histolytica
AGADPK

SEQ ID NO: 2603042 - protein, 6 aa, Entamoeba histolytica
AGDDKT

SEQ ID NO: 2603043 - protein, 9 aa, Entamoeba histolytica
AGEEQPRKV

SEQ ID NO: 2603044 - protein, 11 aa, Entamoeba histolytica
AGFPAHASENQ

SEQ ID NO: 2603045 - protein, 6 aa, Entamoeba histolytica
AGGNMT

SEQ ID NO: 2603046 - protein, 8 aa, Entamoeba histolytica
AGGQAKDF

SEQ ID NO: 2603047 - protein, 11 aa, Entamoeba histolytica
AGIDASNEAEM

SEQ ID NO: 2603048 - protein, 5 aa, Entamoeba histolytica
AGKDG

SEQ ID NO: 2603049 - protein, 8 aa, Entamoeba histolytica
AGKGRTGL

SEQ ID NO: 2603050 - protein, 5 aa, Entamoeba histolytica
AGKKA

SEQ ID NO: 2603051 - protein, 7 aa, Entamoeba histolytica
AGPTIEP

SEQ ID NO: 2603052 - protein, 9 aa, Entamoeba histolytica
AGPTSSGAV

SEQ ID NO: 2603053 - protein, 7 aa, Entamoeba histolytica
AGQEKYR

SEQ ID NO: 2603054 - protein, 7 aa, Entamoeba histolytica
AGQERYR

SEQ ID NO: 2603055 - protein, 7 aa, Entamoeba histolytica
AGRFGTK

SEQ ID NO: 2603056 - protein, 34 aa, Entamoeba histolytica
AGSQETPYKGSDVNKPLPEVQPQQSEEPKEEIKE

SEQ ID NO: 2603057 - protein, 8 aa, Entamoeba histolytica
AGSSKRPI

SEQ ID NO: 2603058 - protein, 5 aa, Entamoeba histolytica
AGTTI

SEQ ID NO: 2603059 - protein, 5 aa, Entamoeba histolytica
AGYDN

SEQ ID NO: 2603060 - protein, 12 aa, Entamoeba histolytica
AIEKGKERYEKR

SEQ ID NO: 2603061 - protein, 10 aa, Entamoeba histolytica
AIGANYQAAE

SEQ ID NO: 2603062 - protein, 6 aa, Entamoeba histolytica
AIPGDN

SEQ ID NO: 2603063 - protein, 5 aa, Entamoeba histolytica
AIPQH

SEQ ID NO: 2603064 - protein, 8 aa, Entamoeba histolytica
AISGDSYK

SEQ ID NO: 2603065 - protein, 10 aa, Entamoeba histolytica
AIVDDSKSPI

SEQ ID NO: 2603066 - protein, 12 aa, Entamoeba histolytica
AIVENSDTSQIN

SEQ ID NO: 2603067 - protein, 9 aa, Entamoeba histolytica
AIYSDKTED

SEQ ID NO: 2603068 - protein, 7 aa, Entamoeba histolytica
AKAKINI

SEQ ID NO: 2603069 - protein, 13 aa, Entamoeba histolytica
AKAQAAHKAQYAA

SEQ ID NO: 2603070 - protein, 18 aa, Entamoeba histolytica
AKEERKPKKSGGKKQGTL

SEQ ID NO: 2603071 - protein, 10 aa, Entamoeba histolytica
AKEGNQRKRV

SEQ ID NO: 2603072 - protein, 4 aa, Entamoeba histolytica
AKEN

SEQ ID NO: 2603073 - protein, 7 aa, Entamoeba histolytica
AKEPTRI

SEQ ID NO: 2603074 - protein, 7 aa, Entamoeba histolytica
AKEVESK

SEQ ID NO: 2603075 - protein, 9 aa, Entamoeba histolytica
AKGDELRSE

SEQ ID NO: 2603076 - protein, 34 aa, Entamoeba histolytica; identical to SEQ ID NO: 2559036

SEQ ID NO: 2603077 - protein, 7 aa, Entamoeba histolytica
AKGTILS

SEQ ID NO: 2603078 - protein, 7 aa, Entamoeba histolytica
AKGTSQH

SEQ ID NO: 2603079 - protein, 24 aa, Entamoeba histolytica
AKHAAAAPTEAEKKPAKGSKKQVK

SEQ ID NO: 2603080 - protein, 7 aa, Entamoeba histolytica
AKIDKNL

SEQ ID NO: 2603081 - protein, 7 aa, Entamoeba histolytica
AKIRKEN

SEQ ID NO: 2603082 - protein, 10 aa, Entamoeba histolytica
AKISPQDTKN

SEQ ID NO: 2603083 - protein, 5 aa, Entamoeba histolytica
AKKEY

SEQ ID NO: 2603084 - protein, 9 aa, Entamoeba histolytica
AKKHNKKAA

SEQ ID NO: 2603085 - protein, 5 aa, Entamoeba histolytica
AKKNA

SEQ ID NO: 2603086 - protein, 9 aa, Entamoeba histolytica
AKKTLTKEN

SEQ ID NO: 2603087 - protein, 17 aa, Entamoeba histolytica
AKNAIAAYKAALAKKIA

SEQ ID NO: 2603088 - protein, 14 aa, Entamoeba histolytica
AKNCKGDQITQGGV

SEQ ID NO: 2603089 - protein, 8 aa, Entamoeba histolytica
AKNDIEKD

SEQ ID NO: 2603090 - protein, 13 aa, Entamoeba histolytica
AKNEAERKERAAK

SEQ ID NO: 2603091 - protein, 13 aa, Entamoeba histolytica
AKNETERKEKAAK

SEQ ID NO: 2603092 - protein, 4 aa, Entamoeba histolytica
AKNI

SEQ ID NO: 2603093 - protein, 8 aa, Entamoeba histolytica
AKNVAKAV

SEQ ID NO: 2603094 - protein, 18 aa, Entamoeba histolytica
AKPEREVEKKTASGRTFK

SEQ ID NO: 2603095 - protein, 9 aa, Entamoeba histolytica
AKQQQAEIG

SEQ ID NO: 2603096 - protein, 18 aa, Entamoeba histolytica
AKSNEITSIKGNSCPRGA

SEQ ID NO: 2603097 - protein, 6 aa, Entamoeba histolytica
AKSRGY

SEQ ID NO: 2603098 - protein, 8 aa, Entamoeba histolytica
AKSSKENV

SEQ ID NO: 2603099 - protein, 7 aa, Entamoeba histolytica
AKSTNKK

SEQ ID NO: 2603100 - protein, 17 aa, Entamoeba histolytica
AKSVDNLGSMFQGWLPY

SEQ ID NO: 2603101 - protein, 10 aa, Entamoeba histolytica
AKSVKGKAKL

SEQ ID NO: 2603102 - protein, 8 aa, Entamoeba histolytica
AKTDNGKL

SEQ ID NO: 2603103 - protein, 8 aa, Entamoeba histolytica
AKTGDGVS

SEQ ID NO: 2603104 - protein, 9 aa, Entamoeba histolytica
AKTGEGVKE

SEQ ID NO: 2603105 - protein, 8 aa, Entamoeba histolytica
AKTKGSDE

SEQ ID NO: 2603106 - protein, 9 aa, Entamoeba histolytica
AKTKRNTYC

SEQ ID NO: 2603107 - protein, 6 aa, Entamoeba histolytica
AKTNEV

SEQ ID NO: 2603108 - protein, 31 aa, Entamoeba histolytica; identical to SEQ ID NO: 2406732

SEQ ID NO: 2603109 - protein, 6 aa, Entamoeba histolytica
AKTSMQ

SEQ ID NO: 2603110 - protein, 6 aa, Entamoeba histolytica
AKYGEI

SEQ ID NO: 2603111 - protein, 5 aa, Entamoeba histolytica
ALDKK

SEQ ID NO: 2603112 - protein, 7 aa, Entamoeba histolytica
ALNKDKK

SEQ ID NO: 2603113 - protein, 7 aa, Entamoeba histolytica
ALPEPDE

SEQ ID NO: 2603114 - protein, 4 aa, Entamoeba histolytica
ALPS

SEQ ID NO: 2603115 - protein, 6 aa, Entamoeba histolytica
ALPYEE

SEQ ID NO: 2603116 - protein, 10 aa, Entamoeba histolytica
ALQDSTHSEQ

SEQ ID NO: 2603117 - protein, 8 aa, Entamoeba histolytica
ALQERAKE

SEQ ID NO: 2603118 - protein, 7 aa, Entamoeba histolytica
ALRDNSM

SEQ ID NO: 2603119 - protein, 13 aa, Entamoeba histolytica
ALTPDNDKETSDL

SEQ ID NO: 2603120 - protein, 7 aa, Entamoeba histolytica
ANADETV

SEQ ID NO: 2603121 - protein, 4 aa, Entamoeba histolytica
ANDF

SEQ ID NO: 2603122 - protein, 4 aa, Entamoeba histolytica
ANET

SEQ ID NO: 2603123 - protein, 9 aa, Entamoeba histolytica
ANGFGTTAC

SEQ ID NO: 2603124 - protein, 13 aa, Entamoeba histolytica
ANINVANKAKNTA

SEQ ID NO: 2603125 - protein, 5 aa, Entamoeba histolytica
ANKER

SEQ ID NO: 2603126 - protein, 7 aa, Entamoeba histolytica
ANLGDAE

SEQ ID NO: 2603127 - protein, 6 aa, Entamoeba histolytica
ANMTDA

SEQ ID NO: 2603128 - protein, 18 aa, Entamoeba histolytica
ANNDNFESYQQRGLEEGT

SEQ ID NO: 2603129 - protein, 21 aa, Entamoeba histolytica
ANQDDRADNVIPGTKQNHLDT

SEQ ID NO: 2603130 - protein, 16 aa, Entamoeba histolytica
ANRKPSLPLPKPGEVE

SEQ ID NO: 2603131 - protein, 7 aa, Entamoeba histolytica
ANRTEST

SEQ ID NO: 2603132 - protein, 6 aa, Entamoeba histolytica
ANSRKA

SEQ ID NO: 2603133 - protein, 8 aa, Entamoeba histolytica
ANTDNAES

SEQ ID NO: 2603134 - protein, 9 aa, Entamoeba histolytica
ANTTHEKAY

SEQ ID NO: 2603135 - protein, 17 aa, Entamoeba histolytica
ANYQQKYTQQGGSRPFG

SEQ ID NO: 2603136 - protein, 4 aa, Entamoeba histolytica
APAQ

SEQ ID NO: 2603137 - protein, 6 aa, Entamoeba histolytica
APDEEI

SEQ ID NO: 2603138 - protein, 4 aa, Entamoeba histolytica
APEA

SEQ ID NO: 2603139 - protein, 8 aa, Entamoeba histolytica
APGSGKTT

SEQ ID NO: 2603140 - protein, 6 aa, Entamoeba histolytica
APGYIP

SEQ ID NO: 2603141 - protein, 9 aa, Entamoeba histolytica
APIPTGKEV

SEQ ID NO: 2603142 - protein, 5 aa, Entamoeba histolytica
APKIP

SEQ ID NO: 2603143 - protein, 6 aa, Entamoeba histolytica
APKQDV

SEQ ID NO: 2603144 - protein, 6 aa, Entamoeba histolytica
APPHGF

SEQ ID NO: 2603145 - protein, 4 aa, Entamoeba histolytica
APSE

SEQ ID NO: 2603146 - protein, 5 aa, Entamoeba histolytica
APSIA

SEQ ID NO: 2603147 - protein, 7 aa, Entamoeba histolytica
APSITER

SEQ ID NO: 2603148 - protein, 5 aa, Entamoeba histolytica
APSYP

SEQ ID NO: 2603149 - protein, 8 aa, Entamoeba histolytica
APTKPVVT

SEQ ID NO: 2603150 - protein, 7 aa, Entamoeba histolytica
AQDVAKR

SEQ ID NO: 2603151 - protein, 4 aa, Entamoeba histolytica
AQEE

SEQ ID NO: 2603152 - protein, 4 aa, Entamoeba histolytica
AQHG

SEQ ID NO: 2603153 - protein, 8 aa, Entamoeba histolytica
AQKAKQNY

SEQ ID NO: 2603154 - protein, 11 aa, Entamoeba histolytica
AQNEVTNSIEE

SEQ ID NO: 2603155 - protein, 8 aa, Entamoeba histolytica
AQPPPDFS

SEQ ID NO: 2603156 - protein, 7 aa, Entamoeba histolytica
AQQSTFE

SEQ ID NO: 2603157 - protein, 9 aa, Entamoeba histolytica
AQTGSGKTA

SEQ ID NO: 2603158 - protein, 8 aa, Entamoeba histolytica
AQTTPEEF

SEQ ID NO: 2603159 - protein, 46 aa, Entamoeba histolytica
ARANRGGSTPHPTRGAPAPRGMPSRGRGGMMPPTQAPEPEEQETPV

SEQ ID NO: 2603160 - protein, 7 aa, Entamoeba histolytica
ARENYSK

SEQ ID NO: 2603161 - protein, 15 aa, Entamoeba histolytica
ARGEKVGEFRRGKSV

SEQ ID NO: 2603162 - protein, 5 aa, Entamoeba histolytica
ARIEN

SEQ ID NO: 2603163 - protein, 19 aa, Entamoeba histolytica
ARPTNPERARRLGYKPKSG

SEQ ID NO: 2603164 - protein, 8 aa, Entamoeba histolytica
ARTTTGSK

SEQ ID NO: 2603165 - protein, 7 aa, Entamoeba histolytica
ASAEQCK

SEQ ID NO: 2603166 - protein, 6 aa, Entamoeba histolytica
ASAPVN

SEQ ID NO: 2603167 - protein, 13 aa, Entamoeba histolytica
ASEEYDRAAEAYD

SEQ ID NO: 2603168 - protein, 33 aa, Entamoeba histolytica
ASGKKGALTKPKKSSGGKAPKKSWSKTKVKEKL

SEQ ID NO: 2603169 - protein, 4 aa, Entamoeba histolytica
ASID

SEQ ID NO: 2603170 - protein, 6 aa, Entamoeba histolytica
ASIPNS

SEQ ID NO: 2603171 - protein, 8 aa, Entamoeba histolytica
ASKDKVSE

SEQ ID NO: 2603172 - protein, 7 aa, Entamoeba histolytica
ASKDSTV

SEQ ID NO: 2603173 - protein, 7 aa, Entamoeba histolytica
ASKRIKG

SEQ ID NO: 2603174 - protein, 7 aa, Entamoeba histolytica
ASNESLA

SEQ ID NO: 2603175 - protein, 9 aa, Entamoeba histolytica
ASNKAREVV

SEQ ID NO: 2603176 - protein, 8 aa, Entamoeba histolytica
ASNKTEVA

SEQ ID NO: 2603177 - protein, 4 aa, Entamoeba histolytica
ASPL

SEQ ID NO: 2603178 - protein, 6 aa, Entamoeba histolytica
ASSEGT

SEQ ID NO: 2603179 - protein, 4 aa, Entamoeba histolytica
ASTI

SEQ ID NO: 2603180 - protein, 6 aa, Entamoeba histolytica
ASTNKM

SEQ ID NO: 2603181 - protein, 8 aa, Entamoeba histolytica
ASTSAGCK

SEQ ID NO: 2603182 - protein, 9 aa, Entamoeba histolytica
ATDTKEQRN

SEQ ID NO: 2603183 - protein, 9 aa, Entamoeba histolytica
ATEPEAVKK

SEQ ID NO: 2603184 - protein, 10 aa, Entamoeba histolytica
ATGAGTEAAQ

SEQ ID NO: 2603185 - protein, 6 aa, Entamoeba histolytica
ATGGDV

SEQ ID NO: 2603186 - protein, 4 aa, Entamoeba histolytica
ATGQ

SEQ ID NO: 2603187 - protein, 19 aa, Entamoeba histolytica
ATKDATKPKKAGDEEKKTM

SEQ ID NO: 2603188 - protein, 5 aa, Entamoeba histolytica
ATKPD

SEQ ID NO: 2603189 - protein, 8 aa, Entamoeba histolytica
ATKSSQMR

SEQ ID NO: 2603190 - protein, 6 aa, Entamoeba histolytica
ATKTMV

SEQ ID NO: 2603191 - protein, 6 aa, Entamoeba histolytica
ATLGSD

SEQ ID NO: 2603192 - protein, 4 aa, Entamoeba histolytica
ATNT

SEQ ID NO: 2603193 - protein, 4 aa, Entamoeba histolytica
ATPE

SEQ ID NO: 2603194 - protein, 10 aa, Entamoeba histolytica
ATRNRTNPTQ

SEQ ID NO: 2603195 - protein, 7 aa, Entamoeba histolytica
ATSGNTG

SEQ ID NO: 2603196 - protein, 11 aa, Entamoeba histolytica
ATSNEQQTNDN

SEQ ID NO: 2603197 - protein, 8 aa, Entamoeba histolytica
ATSSADTT

SEQ ID NO: 2603198 - protein, 11 aa, Entamoeba histolytica
ATYAYSQKDYM

SEQ ID NO: 2603199 - protein, 23 aa, Entamoeba histolytica
AVARAEKALNNAISKEYDTPQKL

SEQ ID NO: 2603200 - protein, 9 aa, Entamoeba histolytica
AVEETGRGI

SEQ ID NO: 2603201 - protein, 13 aa, Entamoeba histolytica
AVGEDDKEEINDL

SEQ ID NO: 2603202 - protein, 5 aa, Entamoeba histolytica
AVGKT

SEQ ID NO: 2603203 - protein, 6 aa, Entamoeba histolytica
AVGYTG

SEQ ID NO: 2603204 - protein, 7 aa, Entamoeba histolytica
AVKEGKT

SEQ ID NO: 2603205 - protein, 5 aa, Entamoeba histolytica
AVRKG

SEQ ID NO: 2603206 - protein, 9 aa, Entamoeba histolytica
AVSEEATPA

SEQ ID NO: 2603207 - protein, 23 aa, Entamoeba histolytica
AVSSGCDAKTQETVGYNGEGNRR

SEQ ID NO: 2603208 - protein, 6 aa, Entamoeba histolytica
AWKPNT

SEQ ID NO: 2603209 - protein, 7 aa, Entamoeba histolytica
AYAQDPT

SEQ ID NO: 2603210 - protein, 4 aa, Entamoeba histolytica
AYDN

SEQ ID NO: 2603211 - protein, 8 aa, Entamoeba histolytica
AYDSNGKK

SEQ ID NO: 2603212 - protein, 6 aa, Entamoeba histolytica
AYGYTQ

SEQ ID NO: 2603213 - protein, 7 aa, Entamoeba histolytica
AYPDVEK

SEQ ID NO: 2603214 - protein, 14 aa, Entamoeba histolytica
AYTQEDRNTYGNTI

SEQ ID NO: 2603215 - protein, 11 aa, Entamoeba histolytica
CAEGDGNTIIE

SEQ ID NO: 2603216 - protein, 5 aa, Entamoeba histolytica
CASGN

SEQ ID NO: 2603217 - protein, 8 aa, Entamoeba histolytica
CDDSSRVT

SEQ ID NO: 2603218 - protein, 7 aa, Entamoeba histolytica
CDGEETS

SEQ ID NO: 2603219 - protein, 4 aa, Entamoeba histolytica
CDIG

SEQ ID NO: 2603220 - protein, 7 aa, Entamoeba histolytica
CDKTPDI

SEQ ID NO: 2603221 - protein, 6 aa, Entamoeba histolytica
CDRNGP

SEQ ID NO: 2603222 - protein, 12 aa, Entamoeba histolytica
CEADGKECCPNR

SEQ ID NO: 2603223 - protein, 6 aa, Entamoeba histolytica
CEATGK

SEQ ID NO: 2603224 - protein, 11 aa, Entamoeba histolytica
CEATGKEITTG

SEQ ID NO: 2603225 - protein, 12 aa, Entamoeba histolytica
CEFTSSAKSLTQ

SEQ ID NO: 2603226 - protein, 5 aa, Entamoeba histolytica
CENPE

SEQ ID NO: 2603227 - protein, 5 aa, Entamoeba histolytica
CEPYP

SEQ ID NO: 2603228 - protein, 8 aa, Entamoeba histolytica
CGATTTTF

SEQ ID NO: 2603229 - protein, 4 aa, Entamoeba histolytica
CGDS

SEQ ID NO: 2603230 - protein, 4 aa, Entamoeba histolytica
CGES

SEQ ID NO: 2603231 - protein, 11 aa, Entamoeba histolytica
CGNEADSEQQY

SEQ ID NO: 2603232 - protein, 4 aa, Entamoeba histolytica
CGPA

SEQ ID NO: 2603233 - protein, 8 aa, Entamoeba histolytica
CGPRPQME

SEQ ID NO: 2603234 - protein, 5 aa, Entamoeba histolytica
CITPG

SEQ ID NO: 2603235 - protein, 4 aa, Entamoeba histolytica
CKEN

SEQ ID NO: 2603236 - protein, 11 aa, Entamoeba histolytica
CKNTENTGKLD

SEQ ID NO: 2603237 - protein, 10 aa, Entamoeba histolytica
CNFPKGDPIE

SEQ ID NO: 2603238 - protein, 9 aa, Entamoeba histolytica
CNKSNQDSL

SEQ ID NO: 2603239 - protein, 8 aa, Entamoeba histolytica
CNKTNQNS

SEQ ID NO: 2603240 - protein, 14 aa, Entamoeba histolytica
CPDEDDDNSRSEEE

SEQ ID NO: 2603241 - protein, 5 aa, Entamoeba histolytica
CPINR

SEQ ID NO: 2603242 - protein, 5 aa, Entamoeba histolytica
CPPLE

SEQ ID NO: 2603243 - protein, 6 aa, Entamoeba histolytica
CSEDRN

SEQ ID NO: 2603244 - protein, 19 aa, Entamoeba histolytica
CTAEGEGLENAETKTPAPF

SEQ ID NO: 2603245 - protein, 8 aa, Entamoeba histolytica
CTDYQSRE

SEQ ID NO: 2603246 - protein, 5 aa, Entamoeba histolytica
CTSLT

SEQ ID NO: 2603247 - protein, 8 aa, Entamoeba histolytica
CTTFSPDG

SEQ ID NO: 2603248 - protein, 20 aa, Entamoeba histolytica
CVTAPQPTIIPQPPNPSYAR

SEQ ID NO: 2603249 - protein, 7 aa, Entamoeba histolytica
DAAKNQI

SEQ ID NO: 2603250 - protein, 17 aa, Entamoeba histolytica
DAEDDATRQVSTYDSEY

SEQ ID NO: 2603251 - protein, 5 aa, Entamoeba histolytica
DAIKP

SEQ ID NO: 2603252 - protein, 39 aa, Entamoeba histolytica
DAKKDAPVIAGEEKVAKVEDKKAASDATVASTEWDDQKK

SEQ ID NO: 2603253 - protein, 5 aa, Entamoeba histolytica
DALGT

SEQ ID NO: 2603254 - protein, 15 aa, Entamoeba histolytica
DANKRLPSIRKTGEA

SEQ ID NO: 2603255 - protein, 4 aa, Entamoeba histolytica
DAPR

SEQ ID NO: 2603256 - protein, 6 aa, Entamoeba histolytica
DAPTVE

SEQ ID NO: 2603257 - protein, 10 aa, Entamoeba histolytica
DAQGRKMSKS

SEQ ID NO: 2603258 - protein, 4 aa, Entamoeba histolytica
DASH

SEQ ID NO: 2603259 - protein, 7 aa, Entamoeba histolytica
DATNSYL

SEQ ID NO: 2603260 - protein, 8 aa, Entamoeba histolytica
DCERKGER

SEQ ID NO: 2603261 - protein, 15 aa, Entamoeba histolytica
DCNDKSKDTDNDKKV

SEQ ID NO: 2603262 - protein, 4 aa, Entamoeba histolytica
DDAS

SEQ ID NO: 2603263 - protein, 13 aa, Entamoeba histolytica
DDEDEEKKDEVTQ

SEQ ID NO: 2603264 - protein, 16 aa, Entamoeba histolytica
DDEDGIDFKQKEKEIE

SEQ ID NO: 2603265 - protein, 6 aa, Entamoeba histolytica
DDEQSL

SEQ ID NO: 2603266 - protein, 5 aa, Entamoeba histolytica
DDIEE

SEQ ID NO: 2603267 - protein, 18 aa, Entamoeba histolytica
DDIEQDKSNITPPLTPPI

SEQ ID NO: 2603268 - protein, 31 aa, Entamoeba histolytica
DDISNNNGFSKSLNVGKRKQKSSKYEKTERK

SEQ ID NO: 2603269 - protein, 7 aa, Entamoeba histolytica
DDKTSFE

SEQ ID NO: 2603270 - protein, 13 aa, Entamoeba histolytica
DDRENELNIPPGK

SEQ ID NO: 2603271 - protein, 10 aa, Entamoeba histolytica
DDSQKDRTKK

SEQ ID NO: 2603272 - protein, 9 aa, Entamoeba histolytica
DDTEREDID

SEQ ID NO: 2603273 - protein, 4 aa, Entamoeba histolytica
DDTR

SEQ ID NO: 2603274 - protein, 8 aa, Entamoeba histolytica
DDVDTSKY

SEQ ID NO: 2603275 - protein, 7 aa, Entamoeba histolytica
DDYQAAQ

SEQ ID NO: 2603276 - protein, 4 aa, Entamoeba histolytica
DEAA

SEQ ID NO: 2603277 - protein, 13 aa, Entamoeba histolytica
DEASNEGAIAGEA

SEQ ID NO: 2603278 - protein, 12 aa, Entamoeba histolytica
DEDFNQELRSNN

SEQ ID NO: 2603279 - protein, 13 aa, Entamoeba histolytica
DEDIKEKEQVNAR

SEQ ID NO: 2603280 - protein, 8 aa, Entamoeba histolytica
DEDKKKEV

SEQ ID NO: 2603281 - protein, 8 aa, Entamoeba histolytica
DEDKYCDE

SEQ ID NO: 2603282 - protein, 4 aa, Entamoeba histolytica
DEEE

SEQ ID NO: 2603283 - protein, 6 aa, Entamoeba histolytica
DEEEKK

SEQ ID NO: 2603284 - protein, 4 aa, Entamoeba histolytica
DEEI

SEQ ID NO: 2603285 - protein, 12 aa, Entamoeba histolytica
DEEPDKRPNAEE

SEQ ID NO: 2603286 - protein, 8 aa, Entamoeba histolytica
DEETQKLA

SEQ ID NO: 2603287 - protein, 4 aa, Entamoeba histolytica
DEFD

SEQ ID NO: 2603288 - protein, 51 aa, Entamoeba histolytica
DEGENPQETKEENKEESKEEEIKEEEIKEENKEESKEEETKEEVNQENTDV

SEQ ID NO: 2603289 - protein, 6 aa, Entamoeba histolytica
DEGNYA

SEQ ID NO: 2603290 - protein, 5 aa, Entamoeba histolytica
DEITE

SEQ ID NO: 2603291 - protein, 8 aa, Entamoeba histolytica
DEKKPNLS

SEQ ID NO: 2603292 - protein, 8 aa, Entamoeba histolytica
DEKMKDAI

SEQ ID NO: 2603293 - protein, 5 aa, Entamoeba histolytica
DEKTQ

SEQ ID NO: 2603294 - protein, 8 aa, Entamoeba histolytica
DELKPKQT

SEQ ID NO: 2603295 - protein, 7 aa, Entamoeba histolytica
DELNKNT

SEQ ID NO: 2603296 - protein, 6 aa, Entamoeba histolytica
DELNTI

SEQ ID NO: 2603297 - protein, 12 aa, Entamoeba histolytica
DENGTETPCDTE

SEQ ID NO: 2603298 - protein, 7 aa, Entamoeba histolytica
DENTEIG

SEQ ID NO: 2603299 - protein, 6 aa, Entamoeba histolytica
DENTIK

SEQ ID NO: 2603300 - protein, 21 aa, Entamoeba histolytica
DENTIKGIEKGELKEEKGRDE

SEQ ID NO: 2603301 - protein, 9 aa, Entamoeba histolytica
DEPKKENKN

SEQ ID NO: 2603302 - protein, 5 aa, Entamoeba histolytica
DEQII

SEQ ID NO: 2603303 - protein, 10 aa, Entamoeba histolytica
DESGERLKRG

SEQ ID NO: 2603304 - protein, 13 aa, Entamoeba histolytica
DESIPERSNDELR

SEQ ID NO: 2603305 - protein, 7 aa, Entamoeba histolytica
DESQKKL

SEQ ID NO: 2603306 - protein, 4 aa, Entamoeba histolytica
DEST

SEQ ID NO: 2603307 - protein, 7 aa, Entamoeba histolytica
DETGPRL

SEQ ID NO: 2603308 - protein, 7 aa, Entamoeba histolytica
DEVDGAS

SEQ ID NO: 2603309 - protein, 6 aa, Entamoeba histolytica
DEYQFT

SEQ ID NO: 2603310 - protein, 6 aa, Entamoeba histolytica
DFGPNQ

SEQ ID NO: 2603311 - protein, 4 aa, Entamoeba histolytica
DFGV

SEQ ID NO: 2603312 - protein, 6 aa, Entamoeba histolytica
DGASEE

SEQ ID NO: 2603313 - protein, 6 aa, Entamoeba histolytica
DGASQA

SEQ ID NO: 2603314 - protein, 6 aa, Entamoeba histolytica
DGAVGK

SEQ ID NO: 2603315 - protein, 12 aa, Entamoeba histolytica
DGDTIETLPDEA

SEQ ID NO: 2603316 - protein, 5 aa, Entamoeba histolytica
DGEEA

SEQ ID NO: 2603317 - protein, 6 aa, Entamoeba histolytica
DGESKV

SEQ ID NO: 2603318 - protein, 5 aa, Entamoeba histolytica
DGGAF

SEQ ID NO: 2603319 - protein, 20 aa, Entamoeba histolytica
DGKPSQDDSNTQPAPQECTQ

SEQ ID NO: 2603320 - protein, 5 aa, Entamoeba histolytica
DGKRY

SEQ ID NO: 2603321 - protein, 6 aa, Entamoeba histolytica
DGKSIQ

SEQ ID NO: 2603322 - protein, 10 aa, Entamoeba histolytica
DGKSQKTKEI

SEQ ID NO: 2603323 - protein, 17 aa, Entamoeba histolytica
DGKTGEMKYKKTEHKAG

SEQ ID NO: 2603324 - protein, 5 aa, Entamoeba histolytica
DGNDG

SEQ ID NO: 2603325 - protein, 4 aa, Entamoeba histolytica
DGNS

SEQ ID NO: 2603326 - protein, 14 aa, Entamoeba histolytica
DGPCTENGQCPYEC

SEQ ID NO: 2603327 - protein, 7 aa, Entamoeba histolytica
DGRLKPG

SEQ ID NO: 2603328 - protein, 7 aa, Entamoeba histolytica
DGSQSYL

SEQ ID NO: 2603329 - protein, 18 aa, Entamoeba histolytica
DGSSVATASYDHTIKIWR

SEQ ID NO: 2603330 - protein, 10 aa, Entamoeba histolytica
DGSVEDSIIN

SEQ ID NO: 2603331 - protein, 4 aa, Entamoeba histolytica
DGTI

SEQ ID NO: 2603332 - protein, 7 aa, Entamoeba histolytica
DGTMNQE

SEQ ID NO: 2603333 - protein, 17 aa, Entamoeba histolytica
DGTQGPIASLGAPAAAL

SEQ ID NO: 2603334 - protein, 5 aa, Entamoeba histolytica
DGTVG

SEQ ID NO: 2603335 - protein, 12 aa, Entamoeba histolytica
DHQISGDSSLSQ

SEQ ID NO: 2603336 - protein, 10 aa, Entamoeba histolytica
DHRRRPQRRR

SEQ ID NO: 2603337 - protein, 7 aa, Entamoeba histolytica
DHSHDRI

SEQ ID NO: 2603338 - protein, 4 aa, Entamoeba histolytica
DHYA

SEQ ID NO: 2603339 - protein, 4 aa, Entamoeba histolytica
DIED

SEQ ID NO: 2603340 - protein, 11 aa, Entamoeba histolytica
DIEPANKDNYV

SEQ ID NO: 2603341 - protein, 10 aa, Entamoeba histolytica
DIIDKNDEEC

SEQ ID NO: 2603342 - protein, 5 aa, Entamoeba histolytica
DINDT

SEQ ID NO: 2603343 - protein, 6 aa, Entamoeba histolytica
DINTQS

SEQ ID NO: 2603344 - protein, 7 aa, Entamoeba histolytica
DIPTSVS

SEQ ID NO: 2603345 - protein, 27 aa, Entamoeba histolytica
DISSDSNSGFDKRGDGTVTPRERNRGY

SEQ ID NO: 2603346 - protein, 6 aa, Entamoeba histolytica
DITNQE

SEQ ID NO: 2603347 - protein, 6 aa, Entamoeba histolytica
DKCKER

SEQ ID NO: 2603348 - protein, 5 aa, Entamoeba histolytica
DKDDA

SEQ ID NO: 2603349 - protein, 26 aa, Entamoeba histolytica
DKDERNYIKKKQENREIQKKKMKERM

SEQ ID NO: 2603350 - protein, 8 aa, Entamoeba histolytica
DKDHSGTL

SEQ ID NO: 2603351 - protein, 9 aa, Entamoeba histolytica
DKDKSGTLE

SEQ ID NO: 2603352 - protein, 42 aa, Entamoeba histolytica
DKDNRDQRYPRGYDDPYYDDPRFDPRYSSSRFDPRFDPRYDP

SEQ ID NO: 2603353 - protein, 6 aa, Entamoeba histolytica
DKEAIE

SEQ ID NO: 2603354 - protein, 51 aa, Entamoeba histolytica
DKEEDNSGEDEMSEENNDSIEDHQPIEGFEQDDDNDEVQKEPKNEFEKQQE

SEQ ID NO: 2603355 - protein, 9 aa, Entamoeba histolytica
DKEENGQIH

SEQ ID NO: 2603356 - protein, 8 aa, Entamoeba histolytica
DKEGPGNC

SEQ ID NO: 2603357 - protein, 5 aa, Entamoeba histolytica
DKEIN

SEQ ID NO: 2603358 - protein, 8 aa, Entamoeba histolytica
DKEKHRTK

SEQ ID NO: 2603359 - protein, 5 aa, Entamoeba histolytica
DKEMK

SEQ ID NO: 2603360 - protein, 5 aa, Entamoeba histolytica
DKESI

SEQ ID NO: 2603361 - protein, 4 aa, Entamoeba histolytica
DKET

SEQ ID NO: 2603362 - protein, 7 aa, Entamoeba histolytica
DKFKTPK

SEQ ID NO: 2603363 - protein, 20 aa, Entamoeba histolytica
DKGKSAPSVETMKDEIEKLL

SEQ ID NO: 2603364 - protein, 11 aa, Entamoeba histolytica
DKHEESKLTPN

SEQ ID NO: 2603365 - protein, 11 aa, Entamoeba histolytica
DKIERDEEEEF

SEQ ID NO: 2603366 - protein, 8 aa, Entamoeba histolytica
DKIETEQF

SEQ ID NO: 2603367 - protein, 6 aa, Entamoeba histolytica
DKINKR

SEQ ID NO: 2603368 - protein, 4 aa, Entamoeba histolytica
DKIP

SEQ ID NO: 2603369 - protein, 8 aa, Entamoeba histolytica
DKKEKLDK

SEQ ID NO: 2603370 - protein, 26 aa, Entamoeba histolytica
DKKETDQKGSVDMNRASSLRKTEDKK

SEQ ID NO: 2603371 - protein, 7 aa, Entamoeba histolytica
DKKISRD

SEQ ID NO: 2603372 - protein, 7 aa, Entamoeba histolytica
DKKITNG

SEQ ID NO: 2603373 - protein, 6 aa, Entamoeba histolytica
DKKQKL

SEQ ID NO: 2603374 - protein, 10 aa, Entamoeba histolytica
DKLPKNEVGK

SEQ ID NO: 2603375 - protein, 6 aa, Entamoeba histolytica
DKNGNS

SEQ ID NO: 2603376 - protein, 7 aa, Entamoeba histolytica
DKNLSGT

SEQ ID NO: 2603377 - protein, 7 aa, Entamoeba histolytica
DKNQTIK

SEQ ID NO: 2603378 - protein, 5 aa, Entamoeba histolytica
DKNTS

SEQ ID NO: 2603379 - protein, 9 aa, Entamoeba histolytica
DKNTSDDEF

SEQ ID NO: 2603380 - protein, 9 aa, Entamoeba histolytica
DKPDSLKRV

SEQ ID NO: 2603381 - protein, 6 aa, Entamoeba histolytica
DKPDVE

SEQ ID NO: 2603382 - protein, 7 aa, Entamoeba histolytica
DKPFTSL

SEQ ID NO: 2603383 - protein, 8 aa, Entamoeba histolytica
DKQEYSSQ

SEQ ID NO: 2603384 - protein, 5 aa, Entamoeba histolytica
DKRAV

SEQ ID NO: 2603385 - protein, 4 aa, Entamoeba histolytica
DKSD

SEQ ID NO: 2603386 - protein, 5 aa, Entamoeba histolytica
DKSIS

SEQ ID NO: 2603387 - protein, 8 aa, Entamoeba histolytica
DKSISNID

SEQ ID NO: 2603388 - protein, 9 aa, Entamoeba histolytica
DKTDTSNFN

SEQ ID NO: 2603389 - protein, 8 aa, Entamoeba histolytica
DKTPARRV

SEQ ID NO: 2603390 - protein, 8 aa, Entamoeba histolytica
DKTPEEVK

SEQ ID NO: 2603391 - protein, 10 aa, Entamoeba histolytica
DKTTPLSTQR

SEQ ID NO: 2603392 - protein, 4 aa, Entamoeba histolytica
DKTW

SEQ ID NO: 2603393 - protein, 7 aa, Entamoeba histolytica
DKTYREK

SEQ ID NO: 2603394 - protein, 5 aa, Entamoeba histolytica
DKVKK

SEQ ID NO: 2603395 - protein, 5 aa, Entamoeba histolytica
DKYGF

SEQ ID NO: 2603396 - protein, 6 aa, Entamoeba histolytica
DKYNES

SEQ ID NO: 2603397 - protein, 8 aa, Entamoeba histolytica
DKYTEGSE

SEQ ID NO: 2603398 - protein, 14 aa, Entamoeba histolytica
DLAGTQKKQLAPAG

SEQ ID NO: 2603399 - protein, 4 aa, Entamoeba histolytica
DLDG

SEQ ID NO: 2603400 - protein, 10 aa, Entamoeba histolytica
DLDNNQLEND

SEQ ID NO: 2603401 - protein, 8 aa, Entamoeba histolytica
DLPASGNQ

SEQ ID NO: 2603402 - protein, 5 aa, Entamoeba histolytica
DLPPD

SEQ ID NO: 2603403 - protein, 4 aa, Entamoeba histolytica
DLPQ

SEQ ID NO: 2603404 - protein, 5 aa, Entamoeba histolytica
DLTTS

SEQ ID NO: 2603405 - protein, 4 aa, Entamoeba histolytica
DMNK

SEQ ID NO: 2603406 - protein, 12 aa, Entamoeba histolytica
DMREDKEQLKRL

SEQ ID NO: 2603407 - protein, 8 aa, Entamoeba histolytica
DNAGFDPT

SEQ ID NO: 2603408 - protein, 7 aa, Entamoeba histolytica
DNEEPDR

SEQ ID NO: 2603409 - protein, 4 aa, Entamoeba histolytica
DNEI

SEQ ID NO: 2603410 - protein, 7 aa, Entamoeba histolytica
DNEKSIR

SEQ ID NO: 2603411 - protein, 4 aa, Entamoeba histolytica
DNEL

SEQ ID NO: 2603412 - protein, 7 aa, Entamoeba histolytica
DNERNEL

SEQ ID NO: 2603413 - protein, 14 aa, Entamoeba histolytica
DNETYSEAIKRGEG

SEQ ID NO: 2603414 - protein, 12 aa, Entamoeba histolytica
DNKKYKFNPQRI

SEQ ID NO: 2603415 - protein, 4 aa, Entamoeba histolytica
DNKL

SEQ ID NO: 2603416 - protein, 5 aa, Entamoeba histolytica
DNKYR

SEQ ID NO: 2603417 - protein, 4 aa, Entamoeba histolytica
DNNE

SEQ ID NO: 2603418 - protein, 8 aa, Entamoeba histolytica
DNNEDKTI

SEQ ID NO: 2603419 - protein, 9 aa, Entamoeba histolytica
DNNGARDEI

SEQ ID NO: 2603420 - protein, 6 aa, Entamoeba histolytica
DNNGSI

SEQ ID NO: 2603421 - protein, 15 aa, Entamoeba histolytica
DNPFESSSNANTLFQ

SEQ ID NO: 2603422 - protein, 8 aa, Entamoeba histolytica
DNPNDENM

SEQ ID NO: 2603423 - protein, 27 aa, Entamoeba histolytica
DNRQPSDYPYYQTTNTTGYQQKEPFNG

SEQ ID NO: 2603424 - protein, 4 aa, Entamoeba histolytica
DNSL

SEQ ID NO: 2603425 - protein, 4 aa, Entamoeba histolytica
DNSP

SEQ ID NO: 2603426 - protein, 7 aa, Entamoeba histolytica
DNTNIGK

SEQ ID NO: 2603427 - protein, 18 aa, Entamoeba histolytica
DNTNPFDDNTPKRDSSKT

SEQ ID NO: 2603428 - protein, 7 aa, Entamoeba histolytica
DNVPIPE

SEQ ID NO: 2603429 - protein, 8 aa, Entamoeba histolytica
DNYPDSDL

SEQ ID NO: 2603430 - protein, 24 aa, Entamoeba histolytica
DPAARAAGIQQTNPLDAFKNAGLF

SEQ ID NO: 2603431 - protein, 5 aa, Entamoeba histolytica
DPASI

SEQ ID NO: 2603432 - protein, 17 aa, Entamoeba histolytica
DPEENEKGMRVSSRGAG

SEQ ID NO: 2603433 - protein, 7 aa, Entamoeba histolytica
DPEKAIE

SEQ ID NO: 2603434 - protein, 8 aa, Entamoeba histolytica
DPGTAKSQ

SEQ ID NO: 2603435 - protein, 11 aa, Entamoeba histolytica
DPKKGDKLTQI

SEQ ID NO: 2603436 - protein, 4 aa, Entamoeba histolytica
DPLG

SEQ ID NO: 2603437 - protein, 7 aa, Entamoeba histolytica
DPNQQVD

SEQ ID NO: 2603438 - protein, 7 aa, Entamoeba histolytica
DPNVGKS

SEQ ID NO: 2603439 - protein, 5 aa, Entamoeba histolytica
DPQDI

SEQ ID NO: 2603440 - protein, 8 aa, Entamoeba histolytica
DPQGNEVP

SEQ ID NO: 2603441 - protein, 8 aa, Entamoeba histolytica
DPQKNSNY

SEQ ID NO: 2603442 - protein, 15 aa, Entamoeba histolytica
DPRRKESSKECLNRN

SEQ ID NO: 2603443 - protein, 7 aa, Entamoeba histolytica
DPSITDG

SEQ ID NO: 2603444 - protein, 7 aa, Entamoeba histolytica
DPSNPIE

SEQ ID NO: 2603445 - protein, 8 aa, Entamoeba histolytica
DPSTAKSQ

SEQ ID NO: 2603446 - protein, 7 aa, Entamoeba histolytica
DPSVGKT

SEQ ID NO: 2603447 - protein, 4 aa, Entamoeba histolytica
DPTE

SEQ ID NO: 2603448 - protein, 8 aa, Entamoeba histolytica
DPTIQNDT

SEQ ID NO: 2603449 - protein, 8 aa, Entamoeba histolytica
DPTSRGKV

SEQ ID NO: 2603450 - protein, 13 aa, Entamoeba histolytica
DQKQAPKSTGTMS

SEQ ID NO: 2603451 - protein, 7 aa, Entamoeba histolytica
DQLKTQC

SEQ ID NO: 2603452 - protein, 8 aa, Entamoeba histolytica
DQQGTASV

SEQ ID NO: 2603453 - protein, 7 aa, Entamoeba histolytica
DQSGSLD

SEQ ID NO: 2603454 - protein, 11 aa, Entamoeba histolytica
DQSNDLSTTSK

SEQ ID NO: 2603455 - protein, 7 aa, Entamoeba histolytica
DQWKSKM

SEQ ID NO: 2603456 - protein, 6 aa, Entamoeba histolytica
DRGSFS

SEQ ID NO: 2603457 - protein, 5 aa, Entamoeba histolytica
DRGSY

SEQ ID NO: 2603458 - protein, 4 aa, Entamoeba histolytica
DRHN

SEQ ID NO: 2603459 - protein, 16 aa, Entamoeba histolytica
DRKSNPARRERPEEAA

SEQ ID NO: 2603460 - protein, 6 aa, Entamoeba histolytica
DRPLSH

SEQ ID NO: 2603461 - protein, 6 aa, Entamoeba histolytica
DRPNEY

SEQ ID NO: 2603462 - protein, 9 aa, Entamoeba histolytica
DRRYTQEDQ

SEQ ID NO: 2603463 - protein, 9 aa, Entamoeba histolytica
DRSKGADKM

SEQ ID NO: 2603464 - protein, 4 aa, Entamoeba histolytica
DRTV

SEQ ID NO: 2603465 - protein, 12 aa, Entamoeba histolytica
DSASKGEGEERI

SEQ ID NO: 2603466 - protein, 5 aa, Entamoeba histolytica
DSDYY

SEQ ID NO: 2603467 - protein, 6 aa, Entamoeba histolytica
DSEDLP

SEQ ID NO: 2603468 - protein, 15 aa, Entamoeba histolytica
DSEDRLGSKYGASEI

SEQ ID NO: 2603469 - protein, 7 aa, Entamoeba histolytica
DSEGSDI

SEQ ID NO: 2603470 - protein, 9 aa, Entamoeba histolytica
DSGENDPNR

SEQ ID NO: 2603471 - protein, 9 aa, Entamoeba histolytica
DSGKEGALN

SEQ ID NO: 2603472 - protein, 6 aa, Entamoeba histolytica
DSGVGK

SEQ ID NO: 2603473 - protein, 7 aa, Entamoeba histolytica
DSGVGKT

SEQ ID NO: 2603474 - protein, 8 aa, Entamoeba histolytica
DSHIPYRN

SEQ ID NO: 2603475 - protein, 4 aa, Entamoeba histolytica
DSKE

SEQ ID NO: 2603476 - protein, 4 aa, Entamoeba histolytica
DSKF

SEQ ID NO: 2603477 - protein, 5 aa, Entamoeba histolytica
DSKSF

SEQ ID NO: 2603478 - protein, 5 aa, Entamoeba histolytica
DSNDY

SEQ ID NO: 2603479 - protein, 7 aa, Entamoeba histolytica
DSNTQLL

SEQ ID NO: 2603480 - protein, 6 aa, Entamoeba histolytica
DSNTSV

SEQ ID NO: 2603481 - protein, 8 aa, Entamoeba histolytica
DSPPGEFN

SEQ ID NO: 2603482 - protein, 4 aa, Entamoeba histolytica
DSPQ

SEQ ID NO: 2603483 - protein, 4 aa, Entamoeba histolytica
DSQI

SEQ ID NO: 2603484 - protein, 5 aa, Entamoeba histolytica
DSSNE

SEQ ID NO: 2603485 - protein, 11 aa, Entamoeba histolytica
DSSVNNFNKNN

SEQ ID NO: 2603486 - protein, 7 aa, Entamoeba histolytica
DSTVPEL

SEQ ID NO: 2603487 - protein, 10 aa, Entamoeba histolytica
DTAGQEKFRE

SEQ ID NO: 2603488 - protein, 7 aa, Entamoeba histolytica
DTAGQEV

SEQ ID NO: 2603489 - protein, 9 aa, Entamoeba histolytica
DTDSTKKTK

SEQ ID NO: 2603490 - protein, 9 aa, Entamoeba histolytica
DTDTPKKTK

SEQ ID NO: 2603491 - protein, 4 aa, Entamoeba histolytica
DTGK

SEQ ID NO: 2603492 - protein, 9 aa, Entamoeba histolytica
DTGKDYEGL

SEQ ID NO: 2603493 - protein, 4 aa, Entamoeba histolytica
DTGV

SEQ ID NO: 2603494 - protein, 6 aa, Entamoeba histolytica
DTIRDG

SEQ ID NO: 2603495 - protein, 5 aa, Entamoeba histolytica
DTNSL

SEQ ID NO: 2603496 - protein, 7 aa, Entamoeba histolytica
DTPAHTA

SEQ ID NO: 2603497 - protein, 6 aa, Entamoeba histolytica
DTPDMG

SEQ ID NO: 2603498 - protein, 5 aa, Entamoeba histolytica
DTPRL

SEQ ID NO: 2603499 - protein, 4 aa, Entamoeba histolytica
DTRY

SEQ ID NO: 2603500 - protein, 13 aa, Entamoeba histolytica
DTSEIIKKSTKNS

SEQ ID NO: 2603501 - protein, 7 aa, Entamoeba histolytica
DTSGEEE

SEQ ID NO: 2603502 - protein, 10 aa, Entamoeba histolytica
DTSNKKSRSI

SEQ ID NO: 2603503 - protein, 8 aa, Entamoeba histolytica
DTSNSIKQ

SEQ ID NO: 2603504 - protein, 16 aa, Entamoeba histolytica
DTTENREKDLKELSGT

SEQ ID NO: 2603505 - protein, 5 aa, Entamoeba histolytica
DTTSI

SEQ ID NO: 2603506 - protein, 12 aa, Entamoeba histolytica
DVEKVSQSAANI

SEQ ID NO: 2603507 - protein, 8 aa, Entamoeba histolytica
DVKSQLKP

SEQ ID NO: 2603508 - protein, 5 aa, Entamoeba histolytica
DVMPG

SEQ ID NO: 2603509 - protein, 14 aa, Entamoeba histolytica
DVPDNTVVAGNPAR

SEQ ID NO: 2603510 - protein, 7 aa, Entamoeba histolytica
DVSEGTE

SEQ ID NO: 2603511 - protein, 9 aa, Entamoeba histolytica
DVSNTQNFG

SEQ ID NO: 2603512 - protein, 7 aa, Entamoeba histolytica
DWRDQTR

SEQ ID NO: 2603513 - protein, 10 aa, Entamoeba histolytica
DYDPKEIGES

SEQ ID NO: 2603514 - protein, 7 aa, Entamoeba histolytica
DYDPKQR

SEQ ID NO: 2603515 - protein, 6 aa, Entamoeba histolytica
DYGKYY

SEQ ID NO: 2603516 - protein, 13 aa, Entamoeba histolytica
DYNDGYNDPYDSF

SEQ ID NO: 2603517 - protein, 6 aa, Entamoeba histolytica
DYRKTW

SEQ ID NO: 2603518 - protein, 4 aa, Entamoeba histolytica
DYSQ

SEQ ID NO: 2603519 - protein, 7 aa, Entamoeba histolytica
DYSSDGK

SEQ ID NO: 2603520 - protein, 11 aa, Entamoeba histolytica
DYYGGASASLN

SEQ ID NO: 2603521 - protein, 6 aa, Entamoeba histolytica
EAAQKY

SEQ ID NO: 2603522 - protein, 4 aa, Entamoeba histolytica
EAEF

SEQ ID NO: 2603523 - protein, 7 aa, Entamoeba histolytica
EAEKRMA

SEQ ID NO: 2603524 - protein, 12 aa, Entamoeba histolytica
EAERRKEEERHQ

SEQ ID NO: 2603525 - protein, 7 aa, Entamoeba histolytica
EAGRGPV

SEQ ID NO: 2603526 - protein, 5 aa, Entamoeba histolytica
EAHPI

SEQ ID NO: 2603527 - protein, 4 aa, Entamoeba histolytica
EAKE

SEQ ID NO: 2603528 - protein, 6 aa, Entamoeba histolytica
EAKEAG

SEQ ID NO: 2603529 - protein, 16 aa, Entamoeba histolytica
EAKEKESQEKQEVKGE

SEQ ID NO: 2603530 - protein, 10 aa, Entamoeba histolytica
EAKEQYKIAP

SEQ ID NO: 2603531 - protein, 7 aa, Entamoeba histolytica
EAKGNDY

SEQ ID NO: 2603532 - protein, 6 aa, Entamoeba histolytica
EAKNIK

SEQ ID NO: 2603533 - protein, 12 aa, Entamoeba histolytica
EAKVTPMILMPM

SEQ ID NO: 2603534 - protein, 13 aa, Entamoeba histolytica
EALGKVAGSTHPT

SEQ ID NO: 2603535 - protein, 7 aa, Entamoeba histolytica
EANEIRA

SEQ ID NO: 2603536 - protein, 31 aa, Entamoeba histolytica; identical to SEQ ID NO: 2418619

SEQ ID NO: 2603537 - protein, 12 aa, Entamoeba histolytica
EAPKRNRNDPHK

SEQ ID NO: 2603538 - protein, 6 aa, Entamoeba histolytica
EAQNGL

SEQ ID NO: 2603539 - protein, 5 aa, Entamoeba histolytica
EASEL

SEQ ID NO: 2603540 - protein, 5 aa, Entamoeba histolytica
EASND

SEQ ID NO: 2603541 - protein, 6 aa, Entamoeba histolytica
EATQEL

SEQ ID NO: 2603542 - protein, 29 aa, Entamoeba histolytica
EAVEQRKKNLEMQKEENKMKKQKRREDAI

SEQ ID NO: 2603543 - protein, 5 aa, Entamoeba histolytica
EAVRQ

SEQ ID NO: 2603544 - protein, 7 aa, Entamoeba histolytica
ECDSGNF

SEQ ID NO: 2603545 - protein, 5 aa, Entamoeba histolytica
ECIEE

SEQ ID NO: 2603546 - protein, 4 aa, Entamoeba histolytica
EDAD

SEQ ID NO: 2603547 - protein, 10 aa, Entamoeba histolytica
EDAKEEIGQV

SEQ ID NO: 2603548 - protein, 14 aa, Entamoeba histolytica
EDASIHRPDAPPEL

SEQ ID NO: 2603549 - protein, 4 aa, Entamoeba histolytica
EDDL

SEQ ID NO: 2603550 - protein, 8 aa, Entamoeba histolytica
EDDNGKTG

SEQ ID NO: 2603551 - protein, 5 aa, Entamoeba histolytica
EDDVA

SEQ ID NO: 2603552 - protein, 6 aa, Entamoeba histolytica
EDEETW

SEQ ID NO: 2603553 - protein, 10 aa, Entamoeba histolytica
EDEMNSYQKE

SEQ ID NO: 2603554 - protein, 9 aa, Entamoeba histolytica
EDEMRRNAP

SEQ ID NO: 2603555 - protein, 10 aa, Entamoeba histolytica
EDFEEEESFD

SEQ ID NO: 2603556 - protein, 7 aa, Entamoeba histolytica
EDFPEDV

SEQ ID NO: 2603557 - protein, 10 aa, Entamoeba histolytica
EDGNKTDGKV

SEQ ID NO: 2603558 - protein, 8 aa, Entamoeba histolytica
EDGTITVG

SEQ ID NO: 2603559 - protein, 8 aa, Entamoeba histolytica
EDGTVRSD

SEQ ID NO: 2603560 - protein, 10 aa, Entamoeba histolytica
EDIEKKENIK

SEQ ID NO: 2603561 - protein, 6 aa, Entamoeba histolytica
EDKAQD

SEQ ID NO: 2603562 - protein, 8 aa, Entamoeba histolytica
EDKKNWEE

SEQ ID NO: 2603563 - protein, 4 aa, Entamoeba histolytica
EDKN

SEQ ID NO: 2603564 - protein, 10 aa, Entamoeba histolytica
EDLEKENDEV

SEQ ID NO: 2603565 - protein, 7 aa, Entamoeba histolytica
EDLRQDE

SEQ ID NO: 2603566 - protein, 5 aa, Entamoeba histolytica
EDMTK

SEQ ID NO: 2603567 - protein, 5 aa, Entamoeba histolytica
EDNME

SEQ ID NO: 2603568 - protein, 9 aa, Entamoeba histolytica
EDNPTAQPK

SEQ ID NO: 2603569 - protein, 9 aa, Entamoeba histolytica
EDQHPTKTL

SEQ ID NO: 2603570 - protein, 5 aa, Entamoeba histolytica
EDSGE

SEQ ID NO: 2603571 - protein, 5 aa, Entamoeba histolytica
EDSIT

SEQ ID NO: 2603572 - protein, 12 aa, Entamoeba histolytica
EDSNKPFPEKSL

SEQ ID NO: 2603573 - protein, 7 aa, Entamoeba histolytica
EDTDGEV

SEQ ID NO: 2603574 - protein, 5 aa, Entamoeba histolytica
EDTDI

SEQ ID NO: 2603575 - protein, 4 aa, Entamoeba histolytica
EDTL

SEQ ID NO: 2603576 - protein, 4 aa, Entamoeba histolytica
EDVQ

SEQ ID NO: 2603577 - protein, 4 aa, Entamoeba histolytica
EEDG

SEQ ID NO: 2603578 - protein, 5 aa, Entamoeba histolytica
EEDME

SEQ ID NO: 2603579 - protein, 5 aa, Entamoeba histolytica
EEEDI

SEQ ID NO: 2603580 - protein, 10 aa, Entamoeba histolytica
EEEKEKSGKF

SEQ ID NO: 2603581 - protein, 10 aa, Entamoeba histolytica
EEEKREKINE

SEQ ID NO: 2603582 - protein, 30 aa, Entamoeba histolytica
EEEMRGKGEMDENTRKRVVKSTKRRRDINK

SEQ ID NO: 2603583 - protein, 11 aa, Entamoeba histolytica
EEEPISSNSTI

SEQ ID NO: 2603584 - protein, 9 aa, Entamoeba histolytica
EEERKRSTC

SEQ ID NO: 2603585 - protein, 13 aa, Entamoeba histolytica
EEERRGEEMEMCE

SEQ ID NO: 2603586 - protein, 10 aa, Entamoeba histolytica
EEEYANTITT

SEQ ID NO: 2603587 - protein, 5 aa, Entamoeba histolytica
EEEYD

SEQ ID NO: 2603588 - protein, 8 aa, Entamoeba histolytica
EEFEEQCK

SEQ ID NO: 2603589 - protein, 8 aa, Entamoeba histolytica
EEGFDTSD

SEQ ID NO: 2603590 - protein, 9 aa, Entamoeba histolytica
EEGKAEEGD

SEQ ID NO: 2603591 - protein, 16 aa, Entamoeba histolytica
EEHAGGAVTRPSYDLG

SEQ ID NO: 2603592 - protein, 5 aa, Entamoeba histolytica
EEHGE

SEQ ID NO: 2603593 - protein, 11 aa, Entamoeba histolytica
EEHKPTGSTQF

SEQ ID NO: 2603594 - protein, 4 aa, Entamoeba histolytica
EEID

SEQ ID NO: 2603595 - protein, 4 aa, Entamoeba histolytica
EEIE

SEQ ID NO: 2603596 - protein, 4 aa, Entamoeba histolytica
EEIN

SEQ ID NO: 2603597 - protein, 5 aa, Entamoeba histolytica
EEKAT

SEQ ID NO: 2603598 - protein, 4 aa, Entamoeba histolytica
EEKI

SEQ ID NO: 2603599 - protein, 5 aa, Entamoeba histolytica
EEKNK

SEQ ID NO: 2603600 - protein, 9 aa, Entamoeba histolytica
EEKPDVTYK

SEQ ID NO: 2603601 - protein, 8 aa, Entamoeba histolytica
EEKRKGLG

SEQ ID NO: 2603602 - protein, 5 aa, Entamoeba histolytica
EEKYP

SEQ ID NO: 2603603 - protein, 8 aa, Entamoeba histolytica
EELEQKKE

SEQ ID NO: 2603604 - protein, 15 aa, Entamoeba histolytica
EELKKNKTIPKNCFY

SEQ ID NO: 2603605 - protein, 4 aa, Entamoeba histolytica
EEMA

SEQ ID NO: 2603606 - protein, 10 aa, Entamoeba histolytica
EENNGIRNEE

SEQ ID NO: 2603607 - protein, 8 aa, Entamoeba histolytica
EENQASNV

SEQ ID NO: 2603608 - protein, 8 aa, Entamoeba histolytica
EEPDDPIV

SEQ ID NO: 2603609 - protein, 12 aa, Entamoeba histolytica
EEPSTPLEEDEL

SEQ ID NO: 2603610 - protein, 9 aa, Entamoeba histolytica
EEQIKQGRE

SEQ ID NO: 2603611 - protein, 12 aa, Entamoeba histolytica
EERESSSVSQQR

SEQ ID NO: 2603612 - protein, 14 aa, Entamoeba histolytica
EERKKGMKREEEKI

SEQ ID NO: 2603613 - protein, 19 aa, Entamoeba histolytica
EERKKQLAEMKEKEGESMA

SEQ ID NO: 2603614 - protein, 20 aa, Entamoeba histolytica
EESDPVKVASEGVRTFRKEK

SEQ ID NO: 2603615 - protein, 6 aa, Entamoeba histolytica
EESEKF

SEQ ID NO: 2603616 - protein, 6 aa, Entamoeba histolytica
EESIES

SEQ ID NO: 2603617 - protein, 6 aa, Entamoeba histolytica
EESMPP

SEQ ID NO: 2603618 - protein, 5 aa, Entamoeba histolytica
EESPH

SEQ ID NO: 2603619 - protein, 7 aa, Entamoeba histolytica
EETESRM

SEQ ID NO: 2603620 - protein, 6 aa, Entamoeba histolytica
EETIQE

SEQ ID NO: 2603621 - protein, 6 aa, Entamoeba histolytica
EETKEI

SEQ ID NO: 2603622 - protein, 10 aa, Entamoeba histolytica
EETLKGKGSM

SEQ ID NO: 2603623 - protein, 6 aa, Entamoeba histolytica
EETQKT

SEQ ID NO: 2603624 - protein, 7 aa, Entamoeba histolytica
EEWYSGE

SEQ ID NO: 2603625 - protein, 11 aa, Entamoeba histolytica
EEYTKDEEIKE

SEQ ID NO: 2603626 - protein, 9 aa, Entamoeba histolytica
EFEECNKKE

SEQ ID NO: 2603627 - protein, 10 aa, Entamoeba histolytica
EFERKKGEEI

SEQ ID NO: 2603628 - protein, 4 aa, Entamoeba histolytica
EFGQ

SEQ ID NO: 2603629 - protein, 9 aa, Entamoeba histolytica
EFKAGNYEK

SEQ ID NO: 2603630 - protein, 5 aa, Entamoeba histolytica
EFKGN

SEQ ID NO: 2603631 - protein, 5 aa, Entamoeba histolytica
EFPEE

SEQ ID NO: 2603632 - protein, 5 aa, Entamoeba histolytica
EFPKD

SEQ ID NO: 2603633 - protein, 10 aa, Entamoeba histolytica
EFPNPKEEAR

SEQ ID NO: 2603634 - protein, 12 aa, Entamoeba histolytica
EFSRREIKGDCD

SEQ ID NO: 2603635 - protein, 5 aa, Entamoeba histolytica
EFYPK

SEQ ID NO: 2603636 - protein, 9 aa, Entamoeba histolytica
EGAITATNE

SEQ ID NO: 2603637 - protein, 5 aa, Entamoeba histolytica
EGATP

SEQ ID NO: 2603638 - protein, 7 aa, Entamoeba histolytica
EGDSKTQ

SEQ ID NO: 2603639 - protein, 5 aa, Entamoeba histolytica
EGEHM

SEQ ID NO: 2603640 - protein, 6 aa, Entamoeba histolytica
EGEHPD

SEQ ID NO: 2603641 - protein, 5 aa, Entamoeba histolytica
EGEKE

SEQ ID NO: 2603642 - protein, 4 aa, Entamoeba histolytica
EGES

SEQ ID NO: 2603643 - protein, 10 aa, Entamoeba histolytica
EGETSSYEEE

SEQ ID NO: 2603644 - protein, 5 aa, Entamoeba histolytica
EGGFD

SEQ ID NO: 2603645 - protein, 5 aa, Entamoeba histolytica
EGGQL

SEQ ID NO: 2603646 - protein, 6 aa, Entamoeba histolytica
EGGRSK

SEQ ID NO: 2603647 - protein, 5 aa, Entamoeba histolytica
EGGSN

SEQ ID NO: 2603648 - protein, 4 aa, Entamoeba histolytica
EGIP

SEQ ID NO: 2603649 - protein, 6 aa, Entamoeba histolytica
EGKETG

SEQ ID NO: 2603650 - protein, 10 aa, Entamoeba histolytica
EGKKLAVNTP

SEQ ID NO: 2603651 - protein, 8 aa, Entamoeba histolytica
EGKPAEEC

SEQ ID NO: 2603652 - protein, 8 aa, Entamoeba histolytica
EGKRPTLE

SEQ ID NO: 2603653 - protein, 4 aa, Entamoeba histolytica
EGKS

SEQ ID NO: 2603654 - protein, 9 aa, Entamoeba histolytica
EGKTKEQCI

SEQ ID NO: 2603655 - protein, 21 aa, Entamoeba histolytica
EGMKETTIKQRPKYQGKFPQN

SEQ ID NO: 2603656 - protein, 19 aa, Entamoeba histolytica
EGMSQQEIEELKEEESIEQ

SEQ ID NO: 2603657 - protein, 4 aa, Entamoeba histolytica
EGND

SEQ ID NO: 2603658 - protein, 6 aa, Entamoeba histolytica
EGNESE

SEQ ID NO: 2603659 - protein, 11 aa, Entamoeba histolytica
EGNPDKLGDGT

SEQ ID NO: 2603660 - protein, 8 aa, Entamoeba histolytica
EGPDGAAI

SEQ ID NO: 2603661 - protein, 4 aa, Entamoeba histolytica
EGPI

SEQ ID NO: 2603662 - protein, 8 aa, Entamoeba histolytica
EGPKTSVD

SEQ ID NO: 2603663 - protein, 12 aa, Entamoeba histolytica
EGQANAKGDSLP

SEQ ID NO: 2603664 - protein, 6 aa, Entamoeba histolytica
EGQYGI

SEQ ID NO: 2603665 - protein, 8 aa, Entamoeba histolytica
EGRSPNDV

SEQ ID NO: 2603666 - protein, 7 aa, Entamoeba histolytica
EGSKVKN

SEQ ID NO: 2603667 - protein, 4 aa, Entamoeba histolytica
EGSS

SEQ ID NO: 2603668 - protein, 7 aa, Entamoeba histolytica
EGTTDGA

SEQ ID NO: 2603669 - protein, 8 aa, Entamoeba histolytica
EGTTKSLD

SEQ ID NO: 2603670 - protein, 16 aa, Entamoeba histolytica
EGVRNGSIKGYTGKEF

SEQ ID NO: 2603671 - protein, 18 aa, Entamoeba histolytica
EHAQKTQRDEFEKQKNEI

SEQ ID NO: 2603672 - protein, 8 aa, Entamoeba histolytica
EHGGEPSS

SEQ ID NO: 2603673 - protein, 5 aa, Entamoeba histolytica
EHGRN

SEQ ID NO: 2603674 - protein, 17 aa, Entamoeba histolytica
EHKATNENEAKRIKESG

SEQ ID NO: 2603675 - protein, 6 aa, Entamoeba histolytica
EHKGDE

SEQ ID NO: 2603676 - protein, 10 aa, Entamoeba histolytica
EHNEGSLEEF

SEQ ID NO: 2603677 - protein, 14 aa, Entamoeba histolytica
EHPGWTREQRDVPL

SEQ ID NO: 2603678 - protein, 9 aa, Entamoeba histolytica
EHPRIKKGT

SEQ ID NO: 2603679 - protein, 9 aa, Entamoeba histolytica
EHPSEVQSQ

SEQ ID NO: 2603680 - protein, 7 aa, Entamoeba histolytica
EHSYENM

SEQ ID NO: 2603681 - protein, 6 aa, Entamoeba histolytica
EHYNDE

SEQ ID NO: 2603682 - protein, 4 aa, Entamoeba histolytica
EIAE

SEQ ID NO: 2603683 - protein, 4 aa, Entamoeba histolytica
EIED

SEQ ID NO: 2603684 - protein, 13 aa, Entamoeba histolytica
EIEEKKQGYEARV

SEQ ID NO: 2603685 - protein, 7 aa, Entamoeba histolytica
EIEEKNQ

SEQ ID NO: 2603686 - protein, 6 aa, Entamoeba histolytica
EIEKAK

SEQ ID NO: 2603687 - protein, 16 aa, Entamoeba histolytica
EIETIRSQSSLSDNVI

SEQ ID NO: 2603688 - protein, 5 aa, Entamoeba histolytica
EIFEP

SEQ ID NO: 2603689 - protein, 5 aa, Entamoeba histolytica
EIGEL

SEQ ID NO: 2603690 - protein, 6 aa, Entamoeba histolytica
EIGIET

SEQ ID NO: 2603691 - protein, 16 aa, Entamoeba histolytica
EIGQYEKRVSASKRNN

SEQ ID NO: 2603692 - protein, 9 aa, Entamoeba histolytica
EIKDKPMEE

SEQ ID NO: 2603693 - protein, 4 aa, Entamoeba histolytica
EINE

SEQ ID NO: 2603694 - protein, 6 aa, Entamoeba histolytica
EINPNW

SEQ ID NO: 2603695 - protein, 4 aa, Entamoeba histolytica
EINS

SEQ ID NO: 2603696 - protein, 9 aa, Entamoeba histolytica
EIPTSVSKI

SEQ ID NO: 2603697 - protein, 10 aa, Entamoeba histolytica
EIPTSVSKIG

SEQ ID NO: 2603698 - protein, 9 aa, Entamoeba histolytica
EIQAPPYEA

SEQ ID NO: 2603699 - protein, 17 aa, Entamoeba histolytica
EIQKLRNESKQLDDEIE

SEQ ID NO: 2603700 - protein, 8 aa, Entamoeba histolytica
EIQKRSGE

SEQ ID NO: 2603701 - protein, 17 aa, Entamoeba histolytica
EIQQDPPCNCSAGPVGD

SEQ ID NO: 2603702 - protein, 8 aa, Entamoeba histolytica
EISEEGKW

SEQ ID NO: 2603703 - protein, 20 aa, Entamoeba histolytica
EISELENKRKKLLGDAATEV

SEQ ID NO: 2603704 - protein, 5 aa, Entamoeba histolytica
EIVTP

SEQ ID NO: 2603705 - protein, 4 aa, Entamoeba histolytica
EIYG

SEQ ID NO: 2603706 - protein, 5 aa, Entamoeba histolytica
EKAQQ

SEQ ID NO: 2603707 - protein, 8 aa, Entamoeba histolytica
EKDDDNNH

SEQ ID NO: 2603708 - protein, 10 aa, Entamoeba histolytica
EKDETKLQEA

SEQ ID NO: 2603709 - protein, 32 aa, Entamoeba histolytica
EKDPSFKALPPNEKQKRAKEEIEKQTKSTEIE

SEQ ID NO: 2603710 - protein, 7 aa, Entamoeba histolytica
EKEEDYC

SEQ ID NO: 2603711 - protein, 16 aa, Entamoeba histolytica
EKEIKQTNNNYNESRI

SEQ ID NO: 2603712 - protein, 13 aa, Entamoeba histolytica
EKEKEGNNQLQNE

SEQ ID NO: 2603713 - protein, 7 aa, Entamoeba histolytica
EKENIPE

SEQ ID NO: 2603714 - protein, 10 aa, Entamoeba histolytica
EKENSNNPSR

SEQ ID NO: 2603715 - protein, 7 aa, Entamoeba histolytica
EKEVDKP

SEQ ID NO: 2603716 - protein, 4 aa, Entamoeba histolytica
EKFD

SEQ ID NO: 2603717 - protein, 15 aa, Entamoeba histolytica
EKFSSDDETNAENKD

SEQ ID NO: 2603718 - protein, 6 aa, Entamoeba histolytica
EKGLTP

SEQ ID NO: 2603719 - protein, 7 aa, Entamoeba histolytica
EKGLYKG

SEQ ID NO: 2603720 - protein, 4 aa, Entamoeba histolytica
EKGN

SEQ ID NO: 2603721 - protein, 8 aa, Entamoeba histolytica
EKGRIQTE

SEQ ID NO: 2603722 - protein, 9 aa, Entamoeba histolytica
EKHDKPEEF

SEQ ID NO: 2603723 - protein, 4 aa, Entamoeba histolytica
EKIG

SEQ ID NO: 2603724 - protein, 7 aa, Entamoeba histolytica
EKIGNKI

SEQ ID NO: 2603725 - protein, 6 aa, Entamoeba histolytica
EKKECE

SEQ ID NO: 2603726 - protein, 8 aa, Entamoeba histolytica
EKKEERNV

SEQ ID NO: 2603727 - protein, 8 aa, Entamoeba histolytica
EKKEMNEC

SEQ ID NO: 2603728 - protein, 7 aa, Entamoeba histolytica
EKKERKF

SEQ ID NO: 2603729 - protein, 8 aa, Entamoeba histolytica
EKKGEEGV

SEQ ID NO: 2603730 - protein, 7 aa, Entamoeba histolytica
EKKKTRR

SEQ ID NO: 2603731 - protein, 4 aa, Entamoeba histolytica
EKKL

SEQ ID NO: 2603732 - protein, 11 aa, Entamoeba histolytica
EKLSANAGTTA

SEQ ID NO: 2603733 - protein, 10 aa, Entamoeba histolytica
EKLTNPNQNV

SEQ ID NO: 2603734 - protein, 13 aa, Entamoeba histolytica
EKMMNSDNTSPIY

SEQ ID NO: 2603735 - protein, 4 aa, Entamoeba histolytica
EKMT

SEQ ID NO: 2603736 - protein, 6 aa, Entamoeba histolytica
EKNAKK

SEQ ID NO: 2603737 - protein, 9 aa, Entamoeba histolytica
EKQNSQSPV

SEQ ID NO: 2603738 - protein, 5 aa, Entamoeba histolytica
EKQQQ

SEQ ID NO: 2603739 - protein, 7 aa, Entamoeba histolytica
EKQTKMH

SEQ ID NO: 2603740 - protein, 4 aa, Entamoeba histolytica
EKRE

SEQ ID NO: 2603741 - protein, 9 aa, Entamoeba histolytica
EKRGINPDN

SEQ ID NO: 2603742 - protein, 23 aa, Entamoeba histolytica
EKRKKEEAQTTQQEVEEKKQENI

SEQ ID NO: 2603743 - protein, 13 aa, Entamoeba histolytica
EKRTPQTSTREVR

SEQ ID NO: 2603744 - protein, 5 aa, Entamoeba histolytica
EKRTR

SEQ ID NO: 2603745 - protein, 11 aa, Entamoeba histolytica
EKSDLNKMDSR

SEQ ID NO: 2603746 - protein, 12 aa, Entamoeba histolytica
EKSKTNKKLEEI

SEQ ID NO: 2603747 - protein, 8 aa, Entamoeba histolytica
EKSSDPVA

SEQ ID NO: 2603748 - protein, 7 aa, Entamoeba histolytica
EKSSNKR

SEQ ID NO: 2603749 - protein, 4 aa, Entamoeba histolytica
EKTD

SEQ ID NO: 2603750 - protein, 8 aa, Entamoeba histolytica
EKTGNDGV

SEQ ID NO: 2603751 - protein, 12 aa, Entamoeba histolytica
EKTKQEKTLEEH

SEQ ID NO: 2603752 - protein, 7 aa, Entamoeba histolytica
EKTNNIV

SEQ ID NO: 2603753 - protein, 12 aa, Entamoeba histolytica
EKWKPSAGSHVI

SEQ ID NO: 2603754 - protein, 4 aa, Entamoeba histolytica
EKYS

SEQ ID NO: 2603755 - protein, 8 aa, Entamoeba histolytica
EKYSIRTN

SEQ ID NO: 2603756 - protein, 7 aa, Entamoeba histolytica
ELDGNSV

SEQ ID NO: 2603757 - protein, 26 aa, Entamoeba histolytica
ELEDDNKYEREKAQISEKMRSSIEKK

SEQ ID NO: 2603758 - protein, 10 aa, Entamoeba histolytica
ELGAGEEDIG

SEQ ID NO: 2603759 - protein, 20 aa, Entamoeba histolytica
ELKGTGGNKKGNSKSGKCIL

SEQ ID NO: 2603760 - protein, 4 aa, Entamoeba histolytica
ELPP

SEQ ID NO: 2603761 - protein, 6 aa, Entamoeba histolytica
ELPQEL

SEQ ID NO: 2603762 - protein, 6 aa, Entamoeba histolytica
ELPRDV

SEQ ID NO: 2603763 - protein, 18 aa, Entamoeba histolytica
ELPSTIPESQQHTVTEGN

SEQ ID NO: 2603764 - protein, 8 aa, Entamoeba histolytica
ELQPFTNE

SEQ ID NO: 2603765 - protein, 4 aa, Entamoeba histolytica
ELSE

SEQ ID NO: 2603766 - protein, 9 aa, Entamoeba histolytica
ELSEEEKGL

SEQ ID NO: 2603767 - protein, 18 aa, Entamoeba histolytica
ELSGTKDEDFEKTVKGSG

SEQ ID NO: 2603768 - protein, 5 aa, Entamoeba histolytica
ELSKE

SEQ ID NO: 2603769 - protein, 12 aa, Entamoeba histolytica
ELSNGSDGISKL

SEQ ID NO: 2603770 - protein, 8 aa, Entamoeba histolytica
ELTPENVE

SEQ ID NO: 2603771 - protein, 9 aa, Entamoeba histolytica
ELTQDEKEI

SEQ ID NO: 2603772 - protein, 5 aa, Entamoeba histolytica
ELTRT

SEQ ID NO: 2603773 - protein, 8 aa, Entamoeba histolytica
EMEAEKGK

SEQ ID NO: 2603774 - protein, 33 aa, Entamoeba histolytica
EMEKQKAIEKENNSITPRDQSKNEEQPTTPSEQ

SEQ ID NO: 2603775 - protein, 11 aa, Entamoeba histolytica
EMENGVTKEYY

SEQ ID NO: 2603776 - protein, 6 aa, Entamoeba histolytica
EMKESN

SEQ ID NO: 2603777 - protein, 6 aa, Entamoeba histolytica
EMSEES

SEQ ID NO: 2603778 - protein, 4 aa, Entamoeba histolytica
EMTE

SEQ ID NO: 2603779 - protein, 7 aa, Entamoeba histolytica
EMTSSEK

SEQ ID NO: 2603780 - protein, 16 aa, Entamoeba histolytica
EMTTPGIAGAELLHNK

SEQ ID NO: 2603781 - protein, 14 aa, Entamoeba histolytica
ENAIKGITKSISDR

SEQ ID NO: 2603782 - protein, 12 aa, Entamoeba histolytica
ENASPNKTTGKW

SEQ ID NO: 2603783 - protein, 6 aa, Entamoeba histolytica
ENDEYT

SEQ ID NO: 2603784 - protein, 4 aa, Entamoeba histolytica
ENDI

SEQ ID NO: 2603785 - protein, 4 aa, Entamoeba histolytica
ENEE

SEQ ID NO: 2603786 - protein, 6 aa, Entamoeba histolytica
ENEECK

SEQ ID NO: 2603787 - protein, 66 aa, Entamoeba histolytica
ENEESYEEEDDDDNSEEDNSEEDNTNESSEEGNSEEDSEEESESSEESSEEEESESYEEDNQMNRY

SEQ ID NO: 2603788 - protein, 17 aa, Entamoeba histolytica
ENEIKEKKLKNTTLPQK

SEQ ID NO: 2603789 - protein, 12 aa, Entamoeba histolytica
ENENGTPSQVPY

SEQ ID NO: 2603790 - protein, 15 aa, Entamoeba histolytica
ENERKSFSKSQNSLK

SEQ ID NO: 2603791 - protein, 9 aa, Entamoeba histolytica
ENETRMSAA

SEQ ID NO: 2603792 - protein, 8 aa, Entamoeba histolytica
ENGENDDW

SEQ ID NO: 2603793 - protein, 6 aa, Entamoeba histolytica
ENGIEY

SEQ ID NO: 2603794 - protein, 4 aa, Entamoeba histolytica
ENGL

SEQ ID NO: 2603795 - protein, 4 aa, Entamoeba histolytica
ENGR

SEQ ID NO: 2603796 - protein, 8 aa, Entamoeba histolytica
ENGSGKSA

SEQ ID NO: 2603797 - protein, 5 aa, Entamoeba histolytica
ENGVS

SEQ ID NO: 2603798 - protein, 7 aa, Entamoeba histolytica
ENHENGK

SEQ ID NO: 2603799 - protein, 8 aa, Entamoeba histolytica
ENISSEAM

SEQ ID NO: 2603800 - protein, 4 aa, Entamoeba histolytica
ENIT

SEQ ID NO: 2603801 - protein, 6 aa, Entamoeba histolytica
ENKEDF

SEQ ID NO: 2603802 - protein, 9 aa, Entamoeba histolytica
ENKEKNDRL

SEQ ID NO: 2603803 - protein, 8 aa, Entamoeba histolytica
ENKKKQMK

SEQ ID NO: 2603804 - protein, 4 aa, Entamoeba histolytica
ENKR

SEQ ID NO: 2603805 - protein, 4 aa, Entamoeba histolytica
ENLN

SEQ ID NO: 2603806 - protein, 4 aa, Entamoeba histolytica
ENNE

SEQ ID NO: 2603807 - protein, 8 aa, Entamoeba histolytica
ENNRQNID

SEQ ID NO: 2603808 - protein, 7 aa, Entamoeba histolytica
ENNVRVP

SEQ ID NO: 2603809 - protein, 4 aa, Entamoeba histolytica
ENPE

SEQ ID NO: 2603810 - protein, 6 aa, Entamoeba histolytica
ENPTLL

SEQ ID NO: 2603811 - protein, 10 aa, Entamoeba histolytica
ENPVTDGEAE

SEQ ID NO: 2603812 - protein, 4 aa, Entamoeba histolytica
ENPY

SEQ ID NO: 2603813 - protein, 15 aa, Entamoeba histolytica
ENQEEFNRPLEESPF

SEQ ID NO: 2603814 - protein, 15 aa, Entamoeba histolytica
ENQEEFNRPLEKSPF

SEQ ID NO: 2603815 - protein, 8 aa, Entamoeba histolytica
ENQGELER

SEQ ID NO: 2603816 - protein, 8 aa, Entamoeba histolytica
ENQKIGEN

SEQ ID NO: 2603817 - protein, 9 aa, Entamoeba histolytica
ENQPTQPIQ

SEQ ID NO: 2603818 - protein, 4 aa, Entamoeba histolytica
ENQQ

SEQ ID NO: 2603819 - protein, 22 aa, Entamoeba histolytica
ENQTNRTSTPPLESEEKKTDEV

SEQ ID NO: 2603820 - protein, 7 aa, Entamoeba histolytica
ENSEEDL

SEQ ID NO: 2603821 - protein, 4 aa, Entamoeba histolytica
ENSG

SEQ ID NO: 2603822 - protein, 6 aa, Entamoeba histolytica
ENSKVI

SEQ ID NO: 2603823 - protein, 4 aa, Entamoeba histolytica
ENSV

SEQ ID NO: 2603824 - protein, 12 aa, Entamoeba histolytica
ENTKTLNSGKIK

SEQ ID NO: 2603825 - protein, 8 aa, Entamoeba histolytica
ENTNDGPI

SEQ ID NO: 2603826 - protein, 22 aa, Entamoeba histolytica
ENWHEGKSCDEWKRNKEQEQED

SEQ ID NO: 2603827 - protein, 7 aa, Entamoeba histolytica
ENYPKGK

SEQ ID NO: 2603828 - protein, 5 aa, Entamoeba histolytica
ENYTE

SEQ ID NO: 2603829 - protein, 8 aa, Entamoeba histolytica
EPEAKERL

SEQ ID NO: 2603830 - protein, 19 aa, Entamoeba histolytica
EPEESAVLEGKAKGPHGIQ

SEQ ID NO: 2603831 - protein, 4 aa, Entamoeba histolytica
EPFD

SEQ ID NO: 2603832 - protein, 8 aa, Entamoeba histolytica
EPGVRGEL

SEQ ID NO: 2603833 - protein, 9 aa, Entamoeba histolytica
EPKESNANK

SEQ ID NO: 2603834 - protein, 5 aa, Entamoeba histolytica
EPLTS

SEQ ID NO: 2603835 - protein, 10 aa, Entamoeba histolytica
EPNNKSTTNN

SEQ ID NO: 2603836 - protein, 17 aa, Entamoeba histolytica
EPNNTEPNKVSNLPEVD

SEQ ID NO: 2603837 - protein, 5 aa, Entamoeba histolytica
EPPSK

SEQ ID NO: 2603838 - protein, 4 aa, Entamoeba histolytica
EPPV

SEQ ID NO: 2603839 - protein, 8 aa, Entamoeba histolytica
EPSGTTYG

SEQ ID NO: 2603840 - protein, 5 aa, Entamoeba histolytica
EPSTF

SEQ ID NO: 2603841 - protein, 11 aa, Entamoeba histolytica
EPTGDLDTKNT

SEQ ID NO: 2603842 - protein, 6 aa, Entamoeba histolytica
EPTNTT

SEQ ID NO: 2603843 - protein, 7 aa, Entamoeba histolytica
EPVENTP

SEQ ID NO: 2603844 - protein, 4 aa, Entamoeba histolytica
EPYN

SEQ ID NO: 2603845 - protein, 4 aa, Entamoeba histolytica
EQED

SEQ ID NO: 2603846 - protein, 12 aa, Entamoeba histolytica
EQISEGIKSTGV

SEQ ID NO: 2603847 - protein, 6 aa, Entamoeba histolytica
EQKEME

SEQ ID NO: 2603848 - protein, 12 aa, Entamoeba histolytica
EQKEQAKGNDKH

SEQ ID NO: 2603849 - protein, 16 aa, Entamoeba histolytica
EQKKNELLTQERKEKK

SEQ ID NO: 2603850 - protein, 10 aa, Entamoeba histolytica
EQLPTSEKTK

SEQ ID NO: 2603851 - protein, 24 aa, Entamoeba histolytica
EQLQKEQKKTAKVGVKKPVVKKDK

SEQ ID NO: 2603852 - protein, 5 aa, Entamoeba histolytica
EQLRQ

SEQ ID NO: 2603853 - protein, 13 aa, Entamoeba histolytica
EQMEQQKIEHQRE

SEQ ID NO: 2603854 - protein, 37 aa, Entamoeba histolytica
EQNTEEEIKQETKEEENQNDNDEITKIKKGNQYGEVK

SEQ ID NO: 2603855 - protein, 4 aa, Entamoeba histolytica
EQPF

SEQ ID NO: 2603856 - protein, 5 aa, Entamoeba histolytica
EQQIQ

SEQ ID NO: 2603857 - protein, 6 aa, Entamoeba histolytica
EQQKYK

SEQ ID NO: 2603858 - protein, 16 aa, Entamoeba histolytica
EQRPEPPIEPTPNVNE

SEQ ID NO: 2603859 - protein, 12 aa, Entamoeba histolytica
EQRRQQEEQRQQ

SEQ ID NO: 2603860 - protein, 4 aa, Entamoeba histolytica
EQRS

SEQ ID NO: 2603861 - protein, 5 aa, Entamoeba histolytica
EQSWD

SEQ ID NO: 2603862 - protein, 11 aa, Entamoeba histolytica
ERFKPNDVGSV

SEQ ID NO: 2603863 - protein, 5 aa, Entamoeba histolytica
ERGEK

SEQ ID NO: 2603864 - protein, 6 aa, Entamoeba histolytica
ERGNNN

SEQ ID NO: 2603865 - protein, 8 aa, Entamoeba histolytica
ERIRPPRY

SEQ ID NO: 2603866 - protein, 5 aa, Entamoeba histolytica
ERKEV

SEQ ID NO: 2603867 - protein, 12 aa, Entamoeba histolytica
ERKRSSRNDETI

SEQ ID NO: 2603868 - protein, 10 aa, Entamoeba histolytica
ERLDGASGAE

SEQ ID NO: 2603869 - protein, 5 aa, Entamoeba histolytica
ERNAF

SEQ ID NO: 2603870 - protein, 9 aa, Entamoeba histolytica
ERNKEDVKT

SEQ ID NO: 2603871 - protein, 18 aa, Entamoeba histolytica
ERPEEFKKTAREWTKLYA

SEQ ID NO: 2603872 - protein, 4 aa, Entamoeba histolytica
ERSK

SEQ ID NO: 2603873 - protein, 4 aa, Entamoeba histolytica
ERVK

SEQ ID NO: 2603874 - protein, 23 aa, Entamoeba histolytica
ESAEEPTKEVDNPFATNETEPSV

SEQ ID NO: 2603875 - protein, 20 aa, Entamoeba histolytica
ESAKRKAKELDLDQPDSKRK

SEQ ID NO: 2603876 - protein, 8 aa, Entamoeba histolytica
ESCTKESC

SEQ ID NO: 2603877 - protein, 7 aa, Entamoeba histolytica
ESDDYYK

SEQ ID NO: 2603878 - protein, 12 aa, Entamoeba histolytica
ESDESSLSSLPP

SEQ ID NO: 2603879 - protein, 4 aa, Entamoeba histolytica
ESDL

SEQ ID NO: 2603880 - protein, 4 aa, Entamoeba histolytica
ESGE

SEQ ID NO: 2603881 - protein, 5 aa, Entamoeba histolytica
ESGKE

SEQ ID NO: 2603882 - protein, 24 aa, Entamoeba histolytica
ESGNEEKRNEEKERKGRKERRQGK

SEQ ID NO: 2603883 - protein, 9 aa, Entamoeba histolytica
ESGNGKSSF

SEQ ID NO: 2603884 - protein, 4 aa, Entamoeba histolytica
ESIE

SEQ ID NO: 2603885 - protein, 4 aa, Entamoeba histolytica
ESIN

SEQ ID NO: 2603886 - protein, 40 aa, Entamoeba histolytica
ESKITFSRTNKRNENITSQFKETSDGFDIPKTKTERQKTM

SEQ ID NO: 2603887 - protein, 10 aa, Entamoeba histolytica
ESKKAVETSP

SEQ ID NO: 2603888 - protein, 8 aa, Entamoeba histolytica
ESKQKEYV

SEQ ID NO: 2603889 - protein, 6 aa, Entamoeba histolytica
ESLPST

SEQ ID NO: 2603890 - protein, 7 aa, Entamoeba histolytica
ESNEKNE

SEQ ID NO: 2603891 - protein, 5 aa, Entamoeba histolytica
ESNLE

SEQ ID NO: 2603892 - protein, 29 aa, Entamoeba histolytica
ESNTIHRKPARPIRSSQSMVSDTDSSESI

SEQ ID NO: 2603893 - protein, 9 aa, Entamoeba histolytica
ESPAITTKR

SEQ ID NO: 2603894 - protein, 4 aa, Entamoeba histolytica
ESPI

SEQ ID NO: 2603895 - protein, 12 aa, Entamoeba histolytica
ESPIKQEKEIDI

SEQ ID NO: 2603896 - protein, 7 aa, Entamoeba histolytica
ESPNGVN

SEQ ID NO: 2603897 - protein, 4 aa, Entamoeba histolytica
ESQS

SEQ ID NO: 2603898 - protein, 10 aa, Entamoeba histolytica
ESSRNENRYR

SEQ ID NO: 2603899 - protein, 7 aa, Entamoeba histolytica
ESTLDGL

SEQ ID NO: 2603900 - protein, 4 aa, Entamoeba histolytica
ESTT

SEQ ID NO: 2603901 - protein, 6 aa, Entamoeba histolytica
ESVCEN

SEQ ID NO: 2603902 - protein, 4 aa, Entamoeba histolytica
ESVY

SEQ ID NO: 2603903 - protein, 11 aa, Entamoeba histolytica
ETADDKQKLRK

SEQ ID NO: 2603904 - protein, 15 aa, Entamoeba histolytica
ETAFNASDNSKQRII

SEQ ID NO: 2603905 - protein, 4 aa, Entamoeba histolytica
ETCT

SEQ ID NO: 2603906 - protein, 10 aa, Entamoeba histolytica
ETDGETPIST

SEQ ID NO: 2603907 - protein, 4 aa, Entamoeba histolytica
ETDI

SEQ ID NO: 2603908 - protein, 40 aa, Entamoeba histolytica; identical to SEQ ID NO: 2423810

SEQ ID NO: 2603909 - protein, 5 aa, Entamoeba histolytica
ETDLN

SEQ ID NO: 2603910 - protein, 51 aa, Entamoeba histolytica
ETEEEVTDDEAEEKKEEETKEEDKKEEDVKIEDDKKEEEKPAKKTKKVKKV

SEQ ID NO: 2603911 - protein, 10 aa, Entamoeba histolytica
ETGASTTIEA

SEQ ID NO: 2603912 - protein, 4 aa, Entamoeba histolytica
ETGE

SEQ ID NO: 2603913 - protein, 10 aa, Entamoeba histolytica
ETGNGKSSLG

SEQ ID NO: 2603914 - protein, 10 aa, Entamoeba histolytica
ETGNGKSSVG

SEQ ID NO: 2603915 - protein, 10 aa, Entamoeba histolytica
ETGSGKTTQI

SEQ ID NO: 2603916 - protein, 4 aa, Entamoeba histolytica
ETIP

SEQ ID NO: 2603917 - protein, 4 aa, Entamoeba histolytica
ETIQ

SEQ ID NO: 2603918 - protein, 4 aa, Entamoeba histolytica
ETIS

SEQ ID NO: 2603919 - protein, 5 aa, Entamoeba histolytica
ETITG

SEQ ID NO: 2603920 - protein, 5 aa, Entamoeba histolytica
ETKNV

SEQ ID NO: 2603921 - protein, 16 aa, Entamoeba histolytica
ETKQKAKEVKQIRQKG

SEQ ID NO: 2603922 - protein, 4 aa, Entamoeba histolytica
ETKS

SEQ ID NO: 2603923 - protein, 5 aa, Entamoeba histolytica
ETKTM

SEQ ID NO: 2603924 - protein, 6 aa, Entamoeba histolytica
ETKVNG

SEQ ID NO: 2603925 - protein, 14 aa, Entamoeba histolytica
ETLKVSKENMGRNE

SEQ ID NO: 2603926 - protein, 5 aa, Entamoeba histolytica
ETLTS

SEQ ID NO: 2603927 - protein, 7 aa, Entamoeba histolytica
ETNSTNK

SEQ ID NO: 2603928 - protein, 11 aa, Entamoeba histolytica
ETQRGELNSTT

SEQ ID NO: 2603929 - protein, 8 aa, Entamoeba histolytica
ETRNVEGE

SEQ ID NO: 2603930 - protein, 9 aa, Entamoeba histolytica
ETSEEFYQT

SEQ ID NO: 2603931 - protein, 6 aa, Entamoeba histolytica
ETSKEL

SEQ ID NO: 2603932 - protein, 4 aa, Entamoeba histolytica
ETSL

SEQ ID NO: 2603933 - protein, 9 aa, Entamoeba histolytica
ETSQKTTGI

SEQ ID NO: 2603934 - protein, 10 aa, Entamoeba histolytica
ETTNPSKFGS

SEQ ID NO: 2603935 - protein, 6 aa, Entamoeba histolytica
EVATDK

SEQ ID NO: 2603936 - protein, 48 aa, Entamoeba histolytica
EVEDNEFEEDEEMEEDMSEGEESDESNDEKMEEREESDDEEEENTKPM

SEQ ID NO: 2603937 - protein, 13 aa, Entamoeba histolytica
EVEGTGYEKPTDD

SEQ ID NO: 2603938 - protein, 17 aa, Entamoeba histolytica
EVEVTTPTATEEKGIET

SEQ ID NO: 2603939 - protein, 18 aa, Entamoeba histolytica
EVGNKEEFDETLKTTTKE

SEQ ID NO: 2603940 - protein, 11 aa, Entamoeba histolytica
EVGSRTRKQCR

SEQ ID NO: 2603941 - protein, 6 aa, Entamoeba histolytica
EVKESY

SEQ ID NO: 2603942 - protein, 5 aa, Entamoeba histolytica
EVKQK

SEQ ID NO: 2603943 - protein, 5 aa, Entamoeba histolytica
EVREV

SEQ ID NO: 2603944 - protein, 14 aa, Entamoeba histolytica
EVSEEKKNKIKNKI

SEQ ID NO: 2603945 - protein, 17 aa, Entamoeba histolytica
EVSTKGTGKYARETEEY

SEQ ID NO: 2603946 - protein, 4 aa, Entamoeba histolytica
EVYG

SEQ ID NO: 2603947 - protein, 63 aa, Entamoeba histolytica
EWDDPTKEEEKHENTTMEEEEEIEEGKDNNKEEGSMEEDKEEENMEEEDKEEGSMEEEEESEE

SEQ ID NO: 2603948 - protein, 5 aa, Entamoeba histolytica
EYANT

SEQ ID NO: 2603949 - protein, 9 aa, Entamoeba histolytica
EYEIEDSLG

SEQ ID NO: 2603950 - protein, 12 aa, Entamoeba histolytica
EYGNNGCGGGFG

SEQ ID NO: 2603951 - protein, 14 aa, Entamoeba histolytica
EYGNNGCGGGFGSN

SEQ ID NO: 2603952 - protein, 10 aa, Entamoeba histolytica
EYHGSAYQND

SEQ ID NO: 2603953 - protein, 5 aa, Entamoeba histolytica
EYNST

SEQ ID NO: 2603954 - protein, 5 aa, Entamoeba histolytica
EYPTA

SEQ ID NO: 2603955 - protein, 8 aa, Entamoeba histolytica
EYQPTSPL

SEQ ID NO: 2603956 - protein, 13 aa, Entamoeba histolytica
EYTQEDRNTYGTT

SEQ ID NO: 2603957 - protein, 16 aa, Entamoeba histolytica
EYTSEEKKTEEPEAEI

SEQ ID NO: 2603958 - protein, 40 aa, Entamoeba histolytica
FAPSINPETVYDNANNAYSNGGAGKYVSRQYDKQPIDNEQ

SEQ ID NO: 2603959 - protein, 15 aa, Entamoeba histolytica
FASPNQHLGKKSIPI

SEQ ID NO: 2603960 - protein, 4 aa, Entamoeba histolytica
FDEG

SEQ ID NO: 2603961 - protein, 6 aa, Entamoeba histolytica
FDEKKD

SEQ ID NO: 2603962 - protein, 17 aa, Entamoeba histolytica
FDKRSTEDNLKNQVSND

SEQ ID NO: 2603963 - protein, 20 aa, Entamoeba histolytica
FDKTTKKNDSIKEADKEKKD

SEQ ID NO: 2603964 - protein, 19 aa, Entamoeba histolytica
FDPDGTPRLYQTDPAGTWT

SEQ ID NO: 2603965 - protein, 6 aa, Entamoeba histolytica
FDPRYD

SEQ ID NO: 2603966 - protein, 19 aa, Entamoeba histolytica
FDSNPSFNEVPTQSQQSPI

SEQ ID NO: 2603967 - protein, 6 aa, Entamoeba histolytica
FDSRPC

SEQ ID NO: 2603968 - protein, 4 aa, Entamoeba histolytica
FEDS

SEQ ID NO: 2603969 - protein, 8 aa, Entamoeba histolytica
FEEECEKR

SEQ ID NO: 2603970 - protein, 7 aa, Entamoeba histolytica
FEETSTI

SEQ ID NO: 2603971 - protein, 12 aa, Entamoeba histolytica
FEPINDPKQDGV

SEQ ID NO: 2603972 - protein, 10 aa, Entamoeba histolytica
FESDKKQLPF

SEQ ID NO: 2603973 - protein, 6 aa, Entamoeba histolytica
FESGEV

SEQ ID NO: 2603974 - protein, 7 aa, Entamoeba histolytica
FESTGIK

SEQ ID NO: 2603975 - protein, 5 aa, Entamoeba histolytica
FETPT

SEQ ID NO: 2603976 - protein, 13 aa, Entamoeba histolytica
FGEGSRKKKVMSR

SEQ ID NO: 2603977 - protein, 4 aa, Entamoeba histolytica
FGKF

SEQ ID NO: 2603978 - protein, 5 aa, Entamoeba histolytica
FGNAT

SEQ ID NO: 2603979 - protein, 11 aa, Entamoeba histolytica
FGNPDNTAAHH

SEQ ID NO: 2603980 - protein, 7 aa, Entamoeba histolytica
FGRGKHS

SEQ ID NO: 2603981 - protein, 11 aa, Entamoeba histolytica
FGRKENGKNNI

SEQ ID NO: 2603982 - protein, 10 aa, Entamoeba histolytica
FKDNGNSKEL

SEQ ID NO: 2603983 - protein, 12 aa, Entamoeba histolytica
FKEGKGRELKDK

SEQ ID NO: 2603984 - protein, 8 aa, Entamoeba histolytica
FKKRAPKA

SEQ ID NO: 2603985 - protein, 9 aa, Entamoeba histolytica
FKPSTGKKM

SEQ ID NO: 2603986 - protein, 5 aa, Entamoeba histolytica
FKSTV

SEQ ID NO: 2603987 - protein, 16 aa, Entamoeba histolytica
FKTKENECSQSPSHKK

SEQ ID NO: 2603988 - protein, 6 aa, Entamoeba histolytica
FNGKSE

SEQ ID NO: 2603989 - protein, 8 aa, Entamoeba histolytica
FNGKSECM

SEQ ID NO: 2603990 - protein, 9 aa, Entamoeba histolytica
FNGKSQYKT

SEQ ID NO: 2603991 - protein, 10 aa, Entamoeba histolytica
FNGKSQYKTD

SEQ ID NO: 2603992 - protein, 5 aa, Entamoeba histolytica
FNKQK

SEQ ID NO: 2603993 - protein, 12 aa, Entamoeba histolytica
FNKTKDGKHGHA

SEQ ID NO: 2603994 - protein, 17 aa, Entamoeba histolytica
FNKTNNSGSLPKNKEYI

SEQ ID NO: 2603995 - protein, 13 aa, Entamoeba histolytica
FNQFPQQQNPFSQ

SEQ ID NO: 2603996 - protein, 4 aa, Entamoeba histolytica
FNQI

SEQ ID NO: 2603997 - protein, 5 aa, Entamoeba histolytica
FNSPS

SEQ ID NO: 2603998 - protein, 14 aa, Entamoeba histolytica
FNTGYEATIGTDFS

SEQ ID NO: 2603999 - protein, 7 aa, Entamoeba histolytica
FPEPRNE

SEQ ID NO: 2604000 - protein, 5 aa, Entamoeba histolytica
FPNNR

SEQ ID NO: 2604001 - protein, 14 aa, Entamoeba histolytica
FPNPEDKEDEVEYP

SEQ ID NO: 2604002 - protein, 5 aa, Entamoeba histolytica
FPSDE

SEQ ID NO: 2604003 - protein, 5 aa, Entamoeba histolytica
FPSPR

SEQ ID NO: 2604004 - protein, 18 aa, Entamoeba histolytica
FQNTSQNTTDVSEPNVPI

SEQ ID NO: 2604005 - protein, 21 aa, Entamoeba histolytica
FQTTPSRLSTSTQQTKPPRLP

SEQ ID NO: 2604006 - protein, 5 aa, Entamoeba histolytica
FRAGA

SEQ ID NO: 2604007 - protein, 5 aa, Entamoeba histolytica
FRDCG

SEQ ID NO: 2604008 - protein, 8 aa, Entamoeba histolytica
FRTNPNKW

SEQ ID NO: 2604009 - protein, 5 aa, Entamoeba histolytica
FSDDG

SEQ ID NO: 2604010 - protein, 37 aa, Entamoeba histolytica
FSDHTSQQTRSSLAKTTSYQSDRESLPTPSMNPNPNQ

SEQ ID NO: 2604011 - protein, 4 aa, Entamoeba histolytica
FSDN

SEQ ID NO: 2604012 - protein, 7 aa, Entamoeba histolytica
FSESFKD

SEQ ID NO: 2604013 - protein, 6 aa, Entamoeba histolytica
FSGDDQ

SEQ ID NO: 2604014 - protein, 31 aa, Entamoeba histolytica
FSGNENAKEEKEVDNPFGNFEESKSETLPEI

SEQ ID NO: 2604015 - protein, 6 aa, Entamoeba histolytica
FSGSTV

SEQ ID NO: 2604016 - protein, 8 aa, Entamoeba histolytica
FSKDPERF

SEQ ID NO: 2604017 - protein, 9 aa, Entamoeba histolytica
FSNDWNTGD

SEQ ID NO: 2604018 - protein, 4 aa, Entamoeba histolytica
FSNS

SEQ ID NO: 2604019 - protein, 12 aa, Entamoeba histolytica
FSNTKPSSTYQH

SEQ ID NO: 2604020 - protein, 6 aa, Entamoeba histolytica
FSPDGS

SEQ ID NO: 2604021 - protein, 4 aa, Entamoeba histolytica
FSPG

SEQ ID NO: 2604022 - protein, 4 aa, Entamoeba histolytica
FSPN

SEQ ID NO: 2604023 - protein, 10 aa, Entamoeba histolytica
FSPTTESTVG

SEQ ID NO: 2604024 - protein, 10 aa, Entamoeba histolytica
FSSDRSIEEY

SEQ ID NO: 2604025 - protein, 6 aa, Entamoeba histolytica
FSSDSN

SEQ ID NO: 2604026 - protein, 8 aa, Entamoeba histolytica
FSTNQNGI

SEQ ID NO: 2604027 - protein, 7 aa, Entamoeba histolytica
FSYSPNG

SEQ ID NO: 2604028 - protein, 6 aa, Entamoeba histolytica
FTADSN

SEQ ID NO: 2604029 - protein, 7 aa, Entamoeba histolytica
FTDSKTV

SEQ ID NO: 2604030 - protein, 14 aa, Entamoeba histolytica
FTDSSNQPKHQDQV

SEQ ID NO: 2604031 - protein, 5 aa, Entamoeba histolytica
FTEKE

SEQ ID NO: 2604032 - protein, 9 aa, Entamoeba histolytica
FTIKKGERI

SEQ ID NO: 2604033 - protein, 12 aa, Entamoeba histolytica
FTKGVNEEIKDN

SEQ ID NO: 2604034 - protein, 11 aa, Entamoeba histolytica
FTPRQKKETIQ

SEQ ID NO: 2604035 - protein, 5 aa, Entamoeba histolytica
FTQQS

SEQ ID NO: 2604036 - protein, 4 aa, Entamoeba histolytica
FYNE

SEQ ID NO: 2604037 - protein, 12 aa, Entamoeba histolytica
GAAGSAAFGSGM

SEQ ID NO: 2604038 - protein, 4 aa, Entamoeba histolytica
GAAM

SEQ ID NO: 2604039 - protein, 7 aa, Entamoeba histolytica
GAEIDEA

SEQ ID NO: 2604040 - protein, 11 aa, Entamoeba histolytica
GAELSDQPNNV

SEQ ID NO: 2604041 - protein, 9 aa, Entamoeba histolytica
GAGFGGETN

SEQ ID NO: 2604042 - protein, 8 aa, Entamoeba histolytica
GAGKTTTI

SEQ ID NO: 2604043 - protein, 7 aa, Entamoeba histolytica
GAIATNN

SEQ ID NO: 2604044 - protein, 6 aa, Entamoeba histolytica
GAISSS

SEQ ID NO: 2604045 - protein, 8 aa, Entamoeba histolytica
GAKGCEVS

SEQ ID NO: 2604046 - protein, 7 aa, Entamoeba histolytica
GAKKEGI

SEQ ID NO: 2604047 - protein, 9 aa, Entamoeba histolytica
GALGSTGRG

SEQ ID NO: 2604048 - protein, 30 aa, Entamoeba histolytica
GAPELPPCPTTPEPINEEIKPKKNKMNNKE

SEQ ID NO: 2604049 - protein, 9 aa, Entamoeba histolytica
GAPVKGESM

SEQ ID NO: 2604050 - protein, 10 aa, Entamoeba histolytica
GATSEGEEIY

SEQ ID NO: 2604051 - protein, 16 aa, Entamoeba histolytica
GAVEYSKEIDPEHKGV

SEQ ID NO: 2604052 - protein, 8 aa, Entamoeba histolytica
GAVGKSSI

SEQ ID NO: 2604053 - protein, 6 aa, Entamoeba histolytica
GAVGKT

SEQ ID NO: 2604054 - protein, 23 aa, Entamoeba histolytica
GCEGGHDEEPMEEEVKESFPKTV

SEQ ID NO: 2604055 - protein, 5 aa, Entamoeba histolytica
GDDLR

SEQ ID NO: 2604056 - protein, 6 aa, Entamoeba histolytica
GDDSPL

SEQ ID NO: 2604057 - protein, 10 aa, Entamoeba histolytica
GDEMDSRSDT

SEQ ID NO: 2604058 - protein, 15 aa, Entamoeba histolytica
GDEYGGRQDVKGDSF

SEQ ID NO: 2604059 - protein, 6 aa, Entamoeba histolytica
GDFPPI

SEQ ID NO: 2604060 - protein, 8 aa, Entamoeba histolytica
GDGFPKGC

SEQ ID NO: 2604061 - protein, 8 aa, Entamoeba histolytica
GDGKSSLG

SEQ ID NO: 2604062 - protein, 8 aa, Entamoeba histolytica
GDGSIRKG

SEQ ID NO: 2604063 - protein, 4 aa, Entamoeba histolytica
GDGT

SEQ ID NO: 2604064 - protein, 11 aa, Entamoeba histolytica
GDGTLRGANAI

SEQ ID NO: 2604065 - protein, 4 aa, Entamoeba histolytica
GDIE

SEQ ID NO: 2604066 - protein, 5 aa, Entamoeba histolytica
GDNYV

SEQ ID NO: 2604067 - protein, 9 aa, Entamoeba histolytica
GDPAKQNVN

SEQ ID NO: 2604068 - protein, 5 aa, Entamoeba histolytica
GDPIT

SEQ ID NO: 2604069 - protein, 9 aa, Entamoeba histolytica
GDPYGKDEE

SEQ ID NO: 2604070 - protein, 18 aa, Entamoeba histolytica
GDRMESNKNQVQKRAEMD

SEQ ID NO: 2604071 - protein, 17 aa, Entamoeba histolytica
GDRNRSSNDLVKSQGSL

SEQ ID NO: 2604072 - protein, 10 aa, Entamoeba histolytica
GDSAQKKSIQ

SEQ ID NO: 2604073 - protein, 10 aa, Entamoeba histolytica
GDSKRAMDEY

SEQ ID NO: 2604074 - protein, 11 aa, Entamoeba histolytica
GDSSFNKTNPI

SEQ ID NO: 2604075 - protein, 7 aa, Entamoeba histolytica
GDTDSPV

SEQ ID NO: 2604076 - protein, 10 aa, Entamoeba histolytica
GDVGDGKLAS

SEQ ID NO: 2604077 - protein, 4 aa, Entamoeba histolytica
GDVK

SEQ ID NO: 2604078 - protein, 4 aa, Entamoeba histolytica
GDYH

SEQ ID NO: 2604079 - protein, 30 aa, Entamoeba histolytica
GDYPSYSLPPNSANNGKESGKKNGKRRERM

SEQ ID NO: 2604080 - protein, 5 aa, Entamoeba histolytica
GEAQL

SEQ ID NO: 2604081 - protein, 6 aa, Entamoeba histolytica
GEDADL

SEQ ID NO: 2604082 - protein, 10 aa, Entamoeba histolytica
GEEARRSSQG

SEQ ID NO: 2604083 - protein, 4 aa, Entamoeba histolytica
GEED

SEQ ID NO: 2604084 - protein, 8 aa, Entamoeba histolytica
GEEEEEGK

SEQ ID NO: 2604085 - protein, 5 aa, Entamoeba histolytica
GEEPM

SEQ ID NO: 2604086 - protein, 22 aa, Entamoeba histolytica
GEEQFYSDDPDMRQSKKAFENT

SEQ ID NO: 2604087 - protein, 4 aa, Entamoeba histolytica
GEEV

SEQ ID NO: 2604088 - protein, 17 aa, Entamoeba histolytica
GEGGVYSKTPGPGAQAA

SEQ ID NO: 2604089 - protein, 5 aa, Entamoeba histolytica
GEGIV

SEQ ID NO: 2604090 - protein, 6 aa, Entamoeba histolytica
GEGLET

SEQ ID NO: 2604091 - protein, 4 aa, Entamoeba histolytica
GEIF

SEQ ID NO: 2604092 - protein, 13 aa, Entamoeba histolytica
GEIPPTAVQDQKV

SEQ ID NO: 2604093 - protein, 6 aa, Entamoeba histolytica
GEIPTA

SEQ ID NO: 2604094 - protein, 6 aa, Entamoeba histolytica
GEIQSH

SEQ ID NO: 2604095 - protein, 9 aa, Entamoeba histolytica
GEKERNNEV

SEQ ID NO: 2604096 - protein, 10 aa, Entamoeba histolytica
GEKKRNILEE

SEQ ID NO: 2604097 - protein, 8 aa, Entamoeba histolytica
GEKLGNGA

SEQ ID NO: 2604098 - protein, 5 aa, Entamoeba histolytica
GELPE

SEQ ID NO: 2604099 - protein, 8 aa, Entamoeba histolytica
GERTGREI

SEQ ID NO: 2604100 - protein, 10 aa, Entamoeba histolytica
GESIDEAKES

SEQ ID NO: 2604101 - protein, 11 aa, Entamoeba histolytica
GESQKTEENNY

SEQ ID NO: 2604102 - protein, 4 aa, Entamoeba histolytica
GESY

SEQ ID NO: 2604103 - protein, 9 aa, Entamoeba histolytica
GEYKKEEMM

SEQ ID NO: 2604104 - protein, 6 aa, Entamoeba histolytica
GFDKRG

SEQ ID NO: 2604105 - protein, 6 aa, Entamoeba histolytica
GFEPTK

SEQ ID NO: 2604106 - protein, 16 aa, Entamoeba histolytica
GFKPEANNGNEGRTKL

SEQ ID NO: 2604107 - protein, 7 aa, Entamoeba histolytica
GFKRETA

SEQ ID NO: 2604108 - protein, 13 aa, Entamoeba histolytica
GFTEDKLGHAENV

SEQ ID NO: 2604109 - protein, 5 aa, Entamoeba histolytica
GGCKE

SEQ ID NO: 2604110 - protein, 14 aa, Entamoeba histolytica
GGGERLVSASDDGT

SEQ ID NO: 2604111 - protein, 9 aa, Entamoeba histolytica
GGGPQPVFP

SEQ ID NO: 2604112 - protein, 10 aa, Entamoeba histolytica
GGHFGRNDPD

SEQ ID NO: 2604113 - protein, 4 aa, Entamoeba histolytica
GGIE

SEQ ID NO: 2604114 - protein, 7 aa, Entamoeba histolytica
GGIKETS

SEQ ID NO: 2604115 - protein, 6 aa, Entamoeba histolytica
GGINEA

SEQ ID NO: 2604116 - protein, 4 aa, Entamoeba histolytica
GGKD

SEQ ID NO: 2604117 - protein, 8 aa, Entamoeba histolytica
GGKGKKIE

SEQ ID NO: 2604118 - protein, 8 aa, Entamoeba histolytica
GGKIEEQK

SEQ ID NO: 2604119 - protein, 8 aa, Entamoeba histolytica
GGKQSGIL

SEQ ID NO: 2604120 - protein, 5 aa, Entamoeba histolytica
GGNNS

SEQ ID NO: 2604121 - protein, 6 aa, Entamoeba histolytica
GGNVKE

SEQ ID NO: 2604122 - protein, 11 aa, Entamoeba histolytica
GGPGGGKTTSL

SEQ ID NO: 2604123 - protein, 8 aa, Entamoeba histolytica
GGQGSRLG

SEQ ID NO: 2604124 - protein, 10 aa, Entamoeba histolytica
GGSIKKNGVY

SEQ ID NO: 2604125 - protein, 4 aa, Entamoeba histolytica
GGSL

SEQ ID NO: 2604126 - protein, 10 aa, Entamoeba histolytica
GGTASGKTTF

SEQ ID NO: 2604127 - protein, 5 aa, Entamoeba histolytica
GGTVE

SEQ ID NO: 2604128 - protein, 12 aa, Entamoeba histolytica
GGVSSAKTAEDI

SEQ ID NO: 2604129 - protein, 19 aa, Entamoeba histolytica
GGYDPLEKDKGIDGAKKRL

SEQ ID NO: 2604130 - protein, 8 aa, Entamoeba histolytica
GHDHKDSR

SEQ ID NO: 2604131 - protein, 13 aa, Entamoeba histolytica
GHEYPTDDLTQQG

SEQ ID NO: 2604132 - protein, 11 aa, Entamoeba histolytica
GHGGKEAAKVA

SEQ ID NO: 2604133 - protein, 8 aa, Entamoeba histolytica
GHNDSEVE

SEQ ID NO: 2604134 - protein, 4 aa, Entamoeba histolytica
GIDK

SEQ ID NO: 2604135 - protein, 8 aa, Entamoeba histolytica
GIEASAKT

SEQ ID NO: 2604136 - protein, 7 aa, Entamoeba histolytica
GIEGEGY

SEQ ID NO: 2604137 - protein, 7 aa, Entamoeba histolytica
GIERDKD

SEQ ID NO: 2604138 - protein, 6 aa, Entamoeba histolytica
GIESRK

SEQ ID NO: 2604139 - protein, 4 aa, Entamoeba histolytica
GIFP

SEQ ID NO: 2604140 - protein, 9 aa, Entamoeba histolytica
GIGKGKQIC

SEQ ID NO: 2604141 - protein, 9 aa, Entamoeba histolytica
GIKKETTIN

SEQ ID NO: 2604142 - protein, 7 aa, Entamoeba histolytica
GIKTTQI

SEQ ID NO: 2604143 - protein, 4 aa, Entamoeba histolytica
GILE

SEQ ID NO: 2604144 - protein, 4 aa, Entamoeba histolytica
GINK

SEQ ID NO: 2604145 - protein, 4 aa, Entamoeba histolytica
GIPE

SEQ ID NO: 2604146 - protein, 5 aa, Entamoeba histolytica
GIPKD

SEQ ID NO: 2604147 - protein, 6 aa, Entamoeba histolytica
GIQNEQ

SEQ ID NO: 2604148 - protein, 9 aa, Entamoeba histolytica
GIQPSQPKI

SEQ ID NO: 2604149 - protein, 7 aa, Entamoeba histolytica
GIQQSWS

SEQ ID NO: 2604150 - protein, 10 aa, Entamoeba histolytica
GIRVGKTGKC

SEQ ID NO: 2604151 - protein, 6 aa, Entamoeba histolytica
GITSDT

SEQ ID NO: 2604152 - protein, 10 aa, Entamoeba histolytica
GKAPTQQQEE

SEQ ID NO: 2604153 - protein, 7 aa, Entamoeba histolytica
GKDPRFK

SEQ ID NO: 2604154 - protein, 7 aa, Entamoeba histolytica
GKDREDY

SEQ ID NO: 2604155 - protein, 4 aa, Entamoeba histolytica
GKED

SEQ ID NO: 2604156 - protein, 8 aa, Entamoeba histolytica
GKEFKEDG

SEQ ID NO: 2604157 - protein, 5 aa, Entamoeba histolytica
GKEGK

SEQ ID NO: 2604158 - protein, 7 aa, Entamoeba histolytica
GKEITAE

SEQ ID NO: 2604159 - protein, 8 aa, Entamoeba histolytica
GKEPNTQY

SEQ ID NO: 2604160 - protein, 5 aa, Entamoeba histolytica
GKFPR

SEQ ID NO: 2604161 - protein, 6 aa, Entamoeba histolytica
GKGGDY

SEQ ID NO: 2604162 - protein, 6 aa, Entamoeba histolytica
GKGSFG

SEQ ID NO: 2604163 - protein, 6 aa, Entamoeba histolytica
GKGSMR

SEQ ID NO: 2604164 - protein, 14 aa, Entamoeba histolytica
GKGSTDNITTIVLK

SEQ ID NO: 2604165 - protein, 5 aa, Entamoeba histolytica
GKGTY

SEQ ID NO: 2604166 - protein, 5 aa, Entamoeba histolytica
GKHRG

SEQ ID NO: 2604167 - protein, 9 aa, Entamoeba histolytica
GKIENGKKA

SEQ ID NO: 2604168 - protein, 9 aa, Entamoeba histolytica
GKKGMPGAI

SEQ ID NO: 2604169 - protein, 4 aa, Entamoeba histolytica
GKKR

SEQ ID NO: 2604170 - protein, 7 aa, Entamoeba histolytica
GKKYGVN

SEQ ID NO: 2604171 - protein, 9 aa, Entamoeba histolytica
GKLRGQRAQ

SEQ ID NO: 2604172 - protein, 4 aa, Entamoeba histolytica
GKNG

SEQ ID NO: 2604173 - protein, 9 aa, Entamoeba histolytica
GKNIEKKDI

SEQ ID NO: 2604174 - protein, 12 aa, Entamoeba histolytica
GKNNEHTVKRTN

SEQ ID NO: 2604175 - protein, 6 aa, Entamoeba histolytica
GKNSEG

SEQ ID NO: 2604176 - protein, 7 aa, Entamoeba histolytica
GKPSEVV

SEQ ID NO: 2604177 - protein, 4 aa, Entamoeba histolytica
GKRL

SEQ ID NO: 2604178 - protein, 7 aa, Entamoeba histolytica
GKSFNTK

SEQ ID NO: 2604179 - protein, 24 aa, Entamoeba histolytica
GKVRNQTKKPEKVDTGKKKFPSGR

SEQ ID NO: 2604180 - protein, 26 aa, Entamoeba histolytica
GKVRNQTKKVEQIDTGVKKRPSGRAR

SEQ ID NO: 2604181 - protein, 8 aa, Entamoeba histolytica
GKVTSSNE

SEQ ID NO: 2604182 - protein, 8 aa, Entamoeba histolytica
GKVTSSSE

SEQ ID NO: 2604183 - protein, 8 aa, Entamoeba histolytica
GKYEETEP

SEQ ID NO: 2604184 - protein, 6 aa, Entamoeba histolytica
GKYGRN

SEQ ID NO: 2604185 - protein, 7 aa, Entamoeba histolytica
GLEKEGI

SEQ ID NO: 2604186 - protein, 8 aa, Entamoeba histolytica
GLESTKDQ

SEQ ID NO: 2604187 - protein, 6 aa, Entamoeba histolytica
GLFEGK

SEQ ID NO: 2604188 - protein, 7 aa, Entamoeba histolytica
GLKPQNM

SEQ ID NO: 2604189 - protein, 7 aa, Entamoeba histolytica
GLPPMGG

SEQ ID NO: 2604190 - protein, 8 aa, Entamoeba histolytica
GLSGPNLR

SEQ ID NO: 2604191 - protein, 12 aa, Entamoeba histolytica
GMEENEFTDARQ

SEQ ID NO: 2604192 - protein, 7 aa, Entamoeba histolytica
GMKNKEE

SEQ ID NO: 2604193 - protein, 7 aa, Entamoeba histolytica
GNAEFTS

SEQ ID NO: 2604194 - protein, 8 aa, Entamoeba histolytica
GNESVGTP

SEQ ID NO: 2604195 - protein, 4 aa, Entamoeba histolytica
GNET

SEQ ID NO: 2604196 - protein, 4 aa, Entamoeba histolytica
GNIE

SEQ ID NO: 2604197 - protein, 16 aa, Entamoeba histolytica
GNKFTTEAKLNEHDAR

SEQ ID NO: 2604198 - protein, 7 aa, Entamoeba histolytica
GNKMPEG

SEQ ID NO: 2604199 - protein, 19 aa, Entamoeba histolytica
GNKREEAKTEREAVTKPNL

SEQ ID NO: 2604200 - protein, 8 aa, Entamoeba histolytica
GNKVTTGD

SEQ ID NO: 2604201 - protein, 4 aa, Entamoeba histolytica
GNND

SEQ ID NO: 2604202 - protein, 5 aa, Entamoeba histolytica
GNNEY

SEQ ID NO: 2604203 - protein, 8 aa, Entamoeba histolytica
GNNGTTVT

SEQ ID NO: 2604204 - protein, 6 aa, Entamoeba histolytica
GNPAHL

SEQ ID NO: 2604205 - protein, 6 aa, Entamoeba histolytica
GNPTVE

SEQ ID NO: 2604206 - protein, 29 aa, Entamoeba histolytica
GNPVQSQQQNVTQNPFGQQQNAQQPQKDI

SEQ ID NO: 2604207 - protein, 10 aa, Entamoeba histolytica
GNQKTVQEMR

SEQ ID NO: 2604208 - protein, 6 aa, Entamoeba histolytica
GNQNQS

SEQ ID NO: 2604209 - protein, 8 aa, Entamoeba histolytica
GNQYKNKK

SEQ ID NO: 2604210 - protein, 4 aa, Entamoeba histolytica
GNRP

SEQ ID NO: 2604211 - protein, 8 aa, Entamoeba histolytica
GNSTIPST

SEQ ID NO: 2604212 - protein, 5 aa, Entamoeba histolytica
GNTEK

SEQ ID NO: 2604213 - protein, 5 aa, Entamoeba histolytica
GNTIN

SEQ ID NO: 2604214 - protein, 12 aa, Entamoeba histolytica
GNTYNEGDATKM

SEQ ID NO: 2604215 - protein, 8 aa, Entamoeba histolytica
GNVHSNTT

SEQ ID NO: 2604216 - protein, 10 aa, Entamoeba histolytica
GPDNSNEKSE

SEQ ID NO: 2604217 - protein, 4 aa, Entamoeba histolytica
GPFA

SEQ ID NO: 2604218 - protein, 12 aa, Entamoeba histolytica
GPGLNKAGKFPT

SEQ ID NO: 2604219 - protein, 4 aa, Entamoeba histolytica
GPIR

SEQ ID NO: 2604220 - protein, 9 aa, Entamoeba histolytica
GPKRKRQHI

SEQ ID NO: 2604221 - protein, 4 aa, Entamoeba histolytica
GPMN

SEQ ID NO: 2604222 - protein, 5 aa, Entamoeba histolytica
GPMNG

SEQ ID NO: 2604223 - protein, 9 aa, Entamoeba histolytica
GPNMGGKST

SEQ ID NO: 2604224 - protein, 9 aa, Entamoeba histolytica
GPSATGKSR

SEQ ID NO: 2604225 - protein, 5 aa, Entamoeba histolytica
GPSIT

SEQ ID NO: 2604226 - protein, 9 aa, Entamoeba histolytica
GPTSAGKTS

SEQ ID NO: 2604227 - protein, 11 aa, Entamoeba histolytica
GPTTIQKPSGV

SEQ ID NO: 2604228 - protein, 12 aa, Entamoeba histolytica
GPVPPQAPMGIG

SEQ ID NO: 2604229 - protein, 5 aa, Entamoeba histolytica
GQDKI

SEQ ID NO: 2604230 - protein, 6 aa, Entamoeba histolytica
GQETYH

SEQ ID NO: 2604231 - protein, 34 aa, Entamoeba histolytica
GQFQSESAVPKDTRYMNEGTTETTDTMGSVSSFS

SEQ ID NO: 2604232 - protein, 5 aa, Entamoeba histolytica
GQGTF

SEQ ID NO: 2604233 - protein, 5 aa, Entamoeba histolytica
GQHDQ

SEQ ID NO: 2604234 - protein, 4 aa, Entamoeba histolytica
GQIK

SEQ ID NO: 2604235 - protein, 9 aa, Entamoeba histolytica
GQIYSQGTK

SEQ ID NO: 2604236 - protein, 9 aa, Entamoeba histolytica
GQKAENEER

SEQ ID NO: 2604237 - protein, 4 aa, Entamoeba histolytica
GQKK

SEQ ID NO: 2604238 - protein, 12 aa, Entamoeba histolytica
GQPLGQPTGGKL

SEQ ID NO: 2604239 - protein, 22 aa, Entamoeba histolytica
GQPRYDDGKYTTNGTDKQYENC

SEQ ID NO: 2604240 - protein, 36 aa, Entamoeba histolytica
GQQRVEVSPSHSIKSPRATSTDRDDPPKRSRRTPIR

SEQ ID NO: 2604241 - protein, 6 aa, Entamoeba histolytica
GRDFPD

SEQ ID NO: 2604242 - protein, 11 aa, Entamoeba histolytica
GRGDFPNQVNN

SEQ ID NO: 2604243 - protein, 9 aa, Entamoeba histolytica
GRGTSTYDG

SEQ ID NO: 2604244 - protein, 10 aa, Entamoeba histolytica
GRLSNGNKCE

SEQ ID NO: 2604245 - protein, 8 aa, Entamoeba histolytica
GRNNDKQR

SEQ ID NO: 2604246 - protein, 8 aa, Entamoeba histolytica
GRNSKTVD

SEQ ID NO: 2604247 - protein, 6 aa, Entamoeba histolytica
GRNTTD

SEQ ID NO: 2604248 - protein, 7 aa, Entamoeba histolytica
GRQKKTL

SEQ ID NO: 2604249 - protein, 8 aa, Entamoeba histolytica
GRTDETIR

SEQ ID NO: 2604250 - protein, 10 aa, Entamoeba histolytica
GRTEQDEIKP

SEQ ID NO: 2604251 - protein, 9 aa, Entamoeba histolytica
GRTGSRGGV

SEQ ID NO: 2604252 - protein, 17 aa, Entamoeba histolytica
GSDEHQNNNPGDSGFGE

SEQ ID NO: 2604253 - protein, 8 aa, Entamoeba histolytica
GSDKIDEA

SEQ ID NO: 2604254 - protein, 5 aa, Entamoeba histolytica
GSDSK

SEQ ID NO: 2604255 - protein, 16 aa, Entamoeba histolytica
GSDSRSQKKMKKQRRY

SEQ ID NO: 2604256 - protein, 6 aa, Entamoeba histolytica
GSEEIK

SEQ ID NO: 2604257 - protein, 7 aa, Entamoeba histolytica
GSEIQTG

SEQ ID NO: 2604258 - protein, 7 aa, Entamoeba histolytica
GSEQNAA

SEQ ID NO: 2604259 - protein, 27 aa, Entamoeba histolytica
GSERLDESGAKGERLEETKNINKSLSA

SEQ ID NO: 2604260 - protein, 4 aa, Entamoeba histolytica
GSET

SEQ ID NO: 2604261 - protein, 6 aa, Entamoeba histolytica
GSEYTG

SEQ ID NO: 2604262 - protein, 6 aa, Entamoeba histolytica
GSGEYS

SEQ ID NO: 2604263 - protein, 11 aa, Entamoeba histolytica
GSGGIKLTKDG

SEQ ID NO: 2604264 - protein, 4 aa, Entamoeba histolytica
GSIE

SEQ ID NO: 2604265 - protein, 10 aa, Entamoeba histolytica
GSIKKNGVYE

SEQ ID NO: 2604266 - protein, 4 aa, Entamoeba histolytica
GSIR

SEQ ID NO: 2604267 - protein, 9 aa, Entamoeba histolytica
GSKDLTEQQ

SEQ ID NO: 2604268 - protein, 6 aa, Entamoeba histolytica
GSKEHI

SEQ ID NO: 2604269 - protein, 36 aa, Entamoeba histolytica
GSLGNTTGFGQIGNTQTSGFGGFGQNNTQQSNGFGG

SEQ ID NO: 2604270 - protein, 15 aa, Entamoeba histolytica
GSLHNGREDIKKDTR

SEQ ID NO: 2604271 - protein, 6 aa, Entamoeba histolytica
GSLPEN

SEQ ID NO: 2604272 - protein, 9 aa, Entamoeba histolytica
GSLTRQNEK

SEQ ID NO: 2604273 - protein, 7 aa, Entamoeba histolytica
GSNGKEY

SEQ ID NO: 2604274 - protein, 6 aa, Entamoeba histolytica
GSPFGN

SEQ ID NO: 2604275 - protein, 9 aa, Entamoeba histolytica
GSPREKGNT

SEQ ID NO: 2604276 - protein, 8 aa, Entamoeba histolytica
GSPTDINR

SEQ ID NO: 2604277 - protein, 7 aa, Entamoeba histolytica
GSSANGR

SEQ ID NO: 2604278 - protein, 6 aa, Entamoeba histolytica
GSSNTT

SEQ ID NO: 2604279 - protein, 5 aa, Entamoeba histolytica
GSTQN

SEQ ID NO: 2604280 - protein, 6 aa, Entamoeba histolytica
GSTTEG

SEQ ID NO: 2604281 - protein, 6 aa, Entamoeba histolytica
GSYPEL

SEQ ID NO: 2604282 - protein, 11 aa, Entamoeba histolytica
GTDTSQGKGQI

SEQ ID NO: 2604283 - protein, 6 aa, Entamoeba histolytica
GTDWDK

SEQ ID NO: 2604284 - protein, 17 aa, Entamoeba histolytica
GTEQYGSSGTSYNNAGE

SEQ ID NO: 2604285 - protein, 11 aa, Entamoeba histolytica
GTGNYTSSPGV

SEQ ID NO: 2604286 - protein, 4 aa, Entamoeba histolytica
GTGV

SEQ ID NO: 2604287 - protein, 8 aa, Entamoeba histolytica
GTIHEGDS

SEQ ID NO: 2604288 - protein, 7 aa, Entamoeba histolytica
GTLTSHD

SEQ ID NO: 2604289 - protein, 7 aa, Entamoeba histolytica
GTNECSL

SEQ ID NO: 2604290 - protein, 4 aa, Entamoeba histolytica
GTNG

SEQ ID NO: 2604291 - protein, 12 aa, Entamoeba histolytica
GTNKKLLGGKGA

SEQ ID NO: 2604292 - protein, 8 aa, Entamoeba histolytica
GTPDYTAP

SEQ ID NO: 2604293 - protein, 4 aa, Entamoeba histolytica
GTPI

SEQ ID NO: 2604294 - protein, 7 aa, Entamoeba histolytica
GTQPPQC

SEQ ID NO: 2604295 - protein, 8 aa, Entamoeba histolytica
GTRHPGMP

SEQ ID NO: 2604296 - protein, 15 aa, Entamoeba histolytica
GTRSIEESKIASKKY

SEQ ID NO: 2604297 - protein, 8 aa, Entamoeba histolytica
GTSGIDAR

SEQ ID NO: 2604298 - protein, 6 aa, Entamoeba histolytica
GTTYAS

SEQ ID NO: 2604299 - protein, 5 aa, Entamoeba histolytica
GTVED

SEQ ID NO: 2604300 - protein, 4 aa, Entamoeba histolytica
GVEA

SEQ ID NO: 2604301 - protein, 9 aa, Entamoeba histolytica
GVEAGLASG

SEQ ID NO: 2604302 - protein, 11 aa, Entamoeba histolytica
GVGEDGPTHQP

SEQ ID NO: 2604303 - protein, 5 aa, Entamoeba histolytica
GVGGT

SEQ ID NO: 2604304 - protein, 18 aa, Entamoeba histolytica
GVGSFNDSDSKKRQYAKD

SEQ ID NO: 2604305 - protein, 16 aa, Entamoeba histolytica
GVHEPNYYGSYTQSAT

SEQ ID NO: 2604306 - protein, 9 aa, Entamoeba histolytica
GVKKPNDNE

SEQ ID NO: 2604307 - protein, 7 aa, Entamoeba histolytica
GVKSTDE

SEQ ID NO: 2604308 - protein, 6 aa, Entamoeba histolytica
GVTIPS

SEQ ID NO: 2604309 - protein, 5 aa, Entamoeba histolytica
GVVKS

SEQ ID NO: 2604310 - protein, 6 aa, Entamoeba histolytica
GWDRTS

SEQ ID NO: 2604311 - protein, 7 aa, Entamoeba histolytica
GWDRTSQ

SEQ ID NO: 2604312 - protein, 8 aa, Entamoeba histolytica
GWDRTSQL

SEQ ID NO: 2604313 - protein, 10 aa, Entamoeba histolytica
GYGTPINGRK

SEQ ID NO: 2604314 - protein, 13 aa, Entamoeba histolytica
GYPQYNQEERNHP

SEQ ID NO: 2604315 - protein, 4 aa, Entamoeba histolytica
GYQN

SEQ ID NO: 2604316 - protein, 6 aa, Entamoeba histolytica
GYTPNE

SEQ ID NO: 2604317 - protein, 6 aa, Entamoeba histolytica
HAEEAK

SEQ ID NO: 2604318 - protein, 5 aa, Entamoeba histolytica
HAEHK

SEQ ID NO: 2604319 - protein, 10 aa, Entamoeba histolytica
HDSSNGFNPF

SEQ ID NO: 2604320 - protein, 4 aa, Entamoeba histolytica
HEDD

SEQ ID NO: 2604321 - protein, 10 aa, Entamoeba histolytica
HEDSTNRDKI

SEQ ID NO: 2604322 - protein, 10 aa, Entamoeba histolytica
HEEANPVEDK

SEQ ID NO: 2604323 - protein, 10 aa, Entamoeba histolytica
HEERIKENGE

SEQ ID NO: 2604324 - protein, 12 aa, Entamoeba histolytica
HEEVTEQKEGEI

SEQ ID NO: 2604325 - protein, 5 aa, Entamoeba histolytica
HEKEG

SEQ ID NO: 2604326 - protein, 7 aa, Entamoeba histolytica
HEKGNEA

SEQ ID NO: 2604327 - protein, 15 aa, Entamoeba histolytica
HIQDPETPGYIKALL

SEQ ID NO: 2604328 - protein, 8 aa, Entamoeba histolytica
HKDIEAAK

SEQ ID NO: 2604329 - protein, 4 aa, Entamoeba histolytica
HKSK

SEQ ID NO: 2604330 - protein, 6 aa, Entamoeba histolytica
HKTEFS

SEQ ID NO: 2604331 - protein, 5 aa, Entamoeba histolytica
HLPTE

SEQ ID NO: 2604332 - protein, 7 aa, Entamoeba histolytica
HMSREEA

SEQ ID NO: 2604333 - protein, 6 aa, Entamoeba histolytica
HNAPEY

SEQ ID NO: 2604334 - protein, 34 aa, Entamoeba histolytica
HNDENVDVNEDEEEIEEDIEEVEEPEIEYEYEYE

SEQ ID NO: 2604335 - protein, 7 aa, Entamoeba histolytica
HNGEEAA

SEQ ID NO: 2604336 - protein, 8 aa, Entamoeba histolytica
HNKPEVEL

SEQ ID NO: 2604337 - protein, 8 aa, Entamoeba histolytica
HNKPITAL

SEQ ID NO: 2604338 - protein, 10 aa, Entamoeba histolytica
HPAKLSNQKK

SEQ ID NO: 2604339 - protein, 5 aa, Entamoeba histolytica
HPGAS

SEQ ID NO: 2604340 - protein, 6 aa, Entamoeba histolytica
HPGASA

SEQ ID NO: 2604341 - protein, 5 aa, Entamoeba histolytica
HPNYP

SEQ ID NO: 2604342 - protein, 7 aa, Entamoeba histolytica
HPTSTTK

SEQ ID NO: 2604343 - protein, 7 aa, Entamoeba histolytica
HPYPKSK

SEQ ID NO: 2604344 - protein, 9 aa, Entamoeba histolytica
HQAGSDSLI

SEQ ID NO: 2604345 - protein, 6 aa, Entamoeba histolytica
HQGSKG

SEQ ID NO: 2604346 - protein, 4 aa, Entamoeba histolytica
HQNE

SEQ ID NO: 2604347 - protein, 6 aa, Entamoeba histolytica
HQNSNA

SEQ ID NO: 2604348 - protein, 7 aa, Entamoeba histolytica
HRDQLDP

SEQ ID NO: 2604349 - protein, 15 aa, Entamoeba histolytica
HREVTQKEALAKGQN

SEQ ID NO: 2604350 - protein, 8 aa, Entamoeba histolytica
HRGRTAAQ

SEQ ID NO: 2604351 - protein, 12 aa, Entamoeba histolytica
HRSEAERACRRA

SEQ ID NO: 2604352 - protein, 23 aa, Entamoeba histolytica
HSAESFDNDLTSISKSLSELTSR

SEQ ID NO: 2604353 - protein, 7 aa, Entamoeba histolytica
HSFTDSN

SEQ ID NO: 2604354 - protein, 6 aa, Entamoeba histolytica
HSKEEK

SEQ ID NO: 2604355 - protein, 4 aa, Entamoeba histolytica
HSKI

SEQ ID NO: 2604356 - protein, 9 aa, Entamoeba histolytica
HSPDSIKDY

SEQ ID NO: 2604357 - protein, 7 aa, Entamoeba histolytica
HSPNSKF

SEQ ID NO: 2604358 - protein, 7 aa, Entamoeba histolytica
HSSFNPS

SEQ ID NO: 2604359 - protein, 4 aa, Entamoeba histolytica
HSSS

SEQ ID NO: 2604360 - protein, 7 aa, Entamoeba histolytica
HSSSQDV

SEQ ID NO: 2604361 - protein, 6 aa, Entamoeba histolytica
HSTGKM

SEQ ID NO: 2604362 - protein, 4 aa, Entamoeba histolytica
HSTV

SEQ ID NO: 2604363 - protein, 31 aa, Entamoeba histolytica
HTKESSSIPPKPPKQKQKRTRKQTVLFPNLV

SEQ ID NO: 2604364 - protein, 7 aa, Entamoeba histolytica
HTLTKTE

SEQ ID NO: 2604365 - protein, 6 aa, Entamoeba histolytica
HTSANV

SEQ ID NO: 2604366 - protein, 4 aa, Entamoeba histolytica
HYRS

SEQ ID NO: 2604367 - protein, 10 aa, Entamoeba histolytica
IAEKPRLAET

SEQ ID NO: 2604368 - protein, 8 aa, Entamoeba histolytica
IARSGTKT

SEQ ID NO: 2604369 - protein, 5 aa, Entamoeba histolytica
IASGA

SEQ ID NO: 2604370 - protein, 6 aa, Entamoeba histolytica
IATNPY

SEQ ID NO: 2604371 - protein, 5 aa, Entamoeba histolytica
IDDEQ

SEQ ID NO: 2604372 - protein, 5 aa, Entamoeba histolytica
IDDND

SEQ ID NO: 2604373 - protein, 10 aa, Entamoeba histolytica
IDDSEKDSLN

SEQ ID NO: 2604374 - protein, 17 aa, Entamoeba histolytica
IDEMDKADEENRKKSLA

SEQ ID NO: 2604375 - protein, 7 aa, Entamoeba histolytica
IDENKGF

SEQ ID NO: 2604376 - protein, 5 aa, Entamoeba histolytica
IDETD

SEQ ID NO: 2604377 - protein, 5 aa, Entamoeba histolytica
IDGKE

SEQ ID NO: 2604378 - protein, 8 aa, Entamoeba histolytica
IDGKGNTV

SEQ ID NO: 2604379 - protein, 6 aa, Entamoeba histolytica
IDGTSN

SEQ ID NO: 2604380 - protein, 8 aa, Entamoeba histolytica
IDKSQSVN

SEQ ID NO: 2604381 - protein, 7 aa, Entamoeba histolytica
IDNDSSR

SEQ ID NO: 2604382 - protein, 6 aa, Entamoeba histolytica
IDNDYE

SEQ ID NO: 2604383 - protein, 16 aa, Entamoeba histolytica
IDNNQGYSKPTIYESE

SEQ ID NO: 2604384 - protein, 7 aa, Entamoeba histolytica
IDNPTSY

SEQ ID NO: 2604385 - protein, 9 aa, Entamoeba histolytica
IDPNNKEVK

SEQ ID NO: 2604386 - protein, 5 aa, Entamoeba histolytica
IDPPK

SEQ ID NO: 2604387 - protein, 4 aa, Entamoeba histolytica
IDPS

SEQ ID NO: 2604388 - protein, 6 aa, Entamoeba histolytica
IDRGNG

SEQ ID NO: 2604389 - protein, 6 aa, Entamoeba histolytica
IDRKET

SEQ ID NO: 2604390 - protein, 23 aa, Entamoeba histolytica
IDSERIKEMTKKQAKRTQEAQIN

SEQ ID NO: 2604391 - protein, 4 aa, Entamoeba histolytica
IDST

SEQ ID NO: 2604392 - protein, 4 aa, Entamoeba histolytica
IDSY

SEQ ID NO: 2604393 - protein, 5 aa, Entamoeba histolytica
IDTIG

SEQ ID NO: 2604394 - protein, 4 aa, Entamoeba histolytica
IDTK

SEQ ID NO: 2604395 - protein, 5 aa, Entamoeba histolytica
IDTTD

SEQ ID NO: 2604396 - protein, 6 aa, Entamoeba histolytica
IEARSS

SEQ ID NO: 2604397 - protein, 11 aa, Entamoeba histolytica
IEATSTRLTYT

SEQ ID NO: 2604398 - protein, 4 aa, Entamoeba histolytica
IEDE

SEQ ID NO: 2604399 - protein, 8 aa, Entamoeba histolytica
IEDKEQGI

SEQ ID NO: 2604400 - protein, 6 aa, Entamoeba histolytica
IEDKKE

SEQ ID NO: 2604401 - protein, 9 aa, Entamoeba histolytica
IEEKGSKGV

SEQ ID NO: 2604402 - protein, 26 aa, Entamoeba histolytica
IEEQPHEDDMDNNNEDELNRNEDRKN

SEQ ID NO: 2604403 - protein, 9 aa, Entamoeba histolytica
IEESSGDIK

SEQ ID NO: 2604404 - protein, 7 aa, Entamoeba histolytica
IEGEEGK

SEQ ID NO: 2604405 - protein, 6 aa, Entamoeba histolytica
IEGEGK

SEQ ID NO: 2604406 - protein, 4 aa, Entamoeba histolytica
IEGR

SEQ ID NO: 2604407 - protein, 11 aa, Entamoeba histolytica
IEGVPKPIDKV

SEQ ID NO: 2604408 - protein, 43 aa, Entamoeba histolytica
IEIPQNEALNEKEEVQNDETMNNSLPNEKMQEKREEKEEKRIK

SEQ ID NO: 2604409 - protein, 19 aa, Entamoeba histolytica
IEIPQNEALNEKEEVQNNE

SEQ ID NO: 2604410 - protein, 7 aa, Entamoeba histolytica
IEKEETV

SEQ ID NO: 2604411 - protein, 11 aa, Entamoeba histolytica
IEKHKKKDFDA

SEQ ID NO: 2604412 - protein, 4 aa, Entamoeba histolytica
IEND

SEQ ID NO: 2604413 - protein, 4 aa, Entamoeba histolytica
IENE

SEQ ID NO: 2604414 - protein, 14 aa, Entamoeba histolytica
IENGTQLPAHAKEG

SEQ ID NO: 2604415 - protein, 10 aa, Entamoeba histolytica
IEPDESEDID

SEQ ID NO: 2604416 - protein, 9 aa, Entamoeba histolytica
IEPNPSHET

SEQ ID NO: 2604417 - protein, 21 aa, Entamoeba histolytica
IEPPPKEEAVRDKNKYDGLDP

SEQ ID NO: 2604418 - protein, 11 aa, Entamoeba histolytica
IEQQKKSDHIN

SEQ ID NO: 2604419 - protein, 6 aa, Entamoeba histolytica
IETPKY

SEQ ID NO: 2604420 - protein, 31 aa, Entamoeba histolytica
IETSPKEEAKNEQKEEVKQEKKEEVQIPIEQ

SEQ ID NO: 2604421 - protein, 5 aa, Entamoeba histolytica
IEVTR

SEQ ID NO: 2604422 - protein, 14 aa, Entamoeba histolytica
IFRGPDNERRRAAE

SEQ ID NO: 2604423 - protein, 10 aa, Entamoeba histolytica
IGDENGKVKG

SEQ ID NO: 2604424 - protein, 8 aa, Entamoeba histolytica
IGDKRNDH

SEQ ID NO: 2604425 - protein, 4 aa, Entamoeba histolytica
IGED

SEQ ID NO: 2604426 - protein, 16 aa, Entamoeba histolytica
IGGTRFQDDTGESEVQ

SEQ ID NO: 2604427 - protein, 5 aa, Entamoeba histolytica
IGKES

SEQ ID NO: 2604428 - protein, 5 aa, Entamoeba histolytica
IGKGA

SEQ ID NO: 2604429 - protein, 8 aa, Entamoeba histolytica
IGKPVGQY

SEQ ID NO: 2604430 - protein, 4 aa, Entamoeba histolytica
IGKT

SEQ ID NO: 2604431 - protein, 6 aa, Entamoeba histolytica
IGQKKE

SEQ ID NO: 2604432 - protein, 4 aa, Entamoeba histolytica
IGSN

SEQ ID NO: 2604433 - protein, 16 aa, Entamoeba histolytica
IGTTGKRGDLYLIIKL

SEQ ID NO: 2604434 - protein, 10 aa, Entamoeba histolytica
IGTTRYPEDT

SEQ ID NO: 2604435 - protein, 7 aa, Entamoeba histolytica
IGYHSDD

SEQ ID NO: 2604436 - protein, 4 aa, Entamoeba histolytica
IIDE

SEQ ID NO: 2604437 - protein, 4 aa, Entamoeba histolytica
IISK

SEQ ID NO: 2604438 - protein, 8 aa, Entamoeba histolytica
IKAKKNVS

SEQ ID NO: 2604439 - protein, 11 aa, Entamoeba histolytica
IKDDEVRGAQY

SEQ ID NO: 2604440 - protein, 10 aa, Entamoeba histolytica
IKEARESAQL

SEQ ID NO: 2604441 - protein, 8 aa, Entamoeba histolytica
IKEEERNK

SEQ ID NO: 2604442 - protein, 10 aa, Entamoeba histolytica
IKEEGRNKLG

SEQ ID NO: 2604443 - protein, 10 aa, Entamoeba histolytica
IKEKGKEIEG

SEQ ID NO: 2604444 - protein, 11 aa, Entamoeba histolytica
IKEKGTDNLGS

SEQ ID NO: 2604445 - protein, 8 aa, Entamoeba histolytica
IKGNEKRT

SEQ ID NO: 2604446 - protein, 8 aa, Entamoeba histolytica
IKGNVSGL

SEQ ID NO: 2604447 - protein, 4 aa, Entamoeba histolytica
IKGY

SEQ ID NO: 2604448 - protein, 7 aa, Entamoeba histolytica
IKKEELK

SEQ ID NO: 2604449 - protein, 7 aa, Entamoeba histolytica
IKKQNTV

SEQ ID NO: 2604450 - protein, 12 aa, Entamoeba histolytica
IKKSGNSEAKKK

SEQ ID NO: 2604451 - protein, 11 aa, Entamoeba histolytica
IKNNSNVEDKE

SEQ ID NO: 2604452 - protein, 4 aa, Entamoeba histolytica
IKPD

SEQ ID NO: 2604453 - protein, 7 aa, Entamoeba histolytica
IKPSGCQ

SEQ ID NO: 2604454 - protein, 9 aa, Entamoeba histolytica
IKPTPQELE

SEQ ID NO: 2604455 - protein, 4 aa, Entamoeba histolytica
IKSE

SEQ ID NO: 2604456 - protein, 25 aa, Entamoeba histolytica
IKSRMNASYSNPSEVELAFEERINN

SEQ ID NO: 2604457 - protein, 7 aa, Entamoeba histolytica
IKTQDES

SEQ ID NO: 2604458 - protein, 7 aa, Entamoeba histolytica
ILTGGDN

SEQ ID NO: 2604459 - protein, 16 aa, Entamoeba histolytica
INASPKDSKRNKLEEL

SEQ ID NO: 2604460 - protein, 4 aa, Entamoeba histolytica
INDQ

SEQ ID NO: 2604461 - protein, 8 aa, Entamoeba histolytica
INDSTNDK

SEQ ID NO: 2604462 - protein, 6 aa, Entamoeba histolytica
INEEQL

SEQ ID NO: 2604463 - protein, 8 aa, Entamoeba histolytica
INEKTKES

SEQ ID NO: 2604464 - protein, 8 aa, Entamoeba histolytica
INGGNDKF

SEQ ID NO: 2604465 - protein, 4 aa, Entamoeba histolytica
INGK

SEQ ID NO: 2604466 - protein, 6 aa, Entamoeba histolytica
INKEDY

SEQ ID NO: 2604467 - protein, 9 aa, Entamoeba histolytica
INKENGKEW

SEQ ID NO: 2604468 - protein, 8 aa, Entamoeba histolytica
INKNDQNK

SEQ ID NO: 2604469 - protein, 9 aa, Entamoeba histolytica
INKYDEAEQ

SEQ ID NO: 2604470 - protein, 12 aa, Entamoeba histolytica
INNFGSDIKDSE

SEQ ID NO: 2604471 - protein, 6 aa, Entamoeba histolytica
INPIEN

SEQ ID NO: 2604472 - protein, 6 aa, Entamoeba histolytica
INPPKF

SEQ ID NO: 2604473 - protein, 9 aa, Entamoeba histolytica
INPPSRFAT

SEQ ID NO: 2604474 - protein, 6 aa, Entamoeba histolytica
INPSEI

SEQ ID NO: 2604475 - protein, 9 aa, Entamoeba histolytica
INQESNKGK

SEQ ID NO: 2604476 - protein, 13 aa, Entamoeba histolytica
INQPEGTSTTDPT

SEQ ID NO: 2604477 - protein, 20 aa, Entamoeba histolytica
INSQPATAVPGSSYASTARS

SEQ ID NO: 2604478 - protein, 7 aa, Entamoeba histolytica
INTTEKR

SEQ ID NO: 2604479 - protein, 17 aa, Entamoeba histolytica
INVGHPKKKEEQKKEYK

SEQ ID NO: 2604480 - protein, 14 aa, Entamoeba histolytica
IPATPKYNEEKDNM

SEQ ID NO: 2604481 - protein, 11 aa, Entamoeba histolytica
IPDENGESKIK

SEQ ID NO: 2604482 - protein, 4 aa, Entamoeba histolytica
IPES

SEQ ID NO: 2604483 - protein, 11 aa, Entamoeba histolytica
IPKEGKVTISA

SEQ ID NO: 2604484 - protein, 17 aa, Entamoeba histolytica
IPNSLQPKCDGRKNINK

SEQ ID NO: 2604485 - protein, 5 aa, Entamoeba histolytica
IPPQQ

SEQ ID NO: 2604486 - protein, 12 aa, Entamoeba histolytica
IPPRPPRENRNT

SEQ ID NO: 2604487 - protein, 5 aa, Entamoeba histolytica
IPPTK

SEQ ID NO: 2604488 - protein, 11 aa, Entamoeba histolytica
IPQPGSLEGEK

SEQ ID NO: 2604489 - protein, 17 aa, Entamoeba histolytica
IPQPYTDTKVPEKKAAI

SEQ ID NO: 2604490 - protein, 6 aa, Entamoeba histolytica
IPSKHS

SEQ ID NO: 2604491 - protein, 5 aa, Entamoeba histolytica
IPSSL

SEQ ID NO: 2604492 - protein, 5 aa, Entamoeba histolytica
IPSSV

SEQ ID NO: 2604493 - protein, 4 aa, Entamoeba histolytica
IPST

SEQ ID NO: 2604494 - protein, 9 aa, Entamoeba histolytica
IPTKAGSLK

SEQ ID NO: 2604495 - protein, 5 aa, Entamoeba histolytica
IPTNV

SEQ ID NO: 2604496 - protein, 11 aa, Entamoeba histolytica
IPTRGSDQSAG

SEQ ID NO: 2604497 - protein, 7 aa, Entamoeba histolytica
IPTSVSK

SEQ ID NO: 2604498 - protein, 8 aa, Entamoeba histolytica
IPTSVSKI

SEQ ID NO: 2604499 - protein, 9 aa, Entamoeba histolytica
IQADYDDGK

SEQ ID NO: 2604500 - protein, 11 aa, Entamoeba histolytica
IQEEKGYKSFG

SEQ ID NO: 2604501 - protein, 4 aa, Entamoeba histolytica
IQER

SEQ ID NO: 2604502 - protein, 13 aa, Entamoeba histolytica
IQKRKEDINDVVD

SEQ ID NO: 2604503 - protein, 15 aa, Entamoeba histolytica
IQPQVSSQQQPISQP

SEQ ID NO: 2604504 - protein, 8 aa, Entamoeba histolytica
IQREEDKN

SEQ ID NO: 2604505 - protein, 42 aa, Entamoeba histolytica
IQRGTKLKKTTTVDKSAPAIGKSSNSSSSGMGGGMPMGGGNP

SEQ ID NO: 2604506 - protein, 11 aa, Entamoeba histolytica
IQRNSLDDEYD

SEQ ID NO: 2604507 - protein, 4 aa, Entamoeba histolytica
IQSP

SEQ ID NO: 2604508 - protein, 17 aa, Entamoeba histolytica
IQTPSKAIQPSNEDTIG

SEQ ID NO: 2604509 - protein, 8 aa, Entamoeba histolytica
IQTQNEVP

SEQ ID NO: 2604510 - protein, 13 aa, Entamoeba histolytica
IQWTTSRRKLTEV

SEQ ID NO: 2604511 - protein, 4 aa, Entamoeba histolytica
IRAE

SEQ ID NO: 2604512 - protein, 8 aa, Entamoeba histolytica
IREGETAL

SEQ ID NO: 2604513 - protein, 29 aa, Entamoeba histolytica
IRENPAAEKKEKKEHKKYPTSKKLTLEQR

SEQ ID NO: 2604514 - protein, 5 aa, Entamoeba histolytica
IRGRT

SEQ ID NO: 2604515 - protein, 7 aa, Entamoeba histolytica
IRHQQGY

SEQ ID NO: 2604516 - protein, 5 aa, Entamoeba histolytica
IRNDP

SEQ ID NO: 2604517 - protein, 15 aa, Entamoeba histolytica
IRPPPLNDPRDLRDP

SEQ ID NO: 2604518 - protein, 10 aa, Entamoeba histolytica
IRRSNQQKYH

SEQ ID NO: 2604519 - protein, 9 aa, Entamoeba histolytica
IRRYETNKV

SEQ ID NO: 2604520 - protein, 8 aa, Entamoeba histolytica
IRSFSPTS

SEQ ID NO: 2604521 - protein, 61 aa, Entamoeba histolytica
IRTRKGDKHKIGKKSEEHNKEEKENTGRSVDETIEEDEGKKKTRINEKKKEKNKRTNKENM

SEQ ID NO: 2604522 - protein, 13 aa, Entamoeba histolytica
ISAQENTKFADIQ

SEQ ID NO: 2604523 - protein, 9 aa, Entamoeba histolytica
ISDATGKIK

SEQ ID NO: 2604524 - protein, 4 aa, Entamoeba histolytica
ISDD

SEQ ID NO: 2604525 - protein, 4 aa, Entamoeba histolytica
ISDE

SEQ ID NO: 2604526 - protein, 4 aa, Entamoeba histolytica
ISDG

SEQ ID NO: 2604527 - protein, 6 aa, Entamoeba histolytica
ISDKNS

SEQ ID NO: 2604528 - protein, 9 aa, Entamoeba histolytica
ISDKRADYE

SEQ ID NO: 2604529 - protein, 12 aa, Entamoeba histolytica
ISDNHNNLDGTS

SEQ ID NO: 2604530 - protein, 37 aa, Entamoeba histolytica
ISDSDSDDDVKTDVKKTTTKKEELSDSDSDDDDDIAA

SEQ ID NO: 2604531 - protein, 4 aa, Entamoeba histolytica
ISEE

SEQ ID NO: 2604532 - protein, 27 aa, Entamoeba histolytica
ISEGNKTEEKEIPKETEEERVNREFEE

SEQ ID NO: 2604533 - protein, 19 aa, Entamoeba histolytica
ISEQNQIPKIQQQKKVEER

SEQ ID NO: 2604534 - protein, 12 aa, Entamoeba histolytica
ISEVGDKCDGLK

SEQ ID NO: 2604535 - protein, 19 aa, Entamoeba histolytica
ISGATVRSTVRRLRDAKNS

SEQ ID NO: 2604536 - protein, 5 aa, Entamoeba histolytica
ISGKE

SEQ ID NO: 2604537 - protein, 11 aa, Entamoeba histolytica
ISISQGSNPLI

SEQ ID NO: 2604538 - protein, 9 aa, Entamoeba histolytica
ISKNTTIKQ

SEQ ID NO: 2604539 - protein, 4 aa, Entamoeba histolytica
ISKS

SEQ ID NO: 2604540 - protein, 12 aa, Entamoeba histolytica
ISKSPQPKQEKK

SEQ ID NO: 2604541 - protein, 12 aa, Entamoeba histolytica
ISNDDESDEQLQ

SEQ ID NO: 2604542 - protein, 9 aa, Entamoeba histolytica
ISNETPSDV

SEQ ID NO: 2604543 - protein, 7 aa, Entamoeba histolytica
ISNNEIE

SEQ ID NO: 2604544 - protein, 9 aa, Entamoeba histolytica
ISNTGNKII

SEQ ID NO: 2604545 - protein, 12 aa, Entamoeba histolytica
ISPEEGEKLKNK

SEQ ID NO: 2604546 - protein, 5 aa, Entamoeba histolytica
ISPEI

SEQ ID NO: 2604547 - protein, 5 aa, Entamoeba histolytica
ISQPN

SEQ ID NO: 2604548 - protein, 10 aa, Entamoeba histolytica
ISSQTISGTT

SEQ ID NO: 2604549 - protein, 7 aa, Entamoeba histolytica
ISTGSYP

SEQ ID NO: 2604550 - protein, 4 aa, Entamoeba histolytica
ISTN

SEQ ID NO: 2604551 - protein, 12 aa, Entamoeba histolytica
ISTNIRDNNDSS

SEQ ID NO: 2604552 - protein, 10 aa, Entamoeba histolytica
ISTPRVRHQR

SEQ ID NO: 2604553 - protein, 22 aa, Entamoeba histolytica
ISTSEHKMNETKEQDKKYKKPV

SEQ ID NO: 2604554 - protein, 6 aa, Entamoeba histolytica
ISTSEP

SEQ ID NO: 2604555 - protein, 18 aa, Entamoeba histolytica
ISTSHDNDLKTNSNTNDF

SEQ ID NO: 2604556 - protein, 4 aa, Entamoeba histolytica
ISWS

SEQ ID NO: 2604557 - protein, 11 aa, Entamoeba histolytica
ITEDDDSINSF

SEQ ID NO: 2604558 - protein, 11 aa, Entamoeba histolytica
ITGEAEKTPVR

SEQ ID NO: 2604559 - protein, 10 aa, Entamoeba histolytica
ITGEAEKTQV

SEQ ID NO: 2604560 - protein, 10 aa, Entamoeba histolytica
ITGETESEFR

SEQ ID NO: 2604561 - protein, 18 aa, Entamoeba histolytica
ITGKDNNGKDLGHGGDDV

SEQ ID NO: 2604562 - protein, 11 aa, Entamoeba histolytica
ITGPDDSPYQG

SEQ ID NO: 2604563 - protein, 4 aa, Entamoeba histolytica
ITGT

SEQ ID NO: 2604564 - protein, 15 aa, Entamoeba histolytica
ITGTSPAPGFFKALL

SEQ ID NO: 2604565 - protein, 4 aa, Entamoeba histolytica
ITKQ

SEQ ID NO: 2604566 - protein, 6 aa, Entamoeba histolytica
ITLSDP

SEQ ID NO: 2604567 - protein, 8 aa, Entamoeba histolytica
ITNENEKR

SEQ ID NO: 2604568 - protein, 6 aa, Entamoeba histolytica
ITSQEY

SEQ ID NO: 2604569 - protein, 4 aa, Entamoeba histolytica
ITSR

SEQ ID NO: 2604570 - protein, 7 aa, Entamoeba histolytica
ITSSNYY

SEQ ID NO: 2604571 - protein, 4 aa, Entamoeba histolytica
ITTE

SEQ ID NO: 2604572 - protein, 15 aa, Entamoeba histolytica
IVKGQKKANNAPSKK

SEQ ID NO: 2604573 - protein, 6 aa, Entamoeba histolytica
IYPPGH

SEQ ID NO: 2604574 - protein, 6 aa, Entamoeba histolytica
KAAPNR

SEQ ID NO: 2604575 - protein, 9 aa, Entamoeba histolytica
KAAQARGDN

SEQ ID NO: 2604576 - protein, 12 aa, Entamoeba histolytica
KADRDESSPYAA

SEQ ID NO: 2604577 - protein, 14 aa, Entamoeba histolytica
KADSGKKKVRITKS

SEQ ID NO: 2604578 - protein, 9 aa, Entamoeba histolytica
KAEAKNTWQ

SEQ ID NO: 2604579 - protein, 4 aa, Entamoeba histolytica
KAEI

SEQ ID NO: 2604580 - protein, 8 aa, Entamoeba histolytica
KAFDNQEA

SEQ ID NO: 2604581 - protein, 7 aa, Entamoeba histolytica
KAGLESS

SEQ ID NO: 2604582 - protein, 11 aa, Entamoeba histolytica
KAGLISKNANI

SEQ ID NO: 2604583 - protein, 13 aa, Entamoeba histolytica
KAKAEELKKAIPK

SEQ ID NO: 2604584 - protein, 41 aa, Entamoeba histolytica
KAKEEEKLKQKMEEMNKPKAAEPIYKEQTNEELFDPLAGLD

SEQ ID NO: 2604585 - protein, 13 aa, Entamoeba histolytica
KAKKEKKKARFRD

SEQ ID NO: 2604586 - protein, 16 aa, Entamoeba histolytica
KAKTPNTTTISDDEWA

SEQ ID NO: 2604587 - protein, 14 aa, Entamoeba histolytica
KALDGNTTVNTSKC

SEQ ID NO: 2604588 - protein, 6 aa, Entamoeba histolytica
KANGEF

SEQ ID NO: 2604589 - protein, 6 aa, Entamoeba histolytica
KAQETF

SEQ ID NO: 2604590 - protein, 7 aa, Entamoeba histolytica
KAQKEQI

SEQ ID NO: 2604591 - protein, 7 aa, Entamoeba histolytica
KAQTPGV

SEQ ID NO: 2604592 - protein, 10 aa, Entamoeba histolytica
KARENQQSRA

SEQ ID NO: 2604593 - protein, 6 aa, Entamoeba histolytica
KARKEI

SEQ ID NO: 2604594 - protein, 11 aa, Entamoeba histolytica
KARNAEYNPKR

SEQ ID NO: 2604595 - protein, 29 aa, Entamoeba histolytica
KASDENEDEDNETQKQTTPSVPVQPEPKV

SEQ ID NO: 2604596 - protein, 10 aa, Entamoeba histolytica
KASSAASAAK

SEQ ID NO: 2604597 - protein, 10 aa, Entamoeba histolytica
KATEETRRNR

SEQ ID NO: 2604598 - protein, 8 aa, Entamoeba histolytica
KATENCTG

SEQ ID NO: 2604599 - protein, 9 aa, Entamoeba histolytica
KAVENSATA

SEQ ID NO: 2604600 - protein, 6 aa, Entamoeba histolytica
KAVKEC

SEQ ID NO: 2604601 - protein, 6 aa, Entamoeba histolytica
KAVQRG

SEQ ID NO: 2604602 - protein, 7 aa, Entamoeba histolytica
KAYSRQQ

SEQ ID NO: 2604603 - protein, 9 aa, Entamoeba histolytica
KCEEEDLDE

SEQ ID NO: 2604604 - protein, 5 aa, Entamoeba histolytica
KCGEA

SEQ ID NO: 2604605 - protein, 18 aa, Entamoeba histolytica
KCSKSDQSSNALKPKLED

SEQ ID NO: 2604606 - protein, 8 aa, Entamoeba histolytica
KCYDSEES

SEQ ID NO: 2604607 - protein, 13 aa, Entamoeba histolytica
KDAQQQIERSASH

SEQ ID NO: 2604608 - protein, 4 aa, Entamoeba histolytica
KDCE

SEQ ID NO: 2604609 - protein, 9 aa, Entamoeba histolytica
KDDITLEEA

SEQ ID NO: 2604610 - protein, 9 aa, Entamoeba histolytica
KDEERKATI

SEQ ID NO: 2604611 - protein, 6 aa, Entamoeba histolytica
KDEHTQ

SEQ ID NO: 2604612 - protein, 11 aa, Entamoeba histolytica
KDEKENTPEIN

SEQ ID NO: 2604613 - protein, 9 aa, Entamoeba histolytica
KDEKEPDRN

SEQ ID NO: 2604614 - protein, 7 aa, Entamoeba histolytica
KDETEEI

SEQ ID NO: 2604615 - protein, 8 aa, Entamoeba histolytica
KDFKPQQV

SEQ ID NO: 2604616 - protein, 7 aa, Entamoeba histolytica
KDGENIA

SEQ ID NO: 2604617 - protein, 7 aa, Entamoeba histolytica
KDGHSAS

SEQ ID NO: 2604618 - protein, 7 aa, Entamoeba histolytica
KDGTKNL

SEQ ID NO: 2604619 - protein, 9 aa, Entamoeba histolytica
KDHPPQDSS

SEQ ID NO: 2604620 - protein, 6 aa, Entamoeba histolytica
KDKKDL

SEQ ID NO: 2604621 - protein, 6 aa, Entamoeba histolytica
KDKPYE

SEQ ID NO: 2604622 - protein, 33 aa, Entamoeba histolytica
KDLENQRKEKKEEKIQKQKNKQKEGRKKQNIVN

SEQ ID NO: 2604623 - protein, 10 aa, Entamoeba histolytica
KDNEVRGAQY

SEQ ID NO: 2604624 - protein, 9 aa, Entamoeba histolytica
KDNGKNEPI

SEQ ID NO: 2604625 - protein, 6 aa, Entamoeba histolytica
KDNNTY

SEQ ID NO: 2604626 - protein, 15 aa, Entamoeba histolytica
KDNSVPQADTTKPSW

SEQ ID NO: 2604627 - protein, 4 aa, Entamoeba histolytica
KDNV

SEQ ID NO: 2604628 - protein, 4 aa, Entamoeba histolytica
KDPD

SEQ ID NO: 2604629 - protein, 9 aa, Entamoeba histolytica
KDPKNPKYN

SEQ ID NO: 2604630 - protein, 6 aa, Entamoeba histolytica
KDQDGF

SEQ ID NO: 2604631 - protein, 7 aa, Entamoeba histolytica
KDSMRGE

SEQ ID NO: 2604632 - protein, 6 aa, Entamoeba histolytica
KDSVYS

SEQ ID NO: 2604633 - protein, 7 aa, Entamoeba histolytica
KDTAAYS

SEQ ID NO: 2604634 - protein, 6 aa, Entamoeba histolytica
KDTLQE

SEQ ID NO: 2604635 - protein, 16 aa, Entamoeba histolytica
KDTMKTVKKEKDAEKM

SEQ ID NO: 2604636 - protein, 5 aa, Entamoeba histolytica
KDVND

SEQ ID NO: 2604637 - protein, 7 aa, Entamoeba histolytica
KDYPKSK

SEQ ID NO: 2604638 - protein, 6 aa, Entamoeba histolytica
KDYSEP

SEQ ID NO: 2604639 - protein, 6 aa, Entamoeba histolytica
KEAERI

SEQ ID NO: 2604640 - protein, 6 aa, Entamoeba histolytica
KEAGNM

SEQ ID NO: 2604641 - protein, 17 aa, Entamoeba histolytica
KEDASSNFAKGKTGYEP

SEQ ID NO: 2604642 - protein, 41 aa, Entamoeba histolytica
KEEAEIKKKTQKIQSIPSEQKEVIENKQKTSKVESIQEPKP

SEQ ID NO: 2604643 - protein, 7 aa, Entamoeba histolytica
KEEFNKE

SEQ ID NO: 2604644 - protein, 5 aa, Entamoeba histolytica
KEEGN

SEQ ID NO: 2604645 - protein, 7 aa, Entamoeba histolytica
KEEHDNV

SEQ ID NO: 2604646 - protein, 4 aa, Entamoeba histolytica
KEEK

SEQ ID NO: 2604647 - protein, 4 aa, Entamoeba histolytica
KEEL

SEQ ID NO: 2604648 - protein, 10 aa, Entamoeba histolytica
KEFEEETKKI

SEQ ID NO: 2604649 - protein, 7 aa, Entamoeba histolytica
KEGEEAR

SEQ ID NO: 2604650 - protein, 13 aa, Entamoeba histolytica
KEGEKIKNTGKKQ

SEQ ID NO: 2604651 - protein, 9 aa, Entamoeba histolytica
KEGKELKQG

SEQ ID NO: 2604652 - protein, 5 aa, Entamoeba histolytica
KEGQP

SEQ ID NO: 2604653 - protein, 6 aa, Entamoeba histolytica
KEGYFN

SEQ ID NO: 2604654 - protein, 16 aa, Entamoeba histolytica
KEIAKFKEEQENLQKE

SEQ ID NO: 2604655 - protein, 4 aa, Entamoeba histolytica
KEIE

SEQ ID NO: 2604656 - protein, 6 aa, Entamoeba histolytica
KEIGNK

SEQ ID NO: 2604657 - protein, 4 aa, Entamoeba histolytica
KEIK

SEQ ID NO: 2604658 - protein, 36 aa, Entamoeba histolytica
KEIKRTDNPIKQEPDKEINKPNEHPQVKPKVNKKSN

SEQ ID NO: 2604659 - protein, 7 aa, Entamoeba histolytica
KEKAVTL

SEQ ID NO: 2604660 - protein, 4 aa, Entamoeba histolytica
KEKG

SEQ ID NO: 2604661 - protein, 16 aa, Entamoeba histolytica
KEKIKEKLSIKTDDVE

SEQ ID NO: 2604662 - protein, 8 aa, Entamoeba histolytica
KEKKQTQI

SEQ ID NO: 2604663 - protein, 6 aa, Entamoeba histolytica
KEKKRD

SEQ ID NO: 2604664 - protein, 5 aa, Entamoeba histolytica
KEKQC

SEQ ID NO: 2604665 - protein, 9 aa, Entamoeba histolytica
KEKQENENY

SEQ ID NO: 2604666 - protein, 7 aa, Entamoeba histolytica
KEKQNTL

SEQ ID NO: 2604667 - protein, 6 aa, Entamoeba histolytica
KEKSPF

SEQ ID NO: 2604668 - protein, 7 aa, Entamoeba histolytica
KEKSSYD

SEQ ID NO: 2604669 - protein, 10 aa, Entamoeba histolytica
KELEEQKQQM

SEQ ID NO: 2604670 - protein, 11 aa, Entamoeba histolytica
KELEKNKKLSK

SEQ ID NO: 2604671 - protein, 6 aa, Entamoeba histolytica
KELKDR

SEQ ID NO: 2604672 - protein, 8 aa, Entamoeba histolytica
KELPENQA

SEQ ID NO: 2604673 - protein, 5 aa, Entamoeba histolytica
KELRE

SEQ ID NO: 2604674 - protein, 4 aa, Entamoeba histolytica
KEMK

SEQ ID NO: 2604675 - protein, 5 aa, Entamoeba histolytica
KEMKE

SEQ ID NO: 2604676 - protein, 10 aa, Entamoeba histolytica
KEMNKEGKKR

SEQ ID NO: 2604677 - protein, 5 aa, Entamoeba histolytica
KENEH

SEQ ID NO: 2604678 - protein, 8 aa, Entamoeba histolytica
KENESKRS

SEQ ID NO: 2604679 - protein, 6 aa, Entamoeba histolytica
KENIGS

SEQ ID NO: 2604680 - protein, 12 aa, Entamoeba histolytica
KENKEQLDDAQT

SEQ ID NO: 2604681 - protein, 5 aa, Entamoeba histolytica
KENKV

SEQ ID NO: 2604682 - protein, 6 aa, Entamoeba histolytica
KENPGK

SEQ ID NO: 2604683 - protein, 4 aa, Entamoeba histolytica
KENQ

SEQ ID NO: 2604684 - protein, 5 aa, Entamoeba histolytica
KENQK

SEQ ID NO: 2604685 - protein, 5 aa, Entamoeba histolytica
KENRS

SEQ ID NO: 2604686 - protein, 6 aa, Entamoeba histolytica
KENTLD

SEQ ID NO: 2604687 - protein, 10 aa, Entamoeba histolytica
KEPKPSYESL

SEQ ID NO: 2604688 - protein, 21 aa, Entamoeba histolytica
KEQEEGQEKEEKEEEKYEPSR

SEQ ID NO: 2604689 - protein, 7 aa, Entamoeba histolytica
KEQERLK

SEQ ID NO: 2604690 - protein, 6 aa, Entamoeba histolytica
KEQGEC

SEQ ID NO: 2604691 - protein, 10 aa, Entamoeba histolytica
KEQGGSLEDS

SEQ ID NO: 2604692 - protein, 15 aa, Entamoeba histolytica
KEQQQMKEQQEQEKL

SEQ ID NO: 2604693 - protein, 4 aa, Entamoeba histolytica
KERK

SEQ ID NO: 2604694 - protein, 5 aa, Entamoeba histolytica
KERKK

SEQ ID NO: 2604695 - protein, 12 aa, Entamoeba histolytica
KERKYKKKRWDS

SEQ ID NO: 2604696 - protein, 8 aa, Entamoeba histolytica
KESENQIK

SEQ ID NO: 2604697 - protein, 4 aa, Entamoeba histolytica
KESF

SEQ ID NO: 2604698 - protein, 6 aa, Entamoeba histolytica
KESIGK

SEQ ID NO: 2604699 - protein, 12 aa, Entamoeba histolytica
KESKNEGGKRYN

SEQ ID NO: 2604700 - protein, 7 aa, Entamoeba histolytica
KESSKTH

SEQ ID NO: 2604701 - protein, 4 aa, Entamoeba histolytica
KETG

SEQ ID NO: 2604702 - protein, 4 aa, Entamoeba histolytica
KETI

SEQ ID NO: 2604703 - protein, 5 aa, Entamoeba histolytica
KETNI

SEQ ID NO: 2604704 - protein, 9 aa, Entamoeba histolytica
KETNPHTTN

SEQ ID NO: 2604705 - protein, 21 aa, Entamoeba histolytica
KETNPSITNPSVHTKQNTIIV

SEQ ID NO: 2604706 - protein, 8 aa, Entamoeba histolytica
KETSNYHE

SEQ ID NO: 2604707 - protein, 8 aa, Entamoeba histolytica
KEVDEKKA

SEQ ID NO: 2604708 - protein, 15 aa, Entamoeba histolytica
KEVESLEKRSLEDAH

SEQ ID NO: 2604709 - protein, 5 aa, Entamoeba histolytica
KEVNE

SEQ ID NO: 2604710 - protein, 9 aa, Entamoeba histolytica
KEVPDSISK

SEQ ID NO: 2604711 - protein, 11 aa, Entamoeba histolytica
KEVTGKSDFVG

SEQ ID NO: 2604712 - protein, 4 aa, Entamoeba histolytica
KEYE

SEQ ID NO: 2604713 - protein, 5 aa, Entamoeba histolytica
KEYGS

SEQ ID NO: 2604714 - protein, 15 aa, Entamoeba histolytica
KEYNEGKEVKLEGEN

SEQ ID NO: 2604715 - protein, 7 aa, Entamoeba histolytica
KEYPHKP

SEQ ID NO: 2604716 - protein, 16 aa, Entamoeba histolytica
KFDKKKGKQNYKKKVR

SEQ ID NO: 2604717 - protein, 6 aa, Entamoeba histolytica
KFKETG

SEQ ID NO: 2604718 - protein, 5 aa, Entamoeba histolytica
KFNEH

SEQ ID NO: 2604719 - protein, 10 aa, Entamoeba histolytica
KFPVGTEGRY

SEQ ID NO: 2604720 - protein, 11 aa, Entamoeba histolytica
KFSSDRSMKEY

SEQ ID NO: 2604721 - protein, 5 aa, Entamoeba histolytica
KFSSN

SEQ ID NO: 2604722 - protein, 5 aa, Entamoeba histolytica
KFTPE

SEQ ID NO: 2604723 - protein, 9 aa, Entamoeba histolytica
KFTSNSETY

SEQ ID NO: 2604724 - protein, 8 aa, Entamoeba histolytica
KGAEKELS

SEQ ID NO: 2604725 - protein, 9 aa, Entamoeba histolytica
KGAHPEDAI

SEQ ID NO: 2604726 - protein, 8 aa, Entamoeba histolytica
KGAKEELS

SEQ ID NO: 2604727 - protein, 8 aa, Entamoeba histolytica
KGAREYAN

SEQ ID NO: 2604728 - protein, 4 aa, Entamoeba histolytica
KGAY

SEQ ID NO: 2604729 - protein, 13 aa, Entamoeba histolytica
KGDDDLDDINIDD

SEQ ID NO: 2604730 - protein, 8 aa, Entamoeba histolytica
KGDEEIKV

SEQ ID NO: 2604731 - protein, 8 aa, Entamoeba histolytica
KGEERPVD

SEQ ID NO: 2604732 - protein, 12 aa, Entamoeba histolytica
KGEGQKTNEEGM

SEQ ID NO: 2604733 - protein, 7 aa, Entamoeba histolytica
KGEMGIS

SEQ ID NO: 2604734 - protein, 17 aa, Entamoeba histolytica
KGEMKEGKEGEKNIRQT

SEQ ID NO: 2604735 - protein, 18 aa, Entamoeba histolytica
KGENLGNGESRNEGENEW

SEQ ID NO: 2604736 - protein, 7 aa, Entamoeba histolytica
KGGSVRL

SEQ ID NO: 2604737 - protein, 10 aa, Entamoeba histolytica
KGIDQPSLDK

SEQ ID NO: 2604738 - protein, 5 aa, Entamoeba histolytica
KGIEE

SEQ ID NO: 2604739 - protein, 4 aa, Entamoeba histolytica
KGIQ

SEQ ID NO: 2604740 - protein, 11 aa, Entamoeba histolytica
KGISEGIENRN

SEQ ID NO: 2604741 - protein, 15 aa, Entamoeba histolytica
KGKPLSQVAEEKGQM

SEQ ID NO: 2604742 - protein, 6 aa, Entamoeba histolytica
KGKYDM

SEQ ID NO: 2604743 - protein, 7 aa, Entamoeba histolytica
KGLNSLT

SEQ ID NO: 2604744 - protein, 4 aa, Entamoeba histolytica
KGLP

SEQ ID NO: 2604745 - protein, 6 aa, Entamoeba histolytica
KGLPTT

SEQ ID NO: 2604746 - protein, 12 aa, Entamoeba histolytica
KGNEEYTTKATP

SEQ ID NO: 2604747 - protein, 8 aa, Entamoeba histolytica
KGNKIRSN

SEQ ID NO: 2604748 - protein, 6 aa, Entamoeba histolytica
KGPKYS

SEQ ID NO: 2604749 - protein, 13 aa, Entamoeba histolytica
KGREIEEKEIEGK

SEQ ID NO: 2604750 - protein, 13 aa, Entamoeba histolytica
KGRKINDVTTDFK

SEQ ID NO: 2604751 - protein, 8 aa, Entamoeba histolytica
KGRQTRPE

SEQ ID NO: 2604752 - protein, 42 aa, Entamoeba histolytica
KGRTEESFKPKRLGGTIERRCSEDKRRNESPMRRERGYSPFE

SEQ ID NO: 2604753 - protein, 6 aa, Entamoeba histolytica
KGRTVI

SEQ ID NO: 2604754 - protein, 7 aa, Entamoeba histolytica
KGRYGEH

SEQ ID NO: 2604755 - protein, 5 aa, Entamoeba histolytica
KGSAN

SEQ ID NO: 2604756 - protein, 6 aa, Entamoeba histolytica
KGSDSH

SEQ ID NO: 2604757 - protein, 15 aa, Entamoeba histolytica
KGSGNNKTMKDGTKK

SEQ ID NO: 2604758 - protein, 6 aa, Entamoeba histolytica
KGSNEV

SEQ ID NO: 2604759 - protein, 10 aa, Entamoeba histolytica
KGTEDKKGIR

SEQ ID NO: 2604760 - protein, 6 aa, Entamoeba histolytica
KGTKAD

SEQ ID NO: 2604761 - protein, 6 aa, Entamoeba histolytica
KHAEGG

SEQ ID NO: 2604762 - protein, 24 aa, Entamoeba histolytica
KHAVSEGQSAVKRASGKGSTSGSQ

SEQ ID NO: 2604763 - protein, 6 aa, Entamoeba histolytica
KHCQSS

SEQ ID NO: 2604764 - protein, 7 aa, Entamoeba histolytica
KHDDYTR

SEQ ID NO: 2604765 - protein, 10 aa, Entamoeba histolytica
KHSDVEDHAR

SEQ ID NO: 2604766 - protein, 5 aa, Entamoeba histolytica
KIDEE

SEQ ID NO: 2604767 - protein, 5 aa, Entamoeba histolytica
KIDNT

SEQ ID NO: 2604768 - protein, 4 aa, Entamoeba histolytica
KIEE

SEQ ID NO: 2604769 - protein, 4 aa, Entamoeba histolytica
KIEG

SEQ ID NO: 2604770 - protein, 7 aa, Entamoeba histolytica
KIETTSE

SEQ ID NO: 2604771 - protein, 12 aa, Entamoeba histolytica
KIGEIGSKREVD

SEQ ID NO: 2604772 - protein, 13 aa, Entamoeba histolytica
KIHDGKSEKNAVD

SEQ ID NO: 2604773 - protein, 7 aa, Entamoeba histolytica
KIHQNRG

SEQ ID NO: 2604774 - protein, 20 aa, Entamoeba histolytica
KIKKSKKVDDSSSFQPPPIN

SEQ ID NO: 2604775 - protein, 8 aa, Entamoeba histolytica
KINGRPVQ

SEQ ID NO: 2604776 - protein, 4 aa, Entamoeba histolytica
KIPK

SEQ ID NO: 2604777 - protein, 9 aa, Entamoeba histolytica
KIPSNSSFE

SEQ ID NO: 2604778 - protein, 10 aa, Entamoeba histolytica
KIPTDDEQSL

SEQ ID NO: 2604779 - protein, 5 aa, Entamoeba histolytica
KIQGE

SEQ ID NO: 2604780 - protein, 7 aa, Entamoeba histolytica
KIQPTVD

SEQ ID NO: 2604781 - protein, 9 aa, Entamoeba histolytica
KIRESHKKV

SEQ ID NO: 2604782 - protein, 4 aa, Entamoeba histolytica
KIRP

SEQ ID NO: 2604783 - protein, 7 aa, Entamoeba histolytica
KITSSNE

SEQ ID NO: 2604784 - protein, 8 aa, Entamoeba histolytica
KKAKKAGF

SEQ ID NO: 2604785 - protein, 5 aa, Entamoeba histolytica
KKANE

SEQ ID NO: 2604786 - protein, 6 aa, Entamoeba histolytica
KKARNI

SEQ ID NO: 2604787 - protein, 9 aa, Entamoeba histolytica
KKARWRKSL

SEQ ID NO: 2604788 - protein, 21 aa, Entamoeba histolytica
KKATKMKDTSLDDCQSSKTVK

SEQ ID NO: 2604789 - protein, 7 aa, Entamoeba histolytica
KKDCEKI

SEQ ID NO: 2604790 - protein, 43 aa, Entamoeba histolytica
KKDDDDLSMSSNSNQVSSVNSSTINARDGNSMSISSNAPPPLV

SEQ ID NO: 2604791 - protein, 8 aa, Entamoeba histolytica
KKDGQYKI

SEQ ID NO: 2604792 - protein, 12 aa, Entamoeba histolytica
KKDGTKIPEGTK

SEQ ID NO: 2604793 - protein, 9 aa, Entamoeba histolytica
KKDQEEGEV

SEQ ID NO: 2604794 - protein, 9 aa, Entamoeba histolytica
KKDSETEQN

SEQ ID NO: 2604795 - protein, 7 aa, Entamoeba histolytica
KKEDVNT

SEQ ID NO: 2604796 - protein, 10 aa, Entamoeba histolytica
KKEGKGPAIT

SEQ ID NO: 2604797 - protein, 8 aa, Entamoeba histolytica
KKEGPKEN

SEQ ID NO: 2604798 - protein, 5 aa, Entamoeba histolytica
KKEIK

SEQ ID NO: 2604799 - protein, 18 aa, Entamoeba histolytica
KKEKDNAEVRIDDPTQYQ

SEQ ID NO: 2604800 - protein, 9 aa, Entamoeba histolytica
KKEKEREHQ

SEQ ID NO: 2604801 - protein, 4 aa, Entamoeba histolytica
KKEL

SEQ ID NO: 2604802 - protein, 12 aa, Entamoeba histolytica
KKENEKISTRNQ

SEQ ID NO: 2604803 - protein, 7 aa, Entamoeba histolytica
KKEQKSK

SEQ ID NO: 2604804 - protein, 8 aa, Entamoeba histolytica
KKESAGVK

SEQ ID NO: 2604805 - protein, 7 aa, Entamoeba histolytica
KKESTLN

SEQ ID NO: 2604806 - protein, 12 aa, Entamoeba histolytica
KKEVQENEKKNN

SEQ ID NO: 2604807 - protein, 8 aa, Entamoeba histolytica
KKFSDKSI

SEQ ID NO: 2604808 - protein, 8 aa, Entamoeba histolytica
KKGDRNEL

SEQ ID NO: 2604809 - protein, 9 aa, Entamoeba histolytica
KKGIAPSQI

SEQ ID NO: 2604810 - protein, 12 aa, Entamoeba histolytica
KKGKQTSKAALS

SEQ ID NO: 2604811 - protein, 7 aa, Entamoeba histolytica
KKHTEAL

SEQ ID NO: 2604812 - protein, 7 aa, Entamoeba histolytica
KKHTTGK

SEQ ID NO: 2604813 - protein, 73 aa, Entamoeba histolytica
KKIEQTKKELASKPKGVSVSGTSSLAPPPPPPGATSVPPPPPPPGASSIPPPPPPPGASSVPPPPPPPGMPGM

SEQ ID NO: 2604814 - protein, 20 aa, Entamoeba histolytica
KKIKEEARKASKIEEGITQN

SEQ ID NO: 2604815 - protein, 13 aa, Entamoeba histolytica
KKINSEDIPDGID

SEQ ID NO: 2604816 - protein, 7 aa, Entamoeba histolytica
KKIQSDI

SEQ ID NO: 2604817 - protein, 18 aa, Entamoeba histolytica
KKITPITTEQGEAKCKDI

SEQ ID NO: 2604818 - protein, 6 aa, Entamoeba histolytica
KKITQE

SEQ ID NO: 2604819 - protein, 8 aa, Entamoeba histolytica
KKITQGTR

SEQ ID NO: 2604820 - protein, 8 aa, Entamoeba histolytica
KKKDRNNK

SEQ ID NO: 2604821 - protein, 7 aa, Entamoeba histolytica
KKKEDVI

SEQ ID NO: 2604822 - protein, 5 aa, Entamoeba histolytica
KKKEE

SEQ ID NO: 2604823 - protein, 13 aa, Entamoeba histolytica
KKKEEETKPKKES

SEQ ID NO: 2604824 - protein, 27 aa, Entamoeba histolytica
KKKELNRKKHAKKERKTKKEKEENGNE

SEQ ID NO: 2604825 - protein, 11 aa, Entamoeba histolytica
KKKGKSMKEED

SEQ ID NO: 2604826 - protein, 7 aa, Entamoeba histolytica
KKKPNNI

SEQ ID NO: 2604827 - protein, 8 aa, Entamoeba histolytica
KKKPYCTH

SEQ ID NO: 2604828 - protein, 5 aa, Entamoeba histolytica
KKKSK

SEQ ID NO: 2604829 - protein, 7 aa, Entamoeba histolytica
KKKSLEH

SEQ ID NO: 2604830 - protein, 4 aa, Entamoeba histolytica
KKLE

SEQ ID NO: 2604831 - protein, 12 aa, Entamoeba histolytica
KKLEMKGPNETS

SEQ ID NO: 2604832 - protein, 9 aa, Entamoeba histolytica
KKMEEEKSK

SEQ ID NO: 2604833 - protein, 7 aa, Entamoeba histolytica
KKNDEIE

SEQ ID NO: 2604834 - protein, 8 aa, Entamoeba histolytica
KKNEEKVS

SEQ ID NO: 2604835 - protein, 5 aa, Entamoeba histolytica
KKNGG

SEQ ID NO: 2604836 - protein, 6 aa, Entamoeba histolytica
KKNGYN

SEQ ID NO: 2604837 - protein, 6 aa, Entamoeba histolytica
KKNQEV

SEQ ID NO: 2604838 - protein, 11 aa, Entamoeba histolytica
KKNSEKDPTYK

SEQ ID NO: 2604839 - protein, 5 aa, Entamoeba histolytica
KKPEL

SEQ ID NO: 2604840 - protein, 14 aa, Entamoeba histolytica
KKPGILTHSGGNPV

SEQ ID NO: 2604841 - protein, 6 aa, Entamoeba histolytica
KKPKMR

SEQ ID NO: 2604842 - protein, 7 aa, Entamoeba histolytica
KKPLTKN

SEQ ID NO: 2604843 - protein, 5 aa, Entamoeba histolytica
KKPNY

SEQ ID NO: 2604844 - protein, 8 aa, Entamoeba histolytica
KKPQTQKQ

SEQ ID NO: 2604845 - protein, 17 aa, Entamoeba histolytica
KKQFEDTAREWTRMYAR

SEQ ID NO: 2604846 - protein, 8 aa, Entamoeba histolytica
KKQRHERT

SEQ ID NO: 2604847 - protein, 8 aa, Entamoeba histolytica
KKQTIQTK

SEQ ID NO: 2604848 - protein, 10 aa, Entamoeba histolytica
KKRDQTLNNA

SEQ ID NO: 2604849 - protein, 7 aa, Entamoeba histolytica
KKRIDSK

SEQ ID NO: 2604850 - protein, 56 aa, Entamoeba histolytica
KKRNAAIKEIKEKKAENAAKKEAARKEAKANGKKATNTYKKSNAKLPKAGHANFNS

SEQ ID NO: 2604851 - protein, 5 aa, Entamoeba histolytica
KKRVA

SEQ ID NO: 2604852 - protein, 13 aa, Entamoeba histolytica
KKSFSGNSSYSPI

SEQ ID NO: 2604853 - protein, 12 aa, Entamoeba histolytica
KKSGKVFGGEEN

SEQ ID NO: 2604854 - protein, 11 aa, Entamoeba histolytica
KKSNSSCFKPS

SEQ ID NO: 2604855 - protein, 8 aa, Entamoeba histolytica
KKSSIPEA

SEQ ID NO: 2604856 - protein, 8 aa, Entamoeba histolytica
KKSTNEEV

SEQ ID NO: 2604857 - protein, 7 aa, Entamoeba histolytica
KKTDESI

SEQ ID NO: 2604858 - protein, 19 aa, Entamoeba histolytica
KKTEMRKQKNGGNHKKGGK

SEQ ID NO: 2604859 - protein, 9 aa, Entamoeba histolytica
KKTNEGLQS

SEQ ID NO: 2604860 - protein, 7 aa, Entamoeba histolytica
KKTNSRL

SEQ ID NO: 2604861 - protein, 4 aa, Entamoeba histolytica
KKTS

SEQ ID NO: 2604862 - protein, 4 aa, Entamoeba histolytica
KKYE

SEQ ID NO: 2604863 - protein, 11 aa, Entamoeba histolytica
KKYSSGLSKEQ

SEQ ID NO: 2604864 - protein, 9 aa, Entamoeba histolytica
KLDEEEKKI

SEQ ID NO: 2604865 - protein, 7 aa, Entamoeba histolytica
KLDNTEI

SEQ ID NO: 2604866 - protein, 5 aa, Entamoeba histolytica
KLDNY

SEQ ID NO: 2604867 - protein, 5 aa, Entamoeba histolytica
KLECN

SEQ ID NO: 2604868 - protein, 8 aa, Entamoeba histolytica
KLEEENMK

SEQ ID NO: 2604869 - protein, 5 aa, Entamoeba histolytica
KLESL

SEQ ID NO: 2604870 - protein, 13 aa, Entamoeba histolytica
KLGDNSSANKAAL

SEQ ID NO: 2604871 - protein, 9 aa, Entamoeba histolytica
KLKEKKKGI

SEQ ID NO: 2604872 - protein, 7 aa, Entamoeba histolytica
KLKNSVK

SEQ ID NO: 2604873 - protein, 23 aa, Entamoeba histolytica
KLKQQPKESEQVNVGKSQPIQQS

SEQ ID NO: 2604874 - protein, 5 aa, Entamoeba histolytica
KLMEE

SEQ ID NO: 2604875 - protein, 5 aa, Entamoeba histolytica
KLNSK

SEQ ID NO: 2604876 - protein, 7 aa, Entamoeba histolytica
KLNSKNV

SEQ ID NO: 2604877 - protein, 8 aa, Entamoeba histolytica
KLPDEEYD

SEQ ID NO: 2604878 - protein, 5 aa, Entamoeba histolytica
KLQQQ

SEQ ID NO: 2604879 - protein, 12 aa, Entamoeba histolytica
KLSEQLKQDEDV

SEQ ID NO: 2604880 - protein, 12 aa, Entamoeba histolytica
KLVSQDDHKNTY

SEQ ID NO: 2604881 - protein, 13 aa, Entamoeba histolytica
KMDANGGGDTPES

SEQ ID NO: 2604882 - protein, 23 aa, Entamoeba histolytica
KMEEEGSCNDSYNEMDQKQKYSY

SEQ ID NO: 2604883 - protein, 13 aa, Entamoeba histolytica
KNAEAKTKKAAEI

SEQ ID NO: 2604884 - protein, 8 aa, Entamoeba histolytica
KNAQLSAK

SEQ ID NO: 2604885 - protein, 6 aa, Entamoeba histolytica
KNDEIK

SEQ ID NO: 2604886 - protein, 13 aa, Entamoeba histolytica
KNDLPQPSVTQQE

SEQ ID NO: 2604887 - protein, 7 aa, Entamoeba histolytica
KNDPTKC

SEQ ID NO: 2604888 - protein, 4 aa, Entamoeba histolytica
KNED

SEQ ID NO: 2604889 - protein, 5 aa, Entamoeba histolytica
KNEDL

SEQ ID NO: 2604890 - protein, 9 aa, Entamoeba histolytica
KNEENKREE

SEQ ID NO: 2604891 - protein, 6 aa, Entamoeba histolytica
KNEHGN

SEQ ID NO: 2604892 - protein, 7 aa, Entamoeba histolytica
KNELPNE

SEQ ID NO: 2604893 - protein, 15 aa, Entamoeba histolytica
KNERFENVPQDESAV

SEQ ID NO: 2604894 - protein, 15 aa, Entamoeba histolytica
KNESPLSLAKEKGSM

SEQ ID NO: 2604895 - protein, 7 aa, Entamoeba histolytica
KNGTVVD

SEQ ID NO: 2604896 - protein, 7 aa, Entamoeba histolytica
KNIEKKD

SEQ ID NO: 2604897 - protein, 16 aa, Entamoeba histolytica
KNIKEELKEMNNKSIE

SEQ ID NO: 2604898 - protein, 4 aa, Entamoeba histolytica
KNIP

SEQ ID NO: 2604899 - protein, 13 aa, Entamoeba histolytica
KNKKTLQIKSKGK

SEQ ID NO: 2604900 - protein, 8 aa, Entamoeba histolytica
KNKTPEEV

SEQ ID NO: 2604901 - protein, 5 aa, Entamoeba histolytica
KNNHS

SEQ ID NO: 2604902 - protein, 4 aa, Entamoeba histolytica
KNNI

SEQ ID NO: 2604903 - protein, 5 aa, Entamoeba histolytica
KNNQT

SEQ ID NO: 2604904 - protein, 27 aa, Entamoeba histolytica
KNPAIRYQQNSELSKRIAEGLTQGLER

SEQ ID NO: 2604905 - protein, 5 aa, Entamoeba histolytica
KNPEI

SEQ ID NO: 2604906 - protein, 8 aa, Entamoeba histolytica
KNPENTAE

SEQ ID NO: 2604907 - protein, 6 aa, Entamoeba histolytica
KNPKYS

SEQ ID NO: 2604908 - protein, 9 aa, Entamoeba histolytica
KNPTFSQKG

SEQ ID NO: 2604909 - protein, 9 aa, Entamoeba histolytica
KNPTRRLTD

SEQ ID NO: 2604910 - protein, 6 aa, Entamoeba histolytica
KNQFET

SEQ ID NO: 2604911 - protein, 5 aa, Entamoeba histolytica
KNQKL

SEQ ID NO: 2604912 - protein, 7 aa, Entamoeba histolytica
KNRKEYD

SEQ ID NO: 2604913 - protein, 5 aa, Entamoeba histolytica
KNRRR

SEQ ID NO: 2604914 - protein, 8 aa, Entamoeba histolytica
KNTPPYLP

SEQ ID NO: 2604915 - protein, 7 aa, Entamoeba histolytica
KNVGDIN

SEQ ID NO: 2604916 - protein, 23 aa, Entamoeba histolytica
KPAGGPKIPQQRMQGPMDQNDAG

SEQ ID NO: 2604917 - protein, 6 aa, Entamoeba histolytica
KPAVPY

SEQ ID NO: 2604918 - protein, 5 aa, Entamoeba histolytica
KPDNL

SEQ ID NO: 2604919 - protein, 5 aa, Entamoeba histolytica
KPEEI

SEQ ID NO: 2604920 - protein, 8 aa, Entamoeba histolytica
KPEEPLPS

SEQ ID NO: 2604921 - protein, 7 aa, Entamoeba histolytica
KPENQVL

SEQ ID NO: 2604922 - protein, 6 aa, Entamoeba histolytica
KPGFDA

SEQ ID NO: 2604923 - protein, 8 aa, Entamoeba histolytica
KPIRIPSK

SEQ ID NO: 2604924 - protein, 9 aa, Entamoeba histolytica
KPKINATNL

SEQ ID NO: 2604925 - protein, 4 aa, Entamoeba histolytica
KPKN

SEQ ID NO: 2604926 - protein, 6 aa, Entamoeba histolytica
KPLLTP

SEQ ID NO: 2604927 - protein, 6 aa, Entamoeba histolytica
KPMSSQ

SEQ ID NO: 2604928 - protein, 7 aa, Entamoeba histolytica
KPNDISS

SEQ ID NO: 2604929 - protein, 4 aa, Entamoeba histolytica
KPNE

SEQ ID NO: 2604930 - protein, 13 aa, Entamoeba histolytica
KPNLGQYKNPPSW

SEQ ID NO: 2604931 - protein, 5 aa, Entamoeba histolytica
KPQQF

SEQ ID NO: 2604932 - protein, 6 aa, Entamoeba histolytica
KPSAED

SEQ ID NO: 2604933 - protein, 6 aa, Entamoeba histolytica
KPSHGK

SEQ ID NO: 2604934 - protein, 6 aa, Entamoeba histolytica
KPTLRA

SEQ ID NO: 2604935 - protein, 8 aa, Entamoeba histolytica
KPTSNDQA

SEQ ID NO: 2604936 - protein, 7 aa, Entamoeba histolytica
KPTVVGE

SEQ ID NO: 2604937 - protein, 9 aa, Entamoeba histolytica
KPVGDGRIK

SEQ ID NO: 2604938 - protein, 6 aa, Entamoeba histolytica
KPVPRS

SEQ ID NO: 2604939 - protein, 26 aa, Entamoeba histolytica
KPVQSQPGQQQNPVQQQQNTQPQKDV

SEQ ID NO: 2604940 - protein, 12 aa, Entamoeba histolytica
KPYDGEHKIKGE

SEQ ID NO: 2604941 - protein, 4 aa, Entamoeba histolytica
KQAN

SEQ ID NO: 2604942 - protein, 8 aa, Entamoeba histolytica
KQAYRAHP

SEQ ID NO: 2604943 - protein, 6 aa, Entamoeba histolytica
KQDEKI

SEQ ID NO: 2604944 - protein, 7 aa, Entamoeba histolytica
KQDKDLE

SEQ ID NO: 2604945 - protein, 6 aa, Entamoeba histolytica
KQDPDV

SEQ ID NO: 2604946 - protein, 8 aa, Entamoeba histolytica
KQGAGKTT

SEQ ID NO: 2604947 - protein, 11 aa, Entamoeba histolytica
KQGEKHPESGA

SEQ ID NO: 2604948 - protein, 6 aa, Entamoeba histolytica
KQGKIG

SEQ ID NO: 2604949 - protein, 8 aa, Entamoeba histolytica
KQGKSNEI

SEQ ID NO: 2604950 - protein, 10 aa, Entamoeba histolytica
KQIAQSLEQT

SEQ ID NO: 2604951 - protein, 6 aa, Entamoeba histolytica
KQIEQE

SEQ ID NO: 2604952 - protein, 10 aa, Entamoeba histolytica
KQKAIAEAKE

SEQ ID NO: 2604953 - protein, 17 aa, Entamoeba histolytica
KQKKESNEEVKENITET

SEQ ID NO: 2604954 - protein, 18 aa, Entamoeba histolytica
KQKPIWTRNPSEITKEEY

SEQ ID NO: 2604955 - protein, 39 aa, Entamoeba histolytica; identical to SEQ ID NO: 2408961

SEQ ID NO: 2604956 - protein, 9 aa, Entamoeba histolytica
KQLESKKSI

SEQ ID NO: 2604957 - protein, 12 aa, Entamoeba histolytica
KQLETKEEQKQL

SEQ ID NO: 2604958 - protein, 16 aa, Entamoeba histolytica
KQLNTPAPVTSPSQFN

SEQ ID NO: 2604959 - protein, 5 aa, Entamoeba histolytica
KQNDL

SEQ ID NO: 2604960 - protein, 24 aa, Entamoeba histolytica
KQNKAGSKKAASKGKKVNSKKTGK

SEQ ID NO: 2604961 - protein, 13 aa, Entamoeba histolytica
KQPHTPRSNGISP

SEQ ID NO: 2604962 - protein, 9 aa, Entamoeba histolytica
KQPYTSKTD

SEQ ID NO: 2604963 - protein, 4 aa, Entamoeba histolytica
KQQN

SEQ ID NO: 2604964 - protein, 22 aa, Entamoeba histolytica
KQQPKKQLEQPKAQTKRMTGRK

SEQ ID NO: 2604965 - protein, 8 aa, Entamoeba histolytica
KQQQIEQQ

SEQ ID NO: 2604966 - protein, 9 aa, Entamoeba histolytica
KQQRAERKL

SEQ ID NO: 2604967 - protein, 6 aa, Entamoeba histolytica
KQQTMQ

SEQ ID NO: 2604968 - protein, 7 aa, Entamoeba histolytica
KQRNKEL

SEQ ID NO: 2604969 - protein, 4 aa, Entamoeba histolytica
KQSE

SEQ ID NO: 2604970 - protein, 4 aa, Entamoeba histolytica
KQSI

SEQ ID NO: 2604971 - protein, 9 aa, Entamoeba histolytica
KQSKNGTKA

SEQ ID NO: 2604972 - protein, 8 aa, Entamoeba histolytica
KQSTKTKE

SEQ ID NO: 2604973 - protein, 6 aa, Entamoeba histolytica
KQTEYD

SEQ ID NO: 2604974 - protein, 4 aa, Entamoeba histolytica
KQTT

SEQ ID NO: 2604975 - protein, 11 aa, Entamoeba histolytica
KQTTTQQQKDE

SEQ ID NO: 2604976 - protein, 24 aa, Entamoeba histolytica
KQVSPQPSIQPTNPPQQQPSQQLQ

SEQ ID NO: 2604977 - protein, 6 aa, Entamoeba histolytica
KQYGEH

SEQ ID NO: 2604978 - protein, 11 aa, Entamoeba histolytica
KQYKKEIEEEE

SEQ ID NO: 2604979 - protein, 20 aa, Entamoeba histolytica
KQYTEDEERKHKTERDNEEL

SEQ ID NO: 2604980 - protein, 6 aa, Entamoeba histolytica
KRDKII

SEQ ID NO: 2604981 - protein, 9 aa, Entamoeba histolytica
KRELTDETL

SEQ ID NO: 2604982 - protein, 6 aa, Entamoeba histolytica
KREMPL

SEQ ID NO: 2604983 - protein, 12 aa, Entamoeba histolytica
KRERGSKKEVND

SEQ ID NO: 2604984 - protein, 15 aa, Entamoeba histolytica
KRERSGSGSRITRRR

SEQ ID NO: 2604985 - protein, 36 aa, Entamoeba histolytica
KRETFAKKQQHSQKKSNEKEGVKTEKTKKVKKAEPA

SEQ ID NO: 2604986 - protein, 12 aa, Entamoeba histolytica
KREYSNGNINSD

SEQ ID NO: 2604987 - protein, 10 aa, Entamoeba histolytica
KRGGEEIRGR

SEQ ID NO: 2604988 - protein, 5 aa, Entamoeba histolytica
KRHIG

SEQ ID NO: 2604989 - protein, 17 aa, Entamoeba histolytica
KRIRNKETVRKSKKRFK

SEQ ID NO: 2604990 - protein, 5 aa, Entamoeba histolytica
KRKEV

SEQ ID NO: 2604991 - protein, 9 aa, Entamoeba histolytica
KRKRGEERR

SEQ ID NO: 2604992 - protein, 4 aa, Entamoeba histolytica
KRLQ

SEQ ID NO: 2604993 - protein, 21 aa, Entamoeba histolytica
KRMKQQNKEYQRKKETQSKEI

SEQ ID NO: 2604994 - protein, 15 aa, Entamoeba histolytica
KRNQDGTIISSSNNG

SEQ ID NO: 2604995 - protein, 5 aa, Entamoeba histolytica
KRNVQ

SEQ ID NO: 2604996 - protein, 6 aa, Entamoeba histolytica
KRPETL

SEQ ID NO: 2604997 - protein, 12 aa, Entamoeba histolytica
KRQFDRKTSKIH

SEQ ID NO: 2604998 - protein, 5 aa, Entamoeba histolytica
KRRNM

SEQ ID NO: 2604999 - protein, 7 aa, Entamoeba histolytica
KRRRDLN

SEQ ID NO: 2605000 - protein, 4 aa, Entamoeba histolytica
KRSG

SEQ ID NO: 2605001 - protein, 11 aa, Entamoeba histolytica
KRSIKSAKKTV

SEQ ID NO: 2605002 - protein, 4 aa, Entamoeba histolytica
KRTA

SEQ ID NO: 2605003 - protein, 8 aa, Entamoeba histolytica
KRYANGEV

SEQ ID NO: 2605004 - protein, 8 aa, Entamoeba histolytica
KSAAGCPS

SEQ ID NO: 2605005 - protein, 21 aa, Entamoeba histolytica
KSAHLAEKKGSSTSTSEPKKV

SEQ ID NO: 2605006 - protein, 8 aa, Entamoeba histolytica
KSANGKIR

SEQ ID NO: 2605007 - protein, 10 aa, Entamoeba histolytica
KSDATKGHAV

SEQ ID NO: 2605008 - protein, 12 aa, Entamoeba histolytica
KSDNEDTSVESV

SEQ ID NO: 2605009 - protein, 12 aa, Entamoeba histolytica
KSDVSNPPYDTR

SEQ ID NO: 2605010 - protein, 9 aa, Entamoeba histolytica
KSELKKGKI

SEQ ID NO: 2605011 - protein, 13 aa, Entamoeba histolytica
KSGLTPKPTAKNF

SEQ ID NO: 2605012 - protein, 9 aa, Entamoeba histolytica
KSGNATRQF

SEQ ID NO: 2605013 - protein, 7 aa, Entamoeba histolytica
KSGYQSY

SEQ ID NO: 2605014 - protein, 4 aa, Entamoeba histolytica
KSID

SEQ ID NO: 2605015 - protein, 7 aa, Entamoeba histolytica
KSINGNK

SEQ ID NO: 2605016 - protein, 22 aa, Entamoeba histolytica
KSIQSKAEQELKERVEKAESVE

SEQ ID NO: 2605017 - protein, 9 aa, Entamoeba histolytica
KSKEGKEKI

SEQ ID NO: 2605018 - protein, 7 aa, Entamoeba histolytica
KSKNGNN

SEQ ID NO: 2605019 - protein, 8 aa, Entamoeba histolytica
KSKSIRSK

SEQ ID NO: 2605020 - protein, 14 aa, Entamoeba histolytica
KSLPNNQNYTSIQE

SEQ ID NO: 2605021 - protein, 5 aa, Entamoeba histolytica
KSLTN

SEQ ID NO: 2605022 - protein, 15 aa, Entamoeba histolytica
KSMDEENRQDNERHS

SEQ ID NO: 2605023 - protein, 4 aa, Entamoeba histolytica
KSMT

SEQ ID NO: 2605024 - protein, 13 aa, Entamoeba histolytica
KSNEKEVKKNKKY

SEQ ID NO: 2605025 - protein, 18 aa, Entamoeba histolytica
KSNRVEKDAVQDGTRVGV

SEQ ID NO: 2605026 - protein, 9 aa, Entamoeba histolytica
KSPTSPIIS

SEQ ID NO: 2605027 - protein, 7 aa, Entamoeba histolytica
KSQDPTI

SEQ ID NO: 2605028 - protein, 11 aa, Entamoeba histolytica
KSQKDNLDKDM

SEQ ID NO: 2605029 - protein, 8 aa, Entamoeba histolytica
KSQTDEMK

SEQ ID NO: 2605030 - protein, 14 aa, Entamoeba histolytica
KSRHNKGRKEEEIN

SEQ ID NO: 2605031 - protein, 4 aa, Entamoeba histolytica
KSRS

SEQ ID NO: 2605032 - protein, 8 aa, Entamoeba histolytica
KSRSNEVT

SEQ ID NO: 2605033 - protein, 4 aa, Entamoeba histolytica
KSSF

SEQ ID NO: 2605034 - protein, 11 aa, Entamoeba histolytica
KSSVISSTSSL

SEQ ID NO: 2605035 - protein, 18 aa, Entamoeba histolytica
KSTGAPPDYFSAGEGQNW

SEQ ID NO: 2605036 - protein, 12 aa, Entamoeba histolytica
KSTKAGDETSRI

SEQ ID NO: 2605037 - protein, 8 aa, Entamoeba histolytica
KSTKVNKN

SEQ ID NO: 2605038 - protein, 4 aa, Entamoeba histolytica
KSTL

SEQ ID NO: 2605039 - protein, 7 aa, Entamoeba histolytica
KSTPSDQ

SEQ ID NO: 2605040 - protein, 10 aa, Entamoeba histolytica
KSVESSSMVP

SEQ ID NO: 2605041 - protein, 11 aa, Entamoeba histolytica
KSVNTSGHVEG

SEQ ID NO: 2605042 - protein, 4 aa, Entamoeba histolytica
KSYK

SEQ ID NO: 2605043 - protein, 31 aa, Entamoeba histolytica
KTANGDFESELKEKEQAKIEQSDATTNGYSS

SEQ ID NO: 2605044 - protein, 8 aa, Entamoeba histolytica
KTDCRNDE

SEQ ID NO: 2605045 - protein, 5 aa, Entamoeba histolytica
KTDSS

SEQ ID NO: 2605046 - protein, 7 aa, Entamoeba histolytica
KTEELEK

SEQ ID NO: 2605047 - protein, 6 aa, Entamoeba histolytica
KTENGI

SEQ ID NO: 2605048 - protein, 7 aa, Entamoeba histolytica
KTGEYSG

SEQ ID NO: 2605049 - protein, 6 aa, Entamoeba histolytica
KTITPV

SEQ ID NO: 2605050 - protein, 25 aa, Entamoeba histolytica
KTKCNPKNKRLVKRDEKCDEEINKK

SEQ ID NO: 2605051 - protein, 7 aa, Entamoeba histolytica
KTKDTFP

SEQ ID NO: 2605052 - protein, 10 aa, Entamoeba histolytica
KTKKGKSPKT

SEQ ID NO: 2605053 - protein, 8 aa, Entamoeba histolytica
KTKNESQV

SEQ ID NO: 2605054 - protein, 7 aa, Entamoeba histolytica
KTKNSII

SEQ ID NO: 2605055 - protein, 12 aa, Entamoeba histolytica
KTKPPSNSTKIN

SEQ ID NO: 2605056 - protein, 8 aa, Entamoeba histolytica
KTKTYLKE

SEQ ID NO: 2605057 - protein, 13 aa, Entamoeba histolytica
KTLKEKYDLRPKN

SEQ ID NO: 2605058 - protein, 4 aa, Entamoeba histolytica
KTLP

SEQ ID NO: 2605059 - protein, 6 aa, Entamoeba histolytica
KTNENE

SEQ ID NO: 2605060 - protein, 8 aa, Entamoeba histolytica
KTNGENTK

SEQ ID NO: 2605061 - protein, 4 aa, Entamoeba histolytica
KTNQ

SEQ ID NO: 2605062 - protein, 7 aa, Entamoeba histolytica
KTPEGTK

SEQ ID NO: 2605063 - protein, 19 aa, Entamoeba histolytica
KTPKDESTTVKTEVIPANK

SEQ ID NO: 2605064 - protein, 5 aa, Entamoeba histolytica
KTPKY

SEQ ID NO: 2605065 - protein, 14 aa, Entamoeba histolytica
KTPNIKGEIPLTKD

SEQ ID NO: 2605066 - protein, 4 aa, Entamoeba histolytica
KTPQ

SEQ ID NO: 2605067 - protein, 6 aa, Entamoeba histolytica
KTQQLG

SEQ ID NO: 2605068 - protein, 4 aa, Entamoeba histolytica
KTQT

SEQ ID NO: 2605069 - protein, 11 aa, Entamoeba histolytica
KTRKESGVELQ

SEQ ID NO: 2605070 - protein, 8 aa, Entamoeba histolytica
KTRKSLKI

SEQ ID NO: 2605071 - protein, 7 aa, Entamoeba histolytica
KTRRGER

SEQ ID NO: 2605072 - protein, 12 aa, Entamoeba histolytica
KTSAKNGEGVTE

SEQ ID NO: 2605073 - protein, 4 aa, Entamoeba histolytica
KTSF

SEQ ID NO: 2605074 - protein, 5 aa, Entamoeba histolytica
KTSSL

SEQ ID NO: 2605075 - protein, 6 aa, Entamoeba histolytica
KTSTTV

SEQ ID NO: 2605076 - protein, 6 aa, Entamoeba histolytica
KTTEKG

SEQ ID NO: 2605077 - protein, 6 aa, Entamoeba histolytica
KTTGTI

SEQ ID NO: 2605078 - protein, 4 aa, Entamoeba histolytica
KTTI

SEQ ID NO: 2605079 - protein, 15 aa, Entamoeba histolytica
KTTKPKEWEQSQEKQ

SEQ ID NO: 2605080 - protein, 15 aa, Entamoeba histolytica
KTTLEAAQRKAAKAL

SEQ ID NO: 2605081 - protein, 9 aa, Entamoeba histolytica
KTTPEGEKC

SEQ ID NO: 2605082 - protein, 5 aa, Entamoeba histolytica
KTTPF

SEQ ID NO: 2605083 - protein, 5 aa, Entamoeba histolytica
KTTRH

SEQ ID NO: 2605084 - protein, 4 aa, Entamoeba histolytica
KTVP

SEQ ID NO: 2605085 - protein, 8 aa, Entamoeba histolytica
KTVQERGA

SEQ ID NO: 2605086 - protein, 14 aa, Entamoeba histolytica
KTYGSCAQKEINNE

SEQ ID NO: 2605087 - protein, 6 aa, Entamoeba histolytica
KTYPGL

SEQ ID NO: 2605088 - protein, 23 aa, Entamoeba histolytica
KVEETEEEKKEQEAKEKDNEELS

SEQ ID NO: 2605089 - protein, 5 aa, Entamoeba histolytica
KVEGT

SEQ ID NO: 2605090 - protein, 7 aa, Entamoeba histolytica
KVGQPTE

SEQ ID NO: 2605091 - protein, 9 aa, Entamoeba histolytica
KVHSDEKPF

SEQ ID NO: 2605092 - protein, 16 aa, Entamoeba histolytica
KVKGKSKWYTGGEQAL

SEQ ID NO: 2605093 - protein, 8 aa, Entamoeba histolytica
KVKNNENF

SEQ ID NO: 2605094 - protein, 21 aa, Entamoeba histolytica
KVKTKKLSKKKGQQESTSPAE

SEQ ID NO: 2605095 - protein, 4 aa, Entamoeba histolytica
KVPT

SEQ ID NO: 2605096 - protein, 8 aa, Entamoeba histolytica
KVQSGQDR

SEQ ID NO: 2605097 - protein, 6 aa, Entamoeba histolytica
KVSPRH

SEQ ID NO: 2605098 - protein, 9 aa, Entamoeba histolytica
KVTQSYPGS

SEQ ID NO: 2605099 - protein, 8 aa, Entamoeba histolytica
KWSPNESK

SEQ ID NO: 2605100 - protein, 15 aa, Entamoeba histolytica
KYDKASEAYKTAAGH

SEQ ID NO: 2605101 - protein, 4 aa, Entamoeba histolytica
KYDS

SEQ ID NO: 2605102 - protein, 19 aa, Entamoeba histolytica
KYEEKEETKMIKETKSDIT

SEQ ID NO: 2605103 - protein, 6 aa, Entamoeba histolytica
KYGNDN

SEQ ID NO: 2605104 - protein, 6 aa, Entamoeba histolytica
KYGNPA

SEQ ID NO: 2605105 - protein, 12 aa, Entamoeba histolytica
KYHPDRNPEGRE

SEQ ID NO: 2605106 - protein, 14 aa, Entamoeba histolytica
KYIPKTTKGTLEQR

SEQ ID NO: 2605107 - protein, 8 aa, Entamoeba histolytica
KYKPGEDD

SEQ ID NO: 2605108 - protein, 8 aa, Entamoeba histolytica
KYNDPELQ

SEQ ID NO: 2605109 - protein, 7 aa, Entamoeba histolytica
KYNPLDE

SEQ ID NO: 2605110 - protein, 5 aa, Entamoeba histolytica
KYNTN

SEQ ID NO: 2605111 - protein, 6 aa, Entamoeba histolytica
KYPASL

SEQ ID NO: 2605112 - protein, 6 aa, Entamoeba histolytica
KYREKA

SEQ ID NO: 2605113 - protein, 4 aa, Entamoeba histolytica
LAGD

SEQ ID NO: 2605114 - protein, 10 aa, Entamoeba histolytica
LAKQGRFNKL

SEQ ID NO: 2605115 - protein, 6 aa, Entamoeba histolytica
LAKTNA

SEQ ID NO: 2605116 - protein, 7 aa, Entamoeba histolytica
LANEEEE

SEQ ID NO: 2605117 - protein, 10 aa, Entamoeba histolytica
LANGSTNTQM

SEQ ID NO: 2605118 - protein, 12 aa, Entamoeba histolytica
LANHTTVDTDGS

SEQ ID NO: 2605119 - protein, 12 aa, Entamoeba histolytica
LANHTTVETDGS

SEQ ID NO: 2605120 - protein, 5 aa, Entamoeba histolytica
LAPDQ

SEQ ID NO: 2605121 - protein, 6 aa, Entamoeba histolytica
LARDEK

SEQ ID NO: 2605122 - protein, 22 aa, Entamoeba histolytica
LARGKKEAQRFHRERKEKSFQR

SEQ ID NO: 2605123 - protein, 14 aa, Entamoeba histolytica
LATEKPKPQKRVER

SEQ ID NO: 2605124 - protein, 5 aa, Entamoeba histolytica
LDALS

SEQ ID NO: 2605125 - protein, 7 aa, Entamoeba histolytica
LDDIDDD

SEQ ID NO: 2605126 - protein, 10 aa, Entamoeba histolytica
LDDSCPSTHN

SEQ ID NO: 2605127 - protein, 6 aa, Entamoeba histolytica
LDEDQN

SEQ ID NO: 2605128 - protein, 4 aa, Entamoeba histolytica
LDEE

SEQ ID NO: 2605129 - protein, 4 aa, Entamoeba histolytica
LDEI

SEQ ID NO: 2605130 - protein, 6 aa, Entamoeba histolytica
LDEPAA

SEQ ID NO: 2605131 - protein, 4 aa, Entamoeba histolytica
LDGD

SEQ ID NO: 2605132 - protein, 8 aa, Entamoeba histolytica
LDKSGYTI

SEQ ID NO: 2605133 - protein, 10 aa, Entamoeba histolytica
LDNEDDLPLR

SEQ ID NO: 2605134 - protein, 12 aa, Entamoeba histolytica
LDQQLGSSSPEV

SEQ ID NO: 2605135 - protein, 6 aa, Entamoeba histolytica
LDRTET

SEQ ID NO: 2605136 - protein, 7 aa, Entamoeba histolytica
LDSSSSP

SEQ ID NO: 2605137 - protein, 4 aa, Entamoeba histolytica
LEAQ

SEQ ID NO: 2605138 - protein, 5 aa, Entamoeba histolytica
LEAQN

SEQ ID NO: 2605139 - protein, 6 aa, Entamoeba histolytica
LEDRYN

SEQ ID NO: 2605140 - protein, 9 aa, Entamoeba histolytica
LEEDPEAEA

SEQ ID NO: 2605141 - protein, 8 aa, Entamoeba histolytica
LEEEGVDK

SEQ ID NO: 2605142 - protein, 8 aa, Entamoeba histolytica
LEEEPHLN

SEQ ID NO: 2605143 - protein, 5 aa, Entamoeba histolytica
LEERQ

SEQ ID NO: 2605144 - protein, 8 aa, Entamoeba histolytica
LEGDGDLL

SEQ ID NO: 2605145 - protein, 5 aa, Entamoeba histolytica
LEINP

SEQ ID NO: 2605146 - protein, 4 aa, Entamoeba histolytica
LEKE

SEQ ID NO: 2605147 - protein, 13 aa, Entamoeba histolytica
LEKGQVEKAESDF

SEQ ID NO: 2605148 - protein, 18 aa, Entamoeba histolytica
LEKKREEETKPERRKTRP

SEQ ID NO: 2605149 - protein, 11 aa, Entamoeba histolytica
LEKNKKDKDAK

SEQ ID NO: 2605150 - protein, 12 aa, Entamoeba histolytica
LENGKEGSDLDE

SEQ ID NO: 2605151 - protein, 6 aa, Entamoeba histolytica
LENTEQ

SEQ ID NO: 2605152 - protein, 4 aa, Entamoeba histolytica
LEPE

SEQ ID NO: 2605153 - protein, 5 aa, Entamoeba histolytica
LERAK

SEQ ID NO: 2605154 - protein, 5 aa, Entamoeba histolytica
LERGE

SEQ ID NO: 2605155 - protein, 8 aa, Entamoeba histolytica
LESSERRS

SEQ ID NO: 2605156 - protein, 13 aa, Entamoeba histolytica
LGASENKEATIVP

SEQ ID NO: 2605157 - protein, 4 aa, Entamoeba histolytica
LGEN

SEQ ID NO: 2605158 - protein, 4 aa, Entamoeba histolytica
LGGG

SEQ ID NO: 2605159 - protein, 12 aa, Entamoeba histolytica
LGGSDEVSGSHK

SEQ ID NO: 2605160 - protein, 25 aa, Entamoeba histolytica
LGNNDGKNLSSPSQFRSKEISKSNV

SEQ ID NO: 2605161 - protein, 15 aa, Entamoeba histolytica
LGNPGISSGVPAPFE

SEQ ID NO: 2605162 - protein, 4 aa, Entamoeba histolytica
LGRT

SEQ ID NO: 2605163 - protein, 14 aa, Entamoeba histolytica
LGSKKAENESNGGC

SEQ ID NO: 2605164 - protein, 5 aa, Entamoeba histolytica
LGTEG

SEQ ID NO: 2605165 - protein, 11 aa, Entamoeba histolytica
LGTSRGAQDPK

SEQ ID NO: 2605166 - protein, 7 aa, Entamoeba histolytica
LGTSTAD

SEQ ID NO: 2605167 - protein, 4 aa, Entamoeba histolytica
LHDD

SEQ ID NO: 2605168 - protein, 5 aa, Entamoeba histolytica
LIGKK

SEQ ID NO: 2605169 - protein, 15 aa, Entamoeba histolytica
LIKAQEKAKEQYMKE

SEQ ID NO: 2605170 - protein, 4 aa, Entamoeba histolytica
LISQ

SEQ ID NO: 2605171 - protein, 6 aa, Entamoeba histolytica
LKADER

SEQ ID NO: 2605172 - protein, 8 aa, Entamoeba histolytica
LKASEKEV

SEQ ID NO: 2605173 - protein, 15 aa, Entamoeba histolytica
LKASNFTRVGYIWDC

SEQ ID NO: 2605174 - protein, 10 aa, Entamoeba histolytica
LKDDKVTMNK

SEQ ID NO: 2605175 - protein, 7 aa, Entamoeba histolytica
LKDEDID

SEQ ID NO: 2605176 - protein, 6 aa, Entamoeba histolytica
LKDGIS

SEQ ID NO: 2605177 - protein, 16 aa, Entamoeba histolytica
LKDKGNDFDNSTTDTT

SEQ ID NO: 2605178 - protein, 7 aa, Entamoeba histolytica
LKDRMKD

SEQ ID NO: 2605179 - protein, 10 aa, Entamoeba histolytica
LKEDKENNSI

SEQ ID NO: 2605180 - protein, 8 aa, Entamoeba histolytica
LKEEDKKL

SEQ ID NO: 2605181 - protein, 6 aa, Entamoeba histolytica
LKEEEI

SEQ ID NO: 2605182 - protein, 8 aa, Entamoeba histolytica
LKEKMSDS

SEQ ID NO: 2605183 - protein, 4 aa, Entamoeba histolytica
LKEQ

SEQ ID NO: 2605184 - protein, 6 aa, Entamoeba histolytica
LKEQGV

SEQ ID NO: 2605185 - protein, 7 aa, Entamoeba histolytica
LKETDES

SEQ ID NO: 2605186 - protein, 5 aa, Entamoeba histolytica
LKGQT

SEQ ID NO: 2605187 - protein, 13 aa, Entamoeba histolytica
LKHTETVDKSAPV

SEQ ID NO: 2605188 - protein, 10 aa, Entamoeba histolytica
LKKDEIERTE

SEQ ID NO: 2605189 - protein, 6 aa, Entamoeba histolytica
LKKDTI

SEQ ID NO: 2605190 - protein, 4 aa, Entamoeba histolytica
LKKE

SEQ ID NO: 2605191 - protein, 8 aa, Entamoeba histolytica
LKKSGKLE

SEQ ID NO: 2605192 - protein, 8 aa, Entamoeba histolytica
LKNNTTLN

SEQ ID NO: 2605193 - protein, 4 aa, Entamoeba histolytica
LKNQ

SEQ ID NO: 2605194 - protein, 7 aa, Entamoeba histolytica
LKPPRFP

SEQ ID NO: 2605195 - protein, 12 aa, Entamoeba histolytica
LKQKAVAEAKEK

SEQ ID NO: 2605196 - protein, 4 aa, Entamoeba histolytica
LKQP

SEQ ID NO: 2605197 - protein, 13 aa, Entamoeba histolytica
LKQQEQAFEEEKR

SEQ ID NO: 2605198 - protein, 9 aa, Entamoeba histolytica
LKTIRDGKS

SEQ ID NO: 2605199 - protein, 6 aa, Entamoeba histolytica
LKYPEE

SEQ ID NO: 2605200 - protein, 10 aa, Entamoeba histolytica
LLDNQGSNIS

SEQ ID NO: 2605201 - protein, 14 aa, Entamoeba histolytica
LNDDSYEECMKADG

SEQ ID NO: 2605202 - protein, 6 aa, Entamoeba histolytica
LNDYQT

SEQ ID NO: 2605203 - protein, 10 aa, Entamoeba histolytica
LNEGEDVDEY

SEQ ID NO: 2605204 - protein, 5 aa, Entamoeba histolytica
LNEND

SEQ ID NO: 2605205 - protein, 4 aa, Entamoeba histolytica
LNEQ

SEQ ID NO: 2605206 - protein, 7 aa, Entamoeba histolytica
LNEQTYG

SEQ ID NO: 2605207 - protein, 10 aa, Entamoeba histolytica
LNGYKEQDKW

SEQ ID NO: 2605208 - protein, 8 aa, Entamoeba histolytica
LNKQLSNG

SEQ ID NO: 2605209 - protein, 11 aa, Entamoeba histolytica
LNNAAAKKYDL

SEQ ID NO: 2605210 - protein, 6 aa, Entamoeba histolytica
LNNEKI

SEQ ID NO: 2605211 - protein, 7 aa, Entamoeba histolytica
LNNPKYG

SEQ ID NO: 2605212 - protein, 7 aa, Entamoeba histolytica
LNNPQKT

SEQ ID NO: 2605213 - protein, 9 aa, Entamoeba histolytica
LNPRTRGPI

SEQ ID NO: 2605214 - protein, 5 aa, Entamoeba histolytica
LNQND

SEQ ID NO: 2605215 - protein, 7 aa, Entamoeba histolytica
LNQYGDY

SEQ ID NO: 2605216 - protein, 12 aa, Entamoeba histolytica
LNYSENGGKTFK

SEQ ID NO: 2605217 - protein, 8 aa, Entamoeba histolytica
LPDNQVRN

SEQ ID NO: 2605218 - protein, 4 aa, Entamoeba histolytica
LPDY

SEQ ID NO: 2605219 - protein, 9 aa, Entamoeba histolytica
LPEKTKEEM

SEQ ID NO: 2605220 - protein, 4 aa, Entamoeba histolytica
LPES

SEQ ID NO: 2605221 - protein, 5 aa, Entamoeba histolytica
LPGDG

SEQ ID NO: 2605222 - protein, 9 aa, Entamoeba histolytica
LPGRTANQI

SEQ ID NO: 2605223 - protein, 16 aa, Entamoeba histolytica
LPKEEENKEKTIAQQI

SEQ ID NO: 2605224 - protein, 4 aa, Entamoeba histolytica
LPKG

SEQ ID NO: 2605225 - protein, 9 aa, Entamoeba histolytica
LPKNELGKE

SEQ ID NO: 2605226 - protein, 8 aa, Entamoeba histolytica
LPKPKSKV

SEQ ID NO: 2605227 - protein, 7 aa, Entamoeba histolytica
LPPEDSY

SEQ ID NO: 2605228 - protein, 6 aa, Entamoeba histolytica
LPPPQA

SEQ ID NO: 2605229 - protein, 26 aa, Entamoeba histolytica
LPQDRKSLLDGEEDEDGPIDTTTNID

SEQ ID NO: 2605230 - protein, 7 aa, Entamoeba histolytica
LPQPNHV

SEQ ID NO: 2605231 - protein, 5 aa, Entamoeba histolytica
LPSED

SEQ ID NO: 2605232 - protein, 4 aa, Entamoeba histolytica
LPSP

SEQ ID NO: 2605233 - protein, 4 aa, Entamoeba histolytica
LPST

SEQ ID NO: 2605234 - protein, 6 aa, Entamoeba histolytica
LPTIPT

SEQ ID NO: 2605235 - protein, 21 aa, Entamoeba histolytica
LPTISQTKKYKTRTTLTPLNT

SEQ ID NO: 2605236 - protein, 12 aa, Entamoeba histolytica
LPTNSTPQNPNQ

SEQ ID NO: 2605237 - protein, 5 aa, Entamoeba histolytica
LPVEG

SEQ ID NO: 2605238 - protein, 10 aa, Entamoeba histolytica
LQEPDSVEEI

SEQ ID NO: 2605239 - protein, 9 aa, Entamoeba histolytica
LQGQQSEWK

SEQ ID NO: 2605240 - protein, 9 aa, Entamoeba histolytica
LQGTKDRKY

SEQ ID NO: 2605241 - protein, 8 aa, Entamoeba histolytica
LQKTGSFK

SEQ ID NO: 2605242 - protein, 9 aa, Entamoeba histolytica
LQPNPQPYL

SEQ ID NO: 2605243 - protein, 4 aa, Entamoeba histolytica
LQPS

SEQ ID NO: 2605244 - protein, 17 aa, Entamoeba histolytica
LQPVDETEARKGHHQKR

SEQ ID NO: 2605245 - protein, 22 aa, Entamoeba histolytica
LREDNNKDHISKKEGEKMAKEL

SEQ ID NO: 2605246 - protein, 17 aa, Entamoeba histolytica
LRKDGSDDVTKQEGDDL

SEQ ID NO: 2605247 - protein, 7 aa, Entamoeba histolytica
LRNPNGK

SEQ ID NO: 2605248 - protein, 10 aa, Entamoeba histolytica
LRSNAGNEQA

SEQ ID NO: 2605249 - protein, 14 aa, Entamoeba histolytica
LSCTSNSSNNTNLS

SEQ ID NO: 2605250 - protein, 5 aa, Entamoeba histolytica
LSDDT

SEQ ID NO: 2605251 - protein, 4 aa, Entamoeba histolytica
LSDE

SEQ ID NO: 2605252 - protein, 5 aa, Entamoeba histolytica
LSDNI

SEQ ID NO: 2605253 - protein, 7 aa, Entamoeba histolytica
LSEEEVN

SEQ ID NO: 2605254 - protein, 13 aa, Entamoeba histolytica
LSEEIKGKEIPKV

SEQ ID NO: 2605255 - protein, 4 aa, Entamoeba histolytica
LSGA

SEQ ID NO: 2605256 - protein, 5 aa, Entamoeba histolytica
LSGEC

SEQ ID NO: 2605257 - protein, 7 aa, Entamoeba histolytica
LSGGQKS

SEQ ID NO: 2605258 - protein, 9 aa, Entamoeba histolytica
LSGKPDAEL

SEQ ID NO: 2605259 - protein, 8 aa, Entamoeba histolytica
LSGKSKRI

SEQ ID NO: 2605260 - protein, 9 aa, Entamoeba histolytica
LSGKSKTTK

SEQ ID NO: 2605261 - protein, 4 aa, Entamoeba histolytica
LSGL

SEQ ID NO: 2605262 - protein, 4 aa, Entamoeba histolytica
LSGR

SEQ ID NO: 2605263 - protein, 6 aa, Entamoeba histolytica
LSKPEL

SEQ ID NO: 2605264 - protein, 8 aa, Entamoeba histolytica
LSLGGEKE

SEQ ID NO: 2605265 - protein, 5 aa, Entamoeba histolytica
LSNEP

SEQ ID NO: 2605266 - protein, 9 aa, Entamoeba histolytica
LSNEQKNYM

SEQ ID NO: 2605267 - protein, 4 aa, Entamoeba histolytica
LSNQ

SEQ ID NO: 2605268 - protein, 6 aa, Entamoeba histolytica
LSPKDF

SEQ ID NO: 2605269 - protein, 4 aa, Entamoeba histolytica
LSPN

SEQ ID NO: 2605270 - protein, 5 aa, Entamoeba histolytica
LSPPL

SEQ ID NO: 2605271 - protein, 6 aa, Entamoeba histolytica
LSPQEQ

SEQ ID NO: 2605272 - protein, 6 aa, Entamoeba histolytica
LSPQES

SEQ ID NO: 2605273 - protein, 6 aa, Entamoeba histolytica
LSPRDL

SEQ ID NO: 2605274 - protein, 8 aa, Entamoeba histolytica
LSPSNNIR

SEQ ID NO: 2605275 - protein, 5 aa, Entamoeba histolytica
LSPTL

SEQ ID NO: 2605276 - protein, 4 aa, Entamoeba histolytica
LSQL

SEQ ID NO: 2605277 - protein, 11 aa, Entamoeba histolytica
LSQQSSTNPLT

SEQ ID NO: 2605278 - protein, 12 aa, Entamoeba histolytica
LSREPNQQEVPL

SEQ ID NO: 2605279 - protein, 12 aa, Entamoeba histolytica
LSSRGTAAVKSA

SEQ ID NO: 2605280 - protein, 10 aa, Entamoeba histolytica
LSSSSDRFNQ

SEQ ID NO: 2605281 - protein, 4 aa, Entamoeba histolytica
LSTE

SEQ ID NO: 2605282 - protein, 8 aa, Entamoeba histolytica
LSTHTNPF

SEQ ID NO: 2605283 - protein, 6 aa, Entamoeba histolytica
LSTNHR

SEQ ID NO: 2605284 - protein, 4 aa, Entamoeba histolytica
LSTR

SEQ ID NO: 2605285 - protein, 4 aa, Entamoeba histolytica
LSTS

SEQ ID NO: 2605286 - protein, 5 aa, Entamoeba histolytica
LSYPN

SEQ ID NO: 2605287 - protein, 6 aa, Entamoeba histolytica
LSYPST

SEQ ID NO: 2605288 - protein, 5 aa, Entamoeba histolytica
LTASD

SEQ ID NO: 2605289 - protein, 5 aa, Entamoeba histolytica
LTDGE

SEQ ID NO: 2605290 - protein, 11 aa, Entamoeba histolytica
LTDPKDGSYPN

SEQ ID NO: 2605291 - protein, 85 aa, Entamoeba histolytica
LTEPAPANSQSASQASGISTPTGSAVTTQEGNSPAQSGLAPAENPASTSPKGNEPPAKVEGNSLQSKQVSGDTPEGGSSTTHSEI

SEQ ID NO: 2605292 - protein, 10 aa, Entamoeba histolytica
LTESYEKKIG

SEQ ID NO: 2605293 - protein, 7 aa, Entamoeba histolytica
LTGGQYA

SEQ ID NO: 2605294 - protein, 15 aa, Entamoeba histolytica
LTKKAGVASKQYRSL

SEQ ID NO: 2605295 - protein, 5 aa, Entamoeba histolytica
LTPEM

SEQ ID NO: 2605296 - protein, 5 aa, Entamoeba histolytica
LTPEQ

SEQ ID NO: 2605297 - protein, 10 aa, Entamoeba histolytica
LTPKPTAKNF

SEQ ID NO: 2605298 - protein, 13 aa, Entamoeba histolytica
LTPSKCKKSQTKY

SEQ ID NO: 2605299 - protein, 9 aa, Entamoeba histolytica
LTQSNLKSK

SEQ ID NO: 2605300 - protein, 7 aa, Entamoeba histolytica
LTRENER

SEQ ID NO: 2605301 - protein, 4 aa, Entamoeba histolytica
LTRS

SEQ ID NO: 2605302 - protein, 4 aa, Entamoeba histolytica
LTSI

SEQ ID NO: 2605303 - protein, 4 aa, Entamoeba histolytica
LTSK

SEQ ID NO: 2605304 - protein, 9 aa, Entamoeba histolytica
LTSKENKEI

SEQ ID NO: 2605305 - protein, 6 aa, Entamoeba histolytica
LTSKKQ

SEQ ID NO: 2605306 - protein, 7 aa, Entamoeba histolytica
LTSMPTQ

SEQ ID NO: 2605307 - protein, 6 aa, Entamoeba histolytica
LTSRKI

SEQ ID NO: 2605308 - protein, 14 aa, Entamoeba histolytica
LTTEGGIKKGLKEK

SEQ ID NO: 2605309 - protein, 4 aa, Entamoeba histolytica
LTTP

SEQ ID NO: 2605310 - protein, 4 aa, Entamoeba histolytica
LTYK

SEQ ID NO: 2605311 - protein, 6 aa, Entamoeba histolytica
LVPEKS

SEQ ID NO: 2605312 - protein, 5 aa, Entamoeba histolytica
LVPYD

SEQ ID NO: 2605313 - protein, 8 aa, Entamoeba histolytica
LVSKKSDL

SEQ ID NO: 2605314 - protein, 8 aa, Entamoeba histolytica
LYEEEREK

SEQ ID NO: 2605315 - protein, 6 aa, Entamoeba histolytica
LYQNNQ

SEQ ID NO: 2605316 - protein, 9 aa, Entamoeba histolytica
MDESNNETR

SEQ ID NO: 2605317 - protein, 9 aa, Entamoeba histolytica
MDNRPASAL

SEQ ID NO: 2605318 - protein, 15 aa, Entamoeba histolytica
MEEEKKQESTTPEMT

SEQ ID NO: 2605319 - protein, 9 aa, Entamoeba histolytica
MENNRGRLG

SEQ ID NO: 2605320 - protein, 7 aa, Entamoeba histolytica
MEPVPTP

SEQ ID NO: 2605321 - protein, 4 aa, Entamoeba histolytica
MGAE

SEQ ID NO: 2605322 - protein, 10 aa, Entamoeba histolytica
MGATPPRQSE

SEQ ID NO: 2605323 - protein, 6 aa, Entamoeba histolytica
MGGHQD

SEQ ID NO: 2605324 - protein, 8 aa, Entamoeba histolytica
MGNISDED

SEQ ID NO: 2605325 - protein, 20 aa, Entamoeba histolytica
MHTDTKKKVTCNGGSEDQIA

SEQ ID NO: 2605326 - protein, 9 aa, Entamoeba histolytica
MIEKEGEKL

SEQ ID NO: 2605327 - protein, 5 aa, Entamoeba histolytica
MIPTN

SEQ ID NO: 2605328 - protein, 10 aa, Entamoeba histolytica
MKDTQLGPNG

SEQ ID NO: 2605329 - protein, 4 aa, Entamoeba histolytica
MKEE

SEQ ID NO: 2605330 - protein, 22 aa, Entamoeba histolytica
MKEEDERKKEQIELEKKQRADE

SEQ ID NO: 2605331 - protein, 7 aa, Entamoeba histolytica
MKEKGVD

SEQ ID NO: 2605332 - protein, 4 aa, Entamoeba histolytica
MKEN

SEQ ID NO: 2605333 - protein, 15 aa, Entamoeba histolytica
MKKDNNASISLQQLW

SEQ ID NO: 2605334 - protein, 11 aa, Entamoeba histolytica
MKKGKKINLTK

SEQ ID NO: 2605335 - protein, 9 aa, Entamoeba histolytica
MKNGQQPKK

SEQ ID NO: 2605336 - protein, 7 aa, Entamoeba histolytica
MKQENRC

SEQ ID NO: 2605337 - protein, 8 aa, Entamoeba histolytica
MKQEQENM

SEQ ID NO: 2605338 - protein, 9 aa, Entamoeba histolytica
MNANAQNKI

SEQ ID NO: 2605339 - protein, 11 aa, Entamoeba histolytica
MNGERRKNSTA

SEQ ID NO: 2605340 - protein, 5 aa, Entamoeba histolytica
MNNET

SEQ ID NO: 2605341 - protein, 5 aa, Entamoeba histolytica
MNRTP

SEQ ID NO: 2605342 - protein, 8 aa, Entamoeba histolytica
MPDEREPR

SEQ ID NO: 2605343 - protein, 6 aa, Entamoeba histolytica
MPDEVR

SEQ ID NO: 2605344 - protein, 36 aa, Entamoeba histolytica
MPPPPPSNCPPPPPSNNLPPPGPANVPPPSSAGRGD

SEQ ID NO: 2605345 - protein, 8 aa, Entamoeba histolytica
MPRPDERS

SEQ ID NO: 2605346 - protein, 5 aa, Entamoeba histolytica
MPRPG

SEQ ID NO: 2605347 - protein, 5 aa, Entamoeba histolytica
MPSSN

SEQ ID NO: 2605348 - protein, 13 aa, Entamoeba histolytica
MPTFGKDKKKAEL

SEQ ID NO: 2605349 - protein, 5 aa, Entamoeba histolytica
MRSGD

SEQ ID NO: 2605350 - protein, 20 aa, Entamoeba histolytica
MSEEEKMKEEKEIQYSNTPI

SEQ ID NO: 2605351 - protein, 22 aa, Entamoeba histolytica
MSEEEKMKEEKEIQYSNTPINQ

SEQ ID NO: 2605352 - protein, 4 aa, Entamoeba histolytica
MSIE

SEQ ID NO: 2605353 - protein, 7 aa, Entamoeba histolytica
MSKDPMK

SEQ ID NO: 2605354 - protein, 10 aa, Entamoeba histolytica
MSSSVEYNPV

SEQ ID NO: 2605355 - protein, 7 aa, Entamoeba histolytica
MVTGGGA

SEQ ID NO: 2605356 - protein, 5 aa, Entamoeba histolytica
MYGGN

SEQ ID NO: 2605357 - protein, 6 aa, Entamoeba histolytica
NAETLE

SEQ ID NO: 2605358 - protein, 4 aa, Entamoeba histolytica
NAFP

SEQ ID NO: 2605359 - protein, 5 aa, Entamoeba histolytica
NAFPN

SEQ ID NO: 2605360 - protein, 7 aa, Entamoeba histolytica
NAGLDAT

SEQ ID NO: 2605361 - protein, 5 aa, Entamoeba histolytica
NAGLN

SEQ ID NO: 2605362 - protein, 13 aa, Entamoeba histolytica
NAHQNATDIQEMP

SEQ ID NO: 2605363 - protein, 10 aa, Entamoeba histolytica
NAKNRDEQTP

SEQ ID NO: 2605364 - protein, 6 aa, Entamoeba histolytica
NALGSN

SEQ ID NO: 2605365 - protein, 7 aa, Entamoeba histolytica
NALKETR

SEQ ID NO: 2605366 - protein, 6 aa, Entamoeba histolytica
NAMEDG

SEQ ID NO: 2605367 - protein, 9 aa, Entamoeba histolytica
NANDNKKEM

SEQ ID NO: 2605368 - protein, 8 aa, Entamoeba histolytica
NAQEKLKK

SEQ ID NO: 2605369 - protein, 21 aa, Entamoeba histolytica
NAQMKEKRKTSQLDQVNNEDE

SEQ ID NO: 2605370 - protein, 6 aa, Entamoeba histolytica
NASQII

SEQ ID NO: 2605371 - protein, 7 aa, Entamoeba histolytica
NATGAEI

SEQ ID NO: 2605372 - protein, 11 aa, Entamoeba histolytica
NAYISKHNEGD

SEQ ID NO: 2605373 - protein, 5 aa, Entamoeba histolytica
NCGNE

SEQ ID NO: 2605374 - protein, 11 aa, Entamoeba histolytica
NDAALGSGGLG

SEQ ID NO: 2605375 - protein, 14 aa, Entamoeba histolytica
NDAGEITDYCNKLL

SEQ ID NO: 2605376 - protein, 4 aa, Entamoeba histolytica
NDDI

SEQ ID NO: 2605377 - protein, 7 aa, Entamoeba histolytica
NDDPKAL

SEQ ID NO: 2605378 - protein, 6 aa, Entamoeba histolytica
NDDPTF

SEQ ID NO: 2605379 - protein, 6 aa, Entamoeba histolytica
NDEERK

SEQ ID NO: 2605380 - protein, 19 aa, Entamoeba histolytica
NDEGEDLDEDDDAYDEKPI

SEQ ID NO: 2605381 - protein, 4 aa, Entamoeba histolytica
NDEI

SEQ ID NO: 2605382 - protein, 6 aa, Entamoeba histolytica
NDEQEL

SEQ ID NO: 2605383 - protein, 5 aa, Entamoeba histolytica
NDFKL

SEQ ID NO: 2605384 - protein, 6 aa, Entamoeba histolytica
NDGATV

SEQ ID NO: 2605385 - protein, 4 aa, Entamoeba histolytica
NDGI

SEQ ID NO: 2605386 - protein, 4 aa, Entamoeba histolytica
NDGL

SEQ ID NO: 2605387 - protein, 5 aa, Entamoeba histolytica
NDGLT

SEQ ID NO: 2605388 - protein, 8 aa, Entamoeba histolytica
NDINDDGL

SEQ ID NO: 2605389 - protein, 14 aa, Entamoeba histolytica
NDIVSQASSLDKPE

SEQ ID NO: 2605390 - protein, 6 aa, Entamoeba histolytica
NDLEGS

SEQ ID NO: 2605391 - protein, 19 aa, Entamoeba histolytica
NDLTQGTFSYSREDSENKF

SEQ ID NO: 2605392 - protein, 9 aa, Entamoeba histolytica
NDNSHDNKS

SEQ ID NO: 2605393 - protein, 8 aa, Entamoeba histolytica
NDPRLDPR

SEQ ID NO: 2605394 - protein, 4 aa, Entamoeba histolytica
NDPY

SEQ ID NO: 2605395 - protein, 12 aa, Entamoeba histolytica
NDQQLDKKRHIG

SEQ ID NO: 2605396 - protein, 11 aa, Entamoeba histolytica
NDRDRIGEARE

SEQ ID NO: 2605397 - protein, 7 aa, Entamoeba histolytica
NDRQRDA

SEQ ID NO: 2605398 - protein, 4 aa, Entamoeba histolytica
NDSH

SEQ ID NO: 2605399 - protein, 15 aa, Entamoeba histolytica
NDSQRESTKNAGKIA

SEQ ID NO: 2605400 - protein, 8 aa, Entamoeba histolytica
NDSSEGSV

SEQ ID NO: 2605401 - protein, 13 aa, Entamoeba histolytica
NDSSKTIQNYIIT

SEQ ID NO: 2605402 - protein, 4 aa, Entamoeba histolytica
NDST

SEQ ID NO: 2605403 - protein, 20 aa, Entamoeba histolytica
NDTAIVPPKEPDVELTQQAR

SEQ ID NO: 2605404 - protein, 7 aa, Entamoeba histolytica
NDTNSTE

SEQ ID NO: 2605405 - protein, 4 aa, Entamoeba histolytica
NDTT

SEQ ID NO: 2605406 - protein, 8 aa, Entamoeba histolytica
NDVKGKDV

SEQ ID NO: 2605407 - protein, 7 aa, Entamoeba histolytica
NDYNPTI

SEQ ID NO: 2605408 - protein, 8 aa, Entamoeba histolytica
NEDEQSIT

SEQ ID NO: 2605409 - protein, 5 aa, Entamoeba histolytica
NEDGD

SEQ ID NO: 2605410 - protein, 6 aa, Entamoeba histolytica
NEDGVE

SEQ ID NO: 2605411 - protein, 4 aa, Entamoeba histolytica
NEDS

SEQ ID NO: 2605412 - protein, 8 aa, Entamoeba histolytica
NEDTTTSI

SEQ ID NO: 2605413 - protein, 18 aa, Entamoeba histolytica
NEEADEAVKEANPDADGY

SEQ ID NO: 2605414 - protein, 4 aa, Entamoeba histolytica
NEED

SEQ ID NO: 2605415 - protein, 5 aa, Entamoeba histolytica
NEEEY

SEQ ID NO: 2605416 - protein, 11 aa, Entamoeba histolytica
NEEFKERGRGE

SEQ ID NO: 2605417 - protein, 5 aa, Entamoeba histolytica
NEEHQ

SEQ ID NO: 2605418 - protein, 13 aa, Entamoeba histolytica
NEEKQDKSISSKI

SEQ ID NO: 2605419 - protein, 4 aa, Entamoeba histolytica
NEEN

SEQ ID NO: 2605420 - protein, 9 aa, Entamoeba histolytica
NEENRKKRK

SEQ ID NO: 2605421 - protein, 4 aa, Entamoeba histolytica
NEET

SEQ ID NO: 2605422 - protein, 8 aa, Entamoeba histolytica
NEEVPHEG

SEQ ID NO: 2605423 - protein, 8 aa, Entamoeba histolytica
NEGEEDTI

SEQ ID NO: 2605424 - protein, 6 aa, Entamoeba histolytica
NEGITG

SEQ ID NO: 2605425 - protein, 4 aa, Entamoeba histolytica
NEGT

SEQ ID NO: 2605426 - protein, 6 aa, Entamoeba histolytica
NEHDTD

SEQ ID NO: 2605427 - protein, 4 aa, Entamoeba histolytica
NEIF

SEQ ID NO: 2605428 - protein, 11 aa, Entamoeba histolytica
NEIGNKQKRSV

SEQ ID NO: 2605429 - protein, 4 aa, Entamoeba histolytica
NEKT

SEQ ID NO: 2605430 - protein, 9 aa, Entamoeba histolytica
NEKTKREQL

SEQ ID NO: 2605431 - protein, 8 aa, Entamoeba histolytica
NEKVKGQP

SEQ ID NO: 2605432 - protein, 5 aa, Entamoeba histolytica
NELEE

SEQ ID NO: 2605433 - protein, 13 aa, Entamoeba histolytica
NELKKELEKVESE

SEQ ID NO: 2605434 - protein, 5 aa, Entamoeba histolytica
NENGE

SEQ ID NO: 2605435 - protein, 8 aa, Entamoeba histolytica
NENKTETK

SEQ ID NO: 2605436 - protein, 4 aa, Entamoeba histolytica
NENL

SEQ ID NO: 2605437 - protein, 5 aa, Entamoeba histolytica
NENQI

SEQ ID NO: 2605438 - protein, 4 aa, Entamoeba histolytica
NEPA

SEQ ID NO: 2605439 - protein, 21 aa, Entamoeba histolytica
NERKRETQKLKELKPEQRYPK

SEQ ID NO: 2605440 - protein, 8 aa, Entamoeba histolytica
NESTKELK

SEQ ID NO: 2605441 - protein, 9 aa, Entamoeba histolytica
NESTSVKSF

SEQ ID NO: 2605442 - protein, 26 aa, Entamoeba histolytica
NESYQHTKKEKQKAKKREVKNTERDK

SEQ ID NO: 2605443 - protein, 10 aa, Entamoeba histolytica
NETADKVKEY

SEQ ID NO: 2605444 - protein, 5 aa, Entamoeba histolytica
NETGL

SEQ ID NO: 2605445 - protein, 6 aa, Entamoeba histolytica
NETSPE

SEQ ID NO: 2605446 - protein, 25 aa, Entamoeba histolytica
NEVKAQEQAKEDKRKALQKKIETAG

SEQ ID NO: 2605447 - protein, 8 aa, Entamoeba histolytica
NFDSPSSF

SEQ ID NO: 2605448 - protein, 5 aa, Entamoeba histolytica
NFEQK

SEQ ID NO: 2605449 - protein, 4 aa, Entamoeba histolytica
NFQE

SEQ ID NO: 2605450 - protein, 7 aa, Entamoeba histolytica
NGAKNEI

SEQ ID NO: 2605451 - protein, 6 aa, Entamoeba histolytica
NGANNE

SEQ ID NO: 2605452 - protein, 4 aa, Entamoeba histolytica
NGDI

SEQ ID NO: 2605453 - protein, 5 aa, Entamoeba histolytica
NGDKT

SEQ ID NO: 2605454 - protein, 23 aa, Entamoeba histolytica
NGEKNAGISMRKDNKVQGSVDDM

SEQ ID NO: 2605455 - protein, 4 aa, Entamoeba histolytica
NGFE

SEQ ID NO: 2605456 - protein, 4 aa, Entamoeba histolytica
NGGD

SEQ ID NO: 2605457 - protein, 5 aa, Entamoeba histolytica
NGIGK

SEQ ID NO: 2605458 - protein, 5 aa, Entamoeba histolytica
NGKKK

SEQ ID NO: 2605459 - protein, 20 aa, Entamoeba histolytica
NGKLLKSKESKGVDQTYPKS

SEQ ID NO: 2605460 - protein, 14 aa, Entamoeba histolytica
NGKPAPESLGRPRD

SEQ ID NO: 2605461 - protein, 12 aa, Entamoeba histolytica
NGKPVNFLDKML

SEQ ID NO: 2605462 - protein, 5 aa, Entamoeba histolytica
NGKQQ

SEQ ID NO: 2605463 - protein, 4 aa, Entamoeba histolytica
NGKT

SEQ ID NO: 2605464 - protein, 6 aa, Entamoeba histolytica
NGKTLS

SEQ ID NO: 2605465 - protein, 8 aa, Entamoeba histolytica
NGKTQQTI

SEQ ID NO: 2605466 - protein, 10 aa, Entamoeba histolytica
NGKVSEEDAK

SEQ ID NO: 2605467 - protein, 8 aa, Entamoeba histolytica
NGLREKTA

SEQ ID NO: 2605468 - protein, 7 aa, Entamoeba histolytica
NGMNPQA

SEQ ID NO: 2605469 - protein, 4 aa, Entamoeba histolytica
NGNK

SEQ ID NO: 2605470 - protein, 5 aa, Entamoeba histolytica
NGNQI

SEQ ID NO: 2605471 - protein, 12 aa, Entamoeba histolytica
NGPENSPYEGGK

SEQ ID NO: 2605472 - protein, 7 aa, Entamoeba histolytica
NGPYVGL

SEQ ID NO: 2605473 - protein, 16 aa, Entamoeba histolytica
NGRAGTDGTTESPEYT

SEQ ID NO: 2605474 - protein, 5 aa, Entamoeba histolytica
NGRHV

SEQ ID NO: 2605475 - protein, 7 aa, Entamoeba histolytica
NGRRDTS

SEQ ID NO: 2605476 - protein, 14 aa, Entamoeba histolytica
NGSFSQAAKTEQEI

SEQ ID NO: 2605477 - protein, 4 aa, Entamoeba histolytica
NGTG

SEQ ID NO: 2605478 - protein, 4 aa, Entamoeba histolytica
NGTT

SEQ ID NO: 2605479 - protein, 7 aa, Entamoeba histolytica
NHENGCD

SEQ ID NO: 2605480 - protein, 8 aa, Entamoeba histolytica
NHEQTDVQ

SEQ ID NO: 2605481 - protein, 7 aa, Entamoeba histolytica
NHESRQI

SEQ ID NO: 2605482 - protein, 7 aa, Entamoeba histolytica
NHESRQV

SEQ ID NO: 2605483 - protein, 6 aa, Entamoeba histolytica
NHIEEE

SEQ ID NO: 2605484 - protein, 5 aa, Entamoeba histolytica
NHQNE

SEQ ID NO: 2605485 - protein, 33 aa, Entamoeba histolytica
NHQSDGANERNDTNQVNEEQHINEKEEDKRNEM

SEQ ID NO: 2605486 - protein, 4 aa, Entamoeba histolytica
NHRG

SEQ ID NO: 2605487 - protein, 7 aa, Entamoeba histolytica
NHSATFE

SEQ ID NO: 2605488 - protein, 13 aa, Entamoeba histolytica
NHSNEDTDKQRLT

SEQ ID NO: 2605489 - protein, 7 aa, Entamoeba histolytica
NHVPRTS

SEQ ID NO: 2605490 - protein, 9 aa, Entamoeba histolytica
NIEEGGHDI

SEQ ID NO: 2605491 - protein, 4 aa, Entamoeba histolytica
NIGE

SEQ ID NO: 2605492 - protein, 10 aa, Entamoeba histolytica
NIGSNEQRFG

SEQ ID NO: 2605493 - protein, 4 aa, Entamoeba histolytica
NIKT

SEQ ID NO: 2605494 - protein, 6 aa, Entamoeba histolytica
NIPSSI

SEQ ID NO: 2605495 - protein, 4 aa, Entamoeba histolytica
NIPT

SEQ ID NO: 2605496 - protein, 9 aa, Entamoeba histolytica
NIPTSVSKI

SEQ ID NO: 2605497 - protein, 5 aa, Entamoeba histolytica
NIQTR

SEQ ID NO: 2605498 - protein, 4 aa, Entamoeba histolytica
NISR

SEQ ID NO: 2605499 - protein, 14 aa, Entamoeba histolytica
NITGEKVKFAFPVV

SEQ ID NO: 2605500 - protein, 6 aa, Entamoeba histolytica
NITWSG

SEQ ID NO: 2605501 - protein, 4 aa, Entamoeba histolytica
NKDS

SEQ ID NO: 2605502 - protein, 7 aa, Entamoeba histolytica
NKEDDIT

SEQ ID NO: 2605503 - protein, 7 aa, Entamoeba histolytica
NKEEDFK

SEQ ID NO: 2605504 - protein, 9 aa, Entamoeba histolytica
NKEKRIEEI

SEQ ID NO: 2605505 - protein, 10 aa, Entamoeba histolytica
NKELRRRGSP

SEQ ID NO: 2605506 - protein, 7 aa, Entamoeba histolytica
NKEWSSI

SEQ ID NO: 2605507 - protein, 11 aa, Entamoeba histolytica
NKFGAEDMREE

SEQ ID NO: 2605508 - protein, 5 aa, Entamoeba histolytica
NKGIA

SEQ ID NO: 2605509 - protein, 4 aa, Entamoeba histolytica
NKGT

SEQ ID NO: 2605510 - protein, 6 aa, Entamoeba histolytica
NKKDKY

SEQ ID NO: 2605511 - protein, 4 aa, Entamoeba histolytica
NKKE

SEQ ID NO: 2605512 - protein, 22 aa, Entamoeba histolytica
NKKEEYVDNPFGEVSDDELKEV

SEQ ID NO: 2605513 - protein, 6 aa, Entamoeba histolytica
NKKERI

SEQ ID NO: 2605514 - protein, 10 aa, Entamoeba histolytica
NKKGQQNELV

SEQ ID NO: 2605515 - protein, 20 aa, Entamoeba histolytica
NKKKVDKKTFEKFKTKEENP

SEQ ID NO: 2605516 - protein, 9 aa, Entamoeba histolytica
NKKRKAKIY

SEQ ID NO: 2605517 - protein, 13 aa, Entamoeba histolytica
NKLTKQETEIYQS

SEQ ID NO: 2605518 - protein, 8 aa, Entamoeba histolytica
NKMDASKN

SEQ ID NO: 2605519 - protein, 15 aa, Entamoeba histolytica
NKNDTKMHQSNSSQI

SEQ ID NO: 2605520 - protein, 6 aa, Entamoeba histolytica
NKNKKT

SEQ ID NO: 2605521 - protein, 7 aa, Entamoeba histolytica
NKNNYLP

SEQ ID NO: 2605522 - protein, 5 aa, Entamoeba histolytica
NKPIK

SEQ ID NO: 2605523 - protein, 4 aa, Entamoeba histolytica
NKPK

SEQ ID NO: 2605524 - protein, 9 aa, Entamoeba histolytica
NKPLNSQDN

SEQ ID NO: 2605525 - protein, 9 aa, Entamoeba histolytica
NKPPSFKNP

SEQ ID NO: 2605526 - protein, 4 aa, Entamoeba histolytica
NKPS

SEQ ID NO: 2605527 - protein, 4 aa, Entamoeba histolytica
NKPT

SEQ ID NO: 2605528 - protein, 12 aa, Entamoeba histolytica
NKPTQSSNVSAL

SEQ ID NO: 2605529 - protein, 4 aa, Entamoeba histolytica
NKRD

SEQ ID NO: 2605530 - protein, 8 aa, Entamoeba histolytica
NKRTQREI

SEQ ID NO: 2605531 - protein, 6 aa, Entamoeba histolytica
NKRYGK

SEQ ID NO: 2605532 - protein, 6 aa, Entamoeba histolytica
NKSDLE

SEQ ID NO: 2605533 - protein, 4 aa, Entamoeba histolytica
NKSS

SEQ ID NO: 2605534 - protein, 51 aa, Entamoeba histolytica; identical to SEQ ID NO: 2569902

SEQ ID NO: 2605535 - protein, 23 aa, Entamoeba histolytica
NKSYGGLKSIEPHKRSKVKSCVI

SEQ ID NO: 2605536 - protein, 15 aa, Entamoeba histolytica
NKTENAVNGISIVKL

SEQ ID NO: 2605537 - protein, 5 aa, Entamoeba histolytica
NKTIK

SEQ ID NO: 2605538 - protein, 7 aa, Entamoeba histolytica
NKTPLSD

SEQ ID NO: 2605539 - protein, 4 aa, Entamoeba histolytica
NKTT

SEQ ID NO: 2605540 - protein, 4 aa, Entamoeba histolytica
NKVN

SEQ ID NO: 2605541 - protein, 8 aa, Entamoeba histolytica
NKYPHKRP

SEQ ID NO: 2605542 - protein, 8 aa, Entamoeba histolytica
NLDGRRKV

SEQ ID NO: 2605543 - protein, 9 aa, Entamoeba histolytica
NLDKSTAKK

SEQ ID NO: 2605544 - protein, 16 aa, Entamoeba histolytica
NLEQRKDQSKSQTSQV

SEQ ID NO: 2605545 - protein, 7 aa, Entamoeba histolytica
NLGPKGT

SEQ ID NO: 2605546 - protein, 15 aa, Entamoeba histolytica
NLKQNKDQSISQTSQ

SEQ ID NO: 2605547 - protein, 29 aa, Entamoeba histolytica
NLNKEEEKEEEEKPKEQEEIADDAFENDG

SEQ ID NO: 2605548 - protein, 5 aa, Entamoeba histolytica
NLPGA

SEQ ID NO: 2605549 - protein, 16 aa, Entamoeba histolytica
NLSENKVVNPDTLPEE

SEQ ID NO: 2605550 - protein, 14 aa, Entamoeba histolytica
NLSSLSPYEQEKLT

SEQ ID NO: 2605551 - protein, 13 aa, Entamoeba histolytica
NLTEENYKTKISS

SEQ ID NO: 2605552 - protein, 4 aa, Entamoeba histolytica
NMNK

SEQ ID NO: 2605553 - protein, 13 aa, Entamoeba histolytica
NNDEETLSKTRNE

SEQ ID NO: 2605554 - protein, 4 aa, Entamoeba histolytica
NNDI

SEQ ID NO: 2605555 - protein, 4 aa, Entamoeba histolytica
NNEI

SEQ ID NO: 2605556 - protein, 4 aa, Entamoeba histolytica
NNEM

SEQ ID NO: 2605557 - protein, 15 aa, Entamoeba histolytica
NNESSASQIPEKPIP

SEQ ID NO: 2605558 - protein, 9 aa, Entamoeba histolytica
NNGKPTVQT

SEQ ID NO: 2605559 - protein, 8 aa, Entamoeba histolytica
NNGNKGYP

SEQ ID NO: 2605560 - protein, 8 aa, Entamoeba histolytica
NNGSTDQS

SEQ ID NO: 2605561 - protein, 8 aa, Entamoeba histolytica
NNIPTNNS

SEQ ID NO: 2605562 - protein, 4 aa, Entamoeba histolytica
NNKI

SEQ ID NO: 2605563 - protein, 12 aa, Entamoeba histolytica
NNKKEKKGPVSL

SEQ ID NO: 2605564 - protein, 4 aa, Entamoeba histolytica
NNKN

SEQ ID NO: 2605565 - protein, 9 aa, Entamoeba histolytica
NNKYGKEDI

SEQ ID NO: 2605566 - protein, 10 aa, Entamoeba histolytica
NNLKEKEIKA

SEQ ID NO: 2605567 - protein, 8 aa, Entamoeba histolytica
NNNDEKEY

SEQ ID NO: 2605568 - protein, 6 aa, Entamoeba histolytica
NNNGKA

SEQ ID NO: 2605569 - protein, 13 aa, Entamoeba histolytica
NNNNYNNNNNASK

SEQ ID NO: 2605570 - protein, 6 aa, Entamoeba histolytica
NNPALD

SEQ ID NO: 2605571 - protein, 8 aa, Entamoeba histolytica
NNPEEMTS

SEQ ID NO: 2605572 - protein, 4 aa, Entamoeba histolytica
NNQI

SEQ ID NO: 2605573 - protein, 5 aa, Entamoeba histolytica
NNQTV

SEQ ID NO: 2605574 - protein, 7 aa, Entamoeba histolytica
NNQVCPK

SEQ ID NO: 2605575 - protein, 6 aa, Entamoeba histolytica
NNSELE

SEQ ID NO: 2605576 - protein, 4 aa, Entamoeba histolytica
NNSF

SEQ ID NO: 2605577 - protein, 4 aa, Entamoeba histolytica
NNSK

SEQ ID NO: 2605578 - protein, 4 aa, Entamoeba histolytica
NNSL

SEQ ID NO: 2605579 - protein, 4 aa, Entamoeba histolytica
NNSP

SEQ ID NO: 2605580 - protein, 6 aa, Entamoeba histolytica
NNSPLT

SEQ ID NO: 2605581 - protein, 10 aa, Entamoeba histolytica
NNSPTEHSLK

SEQ ID NO: 2605582 - protein, 8 aa, Entamoeba histolytica
NNSTQRKL

SEQ ID NO: 2605583 - protein, 4 aa, Entamoeba histolytica
NNTI

SEQ ID NO: 2605584 - protein, 17 aa, Entamoeba histolytica
NNVSKNKTRIEQTERKR

SEQ ID NO: 2605585 - protein, 24 aa, Entamoeba histolytica
NPAKVRRRVSEHPGWTIENRDVPL

SEQ ID NO: 2605586 - protein, 8 aa, Entamoeba histolytica
NPANPNTF

SEQ ID NO: 2605587 - protein, 5 aa, Entamoeba histolytica
NPEGP

SEQ ID NO: 2605588 - protein, 6 aa, Entamoeba histolytica
NPELPS

SEQ ID NO: 2605589 - protein, 13 aa, Entamoeba histolytica
NPERLKRKKHEEY

SEQ ID NO: 2605590 - protein, 4 aa, Entamoeba histolytica
NPIE

SEQ ID NO: 2605591 - protein, 5 aa, Entamoeba histolytica
NPIED

SEQ ID NO: 2605592 - protein, 7 aa, Entamoeba histolytica
NPIETTS

SEQ ID NO: 2605593 - protein, 26 aa, Entamoeba histolytica
NPIQPQNTKQNPFQQQNTQPQPQKDI

SEQ ID NO: 2605594 - protein, 8 aa, Entamoeba histolytica
NPKQRTPK

SEQ ID NO: 2605595 - protein, 17 aa, Entamoeba histolytica
NPNDNSSIRNQTTKDIE

SEQ ID NO: 2605596 - protein, 12 aa, Entamoeba histolytica
NPNKKKVSHSGV

SEQ ID NO: 2605597 - protein, 5 aa, Entamoeba histolytica
NPPYY

SEQ ID NO: 2605598 - protein, 5 aa, Entamoeba histolytica
NPQEW

SEQ ID NO: 2605599 - protein, 4 aa, Entamoeba histolytica
NPQN

SEQ ID NO: 2605600 - protein, 7 aa, Entamoeba histolytica
NPQREKI

SEQ ID NO: 2605601 - protein, 13 aa, Entamoeba histolytica
NPRTNSERKTNHK

SEQ ID NO: 2605602 - protein, 5 aa, Entamoeba histolytica
NPSDW

SEQ ID NO: 2605603 - protein, 11 aa, Entamoeba histolytica
NPSKPESIPQI

SEQ ID NO: 2605604 - protein, 5 aa, Entamoeba histolytica
NPSRI

SEQ ID NO: 2605605 - protein, 14 aa, Entamoeba histolytica
NPTCPLNNPNGFSD

SEQ ID NO: 2605606 - protein, 5 aa, Entamoeba histolytica
NPTWG

SEQ ID NO: 2605607 - protein, 28 aa, Entamoeba histolytica
NPVQPQNKTSQTGQNTQQQNTQQPQKDV

SEQ ID NO: 2605608 - protein, 30 aa, Entamoeba histolytica
NPVQQQNGTQNPFGQQQNGTQNPFGQQQTS

SEQ ID NO: 2605609 - protein, 16 aa, Entamoeba histolytica
NPVQSQNTQPQPQKDI

SEQ ID NO: 2605610 - protein, 7 aa, Entamoeba histolytica
NQEIPHE

SEQ ID NO: 2605611 - protein, 4 aa, Entamoeba histolytica
NQES

SEQ ID NO: 2605612 - protein, 22 aa, Entamoeba histolytica
NQFADAAEAEHFTNESDSEKYN

SEQ ID NO: 2605613 - protein, 6 aa, Entamoeba histolytica
NQIQPL

SEQ ID NO: 2605614 - protein, 5 aa, Entamoeba histolytica
NQKEM

SEQ ID NO: 2605615 - protein, 11 aa, Entamoeba histolytica
NQKIKKDENEL

SEQ ID NO: 2605616 - protein, 4 aa, Entamoeba histolytica
NQLP

SEQ ID NO: 2605617 - protein, 7 aa, Entamoeba histolytica
NQNKPSF

SEQ ID NO: 2605618 - protein, 8 aa, Entamoeba histolytica
NQPSDRRD

SEQ ID NO: 2605619 - protein, 11 aa, Entamoeba histolytica
NQPYTKTPIDK

SEQ ID NO: 2605620 - protein, 9 aa, Entamoeba histolytica
NQQNDNEDM

SEQ ID NO: 2605621 - protein, 6 aa, Entamoeba histolytica
NQRNGV

SEQ ID NO: 2605622 - protein, 6 aa, Entamoeba histolytica
NQRPDA

SEQ ID NO: 2605623 - protein, 4 aa, Entamoeba histolytica
NQSD

SEQ ID NO: 2605624 - protein, 7 aa, Entamoeba histolytica
NQSKIKS

SEQ ID NO: 2605625 - protein, 19 aa, Entamoeba histolytica
NQSSSQPVVSQPPNKQEAF

SEQ ID NO: 2605626 - protein, 8 aa, Entamoeba histolytica
NQSTDGVT

SEQ ID NO: 2605627 - protein, 7 aa, Entamoeba histolytica
NREGYLK

SEQ ID NO: 2605628 - protein, 7 aa, Entamoeba histolytica
NRGEPDG

SEQ ID NO: 2605629 - protein, 10 aa, Entamoeba histolytica
NRGKQYVTSD

SEQ ID NO: 2605630 - protein, 10 aa, Entamoeba histolytica
NRGPYANSIK

SEQ ID NO: 2605631 - protein, 9 aa, Entamoeba histolytica
NRKHEVDEL

SEQ ID NO: 2605632 - protein, 7 aa, Entamoeba histolytica
NRKRKYG

SEQ ID NO: 2605633 - protein, 5 aa, Entamoeba histolytica
NRNNS

SEQ ID NO: 2605634 - protein, 5 aa, Entamoeba histolytica
NRPDI

SEQ ID NO: 2605635 - protein, 8 aa, Entamoeba histolytica
NRPDTLDP

SEQ ID NO: 2605636 - protein, 4 aa, Entamoeba histolytica
NRPE

SEQ ID NO: 2605637 - protein, 5 aa, Entamoeba histolytica
NRPFD

SEQ ID NO: 2605638 - protein, 11 aa, Entamoeba histolytica
NRQGKETTPSV

SEQ ID NO: 2605639 - protein, 7 aa, Entamoeba histolytica
NRRDSAV

SEQ ID NO: 2605640 - protein, 7 aa, Entamoeba histolytica
NRSAPCD

SEQ ID NO: 2605641 - protein, 4 aa, Entamoeba histolytica
NRSR

SEQ ID NO: 2605642 - protein, 29 aa, Entamoeba histolytica
NRYQEPKKIETKEIQGSTNVQKKKTRFTL

SEQ ID NO: 2605643 - protein, 39 aa, Entamoeba histolytica
NSATPSNEQKPPVVTQAPPKPIPQQPTTKPPKKQSPSKG

SEQ ID NO: 2605644 - protein, 7 aa, Entamoeba histolytica
NSEDLSV

SEQ ID NO: 2605645 - protein, 4 aa, Entamoeba histolytica
NSEI

SEQ ID NO: 2605646 - protein, 5 aa, Entamoeba histolytica
NSESI

SEQ ID NO: 2605647 - protein, 7 aa, Entamoeba histolytica
NSGDIPI

SEQ ID NO: 2605648 - protein, 8 aa, Entamoeba histolytica
NSHEEETG

SEQ ID NO: 2605649 - protein, 13 aa, Entamoeba histolytica
NSIEDEEEDDEIG

SEQ ID NO: 2605650 - protein, 12 aa, Entamoeba histolytica
NSIEDEEEDEIG

SEQ ID NO: 2605651 - protein, 37 aa, Entamoeba histolytica
NSIKEEKKRIEEEKNQIINENKEIKEEKEKIEEEKKE

SEQ ID NO: 2605652 - protein, 13 aa, Entamoeba histolytica
NSKDEELNQQKKE

SEQ ID NO: 2605653 - protein, 10 aa, Entamoeba histolytica
NSKETTEQYQ

SEQ ID NO: 2605654 - protein, 4 aa, Entamoeba histolytica
NSKT

SEQ ID NO: 2605655 - protein, 9 aa, Entamoeba histolytica
NSLNESFDN

SEQ ID NO: 2605656 - protein, 21 aa, Entamoeba histolytica
NSLPNEKIEEKREEKEEKRIK

SEQ ID NO: 2605657 - protein, 4 aa, Entamoeba histolytica
NSND

SEQ ID NO: 2605658 - protein, 4 aa, Entamoeba histolytica
NSNE

SEQ ID NO: 2605659 - protein, 7 aa, Entamoeba histolytica
NSNKTPL

SEQ ID NO: 2605660 - protein, 22 aa, Entamoeba histolytica
NSNLSEKDKNELREELNEKESE

SEQ ID NO: 2605661 - protein, 5 aa, Entamoeba histolytica
NSNPF

SEQ ID NO: 2605662 - protein, 7 aa, Entamoeba histolytica
NSNRTSI

SEQ ID NO: 2605663 - protein, 4 aa, Entamoeba histolytica
NSPF

SEQ ID NO: 2605664 - protein, 7 aa, Entamoeba histolytica
NSPQQSP

SEQ ID NO: 2605665 - protein, 5 aa, Entamoeba histolytica
NSPTT

SEQ ID NO: 2605666 - protein, 4 aa, Entamoeba histolytica
NSQY

SEQ ID NO: 2605667 - protein, 6 aa, Entamoeba histolytica
NSSGIE

SEQ ID NO: 2605668 - protein, 13 aa, Entamoeba histolytica
NSSKFIEQLETMK

SEQ ID NO: 2605669 - protein, 7 aa, Entamoeba histolytica
NSSLHPE

SEQ ID NO: 2605670 - protein, 4 aa, Entamoeba histolytica
NSSQ

SEQ ID NO: 2605671 - protein, 4 aa, Entamoeba histolytica
NSYS

SEQ ID NO: 2605672 - protein, 7 aa, Entamoeba histolytica
NSYYNGA

SEQ ID NO: 2605673 - protein, 5 aa, Entamoeba histolytica
NTEKA

SEQ ID NO: 2605674 - protein, 4 aa, Entamoeba histolytica
NTEN

SEQ ID NO: 2605675 - protein, 6 aa, Entamoeba histolytica
NTGQGL

SEQ ID NO: 2605676 - protein, 28 aa, Entamoeba histolytica
NTIADQAKVNVNKQDDDEIYKSLFKSSQ

SEQ ID NO: 2605677 - protein, 8 aa, Entamoeba histolytica
NTKTPERY

SEQ ID NO: 2605678 - protein, 10 aa, Entamoeba histolytica
NTKYKEETKH

SEQ ID NO: 2605679 - protein, 4 aa, Entamoeba histolytica
NTLQ

SEQ ID NO: 2605680 - protein, 15 aa, Entamoeba histolytica
NTNRPPPPMTKEQTL

SEQ ID NO: 2605681 - protein, 8 aa, Entamoeba histolytica
NTPAEGVE

SEQ ID NO: 2605682 - protein, 7 aa, Entamoeba histolytica
NTPAVTN

SEQ ID NO: 2605683 - protein, 10 aa, Entamoeba histolytica
NTPIPSKETI

SEQ ID NO: 2605684 - protein, 24 aa, Entamoeba histolytica
NTPTQQVEEEIKEEEQQKQGNEIP

SEQ ID NO: 2605685 - protein, 6 aa, Entamoeba histolytica
NTQIEG

SEQ ID NO: 2605686 - protein, 16 aa, Entamoeba histolytica
NTQNSSIQIKDSKHRS

SEQ ID NO: 2605687 - protein, 6 aa, Entamoeba histolytica
NTRSSE

SEQ ID NO: 2605688 - protein, 4 aa, Entamoeba histolytica
NTSD

SEQ ID NO: 2605689 - protein, 9 aa, Entamoeba histolytica
NTSGREGKD

SEQ ID NO: 2605690 - protein, 9 aa, Entamoeba histolytica
NTTTSKPHR

SEQ ID NO: 2605691 - protein, 6 aa, Entamoeba histolytica
NTVNIE

SEQ ID NO: 2605692 - protein, 5 aa, Entamoeba histolytica
NTYSP

SEQ ID NO: 2605693 - protein, 5 aa, Entamoeba histolytica
NVGKS

SEQ ID NO: 2605694 - protein, 8 aa, Entamoeba histolytica
NVIKNEKT

SEQ ID NO: 2605695 - protein, 5 aa, Entamoeba histolytica
NVNEL

SEQ ID NO: 2605696 - protein, 6 aa, Entamoeba histolytica
NVQPIQ

SEQ ID NO: 2605697 - protein, 6 aa, Entamoeba histolytica
NWQNTQ

SEQ ID NO: 2605698 - protein, 13 aa, Entamoeba histolytica
NYDPDKDKRFAGS

SEQ ID NO: 2605699 - protein, 8 aa, Entamoeba histolytica
NYDSPEND

SEQ ID NO: 2605700 - protein, 18 aa, Entamoeba histolytica
NYKPTQKKEENDSKNILP

SEQ ID NO: 2605701 - protein, 17 aa, Entamoeba histolytica
NYKSKKEKKPKKNQISS

SEQ ID NO: 2605702 - protein, 4 aa, Entamoeba histolytica
NYPP

SEQ ID NO: 2605703 - protein, 5 aa, Entamoeba histolytica
NYPTK

SEQ ID NO: 2605704 - protein, 6 aa, Entamoeba histolytica
NYQGTN

SEQ ID NO: 2605705 - protein, 6 aa, Entamoeba histolytica
NYQPTI

SEQ ID NO: 2605706 - protein, 10 aa, Entamoeba histolytica
NYSETNTEDM

SEQ ID NO: 2605707 - protein, 5 aa, Entamoeba histolytica
PAIPY

SEQ ID NO: 2605708 - protein, 10 aa, Entamoeba histolytica
PANEPNDYPI

SEQ ID NO: 2605709 - protein, 12 aa, Entamoeba histolytica
PASNLKKTNGMD

SEQ ID NO: 2605710 - protein, 7 aa, Entamoeba histolytica
PATGKTA

SEQ ID NO: 2605711 - protein, 10 aa, Entamoeba histolytica
PCKSIDPDKA

SEQ ID NO: 2605712 - protein, 8 aa, Entamoeba histolytica
PDAHSGYG

SEQ ID NO: 2605713 - protein, 10 aa, Entamoeba histolytica
PDDSEQTQNN

SEQ ID NO: 2605714 - protein, 7 aa, Entamoeba histolytica
PDENGSV

SEQ ID NO: 2605715 - protein, 4 aa, Entamoeba histolytica
PDGE

SEQ ID NO: 2605716 - protein, 10 aa, Entamoeba histolytica
PDKEEERVEP

SEQ ID NO: 2605717 - protein, 11 aa, Entamoeba histolytica
PDLPISTKADF

SEQ ID NO: 2605718 - protein, 4 aa, Entamoeba histolytica
PDNY

SEQ ID NO: 2605719 - protein, 4 aa, Entamoeba histolytica
PDQF

SEQ ID NO: 2605720 - protein, 12 aa, Entamoeba histolytica
PDTSTGANSEVK

SEQ ID NO: 2605721 - protein, 20 aa, Entamoeba histolytica
PEDAFGSCGDKERSIEPNKE

SEQ ID NO: 2605722 - protein, 5 aa, Entamoeba histolytica
PEDIK

SEQ ID NO: 2605723 - protein, 5 aa, Entamoeba histolytica
PEDVR

SEQ ID NO: 2605724 - protein, 26 aa, Entamoeba histolytica
PEEIEAEKKRKEAKEAAKKAEPVGQS

SEQ ID NO: 2605725 - protein, 18 aa, Entamoeba histolytica
PEESETISIEEDKDLSTH

SEQ ID NO: 2605726 - protein, 7 aa, Entamoeba histolytica
PEKARQV

SEQ ID NO: 2605727 - protein, 9 aa, Entamoeba histolytica
PEKKIASYD

SEQ ID NO: 2605728 - protein, 20 aa, Entamoeba histolytica
PEKVKPVADAAPKETKKQGP

SEQ ID NO: 2605729 - protein, 5 aa, Entamoeba histolytica
PELRR

SEQ ID NO: 2605730 - protein, 7 aa, Entamoeba histolytica
PENQNGR

SEQ ID NO: 2605731 - protein, 8 aa, Entamoeba histolytica
PENTITDE

SEQ ID NO: 2605732 - protein, 10 aa, Entamoeba histolytica
PEQPGDLQRV

SEQ ID NO: 2605733 - protein, 7 aa, Entamoeba histolytica
PEQTKDL

SEQ ID NO: 2605734 - protein, 10 aa, Entamoeba histolytica
PERLDSEGNI

SEQ ID NO: 2605735 - protein, 5 aa, Entamoeba histolytica
PESKI

SEQ ID NO: 2605736 - protein, 8 aa, Entamoeba histolytica
PESQGCDY

SEQ ID NO: 2605737 - protein, 4 aa, Entamoeba histolytica
PETD

SEQ ID NO: 2605738 - protein, 4 aa, Entamoeba histolytica
PETL

SEQ ID NO: 2605739 - protein, 7 aa, Entamoeba histolytica
PETWSPS

SEQ ID NO: 2605740 - protein, 4 aa, Entamoeba histolytica
PEVE

SEQ ID NO: 2605741 - protein, 11 aa, Entamoeba histolytica
PEVIPGSTKDA

SEQ ID NO: 2605742 - protein, 6 aa, Entamoeba histolytica
PFGAPY

SEQ ID NO: 2605743 - protein, 4 aa, Entamoeba histolytica
PFPP

SEQ ID NO: 2605744 - protein, 12 aa, Entamoeba histolytica
PFSTTKKEFYSQ

SEQ ID NO: 2605745 - protein, 6 aa, Entamoeba histolytica
PFTSED

SEQ ID NO: 2605746 - protein, 11 aa, Entamoeba histolytica
PGCSKTTSINP

SEQ ID NO: 2605747 - protein, 5 aa, Entamoeba histolytica
PGCVP

SEQ ID NO: 2605748 - protein, 6 aa, Entamoeba histolytica
PGFNDN

SEQ ID NO: 2605749 - protein, 10 aa, Entamoeba histolytica
PGKTTITSDE

SEQ ID NO: 2605750 - protein, 31 aa, Entamoeba histolytica
PGMPPPPPGMPGMPPPPPGMPGMPPPPPGGF

SEQ ID NO: 2605751 - protein, 13 aa, Entamoeba histolytica
PGPKGQVITTGNG

SEQ ID NO: 2605752 - protein, 7 aa, Entamoeba histolytica
PGPNMNS

SEQ ID NO: 2605753 - protein, 4 aa, Entamoeba histolytica
PGRI

SEQ ID NO: 2605754 - protein, 4 aa, Entamoeba histolytica
PGRL

SEQ ID NO: 2605755 - protein, 5 aa, Entamoeba histolytica
PGSDT

SEQ ID NO: 2605756 - protein, 4 aa, Entamoeba histolytica
PGTM

SEQ ID NO: 2605757 - protein, 4 aa, Entamoeba histolytica
PGVG

SEQ ID NO: 2605758 - protein, 4 aa, Entamoeba histolytica
PGVS

SEQ ID NO: 2605759 - protein, 4 aa, Entamoeba histolytica
PHAK

SEQ ID NO: 2605760 - protein, 9 aa, Entamoeba histolytica
PHTSQNQSY

SEQ ID NO: 2605761 - protein, 12 aa, Entamoeba histolytica
PIKARTQGELVP

SEQ ID NO: 2605762 - protein, 4 aa, Entamoeba histolytica
PIKG

SEQ ID NO: 2605763 - protein, 5 aa, Entamoeba histolytica
PINNM

SEQ ID NO: 2605764 - protein, 4 aa, Entamoeba histolytica
PIPD

SEQ ID NO: 2605765 - protein, 15 aa, Entamoeba histolytica
PKALRESKKEKKLSK

SEQ ID NO: 2605766 - protein, 21 aa, Entamoeba histolytica
PKDTEKEYQQYKQNDQLRQKI

SEQ ID NO: 2605767 - protein, 9 aa, Entamoeba histolytica
PKERVRKDP

SEQ ID NO: 2605768 - protein, 6 aa, Entamoeba histolytica
PKGRKL

SEQ ID NO: 2605769 - protein, 11 aa, Entamoeba histolytica
PKGTSKAEYRL

SEQ ID NO: 2605770 - protein, 13 aa, Entamoeba histolytica
PKKGKGKRFWSPE

SEQ ID NO: 2605771 - protein, 23 aa, Entamoeba histolytica
PKKMRGSTSLVDGDGLKTGEVNI

SEQ ID NO: 2605772 - protein, 102 aa, Entamoeba histolytica
PKNKIKNEPKIEESKEEPKKEERRERGNDKHEERKTRQSEKRESRDKESKRESRDRERRDKESRDRESRRERDEHKRREHESRTEHSRRSRSRRRERSPRRK

SEQ ID NO: 2605773 - protein, 8 aa, Entamoeba histolytica
PKPKDTTQ

SEQ ID NO: 2605774 - protein, 12 aa, Entamoeba histolytica
PKPVEENREKRK

SEQ ID NO: 2605775 - protein, 18 aa, Entamoeba histolytica
PKQTKMKELAKKRTEQIE

SEQ ID NO: 2605776 - protein, 13 aa, Entamoeba histolytica
PKTEAFKPKKGKT

SEQ ID NO: 2605777 - protein, 4 aa, Entamoeba histolytica
PKTM

SEQ ID NO: 2605778 - protein, 9 aa, Entamoeba histolytica
PKTPSIEKS

SEQ ID NO: 2605779 - protein, 6 aa, Entamoeba histolytica
PKTSSM

SEQ ID NO: 2605780 - protein, 4 aa, Entamoeba histolytica
PKTV

SEQ ID NO: 2605781 - protein, 4 aa, Entamoeba histolytica
PKVD

SEQ ID NO: 2605782 - protein, 11 aa, Entamoeba histolytica
PKVKGKDSWAK

SEQ ID NO: 2605783 - protein, 8 aa, Entamoeba histolytica
PLASDNVE

SEQ ID NO: 2605784 - protein, 7 aa, Entamoeba histolytica
PLEGTPF

SEQ ID NO: 2605785 - protein, 8 aa, Entamoeba histolytica
PLGPAGSV

SEQ ID NO: 2605786 - protein, 8 aa, Entamoeba histolytica
PLKPSEKE

SEQ ID NO: 2605787 - protein, 5 aa, Entamoeba histolytica
PLPFE

SEQ ID NO: 2605788 - protein, 4 aa, Entamoeba histolytica
PLPG

SEQ ID NO: 2605789 - protein, 4 aa, Entamoeba histolytica
PLPS

SEQ ID NO: 2605790 - protein, 5 aa, Entamoeba histolytica
PLPTN

SEQ ID NO: 2605791 - protein, 4 aa, Entamoeba histolytica
PLSE

SEQ ID NO: 2605792 - protein, 7 aa, Entamoeba histolytica
PLSNSEV

SEQ ID NO: 2605793 - protein, 7 aa, Entamoeba histolytica
PLSPDQI

SEQ ID NO: 2605794 - protein, 4 aa, Entamoeba histolytica
PLTG

SEQ ID NO: 2605795 - protein, 4 aa, Entamoeba histolytica
PMGG

SEQ ID NO: 2605796 - protein, 15 aa, Entamoeba histolytica
PMRRTGQSYGRGEYF

SEQ ID NO: 2605797 - protein, 6 aa, Entamoeba histolytica
PMTPDS

SEQ ID NO: 2605798 - protein, 5 aa, Entamoeba histolytica
PMTPE

SEQ ID NO: 2605799 - protein, 4 aa, Entamoeba histolytica
PNCS

SEQ ID NO: 2605800 - protein, 5 aa, Entamoeba histolytica
PNEEN

SEQ ID NO: 2605801 - protein, 5 aa, Entamoeba histolytica
PNETN

SEQ ID NO: 2605802 - protein, 9 aa, Entamoeba histolytica
PNETPEISL

SEQ ID NO: 2605803 - protein, 5 aa, Entamoeba histolytica
PNGDR

SEQ ID NO: 2605804 - protein, 4 aa, Entamoeba histolytica
PNIE

SEQ ID NO: 2605805 - protein, 4 aa, Entamoeba histolytica
PNIN

SEQ ID NO: 2605806 - protein, 8 aa, Entamoeba histolytica
PNINEYKN

SEQ ID NO: 2605807 - protein, 5 aa, Entamoeba histolytica
PNITK

SEQ ID NO: 2605808 - protein, 4 aa, Entamoeba histolytica
PNIY

SEQ ID NO: 2605809 - protein, 8 aa, Entamoeba histolytica
PNKNETQK

SEQ ID NO: 2605810 - protein, 7 aa, Entamoeba histolytica
PNKPEEI

SEQ ID NO: 2605811 - protein, 4 aa, Entamoeba histolytica
PNMI

SEQ ID NO: 2605812 - protein, 11 aa, Entamoeba histolytica
PNPKPEDAITA

SEQ ID NO: 2605813 - protein, 5 aa, Entamoeba histolytica
PNSYK

SEQ ID NO: 2605814 - protein, 5 aa, Entamoeba histolytica
PPDGD

SEQ ID NO: 2605815 - protein, 6 aa, Entamoeba histolytica
PPGCGK

SEQ ID NO: 2605816 - protein, 7 aa, Entamoeba histolytica
PPGCGKT

SEQ ID NO: 2605817 - protein, 6 aa, Entamoeba histolytica
PPGEDL

SEQ ID NO: 2605818 - protein, 4 aa, Entamoeba histolytica
PPGI

SEQ ID NO: 2605819 - protein, 7 aa, Entamoeba histolytica
PPKIDPS

SEQ ID NO: 2605820 - protein, 4 aa, Entamoeba histolytica
PPLP

SEQ ID NO: 2605821 - protein, 5 aa, Entamoeba histolytica
PPLSP

SEQ ID NO: 2605822 - protein, 7 aa, Entamoeba histolytica
PPNQPFP

SEQ ID NO: 2605823 - protein, 4 aa, Entamoeba histolytica
PPPI

SEQ ID NO: 2605824 - protein, 12 aa, Entamoeba histolytica
PPRQPGSSIMPG

SEQ ID NO: 2605825 - protein, 7 aa, Entamoeba histolytica
PPSFDNV

SEQ ID NO: 2605826 - protein, 5 aa, Entamoeba histolytica
PPTQP

SEQ ID NO: 2605827 - protein, 5 aa, Entamoeba histolytica
PQAEN

SEQ ID NO: 2605828 - protein, 4 aa, Entamoeba histolytica
PQIT

SEQ ID NO: 2605829 - protein, 5 aa, Entamoeba histolytica
PQQET

SEQ ID NO: 2605830 - protein, 4 aa, Entamoeba histolytica
PQQQ

SEQ ID NO: 2605831 - protein, 4 aa, Entamoeba histolytica
PQRK

SEQ ID NO: 2605832 - protein, 8 aa, Entamoeba histolytica
PREGNGDS

SEQ ID NO: 2605833 - protein, 9 aa, Entamoeba histolytica
PRKQETRRS

SEQ ID NO: 2605834 - protein, 11 aa, Entamoeba histolytica
PRKSLEKSREV

SEQ ID NO: 2605835 - protein, 14 aa, Entamoeba histolytica
PRLNESKNIFNIRN

SEQ ID NO: 2605836 - protein, 4 aa, Entamoeba histolytica
PRQG

SEQ ID NO: 2605837 - protein, 7 aa, Entamoeba histolytica
PRRNDKE

SEQ ID NO: 2605838 - protein, 4 aa, Entamoeba histolytica
PRTS

SEQ ID NO: 2605839 - protein, 30 aa, Entamoeba histolytica; identical to SEQ ID NO: 2410038

SEQ ID NO: 2605840 - protein, 10 aa, Entamoeba histolytica
PRYPAPYPFG

SEQ ID NO: 2605841 - protein, 8 aa, Entamoeba histolytica
PSDANETR

SEQ ID NO: 2605842 - protein, 14 aa, Entamoeba histolytica
PSDGHQGLYTTKSD

SEQ ID NO: 2605843 - protein, 17 aa, Entamoeba histolytica
PSDLEKEIRNGRLKTDP

SEQ ID NO: 2605844 - protein, 8 aa, Entamoeba histolytica
PSENNGIK

SEQ ID NO: 2605845 - protein, 13 aa, Entamoeba histolytica
PSEPSGEENGVDK

SEQ ID NO: 2605846 - protein, 4 aa, Entamoeba histolytica
PSEY

SEQ ID NO: 2605847 - protein, 7 aa, Entamoeba histolytica
PSGDRCV

SEQ ID NO: 2605848 - protein, 13 aa, Entamoeba histolytica
PSGIPVHPTGRYN

SEQ ID NO: 2605849 - protein, 8 aa, Entamoeba histolytica
PSGNYGGW

SEQ ID NO: 2605850 - protein, 4 aa, Entamoeba histolytica
PSHT

SEQ ID NO: 2605851 - protein, 13 aa, Entamoeba histolytica
PSIDTSQWKREED

SEQ ID NO: 2605852 - protein, 4 aa, Entamoeba histolytica
PSIK

SEQ ID NO: 2605853 - protein, 8 aa, Entamoeba histolytica
PSKLRGVA

SEQ ID NO: 2605854 - protein, 6 aa, Entamoeba histolytica
PSLPEK

SEQ ID NO: 2605855 - protein, 10 aa, Entamoeba histolytica
PSLQESKEFN

SEQ ID NO: 2605856 - protein, 5 aa, Entamoeba histolytica
PSNFR

SEQ ID NO: 2605857 - protein, 4 aa, Entamoeba histolytica
PSNH

SEQ ID NO: 2605858 - protein, 7 aa, Entamoeba histolytica
PSNKTLP

SEQ ID NO: 2605859 - protein, 5 aa, Entamoeba histolytica
PSQYK

SEQ ID NO: 2605860 - protein, 7 aa, Entamoeba histolytica
PSRNPLS

SEQ ID NO: 2605861 - protein, 7 aa, Entamoeba histolytica
PSTRQLK

SEQ ID NO: 2605862 - protein, 7 aa, Entamoeba histolytica
PSVDHQA

SEQ ID NO: 2605863 - protein, 9 aa, Entamoeba histolytica
PSVEGNEER

SEQ ID NO: 2605864 - protein, 8 aa, Entamoeba histolytica
PSWAKYSR

SEQ ID NO: 2605865 - protein, 9 aa, Entamoeba histolytica
PSYKDETEE

SEQ ID NO: 2605866 - protein, 5 aa, Entamoeba histolytica
PTDED

SEQ ID NO: 2605867 - protein, 8 aa, Entamoeba histolytica
PTDTSLTK

SEQ ID NO: 2605868 - protein, 16 aa, Entamoeba histolytica
PTEADMGNSEVGHNAL

SEQ ID NO: 2605869 - protein, 7 aa, Entamoeba histolytica
PTESLKR

SEQ ID NO: 2605870 - protein, 10 aa, Entamoeba histolytica
PTIEDSYRKQ

SEQ ID NO: 2605871 - protein, 6 aa, Entamoeba histolytica
PTKPGE

SEQ ID NO: 2605872 - protein, 10 aa, Entamoeba histolytica
PTLPEKSHEN

SEQ ID NO: 2605873 - protein, 4 aa, Entamoeba histolytica
PTNV

SEQ ID NO: 2605874 - protein, 4 aa, Entamoeba histolytica
PTPE

SEQ ID NO: 2605875 - protein, 5 aa, Entamoeba histolytica
PTPEM

SEQ ID NO: 2605876 - protein, 7 aa, Entamoeba histolytica
PTPSYEG

SEQ ID NO: 2605877 - protein, 5 aa, Entamoeba histolytica
PTQSP

SEQ ID NO: 2605878 - protein, 5 aa, Entamoeba histolytica
PTSTI

SEQ ID NO: 2605879 - protein, 4 aa, Entamoeba histolytica
PTTK

SEQ ID NO: 2605880 - protein, 45 aa, Entamoeba histolytica; identical to SEQ ID NO: 2410084

SEQ ID NO: 2605881 - protein, 11 aa, Entamoeba histolytica
PVDASKDGIKA

SEQ ID NO: 2605882 - protein, 11 aa, Entamoeba histolytica
PVQQKEAKQVL

SEQ ID NO: 2605883 - protein, 6 aa, Entamoeba histolytica
PVRIPT

SEQ ID NO: 2605884 - protein, 16 aa, Entamoeba histolytica
PVSTPNNGLSPRSKGF

SEQ ID NO: 2605885 - protein, 18 aa, Entamoeba histolytica
PVTEPTPSSPFIHIQRFE

SEQ ID NO: 2605886 - protein, 9 aa, Entamoeba histolytica
QAANDLNIK

SEQ ID NO: 2605887 - protein, 11 aa, Entamoeba histolytica
QACEAAQKENI

SEQ ID NO: 2605888 - protein, 5 aa, Entamoeba histolytica
QAESI

SEQ ID NO: 2605889 - protein, 7 aa, Entamoeba histolytica
QAEVNEI

SEQ ID NO: 2605890 - protein, 6 aa, Entamoeba histolytica
QAPEHL

SEQ ID NO: 2605891 - protein, 5 aa, Entamoeba histolytica
QATFN

SEQ ID NO: 2605892 - protein, 8 aa, Entamoeba histolytica
QATMPPQK

SEQ ID NO: 2605893 - protein, 11 aa, Entamoeba histolytica
QDDIRQNNYEN

SEQ ID NO: 2605894 - protein, 9 aa, Entamoeba histolytica
QDEPTKNDP

SEQ ID NO: 2605895 - protein, 6 aa, Entamoeba histolytica
QDIPRR

SEQ ID NO: 2605896 - protein, 6 aa, Entamoeba histolytica
QDNQEI

SEQ ID NO: 2605897 - protein, 9 aa, Entamoeba histolytica
QDRQSPETI

SEQ ID NO: 2605898 - protein, 90 aa, Entamoeba histolytica
QDSEATSKKHKKYEKSKEKKKMEEEDDDSESESDSGSESESDSESDDHKEDDKDSDTTEKESSNGEEKESSTGEEKEVKKDAVKNVERKE

SEQ ID NO: 2605899 - protein, 11 aa, Entamoeba histolytica
QDSEVGDGTTT

SEQ ID NO: 2605900 - protein, 21 aa, Entamoeba histolytica
QDSIDKKKKEINEKEEEREKL

SEQ ID NO: 2605901 - protein, 6 aa, Entamoeba histolytica
QDTIQK

SEQ ID NO: 2605902 - protein, 14 aa, Entamoeba histolytica
QEANKDAFIPYPFV

SEQ ID NO: 2605903 - protein, 16 aa, Entamoeba histolytica
QEAQRLAGKKEQMEKN

SEQ ID NO: 2605904 - protein, 5 aa, Entamoeba histolytica
QEEIE

SEQ ID NO: 2605905 - protein, 4 aa, Entamoeba histolytica
QEEL

SEQ ID NO: 2605906 - protein, 7 aa, Entamoeba histolytica
QEEQENK

SEQ ID NO: 2605907 - protein, 4 aa, Entamoeba histolytica
QEER

SEQ ID NO: 2605908 - protein, 5 aa, Entamoeba histolytica
QEERR

SEQ ID NO: 2605909 - protein, 5 aa, Entamoeba histolytica
QEGAY

SEQ ID NO: 2605910 - protein, 4 aa, Entamoeba histolytica
QEGF

SEQ ID NO: 2605911 - protein, 9 aa, Entamoeba histolytica
QEGIQGPYE

SEQ ID NO: 2605912 - protein, 9 aa, Entamoeba histolytica
QEHSRDNYN

SEQ ID NO: 2605913 - protein, 4 aa, Entamoeba histolytica
QEIE

SEQ ID NO: 2605914 - protein, 7 aa, Entamoeba histolytica
QEISESV

SEQ ID NO: 2605915 - protein, 8 aa, Entamoeba histolytica
QEKKIRKK

SEQ ID NO: 2605916 - protein, 14 aa, Entamoeba histolytica
QEKPKKNKKEKCII

SEQ ID NO: 2605917 - protein, 24 aa, Entamoeba histolytica
QEKTNEDLMSQTQKGIKRKRREID

SEQ ID NO: 2605918 - protein, 12 aa, Entamoeba histolytica
QEKYEKTQSRVE

SEQ ID NO: 2605919 - protein, 8 aa, Entamoeba histolytica
QELKNTIK

SEQ ID NO: 2605920 - protein, 7 aa, Entamoeba histolytica
QENDKKL

SEQ ID NO: 2605921 - protein, 18 aa, Entamoeba histolytica
QEQENSPRSNQQTTNDCS

SEQ ID NO: 2605922 - protein, 10 aa, Entamoeba histolytica
QESDTGLAPV

SEQ ID NO: 2605923 - protein, 7 aa, Entamoeba histolytica
QESEGEI

SEQ ID NO: 2605924 - protein, 10 aa, Entamoeba histolytica
QESEIPTSVS

SEQ ID NO: 2605925 - protein, 8 aa, Entamoeba histolytica
QESQGQYQ

SEQ ID NO: 2605926 - protein, 4 aa, Entamoeba histolytica
QETF

SEQ ID NO: 2605927 - protein, 16 aa, Entamoeba histolytica
QETINKKENRVDEDIP

SEQ ID NO: 2605928 - protein, 14 aa, Entamoeba histolytica
QEVLKRSEADHWTN

SEQ ID NO: 2605929 - protein, 7 aa, Entamoeba histolytica
QFNPTQD

SEQ ID NO: 2605930 - protein, 14 aa, Entamoeba histolytica
QFRRRREGKTDYYA

SEQ ID NO: 2605931 - protein, 5 aa, Entamoeba histolytica
QFTEA

SEQ ID NO: 2605932 - protein, 7 aa, Entamoeba histolytica
QGCSGYR

SEQ ID NO: 2605933 - protein, 5 aa, Entamoeba histolytica
QGDFG

SEQ ID NO: 2605934 - protein, 8 aa, Entamoeba histolytica
QGKSLEEI

SEQ ID NO: 2605935 - protein, 6 aa, Entamoeba histolytica
QGPTIA

SEQ ID NO: 2605936 - protein, 6 aa, Entamoeba histolytica
QGTSYI

SEQ ID NO: 2605937 - protein, 4 aa, Entamoeba histolytica
QGTT

SEQ ID NO: 2605938 - protein, 23 aa, Entamoeba histolytica
QHQDTSAPVEAAPVAEEKGEVVE

SEQ ID NO: 2605939 - protein, 4 aa, Entamoeba histolytica
QIPD

SEQ ID NO: 2605940 - protein, 4 aa, Entamoeba histolytica
QIPT

SEQ ID NO: 2605941 - protein, 4 aa, Entamoeba histolytica
QIPW

SEQ ID NO: 2605942 - protein, 12 aa, Entamoeba histolytica
QISTKGSIPKRV

SEQ ID NO: 2605943 - protein, 21 aa, Entamoeba histolytica
QITSSQPLSSGLPGNDSLRQA

SEQ ID NO: 2605944 - protein, 33 aa, Entamoeba histolytica
QKEKTSSNAVQNNAPAKPFQEKDVQQNNPLTQQ

SEQ ID NO: 2605945 - protein, 9 aa, Entamoeba histolytica
QKESPDYNP

SEQ ID NO: 2605946 - protein, 4 aa, Entamoeba histolytica
QKFE

SEQ ID NO: 2605947 - protein, 10 aa, Entamoeba histolytica
QKGIDKDEPI

SEQ ID NO: 2605948 - protein, 4 aa, Entamoeba histolytica
QKGW

SEQ ID NO: 2605949 - protein, 8 aa, Entamoeba histolytica
QKISNGVR

SEQ ID NO: 2605950 - protein, 8 aa, Entamoeba histolytica
QKKHTEAL

SEQ ID NO: 2605951 - protein, 22 aa, Entamoeba histolytica
QKKVNGDECCEGKENGYKPSEL

SEQ ID NO: 2605952 - protein, 6 aa, Entamoeba histolytica
QKLQET

SEQ ID NO: 2605953 - protein, 6 aa, Entamoeba histolytica
QKNKEG

SEQ ID NO: 2605954 - protein, 13 aa, Entamoeba histolytica
QKQEYAKKIQNKR

SEQ ID NO: 2605955 - protein, 5 aa, Entamoeba histolytica
QKQKE

SEQ ID NO: 2605956 - protein, 14 aa, Entamoeba histolytica
QKQNKTKFIQKEEN

SEQ ID NO: 2605957 - protein, 21 aa, Entamoeba histolytica
QKTENPQDATKILDSITLLID

SEQ ID NO: 2605958 - protein, 12 aa, Entamoeba histolytica
QKTQERIYEDEQ

SEQ ID NO: 2605959 - protein, 11 aa, Entamoeba histolytica
QKVAGKVTAVR

SEQ ID NO: 2605960 - protein, 14 aa, Entamoeba histolytica
QLEKGKKEKEQYKE

SEQ ID NO: 2605961 - protein, 13 aa, Entamoeba histolytica
QLEKVSKNIEEKV

SEQ ID NO: 2605962 - protein, 51 aa, Entamoeba histolytica
QLERPNERTPLERGASIDRPPIDTKPSLDKVSERTPQDLQSRPQVDRTQRV

SEQ ID NO: 2605963 - protein, 4 aa, Entamoeba histolytica
QLGG

SEQ ID NO: 2605964 - protein, 10 aa, Entamoeba histolytica
QLPQPPAQYQ

SEQ ID NO: 2605965 - protein, 7 aa, Entamoeba histolytica
QLSDPTV

SEQ ID NO: 2605966 - protein, 4 aa, Entamoeba histolytica
QLTE

SEQ ID NO: 2605967 - protein, 4 aa, Entamoeba histolytica
QMEK

SEQ ID NO: 2605968 - protein, 10 aa, Entamoeba histolytica
QMTGKINEGG

SEQ ID NO: 2605969 - protein, 10 aa, Entamoeba histolytica
QNAGEDETFN

SEQ ID NO: 2605970 - protein, 7 aa, Entamoeba histolytica
QNASSQI

SEQ ID NO: 2605971 - protein, 4 aa, Entamoeba histolytica
QNDI

SEQ ID NO: 2605972 - protein, 4 aa, Entamoeba histolytica
QNEI

SEQ ID NO: 2605973 - protein, 5 aa, Entamoeba histolytica
QNENK

SEQ ID NO: 2605974 - protein, 6 aa, Entamoeba histolytica
QNENKE

SEQ ID NO: 2605975 - protein, 18 aa, Entamoeba histolytica
QNLKPKGLDLGSDKSGNI

SEQ ID NO: 2605976 - protein, 4 aa, Entamoeba histolytica
QNNQ

SEQ ID NO: 2605977 - protein, 11 aa, Entamoeba histolytica
QNNSRKEKGCK

SEQ ID NO: 2605978 - protein, 9 aa, Entamoeba histolytica
QNQDEIVKE

SEQ ID NO: 2605979 - protein, 4 aa, Entamoeba histolytica
QNQL

SEQ ID NO: 2605980 - protein, 4 aa, Entamoeba histolytica
QNQM

SEQ ID NO: 2605981 - protein, 6 aa, Entamoeba histolytica
QNQMPL

SEQ ID NO: 2605982 - protein, 4 aa, Entamoeba histolytica
QNSS

SEQ ID NO: 2605983 - protein, 20 aa, Entamoeba histolytica
QNTKKCPSCGDRIQKNGGCN

SEQ ID NO: 2605984 - protein, 8 aa, Entamoeba histolytica
QNVAQGAT

SEQ ID NO: 2605985 - protein, 5 aa, Entamoeba histolytica
QNVPN

SEQ ID NO: 2605986 - protein, 9 aa, Entamoeba histolytica
QPAKVRPNS

SEQ ID NO: 2605987 - protein, 6 aa, Entamoeba histolytica
QPALQT

SEQ ID NO: 2605988 - protein, 4 aa, Entamoeba histolytica
QPEQ

SEQ ID NO: 2605989 - protein, 5 aa, Entamoeba histolytica
QPESL

SEQ ID NO: 2605990 - protein, 7 aa, Entamoeba histolytica
QPGESKN

SEQ ID NO: 2605991 - protein, 5 aa, Entamoeba histolytica
QPGNC

SEQ ID NO: 2605992 - protein, 4 aa, Entamoeba histolytica
QPIQ

SEQ ID NO: 2605993 - protein, 7 aa, Entamoeba histolytica
QPISYGA

SEQ ID NO: 2605994 - protein, 9 aa, Entamoeba histolytica
QPNENNELP

SEQ ID NO: 2605995 - protein, 7 aa, Entamoeba histolytica
QPNSNEL

SEQ ID NO: 2605996 - protein, 6 aa, Entamoeba histolytica
QPPLTY

SEQ ID NO: 2605997 - protein, 15 aa, Entamoeba histolytica
QPQPIKTSPDAPISV

SEQ ID NO: 2605998 - protein, 7 aa, Entamoeba histolytica
QPQQQQA

SEQ ID NO: 2605999 - protein, 4 aa, Entamoeba histolytica
QPRR

SEQ ID NO: 2606000 - protein, 7 aa, Entamoeba histolytica
QPRSSIN

SEQ ID NO: 2606001 - protein, 4 aa, Entamoeba histolytica
QPTN

SEQ ID NO: 2606002 - protein, 9 aa, Entamoeba histolytica
QPVNIPEGT

SEQ ID NO: 2606003 - protein, 36 aa, Entamoeba histolytica
QQEEEKKKRKELLEKEQNKEKEEEKRTKIEKTRDRE

SEQ ID NO: 2606004 - protein, 5 aa, Entamoeba histolytica
QQIPK

SEQ ID NO: 2606005 - protein, 25 aa, Entamoeba histolytica
QQIPTNDSSKGITQTPLSKPQTAET

SEQ ID NO: 2606006 - protein, 5 aa, Entamoeba histolytica
QQLRG

SEQ ID NO: 2606007 - protein, 4 aa, Entamoeba histolytica
QQLS

SEQ ID NO: 2606008 - protein, 5 aa, Entamoeba histolytica
QQNDF

SEQ ID NO: 2606009 - protein, 17 aa, Entamoeba histolytica
QQNTQQPNTQTQPQKDI

SEQ ID NO: 2606010 - protein, 12 aa, Entamoeba histolytica
QQPMKREPEGFN

SEQ ID NO: 2606011 - protein, 11 aa, Entamoeba histolytica
QQYTDQYNQFP

SEQ ID NO: 2606012 - protein, 5 aa, Entamoeba histolytica
QRAIT

SEQ ID NO: 2606013 - protein, 9 aa, Entamoeba histolytica
QRDLPVKGP

SEQ ID NO: 2606014 - protein, 6 aa, Entamoeba histolytica
QRDNEI

SEQ ID NO: 2606015 - protein, 4 aa, Entamoeba histolytica
QREG

SEQ ID NO: 2606016 - protein, 12 aa, Entamoeba histolytica
QRELTESEKENI

SEQ ID NO: 2606017 - protein, 17 aa, Entamoeba histolytica
QREQQTQYLEERKNRKE

SEQ ID NO: 2606018 - protein, 8 aa, Entamoeba histolytica
QRKDEGFE

SEQ ID NO: 2606019 - protein, 10 aa, Entamoeba histolytica
QRLPQPPSFE

SEQ ID NO: 2606020 - protein, 4 aa, Entamoeba histolytica
QRSE

SEQ ID NO: 2606021 - protein, 7 aa, Entamoeba histolytica
QRYEKRH

SEQ ID NO: 2606022 - protein, 7 aa, Entamoeba histolytica
QSASPKQ

SEQ ID NO: 2606023 - protein, 8 aa, Entamoeba histolytica
QSDGKSSF

SEQ ID NO: 2606024 - protein, 7 aa, Entamoeba histolytica
QSGCAEE

SEQ ID NO: 2606025 - protein, 8 aa, Entamoeba histolytica
QSGEESAI

SEQ ID NO: 2606026 - protein, 12 aa, Entamoeba histolytica
QSGGYPDNLPPV

SEQ ID NO: 2606027 - protein, 7 aa, Entamoeba histolytica
QSGYVSP

SEQ ID NO: 2606028 - protein, 4 aa, Entamoeba histolytica
QSIG

SEQ ID NO: 2606029 - protein, 4 aa, Entamoeba histolytica
QSIK

SEQ ID NO: 2606030 - protein, 5 aa, Entamoeba histolytica
QSIPI

SEQ ID NO: 2606031 - protein, 4 aa, Entamoeba histolytica
QSKN

SEQ ID NO: 2606032 - protein, 10 aa, Entamoeba histolytica
QSKNQQVQTL

SEQ ID NO: 2606033 - protein, 8 aa, Entamoeba histolytica
QSKNTKPQ

SEQ ID NO: 2606034 - protein, 15 aa, Entamoeba histolytica
QSKSTAQNVSATPQK

SEQ ID NO: 2606035 - protein, 4 aa, Entamoeba histolytica
QSLP

SEQ ID NO: 2606036 - protein, 4 aa, Entamoeba histolytica
QSLQ

SEQ ID NO: 2606037 - protein, 17 aa, Entamoeba histolytica
QSPPPAQPLLNLIKQVA

SEQ ID NO: 2606038 - protein, 7 aa, Entamoeba histolytica
QSQHSST

SEQ ID NO: 2606039 - protein, 6 aa, Entamoeba histolytica
QSSPNE

SEQ ID NO: 2606040 - protein, 7 aa, Entamoeba histolytica
QTASESK

SEQ ID NO: 2606041 - protein, 11 aa, Entamoeba histolytica
QTDKKDKTKSY

SEQ ID NO: 2606042 - protein, 5 aa, Entamoeba histolytica
QTDPS

SEQ ID NO: 2606043 - protein, 5 aa, Entamoeba histolytica
QTEEI

SEQ ID NO: 2606044 - protein, 6 aa, Entamoeba histolytica
QTESSI

SEQ ID NO: 2606045 - protein, 4 aa, Entamoeba histolytica
QTIN

SEQ ID NO: 2606046 - protein, 14 aa, Entamoeba histolytica
QTKKETEEANTRKF

SEQ ID NO: 2606047 - protein, 4 aa, Entamoeba histolytica
QTKL

SEQ ID NO: 2606048 - protein, 6 aa, Entamoeba histolytica
QTNPKI

SEQ ID NO: 2606049 - protein, 7 aa, Entamoeba histolytica
QTPPPFE

SEQ ID NO: 2606050 - protein, 9 aa, Entamoeba histolytica
QTPRDIQQI

SEQ ID NO: 2606051 - protein, 7 aa, Entamoeba histolytica
QTQFQQQ

SEQ ID NO: 2606052 - protein, 4 aa, Entamoeba histolytica
QTQR

SEQ ID NO: 2606053 - protein, 15 aa, Entamoeba histolytica
QTQRERRSDESIEIG

SEQ ID NO: 2606054 - protein, 11 aa, Entamoeba histolytica
QTSTEKSLEVS

SEQ ID NO: 2606055 - protein, 11 aa, Entamoeba histolytica
QTTQSQRWDKP

SEQ ID NO: 2606056 - protein, 14 aa, Entamoeba histolytica
QVEESEDKKQEFEK

SEQ ID NO: 2606057 - protein, 6 aa, Entamoeba histolytica
QVGRKS

SEQ ID NO: 2606058 - protein, 8 aa, Entamoeba histolytica
QVKTADDG

SEQ ID NO: 2606059 - protein, 12 aa, Entamoeba histolytica
QVTQRKGYKKGN

SEQ ID NO: 2606060 - protein, 9 aa, Entamoeba histolytica
QYTARNGSN

SEQ ID NO: 2606061 - protein, 4 aa, Entamoeba histolytica
QYYD

SEQ ID NO: 2606062 - protein, 5 aa, Entamoeba histolytica
QYYDN

SEQ ID NO: 2606063 - protein, 6 aa, Entamoeba histolytica
QYYQTA

SEQ ID NO: 2606064 - protein, 9 aa, Entamoeba histolytica
RAAENAKSL

SEQ ID NO: 2606065 - protein, 17 aa, Entamoeba histolytica
RAATSQDDIVGDGTTST

SEQ ID NO: 2606066 - protein, 25 aa, Entamoeba histolytica
RADYEKEIEEIKKKNEEDKKREEEL

SEQ ID NO: 2606067 - protein, 10 aa, Entamoeba histolytica
RAGIGATDLK

SEQ ID NO: 2606068 - protein, 13 aa, Entamoeba histolytica
RARRSYRRSPKLK

SEQ ID NO: 2606069 - protein, 8 aa, Entamoeba histolytica
RCENSGVA

SEQ ID NO: 2606070 - protein, 7 aa, Entamoeba histolytica
RCKPGKC

SEQ ID NO: 2606071 - protein, 12 aa, Entamoeba histolytica
RCTAGSAKYHPE

SEQ ID NO: 2606072 - protein, 13 aa, Entamoeba histolytica
RDEETDKEKKPVR

SEQ ID NO: 2606073 - protein, 6 aa, Entamoeba histolytica
RDEFGT

SEQ ID NO: 2606074 - protein, 6 aa, Entamoeba histolytica
RDFTKR

SEQ ID NO: 2606075 - protein, 4 aa, Entamoeba histolytica
RDHL

SEQ ID NO: 2606076 - protein, 9 aa, Entamoeba histolytica
RDKLDEDID

SEQ ID NO: 2606077 - protein, 6 aa, Entamoeba histolytica
RDKQQE

SEQ ID NO: 2606078 - protein, 32 aa, Entamoeba histolytica; identical to SEQ ID NO: 2410335

SEQ ID NO: 2606079 - protein, 4 aa, Entamoeba histolytica
RDPE

SEQ ID NO: 2606080 - protein, 13 aa, Entamoeba histolytica
RDRKRVSRSSEAC

SEQ ID NO: 2606081 - protein, 10 aa, Entamoeba histolytica
RDSPPLPKIS

SEQ ID NO: 2606082 - protein, 4 aa, Entamoeba histolytica
REEE

SEQ ID NO: 2606083 - protein, 4 aa, Entamoeba histolytica
REEL

SEQ ID NO: 2606084 - protein, 16 aa, Entamoeba histolytica
REGEDKDKKQGNPTDV

SEQ ID NO: 2606085 - protein, 11 aa, Entamoeba histolytica
REHPPSSIQSI

SEQ ID NO: 2606086 - protein, 13 aa, Entamoeba histolytica
REIKEAKAGTPLF

SEQ ID NO: 2606087 - protein, 21 aa, Entamoeba histolytica
REKERNRVKEEIKETNRYGDA

SEQ ID NO: 2606088 - protein, 4 aa, Entamoeba histolytica
REKG

SEQ ID NO: 2606089 - protein, 11 aa, Entamoeba histolytica
REKSENERREV

SEQ ID NO: 2606090 - protein, 11 aa, Entamoeba histolytica
RENEEQEKERM

SEQ ID NO: 2606091 - protein, 8 aa, Entamoeba histolytica
RENTTDDE

SEQ ID NO: 2606092 - protein, 9 aa, Entamoeba histolytica
RERAEKSDA

SEQ ID NO: 2606093 - protein, 15 aa, Entamoeba histolytica
RERSMDVRNKEEGGM

SEQ ID NO: 2606094 - protein, 4 aa, Entamoeba histolytica
RESC

SEQ ID NO: 2606095 - protein, 9 aa, Entamoeba histolytica
RESKTYEAI

SEQ ID NO: 2606096 - protein, 4 aa, Entamoeba histolytica
RETF

SEQ ID NO: 2606097 - protein, 11 aa, Entamoeba histolytica
REYPNSLKDGD

SEQ ID NO: 2606098 - protein, 12 aa, Entamoeba histolytica
RFAGAGENEEAL

SEQ ID NO: 2606099 - protein, 10 aa, Entamoeba histolytica
RFTPGSFTNQ

SEQ ID NO: 2606100 - protein, 11 aa, Entamoeba histolytica
RGEAKEKFEGD

SEQ ID NO: 2606101 - protein, 13 aa, Entamoeba histolytica
RGEMKKEEEEAEE

SEQ ID NO: 2606102 - protein, 11 aa, Entamoeba histolytica
RGIRQGKTGKC

SEQ ID NO: 2606103 - protein, 4 aa, Entamoeba histolytica
RGKI

SEQ ID NO: 2606104 - protein, 7 aa, Entamoeba histolytica
RGNGITE

SEQ ID NO: 2606105 - protein, 10 aa, Entamoeba histolytica
RGNRKVSARK

SEQ ID NO: 2606106 - protein, 5 aa, Entamoeba histolytica
RGRKC

SEQ ID NO: 2606107 - protein, 4 aa, Entamoeba histolytica
RGRM

SEQ ID NO: 2606108 - protein, 4 aa, Entamoeba histolytica
RGRT

SEQ ID NO: 2606109 - protein, 7 aa, Entamoeba histolytica
RGSMDSA

SEQ ID NO: 2606110 - protein, 8 aa, Entamoeba histolytica
RGVETDEL

SEQ ID NO: 2606111 - protein, 7 aa, Entamoeba histolytica
RGYKPAV

SEQ ID NO: 2606112 - protein, 22 aa, Entamoeba histolytica
RGYSGISAEEIAKRKQTQSSEV

SEQ ID NO: 2606113 - protein, 4 aa, Entamoeba histolytica
RHIG

SEQ ID NO: 2606114 - protein, 10 aa, Entamoeba histolytica
RHNGGRDYSD

SEQ ID NO: 2606115 - protein, 19 aa, Entamoeba histolytica
RHTGHGKRKGTKNARTPQK

SEQ ID NO: 2606116 - protein, 21 aa, Entamoeba histolytica
RIDAGNSSTIDKLSDRDKYYS

SEQ ID NO: 2606117 - protein, 12 aa, Entamoeba histolytica
RIDSGNSSTIDK

SEQ ID NO: 2606118 - protein, 5 aa, Entamoeba histolytica
RIGET

SEQ ID NO: 2606119 - protein, 10 aa, Entamoeba histolytica
RIGYDGSVTY

SEQ ID NO: 2606120 - protein, 11 aa, Entamoeba histolytica
RIKQESQCPPM

SEQ ID NO: 2606121 - protein, 13 aa, Entamoeba histolytica
RINTSKKEIPSQI

SEQ ID NO: 2606122 - protein, 5 aa, Entamoeba histolytica
RIPGS

SEQ ID NO: 2606123 - protein, 11 aa, Entamoeba histolytica
RKEAGAHGKDT

SEQ ID NO: 2606124 - protein, 20 aa, Entamoeba histolytica
RKEKELKKGIEEKAQEMNEI

SEQ ID NO: 2606125 - protein, 4 aa, Entamoeba histolytica
RKEN

SEQ ID NO: 2606126 - protein, 6 aa, Entamoeba histolytica
RKEQDI

SEQ ID NO: 2606127 - protein, 7 aa, Entamoeba histolytica
RKESAAV

SEQ ID NO: 2606128 - protein, 15 aa, Entamoeba histolytica
RKETTGFPPNQTVDT

SEQ ID NO: 2606129 - protein, 15 aa, Entamoeba histolytica
RKEYQKAKTDVNKRQ

SEQ ID NO: 2606130 - protein, 5 aa, Entamoeba histolytica
RKFEE

SEQ ID NO: 2606131 - protein, 9 aa, Entamoeba histolytica
RKGISNTKR

SEQ ID NO: 2606132 - protein, 4 aa, Entamoeba histolytica
RKHD

SEQ ID NO: 2606133 - protein, 15 aa, Entamoeba histolytica
RKIEELQEEGEKTRE

SEQ ID NO: 2606134 - protein, 4 aa, Entamoeba histolytica
RKIN

SEQ ID NO: 2606135 - protein, 6 aa, Entamoeba histolytica
RKKQSD

SEQ ID NO: 2606136 - protein, 6 aa, Entamoeba histolytica
RKKRNR

SEQ ID NO: 2606137 - protein, 16 aa, Entamoeba histolytica
RKKTNKKGRNQQETKV

SEQ ID NO: 2606138 - protein, 7 aa, Entamoeba histolytica
RKLKEVK

SEQ ID NO: 2606139 - protein, 19 aa, Entamoeba histolytica
RKLKNKESARKSRQKSKEA

SEQ ID NO: 2606140 - protein, 11 aa, Entamoeba histolytica
RKNAPPPSELK

SEQ ID NO: 2606141 - protein, 22 aa, Entamoeba histolytica
RKPKETDTITAEFNKKKEEWQT

SEQ ID NO: 2606142 - protein, 4 aa, Entamoeba histolytica
RKRK

SEQ ID NO: 2606143 - protein, 11 aa, Entamoeba histolytica
RKSLEKSKEVL

SEQ ID NO: 2606144 - protein, 14 aa, Entamoeba histolytica
RKSYYTKKYPNSTI

SEQ ID NO: 2606145 - protein, 5 aa, Entamoeba histolytica
RKTIG

SEQ ID NO: 2606146 - protein, 4 aa, Entamoeba histolytica
RKYT

SEQ ID NO: 2606147 - protein, 13 aa, Entamoeba histolytica
RLEELEREEEAKR

SEQ ID NO: 2606148 - protein, 5 aa, Entamoeba histolytica
RLGTC

SEQ ID NO: 2606149 - protein, 46 aa, Entamoeba histolytica
RLPSKEKSSGKKKTRSSSSNNEVEENDEKEEINQEGKDKEKRVSKE

SEQ ID NO: 2606150 - protein, 5 aa, Entamoeba histolytica
RLSEG

SEQ ID NO: 2606151 - protein, 4 aa, Entamoeba histolytica
RLSG

SEQ ID NO: 2606152 - protein, 19 aa, Entamoeba histolytica
RLVPEGDKLVGSKNPRYLQ

SEQ ID NO: 2606153 - protein, 12 aa, Entamoeba histolytica
RMESDKKRKAEL

SEQ ID NO: 2606154 - protein, 16 aa, Entamoeba histolytica
RMEYEDSISTESPANC

SEQ ID NO: 2606155 - protein, 9 aa, Entamoeba histolytica
RNAGNGEVE

SEQ ID NO: 2606156 - protein, 6 aa, Entamoeba histolytica
RNAQKR

SEQ ID NO: 2606157 - protein, 5 aa, Entamoeba histolytica
RNASD

SEQ ID NO: 2606158 - protein, 8 aa, Entamoeba histolytica
RNASSVDT

SEQ ID NO: 2606159 - protein, 6 aa, Entamoeba histolytica
RNGTHI

SEQ ID NO: 2606160 - protein, 9 aa, Entamoeba histolytica
RNITEKSKK

SEQ ID NO: 2606161 - protein, 9 aa, Entamoeba histolytica
RNLTRDLSN

SEQ ID NO: 2606162 - protein, 10 aa, Entamoeba histolytica
RNQENPYRAQ

SEQ ID NO: 2606163 - protein, 15 aa, Entamoeba histolytica
RNRAGEQLKNGGQKF

SEQ ID NO: 2606164 - protein, 18 aa, Entamoeba histolytica
RNRAVAATKCNAQSSRSH

SEQ ID NO: 2606165 - protein, 6 aa, Entamoeba histolytica
RNREED

SEQ ID NO: 2606166 - protein, 9 aa, Entamoeba histolytica
RNRSNNPVL

SEQ ID NO: 2606167 - protein, 5 aa, Entamoeba histolytica
RNSKI

SEQ ID NO: 2606168 - protein, 18 aa, Entamoeba histolytica
RNTTNQVSPCEEQTNSII

SEQ ID NO: 2606169 - protein, 6 aa, Entamoeba histolytica
RNVDEQ

SEQ ID NO: 2606170 - protein, 17 aa, Entamoeba histolytica
RNYGNGSRTCRKCGARK

SEQ ID NO: 2606171 - protein, 4 aa, Entamoeba histolytica
RPED

SEQ ID NO: 2606172 - protein, 5 aa, Entamoeba histolytica
RPGRL

SEQ ID NO: 2606173 - protein, 24 aa, Entamoeba histolytica
RPKDGFRRQCDSKTIEQFLLKFIK

SEQ ID NO: 2606174 - protein, 7 aa, Entamoeba histolytica
RPKNGRS

SEQ ID NO: 2606175 - protein, 8 aa, Entamoeba histolytica
RPPENEEN

SEQ ID NO: 2606176 - protein, 6 aa, Entamoeba histolytica
RPRSFK

SEQ ID NO: 2606177 - protein, 10 aa, Entamoeba histolytica
RPSDVDYEDV

SEQ ID NO: 2606178 - protein, 5 aa, Entamoeba histolytica
RPTIG

SEQ ID NO: 2606179 - protein, 9 aa, Entamoeba histolytica
RPTKQQEIK

SEQ ID NO: 2606180 - protein, 10 aa, Entamoeba histolytica
RPTTKTNPSL

SEQ ID NO: 2606181 - protein, 32 aa, Entamoeba histolytica
RQEKREEEKKKKDEQEEKKKKDEQEERQKKIT

SEQ ID NO: 2606182 - protein, 11 aa, Entamoeba histolytica
RQETTSKNSEE

SEQ ID NO: 2606183 - protein, 7 aa, Entamoeba histolytica
RQKFTPR

SEQ ID NO: 2606184 - protein, 8 aa, Entamoeba histolytica
RQQKIGEA

SEQ ID NO: 2606185 - protein, 10 aa, Entamoeba histolytica
RQQQEIEEKE

SEQ ID NO: 2606186 - protein, 4 aa, Entamoeba histolytica
RQQV

SEQ ID NO: 2606187 - protein, 6 aa, Entamoeba histolytica
RQSFES

SEQ ID NO: 2606188 - protein, 20 aa, Entamoeba histolytica
RREKRRSSEISIKKEKKNIE

SEQ ID NO: 2606189 - protein, 5 aa, Entamoeba histolytica
RRKGL

SEQ ID NO: 2606190 - protein, 8 aa, Entamoeba histolytica
RRSKKEVE

SEQ ID NO: 2606191 - protein, 17 aa, Entamoeba histolytica
RRYEGFSSSLGEQTDIK

SEQ ID NO: 2606192 - protein, 6 aa, Entamoeba histolytica
RSASVA

SEQ ID NO: 2606193 - protein, 7 aa, Entamoeba histolytica
RSDNTLD

SEQ ID NO: 2606194 - protein, 9 aa, Entamoeba histolytica
RSDTGQDPF

SEQ ID NO: 2606195 - protein, 15 aa, Entamoeba histolytica
RSEEEARKKAAEIKG

SEQ ID NO: 2606196 - protein, 11 aa, Entamoeba histolytica
RSEGGKEITDV

SEQ ID NO: 2606197 - protein, 4 aa, Entamoeba histolytica
RSGY

SEQ ID NO: 2606198 - protein, 7 aa, Entamoeba histolytica
RSHVTQE

SEQ ID NO: 2606199 - protein, 5 aa, Entamoeba histolytica
RSIKG

SEQ ID NO: 2606200 - protein, 8 aa, Entamoeba histolytica
RSKKTSKT

SEQ ID NO: 2606201 - protein, 9 aa, Entamoeba histolytica
RSKRRGIRD

SEQ ID NO: 2606202 - protein, 14 aa, Entamoeba histolytica
RSKSKTRRHYTKLT

SEQ ID NO: 2606203 - protein, 28 aa, Entamoeba histolytica
RSKTEKKKKEIQKEEEIPKITEEEKEKY

SEQ ID NO: 2606204 - protein, 6 aa, Entamoeba histolytica
RSLPKK

SEQ ID NO: 2606205 - protein, 6 aa, Entamoeba histolytica
RSNNNA

SEQ ID NO: 2606206 - protein, 6 aa, Entamoeba histolytica
RSPADS

SEQ ID NO: 2606207 - protein, 7 aa, Entamoeba histolytica
RSPEEFS

SEQ ID NO: 2606208 - protein, 5 aa, Entamoeba histolytica
RSSFR

SEQ ID NO: 2606209 - protein, 8 aa, Entamoeba histolytica
RSVDEGQT

SEQ ID NO: 2606210 - protein, 4 aa, Entamoeba histolytica
RTAR

SEQ ID NO: 2606211 - protein, 7 aa, Entamoeba histolytica
RTARSIR

SEQ ID NO: 2606212 - protein, 5 aa, Entamoeba histolytica
RTEPN

SEQ ID NO: 2606213 - protein, 4 aa, Entamoeba histolytica
RTGG

SEQ ID NO: 2606214 - protein, 11 aa, Entamoeba histolytica
RTHNDVLSNDS

SEQ ID NO: 2606215 - protein, 6 aa, Entamoeba histolytica
RTHNEI

SEQ ID NO: 2606216 - protein, 4 aa, Entamoeba histolytica
RTIS

SEQ ID NO: 2606217 - protein, 13 aa, Entamoeba histolytica
RTLRNTDKLPGHD

SEQ ID NO: 2606218 - protein, 7 aa, Entamoeba histolytica
RTPDPSK

SEQ ID NO: 2606219 - protein, 11 aa, Entamoeba histolytica
RTQVDGEKDID

SEQ ID NO: 2606220 - protein, 6 aa, Entamoeba histolytica
RTQVNK

SEQ ID NO: 2606221 - protein, 6 aa, Entamoeba histolytica
RTSFDN

SEQ ID NO: 2606222 - protein, 4 aa, Entamoeba histolytica
RTSM

SEQ ID NO: 2606223 - protein, 7 aa, Entamoeba histolytica
RTSSLEN

SEQ ID NO: 2606224 - protein, 6 aa, Entamoeba histolytica
RTTGKI

SEQ ID NO: 2606225 - protein, 13 aa, Entamoeba histolytica
RTTNIIGDKGRRI

SEQ ID NO: 2606226 - protein, 8 aa, Entamoeba histolytica
RTVPGNKF

SEQ ID NO: 2606227 - protein, 17 aa, Entamoeba histolytica
RTVTENKSNKNTSDCVV

SEQ ID NO: 2606228 - protein, 9 aa, Entamoeba histolytica
RVDESNEAV

SEQ ID NO: 2606229 - protein, 11 aa, Entamoeba histolytica
RVDGDGKGYIS

SEQ ID NO: 2606230 - protein, 5 aa, Entamoeba histolytica
RVNGQ

SEQ ID NO: 2606231 - protein, 7 aa, Entamoeba histolytica
RVQRGED

SEQ ID NO: 2606232 - protein, 13 aa, Entamoeba histolytica
RYENGRNGKFSVS

SEQ ID NO: 2606233 - protein, 13 aa, Entamoeba histolytica
RYNEGKKGVANAE

SEQ ID NO: 2606234 - protein, 5 aa, Entamoeba histolytica
RYPNN

SEQ ID NO: 2606235 - protein, 10 aa, Entamoeba histolytica
RYPPNTPSSI

SEQ ID NO: 2606236 - protein, 12 aa, Entamoeba histolytica
RYSEGKQGMASA

SEQ ID NO: 2606237 - protein, 5 aa, Entamoeba histolytica
RYSTK

SEQ ID NO: 2606238 - protein, 17 aa, Entamoeba histolytica
SAAYEEWKSKNKPEDRP

SEQ ID NO: 2606239 - protein, 4 aa, Entamoeba histolytica
SADE

SEQ ID NO: 2606240 - protein, 16 aa, Entamoeba histolytica
SADGYSGVEVRKNGSK

SEQ ID NO: 2606241 - protein, 17 aa, Entamoeba histolytica
SADVNNARLNPKCPGMS

SEQ ID NO: 2606242 - protein, 9 aa, Entamoeba histolytica
SAEGLSAKQ

SEQ ID NO: 2606243 - protein, 14 aa, Entamoeba histolytica
SAKNRPAGADAGQF

SEQ ID NO: 2606244 - protein, 7 aa, Entamoeba histolytica
SAKTNIN

SEQ ID NO: 2606245 - protein, 7 aa, Entamoeba histolytica
SANEECT

SEQ ID NO: 2606246 - protein, 4 aa, Entamoeba histolytica
SAPI

SEQ ID NO: 2606247 - protein, 6 aa, Entamoeba histolytica
SAPSWL

SEQ ID NO: 2606248 - protein, 7 aa, Entamoeba histolytica
SASTDRK

SEQ ID NO: 2606249 - protein, 6 aa, Entamoeba histolytica
SATTNL

SEQ ID NO: 2606250 - protein, 6 aa, Entamoeba histolytica
SAVKVN

SEQ ID NO: 2606251 - protein, 5 aa, Entamoeba histolytica
SAVSP

SEQ ID NO: 2606252 - protein, 8 aa, Entamoeba histolytica
SAYLDSEQ

SEQ ID NO: 2606253 - protein, 4 aa, Entamoeba histolytica
SCAN

SEQ ID NO: 2606254 - protein, 7 aa, Entamoeba histolytica
SDAMGRD

SEQ ID NO: 2606255 - protein, 5 aa, Entamoeba histolytica
SDASI

SEQ ID NO: 2606256 - protein, 9 aa, Entamoeba histolytica
SDAVPGYNT

SEQ ID NO: 2606257 - protein, 6 aa, Entamoeba histolytica
SDCYEG

SEQ ID NO: 2606258 - protein, 8 aa, Entamoeba histolytica
SDDQEIEQ

SEQ ID NO: 2606259 - protein, 5 aa, Entamoeba histolytica
SDDSD

SEQ ID NO: 2606260 - protein, 7 aa, Entamoeba histolytica
SDEEMPE

SEQ ID NO: 2606261 - protein, 4 aa, Entamoeba histolytica
SDEL

SEQ ID NO: 2606262 - protein, 16 aa, Entamoeba histolytica
SDEQHTEEKKPKFSSF

SEQ ID NO: 2606263 - protein, 8 aa, Entamoeba histolytica
SDESKDDL

SEQ ID NO: 2606264 - protein, 7 aa, Entamoeba histolytica
SDGAEFN

SEQ ID NO: 2606265 - protein, 6 aa, Entamoeba histolytica
SDGFGE

SEQ ID NO: 2606266 - protein, 17 aa, Entamoeba histolytica
SDGQLTEKGEIKEDIQG

SEQ ID NO: 2606267 - protein, 4 aa, Entamoeba histolytica
SDIE

SEQ ID NO: 2606268 - protein, 10 aa, Entamoeba histolytica
SDISDEDKKH

SEQ ID NO: 2606269 - protein, 4 aa, Entamoeba histolytica
SDKI

SEQ ID NO: 2606270 - protein, 7 aa, Entamoeba histolytica
SDNDTRL

SEQ ID NO: 2606271 - protein, 5 aa, Entamoeba histolytica
SDNKS

SEQ ID NO: 2606272 - protein, 7 aa, Entamoeba histolytica
SDNNEEA

SEQ ID NO: 2606273 - protein, 7 aa, Entamoeba histolytica
SDNSLKN

SEQ ID NO: 2606274 - protein, 15 aa, Entamoeba histolytica
SDNTNINLSSQSKIR

SEQ ID NO: 2606275 - protein, 9 aa, Entamoeba histolytica
SDQQDTLET

SEQ ID NO: 2606276 - protein, 9 aa, Entamoeba histolytica
SDQTRDTLP

SEQ ID NO: 2606277 - protein, 4 aa, Entamoeba histolytica
SDQY

SEQ ID NO: 2606278 - protein, 5 aa, Entamoeba histolytica
SDSPC

SEQ ID NO: 2606279 - protein, 4 aa, Entamoeba histolytica
SDSS

SEQ ID NO: 2606280 - protein, 9 aa, Entamoeba histolytica
SDSSEFGGY

SEQ ID NO: 2606281 - protein, 5 aa, Entamoeba histolytica
SDTFG

SEQ ID NO: 2606282 - protein, 5 aa, Entamoeba histolytica
SDVKN

SEQ ID NO: 2606283 - protein, 8 aa, Entamoeba histolytica
SDYIPSSY

SEQ ID NO: 2606284 - protein, 6 aa, Entamoeba histolytica
SDYNGD

SEQ ID NO: 2606285 - protein, 5 aa, Entamoeba histolytica
SEADV

SEQ ID NO: 2606286 - protein, 7 aa, Entamoeba histolytica
SEDEREM

SEQ ID NO: 2606287 - protein, 4 aa, Entamoeba histolytica
SEDG

SEQ ID NO: 2606288 - protein, 24 aa, Entamoeba histolytica
SEEGFGQEDPKLKTLNEPKEGDYK

SEQ ID NO: 2606289 - protein, 4 aa, Entamoeba histolytica
SEEI

SEQ ID NO: 2606290 - protein, 9 aa, Entamoeba histolytica
SEEKYNIPN

SEQ ID NO: 2606291 - protein, 4 aa, Entamoeba histolytica
SEGV

SEQ ID NO: 2606292 - protein, 9 aa, Entamoeba histolytica
SEGVPTQPR

SEQ ID NO: 2606293 - protein, 5 aa, Entamoeba histolytica
SEHNI

SEQ ID NO: 2606294 - protein, 11 aa, Entamoeba histolytica
SEHSKQKEDVG

SEQ ID NO: 2606295 - protein, 11 aa, Entamoeba histolytica
SEIKTSQRVEN

SEQ ID NO: 2606296 - protein, 5 aa, Entamoeba histolytica
SEKGN

SEQ ID NO: 2606297 - protein, 9 aa, Entamoeba histolytica
SEKGNTQTW

SEQ ID NO: 2606298 - protein, 7 aa, Entamoeba histolytica
SEKKNEI

SEQ ID NO: 2606299 - protein, 7 aa, Entamoeba histolytica
SEKQCPD

SEQ ID NO: 2606300 - protein, 11 aa, Entamoeba histolytica
SELSGGEQQRV

SEQ ID NO: 2606301 - protein, 8 aa, Entamoeba histolytica
SENETNPV

SEQ ID NO: 2606302 - protein, 4 aa, Entamoeba histolytica
SENG

SEQ ID NO: 2606303 - protein, 9 aa, Entamoeba histolytica
SERSQAEQL

SEQ ID NO: 2606304 - protein, 6 aa, Entamoeba histolytica
SERYVE

SEQ ID NO: 2606305 - protein, 9 aa, Entamoeba histolytica
SESDAIDPI

SEQ ID NO: 2606306 - protein, 4 aa, Entamoeba histolytica
SESG

SEQ ID NO: 2606307 - protein, 6 aa, Entamoeba histolytica
SESQLN

SEQ ID NO: 2606308 - protein, 5 aa, Entamoeba histolytica
SESRE

SEQ ID NO: 2606309 - protein, 5 aa, Entamoeba histolytica
SESSA

SEQ ID NO: 2606310 - protein, 6 aa, Entamoeba histolytica
SETPGM

SEQ ID NO: 2606311 - protein, 8 aa, Entamoeba histolytica
SETTRDEW

SEQ ID NO: 2606312 - protein, 6 aa, Entamoeba histolytica
SEYSHQ

SEQ ID NO: 2606313 - protein, 6 aa, Entamoeba histolytica
SEYTNN

SEQ ID NO: 2606314 - protein, 6 aa, Entamoeba histolytica
SFHGNL

SEQ ID NO: 2606315 - protein, 4 aa, Entamoeba histolytica
SFND

SEQ ID NO: 2606316 - protein, 7 aa, Entamoeba histolytica
SFNGKSE

SEQ ID NO: 2606317 - protein, 4 aa, Entamoeba histolytica
SFNN

SEQ ID NO: 2606318 - protein, 6 aa, Entamoeba histolytica
SFSPSG

SEQ ID NO: 2606319 - protein, 42 aa, Entamoeba histolytica
SFSTDNVNEGTDLKSPKPSSNNGSLVGTEESPRLLSPRDPTH

SEQ ID NO: 2606320 - protein, 11 aa, Entamoeba histolytica
SFTKKESNVAS

SEQ ID NO: 2606321 - protein, 9 aa, Entamoeba histolytica
SFTQEDPRF

SEQ ID NO: 2606322 - protein, 8 aa, Entamoeba histolytica
SGADKKDL

SEQ ID NO: 2606323 - protein, 5 aa, Entamoeba histolytica
SGAKG

SEQ ID NO: 2606324 - protein, 6 aa, Entamoeba histolytica
SGAPRV

SEQ ID NO: 2606325 - protein, 18 aa, Entamoeba histolytica
SGESLKDAEKRYKEREPA

SEQ ID NO: 2606326 - protein, 18 aa, Entamoeba histolytica
SGETRDDLKLPEGEMGQK

SEQ ID NO: 2606327 - protein, 8 aa, Entamoeba histolytica
SGEYATNC

SEQ ID NO: 2606328 - protein, 11 aa, Entamoeba histolytica
SGGREQNSDQQ

SEQ ID NO: 2606329 - protein, 9 aa, Entamoeba histolytica
SGGSDGPID

SEQ ID NO: 2606330 - protein, 8 aa, Entamoeba histolytica
SGIGKTEL

SEQ ID NO: 2606331 - protein, 7 aa, Entamoeba histolytica
SGKNNTK

SEQ ID NO: 2606332 - protein, 12 aa, Entamoeba histolytica
SGKTKETCKGRD

SEQ ID NO: 2606333 - protein, 8 aa, Entamoeba histolytica
SGLTADAR

SEQ ID NO: 2606334 - protein, 9 aa, Entamoeba histolytica
SGLTKGPDS

SEQ ID NO: 2606335 - protein, 6 aa, Entamoeba histolytica
SGNKYR

SEQ ID NO: 2606336 - protein, 8 aa, Entamoeba histolytica
SGPGLKTG

SEQ ID NO: 2606337 - protein, 5 aa, Entamoeba histolytica
SGPLC

SEQ ID NO: 2606338 - protein, 7 aa, Entamoeba histolytica
SGRFKPN

SEQ ID NO: 2606339 - protein, 9 aa, Entamoeba histolytica
SGRHKQDKE

SEQ ID NO: 2606340 - protein, 6 aa, Entamoeba histolytica
SGRQEL

SEQ ID NO: 2606341 - protein, 6 aa, Entamoeba histolytica
SGSRDK

SEQ ID NO: 2606342 - protein, 6 aa, Entamoeba histolytica
SGTETE

SEQ ID NO: 2606343 - protein, 10 aa, Entamoeba histolytica
SGTSGNPKGV

SEQ ID NO: 2606344 - protein, 4 aa, Entamoeba histolytica
SGVG

SEQ ID NO: 2606345 - protein, 9 aa, Entamoeba histolytica
SGVPGEGEH

SEQ ID NO: 2606346 - protein, 12 aa, Entamoeba histolytica
SGWSKSKEYSDI

SEQ ID NO: 2606347 - protein, 21 aa, Entamoeba histolytica
SGYDKSNKENEFNKEFDSEKV

SEQ ID NO: 2606348 - protein, 10 aa, Entamoeba histolytica
SHCTSSRDHH

SEQ ID NO: 2606349 - protein, 5 aa, Entamoeba histolytica
SHDET

SEQ ID NO: 2606350 - protein, 5 aa, Entamoeba histolytica
SHENA

SEQ ID NO: 2606351 - protein, 6 aa, Entamoeba histolytica
SHSSSA

SEQ ID NO: 2606352 - protein, 11 aa, Entamoeba histolytica
SIAKLQDPRTV

SEQ ID NO: 2606353 - protein, 4 aa, Entamoeba histolytica
SIDD

SEQ ID NO: 2606354 - protein, 4 aa, Entamoeba histolytica
SIDG

SEQ ID NO: 2606355 - protein, 23 aa, Entamoeba histolytica
SIDNSGTGTSSASGSTTNSSTGL

SEQ ID NO: 2606356 - protein, 13 aa, Entamoeba histolytica
SIDQSKKQTSLSD

SEQ ID NO: 2606357 - protein, 13 aa, Entamoeba histolytica
SIGTDPYPYKCMK

SEQ ID NO: 2606358 - protein, 18 aa, Entamoeba histolytica
SIKQINEKSIHKSSDNHN

SEQ ID NO: 2606359 - protein, 6 aa, Entamoeba histolytica
SINNTD

SEQ ID NO: 2606360 - protein, 43 aa, Entamoeba histolytica
SINSSTSSPFLKPKKSPVEEDEDEWDTWQSRQQKAKTPTLATD

SEQ ID NO: 2606361 - protein, 11 aa, Entamoeba histolytica
SIQDKKPSEDI

SEQ ID NO: 2606362 - protein, 4 aa, Entamoeba histolytica
SIQE

SEQ ID NO: 2606363 - protein, 6 aa, Entamoeba histolytica
SIRSKQ

SEQ ID NO: 2606364 - protein, 8 aa, Entamoeba histolytica
SISKNGNV

SEQ ID NO: 2606365 - protein, 11 aa, Entamoeba histolytica
SISSSCDGDAY

SEQ ID NO: 2606366 - protein, 4 aa, Entamoeba histolytica
SITP

SEQ ID NO: 2606367 - protein, 5 aa, Entamoeba histolytica
SITSF

SEQ ID NO: 2606368 - protein, 14 aa, Entamoeba histolytica
SKCHGNTPCPTTPC

SEQ ID NO: 2606369 - protein, 8 aa, Entamoeba histolytica
SKDYETTH

SEQ ID NO: 2606370 - protein, 7 aa, Entamoeba histolytica
SKEITNN

SEQ ID NO: 2606371 - protein, 15 aa, Entamoeba histolytica
SKENVTKENTTSTFC

SEQ ID NO: 2606372 - protein, 8 aa, Entamoeba histolytica
SKESGDGI

SEQ ID NO: 2606373 - protein, 6 aa, Entamoeba histolytica
SKIGGS

SEQ ID NO: 2606374 - protein, 4 aa, Entamoeba histolytica
SKIS

SEQ ID NO: 2606375 - protein, 10 aa, Entamoeba histolytica
SKKEKEADEF

SEQ ID NO: 2606376 - protein, 6 aa, Entamoeba histolytica
SKKFQE

SEQ ID NO: 2606377 - protein, 5 aa, Entamoeba histolytica
SKKNG

SEQ ID NO: 2606378 - protein, 12 aa, Entamoeba histolytica
SKKQRNVQERKY

SEQ ID NO: 2606379 - protein, 16 aa, Entamoeba histolytica
SKKSKNIKPSKLTPNM

SEQ ID NO: 2606380 - protein, 4 aa, Entamoeba histolytica
SKKV

SEQ ID NO: 2606381 - protein, 12 aa, Entamoeba histolytica
SKNKEGKNDPDA

SEQ ID NO: 2606382 - protein, 5 aa, Entamoeba histolytica
SKNNI

SEQ ID NO: 2606383 - protein, 9 aa, Entamoeba histolytica
SKQNNSNKE

SEQ ID NO: 2606384 - protein, 7 aa, Entamoeba histolytica
SKQRPRK

SEQ ID NO: 2606385 - protein, 9 aa, Entamoeba histolytica
SKRTVTRAY

SEQ ID NO: 2606386 - protein, 4 aa, Entamoeba histolytica
SKSD

SEQ ID NO: 2606387 - protein, 9 aa, Entamoeba histolytica
SKSGEDMTS

SEQ ID NO: 2606388 - protein, 15 aa, Entamoeba histolytica
SKSQDIEAGDGTTTV

SEQ ID NO: 2606389 - protein, 18 aa, Entamoeba histolytica
SKSQQYIPTKPMAAPRRV

SEQ ID NO: 2606390 - protein, 10 aa, Entamoeba histolytica
SKSRNEPKPI

SEQ ID NO: 2606391 - protein, 9 aa, Entamoeba histolytica
SKSRNGKSA

SEQ ID NO: 2606392 - protein, 4 aa, Entamoeba histolytica
SKSV

SEQ ID NO: 2606393 - protein, 4 aa, Entamoeba histolytica
SKTE

SEQ ID NO: 2606394 - protein, 13 aa, Entamoeba histolytica
SKTGMKGEGDMTS

SEQ ID NO: 2606395 - protein, 6 aa, Entamoeba histolytica
SKTQSL

SEQ ID NO: 2606396 - protein, 4 aa, Entamoeba histolytica
SKTT

SEQ ID NO: 2606397 - protein, 9 aa, Entamoeba histolytica
SKTTKGPNR

SEQ ID NO: 2606398 - protein, 6 aa, Entamoeba histolytica
SKWQPE

SEQ ID NO: 2606399 - protein, 5 aa, Entamoeba histolytica
SLDEI

SEQ ID NO: 2606400 - protein, 5 aa, Entamoeba histolytica
SLDGT

SEQ ID NO: 2606401 - protein, 4 aa, Entamoeba histolytica
SLEV

SEQ ID NO: 2606402 - protein, 11 aa, Entamoeba histolytica
SLGGGTGSGLG

SEQ ID NO: 2606403 - protein, 6 aa, Entamoeba histolytica
SLHSEK

SEQ ID NO: 2606404 - protein, 8 aa, Entamoeba histolytica
SLMGGESI

SEQ ID NO: 2606405 - protein, 6 aa, Entamoeba histolytica
SLPDID

SEQ ID NO: 2606406 - protein, 5 aa, Entamoeba histolytica
SLQPL

SEQ ID NO: 2606407 - protein, 5 aa, Entamoeba histolytica
SLSLQ

SEQ ID NO: 2606408 - protein, 5 aa, Entamoeba histolytica
SLTEK

SEQ ID NO: 2606409 - protein, 4 aa, Entamoeba histolytica
SLTT

SEQ ID NO: 2606410 - protein, 6 aa, Entamoeba histolytica
SLYSTP

SEQ ID NO: 2606411 - protein, 11 aa, Entamoeba histolytica
SMEEDDDNDDF

SEQ ID NO: 2606412 - protein, 16 aa, Entamoeba histolytica
SNDDNDDDDDNTNEKI

SEQ ID NO: 2606413 - protein, 15 aa, Entamoeba histolytica
SNDDNDDNTNTNEKI

SEQ ID NO: 2606414 - protein, 5 aa, Entamoeba histolytica
SNDKI

SEQ ID NO: 2606415 - protein, 4 aa, Entamoeba histolytica
SNEE

SEQ ID NO: 2606416 - protein, 5 aa, Entamoeba histolytica
SNEEI

SEQ ID NO: 2606417 - protein, 4 aa, Entamoeba histolytica
SNEQ

SEQ ID NO: 2606418 - protein, 4 aa, Entamoeba histolytica
SNET

SEQ ID NO: 2606419 - protein, 6 aa, Entamoeba histolytica
SNEYDE

SEQ ID NO: 2606420 - protein, 6 aa, Entamoeba histolytica
SNFAAS

SEQ ID NO: 2606421 - protein, 5 aa, Entamoeba histolytica
SNFKS

SEQ ID NO: 2606422 - protein, 7 aa, Entamoeba histolytica
SNGETPL

SEQ ID NO: 2606423 - protein, 5 aa, Entamoeba histolytica
SNGKW

SEQ ID NO: 2606424 - protein, 4 aa, Entamoeba histolytica
SNGN

SEQ ID NO: 2606425 - protein, 7 aa, Entamoeba histolytica
SNGNRVK

SEQ ID NO: 2606426 - protein, 7 aa, Entamoeba histolytica
SNIQQTQ

SEQ ID NO: 2606427 - protein, 4 aa, Entamoeba histolytica
SNKE

SEQ ID NO: 2606428 - protein, 4 aa, Entamoeba histolytica
SNKK

SEQ ID NO: 2606429 - protein, 7 aa, Entamoeba histolytica
SNKTSES

SEQ ID NO: 2606430 - protein, 5 aa, Entamoeba histolytica
SNLKE

SEQ ID NO: 2606431 - protein, 7 aa, Entamoeba histolytica
SNNGNLR

SEQ ID NO: 2606432 - protein, 5 aa, Entamoeba histolytica
SNNQE

SEQ ID NO: 2606433 - protein, 9 aa, Entamoeba histolytica
SNNSNPDTD

SEQ ID NO: 2606434 - protein, 8 aa, Entamoeba histolytica
SNNTLSPT

SEQ ID NO: 2606435 - protein, 8 aa, Entamoeba histolytica
SNPHASSV

SEQ ID NO: 2606436 - protein, 7 aa, Entamoeba histolytica
SNPSSIR

SEQ ID NO: 2606437 - protein, 4 aa, Entamoeba histolytica
SNQP

SEQ ID NO: 2606438 - protein, 4 aa, Entamoeba histolytica
SNSI

SEQ ID NO: 2606439 - protein, 12 aa, Entamoeba histolytica
SNSIYVNTRKLI

SEQ ID NO: 2606440 - protein, 6 aa, Entamoeba histolytica
SNSPDL

SEQ ID NO: 2606441 - protein, 5 aa, Entamoeba histolytica
SNSSI

SEQ ID NO: 2606442 - protein, 5 aa, Entamoeba histolytica
SNSVY

SEQ ID NO: 2606443 - protein, 4 aa, Entamoeba histolytica
SNSY

SEQ ID NO: 2606444 - protein, 5 aa, Entamoeba histolytica
SNSYR

SEQ ID NO: 2606445 - protein, 13 aa, Entamoeba histolytica
SNTGAIGPYQTDE

SEQ ID NO: 2606446 - protein, 7 aa, Entamoeba histolytica
SNTISKK

SEQ ID NO: 2606447 - protein, 8 aa, Entamoeba histolytica
SNTKNKEF

SEQ ID NO: 2606448 - protein, 6 aa, Entamoeba histolytica
SNTNLS

SEQ ID NO: 2606449 - protein, 6 aa, Entamoeba histolytica
SNVRLT

SEQ ID NO: 2606450 - protein, 4 aa, Entamoeba histolytica
SNYE

SEQ ID NO: 2606451 - protein, 8 aa, Entamoeba histolytica
SPATTESQ

SEQ ID NO: 2606452 - protein, 8 aa, Entamoeba histolytica
SPDDDTDV

SEQ ID NO: 2606453 - protein, 5 aa, Entamoeba histolytica
SPDDY

SEQ ID NO: 2606454 - protein, 5 aa, Entamoeba histolytica
SPDSR

SEQ ID NO: 2606455 - protein, 7 aa, Entamoeba histolytica
SPEDTSD

SEQ ID NO: 2606456 - protein, 18 aa, Entamoeba histolytica
SPEEEGEKVTNKMNEDIQ

SEQ ID NO: 2606457 - protein, 5 aa, Entamoeba histolytica
SPENN

SEQ ID NO: 2606458 - protein, 6 aa, Entamoeba histolytica
SPETFQ

SEQ ID NO: 2606459 - protein, 9 aa, Entamoeba histolytica
SPIKAPINK

SEQ ID NO: 2606460 - protein, 4 aa, Entamoeba histolytica
SPIP

SEQ ID NO: 2606461 - protein, 10 aa, Entamoeba histolytica
SPKLSSGVVE

SEQ ID NO: 2606462 - protein, 7 aa, Entamoeba histolytica
SPLNKQE

SEQ ID NO: 2606463 - protein, 21 aa, Entamoeba histolytica
SPLNNQPIPLPPTNQETPNHQ

SEQ ID NO: 2606464 - protein, 8 aa, Entamoeba histolytica
SPLPSKES

SEQ ID NO: 2606465 - protein, 7 aa, Entamoeba histolytica
SPLRKPK

SEQ ID NO: 2606466 - protein, 11 aa, Entamoeba histolytica
SPNGETIITND

SEQ ID NO: 2606467 - protein, 4 aa, Entamoeba histolytica
SPPF

SEQ ID NO: 2606468 - protein, 9 aa, Entamoeba histolytica
SPPSNYSSS

SEQ ID NO: 2606469 - protein, 6 aa, Entamoeba histolytica
SPSNSI

SEQ ID NO: 2606470 - protein, 4 aa, Entamoeba histolytica
SPSS

SEQ ID NO: 2606471 - protein, 5 aa, Entamoeba histolytica
SPTLR

SEQ ID NO: 2606472 - protein, 35 aa, Entamoeba histolytica
SPYTPEPHQDDIPEATTTTEEGTEAPPPPVPAPRR

SEQ ID NO: 2606473 - protein, 14 aa, Entamoeba histolytica
SQDGDVSNKESKFS

SEQ ID NO: 2606474 - protein, 10 aa, Entamoeba histolytica
SQETNLEEAA

SEQ ID NO: 2606475 - protein, 5 aa, Entamoeba histolytica
SQGNI

SEQ ID NO: 2606476 - protein, 6 aa, Entamoeba histolytica
SQIDRE

SEQ ID NO: 2606477 - protein, 4 aa, Entamoeba histolytica
SQKP

SEQ ID NO: 2606478 - protein, 6 aa, Entamoeba histolytica
SQKSIQ

SEQ ID NO: 2606479 - protein, 9 aa, Entamoeba histolytica
SQKTNGNEA

SEQ ID NO: 2606480 - protein, 4 aa, Entamoeba histolytica
SQLE

SEQ ID NO: 2606481 - protein, 12 aa, Entamoeba histolytica
SQNPEYSTNPTL

SEQ ID NO: 2606482 - protein, 13 aa, Entamoeba histolytica
SQNSQNTANSRLT

SEQ ID NO: 2606483 - protein, 4 aa, Entamoeba histolytica
SQPL

SEQ ID NO: 2606484 - protein, 15 aa, Entamoeba histolytica
SQSKINKQSYSKNIV

SEQ ID NO: 2606485 - protein, 5 aa, Entamoeba histolytica
SQTPD

SEQ ID NO: 2606486 - protein, 6 aa, Entamoeba histolytica
SQYGKY

SEQ ID NO: 2606487 - protein, 7 aa, Entamoeba histolytica
SRFGTPD

SEQ ID NO: 2606488 - protein, 5 aa, Entamoeba histolytica
SRKTM

SEQ ID NO: 2606489 - protein, 4 aa, Entamoeba histolytica
SRNE

SEQ ID NO: 2606490 - protein, 4 aa, Entamoeba histolytica
SRPI

SEQ ID NO: 2606491 - protein, 4 aa, Entamoeba histolytica
SRSA

SEQ ID NO: 2606492 - protein, 6 aa, Entamoeba histolytica
SRTENL

SEQ ID NO: 2606493 - protein, 5 aa, Entamoeba histolytica
SRTGH

SEQ ID NO: 2606494 - protein, 11 aa, Entamoeba histolytica
SRTMTDENKKH

SEQ ID NO: 2606495 - protein, 9 aa, Entamoeba histolytica
SRTTPIPTG

SEQ ID NO: 2606496 - protein, 8 aa, Entamoeba histolytica
SSAGGEYT

SEQ ID NO: 2606497 - protein, 6 aa, Entamoeba histolytica
SSDEEF

SEQ ID NO: 2606498 - protein, 4 aa, Entamoeba histolytica
SSDK

SEQ ID NO: 2606499 - protein, 8 aa, Entamoeba histolytica
SSGLGDIP

SEQ ID NO: 2606500 - protein, 7 aa, Entamoeba histolytica
SSIGRTA

SEQ ID NO: 2606501 - protein, 14 aa, Entamoeba histolytica
SSIQETYSKIQKGE

SEQ ID NO: 2606502 - protein, 6 aa, Entamoeba histolytica
SSITSF

SEQ ID NO: 2606503 - protein, 9 aa, Entamoeba histolytica
SSKAEEMEG

SEQ ID NO: 2606504 - protein, 6 aa, Entamoeba histolytica
SSKIEN

SEQ ID NO: 2606505 - protein, 4 aa, Entamoeba histolytica
SSKS

SEQ ID NO: 2606506 - protein, 9 aa, Entamoeba histolytica
SSLDNSPVY

SEQ ID NO: 2606507 - protein, 7 aa, Entamoeba histolytica
SSLQEQS

SEQ ID NO: 2606508 - protein, 20 aa, Entamoeba histolytica
SSLQTSPASDPRKTDERPIL

SEQ ID NO: 2606509 - protein, 7 aa, Entamoeba histolytica
SSNARLT

SEQ ID NO: 2606510 - protein, 4 aa, Entamoeba histolytica
SSPH

SEQ ID NO: 2606511 - protein, 6 aa, Entamoeba histolytica
SSPKST

SEQ ID NO: 2606512 - protein, 5 aa, Entamoeba histolytica
SSPSV

SEQ ID NO: 2606513 - protein, 9 aa, Entamoeba histolytica
SSQIKEGDL

SEQ ID NO: 2606514 - protein, 4 aa, Entamoeba histolytica
SSQL

SEQ ID NO: 2606515 - protein, 9 aa, Entamoeba histolytica
SSQLQTTKE

SEQ ID NO: 2606516 - protein, 7 aa, Entamoeba histolytica
SSQQTKV

SEQ ID NO: 2606517 - protein, 8 aa, Entamoeba histolytica
SSSADSTI

SEQ ID NO: 2606518 - protein, 6 aa, Entamoeba histolytica
SSSEEI

SEQ ID NO: 2606519 - protein, 5 aa, Entamoeba histolytica
SSSEF

SEQ ID NO: 2606520 - protein, 8 aa, Entamoeba histolytica
SSSGGSPY

SEQ ID NO: 2606521 - protein, 10 aa, Entamoeba histolytica
SSSIGPKKRM

SEQ ID NO: 2606522 - protein, 15 aa, Entamoeba histolytica
SSSPSQDDSPTPNIA

SEQ ID NO: 2606523 - protein, 8 aa, Entamoeba histolytica
SSTPLNDF

SEQ ID NO: 2606524 - protein, 5 aa, Entamoeba histolytica
SSTRE

SEQ ID NO: 2606525 - protein, 5 aa, Entamoeba histolytica
SSYAG

SEQ ID NO: 2606526 - protein, 8 aa, Entamoeba histolytica
SSYGKTIQ

SEQ ID NO: 2606527 - protein, 5 aa, Entamoeba histolytica
STAPI

SEQ ID NO: 2606528 - protein, 7 aa, Entamoeba histolytica
STDFPNK

SEQ ID NO: 2606529 - protein, 10 aa, Entamoeba histolytica
STDHVSDTEV

SEQ ID NO: 2606530 - protein, 6 aa, Entamoeba histolytica
STEESY

SEQ ID NO: 2606531 - protein, 9 aa, Entamoeba histolytica
STEGSEEYA

SEQ ID NO: 2606532 - protein, 8 aa, Entamoeba histolytica
STENERQP

SEQ ID NO: 2606533 - protein, 6 aa, Entamoeba histolytica
STFITE

SEQ ID NO: 2606534 - protein, 6 aa, Entamoeba histolytica
STGCDK

SEQ ID NO: 2606535 - protein, 11 aa, Entamoeba histolytica
STGSDVSDKST

SEQ ID NO: 2606536 - protein, 9 aa, Entamoeba histolytica
STKKSYMKT

SEQ ID NO: 2606537 - protein, 7 aa, Entamoeba histolytica
STLEPPV

SEQ ID NO: 2606538 - protein, 12 aa, Entamoeba histolytica
STMIGTAGADSY

SEQ ID NO: 2606539 - protein, 6 aa, Entamoeba histolytica
STNTID

SEQ ID NO: 2606540 - protein, 7 aa, Entamoeba histolytica
STPGPGV

SEQ ID NO: 2606541 - protein, 5 aa, Entamoeba histolytica
STPMY

SEQ ID NO: 2606542 - protein, 5 aa, Entamoeba histolytica
STPNK

SEQ ID NO: 2606543 - protein, 10 aa, Entamoeba histolytica
STPQSDALEV

SEQ ID NO: 2606544 - protein, 6 aa, Entamoeba histolytica
STPSPM

SEQ ID NO: 2606545 - protein, 4 aa, Entamoeba histolytica
STPY

SEQ ID NO: 2606546 - protein, 4 aa, Entamoeba histolytica
STQQ

SEQ ID NO: 2606547 - protein, 6 aa, Entamoeba histolytica
STQQGA

SEQ ID NO: 2606548 - protein, 6 aa, Entamoeba histolytica
STRGEQ

SEQ ID NO: 2606549 - protein, 7 aa, Entamoeba histolytica
STRGEQI

SEQ ID NO: 2606550 - protein, 8 aa, Entamoeba histolytica
STRINRGN

SEQ ID NO: 2606551 - protein, 16 aa, Entamoeba histolytica
STRVLGDGDVTPPGGL

SEQ ID NO: 2606552 - protein, 5 aa, Entamoeba histolytica
STSTE

SEQ ID NO: 2606553 - protein, 20 aa, Entamoeba histolytica
STSTESQERSLNNPNDTHPE

SEQ ID NO: 2606554 - protein, 10 aa, Entamoeba histolytica
STTPSFQRKS

SEQ ID NO: 2606555 - protein, 4 aa, Entamoeba histolytica
STTS

SEQ ID NO: 2606556 - protein, 6 aa, Entamoeba histolytica
STVNPV

SEQ ID NO: 2606557 - protein, 4 aa, Entamoeba histolytica
STYE

SEQ ID NO: 2606558 - protein, 5 aa, Entamoeba histolytica
STYKQ

SEQ ID NO: 2606559 - protein, 6 aa, Entamoeba histolytica
STYNDL

SEQ ID NO: 2606560 - protein, 9 aa, Entamoeba histolytica
SVDGLTSYG

SEQ ID NO: 2606561 - protein, 6 aa, Entamoeba histolytica
SVDSPA

SEQ ID NO: 2606562 - protein, 11 aa, Entamoeba histolytica
SVEDKDETSPV

SEQ ID NO: 2606563 - protein, 9 aa, Entamoeba histolytica
SVEQQRKPY

SEQ ID NO: 2606564 - protein, 10 aa, Entamoeba histolytica
SVGKTVTKEY

SEQ ID NO: 2606565 - protein, 9 aa, Entamoeba histolytica
SVGTQQPSI

SEQ ID NO: 2606566 - protein, 6 aa, Entamoeba histolytica
SVLEAE

SEQ ID NO: 2606567 - protein, 8 aa, Entamoeba histolytica
SVNDCSNP

SEQ ID NO: 2606568 - protein, 7 aa, Entamoeba histolytica
SVQSPDW

SEQ ID NO: 2606569 - protein, 6 aa, Entamoeba histolytica
SVQVTK

SEQ ID NO: 2606570 - protein, 5 aa, Entamoeba histolytica
SVSPA

SEQ ID NO: 2606571 - protein, 8 aa, Entamoeba histolytica
SVSQTSQV

SEQ ID NO: 2606572 - protein, 5 aa, Entamoeba histolytica
SVTGS

SEQ ID NO: 2606573 - protein, 11 aa, Entamoeba histolytica
SVVDKESHEVR

SEQ ID NO: 2606574 - protein, 10 aa, Entamoeba histolytica
SYDATSHFET

SEQ ID NO: 2606575 - protein, 12 aa, Entamoeba histolytica
SYEKSKDEKLND

SEQ ID NO: 2606576 - protein, 4 aa, Entamoeba histolytica
SYET

SEQ ID NO: 2606577 - protein, 6 aa, Entamoeba histolytica
SYFPDK

SEQ ID NO: 2606578 - protein, 9 aa, Entamoeba histolytica
SYKGPSFNT

SEQ ID NO: 2606579 - protein, 14 aa, Entamoeba histolytica
SYKPQKISPKFEGT

SEQ ID NO: 2606580 - protein, 10 aa, Entamoeba histolytica
SYPQNYNQPI

SEQ ID NO: 2606581 - protein, 5 aa, Entamoeba histolytica
SYRNK

SEQ ID NO: 2606582 - protein, 9 aa, Entamoeba histolytica
SYTQYGGLR

SEQ ID NO: 2606583 - protein, 4 aa, Entamoeba histolytica
SYTS

SEQ ID NO: 2606584 - protein, 5 aa, Entamoeba histolytica
SYYRG

SEQ ID NO: 2606585 - protein, 6 aa, Entamoeba histolytica
SYYRGT

SEQ ID NO: 2606586 - protein, 7 aa, Entamoeba histolytica
TAAKSST

SEQ ID NO: 2606587 - protein, 9 aa, Entamoeba histolytica
TAASEAKAH

SEQ ID NO: 2606588 - protein, 7 aa, Entamoeba histolytica
TADKCEY

SEQ ID NO: 2606589 - protein, 14 aa, Entamoeba histolytica
TADQSKKGNPMKGT

SEQ ID NO: 2606590 - protein, 18 aa, Entamoeba histolytica
TAGEKEYETEQKRRKFGD

SEQ ID NO: 2606591 - protein, 11 aa, Entamoeba histolytica
TAGQDEYSSYR

SEQ ID NO: 2606592 - protein, 9 aa, Entamoeba histolytica
TAGQEDYEQ

SEQ ID NO: 2606593 - protein, 7 aa, Entamoeba histolytica
TAGQEEY

SEQ ID NO: 2606594 - protein, 9 aa, Entamoeba histolytica
TAGQEEYSA

SEQ ID NO: 2606595 - protein, 7 aa, Entamoeba histolytica
TAGQERF

SEQ ID NO: 2606596 - protein, 8 aa, Entamoeba histolytica
TAGSATNS

SEQ ID NO: 2606597 - protein, 15 aa, Entamoeba histolytica
TAIDQTKKPAPMKPI

SEQ ID NO: 2606598 - protein, 22 aa, Entamoeba histolytica
TAKIDEGEVVDSKDYFNDFTYC

SEQ ID NO: 2606599 - protein, 9 aa, Entamoeba histolytica
TAKKQGIST

SEQ ID NO: 2606600 - protein, 11 aa, Entamoeba histolytica
TAKSDPQKLQG

SEQ ID NO: 2606601 - protein, 7 aa, Entamoeba histolytica
TAKTNIY

SEQ ID NO: 2606602 - protein, 11 aa, Entamoeba histolytica
TAKVTATRGYG

SEQ ID NO: 2606603 - protein, 11 aa, Entamoeba histolytica
TALEEEKKEGS

SEQ ID NO: 2606604 - protein, 8 aa, Entamoeba histolytica
TAPPPDGL

SEQ ID NO: 2606605 - protein, 8 aa, Entamoeba histolytica
TASQERYR

SEQ ID NO: 2606606 - protein, 7 aa, Entamoeba histolytica
TCPNPKG

SEQ ID NO: 2606607 - protein, 5 aa, Entamoeba histolytica
TCQFE

SEQ ID NO: 2606608 - protein, 8 aa, Entamoeba histolytica
TCSYEPQN

SEQ ID NO: 2606609 - protein, 15 aa, Entamoeba histolytica
TDCTINDEGGNKQIP

SEQ ID NO: 2606610 - protein, 15 aa, Entamoeba histolytica
TDDNIDTNDKELQEE

SEQ ID NO: 2606611 - protein, 10 aa, Entamoeba histolytica
TDEETKPKSV

SEQ ID NO: 2606612 - protein, 5 aa, Entamoeba histolytica
TDGYG

SEQ ID NO: 2606613 - protein, 7 aa, Entamoeba histolytica
TDLTETQ

SEQ ID NO: 2606614 - protein, 13 aa, Entamoeba histolytica
TDNKPGNWAPTSS

SEQ ID NO: 2606615 - protein, 6 aa, Entamoeba histolytica
TDPKDV

SEQ ID NO: 2606616 - protein, 12 aa, Entamoeba histolytica
TDPNPSDPLDPE

SEQ ID NO: 2606617 - protein, 13 aa, Entamoeba histolytica
TDPSGKNGPAARI

SEQ ID NO: 2606618 - protein, 8 aa, Entamoeba histolytica
TDPSIPKS

SEQ ID NO: 2606619 - protein, 4 aa, Entamoeba histolytica
TDQS

SEQ ID NO: 2606620 - protein, 36 aa, Entamoeba histolytica
TDTKTSRKTLPASKIGKLSSVPRKPNGDEGELSPEE

SEQ ID NO: 2606621 - protein, 19 aa, Entamoeba histolytica
TDYKTGTTTMKYPTNEEKW

SEQ ID NO: 2606622 - protein, 6 aa, Entamoeba histolytica
TEAKSP

SEQ ID NO: 2606623 - protein, 15 aa, Entamoeba histolytica
TEASSLARNYNKTTI

SEQ ID NO: 2606624 - protein, 4 aa, Entamoeba histolytica
TEDE

SEQ ID NO: 2606625 - protein, 11 aa, Entamoeba histolytica
TEDGKTPEEFE

SEQ ID NO: 2606626 - protein, 6 aa, Entamoeba histolytica
TEEDAK

SEQ ID NO: 2606627 - protein, 5 aa, Entamoeba histolytica
TEEEE

SEQ ID NO: 2606628 - protein, 4 aa, Entamoeba histolytica
TEES

SEQ ID NO: 2606629 - protein, 12 aa, Entamoeba histolytica
TEFDDKKRNATL

SEQ ID NO: 2606630 - protein, 5 aa, Entamoeba histolytica
TEGIP

SEQ ID NO: 2606631 - protein, 14 aa, Entamoeba histolytica
TEGYISSYSTDSAG

SEQ ID NO: 2606632 - protein, 4 aa, Entamoeba histolytica
TEIP

SEQ ID NO: 2606633 - protein, 17 aa, Entamoeba histolytica
TEKKKEEKKGKEQADPQ

SEQ ID NO: 2606634 - protein, 13 aa, Entamoeba histolytica
TEKSKITPEITPD

SEQ ID NO: 2606635 - protein, 11 aa, Entamoeba histolytica
TENEEKKTGYK

SEQ ID NO: 2606636 - protein, 9 aa, Entamoeba histolytica
TENENYDGS

SEQ ID NO: 2606637 - protein, 7 aa, Entamoeba histolytica
TENPKSL

SEQ ID NO: 2606638 - protein, 5 aa, Entamoeba histolytica
TENQV

SEQ ID NO: 2606639 - protein, 4 aa, Entamoeba histolytica
TENS

SEQ ID NO: 2606640 - protein, 7 aa, Entamoeba histolytica
TESPNTG

SEQ ID NO: 2606641 - protein, 4 aa, Entamoeba histolytica
TESQ

SEQ ID NO: 2606642 - protein, 9 aa, Entamoeba histolytica
TETQRPKGC

SEQ ID NO: 2606643 - protein, 10 aa, Entamoeba histolytica
TETTKKRLES

SEQ ID NO: 2606644 - protein, 5 aa, Entamoeba histolytica
TETTQ

SEQ ID NO: 2606645 - protein, 4 aa, Entamoeba histolytica
TFNE

SEQ ID NO: 2606646 - protein, 6 aa, Entamoeba histolytica
TFPTES

SEQ ID NO: 2606647 - protein, 7 aa, Entamoeba histolytica
TFYPEDK

SEQ ID NO: 2606648 - protein, 10 aa, Entamoeba histolytica
TGAKDEESLN

SEQ ID NO: 2606649 - protein, 4 aa, Entamoeba histolytica
TGDQ

SEQ ID NO: 2606650 - protein, 6 aa, Entamoeba histolytica
TGEKPY

SEQ ID NO: 2606651 - protein, 5 aa, Entamoeba histolytica
TGFGD

SEQ ID NO: 2606652 - protein, 9 aa, Entamoeba histolytica
TGIGPTDIV

SEQ ID NO: 2606653 - protein, 9 aa, Entamoeba histolytica
TGKDFGNEE

SEQ ID NO: 2606654 - protein, 9 aa, Entamoeba histolytica
TGKDVELDD

SEQ ID NO: 2606655 - protein, 4 aa, Entamoeba histolytica
TGNG

SEQ ID NO: 2606656 - protein, 4 aa, Entamoeba histolytica
TGRT

SEQ ID NO: 2606657 - protein, 7 aa, Entamoeba histolytica
TGSLSKG

SEQ ID NO: 2606658 - protein, 6 aa, Entamoeba histolytica
TGSMGS

SEQ ID NO: 2606659 - protein, 13 aa, Entamoeba histolytica
TGSTPKSGEGKLK

SEQ ID NO: 2606660 - protein, 17 aa, Entamoeba histolytica
TGTKPSIRVGEKAPKIC

SEQ ID NO: 2606661 - protein, 4 aa, Entamoeba histolytica
TGYT

SEQ ID NO: 2606662 - protein, 6 aa, Entamoeba histolytica
THDPSK

SEQ ID NO: 2606663 - protein, 7 aa, Entamoeba histolytica
THITQKD

SEQ ID NO: 2606664 - protein, 4 aa, Entamoeba histolytica
THNT

SEQ ID NO: 2606665 - protein, 7 aa, Entamoeba histolytica
THPEHSK

SEQ ID NO: 2606666 - protein, 8 aa, Entamoeba histolytica
THPENGED

SEQ ID NO: 2606667 - protein, 4 aa, Entamoeba histolytica
THQP

SEQ ID NO: 2606668 - protein, 8 aa, Entamoeba histolytica
THRYGPNS

SEQ ID NO: 2606669 - protein, 8 aa, Entamoeba histolytica
THSGKKPF

SEQ ID NO: 2606670 - protein, 12 aa, Entamoeba histolytica
THSSFNNQTHCG

SEQ ID NO: 2606671 - protein, 6 aa, Entamoeba histolytica
THTKIG

SEQ ID NO: 2606672 - protein, 11 aa, Entamoeba histolytica
TIEDSYRTSIS

SEQ ID NO: 2606673 - protein, 5 aa, Entamoeba histolytica
TIEEQ

SEQ ID NO: 2606674 - protein, 43 aa, Entamoeba histolytica
TIEKEVSSIDQENSEVNKELNDKKEKIQQIDTESKKINDEIEE

SEQ ID NO: 2606675 - protein, 14 aa, Entamoeba histolytica
TIESKRNRRQKATL

SEQ ID NO: 2606676 - protein, 5 aa, Entamoeba histolytica
TIGIN

SEQ ID NO: 2606677 - protein, 6 aa, Entamoeba histolytica
TIGTRR

SEQ ID NO: 2606678 - protein, 4 aa, Entamoeba histolytica
TIKG

SEQ ID NO: 2606679 - protein, 11 aa, Entamoeba histolytica
TIKTKGGVRSN

SEQ ID NO: 2606680 - protein, 4 aa, Entamoeba histolytica
TIPP

SEQ ID NO: 2606681 - protein, 16 aa, Entamoeba histolytica
TISESNLSTPNKTTAS

SEQ ID NO: 2606682 - protein, 9 aa, Entamoeba histolytica
TITTGKRTN

SEQ ID NO: 2606683 - protein, 5 aa, Entamoeba histolytica
TKDGN

SEQ ID NO: 2606684 - protein, 17 aa, Entamoeba histolytica
TKEDRKKYGNNVPENVN

SEQ ID NO: 2606685 - protein, 7 aa, Entamoeba histolytica
TKEETLE

SEQ ID NO: 2606686 - protein, 14 aa, Entamoeba histolytica
TKEEYQQLKKDGKI

SEQ ID NO: 2606687 - protein, 4 aa, Entamoeba histolytica
TKEN

SEQ ID NO: 2606688 - protein, 9 aa, Entamoeba histolytica
TKEQNNEGK

SEQ ID NO: 2606689 - protein, 5 aa, Entamoeba histolytica
TKERA

SEQ ID NO: 2606690 - protein, 9 aa, Entamoeba histolytica
TKETKGKIG

SEQ ID NO: 2606691 - protein, 6 aa, Entamoeba histolytica
TKGGFS

SEQ ID NO: 2606692 - protein, 4 aa, Entamoeba histolytica
TKGY

SEQ ID NO: 2606693 - protein, 8 aa, Entamoeba histolytica
TKKDEDWN

SEQ ID NO: 2606694 - protein, 14 aa, Entamoeba histolytica
TKKQIQKKKKRVNT

SEQ ID NO: 2606695 - protein, 15 aa, Entamoeba histolytica
TKKRRGEEKTIERIG

SEQ ID NO: 2606696 - protein, 7 aa, Entamoeba histolytica
TKLSDSI

SEQ ID NO: 2606697 - protein, 5 aa, Entamoeba histolytica
TKNGF

SEQ ID NO: 2606698 - protein, 9 aa, Entamoeba histolytica
TKNNDDEQY

SEQ ID NO: 2606699 - protein, 4 aa, Entamoeba histolytica
TKPI

SEQ ID NO: 2606700 - protein, 7 aa, Entamoeba histolytica
TKPIGDC

SEQ ID NO: 2606701 - protein, 33 aa, Entamoeba histolytica
TKPKEKGCKPVPLSTKHNPTDEGEKKRIEEAGG

SEQ ID NO: 2606702 - protein, 25 aa, Entamoeba histolytica
TKPLNSQDKLKTAREKIKEKMSDSQ

SEQ ID NO: 2606703 - protein, 16 aa, Entamoeba histolytica
TKPLNSQDKLKTVREK

SEQ ID NO: 2606704 - protein, 9 aa, Entamoeba histolytica
TKPLNSQDN

SEQ ID NO: 2606705 - protein, 8 aa, Entamoeba histolytica
TKPNYLSK

SEQ ID NO: 2606706 - protein, 4 aa, Entamoeba histolytica
TKPQ

SEQ ID NO: 2606707 - protein, 10 aa, Entamoeba histolytica
TKQPTFDTSE

SEQ ID NO: 2606708 - protein, 26 aa, Entamoeba histolytica
TKQQEETKESIKEEKKEGEENNNSIP

SEQ ID NO: 2606709 - protein, 10 aa, Entamoeba histolytica
TKRPSQRVTT

SEQ ID NO: 2606710 - protein, 8 aa, Entamoeba histolytica
TKSSGPMI

SEQ ID NO: 2606711 - protein, 8 aa, Entamoeba histolytica
TKSYPDRV

SEQ ID NO: 2606712 - protein, 8 aa, Entamoeba histolytica
TKTAAELD

SEQ ID NO: 2606713 - protein, 19 aa, Entamoeba histolytica
TKTAPTSPPTTSSPIQSKP

SEQ ID NO: 2606714 - protein, 10 aa, Entamoeba histolytica
TKTKANGQTV

SEQ ID NO: 2606715 - protein, 7 aa, Entamoeba histolytica
TKTLTKG

SEQ ID NO: 2606716 - protein, 5 aa, Entamoeba histolytica
TKTPL

SEQ ID NO: 2606717 - protein, 9 aa, Entamoeba histolytica
TKTTFGPQG

SEQ ID NO: 2606718 - protein, 5 aa, Entamoeba histolytica
TKWEP

SEQ ID NO: 2606719 - protein, 6 aa, Entamoeba histolytica
TLASMS

SEQ ID NO: 2606720 - protein, 9 aa, Entamoeba histolytica
TLDKTKQKL

SEQ ID NO: 2606721 - protein, 21 aa, Entamoeba histolytica
TLDPKGSYSPFSEEDISSPKC

SEQ ID NO: 2606722 - protein, 9 aa, Entamoeba histolytica
TLEGHNGAV

SEQ ID NO: 2606723 - protein, 6 aa, Entamoeba histolytica
TLGPRG

SEQ ID NO: 2606724 - protein, 6 aa, Entamoeba histolytica
TLGSYG

SEQ ID NO: 2606725 - protein, 24 aa, Entamoeba histolytica
TLKHKKDINDQKGDLAKQAYSAYE

SEQ ID NO: 2606726 - protein, 4 aa, Entamoeba histolytica
TLPP

SEQ ID NO: 2606727 - protein, 8 aa, Entamoeba histolytica
TLQEEKEK

SEQ ID NO: 2606728 - protein, 7 aa, Entamoeba histolytica
TLSGGEL

SEQ ID NO: 2606729 - protein, 22 aa, Entamoeba histolytica
TLTEEEKKRGVVAASAGNHAQG

SEQ ID NO: 2606730 - protein, 10 aa, Entamoeba histolytica
TNEDVTEVQN

SEQ ID NO: 2606731 - protein, 4 aa, Entamoeba histolytica
TNES

SEQ ID NO: 2606732 - protein, 17 aa, Entamoeba histolytica
TNGIESQSISQSASFIL

SEQ ID NO: 2606733 - protein, 9 aa, Entamoeba histolytica
TNGIGKSTA

SEQ ID NO: 2606734 - protein, 4 aa, Entamoeba histolytica
TNGP

SEQ ID NO: 2606735 - protein, 12 aa, Entamoeba histolytica
TNINPNKKAEQK

SEQ ID NO: 2606736 - protein, 4 aa, Entamoeba histolytica
TNIP

SEQ ID NO: 2606737 - protein, 14 aa, Entamoeba histolytica
TNIQQKKNNNNNNV

SEQ ID NO: 2606738 - protein, 13 aa, Entamoeba histolytica
TNIQQSPSLPQPL

SEQ ID NO: 2606739 - protein, 5 aa, Entamoeba histolytica
TNMSN

SEQ ID NO: 2606740 - protein, 5 aa, Entamoeba histolytica
TNNER

SEQ ID NO: 2606741 - protein, 4 aa, Entamoeba histolytica
TNPD

SEQ ID NO: 2606742 - protein, 4 aa, Entamoeba histolytica
TNPN

SEQ ID NO: 2606743 - protein, 8 aa, Entamoeba histolytica
TNPNCSEQ

SEQ ID NO: 2606744 - protein, 5 aa, Entamoeba histolytica
TNPQA

SEQ ID NO: 2606745 - protein, 5 aa, Entamoeba histolytica
TNPRK

SEQ ID NO: 2606746 - protein, 4 aa, Entamoeba histolytica
TNRR

SEQ ID NO: 2606747 - protein, 11 aa, Entamoeba histolytica
TNSEAQAETIL

SEQ ID NO: 2606748 - protein, 7 aa, Entamoeba histolytica
TNSEEEM

SEQ ID NO: 2606749 - protein, 4 aa, Entamoeba histolytica
TNSK

SEQ ID NO: 2606750 - protein, 6 aa, Entamoeba histolytica
TNTAIS

SEQ ID NO: 2606751 - protein, 4 aa, Entamoeba histolytica
TNTE

SEQ ID NO: 2606752 - protein, 5 aa, Entamoeba histolytica
TNTEV

SEQ ID NO: 2606753 - protein, 14 aa, Entamoeba histolytica
TNTGIGSQDITDGN

SEQ ID NO: 2606754 - protein, 7 aa, Entamoeba histolytica
TNTLGNT

SEQ ID NO: 2606755 - protein, 4 aa, Entamoeba histolytica
TNVG

SEQ ID NO: 2606756 - protein, 9 aa, Entamoeba histolytica
TNVPPNDAQ

SEQ ID NO: 2606757 - protein, 4 aa, Entamoeba histolytica
TNVS

SEQ ID NO: 2606758 - protein, 6 aa, Entamoeba histolytica
TNVSEL

SEQ ID NO: 2606759 - protein, 13 aa, Entamoeba histolytica
TNVSPNKTTTQCT

SEQ ID NO: 2606760 - protein, 8 aa, Entamoeba histolytica
TNYRTPID

SEQ ID NO: 2606761 - protein, 4 aa, Entamoeba histolytica
TPDE

SEQ ID NO: 2606762 - protein, 4 aa, Entamoeba histolytica
TPEI

SEQ ID NO: 2606763 - protein, 4 aa, Entamoeba histolytica
TPEM

SEQ ID NO: 2606764 - protein, 4 aa, Entamoeba histolytica
TPFD

SEQ ID NO: 2606765 - protein, 6 aa, Entamoeba histolytica
TPGHSD

SEQ ID NO: 2606766 - protein, 9 aa, Entamoeba histolytica
TPGQNRNGV

SEQ ID NO: 2606767 - protein, 4 aa, Entamoeba histolytica
TPGR

SEQ ID NO: 2606768 - protein, 13 aa, Entamoeba histolytica
TPIEYNKQENDIE

SEQ ID NO: 2606769 - protein, 18 aa, Entamoeba histolytica
TPIPTDCTKRKGGRRGRR

SEQ ID NO: 2606770 - protein, 8 aa, Entamoeba histolytica
TPKEAAQK

SEQ ID NO: 2606771 - protein, 5 aa, Entamoeba histolytica
TPKEI

SEQ ID NO: 2606772 - protein, 5 aa, Entamoeba histolytica
TPLSD

SEQ ID NO: 2606773 - protein, 5 aa, Entamoeba histolytica
TPNAI

SEQ ID NO: 2606774 - protein, 8 aa, Entamoeba histolytica
TPNPSWAS

SEQ ID NO: 2606775 - protein, 8 aa, Entamoeba histolytica
TPNSNEKM

SEQ ID NO: 2606776 - protein, 19 aa, Entamoeba histolytica
TPPTTTHLKEKKLLKFFTL

SEQ ID NO: 2606777 - protein, 17 aa, Entamoeba histolytica
TPQPFPKLKKKAKCCII

SEQ ID NO: 2606778 - protein, 11 aa, Entamoeba histolytica
TPRGAKVRSGK

SEQ ID NO: 2606779 - protein, 12 aa, Entamoeba histolytica
TPTGNQEEIKGI

SEQ ID NO: 2606780 - protein, 4 aa, Entamoeba histolytica
TPTL

SEQ ID NO: 2606781 - protein, 4 aa, Entamoeba histolytica
TPTY

SEQ ID NO: 2606782 - protein, 5 aa, Entamoeba histolytica
TPWSD

SEQ ID NO: 2606783 - protein, 5 aa, Entamoeba histolytica
TQEED

SEQ ID NO: 2606784 - protein, 27 aa, Entamoeba histolytica
TQEIRKKKGRVTKEQSERMKQRINNWY

SEQ ID NO: 2606785 - protein, 6 aa, Entamoeba histolytica
TQHTKG

SEQ ID NO: 2606786 - protein, 12 aa, Entamoeba histolytica
TQITTELENRAQ

SEQ ID NO: 2606787 - protein, 19 aa, Entamoeba histolytica
TQKGKNPINLDQSTVRGNT

SEQ ID NO: 2606788 - protein, 4 aa, Entamoeba histolytica
TQNF

SEQ ID NO: 2606789 - protein, 5 aa, Entamoeba histolytica
TQNSR

SEQ ID NO: 2606790 - protein, 4 aa, Entamoeba histolytica
TQQQ

SEQ ID NO: 2606791 - protein, 11 aa, Entamoeba histolytica
TQQTESFRRQE

SEQ ID NO: 2606792 - protein, 6 aa, Entamoeba histolytica
TQSTMC

SEQ ID NO: 2606793 - protein, 4 aa, Entamoeba histolytica
TQTH

SEQ ID NO: 2606794 - protein, 14 aa, Entamoeba histolytica
TRAKDFADKAKKDI

SEQ ID NO: 2606795 - protein, 4 aa, Entamoeba histolytica
TREL

SEQ ID NO: 2606796 - protein, 4 aa, Entamoeba histolytica
TRPP

SEQ ID NO: 2606797 - protein, 4 aa, Entamoeba histolytica
TRQE

SEQ ID NO: 2606798 - protein, 4 aa, Entamoeba histolytica
TRQT

SEQ ID NO: 2606799 - protein, 8 aa, Entamoeba histolytica
TRRPATSA

SEQ ID NO: 2606800 - protein, 4 aa, Entamoeba histolytica
TRSG

SEQ ID NO: 2606801 - protein, 7 aa, Entamoeba histolytica
TRSKRAQ

SEQ ID NO: 2606802 - protein, 7 aa, Entamoeba histolytica
TRTFNKK

SEQ ID NO: 2606803 - protein, 10 aa, Entamoeba histolytica
TRTPTQVRSH

SEQ ID NO: 2606804 - protein, 9 aa, Entamoeba histolytica
TSDPSLKDA

SEQ ID NO: 2606805 - protein, 6 aa, Entamoeba histolytica
TSDVEK

SEQ ID NO: 2606806 - protein, 4 aa, Entamoeba histolytica
TSEE

SEQ ID NO: 2606807 - protein, 7 aa, Entamoeba histolytica
TSEQPLT

SEQ ID NO: 2606808 - protein, 8 aa, Entamoeba histolytica
TSERKTYV

SEQ ID NO: 2606809 - protein, 9 aa, Entamoeba histolytica
TSFKSSETL

SEQ ID NO: 2606810 - protein, 4 aa, Entamoeba histolytica
TSFQ

SEQ ID NO: 2606811 - protein, 12 aa, Entamoeba histolytica
TSGMDGNIAIWK

SEQ ID NO: 2606812 - protein, 9 aa, Entamoeba histolytica
TSGSDDLDE

SEQ ID NO: 2606813 - protein, 18 aa, Entamoeba histolytica
TSGSPDYSKLASGAIGNS

SEQ ID NO: 2606814 - protein, 9 aa, Entamoeba histolytica
TSKDPSSKL

SEQ ID NO: 2606815 - protein, 9 aa, Entamoeba histolytica
TSKGLSETT

SEQ ID NO: 2606816 - protein, 10 aa, Entamoeba histolytica
TSKIDGLKKN

SEQ ID NO: 2606817 - protein, 25 aa, Entamoeba histolytica
TSKIRDITQYTKDVSNAYGVDPNRC

SEQ ID NO: 2606818 - protein, 9 aa, Entamoeba histolytica
TSKQKPKCT

SEQ ID NO: 2606819 - protein, 12 aa, Entamoeba histolytica
TSKQSQCEEKED

SEQ ID NO: 2606820 - protein, 13 aa, Entamoeba histolytica
TSKSWSEKDGVPV

SEQ ID NO: 2606821 - protein, 14 aa, Entamoeba histolytica
TSKTTGKNKSAIAE

SEQ ID NO: 2606822 - protein, 7 aa, Entamoeba histolytica
TSLPSHD

SEQ ID NO: 2606823 - protein, 4 aa, Entamoeba histolytica
TSNE

SEQ ID NO: 2606824 - protein, 4 aa, Entamoeba histolytica
TSNS

SEQ ID NO: 2606825 - protein, 5 aa, Entamoeba histolytica
TSNTP

SEQ ID NO: 2606826 - protein, 4 aa, Entamoeba histolytica
TSPL

SEQ ID NO: 2606827 - protein, 5 aa, Entamoeba histolytica
TSPLT

SEQ ID NO: 2606828 - protein, 4 aa, Entamoeba histolytica
TSPN

SEQ ID NO: 2606829 - protein, 9 aa, Entamoeba histolytica
TSQSPENDQ

SEQ ID NO: 2606830 - protein, 8 aa, Entamoeba histolytica
TSRGDQAK

SEQ ID NO: 2606831 - protein, 13 aa, Entamoeba histolytica
TSRGTGDKKQFAI

SEQ ID NO: 2606832 - protein, 7 aa, Entamoeba histolytica
TSRYPEA

SEQ ID NO: 2606833 - protein, 4 aa, Entamoeba histolytica
TSSF

SEQ ID NO: 2606834 - protein, 9 aa, Entamoeba histolytica
TSSKKDINI

SEQ ID NO: 2606835 - protein, 28 aa, Entamoeba histolytica
TSSKPSSHKTTKSKSKEPEQSYQPAYPR

SEQ ID NO: 2606836 - protein, 5 aa, Entamoeba histolytica
TSSNS

SEQ ID NO: 2606837 - protein, 4 aa, Entamoeba histolytica
TSSP

SEQ ID NO: 2606838 - protein, 4 aa, Entamoeba histolytica
TSSS

SEQ ID NO: 2606839 - protein, 10 aa, Entamoeba histolytica
TSTDTDIPIT

SEQ ID NO: 2606840 - protein, 9 aa, Entamoeba histolytica
TSTKSNNNV

SEQ ID NO: 2606841 - protein, 11 aa, Entamoeba histolytica
TSTSIESHEVG

SEQ ID NO: 2606842 - protein, 4 aa, Entamoeba histolytica
TSTT

SEQ ID NO: 2606843 - protein, 5 aa, Entamoeba histolytica
TSVSE

SEQ ID NO: 2606844 - protein, 5 aa, Entamoeba histolytica
TSVSK

SEQ ID NO: 2606845 - protein, 6 aa, Entamoeba histolytica
TSVSKI

SEQ ID NO: 2606846 - protein, 7 aa, Entamoeba histolytica
TTDGITT

SEQ ID NO: 2606847 - protein, 14 aa, Entamoeba histolytica
TTDGPKEKEEDAQL

SEQ ID NO: 2606848 - protein, 5 aa, Entamoeba histolytica
TTDKI

SEQ ID NO: 2606849 - protein, 6 aa, Entamoeba histolytica
TTDNIS

SEQ ID NO: 2606850 - protein, 6 aa, Entamoeba histolytica
TTDSGE

SEQ ID NO: 2606851 - protein, 4 aa, Entamoeba histolytica
TTEQ

SEQ ID NO: 2606852 - protein, 8 aa, Entamoeba histolytica
TTHSSKDY

SEQ ID NO: 2606853 - protein, 4 aa, Entamoeba histolytica
TTIE

SEQ ID NO: 2606854 - protein, 6 aa, Entamoeba histolytica
TTIENS

SEQ ID NO: 2606855 - protein, 6 aa, Entamoeba histolytica
TTKETS

SEQ ID NO: 2606856 - protein, 9 aa, Entamoeba histolytica
TTKGMKNDT

SEQ ID NO: 2606857 - protein, 4 aa, Entamoeba histolytica
TTND

SEQ ID NO: 2606858 - protein, 17 aa, Entamoeba histolytica
TTNNQPKTNPTSTSPFT

SEQ ID NO: 2606859 - protein, 5 aa, Entamoeba histolytica
TTNST

SEQ ID NO: 2606860 - protein, 7 aa, Entamoeba histolytica
TTPSTDH

SEQ ID NO: 2606861 - protein, 5 aa, Entamoeba histolytica
TTSAS

SEQ ID NO: 2606862 - protein, 4 aa, Entamoeba histolytica
TTSE

SEQ ID NO: 2606863 - protein, 4 aa, Entamoeba histolytica
TTSN

SEQ ID NO: 2606864 - protein, 23 aa, Entamoeba histolytica
TTSTSTPSTQPTSQSPSIQSEPI

SEQ ID NO: 2606865 - protein, 4 aa, Entamoeba histolytica
TTTE

SEQ ID NO: 2606866 - protein, 4 aa, Entamoeba histolytica
TTTI

SEQ ID NO: 2606867 - protein, 6 aa, Entamoeba histolytica
TTVNRS

SEQ ID NO: 2606868 - protein, 6 aa, Entamoeba histolytica
TVDGEQ

SEQ ID NO: 2606869 - protein, 12 aa, Entamoeba histolytica
TVETSNPEKEVE

SEQ ID NO: 2606870 - protein, 9 aa, Entamoeba histolytica
TVETTNGNW

SEQ ID NO: 2606871 - protein, 16 aa, Entamoeba histolytica
TVKEPEKIEKSGDKHL

SEQ ID NO: 2606872 - protein, 4 aa, Entamoeba histolytica
TVPP

SEQ ID NO: 2606873 - protein, 12 aa, Entamoeba histolytica
TVQKENGKEVEG

SEQ ID NO: 2606874 - protein, 22 aa, Entamoeba histolytica
TVQTAQDDCDEDKKDLEKAGEL

SEQ ID NO: 2606875 - protein, 14 aa, Entamoeba histolytica
TVSGGGKSEISKSI

SEQ ID NO: 2606876 - protein, 4 aa, Entamoeba histolytica
TVSK

SEQ ID NO: 2606877 - protein, 7 aa, Entamoeba histolytica
TVSREGY

SEQ ID NO: 2606878 - protein, 5 aa, Entamoeba histolytica
TVSRR

SEQ ID NO: 2606879 - protein, 8 aa, Entamoeba histolytica
TWKKPQEW

SEQ ID NO: 2606880 - protein, 5 aa, Entamoeba histolytica
TWTDD

SEQ ID NO: 2606881 - protein, 6 aa, Entamoeba histolytica
TYDESH

SEQ ID NO: 2606882 - protein, 5 aa, Entamoeba histolytica
TYGDY

SEQ ID NO: 2606883 - protein, 5 aa, Entamoeba histolytica
TYGTG

SEQ ID NO: 2606884 - protein, 11 aa, Entamoeba histolytica
TYQAKEEALEK

SEQ ID NO: 2606885 - protein, 6 aa, Entamoeba histolytica
TYSNDT

SEQ ID NO: 2606886 - protein, 7 aa, Entamoeba histolytica
TYTKGKK

SEQ ID NO: 2606887 - protein, 13 aa, Entamoeba histolytica
VADAVRTSLGPRG

SEQ ID NO: 2606888 - protein, 9 aa, Entamoeba histolytica
VAEGADPQV

SEQ ID NO: 2606889 - protein, 4 aa, Entamoeba histolytica
VAGV

SEQ ID NO: 2606890 - protein, 12 aa, Entamoeba histolytica
VAKEQKKTKQFN

SEQ ID NO: 2606891 - protein, 12 aa, Entamoeba histolytica
VAPKKKKNVSKD

SEQ ID NO: 2606892 - protein, 5 aa, Entamoeba histolytica
VASGD

SEQ ID NO: 2606893 - protein, 7 aa, Entamoeba histolytica
VASRGLD

SEQ ID NO: 2606894 - protein, 9 aa, Entamoeba histolytica
VDEGSNEVS

SEQ ID NO: 2606895 - protein, 8 aa, Entamoeba histolytica
VDEKQAIN

SEQ ID NO: 2606896 - protein, 4 aa, Entamoeba histolytica
VDIE

SEQ ID NO: 2606897 - protein, 13 aa, Entamoeba histolytica
VDLHPDNYTDGTF

SEQ ID NO: 2606898 - protein, 24 aa, Entamoeba histolytica
VDNNEAQFPKEKTEKRVKNEYPTL

SEQ ID NO: 2606899 - protein, 5 aa, Entamoeba histolytica
VDNQS

SEQ ID NO: 2606900 - protein, 7 aa, Entamoeba histolytica
VDPSLDV

SEQ ID NO: 2606901 - protein, 6 aa, Entamoeba histolytica
VDSNQT

SEQ ID NO: 2606902 - protein, 4 aa, Entamoeba histolytica
VDTE

SEQ ID NO: 2606903 - protein, 11 aa, Entamoeba histolytica
VDTESVQEEIE

SEQ ID NO: 2606904 - protein, 9 aa, Entamoeba histolytica
VEADSNSEY

SEQ ID NO: 2606905 - protein, 9 aa, Entamoeba histolytica
VEAKTPNVI

SEQ ID NO: 2606906 - protein, 5 aa, Entamoeba histolytica
VEEDV

SEQ ID NO: 2606907 - protein, 7 aa, Entamoeba histolytica
VEEEGKT

SEQ ID NO: 2606908 - protein, 10 aa, Entamoeba histolytica
VEEITTTHKN

SEQ ID NO: 2606909 - protein, 12 aa, Entamoeba histolytica
VEEKARGELEER

SEQ ID NO: 2606910 - protein, 18 aa, Entamoeba histolytica
VEENKRSAELGDKKTDLV

SEQ ID NO: 2606911 - protein, 14 aa, Entamoeba histolytica
VEESEVNHTTAPID

SEQ ID NO: 2606912 - protein, 11 aa, Entamoeba histolytica
VEETQKPQEMT

SEQ ID NO: 2606913 - protein, 4 aa, Entamoeba histolytica
VEGL

SEQ ID NO: 2606914 - protein, 5 aa, Entamoeba histolytica
VEGLA

SEQ ID NO: 2606915 - protein, 9 aa, Entamoeba histolytica
VEKAKIELS

SEQ ID NO: 2606916 - protein, 7 aa, Entamoeba histolytica
VEPITEK

SEQ ID NO: 2606917 - protein, 6 aa, Entamoeba histolytica
VEPKPN

SEQ ID NO: 2606918 - protein, 4 aa, Entamoeba histolytica
VESD

SEQ ID NO: 2606919 - protein, 13 aa, Entamoeba histolytica
VESPGKVKYEDIG

SEQ ID NO: 2606920 - protein, 5 aa, Entamoeba histolytica
VESTS

SEQ ID NO: 2606921 - protein, 4 aa, Entamoeba histolytica
VETE

SEQ ID NO: 2606922 - protein, 8 aa, Entamoeba histolytica
VETEKETL

SEQ ID NO: 2606923 - protein, 10 aa, Entamoeba histolytica
VGEDDRANLE

SEQ ID NO: 2606924 - protein, 6 aa, Entamoeba histolytica
VGEGAK

SEQ ID NO: 2606925 - protein, 14 aa, Entamoeba histolytica
VGGEKEENQNEKYK

SEQ ID NO: 2606926 - protein, 9 aa, Entamoeba histolytica
VGGGTGSGF

SEQ ID NO: 2606927 - protein, 8 aa, Entamoeba histolytica
VGKEEPAI

SEQ ID NO: 2606928 - protein, 4 aa, Entamoeba histolytica
VGKN

SEQ ID NO: 2606929 - protein, 4 aa, Entamoeba histolytica
VGNQ

SEQ ID NO: 2606930 - protein, 7 aa, Entamoeba histolytica
VGPSKKY

SEQ ID NO: 2606931 - protein, 5 aa, Entamoeba histolytica
VGSIT

SEQ ID NO: 2606932 - protein, 7 aa, Entamoeba histolytica
VGSNGSL

SEQ ID NO: 2606933 - protein, 7 aa, Entamoeba histolytica
VGTSGTV

SEQ ID NO: 2606934 - protein, 5 aa, Entamoeba histolytica
VGVGK

SEQ ID NO: 2606935 - protein, 18 aa, Entamoeba histolytica
VHQEEDEEDEIPAQPVTR

SEQ ID NO: 2606936 - protein, 11 aa, Entamoeba histolytica
VHTDNSDKTVK

SEQ ID NO: 2606937 - protein, 5 aa, Entamoeba histolytica
VIEEK

SEQ ID NO: 2606938 - protein, 6 aa, Entamoeba histolytica
VKAPKG

SEQ ID NO: 2606939 - protein, 7 aa, Entamoeba histolytica
VKAQEIG

SEQ ID NO: 2606940 - protein, 5 aa, Entamoeba histolytica
VKATV

SEQ ID NO: 2606941 - protein, 10 aa, Entamoeba histolytica
VKDNEDGTYD

SEQ ID NO: 2606942 - protein, 11 aa, Entamoeba histolytica
VKDNGDGTYDV

SEQ ID NO: 2606943 - protein, 14 aa, Entamoeba histolytica
VKENGKKKGVQVKG

SEQ ID NO: 2606944 - protein, 6 aa, Entamoeba histolytica
VKEPGT

SEQ ID NO: 2606945 - protein, 11 aa, Entamoeba histolytica
VKEPSEKDEEK

SEQ ID NO: 2606946 - protein, 4 aa, Entamoeba histolytica
VKEQ

SEQ ID NO: 2606947 - protein, 6 aa, Entamoeba histolytica
VKGTAP

SEQ ID NO: 2606948 - protein, 8 aa, Entamoeba histolytica
VKKAEELG

SEQ ID NO: 2606949 - protein, 17 aa, Entamoeba histolytica
VKKEQPKIKKTTITPTP

SEQ ID NO: 2606950 - protein, 9 aa, Entamoeba histolytica
VKNNKADEK

SEQ ID NO: 2606951 - protein, 14 aa, Entamoeba histolytica
VKSALKKKTELKPK

SEQ ID NO: 2606952 - protein, 11 aa, Entamoeba histolytica
VKSTTGSSTDV

SEQ ID NO: 2606953 - protein, 11 aa, Entamoeba histolytica
VKTTTGSSTDV

SEQ ID NO: 2606954 - protein, 9 aa, Entamoeba histolytica
VLSKEEKEF

SEQ ID NO: 2606955 - protein, 9 aa, Entamoeba histolytica
VLSTTQKDS

SEQ ID NO: 2606956 - protein, 4 aa, Entamoeba histolytica
VNDE

SEQ ID NO: 2606957 - protein, 4 aa, Entamoeba histolytica
VNDK

SEQ ID NO: 2606958 - protein, 9 aa, Entamoeba histolytica
VNDSTLEER

SEQ ID NO: 2606959 - protein, 7 aa, Entamoeba histolytica
VNEDGER

SEQ ID NO: 2606960 - protein, 6 aa, Entamoeba histolytica
VNEEQI

SEQ ID NO: 2606961 - protein, 4 aa, Entamoeba histolytica
VNEI

SEQ ID NO: 2606962 - protein, 10 aa, Entamoeba histolytica
VNGIKARENK

SEQ ID NO: 2606963 - protein, 4 aa, Entamoeba histolytica
VNGK

SEQ ID NO: 2606964 - protein, 14 aa, Entamoeba histolytica
VNGPNSMKNEQKTI

SEQ ID NO: 2606965 - protein, 8 aa, Entamoeba histolytica
VNIPTSVS

SEQ ID NO: 2606966 - protein, 6 aa, Entamoeba histolytica
VNKKRK

SEQ ID NO: 2606967 - protein, 5 aa, Entamoeba histolytica
VNPSV

SEQ ID NO: 2606968 - protein, 8 aa, Entamoeba histolytica
VNTFSSEG

SEQ ID NO: 2606969 - protein, 5 aa, Entamoeba histolytica
VPESS

SEQ ID NO: 2606970 - protein, 9 aa, Entamoeba histolytica
VPGDPLDKE

SEQ ID NO: 2606971 - protein, 12 aa, Entamoeba histolytica
VPGRTKKQCKDR

SEQ ID NO: 2606972 - protein, 16 aa, Entamoeba histolytica
VPKEEENKEKTIAQQI

SEQ ID NO: 2606973 - protein, 4 aa, Entamoeba histolytica
VPKN

SEQ ID NO: 2606974 - protein, 5 aa, Entamoeba histolytica
VPKPY

SEQ ID NO: 2606975 - protein, 25 aa, Entamoeba histolytica
VPPRSDAPKNSFNKGQHQGKNSFGV

SEQ ID NO: 2606976 - protein, 7 aa, Entamoeba histolytica
VPPTENE

SEQ ID NO: 2606977 - protein, 8 aa, Entamoeba histolytica
VPPTENET

SEQ ID NO: 2606978 - protein, 9 aa, Entamoeba histolytica
VPQENRTKV

SEQ ID NO: 2606979 - protein, 7 aa, Entamoeba histolytica
VPRTVNS

SEQ ID NO: 2606980 - protein, 5 aa, Entamoeba histolytica
VPTPN

SEQ ID NO: 2606981 - protein, 12 aa, Entamoeba histolytica
VPTRTKKQCRER

SEQ ID NO: 2606982 - protein, 8 aa, Entamoeba histolytica
VPTTETKM

SEQ ID NO: 2606983 - protein, 6 aa, Entamoeba histolytica
VPTTTN

SEQ ID NO: 2606984 - protein, 14 aa, Entamoeba histolytica
VQAQYKNAKVGEEV

SEQ ID NO: 2606985 - protein, 12 aa, Entamoeba histolytica
VQPHSTASETVP

SEQ ID NO: 2606986 - protein, 7 aa, Entamoeba histolytica
VQSGQER

SEQ ID NO: 2606987 - protein, 8 aa, Entamoeba histolytica
VRGAQPNS

SEQ ID NO: 2606988 - protein, 9 aa, Entamoeba histolytica
VRRAAAKRM

SEQ ID NO: 2606989 - protein, 7 aa, Entamoeba histolytica
VRSKEKG

SEQ ID NO: 2606990 - protein, 7 aa, Entamoeba histolytica
VSAETSA

SEQ ID NO: 2606991 - protein, 7 aa, Entamoeba histolytica
VSDHNSM

SEQ ID NO: 2606992 - protein, 13 aa, Entamoeba histolytica
VSDSPNSKTNKPL

SEQ ID NO: 2606993 - protein, 6 aa, Entamoeba histolytica
VSEDTK

SEQ ID NO: 2606994 - protein, 6 aa, Entamoeba histolytica
VSEGDG

SEQ ID NO: 2606995 - protein, 9 aa, Entamoeba histolytica
VSEQNKRTL

SEQ ID NO: 2606996 - protein, 8 aa, Entamoeba histolytica
VSETIEPN

SEQ ID NO: 2606997 - protein, 4 aa, Entamoeba histolytica
VSGY

SEQ ID NO: 2606998 - protein, 8 aa, Entamoeba histolytica
VSHPVEQQ

SEQ ID NO: 2606999 - protein, 7 aa, Entamoeba histolytica
VSIEDED

SEQ ID NO: 2607000 - protein, 10 aa, Entamoeba histolytica
VSIKGNEKCK

SEQ ID NO: 2607001 - protein, 8 aa, Entamoeba histolytica
VSKDAKDL

SEQ ID NO: 2607002 - protein, 18 aa, Entamoeba histolytica
VSKLKESNAALKRSGWGR

SEQ ID NO: 2607003 - protein, 9 aa, Entamoeba histolytica
VSNETEYPF

SEQ ID NO: 2607004 - protein, 4 aa, Entamoeba histolytica
VSNK

SEQ ID NO: 2607005 - protein, 19 aa, Entamoeba histolytica
VSQTSSDVVSGSQDIVKSD

SEQ ID NO: 2607006 - protein, 4 aa, Entamoeba histolytica
VSRP

SEQ ID NO: 2607007 - protein, 10 aa, Entamoeba histolytica
VSSEEKTKLN

SEQ ID NO: 2607008 - protein, 5 aa, Entamoeba histolytica
VSSKS

SEQ ID NO: 2607009 - protein, 11 aa, Entamoeba histolytica
VSSQNSTNSID

SEQ ID NO: 2607010 - protein, 6 aa, Entamoeba histolytica
VSSREV

SEQ ID NO: 2607011 - protein, 8 aa, Entamoeba histolytica
VSSSDKKV

SEQ ID NO: 2607012 - protein, 13 aa, Entamoeba histolytica
VSSVTTDKQRTEI

SEQ ID NO: 2607013 - protein, 7 aa, Entamoeba histolytica
VSTDDTV

SEQ ID NO: 2607014 - protein, 12 aa, Entamoeba histolytica
VSTEQGQKFAKE

SEQ ID NO: 2607015 - protein, 12 aa, Entamoeba histolytica
VSTNENFKRTIK

SEQ ID NO: 2607016 - protein, 5 aa, Entamoeba histolytica
VTCEG

SEQ ID NO: 2607017 - protein, 9 aa, Entamoeba histolytica
VTDSLSDSE

SEQ ID NO: 2607018 - protein, 6 aa, Entamoeba histolytica
VTEENT

SEQ ID NO: 2607019 - protein, 4 aa, Entamoeba histolytica
VTET

SEQ ID NO: 2607020 - protein, 13 aa, Entamoeba histolytica
VTGSEDNTMGLFA

SEQ ID NO: 2607021 - protein, 9 aa, Entamoeba histolytica
VTISKDKKA

SEQ ID NO: 2607022 - protein, 5 aa, Entamoeba histolytica
VTKDH

SEQ ID NO: 2607023 - protein, 24 aa, Entamoeba histolytica
VTKTPTQTPTTKNSSFGQKGQPSL

SEQ ID NO: 2607024 - protein, 9 aa, Entamoeba histolytica
VTPEKAIRQ

SEQ ID NO: 2607025 - protein, 4 aa, Entamoeba histolytica
VTQE

SEQ ID NO: 2607026 - protein, 9 aa, Entamoeba histolytica
VTRRSRRMS

SEQ ID NO: 2607027 - protein, 5 aa, Entamoeba histolytica
VTSDM

SEQ ID NO: 2607028 - protein, 5 aa, Entamoeba histolytica
VTSGK

SEQ ID NO: 2607029 - protein, 12 aa, Entamoeba histolytica
VTTGESPKYELT

SEQ ID NO: 2607030 - protein, 6 aa, Entamoeba histolytica
VVETNE

SEQ ID NO: 2607031 - protein, 9 aa, Entamoeba histolytica
VVGSGPAGL

SEQ ID NO: 2607032 - protein, 8 aa, Entamoeba histolytica
VVPKGSPV

SEQ ID NO: 2607033 - protein, 5 aa, Entamoeba histolytica
VYGGR

SEQ ID NO: 2607034 - protein, 16 aa, Entamoeba histolytica
WAPNKATQLCSASDDH

SEQ ID NO: 2607035 - protein, 10 aa, Entamoeba histolytica
WDDQDGGIGS

SEQ ID NO: 2607036 - protein, 8 aa, Entamoeba histolytica
WDKTEETK

SEQ ID NO: 2607037 - protein, 10 aa, Entamoeba histolytica
WGEDTNLDEM

SEQ ID NO: 2607038 - protein, 8 aa, Entamoeba histolytica
WGKSYGSC

SEQ ID NO: 2607039 - protein, 17 aa, Entamoeba histolytica
WGSDSKTFITASADKTC

SEQ ID NO: 2607040 - protein, 10 aa, Entamoeba histolytica
WKGSERKDVA

SEQ ID NO: 2607041 - protein, 4 aa, Entamoeba histolytica
WPKD

SEQ ID NO: 2607042 - protein, 6 aa, Entamoeba histolytica
WPPIQN

SEQ ID NO: 2607043 - protein, 13 aa, Entamoeba histolytica
WPYPSYETLWNTH

SEQ ID NO: 2607044 - protein, 9 aa, Entamoeba histolytica
WSGEGVKNL

SEQ ID NO: 2607045 - protein, 4 aa, Entamoeba histolytica
WSPA

SEQ ID NO: 2607046 - protein, 6 aa, Entamoeba histolytica
WSPDSL

SEQ ID NO: 2607047 - protein, 9 aa, Entamoeba histolytica
WTNEEDNKL

SEQ ID NO: 2607048 - protein, 10 aa, Entamoeba histolytica
YAQDEGKNTI

SEQ ID NO: 2607049 - protein, 12 aa, Entamoeba histolytica
YARTEEGKQDPA

SEQ ID NO: 2607050 - protein, 21 aa, Entamoeba histolytica
YATESNPSIPPPQSQQLPSFQ

SEQ ID NO: 2607051 - protein, 4 aa, Entamoeba histolytica
YDEI

SEQ ID NO: 2607052 - protein, 15 aa, Entamoeba histolytica
YDENKPETHKGRNLK

SEQ ID NO: 2607053 - protein, 6 aa, Entamoeba histolytica
YDGEEI

SEQ ID NO: 2607054 - protein, 10 aa, Entamoeba histolytica
YDKDKDGQIT

SEQ ID NO: 2607055 - protein, 25 aa, Entamoeba histolytica
YDKTLENKKVEKGVKLDTELDANDM

SEQ ID NO: 2607056 - protein, 33 aa, Entamoeba histolytica; identical to SEQ ID NO: 2552741

SEQ ID NO: 2607057 - protein, 7 aa, Entamoeba histolytica
YDPDERI

SEQ ID NO: 2607058 - protein, 9 aa, Entamoeba histolytica
YDPDNGEDY

SEQ ID NO: 2607059 - protein, 4 aa, Entamoeba histolytica
YDPK

SEQ ID NO: 2607060 - protein, 4 aa, Entamoeba histolytica
YDPS

SEQ ID NO: 2607061 - protein, 13 aa, Entamoeba histolytica
YDQYTSDIKDALE

SEQ ID NO: 2607062 - protein, 7 aa, Entamoeba histolytica
YDSSTCV

SEQ ID NO: 2607063 - protein, 6 aa, Entamoeba histolytica
YDTRYD

SEQ ID NO: 2607064 - protein, 19 aa, Entamoeba histolytica
YEEDLKTKLEDSKAKSQKI

SEQ ID NO: 2607065 - protein, 16 aa, Entamoeba histolytica
YEEEIERQKQKKAYGK

SEQ ID NO: 2607066 - protein, 9 aa, Entamoeba histolytica
YEEQESSAV

SEQ ID NO: 2607067 - protein, 10 aa, Entamoeba histolytica
YEEQRTNNIQ

SEQ ID NO: 2607068 - protein, 11 aa, Entamoeba histolytica
YENTYASPEPF

SEQ ID NO: 2607069 - protein, 8 aa, Entamoeba histolytica
YEPTLDDT

SEQ ID NO: 2607070 - protein, 4 aa, Entamoeba histolytica
YETL

SEQ ID NO: 2607071 - protein, 4 aa, Entamoeba histolytica
YGAN

SEQ ID NO: 2607072 - protein, 21 aa, Entamoeba histolytica
YGDQYNKHYNPSHRTLGSGKV

SEQ ID NO: 2607073 - protein, 15 aa, Entamoeba histolytica
YGEPSYSASISKDGS

SEQ ID NO: 2607074 - protein, 13 aa, Entamoeba histolytica
YGITGKGQPMMNN

SEQ ID NO: 2607075 - protein, 13 aa, Entamoeba histolytica
YGKTLYNDVLLNK

SEQ ID NO: 2607076 - protein, 5 aa, Entamoeba histolytica
YGNGC

SEQ ID NO: 2607077 - protein, 10 aa, Entamoeba histolytica
YGTNPSFGPS

SEQ ID NO: 2607078 - protein, 7 aa, Entamoeba histolytica
YGTRYGA

SEQ ID NO: 2607079 - protein, 4 aa, Entamoeba histolytica
YGTS

SEQ ID NO: 2607080 - protein, 18 aa, Entamoeba histolytica
YHPDPLHDDDTSKYLKIT

SEQ ID NO: 2607081 - protein, 4 aa, Entamoeba histolytica
YIKD

SEQ ID NO: 2607082 - protein, 8 aa, Entamoeba histolytica
YIQQEGKI

SEQ ID NO: 2607083 - protein, 12 aa, Entamoeba histolytica
YITESGSLNVTN

SEQ ID NO: 2607084 - protein, 9 aa, Entamoeba histolytica
YKAANPSMM

SEQ ID NO: 2607085 - protein, 4 aa, Entamoeba histolytica
YKGE

SEQ ID NO: 2607086 - protein, 4 aa, Entamoeba histolytica
YKGS

SEQ ID NO: 2607087 - protein, 6 aa, Entamoeba histolytica
YKTTCP

SEQ ID NO: 2607088 - protein, 10 aa, Entamoeba histolytica
YLNEDKEIEE

SEQ ID NO: 2607089 - protein, 5 aa, Entamoeba histolytica
YMSED

SEQ ID NO: 2607090 - protein, 9 aa, Entamoeba histolytica
YMSQTDKGI

SEQ ID NO: 2607091 - protein, 5 aa, Entamoeba histolytica
YNEIE

SEQ ID NO: 2607092 - protein, 8 aa, Entamoeba histolytica
YNGSGPEI

SEQ ID NO: 2607093 - protein, 22 aa, Entamoeba histolytica
YNKIESKELNEQLEYYQSQLNN

SEQ ID NO: 2607094 - protein, 5 aa, Entamoeba histolytica
YNQED

SEQ ID NO: 2607095 - protein, 11 aa, Entamoeba histolytica
YNRFSDENLRK

SEQ ID NO: 2607096 - protein, 7 aa, Entamoeba histolytica
YPDYTEQ

SEQ ID NO: 2607097 - protein, 6 aa, Entamoeba histolytica
YPEPIK

SEQ ID NO: 2607098 - protein, 14 aa, Entamoeba histolytica
YPGSHIGPEPTTDG

SEQ ID NO: 2607099 - protein, 6 aa, Entamoeba histolytica
YPIKPP

SEQ ID NO: 2607100 - protein, 13 aa, Entamoeba histolytica
YPISQKKAISSQF

SEQ ID NO: 2607101 - protein, 4 aa, Entamoeba histolytica
YPKN

SEQ ID NO: 2607102 - protein, 23 aa, Entamoeba histolytica
YPKQAEALANPLDNPELFVLPEQ

SEQ ID NO: 2607103 - protein, 8 aa, Entamoeba histolytica
YPYNPNSV

SEQ ID NO: 2607104 - protein, 10 aa, Entamoeba histolytica
YQENNKEMTG

SEQ ID NO: 2607105 - protein, 17 aa, Entamoeba histolytica
YQQQYQPNYQYNGNSYP

SEQ ID NO: 2607106 - protein, 4 aa, Entamoeba histolytica
YQSK

SEQ ID NO: 2607107 - protein, 4 aa, Entamoeba histolytica
YQTS

SEQ ID NO: 2607108 - protein, 14 aa, Entamoeba histolytica
YRIPEDQKEAAKKI

SEQ ID NO: 2607109 - protein, 6 aa, Entamoeba histolytica
YRPGES

SEQ ID NO: 2607110 - protein, 15 aa, Entamoeba histolytica
YRQQDGEINRENKWR

SEQ ID NO: 2607111 - protein, 10 aa, Entamoeba histolytica
YRSDDRRGDH

SEQ ID NO: 2607112 - protein, 11 aa, Entamoeba histolytica
YSIGKSEMADD

SEQ ID NO: 2607113 - protein, 5 aa, Entamoeba histolytica
YSSIE

SEQ ID NO: 2607114 - protein, 5 aa, Entamoeba histolytica
YSSNV

SEQ ID NO: 2607115 - protein, 6 aa, Entamoeba histolytica
YTDGKS

SEQ ID NO: 2607116 - protein, 7 aa, Entamoeba histolytica
YTEQSAQ

SEQ ID NO: 2607117 - protein, 12 aa, Entamoeba histolytica
YTFSEKKVKTAH

SEQ ID NO: 2607118 - protein, 13 aa, Entamoeba histolytica
YTKEDIKKYGNTI

SEQ ID NO: 2607119 - protein, 10 aa, Entamoeba histolytica
YTKEDRIKYG

SEQ ID NO: 2607120 - protein, 6 aa, Entamoeba histolytica
YTNDKH

SEQ ID NO: 2607121 - protein, 6 aa, Entamoeba histolytica
YTPSGT

SEQ ID NO: 2607122 - protein, 5 aa, Entamoeba histolytica
YTQGM

SEQ ID NO: 2607123 - protein, 11 aa, Entamoeba histolytica
YTSNSPSSLAG

SEQ ID NO: 2607124 - protein, 25 aa, Entamoeba histolytica
YVEKEKKEQLGLKHPNDLKTPIKQK

SEQ ID NO: 2607125 - protein, 4 aa, Entamoeba histolytica
YVPP

SEQ ID NO: 2607126 - protein, 7 aa, Entamoeba histolytica
YVPTEDG

SEQ ID NO: 2607127 - protein, 9 aa, Entamoeba histolytica
YYENDKPFN

SEQ ID NO: 2607128 - protein, 10 aa, Entamoeba histolytica
YYPPYQGYAD

SEQ ID NO: 2607129 - protein, 4 aa, Entamoeba histolytica
YYRG

SEQ ID NO: 2607130 - protein, 7 aa, Entamoeba histolytica
AAAAANQ

SEQ ID NO: 2607131 - protein, 32 aa, Entamoeba histolytica
AAAAKTSESGYRAGSNAAGPMASKGTWEATTD

SEQ ID NO: 2607132 - protein, 21 aa, Entamoeba histolytica
AAAKAPGATRIYTPGEKEHET

SEQ ID NO: 2607133 - protein, 7 aa, Entamoeba histolytica
AAAPGYF

SEQ ID NO: 2607134 - protein, 9 aa, Entamoeba histolytica
AAAPSYYKP

SEQ ID NO: 2607135 - protein, 10 aa, Entamoeba histolytica
AAAPTGNARD

SEQ ID NO: 2607136 - protein, 6 aa, Entamoeba histolytica
AAAREK

SEQ ID NO: 2607137 - protein, 6 aa, Entamoeba histolytica
AAASQK

SEQ ID NO: 2607138 - protein, 6 aa, Entamoeba histolytica
AACENT

SEQ ID NO: 2607139 - protein, 6 aa, Entamoeba histolytica
AACSQQ

SEQ ID NO: 2607140 - protein, 20 aa, Entamoeba histolytica
AADALSKISRQRSNTSNKKD

SEQ ID NO: 2607141 - protein, 9 aa, Entamoeba histolytica
AADDKEKKL

SEQ ID NO: 2607142 - protein, 7 aa, Entamoeba histolytica
AADGPDK

SEQ ID NO: 2607143 - protein, 11 aa, Entamoeba histolytica
AADITGTSDGY

SEQ ID NO: 2607144 - protein, 7 aa, Entamoeba histolytica
AADPEGL

SEQ ID NO: 2607145 - protein, 18 aa, Entamoeba histolytica
AADVPKGSVKPKHTLTGT

SEQ ID NO: 2607146 - protein, 27 aa, Entamoeba histolytica
AAEDAAKAKKEKREKDLKERKKNARVI

SEQ ID NO: 2607147 - protein, 8 aa, Entamoeba histolytica
AAEDENIR

SEQ ID NO: 2607148 - protein, 6 aa, Entamoeba histolytica
AAEDIK

SEQ ID NO: 2607149 - protein, 36 aa, Entamoeba histolytica
AAEEREARERREKERGRYRTKYRRTERSESRERNKK

SEQ ID NO: 2607150 - protein, 14 aa, Entamoeba histolytica
AAEERLKKESEIEG

SEQ ID NO: 2607151 - protein, 52 aa, Entamoeba histolytica
AAEIEANEKKTKKRKSFKEPLKNKEKEGIKSPKQKEKEKKVVTPLPKTRETL

SEQ ID NO: 2607152 - protein, 37 aa, Entamoeba histolytica
AAEKAKVNYKKAVTEHKNAVEAGKTLEGPAQEKNNIK

SEQ ID NO: 2607153 - protein, 9 aa, Entamoeba histolytica
AAEKDKSEV

SEQ ID NO: 2607154 - protein, 6 aa, Entamoeba histolytica
AAEKGL

SEQ ID NO: 2607155 - protein, 4 aa, Entamoeba histolytica
AAEN

SEQ ID NO: 2607156 - protein, 38 aa, Entamoeba histolytica
AAENEAREAERKKEEEEKKPEEKKEEEKKPEPKKEVKK

SEQ ID NO: 2607157 - protein, 10 aa, Entamoeba histolytica
AAENGDKNGM

SEQ ID NO: 2607158 - protein, 7 aa, Entamoeba histolytica
AAEQEKM

SEQ ID NO: 2607159 - protein, 9 aa, Entamoeba histolytica
AAESKHKTI

SEQ ID NO: 2607160 - protein, 11 aa, Entamoeba histolytica
AAFDKGASTIS

SEQ ID NO: 2607161 - protein, 5 aa, Entamoeba histolytica
AAGDI

SEQ ID NO: 2607162 - protein, 11 aa, Entamoeba histolytica
AAGEEEVSPST

SEQ ID NO: 2607163 - protein, 12 aa, Entamoeba histolytica
AAGEKEQEAFNN

SEQ ID NO: 2607164 - protein, 13 aa, Entamoeba histolytica
AAGGGGSCKSGIK

SEQ ID NO: 2607165 - protein, 7 aa, Entamoeba histolytica
AAGGIRT

SEQ ID NO: 2607166 - protein, 7 aa, Entamoeba histolytica
AAGGISS

SEQ ID NO: 2607167 - protein, 33 aa, Entamoeba histolytica; identical to SEQ ID NO: 2405619

SEQ ID NO: 2607168 - protein, 37 aa, Entamoeba histolytica
AAGKSLKKQKAKEVTQEGQLGTSKTDKVSEKELLGNE

SEQ ID NO: 2607169 - protein, 6 aa, Entamoeba histolytica
AAGKTT

SEQ ID NO: 2607170 - protein, 14 aa, Entamoeba histolytica
AAGLDTKAGCTGTY

SEQ ID NO: 2607171 - protein, 5 aa, Entamoeba histolytica
AAGLE

SEQ ID NO: 2607172 - protein, 12 aa, Entamoeba histolytica
AAGLGGTGKKGK

SEQ ID NO: 2607173 - protein, 7 aa, Entamoeba histolytica
AAGRGDH

SEQ ID NO: 2607174 - protein, 6 aa, Entamoeba histolytica
AAGSLK

SEQ ID NO: 2607175 - protein, 7 aa, Entamoeba histolytica
AAGTGIT

SEQ ID NO: 2607176 - protein, 8 aa, Entamoeba histolytica
AAGTGKSY

SEQ ID NO: 2607177 - protein, 15 aa, Entamoeba histolytica
AAHPNYPDRTDDKHP

SEQ ID NO: 2607178 - protein, 7 aa, Entamoeba histolytica
AAHSNSY

SEQ ID NO: 2607179 - protein, 7 aa, Entamoeba histolytica
AAHSNTK

SEQ ID NO: 2607180 - protein, 19 aa, Entamoeba histolytica
AAKEPTGKKEKGGKKGCSL

SEQ ID NO: 2607181 - protein, 8 aa, Entamoeba histolytica
AAKETQNR

SEQ ID NO: 2607182 - protein, 9 aa, Entamoeba histolytica
AAKGEGQQL

SEQ ID NO: 2607183 - protein, 35 aa, Entamoeba histolytica; identical to SEQ ID NO: 2411653

SEQ ID NO: 2607184 - protein, 10 aa, Entamoeba histolytica
AAKNRLSRQA

SEQ ID NO: 2607185 - protein, 6 aa, Entamoeba histolytica
AAKPNS

SEQ ID NO: 2607186 - protein, 5 aa, Entamoeba histolytica
AAKRI

SEQ ID NO: 2607187 - protein, 5 aa, Entamoeba histolytica
AALAA

SEQ ID NO: 2607188 - protein, 6 aa, Entamoeba histolytica
AALKNT

SEQ ID NO: 2607189 - protein, 12 aa, Entamoeba histolytica
AALSPEEQKLYD

SEQ ID NO: 2607190 - protein, 9 aa, Entamoeba histolytica
AALTNSKER

SEQ ID NO: 2607191 - protein, 9 aa, Entamoeba histolytica
AALTRKPKL

SEQ ID NO: 2607192 - protein, 5 aa, Entamoeba histolytica
AAMKP

SEQ ID NO: 2607193 - protein, 10 aa, Entamoeba histolytica
AANAPTAEER

SEQ ID NO: 2607194 - protein, 12 aa, Entamoeba histolytica
AANEAAAVPRKR

SEQ ID NO: 2607195 - protein, 6 aa, Entamoeba histolytica
AANEED

SEQ ID NO: 2607196 - protein, 8 aa, Entamoeba histolytica
AANEEEEK

SEQ ID NO: 2607197 - protein, 7 aa, Entamoeba histolytica
AANEEKV

SEQ ID NO: 2607198 - protein, 6 aa, Entamoeba histolytica
AANETF

SEQ ID NO: 2607199 - protein, 8 aa, Entamoeba histolytica
AANFNDST

SEQ ID NO: 2607200 - protein, 4 aa, Entamoeba histolytica
AANG

SEQ ID NO: 2607201 - protein, 10 aa, Entamoeba histolytica
AANGATKEKI

SEQ ID NO: 2607202 - protein, 4 aa, Entamoeba histolytica
AANI

SEQ ID NO: 2607203 - protein, 31 aa, Entamoeba histolytica
AANKARKEAKSSKVGNKKPSKEIKAKEMAPI

SEQ ID NO: 2607204 - protein, 10 aa, Entamoeba histolytica
AANKATKKVK

SEQ ID NO: 2607205 - protein, 8 aa, Entamoeba histolytica
AANLETTP

SEQ ID NO: 2607206 - protein, 8 aa, Entamoeba histolytica
AANNGSSI

SEQ ID NO: 2607207 - protein, 10 aa, Entamoeba histolytica
AANPKTASYL

SEQ ID NO: 2607208 - protein, 18 aa, Entamoeba histolytica
AANPKTGKYNPNKNLNQN

SEQ ID NO: 2607209 - protein, 8 aa, Entamoeba histolytica
AANPSFGR

SEQ ID NO: 2607210 - protein, 17 aa, Entamoeba histolytica
AANPSNGNYDVKKSPME

SEQ ID NO: 2607211 - protein, 13 aa, Entamoeba histolytica
AANTIKHDERQGR

SEQ ID NO: 2607212 - protein, 19 aa, Entamoeba histolytica
AANTSLNSKVVNQSSQTFA

SEQ ID NO: 2607213 - protein, 30 aa, Entamoeba histolytica
AAPAAEEKKEEEVKEEKKEEAETPAAEEKK

SEQ ID NO: 2607214 - protein, 37 aa, Entamoeba histolytica
AAPAAGAAAQTETKAEEKKEEKKEEEEEEDFGGFGDL

SEQ ID NO: 2607215 - protein, 36 aa, Entamoeba histolytica
AAPAATAAQTETKAEEKKEEKKEEEEEEDFGGFGDL

SEQ ID NO: 2607216 - protein, 31 aa, Entamoeba histolytica
AAPASTEEKKEEEVKEEKKEEATPAETEEKK

SEQ ID NO: 2607217 - protein, 7 aa, Entamoeba histolytica
AAPDNLK

SEQ ID NO: 2607218 - protein, 8 aa, Entamoeba histolytica
AAPEASGI

SEQ ID NO: 2607219 - protein, 8 aa, Entamoeba histolytica
AAPEGSNL

SEQ ID NO: 2607220 - protein, 6 aa, Entamoeba histolytica
AAPEIA

SEQ ID NO: 2607221 - protein, 8 aa, Entamoeba histolytica
AAPETKPV

SEQ ID NO: 2607222 - protein, 4 aa, Entamoeba histolytica
AAPG

SEQ ID NO: 2607223 - protein, 9 aa, Entamoeba histolytica
AAPGNKTTH

SEQ ID NO: 2607224 - protein, 8 aa, Entamoeba histolytica
AAPPHVTN

SEQ ID NO: 2607225 - protein, 27 aa, Entamoeba histolytica
AAPPPLKKKRVTKPKTKSKVKSTNKKN

SEQ ID NO: 2607226 - protein, 22 aa, Entamoeba histolytica
AAPPPPMNKSSVTVAAPPPPMH

SEQ ID NO: 2607227 - protein, 10 aa, Entamoeba histolytica
AAPPPPPSKI

SEQ ID NO: 2607228 - protein, 15 aa, Entamoeba histolytica
AAPPRKRAMSASAQA

SEQ ID NO: 2607229 - protein, 19 aa, Entamoeba histolytica
AAPQDPKGFVSKRNLPEYF

SEQ ID NO: 2607230 - protein, 9 aa, Entamoeba histolytica
AAPTDEQKE

SEQ ID NO: 2607231 - protein, 6 aa, Entamoeba histolytica
AAPTPK

SEQ ID NO: 2607232 - protein, 4 aa, Entamoeba histolytica
AAQA

SEQ ID NO: 2607233 - protein, 24 aa, Entamoeba histolytica
AAQEEAEQMRNAPVRSEPAPSDLP

SEQ ID NO: 2607234 - protein, 7 aa, Entamoeba histolytica
AAQERNY

SEQ ID NO: 2607235 - protein, 14 aa, Entamoeba histolytica
AAQGIEEDKNWEGK

SEQ ID NO: 2607236 - protein, 6 aa, Entamoeba histolytica
AAQKTI

SEQ ID NO: 2607237 - protein, 6 aa, Entamoeba histolytica
AAQSQV

SEQ ID NO: 2607238 - protein, 4 aa, Entamoeba histolytica
AAQT

SEQ ID NO: 2607239 - protein, 6 aa, Entamoeba histolytica
AAQTKS

SEQ ID NO: 2607240 - protein, 14 aa, Entamoeba histolytica
AAQTLQGHKRKVGT

SEQ ID NO: 2607241 - protein, 19 aa, Entamoeba histolytica
AARADSCRNDTGSIDGTCG

SEQ ID NO: 2607242 - protein, 6 aa, Entamoeba histolytica
AARDEY

SEQ ID NO: 2607243 - protein, 12 aa, Entamoeba histolytica
AAREGEKERSNI

SEQ ID NO: 2607244 - protein, 15 aa, Entamoeba histolytica
AARLRRDKQRQERRR

SEQ ID NO: 2607245 - protein, 9 aa, Entamoeba histolytica
AARRKAGKK

SEQ ID NO: 2607246 - protein, 8 aa, Entamoeba histolytica
AARSGGSV

SEQ ID NO: 2607247 - protein, 9 aa, Entamoeba histolytica
AARTGSGKT

SEQ ID NO: 2607248 - protein, 6 aa, Entamoeba histolytica
AARVGD

SEQ ID NO: 2607249 - protein, 12 aa, Entamoeba histolytica
AASGTGKYPTVA

SEQ ID NO: 2607250 - protein, 5 aa, Entamoeba histolytica
AASLY

SEQ ID NO: 2607251 - protein, 6 aa, Entamoeba histolytica
AASNRQ

SEQ ID NO: 2607252 - protein, 12 aa, Entamoeba histolytica
AASPTNPLRFYQ

SEQ ID NO: 2607253 - protein, 8 aa, Entamoeba histolytica
AASQAKAD

SEQ ID NO: 2607254 - protein, 13 aa, Entamoeba histolytica
AASQENKKGNKKK

SEQ ID NO: 2607255 - protein, 5 aa, Entamoeba histolytica
AASQG

SEQ ID NO: 2607256 - protein, 7 aa, Entamoeba histolytica
AASQKQV

SEQ ID NO: 2607257 - protein, 32 aa, Entamoeba histolytica
AASSIKKSAVTVSNNSGVSINDPSPNKNAGGC

SEQ ID NO: 2607258 - protein, 10 aa, Entamoeba histolytica
AASSKKEDFK

SEQ ID NO: 2607259 - protein, 21 aa, Entamoeba histolytica
AASSPNSCASPKSTGSVSSLS

SEQ ID NO: 2607260 - protein, 15 aa, Entamoeba histolytica
AASSPNTSNDGKDHT

SEQ ID NO: 2607261 - protein, 23 aa, Entamoeba histolytica
AATEEKGGKKVVKPKANKQQPVK

SEQ ID NO: 2607262 - protein, 13 aa, Entamoeba histolytica
AATESYKKQIDDL

SEQ ID NO: 2607263 - protein, 9 aa, Entamoeba histolytica
AATKELEAP

SEQ ID NO: 2607264 - protein, 5 aa, Entamoeba histolytica
AATLS

SEQ ID NO: 2607265 - protein, 11 aa, Entamoeba histolytica
AATNLRRPEEG

SEQ ID NO: 2607266 - protein, 10 aa, Entamoeba histolytica
AATNTDSGKY

SEQ ID NO: 2607267 - protein, 18 aa, Entamoeba histolytica
AATSCPPEQARQPLPSVG

SEQ ID NO: 2607268 - protein, 14 aa, Entamoeba histolytica
AATVGKGDTEGDNQ

SEQ ID NO: 2607269 - protein, 11 aa, Entamoeba histolytica
AATVSEENLEY

SEQ ID NO: 2607270 - protein, 7 aa, Entamoeba histolytica
AAVKSKK

SEQ ID NO: 2607271 - protein, 4 aa, Entamoeba histolytica
AAVR

SEQ ID NO: 2607272 - protein, 5 aa, Entamoeba histolytica
AAVTD

SEQ ID NO: 2607273 - protein, 14 aa, Entamoeba histolytica
AAYEETEKIDSTTY

SEQ ID NO: 2607274 - protein, 6 aa, Entamoeba histolytica
AAYEKR

SEQ ID NO: 2607275 - protein, 6 aa, Entamoeba histolytica
AAYGPI

SEQ ID NO: 2607276 - protein, 12 aa, Entamoeba histolytica
AAYGSKHDSTYT

SEQ ID NO: 2607277 - protein, 5 aa, Entamoeba histolytica
AAYKN

SEQ ID NO: 2607278 - protein, 23 aa, Entamoeba histolytica
ACDTGYFSRETKEFSPALGEDSI

SEQ ID NO: 2607279 - protein, 10 aa, Entamoeba histolytica
ACETSGTSQV

SEQ ID NO: 2607280 - protein, 11 aa, Entamoeba histolytica
ACNDPPYSPDI

SEQ ID NO: 2607281 - protein, 4 aa, Entamoeba histolytica
ACNE

SEQ ID NO: 2607282 - protein, 6 aa, Entamoeba histolytica
ACNNRE

SEQ ID NO: 2607283 - protein, 10 aa, Entamoeba histolytica
ACNSSEQTNK

SEQ ID NO: 2607284 - protein, 6 aa, Entamoeba histolytica
ACPPSQ

SEQ ID NO: 2607285 - protein, 6 aa, Entamoeba histolytica
ACPSNS

SEQ ID NO: 2607286 - protein, 13 aa, Entamoeba histolytica
ACQTKITSRETSI

SEQ ID NO: 2607287 - protein, 6 aa, Entamoeba histolytica
ACSEIE

SEQ ID NO: 2607288 - protein, 8 aa, Entamoeba histolytica
ACTQNTDL

SEQ ID NO: 2607289 - protein, 6 aa, Entamoeba histolytica
ACTRSK

SEQ ID NO: 2607290 - protein, 8 aa, Entamoeba histolytica
ACTTNTDL

SEQ ID NO: 2607291 - protein, 4 aa, Entamoeba histolytica
ADAE

SEQ ID NO: 2607292 - protein, 6 aa, Entamoeba histolytica
ADAELG

SEQ ID NO: 2607293 - protein, 4 aa, Entamoeba histolytica
ADAF

SEQ ID NO: 2607294 - protein, 18 aa, Entamoeba histolytica
ADANGDGYITLEEFLAFN

SEQ ID NO: 2607295 - protein, 18 aa, Entamoeba histolytica
ADANGDGYITLEEFLEFS

SEQ ID NO: 2607296 - protein, 12 aa, Entamoeba histolytica
ADARLKQKTQQL

SEQ ID NO: 2607297 - protein, 21 aa, Entamoeba histolytica
ADARNEKNPEKEEEAKKIKED

SEQ ID NO: 2607298 - protein, 7 aa, Entamoeba histolytica
ADCGTTP

SEQ ID NO: 2607299 - protein, 9 aa, Entamoeba histolytica
ADDAGERSL

SEQ ID NO: 2607300 - protein, 7 aa, Entamoeba histolytica
ADDDINK

SEQ ID NO: 2607301 - protein, 6 aa, Entamoeba histolytica
ADDGGV

SEQ ID NO: 2607302 - protein, 8 aa, Entamoeba histolytica
ADDGYTDV

SEQ ID NO: 2607303 - protein, 4 aa, Entamoeba histolytica
ADDP

SEQ ID NO: 2607304 - protein, 5 aa, Entamoeba histolytica
ADDQI

SEQ ID NO: 2607305 - protein, 36 aa, Entamoeba histolytica
ADDRKRKSSLTESMKEPKTKKTAEEMLQEKLKGSSL

SEQ ID NO: 2607306 - protein, 18 aa, Entamoeba histolytica
ADEDAEEGAAGEAGEANV

SEQ ID NO: 2607307 - protein, 7 aa, Entamoeba histolytica
ADEDEEQ

SEQ ID NO: 2607308 - protein, 6 aa, Entamoeba histolytica
ADEDEM

SEQ ID NO: 2607309 - protein, 5 aa, Entamoeba histolytica
ADEDM

SEQ ID NO: 2607310 - protein, 17 aa, Entamoeba histolytica
ADEEEDLKAQAKQRVWD

SEQ ID NO: 2607311 - protein, 6 aa, Entamoeba histolytica
ADEEEM

SEQ ID NO: 2607312 - protein, 23 aa, Entamoeba histolytica
ADEEENEEKESRIEQIKGERKLE

SEQ ID NO: 2607313 - protein, 9 aa, Entamoeba histolytica
ADEGGQGTL

SEQ ID NO: 2607314 - protein, 16 aa, Entamoeba histolytica
ADEGTAMGKKGAEGIS

SEQ ID NO: 2607315 - protein, 8 aa, Entamoeba histolytica
ADEHKDTN

SEQ ID NO: 2607316 - protein, 6 aa, Entamoeba histolytica
ADENHV

SEQ ID NO: 2607317 - protein, 11 aa, Entamoeba histolytica
ADENIEKKGKL

SEQ ID NO: 2607318 - protein, 8 aa, Entamoeba histolytica
ADENSVDE

SEQ ID NO: 2607319 - protein, 8 aa, Entamoeba histolytica
ADERNDKG

SEQ ID NO: 2607320 - protein, 12 aa, Entamoeba histolytica
ADESLNAKPNVD

SEQ ID NO: 2607321 - protein, 6 aa, Entamoeba histolytica
ADETKQ

SEQ ID NO: 2607322 - protein, 4 aa, Entamoeba histolytica
ADEY

SEQ ID NO: 2607323 - protein, 13 aa, Entamoeba histolytica
ADFENRKNTEFTK

SEQ ID NO: 2607324 - protein, 12 aa, Entamoeba histolytica
ADFEQKELTDEV

SEQ ID NO: 2607325 - protein, 5 aa, Entamoeba histolytica
ADFGN

SEQ ID NO: 2607326 - protein, 4 aa, Entamoeba histolytica
ADFH

SEQ ID NO: 2607327 - protein, 11 aa, Entamoeba histolytica
ADGCSKGRNEL

SEQ ID NO: 2607328 - protein, 12 aa, Entamoeba histolytica
ADGDGKLTKEEV

SEQ ID NO: 2607329 - protein, 7 aa, Entamoeba histolytica
ADGERTF

SEQ ID NO: 2607330 - protein, 4 aa, Entamoeba histolytica
ADGF

SEQ ID NO: 2607331 - protein, 14 aa, Entamoeba histolytica
ADGIEDIKESNIPI

SEQ ID NO: 2607332 - protein, 9 aa, Entamoeba histolytica
ADGIGTGWS

SEQ ID NO: 2607333 - protein, 12 aa, Entamoeba histolytica
ADGKASPNSIQV

SEQ ID NO: 2607334 - protein, 12 aa, Entamoeba histolytica
ADGKASPNSMQV

SEQ ID NO: 2607335 - protein, 6 aa, Entamoeba histolytica
ADGNQQ

SEQ ID NO: 2607336 - protein, 7 aa, Entamoeba histolytica
ADGRKEN

SEQ ID NO: 2607337 - protein, 8 aa, Entamoeba histolytica
ADGRTSMG

SEQ ID NO: 2607338 - protein, 14 aa, Entamoeba histolytica
ADGSIIKQRGMKVG

SEQ ID NO: 2607339 - protein, 9 aa, Entamoeba histolytica
ADGSTPEKV

SEQ ID NO: 2607340 - protein, 5 aa, Entamoeba histolytica
ADGTC

SEQ ID NO: 2607341 - protein, 17 aa, Entamoeba histolytica
ADGTIQSNETENDNQME

SEQ ID NO: 2607342 - protein, 7 aa, Entamoeba histolytica
ADGTPPY

SEQ ID NO: 2607343 - protein, 8 aa, Entamoeba histolytica
ADGTYDNY

SEQ ID NO: 2607344 - protein, 7 aa, Entamoeba histolytica
ADHHDPK

SEQ ID NO: 2607345 - protein, 14 aa, Entamoeba histolytica
ADHKKEFQNRFSNR

SEQ ID NO: 2607346 - protein, 4 aa, Entamoeba histolytica
ADID

SEQ ID NO: 2607347 - protein, 9 aa, Entamoeba histolytica
ADIPDVPSR

SEQ ID NO: 2607348 - protein, 7 aa, Entamoeba histolytica
ADIPETK

SEQ ID NO: 2607349 - protein, 7 aa, Entamoeba histolytica
ADITETG

SEQ ID NO: 2607350 - protein, 5 aa, Entamoeba histolytica
ADKAI

SEQ ID NO: 2607351 - protein, 19 aa, Entamoeba histolytica
ADKEEEAKAPQKVEEIPEQ

SEQ ID NO: 2607352 - protein, 10 aa, Entamoeba histolytica
ADKIRKGNLQ

SEQ ID NO: 2607353 - protein, 10 aa, Entamoeba histolytica
ADKKEKPKGH

SEQ ID NO: 2607354 - protein, 7 aa, Entamoeba histolytica
ADKKELK

SEQ ID NO: 2607355 - protein, 7 aa, Entamoeba histolytica
ADKKGNT

SEQ ID NO: 2607356 - protein, 22 aa, Entamoeba histolytica
ADKNHKQALGDALKAKGYEFVF

SEQ ID NO: 2607357 - protein, 7 aa, Entamoeba histolytica
ADKNSRG

SEQ ID NO: 2607358 - protein, 10 aa, Entamoeba histolytica
ADKSKGGVGK

SEQ ID NO: 2607359 - protein, 7 aa, Entamoeba histolytica
ADKSTKK

SEQ ID NO: 2607360 - protein, 7 aa, Entamoeba histolytica
ADKTFTQ

SEQ ID NO: 2607361 - protein, 17 aa, Entamoeba histolytica
ADLAQTREVEEATAKEF

SEQ ID NO: 2607362 - protein, 9 aa, Entamoeba histolytica
ADLKKSLKK

SEQ ID NO: 2607363 - protein, 19 aa, Entamoeba histolytica
ADLKQEREVNTSDGTEFAQ

SEQ ID NO: 2607364 - protein, 10 aa, Entamoeba histolytica
ADLNGASKDL

SEQ ID NO: 2607365 - protein, 9 aa, Entamoeba histolytica
ADLRNSAEH

SEQ ID NO: 2607366 - protein, 6 aa, Entamoeba histolytica
ADMDPC

SEQ ID NO: 2607367 - protein, 44 aa, Entamoeba histolytica
ADMKTKNMKPEDKVPLEPKKVTTNTPKPATAKSVVQKPPKIEKN

SEQ ID NO: 2607368 - protein, 7 aa, Entamoeba histolytica
ADMPKKT

SEQ ID NO: 2607369 - protein, 9 aa, Entamoeba histolytica
ADNAGGQHP

SEQ ID NO: 2607370 - protein, 7 aa, Entamoeba histolytica
ADNCPSV

SEQ ID NO: 2607371 - protein, 4 aa, Entamoeba histolytica
ADND

SEQ ID NO: 2607372 - protein, 16 aa, Entamoeba histolytica
ADNDKIRKERDEYRNK

SEQ ID NO: 2607373 - protein, 11 aa, Entamoeba histolytica
ADNEEKSAQER

SEQ ID NO: 2607374 - protein, 5 aa, Entamoeba histolytica
ADNEI

SEQ ID NO: 2607375 - protein, 12 aa, Entamoeba histolytica
ADNFTAHEDLNE

SEQ ID NO: 2607376 - protein, 6 aa, Entamoeba histolytica
ADNGRM

SEQ ID NO: 2607377 - protein, 10 aa, Entamoeba histolytica
ADNSDIKKNK

SEQ ID NO: 2607378 - protein, 16 aa, Entamoeba histolytica
ADNSNVPNKFKTYPTN

SEQ ID NO: 2607379 - protein, 14 aa, Entamoeba histolytica
ADNTKILSSGRDKT

SEQ ID NO: 2607380 - protein, 58 aa, Entamoeba histolytica; identical to SEQ ID NO: 2411833

SEQ ID NO: 2607381 - protein, 14 aa, Entamoeba histolytica
ADNYQSYFNYLMSL

SEQ ID NO: 2607382 - protein, 11 aa, Entamoeba histolytica
ADPKDKLNEHK

SEQ ID NO: 2607383 - protein, 6 aa, Entamoeba histolytica
ADPLGE

SEQ ID NO: 2607384 - protein, 6 aa, Entamoeba histolytica
ADPLTS

SEQ ID NO: 2607385 - protein, 14 aa, Entamoeba histolytica
ADPNDAFAKNKEEF

SEQ ID NO: 2607386 - protein, 6 aa, Entamoeba histolytica
ADPQAE

SEQ ID NO: 2607387 - protein, 7 aa, Entamoeba histolytica
ADPRGQK

SEQ ID NO: 2607388 - protein, 24 aa, Entamoeba histolytica
ADPSKVEEKCNGSEITTAITSNGK

SEQ ID NO: 2607389 - protein, 4 aa, Entamoeba histolytica
ADPT

SEQ ID NO: 2607390 - protein, 6 aa, Entamoeba histolytica
ADPTIP

SEQ ID NO: 2607391 - protein, 8 aa, Entamoeba histolytica
ADQQEREI

SEQ ID NO: 2607392 - protein, 7 aa, Entamoeba histolytica
ADQQGTW

SEQ ID NO: 2607393 - protein, 11 aa, Entamoeba histolytica
ADRALKNERLN

SEQ ID NO: 2607394 - protein, 14 aa, Entamoeba histolytica
ADRDAVSQKQNDIT

SEQ ID NO: 2607395 - protein, 7 aa, Entamoeba histolytica
ADRESSM

SEQ ID NO: 2607396 - protein, 6 aa, Entamoeba histolytica
ADREVA

SEQ ID NO: 2607397 - protein, 7 aa, Entamoeba histolytica
ADRGDFD

SEQ ID NO: 2607398 - protein, 7 aa, Entamoeba histolytica
ADRTKSC

SEQ ID NO: 2607399 - protein, 14 aa, Entamoeba histolytica
ADSEINKAIPEGRR

SEQ ID NO: 2607400 - protein, 5 aa, Entamoeba histolytica
ADSEY

SEQ ID NO: 2607401 - protein, 6 aa, Entamoeba histolytica
ADSFEK

SEQ ID NO: 2607402 - protein, 9 aa, Entamoeba histolytica
ADSFPKDKH

SEQ ID NO: 2607403 - protein, 12 aa, Entamoeba histolytica
ADSIMDDTTGSY

SEQ ID NO: 2607404 - protein, 7 aa, Entamoeba histolytica
ADSINSL

SEQ ID NO: 2607405 - protein, 5 aa, Entamoeba histolytica
ADSIQ

SEQ ID NO: 2607406 - protein, 8 aa, Entamoeba histolytica
ADSLKPGT

SEQ ID NO: 2607407 - protein, 7 aa, Entamoeba histolytica
ADSMTTA

SEQ ID NO: 2607408 - protein, 8 aa, Entamoeba histolytica
ADSNQISS

SEQ ID NO: 2607409 - protein, 8 aa, Entamoeba histolytica
ADSQESDC

SEQ ID NO: 2607410 - protein, 5 aa, Entamoeba histolytica
ADSQV

SEQ ID NO: 2607411 - protein, 10 aa, Entamoeba histolytica
ADTELGNKPW

SEQ ID NO: 2607412 - protein, 7 aa, Entamoeba histolytica
ADTERAV

SEQ ID NO: 2607413 - protein, 4 aa, Entamoeba histolytica
ADTI

SEQ ID NO: 2607414 - protein, 13 aa, Entamoeba histolytica
ADTISSNTFNESS

SEQ ID NO: 2607415 - protein, 4 aa, Entamoeba histolytica
ADTK

SEQ ID NO: 2607416 - protein, 8 aa, Entamoeba histolytica
ADTNQDTN

SEQ ID NO: 2607417 - protein, 12 aa, Entamoeba histolytica
ADTNQIERSPDD

SEQ ID NO: 2607418 - protein, 6 aa, Entamoeba histolytica
ADTQSQ

SEQ ID NO: 2607419 - protein, 5 aa, Entamoeba histolytica
ADTRE

SEQ ID NO: 2607420 - protein, 9 aa, Entamoeba histolytica
ADTSTEAMN

SEQ ID NO: 2607421 - protein, 8 aa, Entamoeba histolytica
ADVEKSVN

SEQ ID NO: 2607422 - protein, 7 aa, Entamoeba histolytica
ADVGGLE

SEQ ID NO: 2607423 - protein, 8 aa, Entamoeba histolytica
ADVKTDSQ

SEQ ID NO: 2607424 - protein, 4 aa, Entamoeba histolytica
ADVN

SEQ ID NO: 2607425 - protein, 6 aa, Entamoeba histolytica
ADVNVQ

SEQ ID NO: 2607426 - protein, 5 aa, Entamoeba histolytica
ADVSM

SEQ ID NO: 2607427 - protein, 10 aa, Entamoeba histolytica
ADWDAEKKKS

SEQ ID NO: 2607428 - protein, 6 aa, Entamoeba histolytica
ADYDKK

SEQ ID NO: 2607429 - protein, 52 aa, Entamoeba histolytica
ADYETKEASFNTQIGKTQAELKKYQQQVRDDETRMSSLEDEIKKGTDALANK

SEQ ID NO: 2607430 - protein, 7 aa, Entamoeba histolytica
ADYTNAY

SEQ ID NO: 2607431 - protein, 18 aa, Entamoeba histolytica
AEAAMKGGKNLDHPKPIL

SEQ ID NO: 2607432 - protein, 8 aa, Entamoeba histolytica
AEAEKNAP

SEQ ID NO: 2607433 - protein, 13 aa, Entamoeba histolytica
AEAEQNQRGDDSQ

SEQ ID NO: 2607434 - protein, 5 aa, Entamoeba histolytica
AEAEV

SEQ ID NO: 2607435 - protein, 51 aa, Entamoeba histolytica
  misc_feature (13)..(46): Xaa can be any naturally occurring amino acid
AEAEVNNIVWATXXXXXXXXXXXXXXXXXXXXXXXXXXXXXXXXXXCLLIL

SEQ ID NO: 2607436 - protein, 9 aa, Entamoeba histolytica
AEAGEEGKK

SEQ ID NO: 2607437 - protein, 9 aa, Entamoeba histolytica
AEAKNKGRI

SEQ ID NO: 2607438 - protein, 7 aa, Entamoeba histolytica
AEALTQA

SEQ ID NO: 2607439 - protein, 4 aa, Entamoeba histolytica
AEAN

SEQ ID NO: 2607440 - protein, 6 aa, Entamoeba histolytica
AEANGA

SEQ ID NO: 2607441 - protein, 10 aa, Entamoeba histolytica
AEANKKLPFA

SEQ ID NO: 2607442 - protein, 6 aa, Entamoeba histolytica
AEAVGG

SEQ ID NO: 2607443 - protein, 10 aa, Entamoeba histolytica
AECDGSNSVI

SEQ ID NO: 2607444 - protein, 4 aa, Entamoeba histolytica
AECT

SEQ ID NO: 2607445 - protein, 4 aa, Entamoeba histolytica
AEDA

SEQ ID NO: 2607446 - protein, 8 aa, Entamoeba histolytica
AEDDGPIH

SEQ ID NO: 2607447 - protein, 5 aa, Entamoeba histolytica
AEDEE

SEQ ID NO: 2607448 - protein, 9 aa, Entamoeba histolytica
AEDEETRKK

SEQ ID NO: 2607449 - protein, 13 aa, Entamoeba histolytica
AEDETNQTSELST

SEQ ID NO: 2607450 - protein, 5 aa, Entamoeba histolytica
AEDGQ

SEQ ID NO: 2607451 - protein, 6 aa, Entamoeba histolytica
AEDKPV

SEQ ID NO: 2607452 - protein, 25 aa, Entamoeba histolytica
AEDKTTGKKNKITITNDKGRLSKEQ

SEQ ID NO: 2607453 - protein, 4 aa, Entamoeba histolytica
AEDL

SEQ ID NO: 2607454 - protein, 17 aa, Entamoeba histolytica
AEDNGCPRGQKQNYIEG

SEQ ID NO: 2607455 - protein, 13 aa, Entamoeba histolytica
AEDPNQEGARTTY

SEQ ID NO: 2607456 - protein, 9 aa, Entamoeba histolytica
AEDTKWTGK

SEQ ID NO: 2607457 - protein, 8 aa, Entamoeba histolytica
AEEAVDSL

SEQ ID NO: 2607458 - protein, 7 aa, Entamoeba histolytica
AEEDDQL

SEQ ID NO: 2607459 - protein, 4 aa, Entamoeba histolytica
AEEE

SEQ ID NO: 2607460 - protein, 21 aa, Entamoeba histolytica
AEEERKSKSSVSTSGSSLNST

SEQ ID NO: 2607461 - protein, 13 aa, Entamoeba histolytica
AEEETEEKTKPVD

SEQ ID NO: 2607462 - protein, 7 aa, Entamoeba histolytica
AEEGLPE

SEQ ID NO: 2607463 - protein, 5 aa, Entamoeba histolytica
AEEGN

SEQ ID NO: 2607464 - protein, 6 aa, Entamoeba histolytica
AEEGPT

SEQ ID NO: 2607465 - protein, 5 aa, Entamoeba histolytica
AEEHP

SEQ ID NO: 2607466 - protein, 4 aa, Entamoeba histolytica
AEEI

SEQ ID NO: 2607467 - protein, 20 aa, Entamoeba histolytica
AEEKAKKEKKGVHNENAEKI

SEQ ID NO: 2607468 - protein, 9 aa, Entamoeba histolytica
AEEKKDENW

SEQ ID NO: 2607469 - protein, 7 aa, Entamoeba histolytica
AEEKTPD

SEQ ID NO: 2607470 - protein, 8 aa, Entamoeba histolytica
AEEKYGKA

SEQ ID NO: 2607471 - protein, 4 aa, Entamoeba histolytica
AEEL

SEQ ID NO: 2607472 - protein, 5 aa, Entamoeba histolytica
AEELT

SEQ ID NO: 2607473 - protein, 6 aa, Entamoeba histolytica
AEEMEK

SEQ ID NO: 2607474 - protein, 14 aa, Entamoeba histolytica
AEENKYMDNNNNEQ

SEQ ID NO: 2607475 - protein, 11 aa, Entamoeba histolytica
AEENTEKKGKL

SEQ ID NO: 2607476 - protein, 15 aa, Entamoeba histolytica
AEENYKNNISTIRTK

SEQ ID NO: 2607477 - protein, 7 aa, Entamoeba histolytica
AEEQSVR

SEQ ID NO: 2607478 - protein, 7 aa, Entamoeba histolytica
AEERMKE

SEQ ID NO: 2607479 - protein, 10 aa, Entamoeba histolytica
AEERNRNTAE

SEQ ID NO: 2607480 - protein, 18 aa, Entamoeba histolytica
AEESKKRQEEQKKEETMK

SEQ ID NO: 2607481 - protein, 9 aa, Entamoeba histolytica
AEESNPSIT

SEQ ID NO: 2607482 - protein, 8 aa, Entamoeba histolytica
AEETTGDS

SEQ ID NO: 2607483 - protein, 5 aa, Entamoeba histolytica
AEFDV

SEQ ID NO: 2607484 - protein, 4 aa, Entamoeba histolytica
AEFE

SEQ ID NO: 2607485 - protein, 6 aa, Entamoeba histolytica
AEGEFN

SEQ ID NO: 2607486 - protein, 5 aa, Entamoeba histolytica
AEGEQ

SEQ ID NO: 2607487 - protein, 6 aa, Entamoeba histolytica
AEGGYI

SEQ ID NO: 2607488 - protein, 6 aa, Entamoeba histolytica
AEGHVK

SEQ ID NO: 2607489 - protein, 6 aa, Entamoeba histolytica
AEGIES

SEQ ID NO: 2607490 - protein, 10 aa, Entamoeba histolytica
AEGIHSDREI

SEQ ID NO: 2607491 - protein, 9 aa, Entamoeba histolytica
AEGKAQYEN

SEQ ID NO: 2607492 - protein, 21 aa, Entamoeba histolytica
AEGKKLNKYAYGGKAFNQKST

SEQ ID NO: 2607493 - protein, 9 aa, Entamoeba histolytica
AEGNKDPEL

SEQ ID NO: 2607494 - protein, 8 aa, Entamoeba histolytica
AEGNKEQL

SEQ ID NO: 2607495 - protein, 6 aa, Entamoeba histolytica
AEGTGN

SEQ ID NO: 2607496 - protein, 16 aa, Entamoeba histolytica
AEGTSLTKEQFVKYLT

SEQ ID NO: 2607497 - protein, 4 aa, Entamoeba histolytica
AEGV

SEQ ID NO: 2607498 - protein, 6 aa, Entamoeba histolytica
AEGVKS

SEQ ID NO: 2607499 - protein, 5 aa, Entamoeba histolytica
AEHKA

SEQ ID NO: 2607500 - protein, 14 aa, Entamoeba histolytica
AEHSNNELDLEDNS

SEQ ID NO: 2607501 - protein, 4 aa, Entamoeba histolytica
AEHY

SEQ ID NO: 2607502 - protein, 11 aa, Entamoeba histolytica
AEIDPRTIQQE

SEQ ID NO: 2607503 - protein, 20 aa, Entamoeba histolytica
AEIEEKEKELAEAKQGEDPM

SEQ ID NO: 2607504 - protein, 9 aa, Entamoeba histolytica
AEIGKGING

SEQ ID NO: 2607505 - protein, 11 aa, Entamoeba histolytica
AEIKEQQQKEL

SEQ ID NO: 2607506 - protein, 29 aa, Entamoeba histolytica
AEINQETKGDNKNEIKSEEEKEEKKEDEI

SEQ ID NO: 2607507 - protein, 55 aa, Entamoeba histolytica
AEIRETKKVEKKKVDEEQPSVPPQQQVKPQTEIEESQEGLKKEIPKNKDIEISSS

SEQ ID NO: 2607508 - protein, 12 aa, Entamoeba histolytica
AEISKTNVKNVP

SEQ ID NO: 2607509 - protein, 16 aa, Entamoeba histolytica
AEKALKTMNKSELNGK

SEQ ID NO: 2607510 - protein, 8 aa, Entamoeba histolytica
AEKEEEIE

SEQ ID NO: 2607511 - protein, 12 aa, Entamoeba histolytica
AEKEKEKGNEYY

SEQ ID NO: 2607512 - protein, 7 aa, Entamoeba histolytica
AEKENTC

SEQ ID NO: 2607513 - protein, 9 aa, Entamoeba histolytica
AEKERYSKL

SEQ ID NO: 2607514 - protein, 8 aa, Entamoeba histolytica
AEKGETDN

SEQ ID NO: 2607515 - protein, 10 aa, Entamoeba histolytica
AEKGKTDKGV

SEQ ID NO: 2607516 - protein, 5 aa, Entamoeba histolytica
AEKGW

SEQ ID NO: 2607517 - protein, 8 aa, Entamoeba histolytica
AEKKEDGV

SEQ ID NO: 2607518 - protein, 7 aa, Entamoeba histolytica
AEKKEYQ

SEQ ID NO: 2607519 - protein, 9 aa, Entamoeba histolytica
AEKKQPAKH

SEQ ID NO: 2607520 - protein, 16 aa, Entamoeba histolytica
AEKKRGVIAASSGNHG

SEQ ID NO: 2607521 - protein, 9 aa, Entamoeba histolytica
AEKKVEEQA

SEQ ID NO: 2607522 - protein, 5 aa, Entamoeba histolytica
AEKLG

SEQ ID NO: 2607523 - protein, 13 aa, Entamoeba histolytica
AEKNKEKKPKKIH

SEQ ID NO: 2607524 - protein, 11 aa, Entamoeba histolytica
AEKNQRSEIAR

SEQ ID NO: 2607525 - protein, 9 aa, Entamoeba histolytica
AEKPERAKQ

SEQ ID NO: 2607526 - protein, 5 aa, Entamoeba histolytica
AEKQI

SEQ ID NO: 2607527 - protein, 8 aa, Entamoeba histolytica
AEKRKEDM

SEQ ID NO: 2607528 - protein, 12 aa, Entamoeba histolytica
AEKSAEQYKKAV

SEQ ID NO: 2607529 - protein, 6 aa, Entamoeba histolytica
AEKSDF

SEQ ID NO: 2607530 - protein, 6 aa, Entamoeba histolytica
AEKSGS

SEQ ID NO: 2607531 - protein, 11 aa, Entamoeba histolytica
AEKSPFSSPEY

SEQ ID NO: 2607532 - protein, 7 aa, Entamoeba histolytica
AEKTGGK

SEQ ID NO: 2607533 - protein, 11 aa, Entamoeba histolytica
AEKVEKVTTPL

SEQ ID NO: 2607534 - protein, 9 aa, Entamoeba histolytica
AEKVSDEIE

SEQ ID NO: 2607535 - protein, 6 aa, Entamoeba histolytica
AEKYGN

SEQ ID NO: 2607536 - protein, 23 aa, Entamoeba histolytica
AELEKKKKKQIKKMKKETKLQTD

SEQ ID NO: 2607537 - protein, 4 aa, Entamoeba histolytica
AELG

SEQ ID NO: 2607538 - protein, 5 aa, Entamoeba histolytica
AELGT

SEQ ID NO: 2607539 - protein, 4 aa, Entamoeba histolytica
AELI

SEQ ID NO: 2607540 - protein, 4 aa, Entamoeba histolytica
AELK

SEQ ID NO: 2607541 - protein, 11 aa, Entamoeba histolytica
AELKNNKSNVV

SEQ ID NO: 2607542 - protein, 13 aa, Entamoeba histolytica
AELRKKKTSLNEK

SEQ ID NO: 2607543 - protein, 12 aa, Entamoeba histolytica
AELRRKNQELKE

SEQ ID NO: 2607544 - protein, 4 aa, Entamoeba histolytica
AEME

SEQ ID NO: 2607545 - protein, 7 aa, Entamoeba histolytica
AEMETTK

SEQ ID NO: 2607546 - protein, 10 aa, Entamoeba histolytica
AEMKKKAKDV

SEQ ID NO: 2607547 - protein, 10 aa, Entamoeba histolytica
AEMKRKPREI

SEQ ID NO: 2607548 - protein, 23 aa, Entamoeba histolytica
AENANVDADSELQDEQEKLDQMN

SEQ ID NO: 2607549 - protein, 5 aa, Entamoeba histolytica
AENDK

SEQ ID NO: 2607550 - protein, 6 aa, Entamoeba histolytica
AENEEI

SEQ ID NO: 2607551 - protein, 15 aa, Entamoeba histolytica
AENEKLRKAGAGARL

SEQ ID NO: 2607552 - protein, 6 aa, Entamoeba histolytica
AENEKM

SEQ ID NO: 2607553 - protein, 5 aa, Entamoeba histolytica
AENEL

SEQ ID NO: 2607554 - protein, 8 aa, Entamoeba histolytica
AENENTRI

SEQ ID NO: 2607555 - protein, 11 aa, Entamoeba histolytica
AENERKGKNPR

SEQ ID NO: 2607556 - protein, 9 aa, Entamoeba histolytica
AENESDDQL

SEQ ID NO: 2607557 - protein, 20 aa, Entamoeba histolytica
AENESGQENLNNIESHDNQS

SEQ ID NO: 2607558 - protein, 14 aa, Entamoeba histolytica
AENETELSLKEGDK

SEQ ID NO: 2607559 - protein, 10 aa, Entamoeba histolytica
AENFSRQNGG

SEQ ID NO: 2607560 - protein, 7 aa, Entamoeba histolytica
AENKKEI

SEQ ID NO: 2607561 - protein, 6 aa, Entamoeba histolytica
AENNKD

SEQ ID NO: 2607562 - protein, 9 aa, Entamoeba histolytica
AENNRKETF

SEQ ID NO: 2607563 - protein, 9 aa, Entamoeba histolytica
AENPEREKQ

SEQ ID NO: 2607564 - protein, 30 aa, Entamoeba histolytica
AENPPEERKRSKKDSGDEGITSSKKRKLEE

SEQ ID NO: 2607565 - protein, 6 aa, Entamoeba histolytica
AENRKN

SEQ ID NO: 2607566 - protein, 7 aa, Entamoeba histolytica
AENSGLN

SEQ ID NO: 2607567 - protein, 9 aa, Entamoeba histolytica
AENSNTRRH

SEQ ID NO: 2607568 - protein, 7 aa, Entamoeba histolytica
AENYNKR

SEQ ID NO: 2607569 - protein, 6 aa, Entamoeba histolytica
AEPDHL

SEQ ID NO: 2607570 - protein, 6 aa, Entamoeba histolytica
AEPGTY

SEQ ID NO: 2607571 - protein, 9 aa, Entamoeba histolytica
AEPIDKDRI

SEQ ID NO: 2607572 - protein, 9 aa, Entamoeba histolytica
AEPKAKSRN

SEQ ID NO: 2607573 - protein, 9 aa, Entamoeba histolytica
AEPKVVPGV

SEQ ID NO: 2607574 - protein, 7 aa, Entamoeba histolytica
AEPYKGD

SEQ ID NO: 2607575 - protein, 9 aa, Entamoeba histolytica
AEQAKRVLG

SEQ ID NO: 2607576 - protein, 18 aa, Entamoeba histolytica
AEQEAAKTGQKKRPTTAG

SEQ ID NO: 2607577 - protein, 20 aa, Entamoeba histolytica
AEQERKQERIEREKQTVNEM

SEQ ID NO: 2607578 - protein, 5 aa, Entamoeba histolytica
AEQET

SEQ ID NO: 2607579 - protein, 4 aa, Entamoeba histolytica
AEQG

SEQ ID NO: 2607580 - protein, 12 aa, Entamoeba histolytica
AEQKAKDSHRGI

SEQ ID NO: 2607581 - protein, 19 aa, Entamoeba histolytica
AEQKYSDGILTSAKSGLAV

SEQ ID NO: 2607582 - protein, 13 aa, Entamoeba histolytica
AEQNTNKNVAQTT

SEQ ID NO: 2607583 - protein, 14 aa, Entamoeba histolytica
AEQPRQTNKRFQTK

SEQ ID NO: 2607584 - protein, 8 aa, Entamoeba histolytica
AEQQLADN

SEQ ID NO: 2607585 - protein, 11 aa, Entamoeba histolytica
AEQRHTLPSGQ

SEQ ID NO: 2607586 - protein, 7 aa, Entamoeba histolytica
AEQSERY

SEQ ID NO: 2607587 - protein, 8 aa, Entamoeba histolytica
AEQSERYD

SEQ ID NO: 2607588 - protein, 20 aa, Entamoeba histolytica
AEQTNNKNDLERTKTELIPQ

SEQ ID NO: 2607589 - protein, 4 aa, Entamoeba histolytica
AERE

SEQ ID NO: 2607590 - protein, 4 aa, Entamoeba histolytica
AERG

SEQ ID NO: 2607591 - protein, 8 aa, Entamoeba histolytica
AERGSVKR

SEQ ID NO: 2607592 - protein, 7 aa, Entamoeba histolytica
AERISDK

SEQ ID NO: 2607593 - protein, 7 aa, Entamoeba histolytica
AERKAQL

SEQ ID NO: 2607594 - protein, 27 aa, Entamoeba histolytica
AERKEHDINSGVSISAAKQRVGKNKIT

SEQ ID NO: 2607595 - protein, 9 aa, Entamoeba histolytica
AERKEQQKR

SEQ ID NO: 2607596 - protein, 11 aa, Entamoeba histolytica
AERKGIETELR

SEQ ID NO: 2607597 - protein, 5 aa, Entamoeba histolytica
AERKT

SEQ ID NO: 2607598 - protein, 6 aa, Entamoeba histolytica
AERNDI

SEQ ID NO: 2607599 - protein, 5 aa, Entamoeba histolytica
AERNG

SEQ ID NO: 2607600 - protein, 6 aa, Entamoeba histolytica
AERPEE

SEQ ID NO: 2607601 - protein, 6 aa, Entamoeba histolytica
AERREQ

SEQ ID NO: 2607602 - protein, 13 aa, Entamoeba histolytica
AERRQKKAAMGME

SEQ ID NO: 2607603 - protein, 9 aa, Entamoeba histolytica
AERRRPQKI

SEQ ID NO: 2607604 - protein, 12 aa, Entamoeba histolytica
AERSAQDSPTFR

SEQ ID NO: 2607605 - protein, 10 aa, Entamoeba histolytica
AERSAQNSLT

SEQ ID NO: 2607606 - protein, 15 aa, Entamoeba histolytica
AERSHRINSRQVSEI

SEQ ID NO: 2607607 - protein, 26 aa, Entamoeba histolytica
AERSQQNKNKLTEEKKNNEIEEKQKE

SEQ ID NO: 2607608 - protein, 4 aa, Entamoeba histolytica
AERT

SEQ ID NO: 2607609 - protein, 16 aa, Entamoeba histolytica
AERTALKSKTFAANNK

SEQ ID NO: 2607610 - protein, 6 aa, Entamoeba histolytica
AERYPS

SEQ ID NO: 2607611 - protein, 10 aa, Entamoeba histolytica
AESDKGGDNK

SEQ ID NO: 2607612 - protein, 11 aa, Entamoeba histolytica
AESEIKNGEHS

SEQ ID NO: 2607613 - protein, 8 aa, Entamoeba histolytica
AESERAQR

SEQ ID NO: 2607614 - protein, 8 aa, Entamoeba histolytica
AESIDSSE

SEQ ID NO: 2607615 - protein, 9 aa, Entamoeba histolytica
AESIEQAEK

SEQ ID NO: 2607616 - protein, 9 aa, Entamoeba histolytica
AESILGNGS

SEQ ID NO: 2607617 - protein, 20 aa, Entamoeba histolytica
AESLEKAKETAEKVMNILLS

SEQ ID NO: 2607618 - protein, 7 aa, Entamoeba histolytica
AESQEQM

SEQ ID NO: 2607619 - protein, 11 aa, Entamoeba histolytica
AESSESLNNIN

SEQ ID NO: 2607620 - protein, 5 aa, Entamoeba histolytica
AESTS

SEQ ID NO: 2607621 - protein, 6 aa, Entamoeba histolytica
AETAAD

SEQ ID NO: 2607622 - protein, 5 aa, Entamoeba histolytica
AETEG

SEQ ID NO: 2607623 - protein, 9 aa, Entamoeba histolytica
AETEQKIES

SEQ ID NO: 2607624 - protein, 4 aa, Entamoeba histolytica
AETF

SEQ ID NO: 2607625 - protein, 6 aa, Entamoeba histolytica
AETFNE

SEQ ID NO: 2607626 - protein, 8 aa, Entamoeba histolytica
AETGKSNF

SEQ ID NO: 2607627 - protein, 7 aa, Entamoeba histolytica
AETGMGD

SEQ ID NO: 2607628 - protein, 18 aa, Entamoeba histolytica
AETKKQEVKAQGSKVSSK

SEQ ID NO: 2607629 - protein, 13 aa, Entamoeba histolytica
AETLKNEAEAVEE

SEQ ID NO: 2607630 - protein, 9 aa, Entamoeba histolytica
AETPEGESC

SEQ ID NO: 2607631 - protein, 12 aa, Entamoeba histolytica
AETPKKMSTSEA

SEQ ID NO: 2607632 - protein, 7 aa, Entamoeba histolytica
AETQSYQ

SEQ ID NO: 2607633 - protein, 5 aa, Entamoeba histolytica
AETSL

SEQ ID NO: 2607634 - protein, 6 aa, Entamoeba histolytica
AETSLT

SEQ ID NO: 2607635 - protein, 5 aa, Entamoeba histolytica
AETSV

SEQ ID NO: 2607636 - protein, 9 aa, Entamoeba histolytica
AETTASFEK

SEQ ID NO: 2607637 - protein, 6 aa, Entamoeba histolytica
AETVDE

SEQ ID NO: 2607638 - protein, 13 aa, Entamoeba histolytica
AEVDATTKNGSTA

SEQ ID NO: 2607639 - protein, 7 aa, Entamoeba histolytica
AEVGGAN

SEQ ID NO: 2607640 - protein, 20 aa, Entamoeba histolytica
AEVSNAESLNVKTESPQAHD

SEQ ID NO: 2607641 - protein, 6 aa, Entamoeba histolytica
AEVSQV

SEQ ID NO: 2607642 - protein, 16 aa, Entamoeba histolytica
AEYDEKGAEVMLKRPS

SEQ ID NO: 2607643 - protein, 7 aa, Entamoeba histolytica
AEYEDSQ

SEQ ID NO: 2607644 - protein, 8 aa, Entamoeba histolytica
AEYNNHPV

SEQ ID NO: 2607645 - protein, 20 aa, Entamoeba histolytica
AEYVKTSTGFGTHGATPEDV

SEQ ID NO: 2607646 - protein, 5 aa, Entamoeba histolytica
AFDDS

SEQ ID NO: 2607647 - protein, 6 aa, Entamoeba histolytica
AFDEDE

SEQ ID NO: 2607648 - protein, 5 aa, Entamoeba histolytica
AFDGN

SEQ ID NO: 2607649 - protein, 8 aa, Entamoeba histolytica
AFDGNHDG

SEQ ID NO: 2607650 - protein, 6 aa, Entamoeba histolytica
AFDNGD

SEQ ID NO: 2607651 - protein, 4 aa, Entamoeba histolytica
AFDS

SEQ ID NO: 2607652 - protein, 11 aa, Entamoeba histolytica
AFEDGNSEIKS

SEQ ID NO: 2607653 - protein, 7 aa, Entamoeba histolytica
AFEKDHK

SEQ ID NO: 2607654 - protein, 7 aa, Entamoeba histolytica
AFEKDYS

SEQ ID NO: 2607655 - protein, 14 aa, Entamoeba histolytica
AFENEKDKLEMQKR

SEQ ID NO: 2607656 - protein, 9 aa, Entamoeba histolytica
AFENNNAEI

SEQ ID NO: 2607657 - protein, 12 aa, Entamoeba histolytica
AFEPAKNTLDLP

SEQ ID NO: 2607658 - protein, 8 aa, Entamoeba histolytica
AFESQNEE

SEQ ID NO: 2607659 - protein, 9 aa, Entamoeba histolytica
AFGKKEKLP

SEQ ID NO: 2607660 - protein, 13 aa, Entamoeba histolytica
AFGTCDSNTCRPQ

SEQ ID NO: 2607661 - protein, 4 aa, Entamoeba histolytica
AFKD

SEQ ID NO: 2607662 - protein, 7 aa, Entamoeba histolytica
AFKEESK

SEQ ID NO: 2607663 - protein, 8 aa, Entamoeba histolytica
AFKKGGKN

SEQ ID NO: 2607664 - protein, 6 aa, Entamoeba histolytica
AFKKQN

SEQ ID NO: 2607665 - protein, 20 aa, Entamoeba histolytica
AFKNREIAQSSLRQKKRENL

SEQ ID NO: 2607666 - protein, 4 aa, Entamoeba histolytica
AFKR

SEQ ID NO: 2607667 - protein, 8 aa, Entamoeba histolytica
AFKSKESV

SEQ ID NO: 2607668 - protein, 13 aa, Entamoeba histolytica
AFKYENGTPINQG

SEQ ID NO: 2607669 - protein, 6 aa, Entamoeba histolytica
AFNGEK

SEQ ID NO: 2607670 - protein, 9 aa, Entamoeba histolytica
AFNPGNGEF

SEQ ID NO: 2607671 - protein, 5 aa, Entamoeba histolytica
AFNPS

SEQ ID NO: 2607672 - protein, 11 aa, Entamoeba histolytica
AFPDDGIETPT

SEQ ID NO: 2607673 - protein, 4 aa, Entamoeba histolytica
AFPG

SEQ ID NO: 2607674 - protein, 43 aa, Entamoeba histolytica
AFPKKDDKIKIGRSKSEKERKSLQKDLSSTTTFPKQRNQKETI

SEQ ID NO: 2607675 - protein, 7 aa, Entamoeba histolytica
AFPNSPQ

SEQ ID NO: 2607676 - protein, 8 aa, Entamoeba histolytica
AFPNTTEA

SEQ ID NO: 2607677 - protein, 5 aa, Entamoeba histolytica
AFPPE

SEQ ID NO: 2607678 - protein, 5 aa, Entamoeba histolytica
AFPYS

SEQ ID NO: 2607679 - protein, 10 aa, Entamoeba histolytica
AFSDEEKKQL

SEQ ID NO: 2607680 - protein, 5 aa, Entamoeba histolytica
AFSES

SEQ ID NO: 2607681 - protein, 12 aa, Entamoeba histolytica
AFSLRTSSEESI

SEQ ID NO: 2607682 - protein, 5 aa, Entamoeba histolytica
AFSNE

SEQ ID NO: 2607683 - protein, 10 aa, Entamoeba histolytica
AFSNGTVKEH

SEQ ID NO: 2607684 - protein, 6 aa, Entamoeba histolytica
AFSNYS

SEQ ID NO: 2607685 - protein, 8 aa, Entamoeba histolytica
AFSSKGHE

SEQ ID NO: 2607686 - protein, 10 aa, Entamoeba histolytica
AFSSNQKKRL

SEQ ID NO: 2607687 - protein, 9 aa, Entamoeba histolytica
AFSSNSKLD

SEQ ID NO: 2607688 - protein, 7 aa, Entamoeba histolytica
AFTGERK

SEQ ID NO: 2607689 - protein, 8 aa, Entamoeba histolytica
AFTGNKEN

SEQ ID NO: 2607690 - protein, 4 aa, Entamoeba histolytica
AGAD

SEQ ID NO: 2607691 - protein, 9 aa, Entamoeba histolytica
AGADKGNLR

SEQ ID NO: 2607692 - protein, 10 aa, Entamoeba histolytica
AGADKTTMDD

SEQ ID NO: 2607693 - protein, 8 aa, Entamoeba histolytica
AGAEIDEA

SEQ ID NO: 2607694 - protein, 6 aa, Entamoeba histolytica
AGAFDE

SEQ ID NO: 2607695 - protein, 7 aa, Entamoeba histolytica
AGAISSK

SEQ ID NO: 2607696 - protein, 5 aa, Entamoeba histolytica
AGAKK

SEQ ID NO: 2607697 - protein, 5 aa, Entamoeba histolytica
AGASA

SEQ ID NO: 2607698 - protein, 5 aa, Entamoeba histolytica
AGATD

SEQ ID NO: 2607699 - protein, 7 aa, Entamoeba histolytica
AGATNNV

SEQ ID NO: 2607700 - protein, 16 aa, Entamoeba histolytica
AGAVEAAKKANSTRTW

SEQ ID NO: 2607701 - protein, 11 aa, Entamoeba histolytica
AGDAKIPAYYP

SEQ ID NO: 2607702 - protein, 11 aa, Entamoeba histolytica
AGDEINDEEKK

SEQ ID NO: 2607703 - protein, 17 aa, Entamoeba histolytica
AGDFDGSDASARPDEAV

SEQ ID NO: 2607704 - protein, 9 aa, Entamoeba histolytica
AGDIAEDRF

SEQ ID NO: 2607705 - protein, 7 aa, Entamoeba histolytica
AGDIPTQ

SEQ ID NO: 2607706 - protein, 7 aa, Entamoeba histolytica
AGDKPIP

SEQ ID NO: 2607707 - protein, 4 aa, Entamoeba histolytica
AGDL

SEQ ID NO: 2607708 - protein, 12 aa, Entamoeba histolytica
AGDNGIDPSPTE

SEQ ID NO: 2607709 - protein, 8 aa, Entamoeba histolytica
AGDPAAPG

SEQ ID NO: 2607710 - protein, 9 aa, Entamoeba histolytica
AGDPAAPGL

SEQ ID NO: 2607711 - protein, 8 aa, Entamoeba histolytica
AGDQPNNA

SEQ ID NO: 2607712 - protein, 9 aa, Entamoeba histolytica
AGDRAETRD

SEQ ID NO: 2607713 - protein, 9 aa, Entamoeba histolytica
AGDSAKTRD

SEQ ID NO: 2607714 - protein, 6 aa, Entamoeba histolytica
AGDYGG

SEQ ID NO: 2607715 - protein, 5 aa, Entamoeba histolytica
AGEEE

SEQ ID NO: 2607716 - protein, 4 aa, Entamoeba histolytica
AGEG

SEQ ID NO: 2607717 - protein, 5 aa, Entamoeba histolytica
AGEIE

SEQ ID NO: 2607718 - protein, 9 aa, Entamoeba histolytica
AGEKETQVQ

SEQ ID NO: 2607719 - protein, 6 aa, Entamoeba histolytica
AGELSF

SEQ ID NO: 2607720 - protein, 58 aa, Entamoeba histolytica
AGEMKKEGQMEEENPMEEENEEEDQEIKINNKSEKKRNKKDKLDSISVERSDGTKERV

SEQ ID NO: 2607721 - protein, 13 aa, Entamoeba histolytica
AGERRNPLSDEDI

SEQ ID NO: 2607722 - protein, 9 aa, Entamoeba histolytica
AGESEGNLR

SEQ ID NO: 2607723 - protein, 9 aa, Entamoeba histolytica
AGESESNLR

SEQ ID NO: 2607724 - protein, 8 aa, Entamoeba histolytica
AGESQARN

SEQ ID NO: 2607725 - protein, 6 aa, Entamoeba histolytica
AGEWTP

SEQ ID NO: 2607726 - protein, 13 aa, Entamoeba histolytica
AGEYKQEVTEASK

SEQ ID NO: 2607727 - protein, 6 aa, Entamoeba histolytica
AGFKGY

SEQ ID NO: 2607728 - protein, 8 aa, Entamoeba histolytica
AGFSRSNP

SEQ ID NO: 2607729 - protein, 5 aa, Entamoeba histolytica
AGGAA

SEQ ID NO: 2607730 - protein, 6 aa, Entamoeba histolytica
AGGDGC

SEQ ID NO: 2607731 - protein, 7 aa, Entamoeba histolytica
AGGEFSE

SEQ ID NO: 2607732 - protein, 14 aa, Entamoeba histolytica
AGGFDTKQSSFEIE

SEQ ID NO: 2607733 - protein, 5 aa, Entamoeba histolytica
AGGID

SEQ ID NO: 2607734 - protein, 7 aa, Entamoeba histolytica
AGGITRT

SEQ ID NO: 2607735 - protein, 9 aa, Entamoeba histolytica
AGGKDGREK

SEQ ID NO: 2607736 - protein, 6 aa, Entamoeba histolytica
AGGKMT

SEQ ID NO: 2607737 - protein, 8 aa, Entamoeba histolytica
AGGKVTDI

SEQ ID NO: 2607738 - protein, 4 aa, Entamoeba histolytica
AGGL

SEQ ID NO: 2607739 - protein, 7 aa, Entamoeba histolytica
AGGLDTK

SEQ ID NO: 2607740 - protein, 7 aa, Entamoeba histolytica
AGGLGSP

SEQ ID NO: 2607741 - protein, 8 aa, Entamoeba histolytica
AGGPGVIS

SEQ ID NO: 2607742 - protein, 6 aa, Entamoeba histolytica
AGGRNC

SEQ ID NO: 2607743 - protein, 4 aa, Entamoeba histolytica
AGGS

SEQ ID NO: 2607744 - protein, 9 aa, Entamoeba histolytica
AGGSCDNSY

SEQ ID NO: 2607745 - protein, 8 aa, Entamoeba histolytica
AGGSSEVL

SEQ ID NO: 2607746 - protein, 6 aa, Entamoeba histolytica
AGHAPG

SEQ ID NO: 2607747 - protein, 7 aa, Entamoeba histolytica
AGHEKYQ

SEQ ID NO: 2607748 - protein, 5 aa, Entamoeba histolytica
AGHER

SEQ ID NO: 2607749 - protein, 7 aa, Entamoeba histolytica
AGHPNRK

SEQ ID NO: 2607750 - protein, 4 aa, Entamoeba histolytica
AGHS

SEQ ID NO: 2607751 - protein, 5 aa, Entamoeba histolytica
AGIDG

SEQ ID NO: 2607752 - protein, 14 aa, Entamoeba histolytica
AGIETNFKTPTVDD

SEQ ID NO: 2607753 - protein, 5 aa, Entamoeba histolytica
AGIPN

SEQ ID NO: 2607754 - protein, 9 aa, Entamoeba histolytica
AGIQAQKQG

SEQ ID NO: 2607755 - protein, 7 aa, Entamoeba histolytica
AGITTSL

SEQ ID NO: 2607756 - protein, 38 aa, Entamoeba histolytica
AGKAKQVIEDRKAKAAEKKAQKKAKAAQKKAQKKAKML

SEQ ID NO: 2607757 - protein, 8 aa, Entamoeba histolytica
AGKATSQC

SEQ ID NO: 2607758 - protein, 6 aa, Entamoeba histolytica
AGKDRE

SEQ ID NO: 2607759 - protein, 20 aa, Entamoeba histolytica
AGKDSITETDMQKAGMSAEQ

SEQ ID NO: 2607760 - protein, 9 aa, Entamoeba histolytica
AGKEEAKKY

SEQ ID NO: 2607761 - protein, 7 aa, Entamoeba histolytica
AGKGRTG

SEQ ID NO: 2607762 - protein, 15 aa, Entamoeba histolytica
AGKNGKLVHKECAEH

SEQ ID NO: 2607763 - protein, 7 aa, Entamoeba histolytica
AGKPDPF

SEQ ID NO: 2607764 - protein, 8 aa, Entamoeba histolytica
AGKPDPID

SEQ ID NO: 2607765 - protein, 18 aa, Entamoeba histolytica
AGKQSSPYNNPNPSPFLG

SEQ ID NO: 2607766 - protein, 8 aa, Entamoeba histolytica
AGKQTKEG

SEQ ID NO: 2607767 - protein, 4 aa, Entamoeba histolytica
AGKS

SEQ ID NO: 2607768 - protein, 20 aa, Entamoeba histolytica
AGKSLGNELDNKAKAKKTFY

SEQ ID NO: 2607769 - protein, 6 aa, Entamoeba histolytica
AGKSNK

SEQ ID NO: 2607770 - protein, 9 aa, Entamoeba histolytica
AGKSPQQCK

SEQ ID NO: 2607771 - protein, 9 aa, Entamoeba histolytica
AGKSTTSGN

SEQ ID NO: 2607772 - protein, 4 aa, Entamoeba histolytica
AGKT

SEQ ID NO: 2607773 - protein, 5 aa, Entamoeba histolytica
AGKTL

SEQ ID NO: 2607774 - protein, 6 aa, Entamoeba histolytica
AGKTLP

SEQ ID NO: 2607775 - protein, 8 aa, Entamoeba histolytica
AGKTPHQT

SEQ ID NO: 2607776 - protein, 8 aa, Entamoeba histolytica
AGLDGSNR

SEQ ID NO: 2607777 - protein, 5 aa, Entamoeba histolytica
AGLKR

SEQ ID NO: 2607778 - protein, 4 aa, Entamoeba histolytica
AGLM

SEQ ID NO: 2607779 - protein, 7 aa, Entamoeba histolytica
AGLNGEN

SEQ ID NO: 2607780 - protein, 20 aa, Entamoeba histolytica
AGLREQERKEREERSKTLEN

SEQ ID NO: 2607781 - protein, 6 aa, Entamoeba histolytica
AGLYDT

SEQ ID NO: 2607782 - protein, 6 aa, Entamoeba histolytica
AGNEKR

SEQ ID NO: 2607783 - protein, 9 aa, Entamoeba histolytica
AGNKSLYGT

SEQ ID NO: 2607784 - protein, 46 aa, Entamoeba histolytica
AGNLPKQYTQKEKIAAGTDMSNGSVKTQQVETTPTQTTTDKKPTLA

SEQ ID NO: 2607785 - protein, 8 aa, Entamoeba histolytica
AGNPDEKE

SEQ ID NO: 2607786 - protein, 11 aa, Entamoeba histolytica
AGNPERNEVIG

SEQ ID NO: 2607787 - protein, 5 aa, Entamoeba histolytica
AGNPQ

SEQ ID NO: 2607788 - protein, 16 aa, Entamoeba histolytica
AGNQNKLKERNLGKEQ

SEQ ID NO: 2607789 - protein, 17 aa, Entamoeba histolytica
AGNQTISRSAQPLPGAL

SEQ ID NO: 2607790 - protein, 6 aa, Entamoeba histolytica
AGNRAI

SEQ ID NO: 2607791 - protein, 6 aa, Entamoeba histolytica
AGNTKS

SEQ ID NO: 2607792 - protein, 7 aa, Entamoeba histolytica
AGPAGLA

SEQ ID NO: 2607793 - protein, 13 aa, Entamoeba histolytica
AGPCGPCTAGGKT

SEQ ID NO: 2607794 - protein, 6 aa, Entamoeba histolytica
AGPELE

SEQ ID NO: 2607795 - protein, 10 aa, Entamoeba histolytica
AGPENSPFEG

SEQ ID NO: 2607796 - protein, 10 aa, Entamoeba histolytica
AGPGQSSENE

SEQ ID NO: 2607797 - protein, 45 aa, Entamoeba histolytica
AGPQTQQTSPIQQTPTNHSTSQIQSSGHKLSETPSSLPSDPKERR

SEQ ID NO: 2607798 - protein, 13 aa, Entamoeba histolytica
AGPSASGKTTFSK

SEQ ID NO: 2607799 - protein, 9 aa, Entamoeba histolytica
AGPTASSGA

SEQ ID NO: 2607800 - protein, 7 aa, Entamoeba histolytica
AGPTNNL

SEQ ID NO: 2607801 - protein, 6 aa, Entamoeba histolytica
AGQDRF

SEQ ID NO: 2607802 - protein, 4 aa, Entamoeba histolytica
AGQE

SEQ ID NO: 2607803 - protein, 7 aa, Entamoeba histolytica
AGQEDFD

SEQ ID NO: 2607804 - protein, 6 aa, Entamoeba histolytica
AGQEEF

SEQ ID NO: 2607805 - protein, 7 aa, Entamoeba histolytica
AGQEEFD

SEQ ID NO: 2607806 - protein, 6 aa, Entamoeba histolytica
AGQEKF

SEQ ID NO: 2607807 - protein, 9 aa, Entamoeba histolytica
AGQEKFGGL

SEQ ID NO: 2607808 - protein, 7 aa, Entamoeba histolytica
AGQEKYQ

SEQ ID NO: 2607809 - protein, 7 aa, Entamoeba histolytica
AGQERFA

SEQ ID NO: 2607810 - protein, 7 aa, Entamoeba histolytica
AGQERFQ

SEQ ID NO: 2607811 - protein, 4 aa, Entamoeba histolytica
AGQI

SEQ ID NO: 2607812 - protein, 7 aa, Entamoeba histolytica
AGQKAKE

SEQ ID NO: 2607813 - protein, 7 aa, Entamoeba histolytica
AGQLPSD

SEQ ID NO: 2607814 - protein, 5 aa, Entamoeba histolytica
AGQNI

SEQ ID NO: 2607815 - protein, 13 aa, Entamoeba histolytica
AGQSKKAGQLGEL

SEQ ID NO: 2607816 - protein, 11 aa, Entamoeba histolytica
AGQSMGEPSTQ

SEQ ID NO: 2607817 - protein, 13 aa, Entamoeba histolytica
AGRAGRDGKPAES

SEQ ID NO: 2607818 - protein, 5 aa, Entamoeba histolytica
AGRCT

SEQ ID NO: 2607819 - protein, 5 aa, Entamoeba histolytica
AGRGP

SEQ ID NO: 2607820 - protein, 8 aa, Entamoeba histolytica
AGRMQGND

SEQ ID NO: 2607821 - protein, 11 aa, Entamoeba histolytica
AGRPQFDKEGT

SEQ ID NO: 2607822 - protein, 10 aa, Entamoeba histolytica
AGRPQYDNEG

SEQ ID NO: 2607823 - protein, 11 aa, Entamoeba histolytica
AGRPQYDNEGA

SEQ ID NO: 2607824 - protein, 9 aa, Entamoeba histolytica
AGRPTPAHL

SEQ ID NO: 2607825 - protein, 14 aa, Entamoeba histolytica
AGRTARAGKEGTTI

SEQ ID NO: 2607826 - protein, 10 aa, Entamoeba histolytica
AGRTEINPGT

SEQ ID NO: 2607827 - protein, 11 aa, Entamoeba histolytica
AGRTGRAGNEG

SEQ ID NO: 2607828 - protein, 5 aa, Entamoeba histolytica
AGRTK

SEQ ID NO: 2607829 - protein, 7 aa, Entamoeba histolytica
AGRTQLE

SEQ ID NO: 2607830 - protein, 10 aa, Entamoeba histolytica
AGRVNGRVGS

SEQ ID NO: 2607831 - protein, 6 aa, Entamoeba histolytica
AGSAHS

SEQ ID NO: 2607832 - protein, 10 aa, Entamoeba histolytica
AGSASDQSSI

SEQ ID NO: 2607833 - protein, 4 aa, Entamoeba histolytica
AGSD

SEQ ID NO: 2607834 - protein, 12 aa, Entamoeba histolytica
AGSENSKRAGII

SEQ ID NO: 2607835 - protein, 5 aa, Entamoeba histolytica
AGSER

SEQ ID NO: 2607836 - protein, 6 aa, Entamoeba histolytica
AGSERF

SEQ ID NO: 2607837 - protein, 7 aa, Entamoeba histolytica
AGSESKR

SEQ ID NO: 2607838 - protein, 9 aa, Entamoeba histolytica
AGSGDLHPR

SEQ ID NO: 2607839 - protein, 10 aa, Entamoeba histolytica
AGSGEGGVDE

SEQ ID NO: 2607840 - protein, 8 aa, Entamoeba histolytica
AGSGKSTY

SEQ ID NO: 2607841 - protein, 7 aa, Entamoeba histolytica
AGSITSN

SEQ ID NO: 2607842 - protein, 9 aa, Entamoeba histolytica
AGSNKDNTT

SEQ ID NO: 2607843 - protein, 8 aa, Entamoeba histolytica
AGSNRKTC

SEQ ID NO: 2607844 - protein, 7 aa, Entamoeba histolytica
AGSQLGN

SEQ ID NO: 2607845 - protein, 6 aa, Entamoeba histolytica
AGSRPT

SEQ ID NO: 2607846 - protein, 7 aa, Entamoeba histolytica
AGSSNGE

SEQ ID NO: 2607847 - protein, 4 aa, Entamoeba histolytica
AGTD

SEQ ID NO: 2607848 - protein, 7 aa, Entamoeba histolytica
AGTEGDC

SEQ ID NO: 2607849 - protein, 11 aa, Entamoeba histolytica
AGTGKEESEFE

SEQ ID NO: 2607850 - protein, 7 aa, Entamoeba histolytica
AGTIAQK

SEQ ID NO: 2607851 - protein, 6 aa, Entamoeba histolytica
AGTIMK

SEQ ID NO: 2607852 - protein, 4 aa, Entamoeba histolytica
AGTK

SEQ ID NO: 2607853 - protein, 7 aa, Entamoeba histolytica
AGTKEKA

SEQ ID NO: 2607854 - protein, 32 aa, Entamoeba histolytica
AGTLPKQYTEKEKIAAGTDLSNGNPPAKKPTL

SEQ ID NO: 2607855 - protein, 44 aa, Entamoeba histolytica
AGTLPKQYTQKEKIAAGTDMSNGSVKTQQVETTPTTTDKKPTLA

SEQ ID NO: 2607856 - protein, 17 aa, Entamoeba histolytica
AGTLPNEFQKQKAPVEE

SEQ ID NO: 2607857 - protein, 8 aa, Entamoeba histolytica
AGTPEPID

SEQ ID NO: 2607858 - protein, 5 aa, Entamoeba histolytica
AGTRQ

SEQ ID NO: 2607859 - protein, 7 aa, Entamoeba histolytica
AGTSDPY

SEQ ID NO: 2607860 - protein, 5 aa, Entamoeba histolytica
AGTSV

SEQ ID NO: 2607861 - protein, 5 aa, Entamoeba histolytica
AGTTA

SEQ ID NO: 2607862 - protein, 8 aa, Entamoeba histolytica
AGTTNNDH

SEQ ID NO: 2607863 - protein, 6 aa, Entamoeba histolytica
AGTVDG

SEQ ID NO: 2607864 - protein, 6 aa, Entamoeba histolytica
AGTVEE

SEQ ID NO: 2607865 - protein, 5 aa, Entamoeba histolytica
AGVAE

SEQ ID NO: 2607866 - protein, 5 aa, Entamoeba histolytica
AGVGD

SEQ ID NO: 2607867 - protein, 11 aa, Entamoeba histolytica
AGVKPKHLADP

SEQ ID NO: 2607868 - protein, 5 aa, Entamoeba histolytica
AGVKR

SEQ ID NO: 2607869 - protein, 4 aa, Entamoeba histolytica
AGVN

SEQ ID NO: 2607870 - protein, 6 aa, Entamoeba histolytica
AGVQPS

SEQ ID NO: 2607871 - protein, 31 aa, Entamoeba histolytica
AGVSAQKKKDKKLAKMTEGEKKKAQRNNPKA

SEQ ID NO: 2607872 - protein, 12 aa, Entamoeba histolytica
AGVTITSDGNSV

SEQ ID NO: 2607873 - protein, 10 aa, Entamoeba histolytica
AGYDGKERTL

SEQ ID NO: 2607874 - protein, 6 aa, Entamoeba histolytica
AGYDNS

SEQ ID NO: 2607875 - protein, 9 aa, Entamoeba histolytica
AGYDSTETL

SEQ ID NO: 2607876 - protein, 4 aa, Entamoeba histolytica
AGYI

SEQ ID NO: 2607877 - protein, 4 aa, Entamoeba histolytica
AGYN

SEQ ID NO: 2607878 - protein, 7 aa, Entamoeba histolytica
AGYSSQM

SEQ ID NO: 2607879 - protein, 12 aa, Entamoeba histolytica
AGYTDAKESALE

SEQ ID NO: 2607880 - protein, 5 aa, Entamoeba histolytica
AGYTE

SEQ ID NO: 2607881 - protein, 8 aa, Entamoeba histolytica
AHASHPTV

SEQ ID NO: 2607882 - protein, 9 aa, Entamoeba histolytica
AHASSPSLG

SEQ ID NO: 2607883 - protein, 7 aa, Entamoeba histolytica
AHATGKV

SEQ ID NO: 2607884 - protein, 4 aa, Entamoeba histolytica
AHDT

SEQ ID NO: 2607885 - protein, 18 aa, Entamoeba histolytica
AHDVRDATLRNDPNMALP

SEQ ID NO: 2607886 - protein, 6 aa, Entamoeba histolytica
AHEDGD

SEQ ID NO: 2607887 - protein, 14 aa, Entamoeba histolytica
AHEELNKKEIGGRP

SEQ ID NO: 2607888 - protein, 4 aa, Entamoeba histolytica
AHEI

SEQ ID NO: 2607889 - protein, 7 aa, Entamoeba histolytica
AHKEGGK

SEQ ID NO: 2607890 - protein, 6 aa, Entamoeba histolytica
AHKEGK

SEQ ID NO: 2607891 - protein, 10 aa, Entamoeba histolytica
AHKGNCSQSV

SEQ ID NO: 2607892 - protein, 21 aa, Entamoeba histolytica
AHKRGLNPIHPSQRGTSQGPD

SEQ ID NO: 2607893 - protein, 8 aa, Entamoeba histolytica
AHKSGGVT

SEQ ID NO: 2607894 - protein, 6 aa, Entamoeba histolytica
AHNTEH

SEQ ID NO: 2607895 - protein, 11 aa, Entamoeba histolytica
AHNYKNKKRNL

SEQ ID NO: 2607896 - protein, 10 aa, Entamoeba histolytica
AHPDQTNRQF

SEQ ID NO: 2607897 - protein, 20 aa, Entamoeba histolytica
AHPGYEQHTYSQKEIEELNN

SEQ ID NO: 2607898 - protein, 8 aa, Entamoeba histolytica
AHPNGGQS

SEQ ID NO: 2607899 - protein, 7 aa, Entamoeba histolytica
AHPQYSS

SEQ ID NO: 2607900 - protein, 7 aa, Entamoeba histolytica
AHPTTTE

SEQ ID NO: 2607901 - protein, 13 aa, Entamoeba histolytica
AHQEVPSELLNMR

SEQ ID NO: 2607902 - protein, 8 aa, Entamoeba histolytica
AHQKNKGF

SEQ ID NO: 2607903 - protein, 11 aa, Entamoeba histolytica
AHRTGDKAVKK

SEQ ID NO: 2607904 - protein, 7 aa, Entamoeba histolytica
AHSAAVT

SEQ ID NO: 2607905 - protein, 5 aa, Entamoeba histolytica
AHSGE

SEQ ID NO: 2607906 - protein, 26 aa, Entamoeba histolytica
AHSKKSDKRITLESSHPSQSLQSSSG

SEQ ID NO: 2607907 - protein, 8 aa, Entamoeba histolytica
AHSPQQVN

SEQ ID NO: 2607908 - protein, 7 aa, Entamoeba histolytica
AHTQNKP

SEQ ID NO: 2607909 - protein, 11 aa, Entamoeba histolytica
AHTQSGGERSV

SEQ ID NO: 2607910 - protein, 11 aa, Entamoeba histolytica
AHTSGRRNYNE

SEQ ID NO: 2607911 - protein, 6 aa, Entamoeba histolytica
AIAKAT

SEQ ID NO: 2607912 - protein, 22 aa, Entamoeba histolytica
AIDADADINTFATTKATNGHMP

SEQ ID NO: 2607913 - protein, 5 aa, Entamoeba histolytica
AIDES

SEQ ID NO: 2607914 - protein, 6 aa, Entamoeba histolytica
AIDGGI

SEQ ID NO: 2607915 - protein, 19 aa, Entamoeba histolytica
AIDKETKYLAENGDTISQR

SEQ ID NO: 2607916 - protein, 4 aa, Entamoeba histolytica
AIDN

SEQ ID NO: 2607917 - protein, 11 aa, Entamoeba histolytica
AIDPISKKPYT

SEQ ID NO: 2607918 - protein, 6 aa, Entamoeba histolytica
AIDPNT

SEQ ID NO: 2607919 - protein, 7 aa, Entamoeba histolytica
AIDPTGN

SEQ ID NO: 2607920 - protein, 8 aa, Entamoeba histolytica
AIDQCKSN

SEQ ID NO: 2607921 - protein, 5 aa, Entamoeba histolytica
AIDSN

SEQ ID NO: 2607922 - protein, 5 aa, Entamoeba histolytica
AIEDA

SEQ ID NO: 2607923 - protein, 13 aa, Entamoeba histolytica
AIEDEDQRKKYTD

SEQ ID NO: 2607924 - protein, 12 aa, Entamoeba histolytica
AIEDENNAEGID

SEQ ID NO: 2607925 - protein, 4 aa, Entamoeba histolytica
AIEK

SEQ ID NO: 2607926 - protein, 10 aa, Entamoeba histolytica
AIETKRQQIP

SEQ ID NO: 2607927 - protein, 10 aa, Entamoeba histolytica
AIETNSGDLQ

SEQ ID NO: 2607928 - protein, 10 aa, Entamoeba histolytica
AIGDQTIERP

SEQ ID NO: 2607929 - protein, 12 aa, Entamoeba histolytica
AIGIPEDQIREA

SEQ ID NO: 2607930 - protein, 9 aa, Entamoeba histolytica
AIGREEEGI

SEQ ID NO: 2607931 - protein, 6 aa, Entamoeba histolytica
AIGSEC

SEQ ID NO: 2607932 - protein, 27 aa, Entamoeba histolytica
AIGSQSDNNITEHSKDTVKIKHPSSKR

SEQ ID NO: 2607933 - protein, 19 aa, Entamoeba histolytica
AIIPPDQMKRKSHRGGRRV

SEQ ID NO: 2607934 - protein, 10 aa, Entamoeba histolytica
AIKDTSPYVR

SEQ ID NO: 2607935 - protein, 17 aa, Entamoeba histolytica
AIKNARNKVLRNGNGTE

SEQ ID NO: 2607936 - protein, 8 aa, Entamoeba histolytica
AIKNENIE

SEQ ID NO: 2607937 - protein, 19 aa, Entamoeba histolytica
AIKSDTITASIRGENDSIQ

SEQ ID NO: 2607938 - protein, 13 aa, Entamoeba histolytica
AINERSKIEHKDS

SEQ ID NO: 2607939 - protein, 6 aa, Entamoeba histolytica
AINETK

SEQ ID NO: 2607940 - protein, 11 aa, Entamoeba histolytica
AINKTKAQRRI

SEQ ID NO: 2607941 - protein, 9 aa, Entamoeba histolytica
AINNKTTEI

SEQ ID NO: 2607942 - protein, 5 aa, Entamoeba histolytica
AINSK

SEQ ID NO: 2607943 - protein, 17 aa, Entamoeba histolytica
AINTAKQNKIKRTSITN

SEQ ID NO: 2607944 - protein, 13 aa, Entamoeba histolytica
AIPDTPMNTRRTF

SEQ ID NO: 2607945 - protein, 25 aa, Entamoeba histolytica
AIPGTESTSSNSSSKPEKKKKGCFI

SEQ ID NO: 2607946 - protein, 4 aa, Entamoeba histolytica
AIPP

SEQ ID NO: 2607947 - protein, 5 aa, Entamoeba histolytica
AIPPS

SEQ ID NO: 2607948 - protein, 17 aa, Entamoeba histolytica
AIPPSQNNQQLAKPEPK

SEQ ID NO: 2607949 - protein, 8 aa, Entamoeba histolytica
AIPQPYQS

SEQ ID NO: 2607950 - protein, 10 aa, Entamoeba histolytica
AIPSTVGQSK

SEQ ID NO: 2607951 - protein, 4 aa, Entamoeba histolytica
AIQK

SEQ ID NO: 2607952 - protein, 8 aa, Entamoeba histolytica
AIQSATKK

SEQ ID NO: 2607953 - protein, 6 aa, Entamoeba histolytica
AIREES

SEQ ID NO: 2607954 - protein, 5 aa, Entamoeba histolytica
AIRES

SEQ ID NO: 2607955 - protein, 6 aa, Entamoeba histolytica
AIRSRA

SEQ ID NO: 2607956 - protein, 4 aa, Entamoeba histolytica
AIRT

SEQ ID NO: 2607957 - protein, 7 aa, Entamoeba histolytica
AIRTSNT

SEQ ID NO: 2607958 - protein, 4 aa, Entamoeba histolytica
AISA

SEQ ID NO: 2607959 - protein, 12 aa, Entamoeba histolytica
AISKNEDKSGDI

SEQ ID NO: 2607960 - protein, 4 aa, Entamoeba histolytica
AISQ

SEQ ID NO: 2607961 - protein, 13 aa, Entamoeba histolytica
AISSPIFLKIHYE

SEQ ID NO: 2607962 - protein, 31 aa, Entamoeba histolytica
AISSSTSPDEIQKQNDIGLKSQTPFTQSNDV

SEQ ID NO: 2607963 - protein, 13 aa, Entamoeba histolytica
AISTPIATTEIDN

SEQ ID NO: 2607964 - protein, 29 aa, Entamoeba histolytica
AITPKTDQNTKDIKKKSSHRKSTSMPEDD

SEQ ID NO: 2607965 - protein, 25 aa, Entamoeba histolytica
AITPPSDSSPSVNVASPPPVSPRSN

SEQ ID NO: 2607966 - protein, 8 aa, Entamoeba histolytica
AITREEDE

SEQ ID NO: 2607967 - protein, 11 aa, Entamoeba histolytica
AIYDDNTEDKF

SEQ ID NO: 2607968 - protein, 9 aa, Entamoeba histolytica
AIYSDNTED

SEQ ID NO: 2607969 - protein, 11 aa, Entamoeba histolytica
AIYSDNTEDEF

SEQ ID NO: 2607970 - protein, 10 aa, Entamoeba histolytica
AKAAQARGDN

SEQ ID NO: 2607971 - protein, 6 aa, Entamoeba histolytica
AKADED

SEQ ID NO: 2607972 - protein, 6 aa, Entamoeba histolytica
AKADPI

SEQ ID NO: 2607973 - protein, 8 aa, Entamoeba histolytica
AKAEAVKN

SEQ ID NO: 2607974 - protein, 7 aa, Entamoeba histolytica
AKAEGVT

SEQ ID NO: 2607975 - protein, 4 aa, Entamoeba histolytica
AKAG

SEQ ID NO: 2607976 - protein, 8 aa, Entamoeba histolytica
AKAGEDEL

SEQ ID NO: 2607977 - protein, 13 aa, Entamoeba histolytica
AKAQAAHKAQYEA

SEQ ID NO: 2607978 - protein, 11 aa, Entamoeba histolytica
AKASTEDEAVA

SEQ ID NO: 2607979 - protein, 21 aa, Entamoeba histolytica
AKASTKTTKDNKEEKQKGCTK

SEQ ID NO: 2607980 - protein, 12 aa, Entamoeba histolytica
AKAVEKDLEAEG

SEQ ID NO: 2607981 - protein, 35 aa, Entamoeba histolytica
AKDCPKRKEELKKKQEEKIKERMEEEEEIDDEEMS

SEQ ID NO: 2607982 - protein, 9 aa, Entamoeba histolytica
AKDEDSMIE

SEQ ID NO: 2607983 - protein, 5 aa, Entamoeba histolytica
AKDEF

SEQ ID NO: 2607984 - protein, 8 aa, Entamoeba histolytica
AKDEFNKK

SEQ ID NO: 2607985 - protein, 7 aa, Entamoeba histolytica
AKDEGKC

SEQ ID NO: 2607986 - protein, 9 aa, Entamoeba histolytica
AKDEKKAIP

SEQ ID NO: 2607987 - protein, 8 aa, Entamoeba histolytica
AKDGTNSA

SEQ ID NO: 2607988 - protein, 6 aa, Entamoeba histolytica
AKDKHG

SEQ ID NO: 2607989 - protein, 12 aa, Entamoeba histolytica
AKDNFDRAKGPV

SEQ ID NO: 2607990 - protein, 6 aa, Entamoeba histolytica
AKDNIG

SEQ ID NO: 2607991 - protein, 6 aa, Entamoeba histolytica
AKDRMK

SEQ ID NO: 2607992 - protein, 7 aa, Entamoeba histolytica
AKDSAPS

SEQ ID NO: 2607993 - protein, 15 aa, Entamoeba histolytica
AKDSIAHDPTKKSVS

SEQ ID NO: 2607994 - protein, 7 aa, Entamoeba histolytica
AKDSITS

SEQ ID NO: 2607995 - protein, 6 aa, Entamoeba histolytica
AKDSMQ

SEQ ID NO: 2607996 - protein, 5 aa, Entamoeba histolytica
AKDST

SEQ ID NO: 2607997 - protein, 15 aa, Entamoeba histolytica
AKDTIRKNGAEEITT

SEQ ID NO: 2607998 - protein, 4 aa, Entamoeba histolytica
AKDV

SEQ ID NO: 2607999 - protein, 15 aa, Entamoeba histolytica
AKDVAANTNRKTLST

SEQ ID NO: 2608000 - protein, 52 aa, Entamoeba histolytica; identical to SEQ ID NO: 2412484

SEQ ID NO: 2608001 - protein, 7 aa, Entamoeba histolytica
AKEASKT

SEQ ID NO: 2608002 - protein, 19 aa, Entamoeba histolytica
AKEDIQEEDEKDDIEQPNG

SEQ ID NO: 2608003 - protein, 67 aa, Entamoeba histolytica
AKEEEEKIKKEQEERKRKEEEAREAEEQLRKEEEEKAKREEEQEIERKRKEAEDERKRIEEEHKKMQ

SEQ ID NO: 2608004 - protein, 24 aa, Entamoeba histolytica
AKEEGASDVQAKHDEFQKQKDEFE

SEQ ID NO: 2608005 - protein, 8 aa, Entamoeba histolytica
AKEEGHAQ

SEQ ID NO: 2608006 - protein, 12 aa, Entamoeba histolytica
AKEEISKEIGEA

SEQ ID NO: 2608007 - protein, 8 aa, Entamoeba histolytica
AKEELQNH

SEQ ID NO: 2608008 - protein, 19 aa, Entamoeba histolytica
AKEESKKKMSKASDKTGVT

SEQ ID NO: 2608009 - protein, 6 aa, Entamoeba histolytica
AKEEYN

SEQ ID NO: 2608010 - protein, 7 aa, Entamoeba histolytica
AKEGCGK

SEQ ID NO: 2608011 - protein, 7 aa, Entamoeba histolytica
AKEGKEC

SEQ ID NO: 2608012 - protein, 7 aa, Entamoeba histolytica
AKEGNSI

SEQ ID NO: 2608013 - protein, 10 aa, Entamoeba histolytica
AKEHDKESHH

SEQ ID NO: 2608014 - protein, 7 aa, Entamoeba histolytica
AKEIGLT

SEQ ID NO: 2608015 - protein, 7 aa, Entamoeba histolytica
AKEINDE

SEQ ID NO: 2608016 - protein, 7 aa, Entamoeba histolytica
AKEIVDT

SEQ ID NO: 2608017 - protein, 34 aa, Entamoeba histolytica
AKEKEEPTSKQKRQERDIKNNVAGEEQQQKINKE

SEQ ID NO: 2608018 - protein, 7 aa, Entamoeba histolytica
AKEKFEG

SEQ ID NO: 2608019 - protein, 5 aa, Entamoeba histolytica
AKEKG

SEQ ID NO: 2608020 - protein, 12 aa, Entamoeba histolytica
AKEKKDPNTQKL

SEQ ID NO: 2608021 - protein, 7 aa, Entamoeba histolytica
AKELGDD

SEQ ID NO: 2608022 - protein, 8 aa, Entamoeba histolytica
AKELGSWT

SEQ ID NO: 2608023 - protein, 11 aa, Entamoeba histolytica
AKELNESVNKM

SEQ ID NO: 2608024 - protein, 6 aa, Entamoeba histolytica
AKELPY

SEQ ID NO: 2608025 - protein, 7 aa, Entamoeba histolytica
AKELTHE

SEQ ID NO: 2608026 - protein, 6 aa, Entamoeba histolytica
AKEMVS

SEQ ID NO: 2608027 - protein, 7 aa, Entamoeba histolytica
AKENDDL

SEQ ID NO: 2608028 - protein, 5 aa, Entamoeba histolytica
AKENN

SEQ ID NO: 2608029 - protein, 8 aa, Entamoeba histolytica
AKENNEDI

SEQ ID NO: 2608030 - protein, 7 aa, Entamoeba histolytica
AKENTDE

SEQ ID NO: 2608031 - protein, 7 aa, Entamoeba histolytica
AKEPGKH

SEQ ID NO: 2608032 - protein, 8 aa, Entamoeba histolytica
AKEPTKIL

SEQ ID NO: 2608033 - protein, 8 aa, Entamoeba histolytica
AKEQVDKC

SEQ ID NO: 2608034 - protein, 10 aa, Entamoeba histolytica
AKERNNGDEG

SEQ ID NO: 2608035 - protein, 8 aa, Entamoeba histolytica
AKETTGDE

SEQ ID NO: 2608036 - protein, 5 aa, Entamoeba histolytica
AKEVG

SEQ ID NO: 2608037 - protein, 7 aa, Entamoeba histolytica
AKFPGGI

SEQ ID NO: 2608038 - protein, 13 aa, Entamoeba histolytica
AKGAEEKMEYGEQ

SEQ ID NO: 2608039 - protein, 6 aa, Entamoeba histolytica
AKGENK

SEQ ID NO: 2608040 - protein, 13 aa, Entamoeba histolytica
AKGEVSAAQDQLK

SEQ ID NO: 2608041 - protein, 14 aa, Entamoeba histolytica
AKGGFSTNEKATIG

SEQ ID NO: 2608042 - protein, 7 aa, Entamoeba histolytica
AKGGKPY

SEQ ID NO: 2608043 - protein, 5 aa, Entamoeba histolytica
AKGIQ

SEQ ID NO: 2608044 - protein, 9 aa, Entamoeba histolytica
AKGKGGLEE

SEQ ID NO: 2608045 - protein, 15 aa, Entamoeba histolytica
AKGKKIFKGNSCKES

SEQ ID NO: 2608046 - protein, 10 aa, Entamoeba histolytica
AKGKSYISDS

SEQ ID NO: 2608047 - protein, 7 aa, Entamoeba histolytica
AKGPQAD

SEQ ID NO: 2608048 - protein, 13 aa, Entamoeba histolytica
AKGQTTKSSCYNE

SEQ ID NO: 2608049 - protein, 8 aa, Entamoeba histolytica
AKGTAGYV

SEQ ID NO: 2608050 - protein, 8 aa, Entamoeba histolytica
AKGTRTLD

SEQ ID NO: 2608051 - protein, 12 aa, Entamoeba histolytica
AKGVLSPRSRKE

SEQ ID NO: 2608052 - protein, 6 aa, Entamoeba histolytica
AKGVSG

SEQ ID NO: 2608053 - protein, 7 aa, Entamoeba histolytica
AKGYKEN

SEQ ID NO: 2608054 - protein, 24 aa, Entamoeba histolytica
AKHAAAAPAEAEKKPAKGSKKQVK

SEQ ID NO: 2608055 - protein, 6 aa, Entamoeba histolytica
AKHDIP

SEQ ID NO: 2608056 - protein, 7 aa, Entamoeba histolytica
AKHEEEF

SEQ ID NO: 2608057 - protein, 23 aa, Entamoeba histolytica
AKHKRELKQLNEEKEVGNNDKIK

SEQ ID NO: 2608058 - protein, 7 aa, Entamoeba histolytica
AKHTTGV

SEQ ID NO: 2608059 - protein, 9 aa, Entamoeba histolytica
AKIASGGGR

SEQ ID NO: 2608060 - protein, 7 aa, Entamoeba histolytica
AKIEGSC

SEQ ID NO: 2608061 - protein, 12 aa, Entamoeba histolytica
AKIENENSSDTI

SEQ ID NO: 2608062 - protein, 9 aa, Entamoeba histolytica
AKIGGSSDF

SEQ ID NO: 2608063 - protein, 12 aa, Entamoeba histolytica
AKIPLNSKGEID

SEQ ID NO: 2608064 - protein, 4 aa, Entamoeba histolytica
AKIQ

SEQ ID NO: 2608065 - protein, 6 aa, Entamoeba histolytica
AKKADI

SEQ ID NO: 2608066 - protein, 9 aa, Entamoeba histolytica
AKKAENRVS

SEQ ID NO: 2608067 - protein, 7 aa, Entamoeba histolytica
AKKAGKK

SEQ ID NO: 2608068 - protein, 15 aa, Entamoeba histolytica
AKKCNKKTVDQSTIP

SEQ ID NO: 2608069 - protein, 24 aa, Entamoeba histolytica
AKKEGEKKTAQRMTGREDAEFDPS

SEQ ID NO: 2608070 - protein, 17 aa, Entamoeba histolytica
AKKEINELGNKEKNKER

SEQ ID NO: 2608071 - protein, 16 aa, Entamoeba histolytica
AKKEISEVHSKKKGVI

SEQ ID NO: 2608072 - protein, 10 aa, Entamoeba histolytica
AKKERNEEEM

SEQ ID NO: 2608073 - protein, 7 aa, Entamoeba histolytica
AKKESGD

SEQ ID NO: 2608074 - protein, 5 aa, Entamoeba histolytica
AKKHG

SEQ ID NO: 2608075 - protein, 19 aa, Entamoeba histolytica
AKKIETLYKSSSRKEYANK

SEQ ID NO: 2608076 - protein, 5 aa, Entamoeba histolytica
AKKII

SEQ ID NO: 2608077 - protein, 11 aa, Entamoeba histolytica
AKKKDASQAEI

SEQ ID NO: 2608078 - protein, 14 aa, Entamoeba histolytica
AKKKGLKSVEQSAI

SEQ ID NO: 2608079 - protein, 8 aa, Entamoeba histolytica
AKKKSKEL

SEQ ID NO: 2608080 - protein, 8 aa, Entamoeba histolytica
AKKKVSRT

SEQ ID NO: 2608081 - protein, 7 aa, Entamoeba histolytica
AKKLSKK

SEQ ID NO: 2608082 - protein, 9 aa, Entamoeba histolytica
AKKNGIEVD

SEQ ID NO: 2608083 - protein, 7 aa, Entamoeba histolytica
AKKNQAL

SEQ ID NO: 2608084 - protein, 15 aa, Entamoeba histolytica
AKKNRTQPPPDIENE

SEQ ID NO: 2608085 - protein, 10 aa, Entamoeba histolytica
AKKNSPTNVR

SEQ ID NO: 2608086 - protein, 8 aa, Entamoeba histolytica
AKKPIKKE

SEQ ID NO: 2608087 - protein, 9 aa, Entamoeba histolytica
AKKPLDSAG

SEQ ID NO: 2608088 - protein, 14 aa, Entamoeba histolytica
AKKRGKLLRGGEPD

SEQ ID NO: 2608089 - protein, 24 aa, Entamoeba histolytica
AKKRKDKKEKKQEKIEDKKIEGIE

SEQ ID NO: 2608090 - protein, 10 aa, Entamoeba histolytica
AKKRSERAKK

SEQ ID NO: 2608091 - protein, 11 aa, Entamoeba histolytica
AKKSKDEEKVT

SEQ ID NO: 2608092 - protein, 13 aa, Entamoeba histolytica
AKKSKRCHVPCVI

SEQ ID NO: 2608093 - protein, 8 aa, Entamoeba histolytica
AKKSPNVF

SEQ ID NO: 2608094 - protein, 8 aa, Entamoeba histolytica
AKKSQASG

SEQ ID NO: 2608095 - protein, 8 aa, Entamoeba histolytica
AKKSTAVY

SEQ ID NO: 2608096 - protein, 6 aa, Entamoeba histolytica
AKKTNE

SEQ ID NO: 2608097 - protein, 8 aa, Entamoeba histolytica
AKKTQKEE

SEQ ID NO: 2608098 - protein, 11 aa, Entamoeba histolytica
AKKTSDQQALN

SEQ ID NO: 2608099 - protein, 10 aa, Entamoeba histolytica
AKKTTCKGSF

SEQ ID NO: 2608100 - protein, 7 aa, Entamoeba histolytica
AKKVKEF

SEQ ID NO: 2608101 - protein, 5 aa, Entamoeba histolytica
AKKYG

SEQ ID NO: 2608102 - protein, 10 aa, Entamoeba histolytica
AKLGESDSET

SEQ ID NO: 2608103 - protein, 24 aa, Entamoeba histolytica
AKLGGGSPSISSEEIDSIKRPPSQ

SEQ ID NO: 2608104 - protein, 16 aa, Entamoeba histolytica
AKLKNEKINVNEEKES

SEQ ID NO: 2608105 - protein, 12 aa, Entamoeba histolytica
AKLPDEKKRITS

SEQ ID NO: 2608106 - protein, 5 aa, Entamoeba histolytica
AKLPQ

SEQ ID NO: 2608107 - protein, 19 aa, Entamoeba histolytica
AKLPSGYTEANKIKSEARL

SEQ ID NO: 2608108 - protein, 8 aa, Entamoeba histolytica
AKLQNKKG

SEQ ID NO: 2608109 - protein, 7 aa, Entamoeba histolytica
AKLSGGK

SEQ ID NO: 2608110 - protein, 6 aa, Entamoeba histolytica
AKLSPT

SEQ ID NO: 2608111 - protein, 77 aa, Entamoeba histolytica
AKLTGSDVDNKVKEAIAKKDQKVSVSESDSEEEKKDAHVVDSEEEEKKEEEADKKAMEEQKKKDEEFKKKHEQEDPV

SEQ ID NO: 2608112 - protein, 4 aa, Entamoeba histolytica
AKNA

SEQ ID NO: 2608113 - protein, 9 aa, Entamoeba histolytica
AKNANSTEL

SEQ ID NO: 2608114 - protein, 9 aa, Entamoeba histolytica
AKNDKAHKH

SEQ ID NO: 2608115 - protein, 10 aa, Entamoeba histolytica
AKNEKGETPL

SEQ ID NO: 2608116 - protein, 9 aa, Entamoeba histolytica
AKNEMETNL

SEQ ID NO: 2608117 - protein, 8 aa, Entamoeba histolytica
AKNIASKL

SEQ ID NO: 2608118 - protein, 6 aa, Entamoeba histolytica
AKNKNI

SEQ ID NO: 2608119 - protein, 5 aa, Entamoeba histolytica
AKNNI

SEQ ID NO: 2608120 - protein, 10 aa, Entamoeba histolytica
AKNNKKINIT

SEQ ID NO: 2608121 - protein, 9 aa, Entamoeba histolytica
AKNPPESPI

SEQ ID NO: 2608122 - protein, 7 aa, Entamoeba histolytica
AKNPRNK

SEQ ID NO: 2608123 - protein, 6 aa, Entamoeba histolytica
AKNRNK

SEQ ID NO: 2608124 - protein, 24 aa, Entamoeba histolytica
AKNSENDAEIDSLKEEKKALEDEI

SEQ ID NO: 2608125 - protein, 7 aa, Entamoeba histolytica
AKNTNLN

SEQ ID NO: 2608126 - protein, 9 aa, Entamoeba histolytica
AKNVNGDLS

SEQ ID NO: 2608127 - protein, 14 aa, Entamoeba histolytica
AKPCSNQINPPDKD

SEQ ID NO: 2608128 - protein, 8 aa, Entamoeba histolytica
AKPDFEGE

SEQ ID NO: 2608129 - protein, 8 aa, Entamoeba histolytica
AKPGADIG

SEQ ID NO: 2608130 - protein, 10 aa, Entamoeba histolytica
AKPKDGRPYL

SEQ ID NO: 2608131 - protein, 18 aa, Entamoeba histolytica
AKPKQDQLPLTGNTTLDS

SEQ ID NO: 2608132 - protein, 11 aa, Entamoeba histolytica
AKPNEVEPSSG

SEQ ID NO: 2608133 - protein, 8 aa, Entamoeba histolytica
AKPPPPEE

SEQ ID NO: 2608134 - protein, 10 aa, Entamoeba histolytica
AKPQRKTTVT

SEQ ID NO: 2608135 - protein, 13 aa, Entamoeba histolytica
AKPQTDVKQSSFL

SEQ ID NO: 2608136 - protein, 7 aa, Entamoeba histolytica
AKPRGAI

SEQ ID NO: 2608137 - protein, 9 aa, Entamoeba histolytica
AKPRNGSRK

SEQ ID NO: 2608138 - protein, 10 aa, Entamoeba histolytica
AKPRNGSRKT

SEQ ID NO: 2608139 - protein, 28 aa, Entamoeba histolytica
AKPSSVSPQEENKAEEQKEVQEPPRAFS

SEQ ID NO: 2608140 - protein, 8 aa, Entamoeba histolytica
AKPTPTIA

SEQ ID NO: 2608141 - protein, 9 aa, Entamoeba histolytica
AKPYEGSFG

SEQ ID NO: 2608142 - protein, 7 aa, Entamoeba histolytica
AKQDNPI

SEQ ID NO: 2608143 - protein, 10 aa, Entamoeba histolytica
AKQDTKITRK

SEQ ID NO: 2608144 - protein, 9 aa, Entamoeba histolytica
AKQEGYRAR

SEQ ID NO: 2608145 - protein, 7 aa, Entamoeba histolytica
AKQETEH

SEQ ID NO: 2608146 - protein, 12 aa, Entamoeba histolytica
AKQEVLDKGKKT

SEQ ID NO: 2608147 - protein, 7 aa, Entamoeba histolytica
AKQGEAC

SEQ ID NO: 2608148 - protein, 14 aa, Entamoeba histolytica
AKQLDGTKAEVGEL

SEQ ID NO: 2608149 - protein, 11 aa, Entamoeba histolytica
AKQLDPKGSSI

SEQ ID NO: 2608150 - protein, 15 aa, Entamoeba histolytica
AKQMSASISKRSIKN

SEQ ID NO: 2608151 - protein, 14 aa, Entamoeba histolytica
AKQNEDTKQEFENR

SEQ ID NO: 2608152 - protein, 11 aa, Entamoeba histolytica
AKQNGVEKSSI

SEQ ID NO: 2608153 - protein, 6 aa, Entamoeba histolytica
AKQNPT

SEQ ID NO: 2608154 - protein, 7 aa, Entamoeba histolytica
AKQPVEP

SEQ ID NO: 2608155 - protein, 8 aa, Entamoeba histolytica
AKQPVRKS

SEQ ID NO: 2608156 - protein, 21 aa, Entamoeba histolytica
AKQQVEKSATMLSPSNQLTSP

SEQ ID NO: 2608157 - protein, 9 aa, Entamoeba histolytica
AKQRQVQEA

SEQ ID NO: 2608158 - protein, 5 aa, Entamoeba histolytica
AKQRS

SEQ ID NO: 2608159 - protein, 4 aa, Entamoeba histolytica
AKQS

SEQ ID NO: 2608160 - protein, 14 aa, Entamoeba histolytica
AKQSIDKRTPRRLS

SEQ ID NO: 2608161 - protein, 16 aa, Entamoeba histolytica
AKQSQRDGISNTPEQW

SEQ ID NO: 2608162 - protein, 12 aa, Entamoeba histolytica
AKQTGSVDITRG

SEQ ID NO: 2608163 - protein, 6 aa, Entamoeba histolytica
AKQTIP

SEQ ID NO: 2608164 - protein, 40 aa, Entamoeba histolytica
AKQTKKPPSLAKPGESFDPSMQTIDEEAQLNETEGSFIDD

SEQ ID NO: 2608165 - protein, 6 aa, Entamoeba histolytica
AKQTSL

SEQ ID NO: 2608166 - protein, 10 aa, Entamoeba histolytica
AKQTSTPKDI

SEQ ID NO: 2608167 - protein, 5 aa, Entamoeba histolytica
AKQVP

SEQ ID NO: 2608168 - protein, 49 aa, Entamoeba histolytica
AKRATVGGQNNGENKSDEKGNEKKKQESIEEKNQSLQIKEEGNSFPEQK

SEQ ID NO: 2608169 - protein, 6 aa, Entamoeba histolytica
AKRDNF

SEQ ID NO: 2608170 - protein, 6 aa, Entamoeba histolytica
AKRELN

SEQ ID NO: 2608171 - protein, 13 aa, Entamoeba histolytica
AKRESKNRDAAQQ

SEQ ID NO: 2608172 - protein, 8 aa, Entamoeba histolytica
AKRESQNR

SEQ ID NO: 2608173 - protein, 11 aa, Entamoeba histolytica
AKRKAQNPLSL

SEQ ID NO: 2608174 - protein, 37 aa, Entamoeba histolytica
AKRKKKEGVEEKHNCKGKMQHKPEPSEDNKYVDTPVG

SEQ ID NO: 2608175 - protein, 17 aa, Entamoeba histolytica
AKRKLNRKKIKKGKEIK

SEQ ID NO: 2608176 - protein, 6 aa, Entamoeba histolytica
AKRKQI

SEQ ID NO: 2608177 - protein, 13 aa, Entamoeba histolytica
AKRKSKNRDAAQQ

SEQ ID NO: 2608178 - protein, 11 aa, Entamoeba histolytica
AKRMKNPQIQS

SEQ ID NO: 2608179 - protein, 6 aa, Entamoeba histolytica
AKRNRK

SEQ ID NO: 2608180 - protein, 23 aa, Entamoeba histolytica
AKRRTEYQSQVQEESKMEEGDED

SEQ ID NO: 2608181 - protein, 7 aa, Entamoeba histolytica
AKRRYQQ

SEQ ID NO: 2608182 - protein, 8 aa, Entamoeba histolytica
AKSAKNGV

SEQ ID NO: 2608183 - protein, 8 aa, Entamoeba histolytica
AKSAPLAD

SEQ ID NO: 2608184 - protein, 4 aa, Entamoeba histolytica
AKSC

SEQ ID NO: 2608185 - protein, 6 aa, Entamoeba histolytica
AKSDYE

SEQ ID NO: 2608186 - protein, 9 aa, Entamoeba histolytica
AKSHSTQPT

SEQ ID NO: 2608187 - protein, 13 aa, Entamoeba histolytica
AKSIGGDEEFQKD

SEQ ID NO: 2608188 - protein, 9 aa, Entamoeba histolytica
AKSKEVSPI

SEQ ID NO: 2608189 - protein, 8 aa, Entamoeba histolytica
AKSKIGDT

SEQ ID NO: 2608190 - protein, 13 aa, Entamoeba histolytica
AKSKNEKNAKYAD

SEQ ID NO: 2608191 - protein, 7 aa, Entamoeba histolytica
AKSKTNI

SEQ ID NO: 2608192 - protein, 7 aa, Entamoeba histolytica
AKSNKIK

SEQ ID NO: 2608193 - protein, 31 aa, Entamoeba histolytica; identical to SEQ ID NO: 2412665

SEQ ID NO: 2608194 - protein, 10 aa, Entamoeba histolytica
AKSNSTIRSN

SEQ ID NO: 2608195 - protein, 7 aa, Entamoeba histolytica
AKSNYNF

SEQ ID NO: 2608196 - protein, 9 aa, Entamoeba histolytica
AKSQERKQF

SEQ ID NO: 2608197 - protein, 10 aa, Entamoeba histolytica
AKSQKPTQEE

SEQ ID NO: 2608198 - protein, 8 aa, Entamoeba histolytica
AKSRTKEE

SEQ ID NO: 2608199 - protein, 11 aa, Entamoeba histolytica
AKSSLEKKGLD

SEQ ID NO: 2608200 - protein, 10 aa, Entamoeba histolytica
AKSSPKDIPN

SEQ ID NO: 2608201 - protein, 7 aa, Entamoeba histolytica
AKSSYDE

SEQ ID NO: 2608202 - protein, 12 aa, Entamoeba histolytica
AKSTGYSARLTK

SEQ ID NO: 2608203 - protein, 15 aa, Entamoeba histolytica
AKSTITYSQFIDIMH

SEQ ID NO: 2608204 - protein, 12 aa, Entamoeba histolytica
AKSTKKGTTNTF

SEQ ID NO: 2608205 - protein, 8 aa, Entamoeba histolytica
AKSTPEIS

SEQ ID NO: 2608206 - protein, 6 aa, Entamoeba histolytica
AKSTQA

SEQ ID NO: 2608207 - protein, 21 aa, Entamoeba histolytica
AKSVNKKTITEPKTPQELGVT

SEQ ID NO: 2608208 - protein, 33 aa, Entamoeba histolytica
AKSVVESKNKDSENEKAALSEEIDQANEKLKNI

SEQ ID NO: 2608209 - protein, 6 aa, Entamoeba histolytica
AKSYTL

SEQ ID NO: 2608210 - protein, 8 aa, Entamoeba histolytica
AKTDQQIE

SEQ ID NO: 2608211 - protein, 4 aa, Entamoeba histolytica
AKTE

SEQ ID NO: 2608212 - protein, 11 aa, Entamoeba histolytica
AKTESDAIENG

SEQ ID NO: 2608213 - protein, 9 aa, Entamoeba histolytica
AKTGDGCKE

SEQ ID NO: 2608214 - protein, 8 aa, Entamoeba histolytica
AKTGDGIE

SEQ ID NO: 2608215 - protein, 8 aa, Entamoeba histolytica
AKTGDNVD

SEQ ID NO: 2608216 - protein, 8 aa, Entamoeba histolytica
AKTGEGIK

SEQ ID NO: 2608217 - protein, 8 aa, Entamoeba histolytica
AKTGEGVE

SEQ ID NO: 2608218 - protein, 8 aa, Entamoeba histolytica
AKTGEGVN

SEQ ID NO: 2608219 - protein, 8 aa, Entamoeba histolytica
AKTGEGVQ

SEQ ID NO: 2608220 - protein, 8 aa, Entamoeba histolytica
AKTGENIE

SEQ ID NO: 2608221 - protein, 7 aa, Entamoeba histolytica
AKTGQNV

SEQ ID NO: 2608222 - protein, 10 aa, Entamoeba histolytica
AKTGSNVKET

SEQ ID NO: 2608223 - protein, 7 aa, Entamoeba histolytica
AKTGTNV

SEQ ID NO: 2608224 - protein, 6 aa, Entamoeba histolytica
AKTGVG

SEQ ID NO: 2608225 - protein, 6 aa, Entamoeba histolytica
AKTINQ

SEQ ID NO: 2608226 - protein, 6 aa, Entamoeba histolytica
AKTKEV

SEQ ID NO: 2608227 - protein, 9 aa, Entamoeba histolytica
AKTKKGTTW

SEQ ID NO: 2608228 - protein, 11 aa, Entamoeba histolytica
AKTKTKQGEND

SEQ ID NO: 2608229 - protein, 7 aa, Entamoeba histolytica
AKTLPTT

SEQ ID NO: 2608230 - protein, 12 aa, Entamoeba histolytica
AKTLRNNNSSRF

SEQ ID NO: 2608231 - protein, 6 aa, Entamoeba histolytica
AKTNEN

SEQ ID NO: 2608232 - protein, 6 aa, Entamoeba histolytica
AKTNGN

SEQ ID NO: 2608233 - protein, 10 aa, Entamoeba histolytica
AKTNPNELNR

SEQ ID NO: 2608234 - protein, 8 aa, Entamoeba histolytica
AKTNQNIT

SEQ ID NO: 2608235 - protein, 8 aa, Entamoeba histolytica
AKTNTNIA

SEQ ID NO: 2608236 - protein, 6 aa, Entamoeba histolytica
AKTNVG

SEQ ID NO: 2608237 - protein, 6 aa, Entamoeba histolytica
AKTPEE

SEQ ID NO: 2608238 - protein, 7 aa, Entamoeba histolytica
AKTQKGL

SEQ ID NO: 2608239 - protein, 6 aa, Entamoeba histolytica
AKTRLS

SEQ ID NO: 2608240 - protein, 7 aa, Entamoeba histolytica
AKTRPKI

SEQ ID NO: 2608241 - protein, 8 aa, Entamoeba histolytica
AKTSKNSD

SEQ ID NO: 2608242 - protein, 4 aa, Entamoeba histolytica
AKTV

SEQ ID NO: 2608243 - protein, 5 aa, Entamoeba histolytica
AKTVK

SEQ ID NO: 2608244 - protein, 12 aa, Entamoeba histolytica
AKVAKKQQEQLQ

SEQ ID NO: 2608245 - protein, 8 aa, Entamoeba histolytica
AKVDYDAE

SEQ ID NO: 2608246 - protein, 7 aa, Entamoeba histolytica
AKVEDGT

SEQ ID NO: 2608247 - protein, 10 aa, Entamoeba histolytica
AKVEQEEPNF

SEQ ID NO: 2608248 - protein, 10 aa, Entamoeba histolytica
AKVGSDQGFP

SEQ ID NO: 2608249 - protein, 19 aa, Entamoeba histolytica
AKVQENNRGALLADIQAKA

SEQ ID NO: 2608250 - protein, 9 aa, Entamoeba histolytica
AKVRSGKTW

SEQ ID NO: 2608251 - protein, 6 aa, Entamoeba histolytica
AKVSDV

SEQ ID NO: 2608252 - protein, 12 aa, Entamoeba histolytica
AKVTGGAPSKIS

SEQ ID NO: 2608253 - protein, 5 aa, Entamoeba histolytica
AKWSI

SEQ ID NO: 2608254 - protein, 7 aa, Entamoeba histolytica
AKYEAEI

SEQ ID NO: 2608255 - protein, 7 aa, Entamoeba histolytica
AKYHASS

SEQ ID NO: 2608256 - protein, 10 aa, Entamoeba histolytica
AKYNATTVQT

SEQ ID NO: 2608257 - protein, 6 aa, Entamoeba histolytica
AKYNSS

SEQ ID NO: 2608258 - protein, 7 aa, Entamoeba histolytica
AKYPQVP

SEQ ID NO: 2608259 - protein, 4 aa, Entamoeba histolytica
AKYQ

SEQ ID NO: 2608260 - protein, 22 aa, Entamoeba histolytica
AKYVPKELRPKTTRKERRQLTK

SEQ ID NO: 2608261 - protein, 13 aa, Entamoeba histolytica
ALADNTTVETDGS

SEQ ID NO: 2608262 - protein, 10 aa, Entamoeba histolytica
ALAGPNHSST

SEQ ID NO: 2608263 - protein, 9 aa, Entamoeba histolytica
ALANKGGVA

SEQ ID NO: 2608264 - protein, 6 aa, Entamoeba histolytica
ALDDNN

SEQ ID NO: 2608265 - protein, 10 aa, Entamoeba histolytica
ALDEAISKEK

SEQ ID NO: 2608266 - protein, 12 aa, Entamoeba histolytica
ALDEEAAKRGTT

SEQ ID NO: 2608267 - protein, 7 aa, Entamoeba histolytica
ALDGDEV

SEQ ID NO: 2608268 - protein, 8 aa, Entamoeba histolytica
ALDGSNVE

SEQ ID NO: 2608269 - protein, 10 aa, Entamoeba histolytica
ALDGTNVEKA

SEQ ID NO: 2608270 - protein, 9 aa, Entamoeba histolytica
ALDKDSERY

SEQ ID NO: 2608271 - protein, 13 aa, Entamoeba histolytica
ALDKYSRKSIREL

SEQ ID NO: 2608272 - protein, 6 aa, Entamoeba histolytica
ALDQSK

SEQ ID NO: 2608273 - protein, 6 aa, Entamoeba histolytica
ALDRPA

SEQ ID NO: 2608274 - protein, 16 aa, Entamoeba histolytica
ALDSEAAEERRLRGQY

SEQ ID NO: 2608275 - protein, 12 aa, Entamoeba histolytica
ALEAEKEEIEEQ

SEQ ID NO: 2608276 - protein, 21 aa, Entamoeba histolytica
ALEDANKTIEYKPDWSRGYSR

SEQ ID NO: 2608277 - protein, 27 aa, Entamoeba histolytica
ALEDGNMKEKASKAKKNSGETSKVAQS

SEQ ID NO: 2608278 - protein, 27 aa, Entamoeba histolytica
ALEEENEEKLKSALEELEKKKKMKDNV

SEQ ID NO: 2608279 - protein, 11 aa, Entamoeba histolytica
ALEEKKSEKGL

SEQ ID NO: 2608280 - protein, 18 aa, Entamoeba histolytica
ALEEQDEDTTMQEDYTPE

SEQ ID NO: 2608281 - protein, 30 aa, Entamoeba histolytica
ALEGEEDDDDEEEEENEEEIEDVDETEDIE

SEQ ID NO: 2608282 - protein, 7 aa, Entamoeba histolytica
ALEHPEE

SEQ ID NO: 2608283 - protein, 9 aa, Entamoeba histolytica
ALEKNSDSF

SEQ ID NO: 2608284 - protein, 6 aa, Entamoeba histolytica
ALEQPK

SEQ ID NO: 2608285 - protein, 14 aa, Entamoeba histolytica
ALERKGRDLEKEID

SEQ ID NO: 2608286 - protein, 6 aa, Entamoeba histolytica
ALERTS

SEQ ID NO: 2608287 - protein, 6 aa, Entamoeba histolytica
ALESEP

SEQ ID NO: 2608288 - protein, 5 aa, Entamoeba histolytica
ALGDP

SEQ ID NO: 2608289 - protein, 45 aa, Entamoeba histolytica
ALGEEEKKEYQTKADAAKEQYKKDIEKYDGKKQASEEEEEEEGDS

SEQ ID NO: 2608290 - protein, 45 aa, Entamoeba histolytica
ALGEEEKKEYQTKADAAKEQYKKDMEKYNNKKQASEEEEEEEGDS

SEQ ID NO: 2608291 - protein, 6 aa, Entamoeba histolytica
ALGGED

SEQ ID NO: 2608292 - protein, 13 aa, Entamoeba histolytica
ALGISDNDTPPWA

SEQ ID NO: 2608293 - protein, 6 aa, Entamoeba histolytica
ALGKKY

SEQ ID NO: 2608294 - protein, 12 aa, Entamoeba histolytica
ALGNEKKNEELD

SEQ ID NO: 2608295 - protein, 5 aa, Entamoeba histolytica
ALGNS

SEQ ID NO: 2608296 - protein, 19 aa, Entamoeba histolytica
ALGTGNWPQPGGKESRHGV

SEQ ID NO: 2608297 - protein, 9 aa, Entamoeba histolytica
ALGTYSNKD

SEQ ID NO: 2608298 - protein, 8 aa, Entamoeba histolytica
ALHPTASM

SEQ ID NO: 2608299 - protein, 5 aa, Entamoeba histolytica
ALIPT

SEQ ID NO: 2608300 - protein, 9 aa, Entamoeba histolytica
ALKDTKKRL

SEQ ID NO: 2608301 - protein, 5 aa, Entamoeba histolytica
ALKED

SEQ ID NO: 2608302 - protein, 12 aa, Entamoeba histolytica
ALKKRSKRVNIT

SEQ ID NO: 2608303 - protein, 16 aa, Entamoeba histolytica
ALKKTKGDLVSAFFEF

SEQ ID NO: 2608304 - protein, 16 aa, Entamoeba histolytica
ALKKTKGDLVTAFFEF

SEQ ID NO: 2608305 - protein, 10 aa, Entamoeba histolytica
ALKQSQSIRK

SEQ ID NO: 2608306 - protein, 7 aa, Entamoeba histolytica
ALNDPHN

SEQ ID NO: 2608307 - protein, 9 aa, Entamoeba histolytica
ALNGTDTNI

SEQ ID NO: 2608308 - protein, 12 aa, Entamoeba histolytica
ALNKDESISDNI

SEQ ID NO: 2608309 - protein, 7 aa, Entamoeba histolytica
ALNNNNY

SEQ ID NO: 2608310 - protein, 6 aa, Entamoeba histolytica
ALNRTS

SEQ ID NO: 2608311 - protein, 18 aa, Entamoeba histolytica
ALNSKDKKSQGDSSSTIF

SEQ ID NO: 2608312 - protein, 6 aa, Entamoeba histolytica
ALPDAA

SEQ ID NO: 2608313 - protein, 4 aa, Entamoeba histolytica
ALPE

SEQ ID NO: 2608314 - protein, 6 aa, Entamoeba histolytica
ALPENL

SEQ ID NO: 2608315 - protein, 4 aa, Entamoeba histolytica
ALPG

SEQ ID NO: 2608316 - protein, 18 aa, Entamoeba histolytica
ALPKDDNEYEQSSDISDF

SEQ ID NO: 2608317 - protein, 27 aa, Entamoeba histolytica
ALPKEETTTERKMNRRGFKGKRNTRKR

SEQ ID NO: 2608318 - protein, 6 aa, Entamoeba histolytica
ALPNEG

SEQ ID NO: 2608319 - protein, 4 aa, Entamoeba histolytica
ALPP

SEQ ID NO: 2608320 - protein, 8 aa, Entamoeba histolytica
ALPPSEQS

SEQ ID NO: 2608321 - protein, 13 aa, Entamoeba histolytica
ALPQEHTTTNKEL

SEQ ID NO: 2608322 - protein, 12 aa, Entamoeba histolytica
ALPRKAKMNSAT

SEQ ID NO: 2608323 - protein, 10 aa, Entamoeba histolytica
ALPRTTKEYE

SEQ ID NO: 2608324 - protein, 38 aa, Entamoeba histolytica
ALPSGTVISKDDIKKYGGDEIITSSGDTLLGADDKSGV

SEQ ID NO: 2608325 - protein, 7 aa, Entamoeba histolytica
ALPSKLP

SEQ ID NO: 2608326 - protein, 10 aa, Entamoeba histolytica
ALQDSSHAEN

SEQ ID NO: 2608327 - protein, 6 aa, Entamoeba histolytica
ALQEAA

SEQ ID NO: 2608328 - protein, 55 aa, Entamoeba histolytica
ALQEEKENVESSKNSTEKDKKKLEDNLKDTQKKLDDMTADNEKLKAKAKDLEAQL

SEQ ID NO: 2608329 - protein, 5 aa, Entamoeba histolytica
ALQGS

SEQ ID NO: 2608330 - protein, 19 aa, Entamoeba histolytica
ALQNQKPKDLDLGTDKSGN

SEQ ID NO: 2608331 - protein, 5 aa, Entamoeba histolytica
ALQPE

SEQ ID NO: 2608332 - protein, 9 aa, Entamoeba histolytica
ALQQTAKEF

SEQ ID NO: 2608333 - protein, 13 aa, Entamoeba histolytica
ALRDSARNKDHNG

SEQ ID NO: 2608334 - protein, 11 aa, Entamoeba histolytica
ALRKSQNNTAI

SEQ ID NO: 2608335 - protein, 10 aa, Entamoeba histolytica
ALSAEERQTK

SEQ ID NO: 2608336 - protein, 12 aa, Entamoeba histolytica
ALSASSEDDPER

SEQ ID NO: 2608337 - protein, 7 aa, Entamoeba histolytica
ALSDREK

SEQ ID NO: 2608338 - protein, 32 aa, Entamoeba histolytica
ALSEDERSHYSELAKENKKRDLGDEEEKKELL

SEQ ID NO: 2608339 - protein, 13 aa, Entamoeba histolytica
ALSGSLQQHTGKS

SEQ ID NO: 2608340 - protein, 11 aa, Entamoeba histolytica
ALSKSKNNLKQ

SEQ ID NO: 2608341 - protein, 7 aa, Entamoeba histolytica
ALSNQKY

SEQ ID NO: 2608342 - protein, 12 aa, Entamoeba histolytica
ALSNQKYRDLQE

SEQ ID NO: 2608343 - protein, 6 aa, Entamoeba histolytica
ALSPYD

SEQ ID NO: 2608344 - protein, 7 aa, Entamoeba histolytica
ALSREEV

SEQ ID NO: 2608345 - protein, 12 aa, Entamoeba histolytica
ALSSIQSLEENP

SEQ ID NO: 2608346 - protein, 18 aa, Entamoeba histolytica
ALSSNTSSGTYSSTLHPP

SEQ ID NO: 2608347 - protein, 33 aa, Entamoeba histolytica
ALSTTQPNTPHSNTEHQTVEETTSTQQKRVRRA

SEQ ID NO: 2608348 - protein, 42 aa, Entamoeba histolytica
ALTEKTDKIKNQIGSVSSSKKKKLYTTDYPDNQKPEEKEEID

SEQ ID NO: 2608349 - protein, 6 aa, Entamoeba histolytica
ALTENA

SEQ ID NO: 2608350 - protein, 9 aa, Entamoeba histolytica
ALTETKEQA

SEQ ID NO: 2608351 - protein, 5 aa, Entamoeba histolytica
ALTEY

SEQ ID NO: 2608352 - protein, 6 aa, Entamoeba histolytica
ALTGEL

SEQ ID NO: 2608353 - protein, 14 aa, Entamoeba histolytica
ALTKGKKKEEPKKV

SEQ ID NO: 2608354 - protein, 10 aa, Entamoeba histolytica
ALTKPPRVKR

SEQ ID NO: 2608355 - protein, 22 aa, Entamoeba histolytica
ALTKQGDGFDPDMEEDDSEVEE

SEQ ID NO: 2608356 - protein, 10 aa, Entamoeba histolytica
ALTNEPAESC

SEQ ID NO: 2608357 - protein, 5 aa, Entamoeba histolytica
ALTPE

SEQ ID NO: 2608358 - protein, 5 aa, Entamoeba histolytica
ALTPS

SEQ ID NO: 2608359 - protein, 7 aa, Entamoeba histolytica
ALTQSSQ

SEQ ID NO: 2608360 - protein, 14 aa, Entamoeba histolytica
ALTSPSTPAHNDYH

SEQ ID NO: 2608361 - protein, 6 aa, Entamoeba histolytica
ALTTNE

SEQ ID NO: 2608362 - protein, 15 aa, Entamoeba histolytica
ALYGKTSGINSFDDQ

SEQ ID NO: 2608363 - protein, 16 aa, Entamoeba histolytica
AMDGGNASNEDDLTTQ

SEQ ID NO: 2608364 - protein, 5 aa, Entamoeba histolytica
AMDND

SEQ ID NO: 2608365 - protein, 12 aa, Entamoeba histolytica
AMDQNEDEDKII

SEQ ID NO: 2608366 - protein, 8 aa, Entamoeba histolytica
AMEPSEVE

SEQ ID NO: 2608367 - protein, 14 aa, Entamoeba histolytica
AMGKRTKYQEKETA

SEQ ID NO: 2608368 - protein, 9 aa, Entamoeba histolytica
AMGREARQR

SEQ ID NO: 2608369 - protein, 33 aa, Entamoeba histolytica; identical to SEQ ID NO: 2412821

SEQ ID NO: 2608370 - protein, 11 aa, Entamoeba histolytica
AMNKKYDKSKV

SEQ ID NO: 2608371 - protein, 10 aa, Entamoeba histolytica
AMNNESPYTR

SEQ ID NO: 2608372 - protein, 9 aa, Entamoeba histolytica
AMPPSTSIH

SEQ ID NO: 2608373 - protein, 14 aa, Entamoeba histolytica
AMRDSPDVPAVPPQ

SEQ ID NO: 2608374 - protein, 11 aa, Entamoeba histolytica
AMRGGASGVST

SEQ ID NO: 2608375 - protein, 15 aa, Entamoeba histolytica
AMRKERLSSGINSRE

SEQ ID NO: 2608376 - protein, 6 aa, Entamoeba histolytica
AMRKSL

SEQ ID NO: 2608377 - protein, 6 aa, Entamoeba histolytica
AMSDRE

SEQ ID NO: 2608378 - protein, 5 aa, Entamoeba histolytica
AMTDP

SEQ ID NO: 2608379 - protein, 7 aa, Entamoeba histolytica
AMTNNGR

SEQ ID NO: 2608380 - protein, 8 aa, Entamoeba histolytica
ANAATQAR

SEQ ID NO: 2608381 - protein, 4 aa, Entamoeba histolytica
ANAD

SEQ ID NO: 2608382 - protein, 7 aa, Entamoeba histolytica
ANADQNV

SEQ ID NO: 2608383 - protein, 12 aa, Entamoeba histolytica
ANAESNGKQLSE

SEQ ID NO: 2608384 - protein, 4 aa, Entamoeba histolytica
ANAG

SEQ ID NO: 2608385 - protein, 7 aa, Entamoeba histolytica
ANAHNKN

SEQ ID NO: 2608386 - protein, 10 aa, Entamoeba histolytica
ANAKAVSGSK

SEQ ID NO: 2608387 - protein, 5 aa, Entamoeba histolytica
ANAKG

SEQ ID NO: 2608388 - protein, 12 aa, Entamoeba histolytica
ANAKGYAIGPTP

SEQ ID NO: 2608389 - protein, 17 aa, Entamoeba histolytica
ANAPPPKSSHSKQIAQV

SEQ ID NO: 2608390 - protein, 15 aa, Entamoeba histolytica
ANAPQGDNSAQVEKA

SEQ ID NO: 2608391 - protein, 15 aa, Entamoeba histolytica
ANAPQGDNTAELDKA

SEQ ID NO: 2608392 - protein, 5 aa, Entamoeba histolytica
ANAQL

SEQ ID NO: 2608393 - protein, 12 aa, Entamoeba histolytica
ANASMSEEQIKA

SEQ ID NO: 2608394 - protein, 11 aa, Entamoeba histolytica
ANATDEELKKA

SEQ ID NO: 2608395 - protein, 6 aa, Entamoeba histolytica
ANATSK

SEQ ID NO: 2608396 - protein, 12 aa, Entamoeba histolytica
ANCTPSAQESVA

SEQ ID NO: 2608397 - protein, 14 aa, Entamoeba histolytica
ANDDTRVKLNNNGY

SEQ ID NO: 2608398 - protein, 12 aa, Entamoeba histolytica
ANDESSDNNGLT

SEQ ID NO: 2608399 - protein, 15 aa, Entamoeba histolytica
ANDGEYLYSGSNEGH

SEQ ID NO: 2608400 - protein, 31 aa, Entamoeba histolytica
ANDGEYLYSGSNEGTCSTGKAVGISGKGHCT

SEQ ID NO: 2608401 - protein, 6 aa, Entamoeba histolytica
ANDKAM

SEQ ID NO: 2608402 - protein, 6 aa, Entamoeba histolytica
ANDNNA

SEQ ID NO: 2608403 - protein, 10 aa, Entamoeba histolytica
ANDNYDQKQI

SEQ ID NO: 2608404 - protein, 5 aa, Entamoeba histolytica
ANDPA

SEQ ID NO: 2608405 - protein, 6 aa, Entamoeba histolytica
ANDPAN

SEQ ID NO: 2608406 - protein, 10 aa, Entamoeba histolytica
ANDQIEVEGY

SEQ ID NO: 2608407 - protein, 11 aa, Entamoeba histolytica
ANDQSAGIKSE

SEQ ID NO: 2608408 - protein, 17 aa, Entamoeba histolytica
ANDRNRQATFTKRKNGL

SEQ ID NO: 2608409 - protein, 10 aa, Entamoeba histolytica
ANDSKKDKIR

SEQ ID NO: 2608410 - protein, 9 aa, Entamoeba histolytica
ANDSNQLPQ

SEQ ID NO: 2608411 - protein, 7 aa, Entamoeba histolytica
ANDTKQH

SEQ ID NO: 2608412 - protein, 4 aa, Entamoeba histolytica
ANDV

SEQ ID NO: 2608413 - protein, 6 aa, Entamoeba histolytica
ANEALT

SEQ ID NO: 2608414 - protein, 4 aa, Entamoeba histolytica
ANEC

SEQ ID NO: 2608415 - protein, 6 aa, Entamoeba histolytica
ANECTK

SEQ ID NO: 2608416 - protein, 10 aa, Entamoeba histolytica
ANEDDPYKRA

SEQ ID NO: 2608417 - protein, 6 aa, Entamoeba histolytica
ANEDNK

SEQ ID NO: 2608418 - protein, 6 aa, Entamoeba histolytica
ANEEER

SEQ ID NO: 2608419 - protein, 7 aa, Entamoeba histolytica
ANEKTDF

SEQ ID NO: 2608420 - protein, 17 aa, Entamoeba histolytica
ANELEESGIKEELNEEA

SEQ ID NO: 2608421 - protein, 8 aa, Entamoeba histolytica
ANENATQN

SEQ ID NO: 2608422 - protein, 10 aa, Entamoeba histolytica
ANENDGMSKL

SEQ ID NO: 2608423 - protein, 34 aa, Entamoeba histolytica
ANENENTNINREVEKTQNETESKERESNNIENDK

SEQ ID NO: 2608424 - protein, 7 aa, Entamoeba histolytica
ANENSIE

SEQ ID NO: 2608425 - protein, 4 aa, Entamoeba histolytica
ANEP

SEQ ID NO: 2608426 - protein, 7 aa, Entamoeba histolytica
ANEPKFS

SEQ ID NO: 2608427 - protein, 7 aa, Entamoeba histolytica
ANEQDGE

SEQ ID NO: 2608428 - protein, 10 aa, Entamoeba histolytica
ANERATNKEV

SEQ ID NO: 2608429 - protein, 10 aa, Entamoeba histolytica
ANERGATLGA

SEQ ID NO: 2608430 - protein, 11 aa, Entamoeba histolytica
ANERSKMRDSL

SEQ ID NO: 2608431 - protein, 7 aa, Entamoeba histolytica
ANESSPI

SEQ ID NO: 2608432 - protein, 5 aa, Entamoeba histolytica
ANESV

SEQ ID NO: 2608433 - protein, 7 aa, Entamoeba histolytica
ANETKKI

SEQ ID NO: 2608434 - protein, 6 aa, Entamoeba histolytica
ANETNV

SEQ ID NO: 2608435 - protein, 5 aa, Entamoeba histolytica
ANETR

SEQ ID NO: 2608436 - protein, 5 aa, Entamoeba histolytica
ANEVS

SEQ ID NO: 2608437 - protein, 7 aa, Entamoeba histolytica
ANEVTRT

SEQ ID NO: 2608438 - protein, 12 aa, Entamoeba histolytica
ANFDDYNSGKYK

SEQ ID NO: 2608439 - protein, 6 aa, Entamoeba histolytica
ANFDND

SEQ ID NO: 2608440 - protein, 10 aa, Entamoeba histolytica
ANFEKAPSIP

SEQ ID NO: 2608441 - protein, 5 aa, Entamoeba histolytica
ANFNE

SEQ ID NO: 2608442 - protein, 12 aa, Entamoeba histolytica
ANFQQNDRMKEE

SEQ ID NO: 2608443 - protein, 9 aa, Entamoeba histolytica
ANGCGKSNV

SEQ ID NO: 2608444 - protein, 7 aa, Entamoeba histolytica
ANGDIDE

SEQ ID NO: 2608445 - protein, 18 aa, Entamoeba histolytica
ANGEDNEIEAGIDGKVSG

SEQ ID NO: 2608446 - protein, 6 aa, Entamoeba histolytica
ANGELS

SEQ ID NO: 2608447 - protein, 15 aa, Entamoeba histolytica
ANGELSTALDILERG

SEQ ID NO: 2608448 - protein, 8 aa, Entamoeba histolytica
ANGEPLAS

SEQ ID NO: 2608449 - protein, 6 aa, Entamoeba histolytica
ANGIDE

SEQ ID NO: 2608450 - protein, 5 aa, Entamoeba histolytica
ANGIG

SEQ ID NO: 2608451 - protein, 14 aa, Entamoeba histolytica
ANGIPDHTALRRKK

SEQ ID NO: 2608452 - protein, 6 aa, Entamoeba histolytica
ANGKEC

SEQ ID NO: 2608453 - protein, 8 aa, Entamoeba histolytica
ANGLNPDP

SEQ ID NO: 2608454 - protein, 9 aa, Entamoeba histolytica
ANGNDGLTK

SEQ ID NO: 2608455 - protein, 9 aa, Entamoeba histolytica
ANGNKDQTL

SEQ ID NO: 2608456 - protein, 9 aa, Entamoeba histolytica
ANGPSLMTP

SEQ ID NO: 2608457 - protein, 10 aa, Entamoeba histolytica
ANGVATGINT

SEQ ID NO: 2608458 - protein, 7 aa, Entamoeba histolytica
ANGYTTE

SEQ ID NO: 2608459 - protein, 5 aa, Entamoeba histolytica
ANHPA

SEQ ID NO: 2608460 - protein, 12 aa, Entamoeba histolytica
ANIDTVDSDKSN

SEQ ID NO: 2608461 - protein, 20 aa, Entamoeba histolytica
ANIESAKSSLEESLESQKTT

SEQ ID NO: 2608462 - protein, 20 aa, Entamoeba histolytica
ANIGTTGIKQPIKRTPVDIQ

SEQ ID NO: 2608463 - protein, 4 aa, Entamoeba histolytica
ANIK

SEQ ID NO: 2608464 - protein, 7 aa, Entamoeba histolytica
ANIPDQS

SEQ ID NO: 2608465 - protein, 8 aa, Entamoeba histolytica
ANKDQQLN

SEQ ID NO: 2608466 - protein, 8 aa, Entamoeba histolytica
ANKDTEVG

SEQ ID NO: 2608467 - protein, 9 aa, Entamoeba histolytica
ANKEMDDNM

SEQ ID NO: 2608468 - protein, 10 aa, Entamoeba histolytica
ANKGLKKSHF

SEQ ID NO: 2608469 - protein, 7 aa, Entamoeba histolytica
ANKGTLT

SEQ ID NO: 2608470 - protein, 12 aa, Entamoeba histolytica
ANKGVKKGMETN

SEQ ID NO: 2608471 - protein, 10 aa, Entamoeba histolytica
ANKLRKERKR

SEQ ID NO: 2608472 - protein, 22 aa, Entamoeba histolytica
ANKNADLSRFTDQERKEFSGTA

SEQ ID NO: 2608473 - protein, 7 aa, Entamoeba histolytica
ANKNEID

SEQ ID NO: 2608474 - protein, 8 aa, Entamoeba histolytica
ANKNKAKD

SEQ ID NO: 2608475 - protein, 6 aa, Entamoeba histolytica
ANKRPE

SEQ ID NO: 2608476 - protein, 4 aa, Entamoeba histolytica
ANKS

SEQ ID NO: 2608477 - protein, 5 aa, Entamoeba histolytica
ANKSQ

SEQ ID NO: 2608478 - protein, 8 aa, Entamoeba histolytica
ANKTAEEV

SEQ ID NO: 2608479 - protein, 16 aa, Entamoeba histolytica
ANKTEIKDEKISISED

SEQ ID NO: 2608480 - protein, 5 aa, Entamoeba histolytica
ANKTM

SEQ ID NO: 2608481 - protein, 6 aa, Entamoeba histolytica
ANKTSL

SEQ ID NO: 2608482 - protein, 4 aa, Entamoeba histolytica
ANLK

SEQ ID NO: 2608483 - protein, 12 aa, Entamoeba histolytica
ANLKSAPEKFQD

SEQ ID NO: 2608484 - protein, 11 aa, Entamoeba histolytica
ANLRSDSHTRY

SEQ ID NO: 2608485 - protein, 4 aa, Entamoeba histolytica
ANMG

SEQ ID NO: 2608486 - protein, 22 aa, Entamoeba histolytica
ANMGKLAKQKQEKKPTKKIHSK

SEQ ID NO: 2608487 - protein, 8 aa, Entamoeba histolytica
ANMGPDKC

SEQ ID NO: 2608488 - protein, 11 aa, Entamoeba histolytica
ANMKQNEELRK

SEQ ID NO: 2608489 - protein, 9 aa, Entamoeba histolytica
ANNDVEKGI

SEQ ID NO: 2608490 - protein, 4 aa, Entamoeba histolytica
ANNE

SEQ ID NO: 2608491 - protein, 7 aa, Entamoeba histolytica
ANNEALR

SEQ ID NO: 2608492 - protein, 8 aa, Entamoeba histolytica
ANNEPSQA

SEQ ID NO: 2608493 - protein, 9 aa, Entamoeba histolytica
ANNKTNYGE

SEQ ID NO: 2608494 - protein, 8 aa, Entamoeba histolytica
ANNPKMKD

SEQ ID NO: 2608495 - protein, 5 aa, Entamoeba histolytica
ANNRA

SEQ ID NO: 2608496 - protein, 7 aa, Entamoeba histolytica
ANNSTYS

SEQ ID NO: 2608497 - protein, 14 aa, Entamoeba histolytica
ANPAIVDSQKNNAL

SEQ ID NO: 2608498 - protein, 7 aa, Entamoeba histolytica
ANPAPGS

SEQ ID NO: 2608499 - protein, 7 aa, Entamoeba histolytica
ANPGGRI

SEQ ID NO: 2608500 - protein, 14 aa, Entamoeba histolytica
ANPIDNASTGPIIT

SEQ ID NO: 2608501 - protein, 7 aa, Entamoeba histolytica
ANPINEI

SEQ ID NO: 2608502 - protein, 19 aa, Entamoeba histolytica
ANPLKGRYDSNRSLKSNLN

SEQ ID NO: 2608503 - protein, 7 aa, Entamoeba histolytica
ANPMKPN

SEQ ID NO: 2608504 - protein, 7 aa, Entamoeba histolytica
ANPNKDE

SEQ ID NO: 2608505 - protein, 10 aa, Entamoeba histolytica
ANPSVPMNEK

SEQ ID NO: 2608506 - protein, 14 aa, Entamoeba histolytica
ANPTISKEIKNQVN

SEQ ID NO: 2608507 - protein, 10 aa, Entamoeba histolytica
ANPTSTPKGV

SEQ ID NO: 2608508 - protein, 6 aa, Entamoeba histolytica
ANPVEG

SEQ ID NO: 2608509 - protein, 7 aa, Entamoeba histolytica
ANQAKEI

SEQ ID NO: 2608510 - protein, 8 aa, Entamoeba histolytica
ANQENYVR

SEQ ID NO: 2608511 - protein, 8 aa, Entamoeba histolytica
ANQKPQDS

SEQ ID NO: 2608512 - protein, 9 aa, Entamoeba histolytica
ANQNASRVT

SEQ ID NO: 2608513 - protein, 6 aa, Entamoeba histolytica
ANQPIL

SEQ ID NO: 2608514 - protein, 8 aa, Entamoeba histolytica
ANQSATRN

SEQ ID NO: 2608515 - protein, 10 aa, Entamoeba histolytica
ANQVANSPNL

SEQ ID NO: 2608516 - protein, 5 aa, Entamoeba histolytica
ANQYS

SEQ ID NO: 2608517 - protein, 5 aa, Entamoeba histolytica
ANRPR

SEQ ID NO: 2608518 - protein, 24 aa, Entamoeba histolytica
ANRRKDIEVDTSEEEEDDDDDEWS

SEQ ID NO: 2608519 - protein, 8 aa, Entamoeba histolytica
ANSEKVRR

SEQ ID NO: 2608520 - protein, 24 aa, Entamoeba histolytica
ANSEQALKTMPKDKLDKLKNTYKQ

SEQ ID NO: 2608521 - protein, 9 aa, Entamoeba histolytica
ANSGAIGAR

SEQ ID NO: 2608522 - protein, 7 aa, Entamoeba histolytica
ANSGRKI

SEQ ID NO: 2608523 - protein, 7 aa, Entamoeba histolytica
ANSIGET

SEQ ID NO: 2608524 - protein, 9 aa, Entamoeba histolytica
ANSITGNPL

SEQ ID NO: 2608525 - protein, 8 aa, Entamoeba histolytica
ANSKNPRN

SEQ ID NO: 2608526 - protein, 9 aa, Entamoeba histolytica
ANSPEERTE

SEQ ID NO: 2608527 - protein, 7 aa, Entamoeba histolytica
ANSPGEL

SEQ ID NO: 2608528 - protein, 7 aa, Entamoeba histolytica
ANSPINK

SEQ ID NO: 2608529 - protein, 7 aa, Entamoeba histolytica
ANSQPKQ

SEQ ID NO: 2608530 - protein, 14 aa, Entamoeba histolytica
ANSRANARWEDRSN

SEQ ID NO: 2608531 - protein, 8 aa, Entamoeba histolytica
ANSSGDTA

SEQ ID NO: 2608532 - protein, 6 aa, Entamoeba histolytica
ANSSMG

SEQ ID NO: 2608533 - protein, 5 aa, Entamoeba histolytica
ANSSR

SEQ ID NO: 2608534 - protein, 9 aa, Entamoeba histolytica
ANSTEGNNT

SEQ ID NO: 2608535 - protein, 7 aa, Entamoeba histolytica
ANSTSLK

SEQ ID NO: 2608536 - protein, 9 aa, Entamoeba histolytica
ANTASIDKV

SEQ ID NO: 2608537 - protein, 7 aa, Entamoeba histolytica
ANTERTR

SEQ ID NO: 2608538 - protein, 10 aa, Entamoeba histolytica
ANTIGTGKKD

SEQ ID NO: 2608539 - protein, 9 aa, Entamoeba histolytica
ANTKIENEM

SEQ ID NO: 2608540 - protein, 7 aa, Entamoeba histolytica
ANTKNFE

SEQ ID NO: 2608541 - protein, 5 aa, Entamoeba histolytica
ANTNT

SEQ ID NO: 2608542 - protein, 7 aa, Entamoeba histolytica
ANTPLTK

SEQ ID NO: 2608543 - protein, 7 aa, Entamoeba histolytica
ANTPNQS

SEQ ID NO: 2608544 - protein, 4 aa, Entamoeba histolytica
ANTQ

SEQ ID NO: 2608545 - protein, 6 aa, Entamoeba histolytica
ANTQQI

SEQ ID NO: 2608546 - protein, 18 aa, Entamoeba histolytica
ANTQQQQSEENKPNQNEE

SEQ ID NO: 2608547 - protein, 6 aa, Entamoeba histolytica
ANTQRY

SEQ ID NO: 2608548 - protein, 6 aa, Entamoeba histolytica
ANTSFS

SEQ ID NO: 2608549 - protein, 6 aa, Entamoeba histolytica
ANTTRV

SEQ ID NO: 2608550 - protein, 9 aa, Entamoeba histolytica
ANTTTSPQY

SEQ ID NO: 2608551 - protein, 5 aa, Entamoeba histolytica
ANVAK

SEQ ID NO: 2608552 - protein, 14 aa, Entamoeba histolytica
ANVDKAHDEVEEAK

SEQ ID NO: 2608553 - protein, 10 aa, Entamoeba histolytica
ANVEKSKKEA

SEQ ID NO: 2608554 - protein, 6 aa, Entamoeba histolytica
ANVGDS

SEQ ID NO: 2608555 - protein, 12 aa, Entamoeba histolytica
ANVGGLKKTGFT

SEQ ID NO: 2608556 - protein, 13 aa, Entamoeba histolytica
ANVNACDENRYSP

SEQ ID NO: 2608557 - protein, 8 aa, Entamoeba histolytica
ANVTNPND

SEQ ID NO: 2608558 - protein, 9 aa, Entamoeba histolytica
ANYEQNATG

SEQ ID NO: 2608559 - protein, 9 aa, Entamoeba histolytica
ANYGGTNMH

SEQ ID NO: 2608560 - protein, 5 aa, Entamoeba histolytica
APALS

SEQ ID NO: 2608561 - protein, 14 aa, Entamoeba histolytica
APAPNVDVTQTATS

SEQ ID NO: 2608562 - protein, 6 aa, Entamoeba histolytica
APATCK

SEQ ID NO: 2608563 - protein, 11 aa, Entamoeba histolytica
APATSSQDTTK

SEQ ID NO: 2608564 - protein, 4 aa, Entamoeba histolytica
APCA

SEQ ID NO: 2608565 - protein, 4 aa, Entamoeba histolytica
APCN

SEQ ID NO: 2608566 - protein, 16 aa, Entamoeba histolytica
APCSGNEPVPDSYSGA

SEQ ID NO: 2608567 - protein, 10 aa, Entamoeba histolytica
APDEQTNDEW

SEQ ID NO: 2608568 - protein, 12 aa, Entamoeba histolytica
APDLTKTTELSS

SEQ ID NO: 2608569 - protein, 6 aa, Entamoeba histolytica
APDVTG

SEQ ID NO: 2608570 - protein, 6 aa, Entamoeba histolytica
APEAAA

SEQ ID NO: 2608571 - protein, 19 aa, Entamoeba histolytica
APEDDIKTEKKAVQNKRRV

SEQ ID NO: 2608572 - protein, 6 aa, Entamoeba histolytica
APEFKA

SEQ ID NO: 2608573 - protein, 10 aa, Entamoeba histolytica
APEFKKAGKS

SEQ ID NO: 2608574 - protein, 7 aa, Entamoeba histolytica
APEFPGD

SEQ ID NO: 2608575 - protein, 17 aa, Entamoeba histolytica
APEGATKIKEVQAHNRK

SEQ ID NO: 2608576 - protein, 7 aa, Entamoeba histolytica
APEGITK

SEQ ID NO: 2608577 - protein, 8 aa, Entamoeba histolytica
APEKYERV

SEQ ID NO: 2608578 - protein, 21 aa, Entamoeba histolytica
APELPPKPSNPYFPKSKIRKD

SEQ ID NO: 2608579 - protein, 8 aa, Entamoeba histolytica
APELTDNM

SEQ ID NO: 2608580 - protein, 5 aa, Entamoeba histolytica
APENY

SEQ ID NO: 2608581 - protein, 7 aa, Entamoeba histolytica
APENYKD

SEQ ID NO: 2608582 - protein, 6 aa, Entamoeba histolytica
APEQTF

SEQ ID NO: 2608583 - protein, 4 aa, Entamoeba histolytica
APES

SEQ ID NO: 2608584 - protein, 8 aa, Entamoeba histolytica
APESIQPS

SEQ ID NO: 2608585 - protein, 4 aa, Entamoeba histolytica
APET

SEQ ID NO: 2608586 - protein, 15 aa, Entamoeba histolytica
APETLNARDGCGRTP

SEQ ID NO: 2608587 - protein, 4 aa, Entamoeba histolytica
APFF

SEQ ID NO: 2608588 - protein, 5 aa, Entamoeba histolytica
APFIP

SEQ ID NO: 2608589 - protein, 5 aa, Entamoeba histolytica
APFPS

SEQ ID NO: 2608590 - protein, 14 aa, Entamoeba histolytica
APGDSMEKETNVQQ

SEQ ID NO: 2608591 - protein, 7 aa, Entamoeba histolytica
APGEEPK

SEQ ID NO: 2608592 - protein, 7 aa, Entamoeba histolytica
APGEVGK

SEQ ID NO: 2608593 - protein, 9 aa, Entamoeba histolytica
APGFGETRK

SEQ ID NO: 2608594 - protein, 8 aa, Entamoeba histolytica
APGGKTTH

SEQ ID NO: 2608595 - protein, 6 aa, Entamoeba histolytica
APGITG

SEQ ID NO: 2608596 - protein, 7 aa, Entamoeba histolytica
APGQTKE

SEQ ID NO: 2608597 - protein, 4 aa, Entamoeba histolytica
APGS

SEQ ID NO: 2608598 - protein, 8 aa, Entamoeba histolytica
APGSKTSQ

SEQ ID NO: 2608599 - protein, 9 aa, Entamoeba histolytica
APGSKTSQL

SEQ ID NO: 2608600 - protein, 8 aa, Entamoeba histolytica
APGSKTTQ

SEQ ID NO: 2608601 - protein, 8 aa, Entamoeba histolytica
APGSSGIG

SEQ ID NO: 2608602 - protein, 6 aa, Entamoeba histolytica
APGSSL

SEQ ID NO: 2608603 - protein, 6 aa, Entamoeba histolytica
APGSWS

SEQ ID NO: 2608604 - protein, 10 aa, Entamoeba histolytica
APGTKVKPDD

SEQ ID NO: 2608605 - protein, 11 aa, Entamoeba histolytica
APGVGKTTVSK

SEQ ID NO: 2608606 - protein, 6 aa, Entamoeba histolytica
APIDPD

SEQ ID NO: 2608607 - protein, 7 aa, Entamoeba histolytica
APIKGEK

SEQ ID NO: 2608608 - protein, 5 aa, Entamoeba histolytica
APIQG

SEQ ID NO: 2608609 - protein, 9 aa, Entamoeba histolytica
APISIDGKS

SEQ ID NO: 2608610 - protein, 6 aa, Entamoeba histolytica
APISVD

SEQ ID NO: 2608611 - protein, 7 aa, Entamoeba histolytica
APISVEG

SEQ ID NO: 2608612 - protein, 4 aa, Entamoeba histolytica
APIT

SEQ ID NO: 2608613 - protein, 31 aa, Entamoeba histolytica
APKDKERKEWEQREEKATKEYKKSIEEKRKE

SEQ ID NO: 2608614 - protein, 4 aa, Entamoeba histolytica
APKE

SEQ ID NO: 2608615 - protein, 7 aa, Entamoeba histolytica
APKEDIE

SEQ ID NO: 2608616 - protein, 6 aa, Entamoeba histolytica
APKGRK

SEQ ID NO: 2608617 - protein, 16 aa, Entamoeba histolytica
APKKHTTTKPTKRDIA

SEQ ID NO: 2608618 - protein, 6 aa, Entamoeba histolytica
APKKMS

SEQ ID NO: 2608619 - protein, 45 aa, Entamoeba histolytica
APKKTNPVKPTPTRGAHRIEREKKEYDSSTPTQMRTPIPQTPTYT

SEQ ID NO: 2608620 - protein, 5 aa, Entamoeba histolytica
APKLG

SEQ ID NO: 2608621 - protein, 4 aa, Entamoeba histolytica
APKS

SEQ ID NO: 2608622 - protein, 9 aa, Entamoeba histolytica
APKSEQTRV

SEQ ID NO: 2608623 - protein, 17 aa, Entamoeba histolytica
APKSSSSEPLNNTTAEL

SEQ ID NO: 2608624 - protein, 14 aa, Entamoeba histolytica
APKSSTRFEKKRQL

SEQ ID NO: 2608625 - protein, 15 aa, Entamoeba histolytica
APKVAAQKERPFKYL

SEQ ID NO: 2608626 - protein, 15 aa, Entamoeba histolytica
APKVVSQKERPFKYL

SEQ ID NO: 2608627 - protein, 9 aa, Entamoeba histolytica
APLESTATS

SEQ ID NO: 2608628 - protein, 5 aa, Entamoeba histolytica
APLET

SEQ ID NO: 2608629 - protein, 6 aa, Entamoeba histolytica
APLPKR

SEQ ID NO: 2608630 - protein, 11 aa, Entamoeba histolytica
APLPSSTPIKM

SEQ ID NO: 2608631 - protein, 13 aa, Entamoeba histolytica
APLPTQTSLQVPE

SEQ ID NO: 2608632 - protein, 4 aa, Entamoeba histolytica
APLT

SEQ ID NO: 2608633 - protein, 5 aa, Entamoeba histolytica
APLTE

SEQ ID NO: 2608634 - protein, 8 aa, Entamoeba histolytica
APLTPSSR

SEQ ID NO: 2608635 - protein, 5 aa, Entamoeba histolytica
APLTS

SEQ ID NO: 2608636 - protein, 18 aa, Entamoeba histolytica
APMATPNLGQGHIPTTSQ

SEQ ID NO: 2608637 - protein, 4 aa, Entamoeba histolytica
APNC

SEQ ID NO: 2608638 - protein, 11 aa, Entamoeba histolytica
APNDESPANVD

SEQ ID NO: 2608639 - protein, 8 aa, Entamoeba histolytica
APNESAPV

SEQ ID NO: 2608640 - protein, 4 aa, Entamoeba histolytica
APNG

SEQ ID NO: 2608641 - protein, 8 aa, Entamoeba histolytica
APNGNGGL

SEQ ID NO: 2608642 - protein, 10 aa, Entamoeba histolytica
APNKQSKGVN

SEQ ID NO: 2608643 - protein, 11 aa, Entamoeba histolytica
APNMSVEGRTY

SEQ ID NO: 2608644 - protein, 4 aa, Entamoeba histolytica
APNP

SEQ ID NO: 2608645 - protein, 10 aa, Entamoeba histolytica
APNPAAAQKL

SEQ ID NO: 2608646 - protein, 7 aa, Entamoeba histolytica
APNPNTV

SEQ ID NO: 2608647 - protein, 9 aa, Entamoeba histolytica
APNPPYSNE

SEQ ID NO: 2608648 - protein, 13 aa, Entamoeba histolytica
APNQQYKPKELTD

SEQ ID NO: 2608649 - protein, 4 aa, Entamoeba histolytica
APPA

SEQ ID NO: 2608650 - protein, 8 aa, Entamoeba histolytica
APPAEIAD

SEQ ID NO: 2608651 - protein, 4 aa, Entamoeba histolytica
APPE

SEQ ID NO: 2608652 - protein, 5 aa, Entamoeba histolytica
APPEI

SEQ ID NO: 2608653 - protein, 6 aa, Entamoeba histolytica
APPFTC

SEQ ID NO: 2608654 - protein, 7 aa, Entamoeba histolytica
APPGKVY

SEQ ID NO: 2608655 - protein, 6 aa, Entamoeba histolytica
APPHEA

SEQ ID NO: 2608656 - protein, 4 aa, Entamoeba histolytica
APPI

SEQ ID NO: 2608657 - protein, 13 aa, Entamoeba histolytica
APPKESAINKSVD

SEQ ID NO: 2608658 - protein, 9 aa, Entamoeba histolytica
APPKTNEED

SEQ ID NO: 2608659 - protein, 7 aa, Entamoeba histolytica
APPLPEQ

SEQ ID NO: 2608660 - protein, 8 aa, Entamoeba histolytica
APPNSLKT

SEQ ID NO: 2608661 - protein, 5 aa, Entamoeba histolytica
APPPK

SEQ ID NO: 2608662 - protein, 12 aa, Entamoeba histolytica
APPPSCTKPTVS

SEQ ID NO: 2608663 - protein, 28 aa, Entamoeba histolytica
APPSVSSTPTISPASTPSKSKEETPRKH

SEQ ID NO: 2608664 - protein, 4 aa, Entamoeba histolytica
APPT

SEQ ID NO: 2608665 - protein, 5 aa, Entamoeba histolytica
APQAN

SEQ ID NO: 2608666 - protein, 71 aa, Entamoeba histolytica
APQGMPPRGSPAPRGMPRGGPRGAPRGAPRGAPRGAPRGAPRGAPRGAPRGRGGMMPPTQAPEPEEQETPV

SEQ ID NO: 2608667 - protein, 35 aa, Entamoeba histolytica
APQGMPPRGSPAPRGMPRGGPRGAPRGMPRGRGTA

SEQ ID NO: 2608668 - protein, 6 aa, Entamoeba histolytica
APQIPQ

SEQ ID NO: 2608669 - protein, 10 aa, Entamoeba histolytica
APQKEIEEKL

SEQ ID NO: 2608670 - protein, 7 aa, Entamoeba histolytica
APQLPPK

SEQ ID NO: 2608671 - protein, 5 aa, Entamoeba histolytica
APQMP

SEQ ID NO: 2608672 - protein, 5 aa, Entamoeba histolytica
APQNQ

SEQ ID NO: 2608673 - protein, 7 aa, Entamoeba histolytica
APQPNEK

SEQ ID NO: 2608674 - protein, 7 aa, Entamoeba histolytica
APQQCER

SEQ ID NO: 2608675 - protein, 18 aa, Entamoeba histolytica
APQQTKGGESGSDSRESI

SEQ ID NO: 2608676 - protein, 5 aa, Entamoeba histolytica
APQRV

SEQ ID NO: 2608677 - protein, 47 aa, Entamoeba histolytica
APRGMPPRGSPAPRGMPRGGPRGAPRGRGGMMPPTQAPEPEEQETPV

SEQ ID NO: 2608678 - protein, 30 aa, Entamoeba histolytica
APRGMPRGMPSRGSPAPRGMPRGGPRGAPM

SEQ ID NO: 2608679 - protein, 30 aa, Entamoeba histolytica
APRGMPRGMPSRGSPTPRGMPRGGPRGAPM

SEQ ID NO: 2608680 - protein, 27 aa, Entamoeba histolytica
APRGMPRGMPSRGSPTPRGMPSRGAPM

SEQ ID NO: 2608681 - protein, 8 aa, Entamoeba histolytica
APRGVTSE

SEQ ID NO: 2608682 - protein, 11 aa, Entamoeba histolytica
APRHKGRTNTI

SEQ ID NO: 2608683 - protein, 4 aa, Entamoeba histolytica
APRM

SEQ ID NO: 2608684 - protein, 7 aa, Entamoeba histolytica
APRNAGE

SEQ ID NO: 2608685 - protein, 8 aa, Entamoeba histolytica
APRQVSEP

SEQ ID NO: 2608686 - protein, 13 aa, Entamoeba histolytica
APSHSEDKFFELT

SEQ ID NO: 2608687 - protein, 6 aa, Entamoeba histolytica
APSKPY

SEQ ID NO: 2608688 - protein, 9 aa, Entamoeba histolytica
APSKYDPNL

SEQ ID NO: 2608689 - protein, 6 aa, Entamoeba histolytica
APSLRS

SEQ ID NO: 2608690 - protein, 5 aa, Entamoeba histolytica
APSNP

SEQ ID NO: 2608691 - protein, 7 aa, Entamoeba histolytica
APSPENV

SEQ ID NO: 2608692 - protein, 5 aa, Entamoeba histolytica
APSPQ

SEQ ID NO: 2608693 - protein, 7 aa, Entamoeba histolytica
APSQKNL

SEQ ID NO: 2608694 - protein, 12 aa, Entamoeba histolytica
APSSLSNTESFE

SEQ ID NO: 2608695 - protein, 7 aa, Entamoeba histolytica
APSTPNK

SEQ ID NO: 2608696 - protein, 6 aa, Entamoeba histolytica
APSTSI

SEQ ID NO: 2608697 - protein, 8 aa, Entamoeba histolytica
APSVENKN

SEQ ID NO: 2608698 - protein, 14 aa, Entamoeba histolytica
APSVSPGTAYADNE

SEQ ID NO: 2608699 - protein, 12 aa, Entamoeba histolytica
APTAVNKQETDH

SEQ ID NO: 2608700 - protein, 28 aa, Entamoeba histolytica
APTDKGNDKKSQKKGGKKEKSEKKKCVF

SEQ ID NO: 2608701 - protein, 12 aa, Entamoeba histolytica
APTDSLSRRTLD

SEQ ID NO: 2608702 - protein, 21 aa, Entamoeba histolytica
APTEQQNLSENNAVTTNHQPE

SEQ ID NO: 2608703 - protein, 5 aa, Entamoeba histolytica
APTFS

SEQ ID NO: 2608704 - protein, 5 aa, Entamoeba histolytica
APTGH

SEQ ID NO: 2608705 - protein, 4 aa, Entamoeba histolytica
APTI

SEQ ID NO: 2608706 - protein, 6 aa, Entamoeba histolytica
APTIDV

SEQ ID NO: 2608707 - protein, 33 aa, Entamoeba histolytica
APTLRKSNTSRISTLPPSKTRSSLTAKNDFEKG

SEQ ID NO: 2608708 - protein, 8 aa, Entamoeba histolytica
APTPTFEE

SEQ ID NO: 2608709 - protein, 9 aa, Entamoeba histolytica
APTQTTQLN

SEQ ID NO: 2608710 - protein, 8 aa, Entamoeba histolytica
APTRRMKD

SEQ ID NO: 2608711 - protein, 4 aa, Entamoeba histolytica
APTS

SEQ ID NO: 2608712 - protein, 5 aa, Entamoeba histolytica
APTSK

SEQ ID NO: 2608713 - protein, 10 aa, Entamoeba histolytica
APTTPKSHSN

SEQ ID NO: 2608714 - protein, 7 aa, Entamoeba histolytica
APTTTSN

SEQ ID NO: 2608715 - protein, 8 aa, Entamoeba histolytica
APTWTKSG

SEQ ID NO: 2608716 - protein, 14 aa, Entamoeba histolytica
APVAAAAKTIEGGA

SEQ ID NO: 2608717 - protein, 4 aa, Entamoeba histolytica
APVD

SEQ ID NO: 2608718 - protein, 8 aa, Entamoeba histolytica
APVNKEQY

SEQ ID NO: 2608719 - protein, 5 aa, Entamoeba histolytica
APVSE

SEQ ID NO: 2608720 - protein, 5 aa, Entamoeba histolytica
APVSN

SEQ ID NO: 2608721 - protein, 5 aa, Entamoeba histolytica
APVSS

SEQ ID NO: 2608722 - protein, 6 aa, Entamoeba histolytica
APYDDD

SEQ ID NO: 2608723 - protein, 18 aa, Entamoeba histolytica
APYDERKITQAEKERIQR

SEQ ID NO: 2608724 - protein, 8 aa, Entamoeba histolytica
APYGDAES

SEQ ID NO: 2608725 - protein, 7 aa, Entamoeba histolytica
APYGSTY

SEQ ID NO: 2608726 - protein, 4 aa, Entamoeba histolytica
APYT

SEQ ID NO: 2608727 - protein, 15 aa, Entamoeba histolytica
AQAAAVTAARDPKNI

SEQ ID NO: 2608728 - protein, 25 aa, Entamoeba histolytica
AQADPENTYADGEGVEKCDAGKGPV

SEQ ID NO: 2608729 - protein, 6 aa, Entamoeba histolytica
AQAPLK

SEQ ID NO: 2608730 - protein, 7 aa, Entamoeba histolytica
AQAPSIP

SEQ ID NO: 2608731 - protein, 22 aa, Entamoeba histolytica
AQAREEAKAKVAEMKKEKDEEF

SEQ ID NO: 2608732 - protein, 8 aa, Entamoeba histolytica
AQASGNKE

SEQ ID NO: 2608733 - protein, 6 aa, Entamoeba histolytica
AQASSL

SEQ ID NO: 2608734 - protein, 9 aa, Entamoeba histolytica
AQAVNSPER

SEQ ID NO: 2608735 - protein, 9 aa, Entamoeba histolytica
AQDAEPNFS

SEQ ID NO: 2608736 - protein, 5 aa, Entamoeba histolytica
AQDDV

SEQ ID NO: 2608737 - protein, 11 aa, Entamoeba histolytica
AQDKPEDEPVK

SEQ ID NO: 2608738 - protein, 8 aa, Entamoeba histolytica
AQDPSRAK

SEQ ID NO: 2608739 - protein, 11 aa, Entamoeba histolytica
AQDRFSGKKGE

SEQ ID NO: 2608740 - protein, 8 aa, Entamoeba histolytica
AQEDLDPR

SEQ ID NO: 2608741 - protein, 5 aa, Entamoeba histolytica
AQEDY

SEQ ID NO: 2608742 - protein, 20 aa, Entamoeba histolytica
AQEEDSSLDDSSVFSDDESL

SEQ ID NO: 2608743 - protein, 11 aa, Entamoeba histolytica
AQEENNKKAIT

SEQ ID NO: 2608744 - protein, 7 aa, Entamoeba histolytica
AQEHGAS

SEQ ID NO: 2608745 - protein, 5 aa, Entamoeba histolytica
AQEKI

SEQ ID NO: 2608746 - protein, 6 aa, Entamoeba histolytica
AQEKLE

SEQ ID NO: 2608747 - protein, 8 aa, Entamoeba histolytica
AQENNIRS

SEQ ID NO: 2608748 - protein, 14 aa, Entamoeba histolytica
AQEPPKRKTLAGRT

SEQ ID NO: 2608749 - protein, 10 aa, Entamoeba histolytica
AQEQKQPIIT

SEQ ID NO: 2608750 - protein, 53 aa, Entamoeba histolytica
AQEREEKELEEKKIDDMKEKKKYQKKKPKTQKQEEVVTEEPQEEEIKEEEDME

SEQ ID NO: 2608751 - protein, 6 aa, Entamoeba histolytica
AQERID

SEQ ID NO: 2608752 - protein, 5 aa, Entamoeba histolytica
AQERN

SEQ ID NO: 2608753 - protein, 19 aa, Entamoeba histolytica
AQESLKSSNKISTSESNNC

SEQ ID NO: 2608754 - protein, 12 aa, Entamoeba histolytica
AQETGIGAQYGG

SEQ ID NO: 2608755 - protein, 12 aa, Entamoeba histolytica
AQEVHPNGPVRG

SEQ ID NO: 2608756 - protein, 10 aa, Entamoeba histolytica
AQEWNQTTVQ

SEQ ID NO: 2608757 - protein, 4 aa, Entamoeba histolytica
AQFQ

SEQ ID NO: 2608758 - protein, 11 aa, Entamoeba histolytica
AQFSGRDIPEN

SEQ ID NO: 2608759 - protein, 12 aa, Entamoeba histolytica
AQFTEAKDEFVE

SEQ ID NO: 2608760 - protein, 7 aa, Entamoeba histolytica
AQFTTEK

SEQ ID NO: 2608761 - protein, 15 aa, Entamoeba histolytica
AQGAQNALAKASELG

SEQ ID NO: 2608762 - protein, 5 aa, Entamoeba histolytica
AQGEG

SEQ ID NO: 2608763 - protein, 5 aa, Entamoeba histolytica
AQGHP

SEQ ID NO: 2608764 - protein, 11 aa, Entamoeba histolytica
AQGKSESLQTK

SEQ ID NO: 2608765 - protein, 5 aa, Entamoeba histolytica
AQGLK

SEQ ID NO: 2608766 - protein, 10 aa, Entamoeba histolytica
AQGLPENKPR

SEQ ID NO: 2608767 - protein, 10 aa, Entamoeba histolytica
AQGLSKETEI

SEQ ID NO: 2608768 - protein, 22 aa, Entamoeba histolytica
AQGNAPTKSKLKKSSKESTNEY

SEQ ID NO: 2608769 - protein, 12 aa, Entamoeba histolytica
AQGNNNGNHFNN

SEQ ID NO: 2608770 - protein, 16 aa, Entamoeba histolytica
AQGRKVSKEVSVKQPN

SEQ ID NO: 2608771 - protein, 44 aa, Entamoeba histolytica
AQGYNNEEESSKRKEETKPKEKNEQRELTKKQQKKSQKKQKIKE

SEQ ID NO: 2608772 - protein, 8 aa, Entamoeba histolytica
AQHPTPFA

SEQ ID NO: 2608773 - protein, 4 aa, Entamoeba histolytica
AQHQ

SEQ ID NO: 2608774 - protein, 6 aa, Entamoeba histolytica
AQHSGT

SEQ ID NO: 2608775 - protein, 23 aa, Entamoeba histolytica
AQIENEKQKRLKADSLKEEQIKE

SEQ ID NO: 2608776 - protein, 7 aa, Entamoeba histolytica
AQINKSY

SEQ ID NO: 2608777 - protein, 17 aa, Entamoeba histolytica
AQIQTTVSELNDRKERY

SEQ ID NO: 2608778 - protein, 5 aa, Entamoeba histolytica
AQKAI

SEQ ID NO: 2608779 - protein, 33 aa, Entamoeba histolytica
AQKAKEYEQKRKEEKERKKQQQRPQQLQKEKSI

SEQ ID NO: 2608780 - protein, 8 aa, Entamoeba histolytica
AQKASQVG

SEQ ID NO: 2608781 - protein, 15 aa, Entamoeba histolytica
AQKEVTKVNAIAKKQ

SEQ ID NO: 2608782 - protein, 24 aa, Entamoeba histolytica
AQKINEKPQTIADYESGKAIPSQQ

SEQ ID NO: 2608783 - protein, 5 aa, Entamoeba histolytica
AQKKI

SEQ ID NO: 2608784 - protein, 10 aa, Entamoeba histolytica
AQKLKTFSSG

SEQ ID NO: 2608785 - protein, 5 aa, Entamoeba histolytica
AQKPL

SEQ ID NO: 2608786 - protein, 6 aa, Entamoeba histolytica
AQKQLS

SEQ ID NO: 2608787 - protein, 6 aa, Entamoeba histolytica
AQKRKL

SEQ ID NO: 2608788 - protein, 29 aa, Entamoeba histolytica
AQKRRMSELSDEEVGGKRKGDNISPNYDT

SEQ ID NO: 2608789 - protein, 6 aa, Entamoeba histolytica
AQKSLS

SEQ ID NO: 2608790 - protein, 8 aa, Entamoeba histolytica
AQKTGNWR

SEQ ID NO: 2608791 - protein, 19 aa, Entamoeba histolytica
AQKVNDAQERLIKSMKAQQ

SEQ ID NO: 2608792 - protein, 17 aa, Entamoeba histolytica
AQLEKTDTPAIKQTAIN

SEQ ID NO: 2608793 - protein, 12 aa, Entamoeba histolytica
AQLHGNETTEEK

SEQ ID NO: 2608794 - protein, 6 aa, Entamoeba histolytica
AQLPGS

SEQ ID NO: 2608795 - protein, 26 aa, Entamoeba histolytica
AQLPPIEEAEKACEDANIEDNEYTDV

SEQ ID NO: 2608796 - protein, 4 aa, Entamoeba histolytica
AQLR

SEQ ID NO: 2608797 - protein, 6 aa, Entamoeba histolytica
AQLSDF

SEQ ID NO: 2608798 - protein, 7 aa, Entamoeba histolytica
AQMDTGS

SEQ ID NO: 2608799 - protein, 8 aa, Entamoeba histolytica
AQMPKAVK

SEQ ID NO: 2608800 - protein, 4 aa, Entamoeba histolytica
AQMQ

SEQ ID NO: 2608801 - protein, 11 aa, Entamoeba histolytica
AQMTPEPSSVG

SEQ ID NO: 2608802 - protein, 7 aa, Entamoeba histolytica
AQNALTK

SEQ ID NO: 2608803 - protein, 7 aa, Entamoeba histolytica
AQNEIKE

SEQ ID NO: 2608804 - protein, 8 aa, Entamoeba histolytica
AQNEIPQV

SEQ ID NO: 2608805 - protein, 8 aa, Entamoeba histolytica
AQNGECAN

SEQ ID NO: 2608806 - protein, 8 aa, Entamoeba histolytica
AQNGTFED

SEQ ID NO: 2608807 - protein, 11 aa, Entamoeba histolytica
AQNHQRDEEFS

SEQ ID NO: 2608808 - protein, 8 aa, Entamoeba histolytica
AQNPERAK

SEQ ID NO: 2608809 - protein, 8 aa, Entamoeba histolytica
AQNPSNIT

SEQ ID NO: 2608810 - protein, 10 aa, Entamoeba histolytica
AQNPSRENEF

SEQ ID NO: 2608811 - protein, 15 aa, Entamoeba histolytica
AQNQTSLNISSDKAK

SEQ ID NO: 2608812 - protein, 9 aa, Entamoeba histolytica
AQNRKNYRA

SEQ ID NO: 2608813 - protein, 8 aa, Entamoeba histolytica
AQNSGYDR

SEQ ID NO: 2608814 - protein, 5 aa, Entamoeba histolytica
AQNSN

SEQ ID NO: 2608815 - protein, 7 aa, Entamoeba histolytica
AQNSQTL

SEQ ID NO: 2608816 - protein, 7 aa, Entamoeba histolytica
AQNSVDD

SEQ ID NO: 2608817 - protein, 4 aa, Entamoeba histolytica
AQNV

SEQ ID NO: 2608818 - protein, 6 aa, Entamoeba histolytica
AQNYGN

SEQ ID NO: 2608819 - protein, 11 aa, Entamoeba histolytica
AQPASAYQNNV

SEQ ID NO: 2608820 - protein, 10 aa, Entamoeba histolytica
AQPINEKSDI

SEQ ID NO: 2608821 - protein, 12 aa, Entamoeba histolytica
AQPIPQKNSGYV

SEQ ID NO: 2608822 - protein, 5 aa, Entamoeba histolytica
AQPLN

SEQ ID NO: 2608823 - protein, 6 aa, Entamoeba histolytica
AQPLPG

SEQ ID NO: 2608824 - protein, 6 aa, Entamoeba histolytica
AQPNQA

SEQ ID NO: 2608825 - protein, 26 aa, Entamoeba histolytica
AQPPPSKLKVGSNQQTCAAPIPPSIS

SEQ ID NO: 2608826 - protein, 14 aa, Entamoeba histolytica
AQPSTDPASVEDDS

SEQ ID NO: 2608827 - protein, 6 aa, Entamoeba histolytica
AQPTIT

SEQ ID NO: 2608828 - protein, 9 aa, Entamoeba histolytica
AQPTPLTQI

SEQ ID NO: 2608829 - protein, 6 aa, Entamoeba histolytica
AQQDIE

SEQ ID NO: 2608830 - protein, 10 aa, Entamoeba histolytica
AQQKVNPASI

SEQ ID NO: 2608831 - protein, 6 aa, Entamoeba histolytica
AQQNGF

SEQ ID NO: 2608832 - protein, 7 aa, Entamoeba histolytica
AQQNGFV

SEQ ID NO: 2608833 - protein, 10 aa, Entamoeba histolytica
AQQNNKTKEL

SEQ ID NO: 2608834 - protein, 19 aa, Entamoeba histolytica
AQQPKKLTETIKKESTEER

SEQ ID NO: 2608835 - protein, 5 aa, Entamoeba histolytica
AQRDN

SEQ ID NO: 2608836 - protein, 15 aa, Entamoeba histolytica
AQRLKNKSSKLNKTL

SEQ ID NO: 2608837 - protein, 6 aa, Entamoeba histolytica
AQRMDP

SEQ ID NO: 2608838 - protein, 4 aa, Entamoeba histolytica
AQRT

SEQ ID NO: 2608839 - protein, 18 aa, Entamoeba histolytica
AQRTQRKLNDEKKVEQER

SEQ ID NO: 2608840 - protein, 15 aa, Entamoeba histolytica
AQSAPVMKKSNRMSV

SEQ ID NO: 2608841 - protein, 10 aa, Entamoeba histolytica
AQSDLKTTQM

SEQ ID NO: 2608842 - protein, 7 aa, Entamoeba histolytica
AQSENGD

SEQ ID NO: 2608843 - protein, 7 aa, Entamoeba histolytica
AQSETYK

SEQ ID NO: 2608844 - protein, 12 aa, Entamoeba histolytica
AQSFSEKREIGP

SEQ ID NO: 2608845 - protein, 7 aa, Entamoeba histolytica
AQSGNKE

SEQ ID NO: 2608846 - protein, 10 aa, Entamoeba histolytica
AQSIGAPATQ

SEQ ID NO: 2608847 - protein, 5 aa, Entamoeba histolytica
AQSKN

SEQ ID NO: 2608848 - protein, 12 aa, Entamoeba histolytica
AQSLNLDNNQDL

SEQ ID NO: 2608849 - protein, 30 aa, Entamoeba histolytica
AQSLNLDNNQDSIDKKKKEINEKEEEREKL

SEQ ID NO: 2608850 - protein, 22 aa, Entamoeba histolytica
AQSMNGSSWKGSDGSYSSPFGK

SEQ ID NO: 2608851 - protein, 5 aa, Entamoeba histolytica
AQSNI

SEQ ID NO: 2608852 - protein, 6 aa, Entamoeba histolytica
AQSPDV

SEQ ID NO: 2608853 - protein, 7 aa, Entamoeba histolytica
AQSSTCK

SEQ ID NO: 2608854 - protein, 5 aa, Entamoeba histolytica
AQSVE

SEQ ID NO: 2608855 - protein, 14 aa, Entamoeba histolytica
AQSVRSVEKEMVET

SEQ ID NO: 2608856 - protein, 5 aa, Entamoeba histolytica
AQSYY

SEQ ID NO: 2608857 - protein, 7 aa, Entamoeba histolytica
AQTANEA

SEQ ID NO: 2608858 - protein, 7 aa, Entamoeba histolytica
AQTEGAD

SEQ ID NO: 2608859 - protein, 9 aa, Entamoeba histolytica
AQTGEEPTV

SEQ ID NO: 2608860 - protein, 8 aa, Entamoeba histolytica
AQTGSGKT

SEQ ID NO: 2608861 - protein, 20 aa, Entamoeba histolytica
AQTNLNSTTKVEDSDNSQPV

SEQ ID NO: 2608862 - protein, 8 aa, Entamoeba histolytica
AQTNNHRP

SEQ ID NO: 2608863 - protein, 11 aa, Entamoeba histolytica
AQTNQIPPMPT

SEQ ID NO: 2608864 - protein, 5 aa, Entamoeba histolytica
AQTNT

SEQ ID NO: 2608865 - protein, 7 aa, Entamoeba histolytica
AQTPLCQ

SEQ ID NO: 2608866 - protein, 5 aa, Entamoeba histolytica
AQTPQ

SEQ ID NO: 2608867 - protein, 6 aa, Entamoeba histolytica
AQTQNI

SEQ ID NO: 2608868 - protein, 5 aa, Entamoeba histolytica
AQTQR

SEQ ID NO: 2608869 - protein, 6 aa, Entamoeba histolytica
AQTSRT

SEQ ID NO: 2608870 - protein, 6 aa, Entamoeba histolytica
AQTTAR

SEQ ID NO: 2608871 - protein, 7 aa, Entamoeba histolytica
AQYGSQK

SEQ ID NO: 2608872 - protein, 8 aa, Entamoeba histolytica
AQYPHDPP

SEQ ID NO: 2608873 - protein, 6 aa, Entamoeba histolytica
AQYREG

SEQ ID NO: 2608874 - protein, 6 aa, Entamoeba histolytica
ARAAGI

SEQ ID NO: 2608875 - protein, 7 aa, Entamoeba histolytica
ARAGKQA

SEQ ID NO: 2608876 - protein, 6 aa, Entamoeba histolytica
ARAGRM

SEQ ID NO: 2608877 - protein, 8 aa, Entamoeba histolytica
ARAHNNSA

SEQ ID NO: 2608878 - protein, 16 aa, Entamoeba histolytica
ARAKAECREIATKDDA

SEQ ID NO: 2608879 - protein, 7 aa, Entamoeba histolytica
ARANGEH

SEQ ID NO: 2608880 - protein, 20 aa, Entamoeba histolytica
ARANRGGSSMKNTRGTPQRK

SEQ ID NO: 2608881 - protein, 67 aa, Entamoeba histolytica
ARANRGGSTPHPTRGAPAPRGMPSRGAPAGGIPSRGAPAPRGMPSRGRGGMMPPTQAPEPEEQETPV

SEQ ID NO: 2608882 - protein, 29 aa, Entamoeba histolytica
ARAQDVKQKQDDVQRQKEQLDKELKEKEA

SEQ ID NO: 2608883 - protein, 7 aa, Entamoeba histolytica
ARAQVST

SEQ ID NO: 2608884 - protein, 24 aa, Entamoeba histolytica
ARARGPKSSLTRQPTEGRSRDGGL

SEQ ID NO: 2608885 - protein, 10 aa, Entamoeba histolytica
ARAVNQTSIP

SEQ ID NO: 2608886 - protein, 4 aa, Entamoeba histolytica
ARCE

SEQ ID NO: 2608887 - protein, 5 aa, Entamoeba histolytica
ARDAE

SEQ ID NO: 2608888 - protein, 7 aa, Entamoeba histolytica
ARDATNV

SEQ ID NO: 2608889 - protein, 25 aa, Entamoeba histolytica
ARDDYYGRSDRYSLRDSCNDREIDY

SEQ ID NO: 2608890 - protein, 9 aa, Entamoeba histolytica
ARDGSGDVV

SEQ ID NO: 2608891 - protein, 26 aa, Entamoeba histolytica
ARDKEMCGDTQPIQNTNKSQCNDKSM

SEQ ID NO: 2608892 - protein, 9 aa, Entamoeba histolytica
ARDPAKLAS

SEQ ID NO: 2608893 - protein, 8 aa, Entamoeba histolytica
ARDPRLEQ

SEQ ID NO: 2608894 - protein, 12 aa, Entamoeba histolytica
ARDQSDRNRTSP

SEQ ID NO: 2608895 - protein, 11 aa, Entamoeba histolytica
ARDRNKVDEIK

SEQ ID NO: 2608896 - protein, 7 aa, Entamoeba histolytica
ARDSSTY

SEQ ID NO: 2608897 - protein, 6 aa, Entamoeba histolytica
ARDVLE

SEQ ID NO: 2608898 - protein, 8 aa, Entamoeba histolytica
ARDWSGYS

SEQ ID NO: 2608899 - protein, 5 aa, Entamoeba histolytica
AREDR

SEQ ID NO: 2608900 - protein, 6 aa, Entamoeba histolytica
AREEKY

SEQ ID NO: 2608901 - protein, 34 aa, Entamoeba histolytica
AREESKKSIETNNEELQSTEIKQNEKEETTITHQ

SEQ ID NO: 2608902 - protein, 7 aa, Entamoeba histolytica
AREFTPE

SEQ ID NO: 2608903 - protein, 9 aa, Entamoeba histolytica
AREFTSTDI

SEQ ID NO: 2608904 - protein, 9 aa, Entamoeba histolytica
AREHSKGVA

SEQ ID NO: 2608905 - protein, 16 aa, Entamoeba histolytica
AREKKSSKVKSNTIQP

SEQ ID NO: 2608906 - protein, 7 aa, Entamoeba histolytica
ARENSPS

SEQ ID NO: 2608907 - protein, 8 aa, Entamoeba histolytica
ARERQERL

SEQ ID NO: 2608908 - protein, 10 aa, Entamoeba histolytica
ARESSGQKNK

SEQ ID NO: 2608909 - protein, 5 aa, Entamoeba histolytica
ARGAA

SEQ ID NO: 2608910 - protein, 8 aa, Entamoeba histolytica
ARGGAIST

SEQ ID NO: 2608911 - protein, 4 aa, Entamoeba histolytica
ARGI

SEQ ID NO: 2608912 - protein, 4 aa, Entamoeba histolytica
ARGN

SEQ ID NO: 2608913 - protein, 11 aa, Entamoeba histolytica
ARGNGKGNSDL

SEQ ID NO: 2608914 - protein, 62 aa, Entamoeba histolytica
ARGNRGGPAQHSMGGMPSRGAPAPRGMPSRGAPAPRGMPSRGRGGMMPPTQAPEPEEQETPV

SEQ ID NO: 2608915 - protein, 7 aa, Entamoeba histolytica
ARGQGMG

SEQ ID NO: 2608916 - protein, 9 aa, Entamoeba histolytica
ARGSGRDIR

SEQ ID NO: 2608917 - protein, 17 aa, Entamoeba histolytica
ARGSKDNVTAVIIFLNW

SEQ ID NO: 2608918 - protein, 11 aa, Entamoeba histolytica
ARGSKHQGGIN

SEQ ID NO: 2608919 - protein, 14 aa, Entamoeba histolytica
ARGSTDNVSCVVCK

SEQ ID NO: 2608920 - protein, 13 aa, Entamoeba histolytica
ARGTQAFKDQKFE

SEQ ID NO: 2608921 - protein, 14 aa, Entamoeba histolytica
ARHISQSSSPTTEM

SEQ ID NO: 2608922 - protein, 4 aa, Entamoeba histolytica
ARHT

SEQ ID NO: 2608923 - protein, 7 aa, Entamoeba histolytica
ARINHNG

SEQ ID NO: 2608924 - protein, 6 aa, Entamoeba histolytica
ARIPQE

SEQ ID NO: 2608925 - protein, 6 aa, Entamoeba histolytica
ARIPSQ

SEQ ID NO: 2608926 - protein, 12 aa, Entamoeba histolytica
ARIRGSDTIDEI

SEQ ID NO: 2608927 - protein, 12 aa, Entamoeba histolytica
ARKAAKVGRASF

SEQ ID NO: 2608928 - protein, 4 aa, Entamoeba histolytica
ARKE

SEQ ID NO: 2608929 - protein, 10 aa, Entamoeba histolytica
ARKEFKTKEQ

SEQ ID NO: 2608930 - protein, 8 aa, Entamoeba histolytica
ARKEGEKE

SEQ ID NO: 2608931 - protein, 9 aa, Entamoeba histolytica
ARKKEPNTN

SEQ ID NO: 2608932 - protein, 15 aa, Entamoeba histolytica
ARKQAKKDMAAATDP

SEQ ID NO: 2608933 - protein, 8 aa, Entamoeba histolytica
ARKQDDVG

SEQ ID NO: 2608934 - protein, 14 aa, Entamoeba histolytica
ARKQGEAKEDLNAK

SEQ ID NO: 2608935 - protein, 6 aa, Entamoeba histolytica
ARKRED

SEQ ID NO: 2608936 - protein, 8 aa, Entamoeba histolytica
ARKRLPAM

SEQ ID NO: 2608937 - protein, 36 aa, Entamoeba histolytica
ARKSEGRFTQGEKEIKKNESPKEGVTIDPERINSEE

SEQ ID NO: 2608938 - protein, 5 aa, Entamoeba histolytica
ARLEK

SEQ ID NO: 2608939 - protein, 7 aa, Entamoeba histolytica
ARMSGGF

SEQ ID NO: 2608940 - protein, 5 aa, Entamoeba histolytica
ARMTA

SEQ ID NO: 2608941 - protein, 11 aa, Entamoeba histolytica
ARMTKEQSDEV

SEQ ID NO: 2608942 - protein, 7 aa, Entamoeba histolytica
ARNEEKT

SEQ ID NO: 2608943 - protein, 10 aa, Entamoeba histolytica
ARNGKSKKKI

SEQ ID NO: 2608944 - protein, 14 aa, Entamoeba histolytica
ARNNQLKSLPASIG

SEQ ID NO: 2608945 - protein, 18 aa, Entamoeba histolytica
ARNQTDLKYDSEQPQNMR

SEQ ID NO: 2608946 - protein, 7 aa, Entamoeba histolytica
ARNSGGA

SEQ ID NO: 2608947 - protein, 10 aa, Entamoeba histolytica
ARNSKGELTG

SEQ ID NO: 2608948 - protein, 7 aa, Entamoeba histolytica
ARNTSTH

SEQ ID NO: 2608949 - protein, 5 aa, Entamoeba histolytica
ARPDL

SEQ ID NO: 2608950 - protein, 10 aa, Entamoeba histolytica
ARPDSQDGQL

SEQ ID NO: 2608951 - protein, 4 aa, Entamoeba histolytica
ARPE

SEQ ID NO: 2608952 - protein, 9 aa, Entamoeba histolytica
ARPINGRMT

SEQ ID NO: 2608953 - protein, 6 aa, Entamoeba histolytica
ARPIPT

SEQ ID NO: 2608954 - protein, 9 aa, Entamoeba histolytica
ARPKLNANV

SEQ ID NO: 2608955 - protein, 5 aa, Entamoeba histolytica
ARPPK

SEQ ID NO: 2608956 - protein, 32 aa, Entamoeba histolytica
ARPPKERKEVPEGEKKTTAGPRGYRPRRFGPR

SEQ ID NO: 2608957 - protein, 9 aa, Entamoeba histolytica
ARPQGTNEA

SEQ ID NO: 2608958 - protein, 14 aa, Entamoeba histolytica
ARPTNPCISSSNEQ

SEQ ID NO: 2608959 - protein, 6 aa, Entamoeba histolytica
ARPTQF

SEQ ID NO: 2608960 - protein, 5 aa, Entamoeba histolytica
ARQAA

SEQ ID NO: 2608961 - protein, 5 aa, Entamoeba histolytica
ARQDN

SEQ ID NO: 2608962 - protein, 6 aa, Entamoeba histolytica
ARQKQS

SEQ ID NO: 2608963 - protein, 7 aa, Entamoeba histolytica
ARQRETV

SEQ ID NO: 2608964 - protein, 22 aa, Entamoeba histolytica
ARQRYQGKTNNESFYKRKNDSV

SEQ ID NO: 2608965 - protein, 4 aa, Entamoeba histolytica
ARQT

SEQ ID NO: 2608966 - protein, 12 aa, Entamoeba histolytica
ARRQNKIKSKKY

SEQ ID NO: 2608967 - protein, 24 aa, Entamoeba histolytica
ARRRPQLSKELDDAVKTEVNECTS

SEQ ID NO: 2608968 - protein, 12 aa, Entamoeba histolytica
ARSAQVDGFSGA

SEQ ID NO: 2608969 - protein, 13 aa, Entamoeba histolytica
ARSGCNESEFDKE

SEQ ID NO: 2608970 - protein, 7 aa, Entamoeba histolytica
ARSGKNI

SEQ ID NO: 2608971 - protein, 26 aa, Entamoeba histolytica
ARSKADFDSPTLGKVENASKSVKEAT

SEQ ID NO: 2608972 - protein, 8 aa, Entamoeba histolytica
ARSMPTSA

SEQ ID NO: 2608973 - protein, 6 aa, Entamoeba histolytica
ARSPYT

SEQ ID NO: 2608974 - protein, 13 aa, Entamoeba histolytica
ARSSEKNSSGSKF

SEQ ID NO: 2608975 - protein, 17 aa, Entamoeba histolytica
ARSTSLEAQKAKKERMD

SEQ ID NO: 2608976 - protein, 11 aa, Entamoeba histolytica
ARTDKGVSAAN

SEQ ID NO: 2608977 - protein, 8 aa, Entamoeba histolytica
ARTGSGKT

SEQ ID NO: 2608978 - protein, 7 aa, Entamoeba histolytica
ARTNPAT

SEQ ID NO: 2608979 - protein, 12 aa, Entamoeba histolytica
ARTNRSDNKGTI

SEQ ID NO: 2608980 - protein, 6 aa, Entamoeba histolytica
ARTRTK

SEQ ID NO: 2608981 - protein, 10 aa, Entamoeba histolytica
ARTSGMDSNI

SEQ ID NO: 2608982 - protein, 8 aa, Entamoeba histolytica
ARTSHNLE

SEQ ID NO: 2608983 - protein, 6 aa, Entamoeba histolytica
ARTSQN

SEQ ID NO: 2608984 - protein, 4 aa, Entamoeba histolytica
ARTT

SEQ ID NO: 2608985 - protein, 8 aa, Entamoeba histolytica
ARTTFRPE

SEQ ID NO: 2608986 - protein, 9 aa, Entamoeba histolytica
ARTTNNSML

SEQ ID NO: 2608987 - protein, 6 aa, Entamoeba histolytica
ARVDSP

SEQ ID NO: 2608988 - protein, 6 aa, Entamoeba histolytica
ARWPNG

SEQ ID NO: 2608989 - protein, 7 aa, Entamoeba histolytica
ARYGDVN

SEQ ID NO: 2608990 - protein, 11 aa, Entamoeba histolytica
ARYQGDIGETD

SEQ ID NO: 2608991 - protein, 30 aa, Entamoeba histolytica
ASAAGGSNVSVKKQPKKVQNSYASTSSNVD

SEQ ID NO: 2608992 - protein, 15 aa, Entamoeba histolytica
ASAAQRAGRAGRIGE

SEQ ID NO: 2608993 - protein, 7 aa, Entamoeba histolytica
ASAGRQR

SEQ ID NO: 2608994 - protein, 7 aa, Entamoeba histolytica
ASAGSDN

SEQ ID NO: 2608995 - protein, 10 aa, Entamoeba histolytica
ASAKTGDNVK

SEQ ID NO: 2608996 - protein, 4 aa, Entamoeba histolytica
ASAL

SEQ ID NO: 2608997 - protein, 8 aa, Entamoeba histolytica
ASANTYDP

SEQ ID NO: 2608998 - protein, 6 aa, Entamoeba histolytica
ASAPEC

SEQ ID NO: 2608999 - protein, 7 aa, Entamoeba histolytica
ASAPGYF

SEQ ID NO: 2609000 - protein, 5 aa, Entamoeba histolytica
ASAQN

SEQ ID NO: 2609001 - protein, 10 aa, Entamoeba histolytica
ASAQTNEGVI

SEQ ID NO: 2609002 - protein, 6 aa, Entamoeba histolytica
ASASNV

SEQ ID NO: 2609003 - protein, 5 aa, Entamoeba histolytica
ASATN

SEQ ID NO: 2609004 - protein, 7 aa, Entamoeba histolytica
ASATTDI

SEQ ID NO: 2609005 - protein, 9 aa, Entamoeba histolytica
ASATTPKKI

SEQ ID NO: 2609006 - protein, 18 aa, Entamoeba histolytica
ASAVEESSNDKPAEKPDV

SEQ ID NO: 2609007 - protein, 8 aa, Entamoeba histolytica
ASAVGSGY

SEQ ID NO: 2609008 - protein, 8 aa, Entamoeba histolytica
ASAVSSAK

SEQ ID NO: 2609009 - protein, 7 aa, Entamoeba histolytica
ASCANKE

SEQ ID NO: 2609010 - protein, 4 aa, Entamoeba histolytica
ASCG

SEQ ID NO: 2609011 - protein, 7 aa, Entamoeba histolytica
ASCPEQR

SEQ ID NO: 2609012 - protein, 9 aa, Entamoeba histolytica
ASCTPANGE

SEQ ID NO: 2609013 - protein, 6 aa, Entamoeba histolytica
ASDAEK

SEQ ID NO: 2609014 - protein, 11 aa, Entamoeba histolytica
ASDATRRTEGF

SEQ ID NO: 2609015 - protein, 6 aa, Entamoeba histolytica
ASDDDT

SEQ ID NO: 2609016 - protein, 16 aa, Entamoeba histolytica
ASDDIESSYYNEYSET

SEQ ID NO: 2609017 - protein, 7 aa, Entamoeba histolytica
ASDDNTV

SEQ ID NO: 2609018 - protein, 5 aa, Entamoeba histolytica
ASDEI

SEQ ID NO: 2609019 - protein, 7 aa, Entamoeba histolytica
ASDERGI

SEQ ID NO: 2609020 - protein, 10 aa, Entamoeba histolytica
ASDERGIETI

SEQ ID NO: 2609021 - protein, 5 aa, Entamoeba histolytica
ASDFT

SEQ ID NO: 2609022 - protein, 7 aa, Entamoeba histolytica
ASDGDTL

SEQ ID NO: 2609023 - protein, 9 aa, Entamoeba histolytica
ASDKRQSID

SEQ ID NO: 2609024 - protein, 7 aa, Entamoeba histolytica
ASDLDYS

SEQ ID NO: 2609025 - protein, 5 aa, Entamoeba histolytica
ASDNA

SEQ ID NO: 2609026 - protein, 6 aa, Entamoeba histolytica
ASDNKK

SEQ ID NO: 2609027 - protein, 9 aa, Entamoeba histolytica
ASDNNGSHP

SEQ ID NO: 2609028 - protein, 8 aa, Entamoeba histolytica
ASDPRYTY

SEQ ID NO: 2609029 - protein, 8 aa, Entamoeba histolytica
ASDPSLRK

SEQ ID NO: 2609030 - protein, 33 aa, Entamoeba histolytica
ASDRPLMDRPNSDRDYYPSDRMRDSGPYRRDDI

SEQ ID NO: 2609031 - protein, 8 aa, Entamoeba histolytica
ASDSEYGE

SEQ ID NO: 2609032 - protein, 10 aa, Entamoeba histolytica
ASDTRNKSSI

SEQ ID NO: 2609033 - protein, 12 aa, Entamoeba histolytica
ASDYMGSILLHK

SEQ ID NO: 2609034 - protein, 11 aa, Entamoeba histolytica
ASDYRQKTNDL

SEQ ID NO: 2609035 - protein, 5 aa, Entamoeba histolytica
ASEAI

SEQ ID NO: 2609036 - protein, 8 aa, Entamoeba histolytica
ASECGQSE

SEQ ID NO: 2609037 - protein, 8 aa, Entamoeba histolytica
ASEDKRVQ

SEQ ID NO: 2609038 - protein, 6 aa, Entamoeba histolytica
ASEDST

SEQ ID NO: 2609039 - protein, 4 aa, Entamoeba histolytica
ASEE

SEQ ID NO: 2609040 - protein, 16 aa, Entamoeba histolytica
ASEEEKKRKKIEDEIP

SEQ ID NO: 2609041 - protein, 10 aa, Entamoeba histolytica
ASEEGDSPMN

SEQ ID NO: 2609042 - protein, 8 aa, Entamoeba histolytica
ASEEHKDD

SEQ ID NO: 2609043 - protein, 8 aa, Entamoeba histolytica
ASEGDLEM

SEQ ID NO: 2609044 - protein, 8 aa, Entamoeba histolytica
ASEGNEQY

SEQ ID NO: 2609045 - protein, 14 aa, Entamoeba histolytica
ASEKDPKATFTKPS

SEQ ID NO: 2609046 - protein, 4 aa, Entamoeba histolytica
ASEP

SEQ ID NO: 2609047 - protein, 4 aa, Entamoeba histolytica
ASEQ

SEQ ID NO: 2609048 - protein, 8 aa, Entamoeba histolytica
ASERDDPK

SEQ ID NO: 2609049 - protein, 11 aa, Entamoeba histolytica
ASERGKVGYGD

SEQ ID NO: 2609050 - protein, 6 aa, Entamoeba histolytica
ASESQN

SEQ ID NO: 2609051 - protein, 37 aa, Entamoeba histolytica
ASETTGEIEDEIEDEDYGYDEDEEDEDNEDDEDDMTA

SEQ ID NO: 2609052 - protein, 12 aa, Entamoeba histolytica
ASEYATNNKVAL

SEQ ID NO: 2609053 - protein, 7 aa, Entamoeba histolytica
ASFEGEQ

SEQ ID NO: 2609054 - protein, 39 aa, Entamoeba histolytica
ASFGSNASSERITTPEGSYNGSHDGSSHYSSHTKTPGIY

SEQ ID NO: 2609055 - protein, 9 aa, Entamoeba histolytica
ASFGVNGED

SEQ ID NO: 2609056 - protein, 13 aa, Entamoeba histolytica
ASGCSSKISEHAT

SEQ ID NO: 2609057 - protein, 6 aa, Entamoeba histolytica
ASGDKL

SEQ ID NO: 2609058 - protein, 7 aa, Entamoeba histolytica
ASGDVSG

SEQ ID NO: 2609059 - protein, 14 aa, Entamoeba histolytica
ASGGEQDLGHPPMD

SEQ ID NO: 2609060 - protein, 6 aa, Entamoeba histolytica
ASGGYG

SEQ ID NO: 2609061 - protein, 39 aa, Entamoeba histolytica
ASGISNDNGNRTTFTNGKEEEDDITQYTTAADPDENYEN

SEQ ID NO: 2609062 - protein, 17 aa, Entamoeba histolytica
ASGITTYGKKAVTNPFG

SEQ ID NO: 2609063 - protein, 7 aa, Entamoeba histolytica
ASGKIES

SEQ ID NO: 2609064 - protein, 6 aa, Entamoeba histolytica
ASGLRS

SEQ ID NO: 2609065 - protein, 5 aa, Entamoeba histolytica
ASGPM

SEQ ID NO: 2609066 - protein, 5 aa, Entamoeba histolytica
ASGSP

SEQ ID NO: 2609067 - protein, 4 aa, Entamoeba histolytica
ASGT

SEQ ID NO: 2609068 - protein, 8 aa, Entamoeba histolytica
ASGTEEMK

SEQ ID NO: 2609069 - protein, 7 aa, Entamoeba histolytica
ASGTTVS

SEQ ID NO: 2609070 - protein, 4 aa, Entamoeba histolytica
ASGY

SEQ ID NO: 2609071 - protein, 6 aa, Entamoeba histolytica
ASHGIG

SEQ ID NO: 2609072 - protein, 9 aa, Entamoeba histolytica
ASHGPGKTE

SEQ ID NO: 2609073 - protein, 5 aa, Entamoeba histolytica
ASHKR

SEQ ID NO: 2609074 - protein, 5 aa, Entamoeba histolytica
ASHNA

SEQ ID NO: 2609075 - protein, 14 aa, Entamoeba histolytica
ASHPEETHGPSRKE

SEQ ID NO: 2609076 - protein, 12 aa, Entamoeba histolytica
ASIHRPDAPPEL

SEQ ID NO: 2609077 - protein, 9 aa, Entamoeba histolytica
ASIKEEHPD

SEQ ID NO: 2609078 - protein, 12 aa, Entamoeba histolytica
ASIKEEHPDAKV

SEQ ID NO: 2609079 - protein, 8 aa, Entamoeba histolytica
ASINGATS

SEQ ID NO: 2609080 - protein, 6 aa, Entamoeba histolytica
ASIPVT

SEQ ID NO: 2609081 - protein, 6 aa, Entamoeba histolytica
ASIRNY

SEQ ID NO: 2609082 - protein, 4 aa, Entamoeba histolytica
ASIV

SEQ ID NO: 2609083 - protein, 4 aa, Entamoeba histolytica
ASKD

SEQ ID NO: 2609084 - protein, 8 aa, Entamoeba histolytica
ASKDLKGR

SEQ ID NO: 2609085 - protein, 12 aa, Entamoeba histolytica
ASKEKTKEKYAE

SEQ ID NO: 2609086 - protein, 11 aa, Entamoeba histolytica
ASKEKTKEKYV

SEQ ID NO: 2609087 - protein, 7 aa, Entamoeba histolytica
ASKETIG

SEQ ID NO: 2609088 - protein, 14 aa, Entamoeba histolytica
ASKEVRNNKLDGSY

SEQ ID NO: 2609089 - protein, 6 aa, Entamoeba histolytica
ASKFRN

SEQ ID NO: 2609090 - protein, 4 aa, Entamoeba histolytica
ASKG

SEQ ID NO: 2609091 - protein, 15 aa, Entamoeba histolytica
ASKKDGKLKASQLEI

SEQ ID NO: 2609092 - protein, 6 aa, Entamoeba histolytica
ASKKDN

SEQ ID NO: 2609093 - protein, 19 aa, Entamoeba histolytica
ASKKEDANRLLNMKKFFEQ

SEQ ID NO: 2609094 - protein, 8 aa, Entamoeba histolytica
ASKLPTEC

SEQ ID NO: 2609095 - protein, 8 aa, Entamoeba histolytica
ASKNIDGY

SEQ ID NO: 2609096 - protein, 7 aa, Entamoeba histolytica
ASKNQPQ

SEQ ID NO: 2609097 - protein, 6 aa, Entamoeba histolytica
ASKNYL

SEQ ID NO: 2609098 - protein, 7 aa, Entamoeba histolytica
ASKPKFQ

SEQ ID NO: 2609099 - protein, 6 aa, Entamoeba histolytica
ASKPRL

SEQ ID NO: 2609100 - protein, 7 aa, Entamoeba histolytica
ASKPRLI

SEQ ID NO: 2609101 - protein, 9 aa, Entamoeba histolytica
ASKSGKELT

SEQ ID NO: 2609102 - protein, 11 aa, Entamoeba histolytica
ASKSPNKDRKD

SEQ ID NO: 2609103 - protein, 16 aa, Entamoeba histolytica
ASKTAHNSEEQNEFDN

SEQ ID NO: 2609104 - protein, 11 aa, Entamoeba histolytica
ASKTKQNKNVM

SEQ ID NO: 2609105 - protein, 15 aa, Entamoeba histolytica
ASKTKSKTPNNQPLY

SEQ ID NO: 2609106 - protein, 7 aa, Entamoeba histolytica
ASKTPER

SEQ ID NO: 2609107 - protein, 9 aa, Entamoeba histolytica
ASKYTEESY

SEQ ID NO: 2609108 - protein, 12 aa, Entamoeba histolytica
ASLAKGVSTPPD

SEQ ID NO: 2609109 - protein, 4 aa, Entamoeba histolytica
ASLD

SEQ ID NO: 2609110 - protein, 6 aa, Entamoeba histolytica
ASLDAA

SEQ ID NO: 2609111 - protein, 7 aa, Entamoeba histolytica
ASLDGDK

SEQ ID NO: 2609112 - protein, 18 aa, Entamoeba histolytica
ASLENEYGKGIHTQSTVP

SEQ ID NO: 2609113 - protein, 11 aa, Entamoeba histolytica
ASLESKTISDV

SEQ ID NO: 2609114 - protein, 9 aa, Entamoeba histolytica
ASLEYDPSS

SEQ ID NO: 2609115 - protein, 30 aa, Entamoeba histolytica
ASLNASTGNGNTTHTETLNKPANPTHPRAN

SEQ ID NO: 2609116 - protein, 11 aa, Entamoeba histolytica
ASLNDENHNGK

SEQ ID NO: 2609117 - protein, 8 aa, Entamoeba histolytica
ASLNDRAI

SEQ ID NO: 2609118 - protein, 17 aa, Entamoeba histolytica
ASLNQSSPRTKSVQPEV

SEQ ID NO: 2609119 - protein, 30 aa, Entamoeba histolytica
ASLNTTNGKKFQPPTKPHEITPYEKDLTAQ

SEQ ID NO: 2609120 - protein, 6 aa, Entamoeba histolytica
ASLPGE

SEQ ID NO: 2609121 - protein, 8 aa, Entamoeba histolytica
ASLPNAKD

SEQ ID NO: 2609122 - protein, 12 aa, Entamoeba histolytica
ASLPTKSDIPSY

SEQ ID NO: 2609123 - protein, 12 aa, Entamoeba histolytica
ASLQAASNELTA

SEQ ID NO: 2609124 - protein, 4 aa, Entamoeba histolytica
ASLS

SEQ ID NO: 2609125 - protein, 33 aa, Entamoeba histolytica
ASLSNSGSSRKEKRSSKKLNKADIDELKKEHKW

SEQ ID NO: 2609126 - protein, 6 aa, Entamoeba histolytica
ASLTHT

SEQ ID NO: 2609127 - protein, 15 aa, Entamoeba histolytica
ASMEIKNEKGETPLS

SEQ ID NO: 2609128 - protein, 5 aa, Entamoeba histolytica
ASMGN

SEQ ID NO: 2609129 - protein, 12 aa, Entamoeba histolytica
ASMNEDDSGEIN

SEQ ID NO: 2609130 - protein, 9 aa, Entamoeba histolytica
ASMNNELDE

SEQ ID NO: 2609131 - protein, 5 aa, Entamoeba histolytica
ASNAL

SEQ ID NO: 2609132 - protein, 7 aa, Entamoeba histolytica
ASNDIDS

SEQ ID NO: 2609133 - protein, 7 aa, Entamoeba histolytica
ASNDNKT

SEQ ID NO: 2609134 - protein, 10 aa, Entamoeba histolytica
ASNDSLSPCT

SEQ ID NO: 2609135 - protein, 5 aa, Entamoeba histolytica
ASNEI

SEQ ID NO: 2609136 - protein, 8 aa, Entamoeba histolytica
ASNELTES

SEQ ID NO: 2609137 - protein, 10 aa, Entamoeba histolytica
ASNIEATETG

SEQ ID NO: 2609138 - protein, 9 aa, Entamoeba histolytica
ASNLTKNRY

SEQ ID NO: 2609139 - protein, 15 aa, Entamoeba histolytica
ASNNPSNRAGSKAYM

SEQ ID NO: 2609140 - protein, 5 aa, Entamoeba histolytica
ASNPQ

SEQ ID NO: 2609141 - protein, 10 aa, Entamoeba histolytica
ASNPSLYQGT

SEQ ID NO: 2609142 - protein, 10 aa, Entamoeba histolytica
ASNPSRNDIP

SEQ ID NO: 2609143 - protein, 12 aa, Entamoeba histolytica
ASNQPKKEKSPI

SEQ ID NO: 2609144 - protein, 7 aa, Entamoeba histolytica
ASNQRGI

SEQ ID NO: 2609145 - protein, 8 aa, Entamoeba histolytica
ASNSETSK

SEQ ID NO: 2609146 - protein, 40 aa, Entamoeba histolytica
ASNSIQSHTTQNTQFTSSVTETTTTTNVEDNSQPAQDGLE

SEQ ID NO: 2609147 - protein, 8 aa, Entamoeba histolytica
ASNSKSVE

SEQ ID NO: 2609148 - protein, 10 aa, Entamoeba histolytica
ASNSNKNTNL

SEQ ID NO: 2609149 - protein, 5 aa, Entamoeba histolytica
ASNTI

SEQ ID NO: 2609150 - protein, 9 aa, Entamoeba histolytica
ASNTKGTNA

SEQ ID NO: 2609151 - protein, 14 aa, Entamoeba histolytica
ASNTSSGKRTYGKN

SEQ ID NO: 2609152 - protein, 4 aa, Entamoeba histolytica
ASNY

SEQ ID NO: 2609153 - protein, 4 aa, Entamoeba histolytica
ASPA

SEQ ID NO: 2609154 - protein, 7 aa, Entamoeba histolytica
ASPATVG

SEQ ID NO: 2609155 - protein, 5 aa, Entamoeba histolytica
ASPEP

SEQ ID NO: 2609156 - protein, 8 aa, Entamoeba histolytica
ASPEQRGK

SEQ ID NO: 2609157 - protein, 5 aa, Entamoeba histolytica
ASPIN

SEQ ID NO: 2609158 - protein, 6 aa, Entamoeba histolytica
ASPISG

SEQ ID NO: 2609159 - protein, 8 aa, Entamoeba histolytica
ASPKDNQL

SEQ ID NO: 2609160 - protein, 8 aa, Entamoeba histolytica
ASPLDSSE

SEQ ID NO: 2609161 - protein, 10 aa, Entamoeba histolytica
ASPMNQKTSV

SEQ ID NO: 2609162 - protein, 4 aa, Entamoeba histolytica
ASPN

SEQ ID NO: 2609163 - protein, 10 aa, Entamoeba histolytica
ASPNSTPKGV

SEQ ID NO: 2609164 - protein, 18 aa, Entamoeba histolytica
ASPPKDCITPPKKNDRSI

SEQ ID NO: 2609165 - protein, 6 aa, Entamoeba histolytica
ASPPSI

SEQ ID NO: 2609166 - protein, 9 aa, Entamoeba histolytica
ASPQTNDNV

SEQ ID NO: 2609167 - protein, 30 aa, Entamoeba histolytica
ASPRHEESQTPSSPRLKERKSPSSNSPQNI

SEQ ID NO: 2609168 - protein, 5 aa, Entamoeba histolytica
ASPRV

SEQ ID NO: 2609169 - protein, 6 aa, Entamoeba histolytica
ASPSDA

SEQ ID NO: 2609170 - protein, 5 aa, Entamoeba histolytica
ASPSN

SEQ ID NO: 2609171 - protein, 13 aa, Entamoeba histolytica
ASPSSKISRQTTE

SEQ ID NO: 2609172 - protein, 20 aa, Entamoeba histolytica
ASPTKPLSPRKFETKPEIDI

SEQ ID NO: 2609173 - protein, 28 aa, Entamoeba histolytica
ASPTKPLSPRKFETKQDEDIKKDGITQL

SEQ ID NO: 2609174 - protein, 21 aa, Entamoeba histolytica
ASPVNQSFSTMNKKGNKEIEE

SEQ ID NO: 2609175 - protein, 8 aa, Entamoeba histolytica
ASQARKGD

SEQ ID NO: 2609176 - protein, 8 aa, Entamoeba histolytica
ASQASIPT

SEQ ID NO: 2609177 - protein, 4 aa, Entamoeba histolytica
ASQC

SEQ ID NO: 2609178 - protein, 4 aa, Entamoeba histolytica
ASQD

SEQ ID NO: 2609179 - protein, 8 aa, Entamoeba histolytica
ASQEAQSV

SEQ ID NO: 2609180 - protein, 16 aa, Entamoeba histolytica
ASQFADDKCEDPIPGT

SEQ ID NO: 2609181 - protein, 14 aa, Entamoeba histolytica
ASQIATSLSTSSPI

SEQ ID NO: 2609182 - protein, 5 aa, Entamoeba histolytica
ASQKD

SEQ ID NO: 2609183 - protein, 11 aa, Entamoeba histolytica
ASQKEEAQKHL

SEQ ID NO: 2609184 - protein, 9 aa, Entamoeba histolytica
ASQNDFTSI

SEQ ID NO: 2609185 - protein, 18 aa, Entamoeba histolytica
ASQPGLASQPGLASQPVG

SEQ ID NO: 2609186 - protein, 5 aa, Entamoeba histolytica
ASQPI

SEQ ID NO: 2609187 - protein, 6 aa, Entamoeba histolytica
ASQPIK

SEQ ID NO: 2609188 - protein, 15 aa, Entamoeba histolytica
ASQPKKEVKKKKLEN

SEQ ID NO: 2609189 - protein, 10 aa, Entamoeba histolytica
ASQPKRTLKE

SEQ ID NO: 2609190 - protein, 15 aa, Entamoeba histolytica
ASQQTTINTYSENTD

SEQ ID NO: 2609191 - protein, 13 aa, Entamoeba histolytica
ASQRDPFCGSKSP

SEQ ID NO: 2609192 - protein, 6 aa, Entamoeba histolytica
ASQREK

SEQ ID NO: 2609193 - protein, 9 aa, Entamoeba histolytica
ASQSGGVSQ

SEQ ID NO: 2609194 - protein, 8 aa, Entamoeba histolytica
ASQSKEEV

SEQ ID NO: 2609195 - protein, 6 aa, Entamoeba histolytica
ASQSSL

SEQ ID NO: 2609196 - protein, 12 aa, Entamoeba histolytica
ASQSSLDFTQAS

SEQ ID NO: 2609197 - protein, 4 aa, Entamoeba histolytica
ASQV

SEQ ID NO: 2609198 - protein, 8 aa, Entamoeba histolytica
ASRADKYS

SEQ ID NO: 2609199 - protein, 6 aa, Entamoeba histolytica
ASRATT

SEQ ID NO: 2609200 - protein, 14 aa, Entamoeba histolytica
ASRGEIQKNKSLEE

SEQ ID NO: 2609201 - protein, 5 aa, Entamoeba histolytica
ASRGL

SEQ ID NO: 2609202 - protein, 6 aa, Entamoeba histolytica
ASRGLD

SEQ ID NO: 2609203 - protein, 4 aa, Entamoeba histolytica
ASRI

SEQ ID NO: 2609204 - protein, 10 aa, Entamoeba histolytica
ASRKDENRME

SEQ ID NO: 2609205 - protein, 8 aa, Entamoeba histolytica
ASRKDPGC

SEQ ID NO: 2609206 - protein, 39 aa, Entamoeba histolytica
ASRKERKREWKKRQQQTKENDPENQNNERSRSNSRTRTE

SEQ ID NO: 2609207 - protein, 8 aa, Entamoeba histolytica
ASRKRRNH

SEQ ID NO: 2609208 - protein, 6 aa, Entamoeba histolytica
ASRLEE

SEQ ID NO: 2609209 - protein, 7 aa, Entamoeba histolytica
ASRNDGY

SEQ ID NO: 2609210 - protein, 5 aa, Entamoeba histolytica
ASRRY

SEQ ID NO: 2609211 - protein, 11 aa, Entamoeba histolytica
ASRSSKLPGRP

SEQ ID NO: 2609212 - protein, 7 aa, Entamoeba histolytica
ASRTEKK

SEQ ID NO: 2609213 - protein, 12 aa, Entamoeba histolytica
ASRTSKKKNERK

SEQ ID NO: 2609214 - protein, 18 aa, Entamoeba histolytica
ASRYEQRKQSMKSIEDEF

SEQ ID NO: 2609215 - protein, 6 aa, Entamoeba histolytica
ASSARE

SEQ ID NO: 2609216 - protein, 9 aa, Entamoeba histolytica
ASSDDTPDL

SEQ ID NO: 2609217 - protein, 7 aa, Entamoeba histolytica
ASSDLDQ

SEQ ID NO: 2609218 - protein, 7 aa, Entamoeba histolytica
ASSDLQP

SEQ ID NO: 2609219 - protein, 19 aa, Entamoeba histolytica
ASSDPNRAAVPNIPLPEAY

SEQ ID NO: 2609220 - protein, 6 aa, Entamoeba histolytica
ASSDVT

SEQ ID NO: 2609221 - protein, 9 aa, Entamoeba histolytica
ASSDYQQEI

SEQ ID NO: 2609222 - protein, 8 aa, Entamoeba histolytica
ASSEPGEE

SEQ ID NO: 2609223 - protein, 7 aa, Entamoeba histolytica
ASSEREM

SEQ ID NO: 2609224 - protein, 6 aa, Entamoeba histolytica
ASSEVD

SEQ ID NO: 2609225 - protein, 7 aa, Entamoeba histolytica
ASSIKDE

SEQ ID NO: 2609226 - protein, 6 aa, Entamoeba histolytica
ASSIPE

SEQ ID NO: 2609227 - protein, 11 aa, Entamoeba histolytica
ASSIQSEPENI

SEQ ID NO: 2609228 - protein, 8 aa, Entamoeba histolytica
ASSKDKPV

SEQ ID NO: 2609229 - protein, 5 aa, Entamoeba histolytica
ASSKM

SEQ ID NO: 2609230 - protein, 14 aa, Entamoeba histolytica
ASSKSTYHSTTNPS

SEQ ID NO: 2609231 - protein, 6 aa, Entamoeba histolytica
ASSKYT

SEQ ID NO: 2609232 - protein, 11 aa, Entamoeba histolytica
ASSLDHCPQGY

SEQ ID NO: 2609233 - protein, 6 aa, Entamoeba histolytica
ASSLGE

SEQ ID NO: 2609234 - protein, 6 aa, Entamoeba histolytica
ASSLQE

SEQ ID NO: 2609235 - protein, 4 aa, Entamoeba histolytica
ASSM

SEQ ID NO: 2609236 - protein, 7 aa, Entamoeba histolytica
ASSMPSE

SEQ ID NO: 2609237 - protein, 6 aa, Entamoeba histolytica
ASSNET

SEQ ID NO: 2609238 - protein, 11 aa, Entamoeba histolytica
ASSNKQRSENH

SEQ ID NO: 2609239 - protein, 5 aa, Entamoeba histolytica
ASSNL

SEQ ID NO: 2609240 - protein, 5 aa, Entamoeba histolytica
ASSPE

SEQ ID NO: 2609241 - protein, 5 aa, Entamoeba histolytica
ASSPY

SEQ ID NO: 2609242 - protein, 10 aa, Entamoeba histolytica
ASSRLSSQQA

SEQ ID NO: 2609243 - protein, 7 aa, Entamoeba histolytica
ASSRPQM

SEQ ID NO: 2609244 - protein, 6 aa, Entamoeba histolytica
ASSRRY

SEQ ID NO: 2609245 - protein, 6 aa, Entamoeba histolytica
ASSSEL

SEQ ID NO: 2609246 - protein, 7 aa, Entamoeba histolytica
ASSSFYE

SEQ ID NO: 2609247 - protein, 5 aa, Entamoeba histolytica
ASSSL

SEQ ID NO: 2609248 - protein, 11 aa, Entamoeba histolytica
ASSSNETQQGF

SEQ ID NO: 2609249 - protein, 10 aa, Entamoeba histolytica
ASSSRDMSSK

SEQ ID NO: 2609250 - protein, 15 aa, Entamoeba histolytica
ASSSSCPNKTNDHSE

SEQ ID NO: 2609251 - protein, 24 aa, Entamoeba histolytica
ASSSVKIKGKKEKDTKKKFTQEDL

SEQ ID NO: 2609252 - protein, 7 aa, Entamoeba histolytica
ASSTNPL

SEQ ID NO: 2609253 - protein, 9 aa, Entamoeba histolytica
ASTDNESLP

SEQ ID NO: 2609254 - protein, 22 aa, Entamoeba histolytica
ASTDSPNTLKDLQKRGKDTTIY

SEQ ID NO: 2609255 - protein, 8 aa, Entamoeba histolytica
ASTDTTAK

SEQ ID NO: 2609256 - protein, 4 aa, Entamoeba histolytica
ASTE

SEQ ID NO: 2609257 - protein, 7 aa, Entamoeba histolytica
ASTGKSD

SEQ ID NO: 2609258 - protein, 6 aa, Entamoeba histolytica
ASTGYY

SEQ ID NO: 2609259 - protein, 4 aa, Entamoeba histolytica
ASTH

SEQ ID NO: 2609260 - protein, 15 aa, Entamoeba histolytica
ASTIDKREETNPKSI

SEQ ID NO: 2609261 - protein, 5 aa, Entamoeba histolytica
ASTIQ

SEQ ID NO: 2609262 - protein, 16 aa, Entamoeba histolytica
ASTISQNNDWYSKEKK

SEQ ID NO: 2609263 - protein, 8 aa, Entamoeba histolytica
ASTKRQEV

SEQ ID NO: 2609264 - protein, 9 aa, Entamoeba histolytica
ASTKTVIPS

SEQ ID NO: 2609265 - protein, 10 aa, Entamoeba histolytica
ASTKYQSDLY

SEQ ID NO: 2609266 - protein, 4 aa, Entamoeba histolytica
ASTN

SEQ ID NO: 2609267 - protein, 33 aa, Entamoeba histolytica
ASTNGIGSLSTGNINGNSFQPPQQQGLTQQQTS

SEQ ID NO: 2609268 - protein, 8 aa, Entamoeba histolytica
ASTNQITK

SEQ ID NO: 2609269 - protein, 13 aa, Entamoeba histolytica
ASTNSNKYQITEN

SEQ ID NO: 2609270 - protein, 5 aa, Entamoeba histolytica
ASTNT

SEQ ID NO: 2609271 - protein, 8 aa, Entamoeba histolytica
ASTPASEY

SEQ ID NO: 2609272 - protein, 20 aa, Entamoeba histolytica
ASTPVEHPSSPFARFFLEEV

SEQ ID NO: 2609273 - protein, 6 aa, Entamoeba histolytica
ASTQTT

SEQ ID NO: 2609274 - protein, 9 aa, Entamoeba histolytica
ASTRGVTEG

SEQ ID NO: 2609275 - protein, 8 aa, Entamoeba histolytica
ASTSENLK

SEQ ID NO: 2609276 - protein, 5 aa, Entamoeba histolytica
ASTSV

SEQ ID NO: 2609277 - protein, 8 aa, Entamoeba histolytica
ASTTNGNI

SEQ ID NO: 2609278 - protein, 4 aa, Entamoeba histolytica
ASVK

SEQ ID NO: 2609279 - protein, 8 aa, Entamoeba histolytica
ASVNPTGT

SEQ ID NO: 2609280 - protein, 6 aa, Entamoeba histolytica
ASVQPK

SEQ ID NO: 2609281 - protein, 25 aa, Entamoeba histolytica
ASVQPSVARRPGRGRGGRKPPTKKL

SEQ ID NO: 2609282 - protein, 23 aa, Entamoeba histolytica
ASVSAGQNSDATYKCAKYLMDAG

SEQ ID NO: 2609283 - protein, 12 aa, Entamoeba histolytica
ASVTTSTGDSIK

SEQ ID NO: 2609284 - protein, 7 aa, Entamoeba histolytica
ASVYDNP

SEQ ID NO: 2609285 - protein, 7 aa, Entamoeba histolytica
ASYENVE

SEQ ID NO: 2609286 - protein, 14 aa, Entamoeba histolytica
ASYENVEGKWKPEI

SEQ ID NO: 2609287 - protein, 4 aa, Entamoeba histolytica
ASYG

SEQ ID NO: 2609288 - protein, 4 aa, Entamoeba histolytica
ASYN

SEQ ID NO: 2609289 - protein, 11 aa, Entamoeba histolytica
ASYSGSEMKPK

SEQ ID NO: 2609290 - protein, 6 aa, Entamoeba histolytica
ASYSSP

SEQ ID NO: 2609291 - protein, 7 aa, Entamoeba histolytica
ATADTEY

SEQ ID NO: 2609292 - protein, 8 aa, Entamoeba histolytica
ATAGKDGK

SEQ ID NO: 2609293 - protein, 5 aa, Entamoeba histolytica
ATAKN

SEQ ID NO: 2609294 - protein, 5 aa, Entamoeba histolytica
ATANA

SEQ ID NO: 2609295 - protein, 5 aa, Entamoeba histolytica
ATAPF

SEQ ID NO: 2609296 - protein, 8 aa, Entamoeba histolytica
ATAQQKSE

SEQ ID NO: 2609297 - protein, 11 aa, Entamoeba histolytica
ATASDFSGAKA

SEQ ID NO: 2609298 - protein, 9 aa, Entamoeba histolytica
ATASGDGTI

SEQ ID NO: 2609299 - protein, 8 aa, Entamoeba histolytica
ATASKEIS

SEQ ID NO: 2609300 - protein, 10 aa, Entamoeba histolytica
ATASSQNVDD

SEQ ID NO: 2609301 - protein, 10 aa, Entamoeba histolytica
ATATSKVKED

SEQ ID NO: 2609302 - protein, 4 aa, Entamoeba histolytica
ATAV

SEQ ID NO: 2609303 - protein, 9 aa, Entamoeba histolytica
ATCGDTYEG

SEQ ID NO: 2609304 - protein, 6 aa, Entamoeba histolytica
ATCREE

SEQ ID NO: 2609305 - protein, 6 aa, Entamoeba histolytica
ATDAST

SEQ ID NO: 2609306 - protein, 8 aa, Entamoeba histolytica
ATDELTAR

SEQ ID NO: 2609307 - protein, 14 aa, Entamoeba histolytica
ATDGDTHLGGNDFD

SEQ ID NO: 2609308 - protein, 8 aa, Entamoeba histolytica
ATDGKGVD

SEQ ID NO: 2609309 - protein, 6 aa, Entamoeba histolytica
ATDGSY

SEQ ID NO: 2609310 - protein, 4 aa, Entamoeba histolytica
ATDK

SEQ ID NO: 2609311 - protein, 5 aa, Entamoeba histolytica
ATDME

SEQ ID NO: 2609312 - protein, 27 aa, Entamoeba histolytica
ATDNESSKEEDDDDEEVEEEEEPTNTF

SEQ ID NO: 2609313 - protein, 9 aa, Entamoeba histolytica
ATDQKQRKE

SEQ ID NO: 2609314 - protein, 11 aa, Entamoeba histolytica
ATDQPPSAITL

SEQ ID NO: 2609315 - protein, 8 aa, Entamoeba histolytica
ATDSEYGE

SEQ ID NO: 2609316 - protein, 5 aa, Entamoeba histolytica
ATDVR

SEQ ID NO: 2609317 - protein, 4 aa, Entamoeba histolytica
ATEA

SEQ ID NO: 2609318 - protein, 5 aa, Entamoeba histolytica
ATEDP

SEQ ID NO: 2609319 - protein, 4 aa, Entamoeba histolytica
ATEE

SEQ ID NO: 2609320 - protein, 8 aa, Entamoeba histolytica
ATEEGPKQ

SEQ ID NO: 2609321 - protein, 6 aa, Entamoeba histolytica
ATEEQI

SEQ ID NO: 2609322 - protein, 10 aa, Entamoeba histolytica
ATEGTVDDQT

SEQ ID NO: 2609323 - protein, 8 aa, Entamoeba histolytica
ATEKDAYS

SEQ ID NO: 2609324 - protein, 7 aa, Entamoeba histolytica
ATEKELS

SEQ ID NO: 2609325 - protein, 12 aa, Entamoeba histolytica
ATEKKSTKAITV

SEQ ID NO: 2609326 - protein, 17 aa, Entamoeba histolytica
ATEKTEVKIDDGKGDTQ

SEQ ID NO: 2609327 - protein, 4 aa, Entamoeba histolytica
ATEL

SEQ ID NO: 2609328 - protein, 55 aa, Entamoeba histolytica
ATELEEKEQQLKEAKEYSKRFESKVKKEKINESKEERIEDKFEQPTKRRTEVGIK

SEQ ID NO: 2609329 - protein, 8 aa, Entamoeba histolytica
ATENPDEQ

SEQ ID NO: 2609330 - protein, 6 aa, Entamoeba histolytica
ATENRK

SEQ ID NO: 2609331 - protein, 8 aa, Entamoeba histolytica
ATEQGWDT

SEQ ID NO: 2609332 - protein, 4 aa, Entamoeba histolytica
ATER

SEQ ID NO: 2609333 - protein, 8 aa, Entamoeba histolytica
ATERARRR

SEQ ID NO: 2609334 - protein, 9 aa, Entamoeba histolytica
ATERERRRR

SEQ ID NO: 2609335 - protein, 8 aa, Entamoeba histolytica
ATERQRRR

SEQ ID NO: 2609336 - protein, 6 aa, Entamoeba histolytica
ATERVK

SEQ ID NO: 2609337 - protein, 7 aa, Entamoeba histolytica
ATETYKN

SEQ ID NO: 2609338 - protein, 4 aa, Entamoeba histolytica
ATEV

SEQ ID NO: 2609339 - protein, 5 aa, Entamoeba histolytica
ATEVG

SEQ ID NO: 2609340 - protein, 8 aa, Entamoeba histolytica
ATEYNREA

SEQ ID NO: 2609341 - protein, 15 aa, Entamoeba histolytica
ATEYSEDKANQGGSL

SEQ ID NO: 2609342 - protein, 7 aa, Entamoeba histolytica
ATEYTKQ

SEQ ID NO: 2609343 - protein, 13 aa, Entamoeba histolytica
ATFATRKRREQMH

SEQ ID NO: 2609344 - protein, 4 aa, Entamoeba histolytica
ATFD

SEQ ID NO: 2609345 - protein, 6 aa, Entamoeba histolytica
ATGDRV

SEQ ID NO: 2609346 - protein, 6 aa, Entamoeba histolytica
ATGEQI

SEQ ID NO: 2609347 - protein, 7 aa, Entamoeba histolytica
ATGGEDK

SEQ ID NO: 2609348 - protein, 32 aa, Entamoeba histolytica
ATGKKLDDGAINQKKPIRRDCKRSNSVGNPEE

SEQ ID NO: 2609349 - protein, 25 aa, Entamoeba histolytica
ATGKKTGITAKSKQSKFEGSRRSYR

SEQ ID NO: 2609350 - protein, 8 aa, Entamoeba histolytica
ATGMSDER

SEQ ID NO: 2609351 - protein, 6 aa, Entamoeba histolytica
ATGNDQ

SEQ ID NO: 2609352 - protein, 5 aa, Entamoeba histolytica
ATGNE

SEQ ID NO: 2609353 - protein, 4 aa, Entamoeba histolytica
ATGR

SEQ ID NO: 2609354 - protein, 6 aa, Entamoeba histolytica
ATGSEM

SEQ ID NO: 2609355 - protein, 8 aa, Entamoeba histolytica
ATGSEMNP

SEQ ID NO: 2609356 - protein, 8 aa, Entamoeba histolytica
ATGSRDNT

SEQ ID NO: 2609357 - protein, 8 aa, Entamoeba histolytica
ATGSTPTA

SEQ ID NO: 2609358 - protein, 7 aa, Entamoeba histolytica
ATGTETN

SEQ ID NO: 2609359 - protein, 11 aa, Entamoeba histolytica
ATGTVDNVDPS

SEQ ID NO: 2609360 - protein, 19 aa, Entamoeba histolytica
ATGWKRGKGLGKNEDGITS

SEQ ID NO: 2609361 - protein, 5 aa, Entamoeba histolytica
ATHDI

SEQ ID NO: 2609362 - protein, 5 aa, Entamoeba histolytica
ATHDT

SEQ ID NO: 2609363 - protein, 5 aa, Entamoeba histolytica
ATHPG

SEQ ID NO: 2609364 - protein, 8 aa, Entamoeba histolytica
ATHPTDPL

SEQ ID NO: 2609365 - protein, 5 aa, Entamoeba histolytica
ATIAG

SEQ ID NO: 2609366 - protein, 5 aa, Entamoeba histolytica
ATIEG

SEQ ID NO: 2609367 - protein, 9 aa, Entamoeba histolytica
ATIEKNRGC

SEQ ID NO: 2609368 - protein, 6 aa, Entamoeba histolytica
ATIGSD

SEQ ID NO: 2609369 - protein, 6 aa, Entamoeba histolytica
ATIPSA

SEQ ID NO: 2609370 - protein, 8 aa, Entamoeba histolytica
ATITPGNI

SEQ ID NO: 2609371 - protein, 7 aa, Entamoeba histolytica
ATKCESL

SEQ ID NO: 2609372 - protein, 9 aa, Entamoeba histolytica
ATKDEFASF

SEQ ID NO: 2609373 - protein, 6 aa, Entamoeba histolytica
ATKETF

SEQ ID NO: 2609374 - protein, 4 aa, Entamoeba histolytica
ATKG

SEQ ID NO: 2609375 - protein, 7 aa, Entamoeba histolytica
ATKGIKG

SEQ ID NO: 2609376 - protein, 10 aa, Entamoeba histolytica
ATKGKEQNKY

SEQ ID NO: 2609377 - protein, 11 aa, Entamoeba histolytica
ATKGSKNTHEM

SEQ ID NO: 2609378 - protein, 5 aa, Entamoeba histolytica
ATKGY

SEQ ID NO: 2609379 - protein, 8 aa, Entamoeba histolytica
ATKIAYSP

SEQ ID NO: 2609380 - protein, 8 aa, Entamoeba histolytica
ATKKKEIK

SEQ ID NO: 2609381 - protein, 8 aa, Entamoeba histolytica
ATKKSVIT

SEQ ID NO: 2609382 - protein, 11 aa, Entamoeba histolytica
ATKNDKDADVL

SEQ ID NO: 2609383 - protein, 6 aa, Entamoeba histolytica
ATKNKV

SEQ ID NO: 2609384 - protein, 7 aa, Entamoeba histolytica
ATKNNSV

SEQ ID NO: 2609385 - protein, 16 aa, Entamoeba histolytica
ATKPHSIGSSNTYRNN

SEQ ID NO: 2609386 - protein, 10 aa, Entamoeba histolytica
ATKQGGSWKS

SEQ ID NO: 2609387 - protein, 5 aa, Entamoeba histolytica
ATKSM

SEQ ID NO: 2609388 - protein, 6 aa, Entamoeba histolytica
ATKSNA

SEQ ID NO: 2609389 - protein, 4 aa, Entamoeba histolytica
ATKT

SEQ ID NO: 2609390 - protein, 23 aa, Entamoeba histolytica
ATKVETTKSNEEVEKERKNSQEL

SEQ ID NO: 2609391 - protein, 5 aa, Entamoeba histolytica
ATKYK

SEQ ID NO: 2609392 - protein, 9 aa, Entamoeba histolytica
ATLENSDDI

SEQ ID NO: 2609393 - protein, 83 aa, Entamoeba histolytica
ATLKAEVEKKDQELKNKGEELEKEKEEQAKKIEEIQKEKEEQTKKVEELEGEKNNEKQKVEELEKKVNDSEKENNELKGQLKD

SEQ ID NO: 2609394 - protein, 7 aa, Entamoeba histolytica
ATLPSKC

SEQ ID NO: 2609395 - protein, 12 aa, Entamoeba histolytica
ATLRGSGTEPKL

SEQ ID NO: 2609396 - protein, 6 aa, Entamoeba histolytica
ATMKAQ

SEQ ID NO: 2609397 - protein, 6 aa, Entamoeba histolytica
ATNDSY

SEQ ID NO: 2609398 - protein, 17 aa, Entamoeba histolytica
ATNGDVTGCPIAPDQDI

SEQ ID NO: 2609399 - protein, 8 aa, Entamoeba histolytica
ATNGSKKF

SEQ ID NO: 2609400 - protein, 6 aa, Entamoeba histolytica
ATNGTL

SEQ ID NO: 2609401 - protein, 14 aa, Entamoeba histolytica
ATNNEQWGPTTKQY

SEQ ID NO: 2609402 - protein, 15 aa, Entamoeba histolytica
ATNPKGRYDPTKSMS

SEQ ID NO: 2609403 - protein, 6 aa, Entamoeba histolytica
ATNPSM

SEQ ID NO: 2609404 - protein, 20 aa, Entamoeba histolytica
ATNQQTHKKKELRKTVEPTT

SEQ ID NO: 2609405 - protein, 5 aa, Entamoeba histolytica
ATNTV

SEQ ID NO: 2609406 - protein, 8 aa, Entamoeba histolytica
ATPGQQPM

SEQ ID NO: 2609407 - protein, 6 aa, Entamoeba histolytica
ATPINQ

SEQ ID NO: 2609408 - protein, 4 aa, Entamoeba histolytica
ATPL

SEQ ID NO: 2609409 - protein, 14 aa, Entamoeba histolytica
ATPLRATNDGYYDP

SEQ ID NO: 2609410 - protein, 5 aa, Entamoeba histolytica
ATPMT

SEQ ID NO: 2609411 - protein, 4 aa, Entamoeba histolytica
ATPN

SEQ ID NO: 2609412 - protein, 9 aa, Entamoeba histolytica
ATPNGTSTI

SEQ ID NO: 2609413 - protein, 5 aa, Entamoeba histolytica
ATPNN

SEQ ID NO: 2609414 - protein, 7 aa, Entamoeba histolytica
ATPPIEE

SEQ ID NO: 2609415 - protein, 12 aa, Entamoeba histolytica
ATPSAAEQEPFQ

SEQ ID NO: 2609416 - protein, 10 aa, Entamoeba histolytica
ATPSGRKGLQ

SEQ ID NO: 2609417 - protein, 10 aa, Entamoeba histolytica
ATPSPETEEA

SEQ ID NO: 2609418 - protein, 6 aa, Entamoeba histolytica
ATPTSK

SEQ ID NO: 2609419 - protein, 9 aa, Entamoeba histolytica
ATPVSSDLE

SEQ ID NO: 2609420 - protein, 6 aa, Entamoeba histolytica
ATQDFD

SEQ ID NO: 2609421 - protein, 5 aa, Entamoeba histolytica
ATQDN

SEQ ID NO: 2609422 - protein, 5 aa, Entamoeba histolytica
ATQEG

SEQ ID NO: 2609423 - protein, 4 aa, Entamoeba histolytica
ATQN

SEQ ID NO: 2609424 - protein, 4 aa, Entamoeba histolytica
ATQP

SEQ ID NO: 2609425 - protein, 17 aa, Entamoeba histolytica
ATQPQDDKQKEDGISSD

SEQ ID NO: 2609426 - protein, 13 aa, Entamoeba histolytica
ATQPTKSINSIGS

SEQ ID NO: 2609427 - protein, 5 aa, Entamoeba histolytica
ATQTS

SEQ ID NO: 2609428 - protein, 7 aa, Entamoeba histolytica
ATRAEDK

SEQ ID NO: 2609429 - protein, 6 aa, Entamoeba histolytica
ATRGYG

SEQ ID NO: 2609430 - protein, 9 aa, Entamoeba histolytica
ATRKEDGAA

SEQ ID NO: 2609431 - protein, 14 aa, Entamoeba histolytica
ATRPKNLDYDGAEK

SEQ ID NO: 2609432 - protein, 12 aa, Entamoeba histolytica
ATRVDRKETQEY

SEQ ID NO: 2609433 - protein, 6 aa, Entamoeba histolytica
ATSDIK

SEQ ID NO: 2609434 - protein, 16 aa, Entamoeba histolytica
ATSFKGYTDGTVETLE

SEQ ID NO: 2609435 - protein, 8 aa, Entamoeba histolytica
ATSGNTGI

SEQ ID NO: 2609436 - protein, 5 aa, Entamoeba histolytica
ATSGS

SEQ ID NO: 2609437 - protein, 9 aa, Entamoeba histolytica
ATSGTFKTN

SEQ ID NO: 2609438 - protein, 6 aa, Entamoeba histolytica
ATSKES

SEQ ID NO: 2609439 - protein, 4 aa, Entamoeba histolytica
ATSN

SEQ ID NO: 2609440 - protein, 10 aa, Entamoeba histolytica
ATSQASRENY

SEQ ID NO: 2609441 - protein, 9 aa, Entamoeba histolytica
ATSQDDTKL

SEQ ID NO: 2609442 - protein, 8 aa, Entamoeba histolytica
ATSQGKKE

SEQ ID NO: 2609443 - protein, 7 aa, Entamoeba histolytica
ATSQSSN

SEQ ID NO: 2609444 - protein, 23 aa, Entamoeba histolytica
ATSSAQKETPSPSNFSRKNSSFQ

SEQ ID NO: 2609445 - protein, 8 aa, Entamoeba histolytica
ATSYDEQP

SEQ ID NO: 2609446 - protein, 11 aa, Entamoeba histolytica
ATSYDKDRGVA

SEQ ID NO: 2609447 - protein, 7 aa, Entamoeba histolytica
ATTDQTT

SEQ ID NO: 2609448 - protein, 6 aa, Entamoeba histolytica
ATTDSL

SEQ ID NO: 2609449 - protein, 6 aa, Entamoeba histolytica
ATTEFV

SEQ ID NO: 2609450 - protein, 19 aa, Entamoeba histolytica
ATTEKINQRKKQKTVKFPF

SEQ ID NO: 2609451 - protein, 8 aa, Entamoeba histolytica
ATTEKTYS

SEQ ID NO: 2609452 - protein, 8 aa, Entamoeba histolytica
ATTGQDKT

SEQ ID NO: 2609453 - protein, 16 aa, Entamoeba histolytica
ATTGRGRVDDSGPASH

SEQ ID NO: 2609454 - protein, 4 aa, Entamoeba histolytica
ATTI

SEQ ID NO: 2609455 - protein, 14 aa, Entamoeba histolytica
ATTINEKGHEYEAD

SEQ ID NO: 2609456 - protein, 10 aa, Entamoeba histolytica
ATTKQEKDSW

SEQ ID NO: 2609457 - protein, 11 aa, Entamoeba histolytica
ATTPMNSPDER

SEQ ID NO: 2609458 - protein, 7 aa, Entamoeba histolytica
ATTSIDN

SEQ ID NO: 2609459 - protein, 11 aa, Entamoeba histolytica
ATTSSKPVLPD

SEQ ID NO: 2609460 - protein, 5 aa, Entamoeba histolytica
ATTTF

SEQ ID NO: 2609461 - protein, 13 aa, Entamoeba histolytica
ATTWHDPRDNPLP

SEQ ID NO: 2609462 - protein, 13 aa, Entamoeba histolytica
ATVDKKDKTIAEM

SEQ ID NO: 2609463 - protein, 18 aa, Entamoeba histolytica
ATVGAPGLRNPSKAPPEL

SEQ ID NO: 2609464 - protein, 6 aa, Entamoeba histolytica
ATVGSE

SEQ ID NO: 2609465 - protein, 6 aa, Entamoeba histolytica
ATVKRE

SEQ ID NO: 2609466 - protein, 8 aa, Entamoeba histolytica
ATVNDNGS

SEQ ID NO: 2609467 - protein, 5 aa, Entamoeba histolytica
ATVSR

SEQ ID NO: 2609468 - protein, 12 aa, Entamoeba histolytica
ATVSSASPYAKQ

SEQ ID NO: 2609469 - protein, 9 aa, Entamoeba histolytica
ATVSTYATS

SEQ ID NO: 2609470 - protein, 7 aa, Entamoeba histolytica
ATVYGEP

SEQ ID NO: 2609471 - protein, 9 aa, Entamoeba histolytica
ATYNRSKEE

SEQ ID NO: 2609472 - protein, 9 aa, Entamoeba histolytica
ATYQADENI

SEQ ID NO: 2609473 - protein, 9 aa, Entamoeba histolytica
AVAPGQNKN

SEQ ID NO: 2609474 - protein, 9 aa, Entamoeba histolytica
AVASSEKLT

SEQ ID NO: 2609475 - protein, 23 aa, Entamoeba histolytica
AVDDNDTVPLENKKEPKKSKCYL

SEQ ID NO: 2609476 - protein, 6 aa, Entamoeba histolytica
AVDEEK

SEQ ID NO: 2609477 - protein, 5 aa, Entamoeba histolytica
AVDGE

SEQ ID NO: 2609478 - protein, 7 aa, Entamoeba histolytica
AVDGEIE

SEQ ID NO: 2609479 - protein, 7 aa, Entamoeba histolytica
AVDGTPV

SEQ ID NO: 2609480 - protein, 14 aa, Entamoeba histolytica
AVDNLSKYDPSHKE

SEQ ID NO: 2609481 - protein, 10 aa, Entamoeba histolytica
AVDPESKYQI

SEQ ID NO: 2609482 - protein, 6 aa, Entamoeba histolytica
AVDTDN

SEQ ID NO: 2609483 - protein, 23 aa, Entamoeba histolytica
AVDTQDKKQKRLNNEIETSCGSS

SEQ ID NO: 2609484 - protein, 13 aa, Entamoeba histolytica
AVEEKKKALEETL

SEQ ID NO: 2609485 - protein, 25 aa, Entamoeba histolytica
AVERKVSDLEKKVEGYKTDYETSQN

SEQ ID NO: 2609486 - protein, 4 aa, Entamoeba histolytica
AVGE

SEQ ID NO: 2609487 - protein, 5 aa, Entamoeba histolytica
AVGEN

SEQ ID NO: 2609488 - protein, 13 aa, Entamoeba histolytica
AVGGAETLDQPDI

SEQ ID NO: 2609489 - protein, 14 aa, Entamoeba histolytica
AVGHSSEDKKKFGI

SEQ ID NO: 2609490 - protein, 4 aa, Entamoeba histolytica
AVGK

SEQ ID NO: 2609491 - protein, 9 aa, Entamoeba histolytica
AVGKTSLSN

SEQ ID NO: 2609492 - protein, 9 aa, Entamoeba histolytica
AVGNEETPL

SEQ ID NO: 2609493 - protein, 8 aa, Entamoeba histolytica
AVHDNTTT

SEQ ID NO: 2609494 - protein, 8 aa, Entamoeba histolytica
AVHNKSTT

SEQ ID NO: 2609495 - protein, 6 aa, Entamoeba histolytica
AVIESR

SEQ ID NO: 2609496 - protein, 11 aa, Entamoeba histolytica
AVITDDNGTVF

SEQ ID NO: 2609497 - protein, 16 aa, Entamoeba histolytica
AVKATKINPNYSNDSL

SEQ ID NO: 2609498 - protein, 10 aa, Entamoeba histolytica
AVKEGKCDQS

SEQ ID NO: 2609499 - protein, 50 aa, Entamoeba histolytica
AVKNKDVKKKKIAENLSEDLAPSINDSKASLVDKENKAKKEKAKQSLEKL

SEQ ID NO: 2609500 - protein, 9 aa, Entamoeba histolytica
AVKNSDDDT

SEQ ID NO: 2609501 - protein, 7 aa, Entamoeba histolytica
AVKQGPV

SEQ ID NO: 2609502 - protein, 6 aa, Entamoeba histolytica
AVKSDE

SEQ ID NO: 2609503 - protein, 4 aa, Entamoeba histolytica
AVLE

SEQ ID NO: 2609504 - protein, 11 aa, Entamoeba histolytica
AVLSKAPPSHI

SEQ ID NO: 2609505 - protein, 8 aa, Entamoeba histolytica
AVNEEKMG

SEQ ID NO: 2609506 - protein, 9 aa, Entamoeba histolytica
AVNKRNKSL

SEQ ID NO: 2609507 - protein, 23 aa, Entamoeba histolytica
AVNKTQKKVEKNIKKVTEKHAIK

SEQ ID NO: 2609508 - protein, 39 aa, Entamoeba histolytica
AVNNKNTGALAKNAKEALTATKATVPKMKETAQKQKEPL

SEQ ID NO: 2609509 - protein, 8 aa, Entamoeba histolytica
AVNNTKSR

SEQ ID NO: 2609510 - protein, 5 aa, Entamoeba histolytica
AVNPN

SEQ ID NO: 2609511 - protein, 7 aa, Entamoeba histolytica
AVNRGDV

SEQ ID NO: 2609512 - protein, 7 aa, Entamoeba histolytica
AVPGYNT

SEQ ID NO: 2609513 - protein, 11 aa, Entamoeba histolytica
AVPSRSRKQCR

SEQ ID NO: 2609514 - protein, 12 aa, Entamoeba histolytica
AVPSTWNATEDI

SEQ ID NO: 2609515 - protein, 13 aa, Entamoeba histolytica
AVPTPEAKRTESE

SEQ ID NO: 2609516 - protein, 11 aa, Entamoeba histolytica
AVQNRDTDRED

SEQ ID NO: 2609517 - protein, 9 aa, Entamoeba histolytica
AVQQGTVPK

SEQ ID NO: 2609518 - protein, 9 aa, Entamoeba histolytica
AVQTKSKDL

SEQ ID NO: 2609519 - protein, 15 aa, Entamoeba histolytica
AVRAGAYDSADDTKV

SEQ ID NO: 2609520 - protein, 6 aa, Entamoeba histolytica
AVRGKG

SEQ ID NO: 2609521 - protein, 10 aa, Entamoeba histolytica
AVRNDDKKKY

SEQ ID NO: 2609522 - protein, 7 aa, Entamoeba histolytica
AVRSPSE

SEQ ID NO: 2609523 - protein, 9 aa, Entamoeba histolytica
AVSGKGNSE

SEQ ID NO: 2609524 - protein, 12 aa, Entamoeba histolytica
AVSGNGSNSSQC

SEQ ID NO: 2609525 - protein, 8 aa, Entamoeba histolytica
AVSLTDTN

SEQ ID NO: 2609526 - protein, 6 aa, Entamoeba histolytica
AVSSKT

SEQ ID NO: 2609527 - protein, 5 aa, Entamoeba histolytica
AVSSN

SEQ ID NO: 2609528 - protein, 6 aa, Entamoeba histolytica
AVSSPQ

SEQ ID NO: 2609529 - protein, 13 aa, Entamoeba histolytica
AVSSTLPLDEPEW

SEQ ID NO: 2609530 - protein, 4 aa, Entamoeba histolytica
AVTD

SEQ ID NO: 2609531 - protein, 10 aa, Entamoeba histolytica
AVTKPKETVK

SEQ ID NO: 2609532 - protein, 9 aa, Entamoeba histolytica
AVTPGQNQK

SEQ ID NO: 2609533 - protein, 41 aa, Entamoeba histolytica
AVTSPRIKSQTIQSEKTSPKTSPRISPRTPPIIKDKEQQVE

SEQ ID NO: 2609534 - protein, 6 aa, Entamoeba histolytica
AVVGAG

SEQ ID NO: 2609535 - protein, 6 aa, Entamoeba histolytica
AVVGSG

SEQ ID NO: 2609536 - protein, 6 aa, Entamoeba histolytica
AWTERS

SEQ ID NO: 2609537 - protein, 5 aa, Entamoeba histolytica
AYAPA

SEQ ID NO: 2609538 - protein, 12 aa, Entamoeba histolytica
AYASTAKKGDFR

SEQ ID NO: 2609539 - protein, 11 aa, Entamoeba histolytica
AYDKDGSSNTV

SEQ ID NO: 2609540 - protein, 7 aa, Entamoeba histolytica
AYDPKNL

SEQ ID NO: 2609541 - protein, 4 aa, Entamoeba histolytica
AYEK

SEQ ID NO: 2609542 - protein, 6 aa, Entamoeba histolytica
AYEKGG

SEQ ID NO: 2609543 - protein, 5 aa, Entamoeba histolytica
AYGAT

SEQ ID NO: 2609544 - protein, 7 aa, Entamoeba histolytica
AYGNDGV

SEQ ID NO: 2609545 - protein, 17 aa, Entamoeba histolytica
AYGPGCPGLNTPATSAK

SEQ ID NO: 2609546 - protein, 12 aa, Entamoeba histolytica
AYKDEPDGIEYS

SEQ ID NO: 2609547 - protein, 6 aa, Entamoeba histolytica
AYKPDQ

SEQ ID NO: 2609548 - protein, 6 aa, Entamoeba histolytica
AYKSKW

SEQ ID NO: 2609549 - protein, 4 aa, Entamoeba histolytica
AYNL

SEQ ID NO: 2609550 - protein, 9 aa, Entamoeba histolytica
AYNPYTEPS

SEQ ID NO: 2609551 - protein, 14 aa, Entamoeba histolytica
AYNRAQQSRHNKSP

SEQ ID NO: 2609552 - protein, 6 aa, Entamoeba histolytica
AYNTNK

SEQ ID NO: 2609553 - protein, 16 aa, Entamoeba histolytica
AYNTSLEKLGNDSSNY

SEQ ID NO: 2609554 - protein, 4 aa, Entamoeba histolytica
AYPD

SEQ ID NO: 2609555 - protein, 5 aa, Entamoeba histolytica
AYPEN

SEQ ID NO: 2609556 - protein, 4 aa, Entamoeba histolytica
AYPL

SEQ ID NO: 2609557 - protein, 5 aa, Entamoeba histolytica
AYPPL

SEQ ID NO: 2609558 - protein, 4 aa, Entamoeba histolytica
AYPS

SEQ ID NO: 2609559 - protein, 12 aa, Entamoeba histolytica
AYPSSTSVVTES

SEQ ID NO: 2609560 - protein, 6 aa, Entamoeba histolytica
AYQNKA

SEQ ID NO: 2609561 - protein, 4 aa, Entamoeba histolytica
AYQR

SEQ ID NO: 2609562 - protein, 6 aa, Entamoeba histolytica
AYRSTQ

SEQ ID NO: 2609563 - protein, 14 aa, Entamoeba histolytica
AYSEDKSLTGTARY

SEQ ID NO: 2609564 - protein, 11 aa, Entamoeba histolytica
AYSESEKVKLT

SEQ ID NO: 2609565 - protein, 6 aa, Entamoeba histolytica
AYSGEC

SEQ ID NO: 2609566 - protein, 15 aa, Entamoeba histolytica
AYSGGLDTKFNETGE

SEQ ID NO: 2609567 - protein, 20 aa, Entamoeba histolytica
AYSSDYKTSMTETHETRKKV

SEQ ID NO: 2609568 - protein, 10 aa, Entamoeba histolytica
AYTEEDRIKY

SEQ ID NO: 2609569 - protein, 10 aa, Entamoeba histolytica
AYTGNEQNNK

SEQ ID NO: 2609570 - protein, 4 aa, Entamoeba histolytica
AYTQ

SEQ ID NO: 2609571 - protein, 15 aa, Entamoeba histolytica
AYYTKNTGKPLKDIT

SEQ ID NO: 2609572 - protein, 20 aa, Entamoeba histolytica
CAAPRLKDAGLNDDEKNEAY

SEQ ID NO: 2609573 - protein, 8 aa, Entamoeba histolytica
CADETRIR

SEQ ID NO: 2609574 - protein, 16 aa, Entamoeba histolytica
CADQRAGRAGRTGPGK

SEQ ID NO: 2609575 - protein, 10 aa, Entamoeba histolytica
CAETQRKNLE

SEQ ID NO: 2609576 - protein, 49 aa, Entamoeba histolytica
CANNNKKLGESTLTEQNSSESKDTLLSTSTEQDQQLTTSSSNDDNKKID

SEQ ID NO: 2609577 - protein, 10 aa, Entamoeba histolytica
CAPTEDEVNS

SEQ ID NO: 2609578 - protein, 8 aa, Entamoeba histolytica
CARPESKV

SEQ ID NO: 2609579 - protein, 8 aa, Entamoeba histolytica
CARPESQV

SEQ ID NO: 2609580 - protein, 27 aa, Entamoeba histolytica
CASKTVPVSNAQQSINSSEKDAQINQL

SEQ ID NO: 2609581 - protein, 7 aa, Entamoeba histolytica
CASNDST

SEQ ID NO: 2609582 - protein, 22 aa, Entamoeba histolytica
CATESNTSMEKRNATIKKYEKG

SEQ ID NO: 2609583 - protein, 9 aa, Entamoeba histolytica
CATTEDPNI

SEQ ID NO: 2609584 - protein, 17 aa, Entamoeba histolytica
CATTPTFTLGDNIQYSI

SEQ ID NO: 2609585 - protein, 11 aa, Entamoeba histolytica
CCNDEPNTFAD

SEQ ID NO: 2609586 - protein, 20 aa, Entamoeba histolytica
CCNGDGTPFSAERILIVQMG

SEQ ID NO: 2609587 - protein, 4 aa, Entamoeba histolytica
CDAK

SEQ ID NO: 2609588 - protein, 17 aa, Entamoeba histolytica
CDASDAGSEIAADRTKG

SEQ ID NO: 2609589 - protein, 5 aa, Entamoeba histolytica
CDDES

SEQ ID NO: 2609590 - protein, 4 aa, Entamoeba histolytica
CDDP

SEQ ID NO: 2609591 - protein, 8 aa, Entamoeba histolytica
CDDPSVRR

SEQ ID NO: 2609592 - protein, 12 aa, Entamoeba histolytica
CDDYSEENNEKY

SEQ ID NO: 2609593 - protein, 5 aa, Entamoeba histolytica
CDEEM

SEQ ID NO: 2609594 - protein, 9 aa, Entamoeba histolytica
CDEGKIDIK

SEQ ID NO: 2609595 - protein, 6 aa, Entamoeba histolytica
CDEKRR

SEQ ID NO: 2609596 - protein, 6 aa, Entamoeba histolytica
CDEKVS

SEQ ID NO: 2609597 - protein, 10 aa, Entamoeba histolytica
CDELSEEEWE

SEQ ID NO: 2609598 - protein, 11 aa, Entamoeba histolytica
CDENVKNEIKE

SEQ ID NO: 2609599 - protein, 9 aa, Entamoeba histolytica
CDESEEDDC

SEQ ID NO: 2609600 - protein, 14 aa, Entamoeba histolytica
CDESNNECSIKSDN

SEQ ID NO: 2609601 - protein, 8 aa, Entamoeba histolytica
CDESSPNV

SEQ ID NO: 2609602 - protein, 13 aa, Entamoeba histolytica
CDETDENRKKERI

SEQ ID NO: 2609603 - protein, 10 aa, Entamoeba histolytica
CDETKKVSTI

SEQ ID NO: 2609604 - protein, 5 aa, Entamoeba histolytica
CDETY

SEQ ID NO: 2609605 - protein, 22 aa, Entamoeba histolytica
CDGCPSKGSCSSSTSSQGGCSH

SEQ ID NO: 2609606 - protein, 6 aa, Entamoeba histolytica
CDGGNN

SEQ ID NO: 2609607 - protein, 7 aa, Entamoeba histolytica
CDIPNGV

SEQ ID NO: 2609608 - protein, 7 aa, Entamoeba histolytica
CDKDDDI

SEQ ID NO: 2609609 - protein, 14 aa, Entamoeba histolytica
CDKEEKSKKKPSLK

SEQ ID NO: 2609610 - protein, 5 aa, Entamoeba histolytica
CDKQE

SEQ ID NO: 2609611 - protein, 19 aa, Entamoeba histolytica
CDLDNRTVTTEQAQEFANN

SEQ ID NO: 2609612 - protein, 6 aa, Entamoeba histolytica
CDLEEQ

SEQ ID NO: 2609613 - protein, 19 aa, Entamoeba histolytica
CDLEEQRQIPNEEAKKLAE

SEQ ID NO: 2609614 - protein, 10 aa, Entamoeba histolytica
CDNANDPDVA

SEQ ID NO: 2609615 - protein, 12 aa, Entamoeba histolytica
CDNGVGKEYYND

SEQ ID NO: 2609616 - protein, 8 aa, Entamoeba histolytica
CDNKPTGL

SEQ ID NO: 2609617 - protein, 6 aa, Entamoeba histolytica
CDNTSQ

SEQ ID NO: 2609618 - protein, 6 aa, Entamoeba histolytica
CDPKSK

SEQ ID NO: 2609619 - protein, 5 aa, Entamoeba histolytica
CDPNV

SEQ ID NO: 2609620 - protein, 10 aa, Entamoeba histolytica
CDPQTKQRID

SEQ ID NO: 2609621 - protein, 6 aa, Entamoeba histolytica
CDPSVR

SEQ ID NO: 2609622 - protein, 12 aa, Entamoeba histolytica
CDQPTKTLLLEQ

SEQ ID NO: 2609623 - protein, 21 aa, Entamoeba histolytica
CDSCPSKGKCGGGNNGPDREL

SEQ ID NO: 2609624 - protein, 8 aa, Entamoeba histolytica
CDSHPEDD

SEQ ID NO: 2609625 - protein, 13 aa, Entamoeba histolytica
CDSPAEKAGLQEG

SEQ ID NO: 2609626 - protein, 21 aa, Entamoeba histolytica
CDSSQRTVTTDEGKNKAKELN

SEQ ID NO: 2609627 - protein, 5 aa, Entamoeba histolytica
CDSTD

SEQ ID NO: 2609628 - protein, 7 aa, Entamoeba histolytica
CDTKRSD

SEQ ID NO: 2609629 - protein, 7 aa, Entamoeba histolytica
CDTPEKK

SEQ ID NO: 2609630 - protein, 5 aa, Entamoeba histolytica
CDTSN

SEQ ID NO: 2609631 - protein, 6 aa, Entamoeba histolytica
CEAEGT

SEQ ID NO: 2609632 - protein, 11 aa, Entamoeba histolytica
CEDGSDENKNF

SEQ ID NO: 2609633 - protein, 10 aa, Entamoeba histolytica
CEDQEGNSTF

SEQ ID NO: 2609634 - protein, 24 aa, Entamoeba histolytica
CEDSVSPEIESTATVNDIQVFCLR

SEQ ID NO: 2609635 - protein, 9 aa, Entamoeba histolytica
CEEAPKTRY

SEQ ID NO: 2609636 - protein, 8 aa, Entamoeba histolytica
CEEATTNA

SEQ ID NO: 2609637 - protein, 15 aa, Entamoeba histolytica
CEEGGSKTESFSENG

SEQ ID NO: 2609638 - protein, 5 aa, Entamoeba histolytica
CEEGN

SEQ ID NO: 2609639 - protein, 17 aa, Entamoeba histolytica
CEEGNYRIGENTKDDAK

SEQ ID NO: 2609640 - protein, 8 aa, Entamoeba histolytica
CEENNKNI

SEQ ID NO: 2609641 - protein, 8 aa, Entamoeba histolytica
CEEQLEGG

SEQ ID NO: 2609642 - protein, 9 aa, Entamoeba histolytica
CEESPQNTV

SEQ ID NO: 2609643 - protein, 9 aa, Entamoeba histolytica
CEETGTRYK

SEQ ID NO: 2609644 - protein, 16 aa, Entamoeba histolytica
CEGATAESIVKPGRSF

SEQ ID NO: 2609645 - protein, 5 aa, Entamoeba histolytica
CEGRN

SEQ ID NO: 2609646 - protein, 9 aa, Entamoeba histolytica
CEGRNMTAG

SEQ ID NO: 2609647 - protein, 5 aa, Entamoeba histolytica
CEKDE

SEQ ID NO: 2609648 - protein, 6 aa, Entamoeba histolytica
CEKEGV

SEQ ID NO: 2609649 - protein, 9 aa, Entamoeba histolytica
CEKENREVE

SEQ ID NO: 2609650 - protein, 21 aa, Entamoeba histolytica
CEKERIREGKEKNNQTYSNNE

SEQ ID NO: 2609651 - protein, 5 aa, Entamoeba histolytica
CEKES

SEQ ID NO: 2609652 - protein, 41 aa, Entamoeba histolytica
CEKKAKKEAKKAQKKSKKEEKKAKKEARKAEIKAKAQEVKK

SEQ ID NO: 2609653 - protein, 5 aa, Entamoeba histolytica
CEKNE

SEQ ID NO: 2609654 - protein, 8 aa, Entamoeba histolytica
CEKNPEND

SEQ ID NO: 2609655 - protein, 7 aa, Entamoeba histolytica
CEKTPSS

SEQ ID NO: 2609656 - protein, 8 aa, Entamoeba histolytica
CEKTTTLQ

SEQ ID NO: 2609657 - protein, 5 aa, Entamoeba histolytica
CELKP

SEQ ID NO: 2609658 - protein, 7 aa, Entamoeba histolytica
CENGKKA

SEQ ID NO: 2609659 - protein, 4 aa, Entamoeba histolytica
CEPE

SEQ ID NO: 2609660 - protein, 6 aa, Entamoeba histolytica
CEPTPT

SEQ ID NO: 2609661 - protein, 10 aa, Entamoeba histolytica
CEQKAVPTTI

SEQ ID NO: 2609662 - protein, 9 aa, Entamoeba histolytica
CEQNKSIKK

SEQ ID NO: 2609663 - protein, 4 aa, Entamoeba histolytica
CEQP

SEQ ID NO: 2609664 - protein, 8 aa, Entamoeba histolytica
CERAEKEN

SEQ ID NO: 2609665 - protein, 5 aa, Entamoeba histolytica
CEREK

SEQ ID NO: 2609666 - protein, 7 aa, Entamoeba histolytica
CESADTY

SEQ ID NO: 2609667 - protein, 10 aa, Entamoeba histolytica
CESDGDIDGI

SEQ ID NO: 2609668 - protein, 11 aa, Entamoeba histolytica
CESDLSTSSEI

SEQ ID NO: 2609669 - protein, 5 aa, Entamoeba histolytica
CESDS

SEQ ID NO: 2609670 - protein, 11 aa, Entamoeba histolytica
CESDSKKAQEV

SEQ ID NO: 2609671 - protein, 6 aa, Entamoeba histolytica
CESEAL

SEQ ID NO: 2609672 - protein, 8 aa, Entamoeba histolytica
CESGIPEV

SEQ ID NO: 2609673 - protein, 7 aa, Entamoeba histolytica
CESKENG

SEQ ID NO: 2609674 - protein, 12 aa, Entamoeba histolytica
CESKRKRSSTPI

SEQ ID NO: 2609675 - protein, 30 aa, Entamoeba histolytica
CESKSRNSKSKSESSKSLKRSGRKNNNIET

SEQ ID NO: 2609676 - protein, 7 aa, Entamoeba histolytica
CESPANV

SEQ ID NO: 2609677 - protein, 23 aa, Entamoeba histolytica
CESQKEFVNEEENESIERIKKKD

SEQ ID NO: 2609678 - protein, 4 aa, Entamoeba histolytica
CEST

SEQ ID NO: 2609679 - protein, 5 aa, Entamoeba histolytica
CETAR

SEQ ID NO: 2609680 - protein, 6 aa, Entamoeba histolytica
CETKNA

SEQ ID NO: 2609681 - protein, 8 aa, Entamoeba histolytica
CETKSDEQ

SEQ ID NO: 2609682 - protein, 5 aa, Entamoeba histolytica
CETPQ

SEQ ID NO: 2609683 - protein, 8 aa, Entamoeba histolytica
CETPQENS

SEQ ID NO: 2609684 - protein, 7 aa, Entamoeba histolytica
CETQVND

SEQ ID NO: 2609685 - protein, 6 aa, Entamoeba histolytica
CETRKQ

SEQ ID NO: 2609686 - protein, 9 aa, Entamoeba histolytica
CEVPQNGGK

SEQ ID NO: 2609687 - protein, 5 aa, Entamoeba histolytica
CEYPE

SEQ ID NO: 2609688 - protein, 6 aa, Entamoeba histolytica
CFPEGE

SEQ ID NO: 2609689 - protein, 8 aa, Entamoeba histolytica
CFRESTGE

SEQ ID NO: 2609690 - protein, 5 aa, Entamoeba histolytica
CFSAR

SEQ ID NO: 2609691 - protein, 5 aa, Entamoeba histolytica
CFSEE

SEQ ID NO: 2609692 - protein, 6 aa, Entamoeba histolytica
CFSGSN

SEQ ID NO: 2609693 - protein, 4 aa, Entamoeba histolytica
CGAD

SEQ ID NO: 2609694 - protein, 6 aa, Entamoeba histolytica
CGADGK

SEQ ID NO: 2609695 - protein, 7 aa, Entamoeba histolytica
CGAGGPI

SEQ ID NO: 2609696 - protein, 29 aa, Entamoeba histolytica
CGAPTGESAASHEPTTQHRPTTPPPSALD

SEQ ID NO: 2609697 - protein, 6 aa, Entamoeba histolytica
CGCEEN

SEQ ID NO: 2609698 - protein, 6 aa, Entamoeba histolytica
CGDAKK

SEQ ID NO: 2609699 - protein, 4 aa, Entamoeba histolytica
CGDD

SEQ ID NO: 2609700 - protein, 36 aa, Entamoeba histolytica
CGDEDEKKKEKKKVEKKEDSPLKKEEKEESSANVST

SEQ ID NO: 2609701 - protein, 7 aa, Entamoeba histolytica
CGDKGDQ

SEQ ID NO: 2609702 - protein, 5 aa, Entamoeba histolytica
CGDSL

SEQ ID NO: 2609703 - protein, 9 aa, Entamoeba histolytica
CGEDKQKPI

SEQ ID NO: 2609704 - protein, 4 aa, Entamoeba histolytica
CGEE

SEQ ID NO: 2609705 - protein, 6 aa, Entamoeba histolytica
CGEERK

SEQ ID NO: 2609706 - protein, 5 aa, Entamoeba histolytica
CGEHP

SEQ ID NO: 2609707 - protein, 6 aa, Entamoeba histolytica
CGENDD

SEQ ID NO: 2609708 - protein, 6 aa, Entamoeba histolytica
CGETGH

SEQ ID NO: 2609709 - protein, 16 aa, Entamoeba histolytica
CGGEANETAELSGEID

SEQ ID NO: 2609710 - protein, 7 aa, Entamoeba histolytica
CGGKSNN

SEQ ID NO: 2609711 - protein, 9 aa, Entamoeba histolytica
CGGQPTDKT

SEQ ID NO: 2609712 - protein, 6 aa, Entamoeba histolytica
CGGQSG

SEQ ID NO: 2609713 - protein, 6 aa, Entamoeba histolytica
CGGTTT

SEQ ID NO: 2609714 - protein, 8 aa, Entamoeba histolytica
CGGYTERG

SEQ ID NO: 2609715 - protein, 14 aa, Entamoeba histolytica
CGISSSEPIKNEQV

SEQ ID NO: 2609716 - protein, 6 aa, Entamoeba histolytica
CGKDKS

SEQ ID NO: 2609717 - protein, 10 aa, Entamoeba histolytica
CGKEKSKFSC

SEQ ID NO: 2609718 - protein, 9 aa, Entamoeba histolytica
CGKEMTQNL

SEQ ID NO: 2609719 - protein, 6 aa, Entamoeba histolytica
CGKGIK

SEQ ID NO: 2609720 - protein, 4 aa, Entamoeba histolytica
CGKP

SEQ ID NO: 2609721 - protein, 10 aa, Entamoeba histolytica
CGKPPPEKNG

SEQ ID NO: 2609722 - protein, 7 aa, Entamoeba histolytica
CGKPVEG

SEQ ID NO: 2609723 - protein, 9 aa, Entamoeba histolytica
CGKPVEGGV

SEQ ID NO: 2609724 - protein, 24 aa, Entamoeba histolytica
CGKQLGGKFGLKGQKKLCPDCVAK

SEQ ID NO: 2609725 - protein, 12 aa, Entamoeba histolytica
CGMGSRPAKSAR

SEQ ID NO: 2609726 - protein, 12 aa, Entamoeba histolytica
CGMNDEKELSKT

SEQ ID NO: 2609727 - protein, 5 aa, Entamoeba histolytica
CGNEN

SEQ ID NO: 2609728 - protein, 6 aa, Entamoeba histolytica
CGNGKY

SEQ ID NO: 2609729 - protein, 4 aa, Entamoeba histolytica
CGNN

SEQ ID NO: 2609730 - protein, 17 aa, Entamoeba histolytica
CGNNEQPVWSEDTRKKF

SEQ ID NO: 2609731 - protein, 4 aa, Entamoeba histolytica
CGNP

SEQ ID NO: 2609732 - protein, 5 aa, Entamoeba histolytica
CGNPI

SEQ ID NO: 2609733 - protein, 6 aa, Entamoeba histolytica
CGNQLG

SEQ ID NO: 2609734 - protein, 6 aa, Entamoeba histolytica
CGNQVG

SEQ ID NO: 2609735 - protein, 14 aa, Entamoeba histolytica
CGNSEETTTPPYEI

SEQ ID NO: 2609736 - protein, 4 aa, Entamoeba histolytica
CGNT

SEQ ID NO: 2609737 - protein, 5 aa, Entamoeba histolytica
CGPPE

SEQ ID NO: 2609738 - protein, 5 aa, Entamoeba histolytica
CGPQL

SEQ ID NO: 2609739 - protein, 5 aa, Entamoeba histolytica
CGPTS

SEQ ID NO: 2609740 - protein, 9 aa, Entamoeba histolytica
CGQAGDRMH

SEQ ID NO: 2609741 - protein, 4 aa, Entamoeba histolytica
CGQP

SEQ ID NO: 2609742 - protein, 6 aa, Entamoeba histolytica
CGQPLQ

SEQ ID NO: 2609743 - protein, 10 aa, Entamoeba histolytica
CGRANTATFL

SEQ ID NO: 2609744 - protein, 8 aa, Entamoeba histolytica
CGRSTELQ

SEQ ID NO: 2609745 - protein, 6 aa, Entamoeba histolytica
CGSAES

SEQ ID NO: 2609746 - protein, 8 aa, Entamoeba histolytica
CGSAGYDR

SEQ ID NO: 2609747 - protein, 8 aa, Entamoeba histolytica
CGSEEAYS

SEQ ID NO: 2609748 - protein, 9 aa, Entamoeba histolytica
CGSENGTIN

SEQ ID NO: 2609749 - protein, 12 aa, Entamoeba histolytica
CGSESLKKEECV

SEQ ID NO: 2609750 - protein, 4 aa, Entamoeba histolytica
CGSL

SEQ ID NO: 2609751 - protein, 4 aa, Entamoeba histolytica
CGSN

SEQ ID NO: 2609752 - protein, 30 aa, Entamoeba histolytica
CGSNTNGNIKEENNLETDNESESEVPPKKE

SEQ ID NO: 2609753 - protein, 5 aa, Entamoeba histolytica
CGSPF

SEQ ID NO: 2609754 - protein, 6 aa, Entamoeba histolytica
CGSPIP

SEQ ID NO: 2609755 - protein, 9 aa, Entamoeba histolytica
CGSQTNTNL

SEQ ID NO: 2609756 - protein, 8 aa, Entamoeba histolytica
CGSSDGQI

SEQ ID NO: 2609757 - protein, 5 aa, Entamoeba histolytica
CGSTD

SEQ ID NO: 2609758 - protein, 6 aa, Entamoeba histolytica
CGSTSL

SEQ ID NO: 2609759 - protein, 5 aa, Entamoeba histolytica
CGTQR

SEQ ID NO: 2609760 - protein, 6 aa, Entamoeba histolytica
CGVENR

SEQ ID NO: 2609761 - protein, 10 aa, Entamoeba histolytica
CGWGDKPSFA

SEQ ID NO: 2609762 - protein, 7 aa, Entamoeba histolytica
CGYPSDV

SEQ ID NO: 2609763 - protein, 10 aa, Entamoeba histolytica
CGYQGDELTG

SEQ ID NO: 2609764 - protein, 9 aa, Entamoeba histolytica
CHENENRYD

SEQ ID NO: 2609765 - protein, 4 aa, Entamoeba histolytica
CHNE

SEQ ID NO: 2609766 - protein, 5 aa, Entamoeba histolytica
CHPPC

SEQ ID NO: 2609767 - protein, 12 aa, Entamoeba histolytica
CHPQKPKQPPLC

SEQ ID NO: 2609768 - protein, 4 aa, Entamoeba histolytica
CHRP

SEQ ID NO: 2609769 - protein, 4 aa, Entamoeba histolytica
CHSE

SEQ ID NO: 2609770 - protein, 9 aa, Entamoeba histolytica
CISKDNDPV

SEQ ID NO: 2609771 - protein, 7 aa, Entamoeba histolytica
CITGPKS

SEQ ID NO: 2609772 - protein, 6 aa, Entamoeba histolytica
CITPGT

SEQ ID NO: 2609773 - protein, 12 aa, Entamoeba histolytica
CKADDYKGCPKK

SEQ ID NO: 2609774 - protein, 4 aa, Entamoeba histolytica
CKDT

SEQ ID NO: 2609775 - protein, 9 aa, Entamoeba histolytica
CKEAIDSTR

SEQ ID NO: 2609776 - protein, 10 aa, Entamoeba histolytica
CKEAKKNKCS

SEQ ID NO: 2609777 - protein, 13 aa, Entamoeba histolytica
CKEARYKNTETTV

SEQ ID NO: 2609778 - protein, 6 aa, Entamoeba histolytica
CKEDTP

SEQ ID NO: 2609779 - protein, 11 aa, Entamoeba histolytica
CKEGNENYYKR

SEQ ID NO: 2609780 - protein, 13 aa, Entamoeba histolytica
CKEKKNVKHGDNL

SEQ ID NO: 2609781 - protein, 11 aa, Entamoeba histolytica
CKENPSTRTKI

SEQ ID NO: 2609782 - protein, 8 aa, Entamoeba histolytica
CKEPSYDD

SEQ ID NO: 2609783 - protein, 9 aa, Entamoeba histolytica
CKERQKPEV

SEQ ID NO: 2609784 - protein, 9 aa, Entamoeba histolytica
CKESTDDYL

SEQ ID NO: 2609785 - protein, 11 aa, Entamoeba histolytica
CKGDESEFEGK

SEQ ID NO: 2609786 - protein, 8 aa, Entamoeba histolytica
CKGDQSSI

SEQ ID NO: 2609787 - protein, 15 aa, Entamoeba histolytica
CKGKGTKSGKDVKKC

SEQ ID NO: 2609788 - protein, 21 aa, Entamoeba histolytica
CKGKGTKSGNEPTKCTKCGGN

SEQ ID NO: 2609789 - protein, 4 aa, Entamoeba histolytica
CKGN

SEQ ID NO: 2609790 - protein, 9 aa, Entamoeba histolytica
CKGSDKSVQ

SEQ ID NO: 2609791 - protein, 8 aa, Entamoeba histolytica
CKGTPRDD

SEQ ID NO: 2609792 - protein, 6 aa, Entamoeba histolytica
CKKAEV

SEQ ID NO: 2609793 - protein, 10 aa, Entamoeba histolytica
CKKEGEEEEF

SEQ ID NO: 2609794 - protein, 10 aa, Entamoeba histolytica
CKKEKDKREG

SEQ ID NO: 2609795 - protein, 8 aa, Entamoeba histolytica
CKKGGSCT

SEQ ID NO: 2609796 - protein, 8 aa, Entamoeba histolytica
CKKKESPF

SEQ ID NO: 2609797 - protein, 7 aa, Entamoeba histolytica
CKKPYNP

SEQ ID NO: 2609798 - protein, 12 aa, Entamoeba histolytica
CKKSELESEYNY

SEQ ID NO: 2609799 - protein, 6 aa, Entamoeba histolytica
CKKTGT

SEQ ID NO: 2609800 - protein, 4 aa, Entamoeba histolytica
CKLP

SEQ ID NO: 2609801 - protein, 4 aa, Entamoeba histolytica
CKLT

SEQ ID NO: 2609802 - protein, 13 aa, Entamoeba histolytica
CKNDSDKKKYRNV

SEQ ID NO: 2609803 - protein, 14 aa, Entamoeba histolytica
CKNKEQKEYNEQEI

SEQ ID NO: 2609804 - protein, 6 aa, Entamoeba histolytica
CKNSSI

SEQ ID NO: 2609805 - protein, 11 aa, Entamoeba histolytica
CKNTEIKGELD

SEQ ID NO: 2609806 - protein, 12 aa, Entamoeba histolytica
CKNTENTGKLDS

SEQ ID NO: 2609807 - protein, 8 aa, Entamoeba histolytica
CKPEGKAV

SEQ ID NO: 2609808 - protein, 42 aa, Entamoeba histolytica
CKPQKEDVSKTRLQSGRSQRTHSCAPTPQFTSSHKPDESKTL

SEQ ID NO: 2609809 - protein, 7 aa, Entamoeba histolytica
CKPRNDK

SEQ ID NO: 2609810 - protein, 9 aa, Entamoeba histolytica
CKPYKGETG

SEQ ID NO: 2609811 - protein, 5 aa, Entamoeba histolytica
CKQAV

SEQ ID NO: 2609812 - protein, 9 aa, Entamoeba histolytica
CKQSNGSIK

SEQ ID NO: 2609813 - protein, 29 aa, Entamoeba histolytica
CKQTQSQPTSYRQTTLNKTTTQQNSARLA

SEQ ID NO: 2609814 - protein, 11 aa, Entamoeba histolytica
CKQYESGECDR

SEQ ID NO: 2609815 - protein, 10 aa, Entamoeba histolytica
CKRKDQKPDE

SEQ ID NO: 2609816 - protein, 6 aa, Entamoeba histolytica
CKSAVE

SEQ ID NO: 2609817 - protein, 8 aa, Entamoeba histolytica
CKSNETSL

SEQ ID NO: 2609818 - protein, 9 aa, Entamoeba histolytica
CKSNPEHCS

SEQ ID NO: 2609819 - protein, 4 aa, Entamoeba histolytica
CKST

SEQ ID NO: 2609820 - protein, 10 aa, Entamoeba histolytica
CKSTPNPKPF

SEQ ID NO: 2609821 - protein, 14 aa, Entamoeba histolytica
CKSTQRKRALTGRD

SEQ ID NO: 2609822 - protein, 6 aa, Entamoeba histolytica
CKSVGD

SEQ ID NO: 2609823 - protein, 5 aa, Entamoeba histolytica
CKTCH

SEQ ID NO: 2609824 - protein, 4 aa, Entamoeba histolytica
CKTE

SEQ ID NO: 2609825 - protein, 23 aa, Entamoeba histolytica
CKTMDEKAKQEKIKEQRKYYQEK

SEQ ID NO: 2609826 - protein, 12 aa, Entamoeba histolytica
CKTNTISSQQQN

SEQ ID NO: 2609827 - protein, 18 aa, Entamoeba histolytica
CKTQKTSKKHQNPINCKF

SEQ ID NO: 2609828 - protein, 7 aa, Entamoeba histolytica
CKTTKTN

SEQ ID NO: 2609829 - protein, 14 aa, Entamoeba histolytica
CLDASQKHIDPSKK

SEQ ID NO: 2609830 - protein, 6 aa, Entamoeba histolytica
CLKSSE

SEQ ID NO: 2609831 - protein, 7 aa, Entamoeba histolytica
CLNDSPV

SEQ ID NO: 2609832 - protein, 14 aa, Entamoeba histolytica
CLNQKEENEKNNNL

SEQ ID NO: 2609833 - protein, 7 aa, Entamoeba histolytica
CLPESEA

SEQ ID NO: 2609834 - protein, 7 aa, Entamoeba histolytica
CLQERRK

SEQ ID NO: 2609835 - protein, 8 aa, Entamoeba histolytica
CNANDTSV

SEQ ID NO: 2609836 - protein, 8 aa, Entamoeba histolytica
CNAQPNEA

SEQ ID NO: 2609837 - protein, 9 aa, Entamoeba histolytica
CNDDSKPSL

SEQ ID NO: 2609838 - protein, 7 aa, Entamoeba histolytica
CNDHKSY

SEQ ID NO: 2609839 - protein, 5 aa, Entamoeba histolytica
CNDSY

SEQ ID NO: 2609840 - protein, 6 aa, Entamoeba histolytica
CNEEGD

SEQ ID NO: 2609841 - protein, 30 aa, Entamoeba histolytica
CNEEKENKMEEEKENKMEEEGNDDDRSGKY

SEQ ID NO: 2609842 - protein, 6 aa, Entamoeba histolytica
CNEKAK

SEQ ID NO: 2609843 - protein, 9 aa, Entamoeba histolytica
CNEKPNNDI

SEQ ID NO: 2609844 - protein, 10 aa, Entamoeba histolytica
CNEKTNIEIG

SEQ ID NO: 2609845 - protein, 5 aa, Entamoeba histolytica
CNENQ

SEQ ID NO: 2609846 - protein, 9 aa, Entamoeba histolytica
CNERKEHEI

SEQ ID NO: 2609847 - protein, 7 aa, Entamoeba histolytica
CNESNDI

SEQ ID NO: 2609848 - protein, 7 aa, Entamoeba histolytica
CNETNQK

SEQ ID NO: 2609849 - protein, 9 aa, Entamoeba histolytica
CNGCKNPDI

SEQ ID NO: 2609850 - protein, 5 aa, Entamoeba histolytica
CNGKQ

SEQ ID NO: 2609851 - protein, 4 aa, Entamoeba histolytica
CNGN

SEQ ID NO: 2609852 - protein, 7 aa, Entamoeba histolytica
CNGNPQV

SEQ ID NO: 2609853 - protein, 6 aa, Entamoeba histolytica
CNGSPY

SEQ ID NO: 2609854 - protein, 10 aa, Entamoeba histolytica
CNHTKQSYNP

SEQ ID NO: 2609855 - protein, 4 aa, Entamoeba histolytica
CNKE

SEQ ID NO: 2609856 - protein, 7 aa, Entamoeba histolytica
CNKEDDW

SEQ ID NO: 2609857 - protein, 10 aa, Entamoeba histolytica
CNKGQEANTF

SEQ ID NO: 2609858 - protein, 13 aa, Entamoeba histolytica
CNKNNTKSTPSKK

SEQ ID NO: 2609859 - protein, 8 aa, Entamoeba histolytica
CNKSNQNS

SEQ ID NO: 2609860 - protein, 15 aa, Entamoeba histolytica
CNKTTAKADNSLEGI

SEQ ID NO: 2609861 - protein, 15 aa, Entamoeba histolytica
CNLSQQKDDHITSSS

SEQ ID NO: 2609862 - protein, 5 aa, Entamoeba histolytica
CNNDT

SEQ ID NO: 2609863 - protein, 5 aa, Entamoeba histolytica
CNNEF

SEQ ID NO: 2609864 - protein, 6 aa, Entamoeba histolytica
CNNPIK

SEQ ID NO: 2609865 - protein, 10 aa, Entamoeba histolytica
CNNQQRLEKA

SEQ ID NO: 2609866 - protein, 15 aa, Entamoeba histolytica
CNNSTGGVFKAAKRK

SEQ ID NO: 2609867 - protein, 4 aa, Entamoeba histolytica
CNPE

SEQ ID NO: 2609868 - protein, 6 aa, Entamoeba histolytica
CNPEVT

SEQ ID NO: 2609869 - protein, 19 aa, Entamoeba histolytica
CNPHKKKQLKQEIKQTIQN

SEQ ID NO: 2609870 - protein, 4 aa, Entamoeba histolytica
CNPN

SEQ ID NO: 2609871 - protein, 5 aa, Entamoeba histolytica
CNPNH

SEQ ID NO: 2609872 - protein, 6 aa, Entamoeba histolytica
CNPSSH

SEQ ID NO: 2609873 - protein, 4 aa, Entamoeba histolytica
CNQA

SEQ ID NO: 2609874 - protein, 18 aa, Entamoeba histolytica
CNQEEKEDDGKQEKGEEF

SEQ ID NO: 2609875 - protein, 15 aa, Entamoeba histolytica
CNQGKESSVRIKERD

SEQ ID NO: 2609876 - protein, 11 aa, Entamoeba histolytica
CNQLPNPSNCS

SEQ ID NO: 2609877 - protein, 8 aa, Entamoeba histolytica
CNRKRNGK

SEQ ID NO: 2609878 - protein, 5 aa, Entamoeba histolytica
CNSCN

SEQ ID NO: 2609879 - protein, 10 aa, Entamoeba histolytica
CNSEEKAKQI

SEQ ID NO: 2609880 - protein, 9 aa, Entamoeba histolytica
CNSGNPQLL

SEQ ID NO: 2609881 - protein, 8 aa, Entamoeba histolytica
CNSGSKQY

SEQ ID NO: 2609882 - protein, 7 aa, Entamoeba histolytica
CNSKTKV

SEQ ID NO: 2609883 - protein, 6 aa, Entamoeba histolytica
CNSNDF

SEQ ID NO: 2609884 - protein, 15 aa, Entamoeba histolytica
CNSNDTSKMTSDENT

SEQ ID NO: 2609885 - protein, 5 aa, Entamoeba histolytica
CNSPL

SEQ ID NO: 2609886 - protein, 12 aa, Entamoeba histolytica
CNSSEKRNQTVE

SEQ ID NO: 2609887 - protein, 10 aa, Entamoeba histolytica
CNSSISPSLD

SEQ ID NO: 2609888 - protein, 5 aa, Entamoeba histolytica
CNSSL

SEQ ID NO: 2609889 - protein, 11 aa, Entamoeba histolytica
CNSSNKNTLNS

SEQ ID NO: 2609890 - protein, 6 aa, Entamoeba histolytica
CNSSYF

SEQ ID NO: 2609891 - protein, 7 aa, Entamoeba histolytica
CNSTGLT

SEQ ID NO: 2609892 - protein, 10 aa, Entamoeba histolytica
CNSTNAEQIA

SEQ ID NO: 2609893 - protein, 9 aa, Entamoeba histolytica
CNSTTGKGI

SEQ ID NO: 2609894 - protein, 13 aa, Entamoeba histolytica
CNSVPSLNGIPHY

SEQ ID NO: 2609895 - protein, 4 aa, Entamoeba histolytica
CNTA

SEQ ID NO: 2609896 - protein, 7 aa, Entamoeba histolytica
CNTAKLP

SEQ ID NO: 2609897 - protein, 10 aa, Entamoeba histolytica
CNTKDTLEHK

SEQ ID NO: 2609898 - protein, 7 aa, Entamoeba histolytica
CNTKSNV

SEQ ID NO: 2609899 - protein, 6 aa, Entamoeba histolytica
CNTNGA

SEQ ID NO: 2609900 - protein, 7 aa, Entamoeba histolytica
CNTSNQI

SEQ ID NO: 2609901 - protein, 4 aa, Entamoeba histolytica
CPAP

SEQ ID NO: 2609902 - protein, 16 aa, Entamoeba histolytica
CPDSEKIDYSSLSKKT

SEQ ID NO: 2609903 - protein, 8 aa, Entamoeba histolytica
CPDYSEAT

SEQ ID NO: 2609904 - protein, 6 aa, Entamoeba histolytica
CPEDTA

SEQ ID NO: 2609905 - protein, 7 aa, Entamoeba histolytica
CPEESRE

SEQ ID NO: 2609906 - protein, 10 aa, Entamoeba histolytica
CPEETLSRTG

SEQ ID NO: 2609907 - protein, 17 aa, Entamoeba histolytica
CPENNNPAFDKKEAAGL

SEQ ID NO: 2609908 - protein, 8 aa, Entamoeba histolytica
CPEPRTGK

SEQ ID NO: 2609909 - protein, 4 aa, Entamoeba histolytica
CPER

SEQ ID NO: 2609910 - protein, 5 aa, Entamoeba histolytica
CPGMS

SEQ ID NO: 2609911 - protein, 7 aa, Entamoeba histolytica
CPKCGGD

SEQ ID NO: 2609912 - protein, 6 aa, Entamoeba histolytica
CPKEIP

SEQ ID NO: 2609913 - protein, 6 aa, Entamoeba histolytica
CPKGDK

SEQ ID NO: 2609914 - protein, 8 aa, Entamoeba histolytica
CPKGDKAQ

SEQ ID NO: 2609915 - protein, 6 aa, Entamoeba histolytica
CPKGFQ

SEQ ID NO: 2609916 - protein, 10 aa, Entamoeba histolytica
CPKSDNYSFS

SEQ ID NO: 2609917 - protein, 5 aa, Entamoeba histolytica
CPKSY

SEQ ID NO: 2609918 - protein, 10 aa, Entamoeba histolytica
CPLTSNPSYW

SEQ ID NO: 2609919 - protein, 5 aa, Entamoeba histolytica
CPMDP

SEQ ID NO: 2609920 - protein, 13 aa, Entamoeba histolytica
CPNNPARKSTYGK

SEQ ID NO: 2609921 - protein, 5 aa, Entamoeba histolytica
CPNRK

SEQ ID NO: 2609922 - protein, 11 aa, Entamoeba histolytica
CPNSPREVSSY

SEQ ID NO: 2609923 - protein, 10 aa, Entamoeba histolytica
CPNTSTPNEW

SEQ ID NO: 2609924 - protein, 9 aa, Entamoeba histolytica
CPPERTGDI

SEQ ID NO: 2609925 - protein, 7 aa, Entamoeba histolytica
CPPGQNI

SEQ ID NO: 2609926 - protein, 20 aa, Entamoeba histolytica
CPPLPPKAERFNQERELTPL

SEQ ID NO: 2609927 - protein, 11 aa, Entamoeba histolytica
CPPPDSNPIPF

SEQ ID NO: 2609928 - protein, 68 aa, Entamoeba histolytica
CPPPMGGYPPQPMGAYPPPMGAYPPPMGAYPPPMGGMSGPMGGCPPPMGAYPPPMGGMPGPGGYPMGG

SEQ ID NO: 2609929 - protein, 10 aa, Entamoeba histolytica
CPPPPPGNSS

SEQ ID NO: 2609930 - protein, 9 aa, Entamoeba histolytica
CPPSEFKSA

SEQ ID NO: 2609931 - protein, 7 aa, Entamoeba histolytica
CPRTSRR

SEQ ID NO: 2609932 - protein, 8 aa, Entamoeba histolytica
CPSERNKI

SEQ ID NO: 2609933 - protein, 11 aa, Entamoeba histolytica
CPSFTQDGMND

SEQ ID NO: 2609934 - protein, 17 aa, Entamoeba histolytica
CPSHSSSQDSDVEGSSV

SEQ ID NO: 2609935 - protein, 4 aa, Entamoeba histolytica
CPSI

SEQ ID NO: 2609936 - protein, 14 aa, Entamoeba histolytica
CPSKASMIKEAIKS

SEQ ID NO: 2609937 - protein, 4 aa, Entamoeba histolytica
CPSS

SEQ ID NO: 2609938 - protein, 11 aa, Entamoeba histolytica
CPSSEHVNESR

SEQ ID NO: 2609939 - protein, 12 aa, Entamoeba histolytica
CPSSEHVNESRK

SEQ ID NO: 2609940 - protein, 5 aa, Entamoeba histolytica
CPTDK

SEQ ID NO: 2609941 - protein, 4 aa, Entamoeba histolytica
CPTL

SEQ ID NO: 2609942 - protein, 4 aa, Entamoeba histolytica
CPTT

SEQ ID NO: 2609943 - protein, 4 aa, Entamoeba histolytica
CQDN

SEQ ID NO: 2609944 - protein, 9 aa, Entamoeba histolytica
CQDTSMPFT

SEQ ID NO: 2609945 - protein, 6 aa, Entamoeba histolytica
CQEDGN

SEQ ID NO: 2609946 - protein, 5 aa, Entamoeba histolytica
CQEHP

SEQ ID NO: 2609947 - protein, 5 aa, Entamoeba histolytica
CQEKG

SEQ ID NO: 2609948 - protein, 10 aa, Entamoeba histolytica
CQELRKDGRF

SEQ ID NO: 2609949 - protein, 9 aa, Entamoeba histolytica
CQGGYQGKT

SEQ ID NO: 2609950 - protein, 16 aa, Entamoeba histolytica
CQKEEVDKNDYVTSQD

SEQ ID NO: 2609951 - protein, 15 aa, Entamoeba histolytica
CQKEKMNAKKNFDNQ

SEQ ID NO: 2609952 - protein, 14 aa, Entamoeba histolytica
CQKEKNYAKRRLDN

SEQ ID NO: 2609953 - protein, 36 aa, Entamoeba histolytica
CQKKKKSFNKQHNEKCRTSKLEEITSESTDDKSNEQ

SEQ ID NO: 2609954 - protein, 6 aa, Entamoeba histolytica
CQNDDP

SEQ ID NO: 2609955 - protein, 9 aa, Entamoeba histolytica
CQNKGNNKP

SEQ ID NO: 2609956 - protein, 9 aa, Entamoeba histolytica
CQNNDEMKE

SEQ ID NO: 2609957 - protein, 4 aa, Entamoeba histolytica
CQPP

SEQ ID NO: 2609958 - protein, 30 aa, Entamoeba histolytica
CQPTKFNPDNKEEKEGNNKSTEEQDKEEPE

SEQ ID NO: 2609959 - protein, 5 aa, Entamoeba histolytica
CQPYN

SEQ ID NO: 2609960 - protein, 6 aa, Entamoeba histolytica
CQQQKD

SEQ ID NO: 2609961 - protein, 8 aa, Entamoeba histolytica
CQQRHSEI

SEQ ID NO: 2609962 - protein, 4 aa, Entamoeba histolytica
CQRQ

SEQ ID NO: 2609963 - protein, 5 aa, Entamoeba histolytica
CQSAG

SEQ ID NO: 2609964 - protein, 7 aa, Entamoeba histolytica
CQSEGGL

SEQ ID NO: 2609965 - protein, 6 aa, Entamoeba histolytica
CQSGPA

SEQ ID NO: 2609966 - protein, 11 aa, Entamoeba histolytica
CQSNKESNNDY

SEQ ID NO: 2609967 - protein, 9 aa, Entamoeba histolytica
CQSQSDLPQ

SEQ ID NO: 2609968 - protein, 4 aa, Entamoeba histolytica
CQTP

SEQ ID NO: 2609969 - protein, 6 aa, Entamoeba histolytica
CQTPET

SEQ ID NO: 2609970 - protein, 7 aa, Entamoeba histolytica
CQYKNNG

SEQ ID NO: 2609971 - protein, 6 aa, Entamoeba histolytica
CRDANG

SEQ ID NO: 2609972 - protein, 12 aa, Entamoeba histolytica
CRDKKRDKMNEL

SEQ ID NO: 2609973 - protein, 10 aa, Entamoeba histolytica
CRDNSTTAIV

SEQ ID NO: 2609974 - protein, 7 aa, Entamoeba histolytica
CRDSNPI

SEQ ID NO: 2609975 - protein, 9 aa, Entamoeba histolytica
CRDTRTREV

SEQ ID NO: 2609976 - protein, 8 aa, Entamoeba histolytica
CRKAPKPR

SEQ ID NO: 2609977 - protein, 7 aa, Entamoeba histolytica
CRKTPKP

SEQ ID NO: 2609978 - protein, 9 aa, Entamoeba histolytica
CRSDKTKLT

SEQ ID NO: 2609979 - protein, 11 aa, Entamoeba histolytica
CRSKKEEGYSY

SEQ ID NO: 2609980 - protein, 10 aa, Entamoeba histolytica
CRSNKKDEII

SEQ ID NO: 2609981 - protein, 7 aa, Entamoeba histolytica
CRSPSEF

SEQ ID NO: 2609982 - protein, 5 aa, Entamoeba histolytica
CRTKD

SEQ ID NO: 2609983 - protein, 7 aa, Entamoeba histolytica
CRTKGID

SEQ ID NO: 2609984 - protein, 4 aa, Entamoeba histolytica
CRTP

SEQ ID NO: 2609985 - protein, 5 aa, Entamoeba histolytica
CSAEG

SEQ ID NO: 2609986 - protein, 10 aa, Entamoeba histolytica
CSANTKKMSL

SEQ ID NO: 2609987 - protein, 19 aa, Entamoeba histolytica
CSASITGYAGPSPSLEESK

SEQ ID NO: 2609988 - protein, 7 aa, Entamoeba histolytica
CSDASDH

SEQ ID NO: 2609989 - protein, 4 aa, Entamoeba histolytica
CSDD

SEQ ID NO: 2609990 - protein, 6 aa, Entamoeba histolytica
CSDDKT

SEQ ID NO: 2609991 - protein, 8 aa, Entamoeba histolytica
CSDGGSAT

SEQ ID NO: 2609992 - protein, 12 aa, Entamoeba histolytica
CSDGKDKYRSLT

SEQ ID NO: 2609993 - protein, 13 aa, Entamoeba histolytica
CSDPIKKNASTQN

SEQ ID NO: 2609994 - protein, 8 aa, Entamoeba histolytica
CSDRQSSY

SEQ ID NO: 2609995 - protein, 7 aa, Entamoeba histolytica
CSDTVDE

SEQ ID NO: 2609996 - protein, 6 aa, Entamoeba histolytica
CSEENI

SEQ ID NO: 2609997 - protein, 10 aa, Entamoeba histolytica
CSEETTKKLS

SEQ ID NO: 2609998 - protein, 8 aa, Entamoeba histolytica
CSEETTTG

SEQ ID NO: 2609999 - protein, 10 aa, Entamoeba histolytica
CSEKDEKTKI

SEQ ID NO: 2610000 - protein, 6 aa, Entamoeba histolytica
CSEKNR

SEQ ID NO: 2610001 - protein, 17 aa, Entamoeba histolytica
CSEKTANRRFQTNKKTE

SEQ ID NO: 2610002 - protein, 8 aa, Entamoeba histolytica
CSENDAHS

SEQ ID NO: 2610003 - protein, 7 aa, Entamoeba histolytica
CSESADI

SEQ ID NO: 2610004 - protein, 6 aa, Entamoeba histolytica
CSETND

SEQ ID NO: 2610005 - protein, 5 aa, Entamoeba histolytica
CSFEQ

SEQ ID NO: 2610006 - protein, 4 aa, Entamoeba histolytica
CSFN

SEQ ID NO: 2610007 - protein, 11 aa, Entamoeba histolytica
CSGAKTDQAIS

SEQ ID NO: 2610008 - protein, 5 aa, Entamoeba histolytica
CSGDG

SEQ ID NO: 2610009 - protein, 14 aa, Entamoeba histolytica
CSGDGTLRKNPDAW

SEQ ID NO: 2610010 - protein, 4 aa, Entamoeba histolytica
CSGE

SEQ ID NO: 2610011 - protein, 9 aa, Entamoeba histolytica
CSGENNPLP

SEQ ID NO: 2610012 - protein, 10 aa, Entamoeba histolytica
CSGESNKDDV

SEQ ID NO: 2610013 - protein, 5 aa, Entamoeba histolytica
CSGIN

SEQ ID NO: 2610014 - protein, 4 aa, Entamoeba histolytica
CSGN

SEQ ID NO: 2610015 - protein, 20 aa, Entamoeba histolytica
CSGNGTKSGIKAQTCGTCRG

SEQ ID NO: 2610016 - protein, 10 aa, Entamoeba histolytica
CSGSNDKGTF

SEQ ID NO: 2610017 - protein, 16 aa, Entamoeba histolytica
CSHGRDSHIRQVQIFG

SEQ ID NO: 2610018 - protein, 8 aa, Entamoeba histolytica
CSHLSEKG

SEQ ID NO: 2610019 - protein, 5 aa, Entamoeba histolytica
CSISN

SEQ ID NO: 2610020 - protein, 11 aa, Entamoeba histolytica
CSKGMEAKDQR

SEQ ID NO: 2610021 - protein, 8 aa, Entamoeba histolytica
CSKKDIEI

SEQ ID NO: 2610022 - protein, 7 aa, Entamoeba histolytica
CSKKRHE

SEQ ID NO: 2610023 - protein, 6 aa, Entamoeba histolytica
CSKNES

SEQ ID NO: 2610024 - protein, 14 aa, Entamoeba histolytica
CSKNRKIVPPNPVP

SEQ ID NO: 2610025 - protein, 9 aa, Entamoeba histolytica
CSKRSWDGQ

SEQ ID NO: 2610026 - protein, 11 aa, Entamoeba histolytica
CSLPQSNPIKY

SEQ ID NO: 2610027 - protein, 5 aa, Entamoeba histolytica
CSNCN

SEQ ID NO: 2610028 - protein, 4 aa, Entamoeba histolytica
CSND

SEQ ID NO: 2610029 - protein, 10 aa, Entamoeba histolytica
CSNEEEEGRE

SEQ ID NO: 2610030 - protein, 5 aa, Entamoeba histolytica
CSNEF

SEQ ID NO: 2610031 - protein, 10 aa, Entamoeba histolytica
CSNELSEENA

SEQ ID NO: 2610032 - protein, 7 aa, Entamoeba histolytica
CSNGDQI

SEQ ID NO: 2610033 - protein, 10 aa, Entamoeba histolytica
CSNGGDPKVN

SEQ ID NO: 2610034 - protein, 6 aa, Entamoeba histolytica
CSNKDR

SEQ ID NO: 2610035 - protein, 9 aa, Entamoeba histolytica
CSNKSDNHQ

SEQ ID NO: 2610036 - protein, 9 aa, Entamoeba histolytica
CSNQTQRSQ

SEQ ID NO: 2610037 - protein, 8 aa, Entamoeba histolytica
CSNSPDSI

SEQ ID NO: 2610038 - protein, 17 aa, Entamoeba histolytica
CSNSPNNLNEITNSPLT

SEQ ID NO: 2610039 - protein, 8 aa, Entamoeba histolytica
CSNTEVSS

SEQ ID NO: 2610040 - protein, 7 aa, Entamoeba histolytica
CSPNNQK

SEQ ID NO: 2610041 - protein, 8 aa, Entamoeba histolytica
CSPRNKSY

SEQ ID NO: 2610042 - protein, 27 aa, Entamoeba histolytica
CSPSPYARPPVYSQGTYSSSSLGRAPP

SEQ ID NO: 2610043 - protein, 24 aa, Entamoeba histolytica
CSPSSMPSSSDETITYTKVTCEND

SEQ ID NO: 2610044 - protein, 5 aa, Entamoeba histolytica
CSPTN

SEQ ID NO: 2610045 - protein, 10 aa, Entamoeba histolytica
CSQEEREKVA

SEQ ID NO: 2610046 - protein, 10 aa, Entamoeba histolytica
CSQITTTSKT

SEQ ID NO: 2610047 - protein, 8 aa, Entamoeba histolytica
CSQNKSTQ

SEQ ID NO: 2610048 - protein, 5 aa, Entamoeba histolytica
CSQQN

SEQ ID NO: 2610049 - protein, 5 aa, Entamoeba histolytica
CSRAI

SEQ ID NO: 2610050 - protein, 4 aa, Entamoeba histolytica
CSRD

SEQ ID NO: 2610051 - protein, 4 aa, Entamoeba histolytica
CSSD

SEQ ID NO: 2610052 - protein, 5 aa, Entamoeba histolytica
CSSDH

SEQ ID NO: 2610053 - protein, 9 aa, Entamoeba histolytica
CSSEGGSNI

SEQ ID NO: 2610054 - protein, 6 aa, Entamoeba histolytica
CSSNEN

SEQ ID NO: 2610055 - protein, 6 aa, Entamoeba histolytica
CSSPTL

SEQ ID NO: 2610056 - protein, 7 aa, Entamoeba histolytica
CSSQNHR

SEQ ID NO: 2610057 - protein, 15 aa, Entamoeba histolytica
CSSRGDGETEASRRV

SEQ ID NO: 2610058 - protein, 9 aa, Entamoeba histolytica
CSSSRNHQH

SEQ ID NO: 2610059 - protein, 5 aa, Entamoeba histolytica
CSSSS

SEQ ID NO: 2610060 - protein, 10 aa, Entamoeba histolytica
CSSTSTAYSE

SEQ ID NO: 2610061 - protein, 4 aa, Entamoeba histolytica
CSTD

SEQ ID NO: 2610062 - protein, 8 aa, Entamoeba histolytica
CSTESKRM

SEQ ID NO: 2610063 - protein, 18 aa, Entamoeba histolytica
CSTESQNHEEEKKKERKK

SEQ ID NO: 2610064 - protein, 10 aa, Entamoeba histolytica
CSTIEKEQEV

SEQ ID NO: 2610065 - protein, 6 aa, Entamoeba histolytica
CSTPSF

SEQ ID NO: 2610066 - protein, 5 aa, Entamoeba histolytica
CSTSP

SEQ ID NO: 2610067 - protein, 6 aa, Entamoeba histolytica
CSTSPI

SEQ ID NO: 2610068 - protein, 5 aa, Entamoeba histolytica
CSTSS

SEQ ID NO: 2610069 - protein, 8 aa, Entamoeba histolytica
CSTTEKQT

SEQ ID NO: 2610070 - protein, 4 aa, Entamoeba histolytica
CSVG

SEQ ID NO: 2610071 - protein, 10 aa, Entamoeba histolytica
CSVSKKEEAV

SEQ ID NO: 2610072 - protein, 6 aa, Entamoeba histolytica
CTADKG

SEQ ID NO: 2610073 - protein, 11 aa, Entamoeba histolytica
CTASSQQINAQ

SEQ ID NO: 2610074 - protein, 10 aa, Entamoeba histolytica
CTDENDSNTI

SEQ ID NO: 2610075 - protein, 16 aa, Entamoeba histolytica
CTDIETKNEKTPSNYA

SEQ ID NO: 2610076 - protein, 8 aa, Entamoeba histolytica
CTDNETIK

SEQ ID NO: 2610077 - protein, 5 aa, Entamoeba histolytica
CTDTS

SEQ ID NO: 2610078 - protein, 13 aa, Entamoeba histolytica
CTEEEYNSFSPQT

SEQ ID NO: 2610079 - protein, 5 aa, Entamoeba histolytica
CTEEL

SEQ ID NO: 2610080 - protein, 4 aa, Entamoeba histolytica
CTEK

SEQ ID NO: 2610081 - protein, 10 aa, Entamoeba histolytica
CTEKEEREGV

SEQ ID NO: 2610082 - protein, 11 aa, Entamoeba histolytica
CTEKITQETRW

SEQ ID NO: 2610083 - protein, 4 aa, Entamoeba histolytica
CTEP

SEQ ID NO: 2610084 - protein, 27 aa, Entamoeba histolytica
CTESKNPFFNTKDNRNEKIVKIIIIGQ

SEQ ID NO: 2610085 - protein, 8 aa, Entamoeba histolytica
CTGAPTNV

SEQ ID NO: 2610086 - protein, 11 aa, Entamoeba histolytica
CTGESKPNEDD

SEQ ID NO: 2610087 - protein, 11 aa, Entamoeba histolytica
CTGTSGAYTNS

SEQ ID NO: 2610088 - protein, 13 aa, Entamoeba histolytica
CTGTSPPNSNGGK

SEQ ID NO: 2610089 - protein, 18 aa, Entamoeba histolytica
CTKDHGPSSLKEIGETEF

SEQ ID NO: 2610090 - protein, 9 aa, Entamoeba histolytica
CTKDKNTAI

SEQ ID NO: 2610091 - protein, 8 aa, Entamoeba histolytica
CTKGKEVN

SEQ ID NO: 2610092 - protein, 24 aa, Entamoeba histolytica
CTKTRNITKNITTSNGVTTKKTNT

SEQ ID NO: 2610093 - protein, 6 aa, Entamoeba histolytica
CTKYPE

SEQ ID NO: 2610094 - protein, 5 aa, Entamoeba histolytica
CTNGT

SEQ ID NO: 2610095 - protein, 4 aa, Entamoeba histolytica
CTNI

SEQ ID NO: 2610096 - protein, 4 aa, Entamoeba histolytica
CTNY

SEQ ID NO: 2610097 - protein, 6 aa, Entamoeba histolytica
CTPDTQ

SEQ ID NO: 2610098 - protein, 9 aa, Entamoeba histolytica
CTPQPPLSF

SEQ ID NO: 2610099 - protein, 6 aa, Entamoeba histolytica
CTPSAL

SEQ ID NO: 2610100 - protein, 5 aa, Entamoeba histolytica
CTPTS

SEQ ID NO: 2610101 - protein, 11 aa, Entamoeba histolytica
CTQKDSTYFEQ

SEQ ID NO: 2610102 - protein, 4 aa, Entamoeba histolytica
CTQQ

SEQ ID NO: 2610103 - protein, 9 aa, Entamoeba histolytica
CTQQTGERN

SEQ ID NO: 2610104 - protein, 17 aa, Entamoeba histolytica
CTQQTQTVYKTRNPSWN

SEQ ID NO: 2610105 - protein, 11 aa, Entamoeba histolytica
CTQRSKKEEWS

SEQ ID NO: 2610106 - protein, 6 aa, Entamoeba histolytica
CTQTEG

SEQ ID NO: 2610107 - protein, 6 aa, Entamoeba histolytica
CTRAGP

SEQ ID NO: 2610108 - protein, 7 aa, Entamoeba histolytica
CTSASVA

SEQ ID NO: 2610109 - protein, 6 aa, Entamoeba histolytica
CTSDGS

SEQ ID NO: 2610110 - protein, 4 aa, Entamoeba histolytica
CTSK

SEQ ID NO: 2610111 - protein, 7 aa, Entamoeba histolytica
CTSKPQG

SEQ ID NO: 2610112 - protein, 7 aa, Entamoeba histolytica
CTSQEGR

SEQ ID NO: 2610113 - protein, 4 aa, Entamoeba histolytica
CTSS

SEQ ID NO: 2610114 - protein, 6 aa, Entamoeba histolytica
CTSSAQ

SEQ ID NO: 2610115 - protein, 9 aa, Entamoeba histolytica
CTSSDKKFS

SEQ ID NO: 2610116 - protein, 7 aa, Entamoeba histolytica
CTSSTHS

SEQ ID NO: 2610117 - protein, 8 aa, Entamoeba histolytica
CTTNKNGK

SEQ ID NO: 2610118 - protein, 6 aa, Entamoeba histolytica
CTTPDD

SEQ ID NO: 2610119 - protein, 6 aa, Entamoeba histolytica
CTTPDN

SEQ ID NO: 2610120 - protein, 5 aa, Entamoeba histolytica
CTTSN

SEQ ID NO: 2610121 - protein, 8 aa, Entamoeba histolytica
CTYNKTQG

SEQ ID NO: 2610122 - protein, 20 aa, Entamoeba histolytica
CVEEGSEKEYKYENTENNEI

SEQ ID NO: 2610123 - protein, 12 aa, Entamoeba histolytica
CVEQSKSRYRSK

SEQ ID NO: 2610124 - protein, 5 aa, Entamoeba histolytica
CVKQP

SEQ ID NO: 2610125 - protein, 6 aa, Entamoeba histolytica
CVNPEG

SEQ ID NO: 2610126 - protein, 7 aa, Entamoeba histolytica
CVQTTGN

SEQ ID NO: 2610127 - protein, 9 aa, Entamoeba histolytica
CYATATEDM

SEQ ID NO: 2610128 - protein, 5 aa, Entamoeba histolytica
CYDQQ

SEQ ID NO: 2610129 - protein, 7 aa, Entamoeba histolytica
CYNPGRK

SEQ ID NO: 2610130 - protein, 7 aa, Entamoeba histolytica
CYNTPVG

SEQ ID NO: 2610131 - protein, 8 aa, Entamoeba histolytica
CYQPKPSE

SEQ ID NO: 2610132 - protein, 7 aa, Entamoeba histolytica
DAAEKLG

SEQ ID NO: 2610133 - protein, 16 aa, Entamoeba histolytica
DAAEQPNYQSSGYKKK

SEQ ID NO: 2610134 - protein, 8 aa, Entamoeba histolytica
DAAPQSLS

SEQ ID NO: 2610135 - protein, 5 aa, Entamoeba histolytica
DAAPR

SEQ ID NO: 2610136 - protein, 14 aa, Entamoeba histolytica
DAARENANKRGAGN

SEQ ID NO: 2610137 - protein, 19 aa, Entamoeba histolytica
DAASEIEESIPQSQNGKLA

SEQ ID NO: 2610138 - protein, 8 aa, Entamoeba histolytica
DAATGDDW

SEQ ID NO: 2610139 - protein, 9 aa, Entamoeba histolytica
DAATSQEKH

SEQ ID NO: 2610140 - protein, 7 aa, Entamoeba histolytica
DADDEDI

SEQ ID NO: 2610141 - protein, 8 aa, Entamoeba histolytica
DADDVNPQ

SEQ ID NO: 2610142 - protein, 10 aa, Entamoeba histolytica
DADEEDDDDR

SEQ ID NO: 2610143 - protein, 6 aa, Entamoeba histolytica
DADESS

SEQ ID NO: 2610144 - protein, 5 aa, Entamoeba histolytica
DADGK

SEQ ID NO: 2610145 - protein, 11 aa, Entamoeba histolytica
DADGNGEIDQN

SEQ ID NO: 2610146 - protein, 8 aa, Entamoeba histolytica
DADIGNKE

SEQ ID NO: 2610147 - protein, 7 aa, Entamoeba histolytica
DADKKYQ

SEQ ID NO: 2610148 - protein, 10 aa, Entamoeba histolytica
DADKSGSLDV

SEQ ID NO: 2610149 - protein, 6 aa, Entamoeba histolytica
DADPKY

SEQ ID NO: 2610150 - protein, 6 aa, Entamoeba histolytica
DADSYN

SEQ ID NO: 2610151 - protein, 20 aa, Entamoeba histolytica
DAEAEEDNDDESEEYQMTEK

SEQ ID NO: 2610152 - protein, 9 aa, Entamoeba histolytica
DAEDAVSLG

SEQ ID NO: 2610153 - protein, 10 aa, Entamoeba histolytica
DAEEWKTKTI

SEQ ID NO: 2610154 - protein, 21 aa, Entamoeba histolytica
DAEFSATKKTPTQPTQPTKPY

SEQ ID NO: 2610155 - protein, 7 aa, Entamoeba histolytica
DAEGAKK

SEQ ID NO: 2610156 - protein, 7 aa, Entamoeba histolytica
DAEKEGG

SEQ ID NO: 2610157 - protein, 6 aa, Entamoeba histolytica
DAELDE

SEQ ID NO: 2610158 - protein, 14 aa, Entamoeba histolytica
DAELSTDPTPKGDE

SEQ ID NO: 2610159 - protein, 6 aa, Entamoeba histolytica
DAENQE

SEQ ID NO: 2610160 - protein, 16 aa, Entamoeba histolytica
DAEPQEPKDEEEMNDL

SEQ ID NO: 2610161 - protein, 5 aa, Entamoeba histolytica
DAEQE

SEQ ID NO: 2610162 - protein, 33 aa, Entamoeba histolytica
DAEVEPEEEGEEEIVQNEEKETKMDDGIEETDL

SEQ ID NO: 2610163 - protein, 8 aa, Entamoeba histolytica
DAFEKQND

SEQ ID NO: 2610164 - protein, 9 aa, Entamoeba histolytica
DAFERGDKA

SEQ ID NO: 2610165 - protein, 11 aa, Entamoeba histolytica
DAFHSKRDYPH

SEQ ID NO: 2610166 - protein, 19 aa, Entamoeba histolytica
DAGDGVEDANFAKETADNG

SEQ ID NO: 2610167 - protein, 5 aa, Entamoeba histolytica
DAGEF

SEQ ID NO: 2610168 - protein, 10 aa, Entamoeba histolytica
DAGENAKQYT

SEQ ID NO: 2610169 - protein, 12 aa, Entamoeba histolytica
DAGITKSKEESP

SEQ ID NO: 2610170 - protein, 8 aa, Entamoeba histolytica
DAGKSDGW

SEQ ID NO: 2610171 - protein, 11 aa, Entamoeba histolytica
DAGKTVRIGSQ

SEQ ID NO: 2610172 - protein, 10 aa, Entamoeba histolytica
DAGLTRPSGM

SEQ ID NO: 2610173 - protein, 7 aa, Entamoeba histolytica
DAGTQRR

SEQ ID NO: 2610174 - protein, 7 aa, Entamoeba histolytica
DAGVGKT

SEQ ID NO: 2610175 - protein, 13 aa, Entamoeba histolytica
DAHPRGSGNTLNM

SEQ ID NO: 2610176 - protein, 14 aa, Entamoeba histolytica
DAHSQNGIDETTFT

SEQ ID NO: 2610177 - protein, 10 aa, Entamoeba histolytica
DAIAKGEPFK

SEQ ID NO: 2610178 - protein, 5 aa, Entamoeba histolytica
DAIEE

SEQ ID NO: 2610179 - protein, 7 aa, Entamoeba histolytica
DAIGRTK

SEQ ID NO: 2610180 - protein, 5 aa, Entamoeba histolytica
DAIKN

SEQ ID NO: 2610181 - protein, 8 aa, Entamoeba histolytica
DAISGASN

SEQ ID NO: 2610182 - protein, 5 aa, Entamoeba histolytica
DAISS

SEQ ID NO: 2610183 - protein, 9 aa, Entamoeba histolytica
DAKDANEGI

SEQ ID NO: 2610184 - protein, 15 aa, Entamoeba histolytica
DAKERDGTYDKFSRI

SEQ ID NO: 2610185 - protein, 20 aa, Entamoeba histolytica
DAKETEKTRLKEIIEKIKKS

SEQ ID NO: 2610186 - protein, 12 aa, Entamoeba histolytica
DAKEWKERGRGD

SEQ ID NO: 2610187 - protein, 7 aa, Entamoeba histolytica
DAKGGFT

SEQ ID NO: 2610188 - protein, 8 aa, Entamoeba histolytica
DAKHRKRM

SEQ ID NO: 2610189 - protein, 10 aa, Entamoeba histolytica
DAKKERQDID

SEQ ID NO: 2610190 - protein, 9 aa, Entamoeba histolytica
DAKKNPFTL

SEQ ID NO: 2610191 - protein, 9 aa, Entamoeba histolytica
DAKKQDDII

SEQ ID NO: 2610192 - protein, 54 aa, Entamoeba histolytica
DAKKSGRKDDVKKIKDTKEEYEKASEEVKKAKKDPKDKEQRQKASEKLRKYQET

SEQ ID NO: 2610193 - protein, 10 aa, Entamoeba histolytica
DAKMQKDEGG

SEQ ID NO: 2610194 - protein, 6 aa, Entamoeba histolytica
DAKNDP

SEQ ID NO: 2610195 - protein, 9 aa, Entamoeba histolytica
DAKNKIDTF

SEQ ID NO: 2610196 - protein, 19 aa, Entamoeba histolytica
DAKQARVDEMKEEKQEEEI

SEQ ID NO: 2610197 - protein, 13 aa, Entamoeba histolytica
DALKSEKNEDSVM

SEQ ID NO: 2610198 - protein, 6 aa, Entamoeba histolytica
DALNEN

SEQ ID NO: 2610199 - protein, 5 aa, Entamoeba histolytica
DALQN

SEQ ID NO: 2610200 - protein, 4 aa, Entamoeba histolytica
DALS

SEQ ID NO: 2610201 - protein, 6 aa, Entamoeba histolytica
DALTET

SEQ ID NO: 2610202 - protein, 10 aa, Entamoeba histolytica
DALTPDAQTA

SEQ ID NO: 2610203 - protein, 7 aa, Entamoeba histolytica
DALTTKP

SEQ ID NO: 2610204 - protein, 4 aa, Entamoeba histolytica
DANA

SEQ ID NO: 2610205 - protein, 4 aa, Entamoeba histolytica
DAND

SEQ ID NO: 2610206 - protein, 45 aa, Entamoeba histolytica
DANDNVSMDEDSYYDEEDDEPRKRTKDCSQDCQPKRKATDQECKH

SEQ ID NO: 2610207 - protein, 9 aa, Entamoeba histolytica
DANDSDVKR

SEQ ID NO: 2610208 - protein, 7 aa, Entamoeba histolytica
DANECNE

SEQ ID NO: 2610209 - protein, 4 aa, Entamoeba histolytica
DANG

SEQ ID NO: 2610210 - protein, 9 aa, Entamoeba histolytica
DANGKKYQV

SEQ ID NO: 2610211 - protein, 7 aa, Entamoeba histolytica
DANGKSP

SEQ ID NO: 2610212 - protein, 11 aa, Entamoeba histolytica
DANGNATNNTC

SEQ ID NO: 2610213 - protein, 8 aa, Entamoeba histolytica
DANKPNAI

SEQ ID NO: 2610214 - protein, 7 aa, Entamoeba histolytica
DANNHTY

SEQ ID NO: 2610215 - protein, 9 aa, Entamoeba histolytica
DANNNGEKV

SEQ ID NO: 2610216 - protein, 7 aa, Entamoeba histolytica
DANNTIE

SEQ ID NO: 2610217 - protein, 16 aa, Entamoeba histolytica
DANSEIKTLQTENSSL

SEQ ID NO: 2610218 - protein, 7 aa, Entamoeba histolytica
DANTSTV

SEQ ID NO: 2610219 - protein, 11 aa, Entamoeba histolytica
DANTTEETKSS

SEQ ID NO: 2610220 - protein, 13 aa, Entamoeba histolytica
DANVSEAASEALN

SEQ ID NO: 2610221 - protein, 6 aa, Entamoeba histolytica
DAPCNG

SEQ ID NO: 2610222 - protein, 17 aa, Entamoeba histolytica
DAPDDDPTAKTLKDGRR

SEQ ID NO: 2610223 - protein, 7 aa, Entamoeba histolytica
DAPESIS

SEQ ID NO: 2610224 - protein, 5 aa, Entamoeba histolytica
DAPFL

SEQ ID NO: 2610225 - protein, 14 aa, Entamoeba histolytica
DAPKTGAEVDGGEI

SEQ ID NO: 2610226 - protein, 6 aa, Entamoeba histolytica
DAPKTI

SEQ ID NO: 2610227 - protein, 6 aa, Entamoeba histolytica
DAPKYH

SEQ ID NO: 2610228 - protein, 6 aa, Entamoeba histolytica
DAPNHL

SEQ ID NO: 2610229 - protein, 7 aa, Entamoeba histolytica
DAPPCGT

SEQ ID NO: 2610230 - protein, 12 aa, Entamoeba histolytica
DAPQKAGGQHRS

SEQ ID NO: 2610231 - protein, 8 aa, Entamoeba histolytica
DAPRQRNT

SEQ ID NO: 2610232 - protein, 5 aa, Entamoeba histolytica
DAPSL

SEQ ID NO: 2610233 - protein, 9 aa, Entamoeba histolytica
DAPSSPRSF

SEQ ID NO: 2610234 - protein, 8 aa, Entamoeba histolytica
DAPTSVGK

SEQ ID NO: 2610235 - protein, 7 aa, Entamoeba histolytica
DAPYHDD

SEQ ID NO: 2610236 - protein, 7 aa, Entamoeba histolytica
DAQDSNF

SEQ ID NO: 2610237 - protein, 37 aa, Entamoeba histolytica
DAQKAAELKKKDLNKTAQNPSNSTKLSSSSSQQGEKV

SEQ ID NO: 2610238 - protein, 83 aa, Entamoeba histolytica
DAQKKAQESKAAADESKAKSAEAKRTAELAAQRAEESAQAADAANKAAEAANKAAEIAKADEEAAIARQKEAQAAEDEVTKAL

SEQ ID NO: 2610239 - protein, 14 aa, Entamoeba histolytica
DAQRQDTKDAGTLA

SEQ ID NO: 2610240 - protein, 8 aa, Entamoeba histolytica
DAQSPNEM

SEQ ID NO: 2610241 - protein, 4 aa, Entamoeba histolytica
DAQT

SEQ ID NO: 2610242 - protein, 18 aa, Entamoeba histolytica
DAQTGNNSIDENRKNQIK

SEQ ID NO: 2610243 - protein, 10 aa, Entamoeba histolytica
DARETNVKKQ

SEQ ID NO: 2610244 - protein, 9 aa, Entamoeba histolytica
DARKNSNSE

SEQ ID NO: 2610245 - protein, 6 aa, Entamoeba histolytica
DARPIK

SEQ ID NO: 2610246 - protein, 5 aa, Entamoeba histolytica
DARRG

SEQ ID NO: 2610247 - protein, 8 aa, Entamoeba histolytica
DARRSVSD

SEQ ID NO: 2610248 - protein, 7 aa, Entamoeba histolytica
DARRTHF

SEQ ID NO: 2610249 - protein, 7 aa, Entamoeba histolytica
DARTPAD

SEQ ID NO: 2610250 - protein, 10 aa, Entamoeba histolytica
DARVDSDELR

SEQ ID NO: 2610251 - protein, 6 aa, Entamoeba histolytica
DASARA

SEQ ID NO: 2610252 - protein, 8 aa, Entamoeba histolytica
DASCTSNE

SEQ ID NO: 2610253 - protein, 11 aa, Entamoeba histolytica
DASDKKNEKLN

SEQ ID NO: 2610254 - protein, 9 aa, Entamoeba histolytica
DASDQFNQI

SEQ ID NO: 2610255 - protein, 5 aa, Entamoeba histolytica
DASEE

SEQ ID NO: 2610256 - protein, 9 aa, Entamoeba histolytica
DASGRTPDV

SEQ ID NO: 2610257 - protein, 11 aa, Entamoeba histolytica
DASKAKRNKTN

SEQ ID NO: 2610258 - protein, 13 aa, Entamoeba histolytica
DASLQPTQKKQSC

SEQ ID NO: 2610259 - protein, 11 aa, Entamoeba histolytica
DASNGSTQLST

SEQ ID NO: 2610260 - protein, 10 aa, Entamoeba histolytica
DASNPPKPED

SEQ ID NO: 2610261 - protein, 6 aa, Entamoeba histolytica
DASQDE

SEQ ID NO: 2610262 - protein, 5 aa, Entamoeba histolytica
DASQH

SEQ ID NO: 2610263 - protein, 15 aa, Entamoeba histolytica
DASRRKSSSSESLSP

SEQ ID NO: 2610264 - protein, 7 aa, Entamoeba histolytica
DASSYTV

SEQ ID NO: 2610265 - protein, 20 aa, Entamoeba histolytica
DASTSTIKIEDDKPITKENV

SEQ ID NO: 2610266 - protein, 7 aa, Entamoeba histolytica
DATAGVY

SEQ ID NO: 2610267 - protein, 8 aa, Entamoeba histolytica
DATATSKQ

SEQ ID NO: 2610268 - protein, 7 aa, Entamoeba histolytica
DATEEQI

SEQ ID NO: 2610269 - protein, 5 aa, Entamoeba histolytica
DATEI

SEQ ID NO: 2610270 - protein, 10 aa, Entamoeba histolytica
DATEKGESIE

SEQ ID NO: 2610271 - protein, 11 aa, Entamoeba histolytica
DATEKSRITAT

SEQ ID NO: 2610272 - protein, 8 aa, Entamoeba histolytica
DATHGQQD

SEQ ID NO: 2610273 - protein, 5 aa, Entamoeba histolytica
DATIQ

SEQ ID NO: 2610274 - protein, 10 aa, Entamoeba histolytica
DATKPLTTQY

SEQ ID NO: 2610275 - protein, 7 aa, Entamoeba histolytica
DATPNDR

SEQ ID NO: 2610276 - protein, 13 aa, Entamoeba histolytica
DATPQLSTPQSGL

SEQ ID NO: 2610277 - protein, 7 aa, Entamoeba histolytica
DATQAMG

SEQ ID NO: 2610278 - protein, 4 aa, Entamoeba histolytica
DATS

SEQ ID NO: 2610279 - protein, 4 aa, Entamoeba histolytica
DATT

SEQ ID NO: 2610280 - protein, 6 aa, Entamoeba histolytica
DATTTY

SEQ ID NO: 2610281 - protein, 7 aa, Entamoeba histolytica
DAVEEDK

SEQ ID NO: 2610282 - protein, 9 aa, Entamoeba histolytica
DAVEQAKGK

SEQ ID NO: 2610283 - protein, 6 aa, Entamoeba histolytica
DAVKNS

SEQ ID NO: 2610284 - protein, 8 aa, Entamoeba histolytica
DAVNKATE

SEQ ID NO: 2610285 - protein, 5 aa, Entamoeba histolytica
DAVPD

SEQ ID NO: 2610286 - protein, 5 aa, Entamoeba histolytica
DAVPG

SEQ ID NO: 2610287 - protein, 7 aa, Entamoeba histolytica
DAVPGFN

SEQ ID NO: 2610288 - protein, 8 aa, Entamoeba histolytica
DAVPGYNT

SEQ ID NO: 2610289 - protein, 7 aa, Entamoeba histolytica
DAYDSLT

SEQ ID NO: 2610290 - protein, 7 aa, Entamoeba histolytica
DCDIETR

SEQ ID NO: 2610291 - protein, 5 aa, Entamoeba histolytica
DCDKP

SEQ ID NO: 2610292 - protein, 9 aa, Entamoeba histolytica
DCDNSGNTA

SEQ ID NO: 2610293 - protein, 4 aa, Entamoeba histolytica
DCEN

SEQ ID NO: 2610294 - protein, 5 aa, Entamoeba histolytica
DCETP

SEQ ID NO: 2610295 - protein, 15 aa, Entamoeba histolytica
DCGGHDHSKEDGRWK

SEQ ID NO: 2610296 - protein, 6 aa, Entamoeba histolytica
DCGLPK

SEQ ID NO: 2610297 - protein, 8 aa, Entamoeba histolytica
DCGPKTSA

SEQ ID NO: 2610298 - protein, 8 aa, Entamoeba histolytica
DCKEIASA

SEQ ID NO: 2610299 - protein, 6 aa, Entamoeba histolytica
DCLGEK

SEQ ID NO: 2610300 - protein, 15 aa, Entamoeba histolytica
DCLSEEELKKAQEDL

SEQ ID NO: 2610301 - protein, 7 aa, Entamoeba histolytica
DCNEEIS

SEQ ID NO: 2610302 - protein, 9 aa, Entamoeba histolytica
DCNGKKERE

SEQ ID NO: 2610303 - protein, 8 aa, Entamoeba histolytica
DCNSDKDI

SEQ ID NO: 2610304 - protein, 8 aa, Entamoeba histolytica
DCPDGTKQ

SEQ ID NO: 2610305 - protein, 59 aa, Entamoeba histolytica
DCPNKRKKQTGDDDQDDYVSKRDIEEKGFKSGDGDEEKPIKPTKSEQDEVPKKKKKVIK

SEQ ID NO: 2610306 - protein, 5 aa, Entamoeba histolytica
DCQIS

SEQ ID NO: 2610307 - protein, 4 aa, Entamoeba histolytica
DCSK

SEQ ID NO: 2610308 - protein, 8 aa, Entamoeba histolytica
DCSNNNSL

SEQ ID NO: 2610309 - protein, 9 aa, Entamoeba histolytica
DCSNSEDYS

SEQ ID NO: 2610310 - protein, 8 aa, Entamoeba histolytica
DCSSESTE

SEQ ID NO: 2610311 - protein, 4 aa, Entamoeba histolytica
DCTG

SEQ ID NO: 2610312 - protein, 8 aa, Entamoeba histolytica
DCTGEKMN

SEQ ID NO: 2610313 - protein, 18 aa, Entamoeba histolytica
DCTPEEKYAGNQRSKELT

SEQ ID NO: 2610314 - protein, 8 aa, Entamoeba histolytica
DCTSQPSM

SEQ ID NO: 2610315 - protein, 4 aa, Entamoeba histolytica
DCTT

SEQ ID NO: 2610316 - protein, 7 aa, Entamoeba histolytica
DCVTGPK

SEQ ID NO: 2610317 - protein, 5 aa, Entamoeba histolytica
DDAAK

SEQ ID NO: 2610318 - protein, 6 aa, Entamoeba histolytica
DDAESK

SEQ ID NO: 2610319 - protein, 7 aa, Entamoeba histolytica
DDAKDAM

SEQ ID NO: 2610320 - protein, 15 aa, Entamoeba histolytica
DDAKNEAVKKRKEAE

SEQ ID NO: 2610321 - protein, 5 aa, Entamoeba histolytica
DDAKT

SEQ ID NO: 2610322 - protein, 20 aa, Entamoeba histolytica
DDANNKYKKNFEIPKKSMEE

SEQ ID NO: 2610323 - protein, 7 aa, Entamoeba histolytica
DDASKIV

SEQ ID NO: 2610324 - protein, 6 aa, Entamoeba histolytica
DDASSV

SEQ ID NO: 2610325 - protein, 6 aa, Entamoeba histolytica
DDAYTQ

SEQ ID NO: 2610326 - protein, 6 aa, Entamoeba histolytica
DDCSRN

SEQ ID NO: 2610327 - protein, 8 aa, Entamoeba histolytica
DDCSSCDD

SEQ ID NO: 2610328 - protein, 5 aa, Entamoeba histolytica
DDCTE

SEQ ID NO: 2610329 - protein, 10 aa, Entamoeba histolytica
DDCTSQEYEV

SEQ ID NO: 2610330 - protein, 38 aa, Entamoeba histolytica
DDDDDDCSSISMNDDSSTSASEIEIEKGEKKKGDNVNN

SEQ ID NO: 2610331 - protein, 9 aa, Entamoeba histolytica
DDDDDEYRN

SEQ ID NO: 2610332 - protein, 9 aa, Entamoeba histolytica
DDDDDYDDY

SEQ ID NO: 2610333 - protein, 19 aa, Entamoeba histolytica
DDDDEDKLEKESDEPGDNK

SEQ ID NO: 2610334 - protein, 10 aa, Entamoeba histolytica
DDDDENQIQR

SEQ ID NO: 2610335 - protein, 32 aa, Entamoeba histolytica
DDDDESSQETTSEQDDNNNDMTRSMSMFNFHH

SEQ ID NO: 2610336 - protein, 13 aa, Entamoeba histolytica
DDDDFDEDDFQEQ

SEQ ID NO: 2610337 - protein, 15 aa, Entamoeba histolytica
DDDDNSSLTDVTEDD

SEQ ID NO: 2610338 - protein, 6 aa, Entamoeba histolytica
DDDDTR

SEQ ID NO: 2610339 - protein, 5 aa, Entamoeba histolytica
DDDEA

SEQ ID NO: 2610340 - protein, 7 aa, Entamoeba histolytica
DDDEDLD

SEQ ID NO: 2610341 - protein, 7 aa, Entamoeba histolytica
DDDELKS

SEQ ID NO: 2610342 - protein, 56 aa, Entamoeba histolytica
DDDESLETNPEEESNKEEIKKEETNNKEETKKEETNEGCKDQGDGDSCVTERSQSP

SEQ ID NO: 2610343 - protein, 20 aa, Entamoeba histolytica
DDDGFQSDNNSSNKLNDQTE

SEQ ID NO: 2610344 - protein, 7 aa, Entamoeba histolytica
DDDIDSQ

SEQ ID NO: 2610345 - protein, 4 aa, Entamoeba histolytica
DDDL

SEQ ID NO: 2610346 - protein, 7 aa, Entamoeba histolytica
DDDLNSL

SEQ ID NO: 2610347 - protein, 9 aa, Entamoeba histolytica
DDDLREQRY

SEQ ID NO: 2610348 - protein, 6 aa, Entamoeba histolytica
DDDLRQ

SEQ ID NO: 2610349 - protein, 19 aa, Entamoeba histolytica
DDDNVGKTQSCNTSGVAND

SEQ ID NO: 2610350 - protein, 17 aa, Entamoeba histolytica
DDDNVGPIKPAQQQHNQ

SEQ ID NO: 2610351 - protein, 5 aa, Entamoeba histolytica
DDDQR

SEQ ID NO: 2610352 - protein, 8 aa, Entamoeba histolytica
DDDQRSKF

SEQ ID NO: 2610353 - protein, 8 aa, Entamoeba histolytica
DDDRTESF

SEQ ID NO: 2610354 - protein, 8 aa, Entamoeba histolytica
DDDSDKTN

SEQ ID NO: 2610355 - protein, 9 aa, Entamoeba histolytica
DDDTTSSSR

SEQ ID NO: 2610356 - protein, 4 aa, Entamoeba histolytica
DDDY

SEQ ID NO: 2610357 - protein, 5 aa, Entamoeba histolytica
DDDYE

SEQ ID NO: 2610358 - protein, 16 aa, Entamoeba histolytica
DDDYGYSQPKRPVKAD

SEQ ID NO: 2610359 - protein, 20 aa, Entamoeba histolytica
DDEALETKRSMSEKEKQNIF

SEQ ID NO: 2610360 - protein, 4 aa, Entamoeba histolytica
DDEC

SEQ ID NO: 2610361 - protein, 22 aa, Entamoeba histolytica
DDEDDEVPIRPHTTEGVTNGPS

SEQ ID NO: 2610362 - protein, 6 aa, Entamoeba histolytica
DDEDEI

SEQ ID NO: 2610363 - protein, 9 aa, Entamoeba histolytica
DDEDKGVVT

SEQ ID NO: 2610364 - protein, 10 aa, Entamoeba histolytica
DDEDNPPIPP

SEQ ID NO: 2610365 - protein, 22 aa, Entamoeba histolytica
DDEDREVQRRIEEEKKRREEEL

SEQ ID NO: 2610366 - protein, 26 aa, Entamoeba histolytica
DDEDSIGESSEMFPDAEQTKIKQRSY

SEQ ID NO: 2610367 - protein, 4 aa, Entamoeba histolytica
DDEE

SEQ ID NO: 2610368 - protein, 5 aa, Entamoeba histolytica
DDEEA

SEQ ID NO: 2610369 - protein, 21 aa, Entamoeba histolytica
DDEEEKTETETQKDNRKRTGQ

SEQ ID NO: 2610370 - protein, 9 aa, Entamoeba histolytica
DDEEPPLDY

SEQ ID NO: 2610371 - protein, 24 aa, Entamoeba histolytica
DDEETDNLKEEKQDEHIKQTKKKI

SEQ ID NO: 2610372 - protein, 13 aa, Entamoeba histolytica
DDEEYDYTDDDDD

SEQ ID NO: 2610373 - protein, 5 aa, Entamoeba histolytica
DDEGK

SEQ ID NO: 2610374 - protein, 8 aa, Entamoeba histolytica
DDEGNEEY

SEQ ID NO: 2610375 - protein, 9 aa, Entamoeba histolytica
DDEIDERDD

SEQ ID NO: 2610376 - protein, 12 aa, Entamoeba histolytica
DDEIGAEKSVEK

SEQ ID NO: 2610377 - protein, 8 aa, Entamoeba histolytica
DDEIGEKM

SEQ ID NO: 2610378 - protein, 14 aa, Entamoeba histolytica
DDEKDQTHIHILLD

SEQ ID NO: 2610379 - protein, 11 aa, Entamoeba histolytica
DDEKGENNKKI

SEQ ID NO: 2610380 - protein, 7 aa, Entamoeba histolytica
DDEKQQY

SEQ ID NO: 2610381 - protein, 9 aa, Entamoeba histolytica
DDEKQYEEL

SEQ ID NO: 2610382 - protein, 6 aa, Entamoeba histolytica
DDEKVY

SEQ ID NO: 2610383 - protein, 9 aa, Entamoeba histolytica
DDELGNSKF

SEQ ID NO: 2610384 - protein, 9 aa, Entamoeba histolytica
DDELGQSKF

SEQ ID NO: 2610385 - protein, 7 aa, Entamoeba histolytica
DDELKQK

SEQ ID NO: 2610386 - protein, 13 aa, Entamoeba histolytica
DDEMKNKIKEMKE

SEQ ID NO: 2610387 - protein, 14 aa, Entamoeba histolytica
DDEMSISSGPGVDA

SEQ ID NO: 2610388 - protein, 63 aa, Entamoeba histolytica
DDENDNGSVEEIQSDSTDEEMSEEDEEMFEEDEEDEDPKPKRKTRSSKKEKSDDSFIVDDDEI

SEQ ID NO: 2610389 - protein, 6 aa, Entamoeba histolytica
DDENQS

SEQ ID NO: 2610390 - protein, 8 aa, Entamoeba histolytica
DDEPNEKM

SEQ ID NO: 2610391 - protein, 8 aa, Entamoeba histolytica
DDEQDVSS

SEQ ID NO: 2610392 - protein, 9 aa, Entamoeba histolytica
DDEQQTKVA

SEQ ID NO: 2610393 - protein, 6 aa, Entamoeba histolytica
DDEQVR

SEQ ID NO: 2610394 - protein, 7 aa, Entamoeba histolytica
DDERNEI

SEQ ID NO: 2610395 - protein, 11 aa, Entamoeba histolytica
DDETAKNNQLK

SEQ ID NO: 2610396 - protein, 7 aa, Entamoeba histolytica
DDETATK

SEQ ID NO: 2610397 - protein, 16 aa, Entamoeba histolytica
DDETEETQKQPLPEND

SEQ ID NO: 2610398 - protein, 16 aa, Entamoeba histolytica
DDETISVSSHSTQKTT

SEQ ID NO: 2610399 - protein, 13 aa, Entamoeba histolytica
DDETQHKTSPITS

SEQ ID NO: 2610400 - protein, 11 aa, Entamoeba histolytica
DDEYDPENKEV

SEQ ID NO: 2610401 - protein, 11 aa, Entamoeba histolytica
DDEYPSGEIEI

SEQ ID NO: 2610402 - protein, 6 aa, Entamoeba histolytica
DDEYQN

SEQ ID NO: 2610403 - protein, 5 aa, Entamoeba histolytica
DDEYS

SEQ ID NO: 2610404 - protein, 8 aa, Entamoeba histolytica
DDFDNASA

SEQ ID NO: 2610405 - protein, 5 aa, Entamoeba histolytica
DDFGN

SEQ ID NO: 2610406 - protein, 7 aa, Entamoeba histolytica
DDFPSTF

SEQ ID NO: 2610407 - protein, 13 aa, Entamoeba histolytica
DDFSDETDKTEKL

SEQ ID NO: 2610408 - protein, 22 aa, Entamoeba histolytica
DDFSQEKFHGQKEESMKQKESV

SEQ ID NO: 2610409 - protein, 10 aa, Entamoeba histolytica
DDGDKTHCNW

SEQ ID NO: 2610410 - protein, 4 aa, Entamoeba histolytica
DDGE

SEQ ID NO: 2610411 - protein, 9 aa, Entamoeba histolytica
DDGEHAAGK

SEQ ID NO: 2610412 - protein, 6 aa, Entamoeba histolytica
DDGENI

SEQ ID NO: 2610413 - protein, 11 aa, Entamoeba histolytica
DDGFKPDSYGK

SEQ ID NO: 2610414 - protein, 7 aa, Entamoeba histolytica
DDGIDLE

SEQ ID NO: 2610415 - protein, 5 aa, Entamoeba histolytica
DDGIQ

SEQ ID NO: 2610416 - protein, 4 aa, Entamoeba histolytica
DDGK

SEQ ID NO: 2610417 - protein, 23 aa, Entamoeba histolytica
DDGKGFEREKLDGSEKKDLPSPF

SEQ ID NO: 2610418 - protein, 4 aa, Entamoeba histolytica
DDGL

SEQ ID NO: 2610419 - protein, 10 aa, Entamoeba histolytica
DDGLPRPGEV

SEQ ID NO: 2610420 - protein, 7 aa, Entamoeba histolytica
DDGNATI

SEQ ID NO: 2610421 - protein, 10 aa, Entamoeba histolytica
DDGNKQGDKT

SEQ ID NO: 2610422 - protein, 6 aa, Entamoeba histolytica
DDGNQI

SEQ ID NO: 2610423 - protein, 9 aa, Entamoeba histolytica
DDGNSIKDT

SEQ ID NO: 2610424 - protein, 5 aa, Entamoeba histolytica
DDGNV

SEQ ID NO: 2610425 - protein, 13 aa, Entamoeba histolytica
DDGQGLERKRHVG

SEQ ID NO: 2610426 - protein, 7 aa, Entamoeba histolytica
DDGRRLA

SEQ ID NO: 2610427 - protein, 6 aa, Entamoeba histolytica
DDGSDF

SEQ ID NO: 2610428 - protein, 7 aa, Entamoeba histolytica
DDGSVTA

SEQ ID NO: 2610429 - protein, 6 aa, Entamoeba histolytica
DDGTFT

SEQ ID NO: 2610430 - protein, 9 aa, Entamoeba histolytica
DDHEIKESP

SEQ ID NO: 2610431 - protein, 25 aa, Entamoeba histolytica
DDHNKQITPFSNTQNSEYLDNSYSK

SEQ ID NO: 2610432 - protein, 13 aa, Entamoeba histolytica
DDHNQNNGNGEED

SEQ ID NO: 2610433 - protein, 5 aa, Entamoeba histolytica
DDHVN

SEQ ID NO: 2610434 - protein, 5 aa, Entamoeba histolytica
DDIDH

SEQ ID NO: 2610435 - protein, 7 aa, Entamoeba histolytica
DDIDSTV

SEQ ID NO: 2610436 - protein, 8 aa, Entamoeba histolytica
DDIEDYNG

SEQ ID NO: 2610437 - protein, 16 aa, Entamoeba histolytica
DDIEETKRIIGDIDIN

SEQ ID NO: 2610438 - protein, 10 aa, Entamoeba histolytica
DDIEKEDKRF

SEQ ID NO: 2610439 - protein, 5 aa, Entamoeba histolytica
DDIGS

SEQ ID NO: 2610440 - protein, 6 aa, Entamoeba histolytica
DDIGTD

SEQ ID NO: 2610441 - protein, 7 aa, Entamoeba histolytica
DDIGTSE

SEQ ID NO: 2610442 - protein, 8 aa, Entamoeba histolytica
DDIHQKER

SEQ ID NO: 2610443 - protein, 4 aa, Entamoeba histolytica
DDIN

SEQ ID NO: 2610444 - protein, 4 aa, Entamoeba histolytica
DDIP

SEQ ID NO: 2610445 - protein, 5 aa, Entamoeba histolytica
DDIQK

SEQ ID NO: 2610446 - protein, 15 aa, Entamoeba histolytica
DDIQQVKENTTNAYY

SEQ ID NO: 2610447 - protein, 20 aa, Entamoeba histolytica
DDIQRRENEIREREGEVRRR

SEQ ID NO: 2610448 - protein, 5 aa, Entamoeba histolytica
DDIRS

SEQ ID NO: 2610449 - protein, 9 aa, Entamoeba histolytica
DDISKSEAL

SEQ ID NO: 2610450 - protein, 13 aa, Entamoeba histolytica
DDISRNDSTDFES

SEQ ID NO: 2610451 - protein, 6 aa, Entamoeba histolytica
DDITDE

SEQ ID NO: 2610452 - protein, 33 aa, Entamoeba histolytica
DDKCQTKDGSLYDPSSCKQYSLSEQSRKPIITN

SEQ ID NO: 2610453 - protein, 11 aa, Entamoeba histolytica
DDKDGSNNFPG

SEQ ID NO: 2610454 - protein, 8 aa, Entamoeba histolytica
DDKEDDTV

SEQ ID NO: 2610455 - protein, 28 aa, Entamoeba histolytica
DDKEEEQPNEAVPAVEETPIEDSKMEEV

SEQ ID NO: 2610456 - protein, 13 aa, Entamoeba histolytica
DDKEEEQPTEAVP

SEQ ID NO: 2610457 - protein, 43 aa, Entamoeba histolytica
DDKEEKNENNLEGEKESAKKEDNTEEEEKKSIKSKTSKTEVIN

SEQ ID NO: 2610458 - protein, 12 aa, Entamoeba histolytica
DDKEKDSTAIEP

SEQ ID NO: 2610459 - protein, 5 aa, Entamoeba histolytica
DDKGN

SEQ ID NO: 2610460 - protein, 58 aa, Entamoeba histolytica
DDKGVDTEDSPSSEISIGSENESFSNDNSQPKDKTINDSQEKEEKKRNICNEKGSIHE

SEQ ID NO: 2610461 - protein, 11 aa, Entamoeba histolytica
DDKHETLTTRE

SEQ ID NO: 2610462 - protein, 7 aa, Entamoeba histolytica
DDKINKR

SEQ ID NO: 2610463 - protein, 8 aa, Entamoeba histolytica
DDKKDYAD

SEQ ID NO: 2610464 - protein, 9 aa, Entamoeba histolytica
DDKKESYRE

SEQ ID NO: 2610465 - protein, 10 aa, Entamoeba histolytica
DDKKPKHSQE

SEQ ID NO: 2610466 - protein, 6 aa, Entamoeba histolytica
DDKNEE

SEQ ID NO: 2610467 - protein, 32 aa, Entamoeba histolytica; identical to SEQ ID NO: 2414889

SEQ ID NO: 2610468 - protein, 8 aa, Entamoeba histolytica
DDKNKSFS

SEQ ID NO: 2610469 - protein, 13 aa, Entamoeba histolytica
DDKNNTRQAKSDC

SEQ ID NO: 2610470 - protein, 7 aa, Entamoeba histolytica
DDKSFNG

SEQ ID NO: 2610471 - protein, 5 aa, Entamoeba histolytica
DDKSK

SEQ ID NO: 2610472 - protein, 10 aa, Entamoeba histolytica
DDKSSKPVEV

SEQ ID NO: 2610473 - protein, 8 aa, Entamoeba histolytica
DDKSYQKL

SEQ ID NO: 2610474 - protein, 4 aa, Entamoeba histolytica
DDKT

SEQ ID NO: 2610475 - protein, 16 aa, Entamoeba histolytica
DDKTKKIEIKNEKERT

SEQ ID NO: 2610476 - protein, 10 aa, Entamoeba histolytica
DDKTNLTEIG

SEQ ID NO: 2610477 - protein, 9 aa, Entamoeba histolytica
DDKTPPSPL

SEQ ID NO: 2610478 - protein, 7 aa, Entamoeba histolytica
DDKTTKH

SEQ ID NO: 2610479 - protein, 4 aa, Entamoeba histolytica
DDKV

SEQ ID NO: 2610480 - protein, 8 aa, Entamoeba histolytica
DDKYEEKL

SEQ ID NO: 2610481 - protein, 13 aa, Entamoeba histolytica
DDKYQMVGGGNAL

SEQ ID NO: 2610482 - protein, 20 aa, Entamoeba histolytica
DDLDSNIERNSNEIEKQEDL

SEQ ID NO: 2610483 - protein, 10 aa, Entamoeba histolytica
DDLENSEAKE

SEQ ID NO: 2610484 - protein, 5 aa, Entamoeba histolytica
DDLGY

SEQ ID NO: 2610485 - protein, 16 aa, Entamoeba histolytica
DDLKKIDDKYKTHCQG

SEQ ID NO: 2610486 - protein, 4 aa, Entamoeba histolytica
DDLL

SEQ ID NO: 2610487 - protein, 6 aa, Entamoeba histolytica
DDLNGT

SEQ ID NO: 2610488 - protein, 24 aa, Entamoeba histolytica
DDLPPSPSQHQPNPHSCSSKKCCL

SEQ ID NO: 2610489 - protein, 8 aa, Entamoeba histolytica
DDLQPSNV

SEQ ID NO: 2610490 - protein, 4 aa, Entamoeba histolytica
DDLR

SEQ ID NO: 2610491 - protein, 7 aa, Entamoeba histolytica
DDLSGAD

SEQ ID NO: 2610492 - protein, 26 aa, Entamoeba histolytica
DDLSKDDSEDDTLDQTDSEDDSNTPF

SEQ ID NO: 2610493 - protein, 13 aa, Entamoeba histolytica
DDLSTNKSIRNSI

SEQ ID NO: 2610494 - protein, 13 aa, Entamoeba histolytica
DDLTKQRGKQYKM

SEQ ID NO: 2610495 - protein, 4 aa, Entamoeba histolytica
DDLY

SEQ ID NO: 2610496 - protein, 10 aa, Entamoeba histolytica
DDMDQEPVKS

SEQ ID NO: 2610497 - protein, 9 aa, Entamoeba histolytica
DDMGDDTID

SEQ ID NO: 2610498 - protein, 9 aa, Entamoeba histolytica
DDMGDNTID

SEQ ID NO: 2610499 - protein, 5 aa, Entamoeba histolytica
DDMKN

SEQ ID NO: 2610500 - protein, 6 aa, Entamoeba histolytica
DDMNSS

SEQ ID NO: 2610501 - protein, 6 aa, Entamoeba histolytica
DDMRAD

SEQ ID NO: 2610502 - protein, 5 aa, Entamoeba histolytica
DDNAI

SEQ ID NO: 2610503 - protein, 5 aa, Entamoeba histolytica
DDNDS

SEQ ID NO: 2610504 - protein, 5 aa, Entamoeba histolytica
DDNEI

SEQ ID NO: 2610505 - protein, 14 aa, Entamoeba histolytica
DDNENKTKTPELPD

SEQ ID NO: 2610506 - protein, 6 aa, Entamoeba histolytica
DDNIGN

SEQ ID NO: 2610507 - protein, 21 aa, Entamoeba histolytica
DDNIKSDNQEKEKLTAEQTKK

SEQ ID NO: 2610508 - protein, 8 aa, Entamoeba histolytica
DDNKDEEL

SEQ ID NO: 2610509 - protein, 5 aa, Entamoeba histolytica
DDNKS

SEQ ID NO: 2610510 - protein, 5 aa, Entamoeba histolytica
DDNLT

SEQ ID NO: 2610511 - protein, 11 aa, Entamoeba histolytica
DDNPKQSNGYD

SEQ ID NO: 2610512 - protein, 5 aa, Entamoeba histolytica
DDNPY

SEQ ID NO: 2610513 - protein, 4 aa, Entamoeba histolytica
DDNQ

SEQ ID NO: 2610514 - protein, 7 aa, Entamoeba histolytica
DDNRTEC

SEQ ID NO: 2610515 - protein, 10 aa, Entamoeba histolytica
DDNSEIRNPK

SEQ ID NO: 2610516 - protein, 7 aa, Entamoeba histolytica
DDNSLPD

SEQ ID NO: 2610517 - protein, 10 aa, Entamoeba histolytica
DDNSSFTHSH

SEQ ID NO: 2610518 - protein, 16 aa, Entamoeba histolytica
DDNTEAKRKLTDFGSA

SEQ ID NO: 2610519 - protein, 8 aa, Entamoeba histolytica
DDNTPINY

SEQ ID NO: 2610520 - protein, 9 aa, Entamoeba histolytica
DDNVKKAKF

SEQ ID NO: 2610521 - protein, 6 aa, Entamoeba histolytica
DDNYSD

SEQ ID NO: 2610522 - protein, 7 aa, Entamoeba histolytica
DDPDHPF

SEQ ID NO: 2610523 - protein, 5 aa, Entamoeba histolytica
DDPDI

SEQ ID NO: 2610524 - protein, 15 aa, Entamoeba histolytica
DDPDVIPGDTIEPET

SEQ ID NO: 2610525 - protein, 6 aa, Entamoeba histolytica
DDPEDV

SEQ ID NO: 2610526 - protein, 9 aa, Entamoeba histolytica
DDPENTAIG

SEQ ID NO: 2610527 - protein, 6 aa, Entamoeba histolytica
DDPGDL

SEQ ID NO: 2610528 - protein, 13 aa, Entamoeba histolytica
DDPHVKEAKPNPQ

SEQ ID NO: 2610529 - protein, 4 aa, Entamoeba histolytica
DDPI

SEQ ID NO: 2610530 - protein, 7 aa, Entamoeba histolytica
DDPKKYY

SEQ ID NO: 2610531 - protein, 8 aa, Entamoeba histolytica
DDPNPIAK

SEQ ID NO: 2610532 - protein, 8 aa, Entamoeba histolytica
DDPNYSNS

SEQ ID NO: 2610533 - protein, 6 aa, Entamoeba histolytica
DDPNYY

SEQ ID NO: 2610534 - protein, 5 aa, Entamoeba histolytica
DDPQL

SEQ ID NO: 2610535 - protein, 8 aa, Entamoeba histolytica
DDPSFTNS

SEQ ID NO: 2610536 - protein, 8 aa, Entamoeba histolytica
DDPSGNSF

SEQ ID NO: 2610537 - protein, 11 aa, Entamoeba histolytica
DDPSVPEEAKN

SEQ ID NO: 2610538 - protein, 6 aa, Entamoeba histolytica
DDPTEI

SEQ ID NO: 2610539 - protein, 8 aa, Entamoeba histolytica
DDPTGLGD

SEQ ID NO: 2610540 - protein, 15 aa, Entamoeba histolytica
DDPTLPDDEKDSASL

SEQ ID NO: 2610541 - protein, 5 aa, Entamoeba histolytica
DDPTN

SEQ ID NO: 2610542 - protein, 4 aa, Entamoeba histolytica
DDPV

SEQ ID NO: 2610543 - protein, 5 aa, Entamoeba histolytica
DDPYQ

SEQ ID NO: 2610544 - protein, 6 aa, Entamoeba histolytica
DDQDQE

SEQ ID NO: 2610545 - protein, 7 aa, Entamoeba histolytica
DDQDSFK

SEQ ID NO: 2610546 - protein, 16 aa, Entamoeba histolytica
DDQEEYHSDEDLLDEE

SEQ ID NO: 2610547 - protein, 5 aa, Entamoeba histolytica
DDQGS

SEQ ID NO: 2610548 - protein, 23 aa, Entamoeba histolytica
DDQIDEGDMSIEEGNVIDEEDDV

SEQ ID NO: 2610549 - protein, 6 aa, Entamoeba histolytica
DDQNND

SEQ ID NO: 2610550 - protein, 8 aa, Entamoeba histolytica
DDQNPSKY

SEQ ID NO: 2610551 - protein, 35 aa, Entamoeba histolytica
DDQPSSTTNISAKENDIKENDTEHKEQVKSDDTTV

SEQ ID NO: 2610552 - protein, 8 aa, Entamoeba histolytica
DDQQVKKN

SEQ ID NO: 2610553 - protein, 7 aa, Entamoeba histolytica
DDQREQV

SEQ ID NO: 2610554 - protein, 8 aa, Entamoeba histolytica
DDQRRNQL

SEQ ID NO: 2610555 - protein, 5 aa, Entamoeba histolytica
DDQSY

SEQ ID NO: 2610556 - protein, 8 aa, Entamoeba histolytica
DDRATGIK

SEQ ID NO: 2610557 - protein, 4 aa, Entamoeba histolytica
DDRK

SEQ ID NO: 2610558 - protein, 25 aa, Entamoeba histolytica
DDRKKVLQNTRSQYSIGKSTCNNEE

SEQ ID NO: 2610559 - protein, 37 aa, Entamoeba histolytica
DDRKNRTLTMSQRSDAFNAAKNIRQKKVQQLDRSTSM

SEQ ID NO: 2610560 - protein, 16 aa, Entamoeba histolytica
DDRMSAEKALEHPFFN

SEQ ID NO: 2610561 - protein, 7 aa, Entamoeba histolytica
DDRNDSI

SEQ ID NO: 2610562 - protein, 5 aa, Entamoeba histolytica
DDRPN

SEQ ID NO: 2610563 - protein, 11 aa, Entamoeba histolytica
DDRSLQRSSFG

SEQ ID NO: 2610564 - protein, 13 aa, Entamoeba histolytica
DDRSYGKLLSSFI

SEQ ID NO: 2610565 - protein, 4 aa, Entamoeba histolytica
DDRT

SEQ ID NO: 2610566 - protein, 21 aa, Entamoeba histolytica
DDSEAGGSECADEPNERAEIQ

SEQ ID NO: 2610567 - protein, 7 aa, Entamoeba histolytica
DDSEDNN

SEQ ID NO: 2610568 - protein, 12 aa, Entamoeba histolytica
DDSENAGFTSGN

SEQ ID NO: 2610569 - protein, 4 aa, Entamoeba histolytica
DDSF

SEQ ID NO: 2610570 - protein, 6 aa, Entamoeba histolytica
DDSGEF

SEQ ID NO: 2610571 - protein, 19 aa, Entamoeba histolytica
DDSGNQIIKNEGEKSQHGF

SEQ ID NO: 2610572 - protein, 10 aa, Entamoeba histolytica
DDSGPKTDIL

SEQ ID NO: 2610573 - protein, 4 aa, Entamoeba histolytica
DDSI

SEQ ID NO: 2610574 - protein, 10 aa, Entamoeba histolytica
DDSKDGDALS

SEQ ID NO: 2610575 - protein, 6 aa, Entamoeba histolytica
DDSKKN

SEQ ID NO: 2610576 - protein, 6 aa, Entamoeba histolytica
DDSKNG

SEQ ID NO: 2610577 - protein, 63 aa, Entamoeba histolytica
DDSKRKGANAPPPPPPAGAPPPPSGGMPPPPPPPAGAPPPPVGMPPPPSNHSMPKPSSAGRGD

SEQ ID NO: 2610578 - protein, 6 aa, Entamoeba histolytica
DDSKTK

SEQ ID NO: 2610579 - protein, 7 aa, Entamoeba histolytica
DDSMPLP

SEQ ID NO: 2610580 - protein, 8 aa, Entamoeba histolytica
DDSNNHEL

SEQ ID NO: 2610581 - protein, 7 aa, Entamoeba histolytica
DDSNQVL

SEQ ID NO: 2610582 - protein, 12 aa, Entamoeba histolytica
DDSQNDSVHSSN

SEQ ID NO: 2610583 - protein, 9 aa, Entamoeba histolytica
DDSSCSSSC

SEQ ID NO: 2610584 - protein, 20 aa, Entamoeba histolytica
DDSSEDSETISPNEETDISS

SEQ ID NO: 2610585 - protein, 22 aa, Entamoeba histolytica
DDSSEESNSSFTSPVKTQPCSF

SEQ ID NO: 2610586 - protein, 9 aa, Entamoeba histolytica
DDSSEYSDT

SEQ ID NO: 2610587 - protein, 5 aa, Entamoeba histolytica
DDSSI

SEQ ID NO: 2610588 - protein, 8 aa, Entamoeba histolytica
DDSSPVAD

SEQ ID NO: 2610589 - protein, 9 aa, Entamoeba histolytica
DDSSSLKEW

SEQ ID NO: 2610590 - protein, 5 aa, Entamoeba histolytica
DDSSV

SEQ ID NO: 2610591 - protein, 13 aa, Entamoeba histolytica
DDSSVHHSKPAPD

SEQ ID NO: 2610592 - protein, 6 aa, Entamoeba histolytica
DDSTRL

SEQ ID NO: 2610593 - protein, 6 aa, Entamoeba histolytica
DDSVKE

SEQ ID NO: 2610594 - protein, 14 aa, Entamoeba histolytica
DDSVKRPDAKNKQE

SEQ ID NO: 2610595 - protein, 5 aa, Entamoeba histolytica
DDSVQ

SEQ ID NO: 2610596 - protein, 12 aa, Entamoeba histolytica
DDSYDQGTTEDN

SEQ ID NO: 2610597 - protein, 13 aa, Entamoeba histolytica
DDSYDSNDYPHSQ

SEQ ID NO: 2610598 - protein, 12 aa, Entamoeba histolytica
DDSYDSYEYPHS

SEQ ID NO: 2610599 - protein, 10 aa, Entamoeba histolytica
DDSYPRTNAK

SEQ ID NO: 2610600 - protein, 8 aa, Entamoeba histolytica
DDTCANPD

SEQ ID NO: 2610601 - protein, 13 aa, Entamoeba histolytica
DDTDTPCVSPPLP

SEQ ID NO: 2610602 - protein, 7 aa, Entamoeba histolytica
DDTGKIP

SEQ ID NO: 2610603 - protein, 5 aa, Entamoeba histolytica
DDTID

SEQ ID NO: 2610604 - protein, 10 aa, Entamoeba histolytica
DDTIKTPKTH

SEQ ID NO: 2610605 - protein, 5 aa, Entamoeba histolytica
DDTIN

SEQ ID NO: 2610606 - protein, 6 aa, Entamoeba histolytica
DDTISD

SEQ ID NO: 2610607 - protein, 8 aa, Entamoeba histolytica
DDTKEEYI

SEQ ID NO: 2610608 - protein, 14 aa, Entamoeba histolytica
DDTKRKQARQKQIT

SEQ ID NO: 2610609 - protein, 14 aa, Entamoeba histolytica
DDTKTINSVKTKQL

SEQ ID NO: 2610610 - protein, 4 aa, Entamoeba histolytica
DDTN

SEQ ID NO: 2610611 - protein, 7 aa, Entamoeba histolytica
DDTNSKV

SEQ ID NO: 2610612 - protein, 5 aa, Entamoeba histolytica
DDTPL

SEQ ID NO: 2610613 - protein, 9 aa, Entamoeba histolytica
DDTPTMQTS

SEQ ID NO: 2610614 - protein, 8 aa, Entamoeba histolytica
DDTRDQAA

SEQ ID NO: 2610615 - protein, 6 aa, Entamoeba histolytica
DDTRGQ

SEQ ID NO: 2610616 - protein, 9 aa, Entamoeba histolytica
DDTSMRNAL

SEQ ID NO: 2610617 - protein, 22 aa, Entamoeba histolytica
DDTSSSSSDLDDDIKQYIYHSD

SEQ ID NO: 2610618 - protein, 4 aa, Entamoeba histolytica
DDTT

SEQ ID NO: 2610619 - protein, 5 aa, Entamoeba histolytica
DDTTR

SEQ ID NO: 2610620 - protein, 15 aa, Entamoeba histolytica
DDTTTKTIKPSKNKD

SEQ ID NO: 2610621 - protein, 11 aa, Entamoeba histolytica
DDTVDGNPDIG

SEQ ID NO: 2610622 - protein, 7 aa, Entamoeba histolytica
DDTYGRG

SEQ ID NO: 2610623 - protein, 7 aa, Entamoeba histolytica
DDVAGAE

SEQ ID NO: 2610624 - protein, 9 aa, Entamoeba histolytica
DDVKGNNEC

SEQ ID NO: 2610625 - protein, 6 aa, Entamoeba histolytica
DDVKQL

SEQ ID NO: 2610626 - protein, 14 aa, Entamoeba histolytica
DDVNTKELQKLQGN

SEQ ID NO: 2610627 - protein, 13 aa, Entamoeba histolytica
DDVNTSDEESIDT

SEQ ID NO: 2610628 - protein, 14 aa, Entamoeba histolytica
DDVQPYEKKSFSPI

SEQ ID NO: 2610629 - protein, 17 aa, Entamoeba histolytica
DDYAQAKRISTSYEGEQ

SEQ ID NO: 2610630 - protein, 19 aa, Entamoeba histolytica
DDYDYTSDETIENNPDKIN

SEQ ID NO: 2610631 - protein, 7 aa, Entamoeba histolytica
DDYGKYY

SEQ ID NO: 2610632 - protein, 10 aa, Entamoeba histolytica
DDYKPSGNLY

SEQ ID NO: 2610633 - protein, 9 aa, Entamoeba histolytica
DDYNAISKY

SEQ ID NO: 2610634 - protein, 6 aa, Entamoeba histolytica
DDYPEF

SEQ ID NO: 2610635 - protein, 16 aa, Entamoeba histolytica
DDYSANPQRQESFPSI

SEQ ID NO: 2610636 - protein, 12 aa, Entamoeba histolytica
DDYYNQEDDGIE

SEQ ID NO: 2610637 - protein, 6 aa, Entamoeba histolytica
DEACEE

SEQ ID NO: 2610638 - protein, 12 aa, Entamoeba histolytica
DEADDTIPQNTT

SEQ ID NO: 2610639 - protein, 9 aa, Entamoeba histolytica
DEAEGKITN

SEQ ID NO: 2610640 - protein, 6 aa, Entamoeba histolytica
DEAETI

SEQ ID NO: 2610641 - protein, 18 aa, Entamoeba histolytica
DEAHENMDGLSDQAKAAL

SEQ ID NO: 2610642 - protein, 8 aa, Entamoeba histolytica
DEAKDEIN

SEQ ID NO: 2610643 - protein, 8 aa, Entamoeba histolytica
DEAKKAGF

SEQ ID NO: 2610644 - protein, 8 aa, Entamoeba histolytica
DEARTNYN

SEQ ID NO: 2610645 - protein, 79 aa, Entamoeba histolytica
DEASEKLPKLPTSQQKERIKNAKKQTKNSKKKVKEVKKQQKQEIKKAKKDMKETKKVEKETKKLAKKELKDEKKMTKGL

SEQ ID NO: 2610646 - protein, 5 aa, Entamoeba histolytica
DEASR

SEQ ID NO: 2610647 - protein, 7 aa, Entamoeba histolytica
DEASTRI

SEQ ID NO: 2610648 - protein, 9 aa, Entamoeba histolytica
DEAYGRNQG

SEQ ID NO: 2610649 - protein, 9 aa, Entamoeba histolytica
DECKNDKSC

SEQ ID NO: 2610650 - protein, 4 aa, Entamoeba histolytica
DECN

SEQ ID NO: 2610651 - protein, 8 aa, Entamoeba histolytica
DECNPKGI

SEQ ID NO: 2610652 - protein, 5 aa, Entamoeba histolytica
DEDAK

SEQ ID NO: 2610653 - protein, 12 aa, Entamoeba histolytica
DEDCEDSRDSDD

SEQ ID NO: 2610654 - protein, 9 aa, Entamoeba histolytica
DEDDDKPIK

SEQ ID NO: 2610655 - protein, 12 aa, Entamoeba histolytica
DEDDFGKDGLDS

SEQ ID NO: 2610656 - protein, 7 aa, Entamoeba histolytica
DEDDHVR

SEQ ID NO: 2610657 - protein, 6 aa, Entamoeba histolytica
DEDDLE

SEQ ID NO: 2610658 - protein, 8 aa, Entamoeba histolytica
DEDDVNEI

SEQ ID NO: 2610659 - protein, 7 aa, Entamoeba histolytica
DEDDYDY

SEQ ID NO: 2610660 - protein, 9 aa, Entamoeba histolytica
DEDEEQQPV

SEQ ID NO: 2610661 - protein, 45 aa, Entamoeba histolytica
DEDEEVQEKKSTSSSSSNSGDQYGQLETSDPSEQEAEDDYGTFEP

SEQ ID NO: 2610662 - protein, 5 aa, Entamoeba histolytica
DEDEG

SEQ ID NO: 2610663 - protein, 7 aa, Entamoeba histolytica
DEDEKDN

SEQ ID NO: 2610664 - protein, 15 aa, Entamoeba histolytica
DEDEWKRGKENETID

SEQ ID NO: 2610665 - protein, 28 aa, Entamoeba histolytica
DEDFDNSTQITDSTTQNHIDQKQTHQGF

SEQ ID NO: 2610666 - protein, 8 aa, Entamoeba histolytica
DEDGGNQE

SEQ ID NO: 2610667 - protein, 7 aa, Entamoeba histolytica
DEDGNSI

SEQ ID NO: 2610668 - protein, 10 aa, Entamoeba histolytica
DEDGRINEFE

SEQ ID NO: 2610669 - protein, 18 aa, Entamoeba histolytica
DEDGYSKNGRIGCTQPRR

SEQ ID NO: 2610670 - protein, 12 aa, Entamoeba histolytica
DEDHKEQLPTTE

SEQ ID NO: 2610671 - protein, 7 aa, Entamoeba histolytica
DEDKDGY

SEQ ID NO: 2610672 - protein, 6 aa, Entamoeba histolytica
DEDKIT

SEQ ID NO: 2610673 - protein, 8 aa, Entamoeba histolytica
DEDNNISK

SEQ ID NO: 2610674 - protein, 18 aa, Entamoeba histolytica
DEDNNTQENEKEEGIDYE

SEQ ID NO: 2610675 - protein, 49 aa, Entamoeba histolytica
DEDNTKQVKESNKTTETPKPKTIKKERRNKTQKKKTERNENEEESSTQI

SEQ ID NO: 2610676 - protein, 7 aa, Entamoeba histolytica
DEDQPKQ

SEQ ID NO: 2610677 - protein, 9 aa, Entamoeba histolytica
DEDSGDFET

SEQ ID NO: 2610678 - protein, 8 aa, Entamoeba histolytica
DEDSNNPI

SEQ ID NO: 2610679 - protein, 5 aa, Entamoeba histolytica
DEDSQ

SEQ ID NO: 2610680 - protein, 6 aa, Entamoeba histolytica
DEDSSL

SEQ ID NO: 2610681 - protein, 9 aa, Entamoeba histolytica
DEDSTTPFG

SEQ ID NO: 2610682 - protein, 5 aa, Entamoeba histolytica
DEDSV

SEQ ID NO: 2610683 - protein, 9 aa, Entamoeba histolytica
DEDTDEVGI

SEQ ID NO: 2610684 - protein, 5 aa, Entamoeba histolytica
DEDTE

SEQ ID NO: 2610685 - protein, 11 aa, Entamoeba histolytica
DEDTSKRNDSM

SEQ ID NO: 2610686 - protein, 13 aa, Entamoeba histolytica
DEDTTEESSDVES

SEQ ID NO: 2610687 - protein, 7 aa, Entamoeba histolytica
DEDTTKT

SEQ ID NO: 2610688 - protein, 8 aa, Entamoeba histolytica
DEDWTGDN

SEQ ID NO: 2610689 - protein, 30 aa, Entamoeba histolytica
DEDYAKNQQGFIPETSPTIPKITSSTRIEG

SEQ ID NO: 2610690 - protein, 13 aa, Entamoeba histolytica
DEDYEGGERKEFG

SEQ ID NO: 2610691 - protein, 5 aa, Entamoeba histolytica
DEEAG

SEQ ID NO: 2610692 - protein, 6 aa, Entamoeba histolytica
DEEANE

SEQ ID NO: 2610693 - protein, 4 aa, Entamoeba histolytica
DEED

SEQ ID NO: 2610694 - protein, 10 aa, Entamoeba histolytica
DEEDAGVGER

SEQ ID NO: 2610695 - protein, 8 aa, Entamoeba histolytica
DEEDASQA

SEQ ID NO: 2610696 - protein, 31 aa, Entamoeba histolytica
DEEDDEGDDDYDANKFEDYDQEDMSEEGHSE

SEQ ID NO: 2610697 - protein, 8 aa, Entamoeba histolytica
DEEDEEWN

SEQ ID NO: 2610698 - protein, 8 aa, Entamoeba histolytica
DEEDSSIE

SEQ ID NO: 2610699 - protein, 20 aa, Entamoeba histolytica
DEEEEEERIPMSSERESEEI

SEQ ID NO: 2610700 - protein, 19 aa, Entamoeba histolytica
DEEEEERIPMSSERESEEI

SEQ ID NO: 2610701 - protein, 46 aa, Entamoeba histolytica
DEEEENEEVDLEKDESEDEKMDEKADSGIVDDETIEKAKKEAQQRE

SEQ ID NO: 2610702 - protein, 12 aa, Entamoeba histolytica
DEEEKKEWTSYN

SEQ ID NO: 2610703 - protein, 7 aa, Entamoeba histolytica
DEEEPAE

SEQ ID NO: 2610704 - protein, 6 aa, Entamoeba histolytica
DEEEQF

SEQ ID NO: 2610705 - protein, 8 aa, Entamoeba histolytica
DEEEQRDE

SEQ ID NO: 2610706 - protein, 5 aa, Entamoeba histolytica
DEEFE

SEQ ID NO: 2610707 - protein, 6 aa, Entamoeba histolytica
DEEFET

SEQ ID NO: 2610708 - protein, 4 aa, Entamoeba histolytica
DEEG

SEQ ID NO: 2610709 - protein, 6 aa, Entamoeba histolytica
DEEHTG

SEQ ID NO: 2610710 - protein, 7 aa, Entamoeba histolytica
DEEIGES

SEQ ID NO: 2610711 - protein, 6 aa, Entamoeba histolytica
DEEIGR

SEQ ID NO: 2610712 - protein, 6 aa, Entamoeba histolytica
DEEIKE

SEQ ID NO: 2610713 - protein, 7 aa, Entamoeba histolytica
DEEINPE

SEQ ID NO: 2610714 - protein, 13 aa, Entamoeba histolytica
DEEINRKVSTKDL

SEQ ID NO: 2610715 - protein, 7 aa, Entamoeba histolytica
DEEIQEV

SEQ ID NO: 2610716 - protein, 6 aa, Entamoeba histolytica
DEEIRQ

SEQ ID NO: 2610717 - protein, 8 aa, Entamoeba histolytica
DEEKARQL

SEQ ID NO: 2610718 - protein, 13 aa, Entamoeba histolytica
DEEKCTKDYYQDN

SEQ ID NO: 2610719 - protein, 6 aa, Entamoeba histolytica
DEEKEP

SEQ ID NO: 2610720 - protein, 28 aa, Entamoeba histolytica
DEEKEVEKTDKKKAKKEETEEESEEKKV

SEQ ID NO: 2610721 - protein, 6 aa, Entamoeba histolytica
DEEKFS

SEQ ID NO: 2610722 - protein, 20 aa, Entamoeba histolytica
DEEKKIKEQQHKENKRRKHD

SEQ ID NO: 2610723 - protein, 12 aa, Entamoeba histolytica
DEEKNFKRQGDD

SEQ ID NO: 2610724 - protein, 20 aa, Entamoeba histolytica
DEEKSINQQQTNLSSTNTVE

SEQ ID NO: 2610725 - protein, 8 aa, Entamoeba histolytica
DEEKTKYE

SEQ ID NO: 2610726 - protein, 60 aa, Entamoeba histolytica
DEEKVNKKMEEEKLTQEKQSKTIQKEEDTKKKEEDKKKQEEDKITTKSNQTELVEEGSKT

SEQ ID NO: 2610727 - protein, 4 aa, Entamoeba histolytica
DEEL

SEQ ID NO: 2610728 - protein, 6 aa, Entamoeba histolytica
DEELQR

SEQ ID NO: 2610729 - protein, 6 aa, Entamoeba histolytica
DEELRD

SEQ ID NO: 2610730 - protein, 5 aa, Entamoeba histolytica
DEENE

SEQ ID NO: 2610731 - protein, 14 aa, Entamoeba histolytica
DEENENNDNNSDDF

SEQ ID NO: 2610732 - protein, 6 aa, Entamoeba histolytica
DEENEW

SEQ ID NO: 2610733 - protein, 7 aa, Entamoeba histolytica
DEENLES

SEQ ID NO: 2610734 - protein, 10 aa, Entamoeba histolytica
DEENQRTTGM

SEQ ID NO: 2610735 - protein, 6 aa, Entamoeba histolytica
DEENRE

SEQ ID NO: 2610736 - protein, 7 aa, Entamoeba histolytica
DEENSSF

SEQ ID NO: 2610737 - protein, 17 aa, Entamoeba histolytica
DEEPAEPPKNELESQIN

SEQ ID NO: 2610738 - protein, 19 aa, Entamoeba histolytica
DEEPEEEEESEMLSKSKED

SEQ ID NO: 2610739 - protein, 4 aa, Entamoeba histolytica
DEEQ

SEQ ID NO: 2610740 - protein, 14 aa, Entamoeba histolytica
DEEQKIHDKNYRNE

SEQ ID NO: 2610741 - protein, 5 aa, Entamoeba histolytica
DEERF

SEQ ID NO: 2610742 - protein, 7 aa, Entamoeba histolytica
DEERKDK

SEQ ID NO: 2610743 - protein, 8 aa, Entamoeba histolytica
DEERKKKL

SEQ ID NO: 2610744 - protein, 6 aa, Entamoeba histolytica
DEERTK

SEQ ID NO: 2610745 - protein, 6 aa, Entamoeba histolytica
DEERVR

SEQ ID NO: 2610746 - protein, 19 aa, Entamoeba histolytica
DEESDAVSSPLQNPSPTAP

SEQ ID NO: 2610747 - protein, 12 aa, Entamoeba histolytica
DEESDDKPPVVK

SEQ ID NO: 2610748 - protein, 9 aa, Entamoeba histolytica
DEESEKKMY

SEQ ID NO: 2610749 - protein, 7 aa, Entamoeba histolytica
DEESEQS

SEQ ID NO: 2610750 - protein, 6 aa, Entamoeba histolytica
DEESFK

SEQ ID NO: 2610751 - protein, 8 aa, Entamoeba histolytica
DEESIGNQ

SEQ ID NO: 2610752 - protein, 23 aa, Entamoeba histolytica
DEESKDVTPPKVASQSINSSSQS

SEQ ID NO: 2610753 - protein, 11 aa, Entamoeba histolytica
DEESKKVTGYF

SEQ ID NO: 2610754 - protein, 7 aa, Entamoeba histolytica
DEESTFE

SEQ ID NO: 2610755 - protein, 7 aa, Entamoeba histolytica
DEESYNY

SEQ ID NO: 2610756 - protein, 19 aa, Entamoeba histolytica
DEETAEKAVNEMNGKEIDG

SEQ ID NO: 2610757 - protein, 9 aa, Entamoeba histolytica
DEETEMPVD

SEQ ID NO: 2610758 - protein, 8 aa, Entamoeba histolytica
DEETKNHI

SEQ ID NO: 2610759 - protein, 6 aa, Entamoeba histolytica
DEETNE

SEQ ID NO: 2610760 - protein, 8 aa, Entamoeba histolytica
DEETPQTD

SEQ ID NO: 2610761 - protein, 4 aa, Entamoeba histolytica
DEEV

SEQ ID NO: 2610762 - protein, 6 aa, Entamoeba histolytica
DEEVEE

SEQ ID NO: 2610763 - protein, 9 aa, Entamoeba histolytica
DEEVPNQDR

SEQ ID NO: 2610764 - protein, 15 aa, Entamoeba histolytica
DEEYNEEDEAEESNY

SEQ ID NO: 2610765 - protein, 9 aa, Entamoeba histolytica
DEFAKYSKN

SEQ ID NO: 2610766 - protein, 6 aa, Entamoeba histolytica
DEFDDT

SEQ ID NO: 2610767 - protein, 6 aa, Entamoeba histolytica
DEFDEM

SEQ ID NO: 2610768 - protein, 10 aa, Entamoeba histolytica
DEFDPNDYDD

SEQ ID NO: 2610769 - protein, 4 aa, Entamoeba histolytica
DEFE

SEQ ID NO: 2610770 - protein, 6 aa, Entamoeba histolytica
DEFEQK

SEQ ID NO: 2610771 - protein, 40 aa, Entamoeba histolytica
DEFGESDESDEKISTSKIKQVRERKKKGRDKRERKTRQIK

SEQ ID NO: 2610772 - protein, 4 aa, Entamoeba histolytica
DEFK

SEQ ID NO: 2610773 - protein, 6 aa, Entamoeba histolytica
DEFKPT

SEQ ID NO: 2610774 - protein, 6 aa, Entamoeba histolytica
DEFPTD

SEQ ID NO: 2610775 - protein, 13 aa, Entamoeba histolytica
DEFSDETDETNDL

SEQ ID NO: 2610776 - protein, 4 aa, Entamoeba histolytica
DEGC

SEQ ID NO: 2610777 - protein, 8 aa, Entamoeba histolytica
DEGCPSSR

SEQ ID NO: 2610778 - protein, 8 aa, Entamoeba histolytica
DEGEELEE

SEQ ID NO: 2610779 - protein, 8 aa, Entamoeba histolytica
DEGEGIES

SEQ ID NO: 2610780 - protein, 6 aa, Entamoeba histolytica
DEGEIK

SEQ ID NO: 2610781 - protein, 9 aa, Entamoeba histolytica
DEGEQNNGL

SEQ ID NO: 2610782 - protein, 5 aa, Entamoeba histolytica
DEGHD

SEQ ID NO: 2610783 - protein, 8 aa, Entamoeba histolytica
DEGHPGNR

SEQ ID NO: 2610784 - protein, 11 aa, Entamoeba histolytica
DEGIEVTEEQT

SEQ ID NO: 2610785 - protein, 7 aa, Entamoeba histolytica
DEGINSL

SEQ ID NO: 2610786 - protein, 5 aa, Entamoeba histolytica
DEGKS

SEQ ID NO: 2610787 - protein, 4 aa, Entamoeba histolytica
DEGL

SEQ ID NO: 2610788 - protein, 5 aa, Entamoeba histolytica
DEGMK

SEQ ID NO: 2610789 - protein, 8 aa, Entamoeba histolytica
DEGNENEE

SEQ ID NO: 2610790 - protein, 14 aa, Entamoeba histolytica
DEGNPDKTESGDVN

SEQ ID NO: 2610791 - protein, 6 aa, Entamoeba histolytica
DEGQEW

SEQ ID NO: 2610792 - protein, 5 aa, Entamoeba histolytica
DEGRV

SEQ ID NO: 2610793 - protein, 5 aa, Entamoeba histolytica
DEGSK

SEQ ID NO: 2610794 - protein, 6 aa, Entamoeba histolytica
DEGYRG

SEQ ID NO: 2610795 - protein, 12 aa, Entamoeba histolytica
DEHPKQYSNEIT

SEQ ID NO: 2610796 - protein, 7 aa, Entamoeba histolytica
DEHQKQF

SEQ ID NO: 2610797 - protein, 13 aa, Entamoeba histolytica
DEHSRSPHPIEGG

SEQ ID NO: 2610798 - protein, 8 aa, Entamoeba histolytica
DEHTQPQQ

SEQ ID NO: 2610799 - protein, 20 aa, Entamoeba histolytica
DEIDAPGNDALNGKPEDIGS

SEQ ID NO: 2610800 - protein, 7 aa, Entamoeba histolytica
DEIDPEI

SEQ ID NO: 2610801 - protein, 13 aa, Entamoeba histolytica
DEIDRQKNSAERC

SEQ ID NO: 2610802 - protein, 9 aa, Entamoeba histolytica
DEIEDEKEM

SEQ ID NO: 2610803 - protein, 10 aa, Entamoeba histolytica
DEIEKSDKNR

SEQ ID NO: 2610804 - protein, 8 aa, Entamoeba histolytica
DEIENDKN

SEQ ID NO: 2610805 - protein, 8 aa, Entamoeba histolytica
DEIENNKK

SEQ ID NO: 2610806 - protein, 11 aa, Entamoeba histolytica
DEIESCPSIPS

SEQ ID NO: 2610807 - protein, 6 aa, Entamoeba histolytica
DEIGSE

SEQ ID NO: 2610808 - protein, 9 aa, Entamoeba histolytica
DEIKDKQME

SEQ ID NO: 2610809 - protein, 24 aa, Entamoeba histolytica
DEIKEEENDIEQSVHEDQKNIEEI

SEQ ID NO: 2610810 - protein, 14 aa, Entamoeba histolytica
DEIKKKKINKEKFK

SEQ ID NO: 2610811 - protein, 9 aa, Entamoeba histolytica
DEIKPSKFY

SEQ ID NO: 2610812 - protein, 6 aa, Entamoeba histolytica
DEINEN

SEQ ID NO: 2610813 - protein, 22 aa, Entamoeba histolytica
DEIPEKRKRKSIKQEGTPQPKV

SEQ ID NO: 2610814 - protein, 5 aa, Entamoeba histolytica
DEIPI

SEQ ID NO: 2610815 - protein, 5 aa, Entamoeba histolytica
DEIPV

SEQ ID NO: 2610816 - protein, 13 aa, Entamoeba histolytica
DEIQGAKDESDAS

SEQ ID NO: 2610817 - protein, 8 aa, Entamoeba histolytica
DEIQSGSI

SEQ ID NO: 2610818 - protein, 6 aa, Entamoeba histolytica
DEIQSR

SEQ ID NO: 2610819 - protein, 5 aa, Entamoeba histolytica
DEISE

SEQ ID NO: 2610820 - protein, 4 aa, Entamoeba histolytica
DEIT

SEQ ID NO: 2610821 - protein, 6 aa, Entamoeba histolytica
DEITDL

SEQ ID NO: 2610822 - protein, 8 aa, Entamoeba histolytica
DEITNESI

SEQ ID NO: 2610823 - protein, 14 aa, Entamoeba histolytica
DEITPKDSSSEHQI

SEQ ID NO: 2610824 - protein, 15 aa, Entamoeba histolytica
DEKADKLKQYEPTDV

SEQ ID NO: 2610825 - protein, 9 aa, Entamoeba histolytica
DEKAKDATT

SEQ ID NO: 2610826 - protein, 5 aa, Entamoeba histolytica
DEKAS

SEQ ID NO: 2610827 - protein, 10 aa, Entamoeba histolytica
DEKDASEVAA

SEQ ID NO: 2610828 - protein, 5 aa, Entamoeba histolytica
DEKDM

SEQ ID NO: 2610829 - protein, 9 aa, Entamoeba histolytica
DEKEDLSSL

SEQ ID NO: 2610830 - protein, 7 aa, Entamoeba histolytica
DEKEISK

SEQ ID NO: 2610831 - protein, 6 aa, Entamoeba histolytica
DEKEMG

SEQ ID NO: 2610832 - protein, 15 aa, Entamoeba histolytica
DEKETSEESKKRGAT

SEQ ID NO: 2610833 - protein, 6 aa, Entamoeba histolytica
DEKEWK

SEQ ID NO: 2610834 - protein, 5 aa, Entamoeba histolytica
DEKGA

SEQ ID NO: 2610835 - protein, 8 aa, Entamoeba histolytica
DEKGNTPL

SEQ ID NO: 2610836 - protein, 4 aa, Entamoeba histolytica
DEKI

SEQ ID NO: 2610837 - protein, 7 aa, Entamoeba histolytica
DEKIEEA

SEQ ID NO: 2610838 - protein, 7 aa, Entamoeba histolytica
DEKIEGK

SEQ ID NO: 2610839 - protein, 6 aa, Entamoeba histolytica
DEKINK

SEQ ID NO: 2610840 - protein, 18 aa, Entamoeba histolytica
DEKKEEEMYCSSYCLIQK

SEQ ID NO: 2610841 - protein, 5 aa, Entamoeba histolytica
DEKKK

SEQ ID NO: 2610842 - protein, 9 aa, Entamoeba histolytica
DEKKKRDVM

SEQ ID NO: 2610843 - protein, 16 aa, Entamoeba histolytica
DEKKKYMPTRKGGIAK

SEQ ID NO: 2610844 - protein, 12 aa, Entamoeba histolytica
DEKKSKKSKCTE

SEQ ID NO: 2610845 - protein, 7 aa, Entamoeba histolytica
DEKLNKR

SEQ ID NO: 2610846 - protein, 5 aa, Entamoeba histolytica
DEKLS

SEQ ID NO: 2610847 - protein, 14 aa, Entamoeba histolytica
DEKLSSIKKREKEL

SEQ ID NO: 2610848 - protein, 8 aa, Entamoeba histolytica
DEKNASEA

SEQ ID NO: 2610849 - protein, 30 aa, Entamoeba histolytica
DEKNEEQQSPKHKEKKVKKSKKHQEDDGEI

SEQ ID NO: 2610850 - protein, 8 aa, Entamoeba histolytica
DEKNENEL

SEQ ID NO: 2610851 - protein, 30 aa, Entamoeba histolytica; identical to SEQ ID NO: 2415260

SEQ ID NO: 2610852 - protein, 7 aa, Entamoeba histolytica
DEKNLKR

SEQ ID NO: 2610853 - protein, 43 aa, Entamoeba histolytica; identical to SEQ ID NO: 2415263

SEQ ID NO: 2610854 - protein, 27 aa, Entamoeba histolytica
DEKPLTQSNSKPMSQPSSQPVTPQKTM

SEQ ID NO: 2610855 - protein, 4 aa, Entamoeba histolytica
DEKQ

SEQ ID NO: 2610856 - protein, 6 aa, Entamoeba histolytica
DEKQIN

SEQ ID NO: 2610857 - protein, 28 aa, Entamoeba histolytica
DEKQNNIPESKEPIKESKESQENNTERV

SEQ ID NO: 2610858 - protein, 18 aa, Entamoeba histolytica
DEKQNSKDIENNQIEESI

SEQ ID NO: 2610859 - protein, 10 aa, Entamoeba histolytica
DEKQRKQGDG

SEQ ID NO: 2610860 - protein, 16 aa, Entamoeba histolytica
DEKRDLEEKLKKKDDI

SEQ ID NO: 2610861 - protein, 12 aa, Entamoeba histolytica
DEKRKAETIEKG

SEQ ID NO: 2610862 - protein, 25 aa, Entamoeba histolytica
DEKRKEVADKSLAAYQEATDTAASL

SEQ ID NO: 2610863 - protein, 30 aa, Entamoeba histolytica; identical to SEQ ID NO: 2415266

SEQ ID NO: 2610864 - protein, 9 aa, Entamoeba histolytica
DEKRKNIQQ

SEQ ID NO: 2610865 - protein, 31 aa, Entamoeba histolytica; identical to SEQ ID NO: 2415268

SEQ ID NO: 2610866 - protein, 7 aa, Entamoeba histolytica
DEKRRNK

SEQ ID NO: 2610867 - protein, 7 aa, Entamoeba histolytica
DEKRVSQ

SEQ ID NO: 2610868 - protein, 5 aa, Entamoeba histolytica
DEKRW

SEQ ID NO: 2610869 - protein, 17 aa, Entamoeba histolytica
DEKSAGLALKNENGKFW

SEQ ID NO: 2610870 - protein, 8 aa, Entamoeba histolytica
DEKSTKVV

SEQ ID NO: 2610871 - protein, 7 aa, Entamoeba histolytica
DEKTPEE

SEQ ID NO: 2610872 - protein, 7 aa, Entamoeba histolytica
DEKTPEN

SEQ ID NO: 2610873 - protein, 8 aa, Entamoeba histolytica
DEKTRNNA

SEQ ID NO: 2610874 - protein, 14 aa, Entamoeba histolytica
DEKTVGWEKSRYDE

SEQ ID NO: 2610875 - protein, 5 aa, Entamoeba histolytica
DEKVD

SEQ ID NO: 2610876 - protein, 103 aa, Entamoeba histolytica
DEKYEKKDEEIKRMNEKKNEDQIKEIENQNDKKKRGTTRNGYRRTLSTEKSSTNPTHSNENVKYQQKERGSLNKVPKQSLKEEEKQEKEIDEKSKKEIKEEEK

SEQ ID NO: 2610877 - protein, 6 aa, Entamoeba histolytica
DEKYQP

SEQ ID NO: 2610878 - protein, 10 aa, Entamoeba histolytica
DELDDSTQQE

SEQ ID NO: 2610879 - protein, 16 aa, Entamoeba histolytica
DELDGDSLIPDTSTAE

SEQ ID NO: 2610880 - protein, 4 aa, Entamoeba histolytica
DELE

SEQ ID NO: 2610881 - protein, 12 aa, Entamoeba histolytica
DELENQFDNTRR

SEQ ID NO: 2610882 - protein, 16 aa, Entamoeba histolytica
DELEPQSSYLPEVKED

SEQ ID NO: 2610883 - protein, 8 aa, Entamoeba histolytica
DELEREVN

SEQ ID NO: 2610884 - protein, 13 aa, Entamoeba histolytica
DELERKKQSGTGL

SEQ ID NO: 2610885 - protein, 8 aa, Entamoeba histolytica
DELGQNSN

SEQ ID NO: 2610886 - protein, 5 aa, Entamoeba histolytica
DELIA

SEQ ID NO: 2610887 - protein, 4 aa, Entamoeba histolytica
DELK

SEQ ID NO: 2610888 - protein, 6 aa, Entamoeba histolytica
DELKMD

SEQ ID NO: 2610889 - protein, 7 aa, Entamoeba histolytica
DELKQGC

SEQ ID NO: 2610890 - protein, 12 aa, Entamoeba histolytica
DELNEGDSQEEI

SEQ ID NO: 2610891 - protein, 30 aa, Entamoeba histolytica
DELNQASKKQETELQESHRNIQEVDEGEVC

SEQ ID NO: 2610892 - protein, 6 aa, Entamoeba histolytica
DELNQI

SEQ ID NO: 2610893 - protein, 9 aa, Entamoeba histolytica
DELNQTVNN

SEQ ID NO: 2610894 - protein, 6 aa, Entamoeba histolytica
DELQTI

SEQ ID NO: 2610895 - protein, 4 aa, Entamoeba histolytica
DELR

SEQ ID NO: 2610896 - protein, 5 aa, Entamoeba histolytica
DELRE

SEQ ID NO: 2610897 - protein, 5 aa, Entamoeba histolytica
DELRG

SEQ ID NO: 2610898 - protein, 11 aa, Entamoeba histolytica
DELYRNDKRGF

SEQ ID NO: 2610899 - protein, 61 aa, Entamoeba histolytica
DEMDESSEKDPTMESDENDNNNEEEQNENEDDDDMEEEDQELEAESLEEDDLGDEEEQQIR

SEQ ID NO: 2610900 - protein, 10 aa, Entamoeba histolytica
DEMDPEPVSQ

SEQ ID NO: 2610901 - protein, 13 aa, Entamoeba histolytica
DEMKKEIEKNGFN

SEQ ID NO: 2610902 - protein, 22 aa, Entamoeba histolytica
DEMNGVGEAKKKKPVAKKPAVK

SEQ ID NO: 2610903 - protein, 11 aa, Entamoeba histolytica
DEMNKNGMNGQ

SEQ ID NO: 2610904 - protein, 7 aa, Entamoeba histolytica
DENANNN

SEQ ID NO: 2610905 - protein, 8 aa, Entamoeba histolytica
DENDDPIP

SEQ ID NO: 2610906 - protein, 6 aa, Entamoeba histolytica
DENDEN

SEQ ID NO: 2610907 - protein, 7 aa, Entamoeba histolytica
DENDGEW

SEQ ID NO: 2610908 - protein, 5 aa, Entamoeba histolytica
DENDL

SEQ ID NO: 2610909 - protein, 5 aa, Entamoeba histolytica
DENDS

SEQ ID NO: 2610910 - protein, 8 aa, Entamoeba histolytica
DENDSDIQ

SEQ ID NO: 2610911 - protein, 9 aa, Entamoeba histolytica
DENEDGKMD

SEQ ID NO: 2610912 - protein, 10 aa, Entamoeba histolytica
DENEGQNVTI

SEQ ID NO: 2610913 - protein, 5 aa, Entamoeba histolytica
DENEI

SEQ ID NO: 2610914 - protein, 13 aa, Entamoeba histolytica
DENEKCKKDMKNV

SEQ ID NO: 2610915 - protein, 20 aa, Entamoeba histolytica
DENEKKESKSILKGSKRQSI

SEQ ID NO: 2610916 - protein, 9 aa, Entamoeba histolytica
DENEKNIPN

SEQ ID NO: 2610917 - protein, 6 aa, Entamoeba histolytica
DENEPV

SEQ ID NO: 2610918 - protein, 6 aa, Entamoeba histolytica
DENEQM

SEQ ID NO: 2610919 - protein, 20 aa, Entamoeba histolytica
DENETYSEEFDSSIKKKEYI

SEQ ID NO: 2610920 - protein, 8 aa, Entamoeba histolytica
DENEVNEF

SEQ ID NO: 2610921 - protein, 16 aa, Entamoeba histolytica
DENEWKRGEEKGVKAK

SEQ ID NO: 2610922 - protein, 6 aa, Entamoeba histolytica
DENGDE

SEQ ID NO: 2610923 - protein, 17 aa, Entamoeba histolytica
DENGENHDSIKTRSSFT

SEQ ID NO: 2610924 - protein, 6 aa, Entamoeba histolytica
DENGGQ

SEQ ID NO: 2610925 - protein, 9 aa, Entamoeba histolytica
DENGIPDDD

SEQ ID NO: 2610926 - protein, 8 aa, Entamoeba histolytica
DENGNTPF

SEQ ID NO: 2610927 - protein, 7 aa, Entamoeba histolytica
DENGRTI

SEQ ID NO: 2610928 - protein, 15 aa, Entamoeba histolytica
DENGVADDDLPPLEY

SEQ ID NO: 2610929 - protein, 7 aa, Entamoeba histolytica
DENHRKK

SEQ ID NO: 2610930 - protein, 4 aa, Entamoeba histolytica
DENI

SEQ ID NO: 2610931 - protein, 7 aa, Entamoeba histolytica
DENKIKV

SEQ ID NO: 2610932 - protein, 11 aa, Entamoeba histolytica
DENKKDQSLRN

SEQ ID NO: 2610933 - protein, 7 aa, Entamoeba histolytica
DENKKTV

SEQ ID NO: 2610934 - protein, 14 aa, Entamoeba histolytica
DENKRLEKKSETVI

SEQ ID NO: 2610935 - protein, 9 aa, Entamoeba histolytica
DENKSVEPL

SEQ ID NO: 2610936 - protein, 5 aa, Entamoeba histolytica
DENKT

SEQ ID NO: 2610937 - protein, 9 aa, Entamoeba histolytica
DENLKTKTD

SEQ ID NO: 2610938 - protein, 5 aa, Entamoeba histolytica
DENLT

SEQ ID NO: 2610939 - protein, 8 aa, Entamoeba histolytica
DENNAVKK

SEQ ID NO: 2610940 - protein, 9 aa, Entamoeba histolytica
DENNSGYGV

SEQ ID NO: 2610941 - protein, 6 aa, Entamoeba histolytica
DENPPY

SEQ ID NO: 2610942 - protein, 10 aa, Entamoeba histolytica
DENPQNNETE

SEQ ID NO: 2610943 - protein, 5 aa, Entamoeba histolytica
DENPS

SEQ ID NO: 2610944 - protein, 6 aa, Entamoeba histolytica
DENQNN

SEQ ID NO: 2610945 - protein, 11 aa, Entamoeba histolytica
DENQSLKQTVN

SEQ ID NO: 2610946 - protein, 6 aa, Entamoeba histolytica
DENQTL

SEQ ID NO: 2610947 - protein, 20 aa, Entamoeba histolytica
DENRYGQQQKRNPPSTGITW

SEQ ID NO: 2610948 - protein, 16 aa, Entamoeba histolytica
DENSDDDPLFGEESPK

SEQ ID NO: 2610949 - protein, 6 aa, Entamoeba histolytica
DENSEI

SEQ ID NO: 2610950 - protein, 9 aa, Entamoeba histolytica
DENTPKELT

SEQ ID NO: 2610951 - protein, 4 aa, Entamoeba histolytica
DENW

SEQ ID NO: 2610952 - protein, 8 aa, Entamoeba histolytica
DENYKTSI

SEQ ID NO: 2610953 - protein, 12 aa, Entamoeba histolytica
DEPANSATESIT

SEQ ID NO: 2610954 - protein, 5 aa, Entamoeba histolytica
DEPDN

SEQ ID NO: 2610955 - protein, 6 aa, Entamoeba histolytica
DEPDVT

SEQ ID NO: 2610956 - protein, 8 aa, Entamoeba histolytica
DEPEETET

SEQ ID NO: 2610957 - protein, 6 aa, Entamoeba histolytica
DEPFPK

SEQ ID NO: 2610958 - protein, 5 aa, Entamoeba histolytica
DEPFQ

SEQ ID NO: 2610959 - protein, 4 aa, Entamoeba histolytica
DEPH

SEQ ID NO: 2610960 - protein, 4 aa, Entamoeba histolytica
DEPL

SEQ ID NO: 2610961 - protein, 20 aa, Entamoeba histolytica
DEPNDVSDIEEDVTSDDEGN

SEQ ID NO: 2610962 - protein, 35 aa, Entamoeba histolytica
DEPNQPSHEITPTTVKEEEEKESHIKEVSSDKHHP

SEQ ID NO: 2610963 - protein, 13 aa, Entamoeba histolytica
DEPPYSPKDSGNC

SEQ ID NO: 2610964 - protein, 12 aa, Entamoeba histolytica
DEPRYPSYQYPL

SEQ ID NO: 2610965 - protein, 9 aa, Entamoeba histolytica
DEPSGQKGI

SEQ ID NO: 2610966 - protein, 13 aa, Entamoeba histolytica
DEPSHSKRSTLQE

SEQ ID NO: 2610967 - protein, 4 aa, Entamoeba histolytica
DEPT

SEQ ID NO: 2610968 - protein, 4 aa, Entamoeba histolytica
DEPY

SEQ ID NO: 2610969 - protein, 12 aa, Entamoeba histolytica
DEQALERKRHVG

SEQ ID NO: 2610970 - protein, 21 aa, Entamoeba histolytica
DEQEESMDREPTYQNHAQVKG

SEQ ID NO: 2610971 - protein, 8 aa, Entamoeba histolytica
DEQEGPDK

SEQ ID NO: 2610972 - protein, 5 aa, Entamoeba histolytica
DEQEQ

SEQ ID NO: 2610973 - protein, 5 aa, Entamoeba histolytica
DEQFM

SEQ ID NO: 2610974 - protein, 8 aa, Entamoeba histolytica
DEQGNEKY

SEQ ID NO: 2610975 - protein, 5 aa, Entamoeba histolytica
DEQIR

SEQ ID NO: 2610976 - protein, 11 aa, Entamoeba histolytica
DEQKEEIETTF

SEQ ID NO: 2610977 - protein, 9 aa, Entamoeba histolytica
DEQKGSMEV

SEQ ID NO: 2610978 - protein, 5 aa, Entamoeba histolytica
DEQKK

SEQ ID NO: 2610979 - protein, 9 aa, Entamoeba histolytica
DEQKRQEEF

SEQ ID NO: 2610980 - protein, 12 aa, Entamoeba histolytica
DEQKTEKKRHIG

SEQ ID NO: 2610981 - protein, 7 aa, Entamoeba histolytica
DEQLKRT

SEQ ID NO: 2610982 - protein, 6 aa, Entamoeba histolytica
DEQNKL

SEQ ID NO: 2610983 - protein, 6 aa, Entamoeba histolytica
DEQNPN

SEQ ID NO: 2610984 - protein, 7 aa, Entamoeba histolytica
DEQNRER

SEQ ID NO: 2610985 - protein, 4 aa, Entamoeba histolytica
DEQQ

SEQ ID NO: 2610986 - protein, 7 aa, Entamoeba histolytica
DEQRNEV

SEQ ID NO: 2610987 - protein, 4 aa, Entamoeba histolytica
DEQT

SEQ ID NO: 2610988 - protein, 22 aa, Entamoeba histolytica
DEQTKTKTIIGNEENNNRLHKE

SEQ ID NO: 2610989 - protein, 7 aa, Entamoeba histolytica
DEQVDEI

SEQ ID NO: 2610990 - protein, 7 aa, Entamoeba histolytica
DEQVGDR

SEQ ID NO: 2610991 - protein, 13 aa, Entamoeba histolytica
DEQVTNTTFDQQN

SEQ ID NO: 2610992 - protein, 7 aa, Entamoeba histolytica
DERGNTG

SEQ ID NO: 2610993 - protein, 5 aa, Entamoeba histolytica
DERIT

SEQ ID NO: 2610994 - protein, 4 aa, Entamoeba histolytica
DERK

SEQ ID NO: 2610995 - protein, 6 aa, Entamoeba histolytica
DERKEL

SEQ ID NO: 2610996 - protein, 8 aa, Entamoeba histolytica
DERKGVKN

SEQ ID NO: 2610997 - protein, 13 aa, Entamoeba histolytica
DERKKETSTSPNF

SEQ ID NO: 2610998 - protein, 24 aa, Entamoeba histolytica
DERKKREEKKSLQPIKKPISKPTY

SEQ ID NO: 2610999 - protein, 7 aa, Entamoeba histolytica
DERKRRT

SEQ ID NO: 2611000 - protein, 6 aa, Entamoeba histolytica
DERNHI

SEQ ID NO: 2611001 - protein, 14 aa, Entamoeba histolytica
DERNKKYNLNGTEF

SEQ ID NO: 2611002 - protein, 6 aa, Entamoeba histolytica
DERNKV

SEQ ID NO: 2611003 - protein, 11 aa, Entamoeba histolytica
DERNVVKQSQL

SEQ ID NO: 2611004 - protein, 16 aa, Entamoeba histolytica
DERPMPKTPRTMTSIS

SEQ ID NO: 2611005 - protein, 6 aa, Entamoeba histolytica
DERRDT

SEQ ID NO: 2611006 - protein, 7 aa, Entamoeba histolytica
DERSEEN

SEQ ID NO: 2611007 - protein, 6 aa, Entamoeba histolytica
DERYHA

SEQ ID NO: 2611008 - protein, 5 aa, Entamoeba histolytica
DESAE

SEQ ID NO: 2611009 - protein, 7 aa, Entamoeba histolytica
DESCYEN

SEQ ID NO: 2611010 - protein, 5 aa, Entamoeba histolytica
DESDA

SEQ ID NO: 2611011 - protein, 5 aa, Entamoeba histolytica
DESDL

SEQ ID NO: 2611012 - protein, 7 aa, Entamoeba histolytica
DESDSVP

SEQ ID NO: 2611013 - protein, 10 aa, Entamoeba histolytica
DESEDKEKIK

SEQ ID NO: 2611014 - protein, 6 aa, Entamoeba histolytica
DESEEG

SEQ ID NO: 2611015 - protein, 13 aa, Entamoeba histolytica
DESEQGTNQNGGF

SEQ ID NO: 2611016 - protein, 15 aa, Entamoeba histolytica
DESETHPESRMPEET

SEQ ID NO: 2611017 - protein, 17 aa, Entamoeba histolytica
DESFTDNDYYDISSHPY

SEQ ID NO: 2611018 - protein, 4 aa, Entamoeba histolytica
DESI

SEQ ID NO: 2611019 - protein, 24 aa, Entamoeba histolytica
DESIDSSERMEIEEGEDENQTSGI

SEQ ID NO: 2611020 - protein, 7 aa, Entamoeba histolytica
DESIGTP

SEQ ID NO: 2611021 - protein, 7 aa, Entamoeba histolytica
DESIPYE

SEQ ID NO: 2611022 - protein, 15 aa, Entamoeba histolytica
DESITNKSTKIEKDS

SEQ ID NO: 2611023 - protein, 9 aa, Entamoeba histolytica
DESKCDDEG

SEQ ID NO: 2611024 - protein, 8 aa, Entamoeba histolytica
DESKKYKK

SEQ ID NO: 2611025 - protein, 6 aa, Entamoeba histolytica
DESKNN

SEQ ID NO: 2611026 - protein, 7 aa, Entamoeba histolytica
DESKRSV

SEQ ID NO: 2611027 - protein, 10 aa, Entamoeba histolytica
DESKVKEYGD

SEQ ID NO: 2611028 - protein, 21 aa, Entamoeba histolytica
DESKVVDDNNMSEENLEKVDL

SEQ ID NO: 2611029 - protein, 13 aa, Entamoeba histolytica
DESLEKVTQYTND

SEQ ID NO: 2611030 - protein, 8 aa, Entamoeba histolytica
DESLQAPT

SEQ ID NO: 2611031 - protein, 8 aa, Entamoeba histolytica
DESLYPDE

SEQ ID NO: 2611032 - protein, 6 aa, Entamoeba histolytica
DESMEN

SEQ ID NO: 2611033 - protein, 5 aa, Entamoeba histolytica
DESMT

SEQ ID NO: 2611034 - protein, 7 aa, Entamoeba histolytica
DESNKEI

SEQ ID NO: 2611035 - protein, 14 aa, Entamoeba histolytica
DESPRLSPRGYEER

SEQ ID NO: 2611036 - protein, 10 aa, Entamoeba histolytica
DESQDELNEN

SEQ ID NO: 2611037 - protein, 10 aa, Entamoeba histolytica
DESQENNDSM

SEQ ID NO: 2611038 - protein, 7 aa, Entamoeba histolytica
DESQKTL

SEQ ID NO: 2611039 - protein, 9 aa, Entamoeba histolytica
DESSLESSL

SEQ ID NO: 2611040 - protein, 9 aa, Entamoeba histolytica
DESSNGTMV

SEQ ID NO: 2611041 - protein, 9 aa, Entamoeba histolytica
DESSRTFVG

SEQ ID NO: 2611042 - protein, 16 aa, Entamoeba histolytica
DESTDTKEQLPQPDKM

SEQ ID NO: 2611043 - protein, 25 aa, Entamoeba histolytica
DESVDPFGSNNSTVDPFGVSSNSVD

SEQ ID NO: 2611044 - protein, 7 aa, Entamoeba histolytica
DESVGIN

SEQ ID NO: 2611045 - protein, 8 aa, Entamoeba histolytica
DESVSNSC

SEQ ID NO: 2611046 - protein, 19 aa, Entamoeba histolytica
DESVSPPKTNTKRLSSQKN

SEQ ID NO: 2611047 - protein, 5 aa, Entamoeba histolytica
DESYS

SEQ ID NO: 2611048 - protein, 7 aa, Entamoeba histolytica
DETDESY

SEQ ID NO: 2611049 - protein, 10 aa, Entamoeba histolytica
DETDIPKEES

SEQ ID NO: 2611050 - protein, 6 aa, Entamoeba histolytica
DETDNE

SEQ ID NO: 2611051 - protein, 8 aa, Entamoeba histolytica
DETEEHQG

SEQ ID NO: 2611052 - protein, 9 aa, Entamoeba histolytica
DETEETREC

SEQ ID NO: 2611053 - protein, 5 aa, Entamoeba histolytica
DETEK

SEQ ID NO: 2611054 - protein, 10 aa, Entamoeba histolytica
DETEKELNSD

SEQ ID NO: 2611055 - protein, 8 aa, Entamoeba histolytica
DETGDRKT

SEQ ID NO: 2611056 - protein, 15 aa, Entamoeba histolytica
DETGELDDKDYYGNK

SEQ ID NO: 2611057 - protein, 6 aa, Entamoeba histolytica
DETGHL

SEQ ID NO: 2611058 - protein, 7 aa, Entamoeba histolytica
DETGIGK

SEQ ID NO: 2611059 - protein, 7 aa, Entamoeba histolytica
DETGYNE

SEQ ID NO: 2611060 - protein, 4 aa, Entamoeba histolytica
DETI

SEQ ID NO: 2611061 - protein, 7 aa, Entamoeba histolytica
DETISGK

SEQ ID NO: 2611062 - protein, 31 aa, Entamoeba histolytica
DETKPIDNIETKNVDKKTEHTDNEKHEQTSS

SEQ ID NO: 2611063 - protein, 7 aa, Entamoeba histolytica
DETKQRT

SEQ ID NO: 2611064 - protein, 12 aa, Entamoeba histolytica
DETLEEDNEDVR

SEQ ID NO: 2611065 - protein, 7 aa, Entamoeba histolytica
DETNDVK

SEQ ID NO: 2611066 - protein, 6 aa, Entamoeba histolytica
DETNKY

SEQ ID NO: 2611067 - protein, 5 aa, Entamoeba histolytica
DETNN

SEQ ID NO: 2611068 - protein, 17 aa, Entamoeba histolytica
DETNSNEQSKDSRMNED

SEQ ID NO: 2611069 - protein, 44 aa, Entamoeba histolytica
DETPQSNEKKPSKPLVKKPSKPLIKKPSKPSKSDEKSSLKESQL

SEQ ID NO: 2611070 - protein, 8 aa, Entamoeba histolytica
DETQTEYM

SEQ ID NO: 2611071 - protein, 4 aa, Entamoeba histolytica
DETR

SEQ ID NO: 2611072 - protein, 6 aa, Entamoeba histolytica
DETSFK

SEQ ID NO: 2611073 - protein, 9 aa, Entamoeba histolytica
DETSQEGKL

SEQ ID NO: 2611074 - protein, 5 aa, Entamoeba histolytica
DETSY

SEQ ID NO: 2611075 - protein, 57 aa, Entamoeba histolytica
DETTEKKEIELDSQKSSGINLEQTDSSKNDRKSQKKKSGEKKEKKANLSDKKRKRSI

SEQ ID NO: 2611076 - protein, 11 aa, Entamoeba histolytica
DETTGKYGEER

SEQ ID NO: 2611077 - protein, 5 aa, Entamoeba histolytica
DETTI

SEQ ID NO: 2611078 - protein, 7 aa, Entamoeba histolytica
DETTPSV

SEQ ID NO: 2611079 - protein, 6 aa, Entamoeba histolytica
DETVKE

SEQ ID NO: 2611080 - protein, 15 aa, Entamoeba histolytica
DETYKVKGKYDDCDR

SEQ ID NO: 2611081 - protein, 24 aa, Entamoeba histolytica
DEVASTEKKTKKKDKKEEEKKKEE

SEQ ID NO: 2611082 - protein, 7 aa, Entamoeba histolytica
DEVDKSV

SEQ ID NO: 2611083 - protein, 6 aa, Entamoeba histolytica
DEVDSN

SEQ ID NO: 2611084 - protein, 24 aa, Entamoeba histolytica
DEVEDFKNEGENKGDVREEEKQEE

SEQ ID NO: 2611085 - protein, 9 aa, Entamoeba histolytica
DEVESGKYY

SEQ ID NO: 2611086 - protein, 28 aa, Entamoeba histolytica
DEVESNDNSSQSPAFDDFEEEDKEIEDD

SEQ ID NO: 2611087 - protein, 11 aa, Entamoeba histolytica
DEVGEDEMKEG

SEQ ID NO: 2611088 - protein, 5 aa, Entamoeba histolytica
DEVHP

SEQ ID NO: 2611089 - protein, 19 aa, Entamoeba histolytica
DEVKKEHEVVEKKEENIHQ

SEQ ID NO: 2611090 - protein, 11 aa, Entamoeba histolytica
DEVPEESYKDS

SEQ ID NO: 2611091 - protein, 7 aa, Entamoeba histolytica
DEVPENM

SEQ ID NO: 2611092 - protein, 11 aa, Entamoeba histolytica
DEVPESSYKDS

SEQ ID NO: 2611093 - protein, 7 aa, Entamoeba histolytica
DEVPPQF

SEQ ID NO: 2611094 - protein, 13 aa, Entamoeba histolytica
DEVPTRTKKQCKE

SEQ ID NO: 2611095 - protein, 8 aa, Entamoeba histolytica
DEVQEKDV

SEQ ID NO: 2611096 - protein, 5 aa, Entamoeba histolytica
DEVSA

SEQ ID NO: 2611097 - protein, 11 aa, Entamoeba histolytica
DEVSDKKPEES

SEQ ID NO: 2611098 - protein, 4 aa, Entamoeba histolytica
DEVT

SEQ ID NO: 2611099 - protein, 6 aa, Entamoeba histolytica
DEVVPN

SEQ ID NO: 2611100 - protein, 4 aa, Entamoeba histolytica
DEWE

SEQ ID NO: 2611101 - protein, 7 aa, Entamoeba histolytica
DEWNPSS

SEQ ID NO: 2611102 - protein, 6 aa, Entamoeba histolytica
DEYDER

SEQ ID NO: 2611103 - protein, 12 aa, Entamoeba histolytica
DEYEENKLQETI

SEQ ID NO: 2611104 - protein, 5 aa, Entamoeba histolytica
DEYFK

SEQ ID NO: 2611105 - protein, 6 aa, Entamoeba histolytica
DEYGKG

SEQ ID NO: 2611106 - protein, 6 aa, Entamoeba histolytica
DEYGNA

SEQ ID NO: 2611107 - protein, 9 aa, Entamoeba histolytica
DEYITREKS

SEQ ID NO: 2611108 - protein, 10 aa, Entamoeba histolytica
DEYKDKKNIV

SEQ ID NO: 2611109 - protein, 5 aa, Entamoeba histolytica
DEYKN

SEQ ID NO: 2611110 - protein, 4 aa, Entamoeba histolytica
DEYN

SEQ ID NO: 2611111 - protein, 10 aa, Entamoeba histolytica
DEYNGETRTR

SEQ ID NO: 2611112 - protein, 4 aa, Entamoeba histolytica
DEYP

SEQ ID NO: 2611113 - protein, 13 aa, Entamoeba histolytica
DEYSKKINRNELT

SEQ ID NO: 2611114 - protein, 7 aa, Entamoeba histolytica
DEYTKED

SEQ ID NO: 2611115 - protein, 10 aa, Entamoeba histolytica
DEYTKEMNEK

SEQ ID NO: 2611116 - protein, 8 aa, Entamoeba histolytica
DFAENAEY

SEQ ID NO: 2611117 - protein, 8 aa, Entamoeba histolytica
DFAKTEKC

SEQ ID NO: 2611118 - protein, 13 aa, Entamoeba histolytica
DFATQNPSYPNSK

SEQ ID NO: 2611119 - protein, 8 aa, Entamoeba histolytica
DFDETTSI

SEQ ID NO: 2611120 - protein, 6 aa, Entamoeba histolytica
DFDGDE

SEQ ID NO: 2611121 - protein, 29 aa, Entamoeba histolytica
DFDGEEYDEEPNEDGNNKDQEEEDVDRDQ

SEQ ID NO: 2611122 - protein, 10 aa, Entamoeba histolytica
DFDPDNGEDY

SEQ ID NO: 2611123 - protein, 8 aa, Entamoeba histolytica
DFDRRTKC

SEQ ID NO: 2611124 - protein, 7 aa, Entamoeba histolytica
DFEDGEN

SEQ ID NO: 2611125 - protein, 6 aa, Entamoeba histolytica
DFEEGR

SEQ ID NO: 2611126 - protein, 7 aa, Entamoeba histolytica
DFEGQTE

SEQ ID NO: 2611127 - protein, 10 aa, Entamoeba histolytica
DFEHPSNTEK

SEQ ID NO: 2611128 - protein, 15 aa, Entamoeba histolytica
DFEKCKKSKKPGIVT

SEQ ID NO: 2611129 - protein, 20 aa, Entamoeba histolytica
DFEKQEIEQEVGKKQLTQEM

SEQ ID NO: 2611130 - protein, 17 aa, Entamoeba histolytica
DFERETMSSYEKQRNSY

SEQ ID NO: 2611131 - protein, 4 aa, Entamoeba histolytica
DFGD

SEQ ID NO: 2611132 - protein, 5 aa, Entamoeba histolytica
DFGDF

SEQ ID NO: 2611133 - protein, 5 aa, Entamoeba histolytica
DFGQQ

SEQ ID NO: 2611134 - protein, 7 aa, Entamoeba histolytica
DFGTQSE

SEQ ID NO: 2611135 - protein, 9 aa, Entamoeba histolytica
DFGTSTKVG

SEQ ID NO: 2611136 - protein, 4 aa, Entamoeba histolytica
DFIE

SEQ ID NO: 2611137 - protein, 5 aa, Entamoeba histolytica
DFIEE

SEQ ID NO: 2611138 - protein, 6 aa, Entamoeba histolytica
DFKNKG

SEQ ID NO: 2611139 - protein, 8 aa, Entamoeba histolytica
DFKSIDKD

SEQ ID NO: 2611140 - protein, 7 aa, Entamoeba histolytica
DFKTEGK

SEQ ID NO: 2611141 - protein, 9 aa, Entamoeba histolytica
DFKTGQTKI

SEQ ID NO: 2611142 - protein, 11 aa, Entamoeba histolytica
DFNETSHDEEN

SEQ ID NO: 2611143 - protein, 6 aa, Entamoeba histolytica
DFNGTD

SEQ ID NO: 2611144 - protein, 4 aa, Entamoeba histolytica
DFNI

SEQ ID NO: 2611145 - protein, 8 aa, Entamoeba histolytica
DFNPPSES

SEQ ID NO: 2611146 - protein, 89 aa, Entamoeba histolytica
DFPATRTRSTKKKIKKSVEKKTGHEETEEESTNVRSTEEEQTKKRQRYSTRKKTKRRISNKTLKSKFQEIDQSNSQKSEEEKPKRKLSK

SEQ ID NO: 2611147 - protein, 7 aa, Entamoeba histolytica
DFPGGDL

SEQ ID NO: 2611148 - protein, 5 aa, Entamoeba histolytica
DFPNS

SEQ ID NO: 2611149 - protein, 5 aa, Entamoeba histolytica
DFPQG

SEQ ID NO: 2611150 - protein, 7 aa, Entamoeba histolytica
DFPSGNS

SEQ ID NO: 2611151 - protein, 5 aa, Entamoeba histolytica
DFPSL

SEQ ID NO: 2611152 - protein, 6 aa, Entamoeba histolytica
DFPSSE

SEQ ID NO: 2611153 - protein, 5 aa, Entamoeba histolytica
DFPTL

SEQ ID NO: 2611154 - protein, 5 aa, Entamoeba histolytica
DFQDP

SEQ ID NO: 2611155 - protein, 11 aa, Entamoeba histolytica
DFQESNKNRLP

SEQ ID NO: 2611156 - protein, 7 aa, Entamoeba histolytica
DFQEVGE

SEQ ID NO: 2611157 - protein, 5 aa, Entamoeba histolytica
DFQKY

SEQ ID NO: 2611158 - protein, 4 aa, Entamoeba histolytica
DFQP

SEQ ID NO: 2611159 - protein, 4 aa, Entamoeba histolytica
DFQR

SEQ ID NO: 2611160 - protein, 5 aa, Entamoeba histolytica
DFQSE

SEQ ID NO: 2611161 - protein, 9 aa, Entamoeba histolytica
DFSGETDRH

SEQ ID NO: 2611162 - protein, 34 aa, Entamoeba histolytica
DFSISQDEKSTNCQKSHGSERKKFKKDEAKYTLK

SEQ ID NO: 2611163 - protein, 13 aa, Entamoeba histolytica
DFSNSDKLPPLSA

SEQ ID NO: 2611164 - protein, 42 aa, Entamoeba histolytica
DFSQNTSVQEHPKPINTSINQQQLTPTNTISQPPPKTSSTNQ

SEQ ID NO: 2611165 - protein, 10 aa, Entamoeba histolytica
DFSSNGSYVN

SEQ ID NO: 2611166 - protein, 12 aa, Entamoeba histolytica
DFSSSSKKEDKF

SEQ ID NO: 2611167 - protein, 39 aa, Entamoeba histolytica; identical to SEQ ID NO: 2415574

SEQ ID NO: 2611168 - protein, 5 aa, Entamoeba histolytica
DFTEQ

SEQ ID NO: 2611169 - protein, 10 aa, Entamoeba histolytica
DFTPDSAAIA

SEQ ID NO: 2611170 - protein, 4 aa, Entamoeba histolytica
DFTT

SEQ ID NO: 2611171 - protein, 7 aa, Entamoeba histolytica
DFTTPQE

SEQ ID NO: 2611172 - protein, 12 aa, Entamoeba histolytica
DFVSSTNENMQE

SEQ ID NO: 2611173 - protein, 15 aa, Entamoeba histolytica
DFYDGTKKKTQTPEL

SEQ ID NO: 2611174 - protein, 6 aa, Entamoeba histolytica
DGAFYG

SEQ ID NO: 2611175 - protein, 7 aa, Entamoeba histolytica
DGAGQRP

SEQ ID NO: 2611176 - protein, 10 aa, Entamoeba histolytica
DGAKAGRNYY

SEQ ID NO: 2611177 - protein, 10 aa, Entamoeba histolytica
DGAKNDANSE

SEQ ID NO: 2611178 - protein, 8 aa, Entamoeba histolytica
DGAKNDIN

SEQ ID NO: 2611179 - protein, 7 aa, Entamoeba histolytica
DGASKGF

SEQ ID NO: 2611180 - protein, 7 aa, Entamoeba histolytica
DGASTGI

SEQ ID NO: 2611181 - protein, 7 aa, Entamoeba histolytica
DGCGKSN

SEQ ID NO: 2611182 - protein, 4 aa, Entamoeba histolytica
DGCN

SEQ ID NO: 2611183 - protein, 6 aa, Entamoeba histolytica
DGCPTV

SEQ ID NO: 2611184 - protein, 9 aa, Entamoeba histolytica
DGDAKSLKS

SEQ ID NO: 2611185 - protein, 7 aa, Entamoeba histolytica
DGDATHA

SEQ ID NO: 2611186 - protein, 6 aa, Entamoeba histolytica
DGDEIE

SEQ ID NO: 2611187 - protein, 14 aa, Entamoeba histolytica
DGDEINTNAPAMTV

SEQ ID NO: 2611188 - protein, 8 aa, Entamoeba histolytica
DGDGDIDK

SEQ ID NO: 2611189 - protein, 7 aa, Entamoeba histolytica
DGDGDRN

SEQ ID NO: 2611190 - protein, 11 aa, Entamoeba histolytica
DGDGKLTKEEV

SEQ ID NO: 2611191 - protein, 10 aa, Entamoeba histolytica
DGDGWKPTSK

SEQ ID NO: 2611192 - protein, 5 aa, Entamoeba histolytica
DGDGY

SEQ ID NO: 2611193 - protein, 8 aa, Entamoeba histolytica
DGDHSGAW

SEQ ID NO: 2611194 - protein, 4 aa, Entamoeba histolytica
DGDI

SEQ ID NO: 2611195 - protein, 17 aa, Entamoeba histolytica
DGDKQRDNNTESDEDIK

SEQ ID NO: 2611196 - protein, 22 aa, Entamoeba histolytica
DGDNDTGYFEDERGMKQSHMKK

SEQ ID NO: 2611197 - protein, 15 aa, Entamoeba histolytica
DGDNDVVHPQHEEEE

SEQ ID NO: 2611198 - protein, 8 aa, Entamoeba histolytica
DGDNEPAV

SEQ ID NO: 2611199 - protein, 10 aa, Entamoeba histolytica
DGDNEQYANI

SEQ ID NO: 2611200 - protein, 10 aa, Entamoeba histolytica
DGDSYRSPFS

SEQ ID NO: 2611201 - protein, 6 aa, Entamoeba histolytica
DGDVKL

SEQ ID NO: 2611202 - protein, 8 aa, Entamoeba histolytica
DGDYNGTK

SEQ ID NO: 2611203 - protein, 5 aa, Entamoeba histolytica
DGEAA

SEQ ID NO: 2611204 - protein, 28 aa, Entamoeba histolytica
DGEDMKEETTQEQSLQKNDLNHKVKQED

SEQ ID NO: 2611205 - protein, 5 aa, Entamoeba histolytica
DGEDP

SEQ ID NO: 2611206 - protein, 4 aa, Entamoeba histolytica
DGEE

SEQ ID NO: 2611207 - protein, 70 aa, Entamoeba histolytica
DGEEAEQGEEKAKEEGAEEPKEEEKKEVAEEEPKKEEEEKEEEKKEEGAEEPKEEIEGKKVAQKQQGSIP

SEQ ID NO: 2611208 - protein, 5 aa, Entamoeba histolytica
DGEEK

SEQ ID NO: 2611209 - protein, 8 aa, Entamoeba histolytica
DGEESDEL

SEQ ID NO: 2611210 - protein, 4 aa, Entamoeba histolytica
DGEG

SEQ ID NO: 2611211 - protein, 14 aa, Entamoeba histolytica
DGEGIERPNDQEDN

SEQ ID NO: 2611212 - protein, 98 aa, Entamoeba histolytica
DGEGKRKIKKGESSTKEEETKTKNDNEKKEETESVINNNEEQLKVEDKKDETTIISENNENNISTEEPNNNIQSESKKTENITEETEKVLSENEKEEI

SEQ ID NO: 2611213 - protein, 11 aa, Entamoeba histolytica
DGEGNIGPSIA

SEQ ID NO: 2611214 - protein, 9 aa, Entamoeba histolytica
DGEGTIDES

SEQ ID NO: 2611215 - protein, 30 aa, Entamoeba histolytica
DGEKKNGNSCLSSTLTSSISESTQSSSIDL

SEQ ID NO: 2611216 - protein, 8 aa, Entamoeba histolytica
DGENETKS

SEQ ID NO: 2611217 - protein, 13 aa, Entamoeba histolytica
DGENINNDPVSQF

SEQ ID NO: 2611218 - protein, 7 aa, Entamoeba histolytica
DGENNTY

SEQ ID NO: 2611219 - protein, 4 aa, Entamoeba histolytica
DGEP

SEQ ID NO: 2611220 - protein, 5 aa, Entamoeba histolytica
DGEPI

SEQ ID NO: 2611221 - protein, 10 aa, Entamoeba histolytica
DGEPKENINT

SEQ ID NO: 2611222 - protein, 6 aa, Entamoeba histolytica
DGEPVR

SEQ ID NO: 2611223 - protein, 10 aa, Entamoeba histolytica
DGEPYMQSKT

SEQ ID NO: 2611224 - protein, 7 aa, Entamoeba histolytica
DGEQANK

SEQ ID NO: 2611225 - protein, 8 aa, Entamoeba histolytica
DGEQLKEK

SEQ ID NO: 2611226 - protein, 7 aa, Entamoeba histolytica
DGEQVDS

SEQ ID NO: 2611227 - protein, 6 aa, Entamoeba histolytica
DGERQP

SEQ ID NO: 2611228 - protein, 11 aa, Entamoeba histolytica
DGERRTKEEIG

SEQ ID NO: 2611229 - protein, 21 aa, Entamoeba histolytica
DGESGEKGGMASETLSSEVEQ

SEQ ID NO: 2611230 - protein, 7 aa, Entamoeba histolytica
DGESMSN

SEQ ID NO: 2611231 - protein, 8 aa, Entamoeba histolytica
DGETLPTK

SEQ ID NO: 2611232 - protein, 4 aa, Entamoeba histolytica
DGEV

SEQ ID NO: 2611233 - protein, 4 aa, Entamoeba histolytica
DGFD

SEQ ID NO: 2611234 - protein, 6 aa, Entamoeba histolytica
DGFDKQ

SEQ ID NO: 2611235 - protein, 8 aa, Entamoeba histolytica
DGFGNKEY

SEQ ID NO: 2611236 - protein, 4 aa, Entamoeba histolytica
DGFI

SEQ ID NO: 2611237 - protein, 7 aa, Entamoeba histolytica
DGFKKER

SEQ ID NO: 2611238 - protein, 18 aa, Entamoeba histolytica
DGFLTKPKEKKKELKEGM

SEQ ID NO: 2611239 - protein, 16 aa, Entamoeba histolytica
DGFNNNNFNENVGGKE

SEQ ID NO: 2611240 - protein, 6 aa, Entamoeba histolytica
DGFQTS

SEQ ID NO: 2611241 - protein, 4 aa, Entamoeba histolytica
DGFS

SEQ ID NO: 2611242 - protein, 5 aa, Entamoeba histolytica
DGFTG

SEQ ID NO: 2611243 - protein, 5 aa, Entamoeba histolytica
DGGDA

SEQ ID NO: 2611244 - protein, 5 aa, Entamoeba histolytica
DGGDE

SEQ ID NO: 2611245 - protein, 6 aa, Entamoeba histolytica
DGGDIK

SEQ ID NO: 2611246 - protein, 14 aa, Entamoeba histolytica
DGGDKTYHIKSLWE

SEQ ID NO: 2611247 - protein, 6 aa, Entamoeba histolytica
DGGETD

SEQ ID NO: 2611248 - protein, 5 aa, Entamoeba histolytica
DGGGF

SEQ ID NO: 2611249 - protein, 8 aa, Entamoeba histolytica
DGGGSKCT

SEQ ID NO: 2611250 - protein, 9 aa, Entamoeba histolytica
DGGISDKTV

SEQ ID NO: 2611251 - protein, 13 aa, Entamoeba histolytica
DGGIVSSGNELKS

SEQ ID NO: 2611252 - protein, 5 aa, Entamoeba histolytica
DGGKS

SEQ ID NO: 2611253 - protein, 5 aa, Entamoeba histolytica
DGGLA

SEQ ID NO: 2611254 - protein, 7 aa, Entamoeba histolytica
DGGNVTL

SEQ ID NO: 2611255 - protein, 5 aa, Entamoeba histolytica
DGGQD

SEQ ID NO: 2611256 - protein, 7 aa, Entamoeba histolytica
DGGVGKS

SEQ ID NO: 2611257 - protein, 8 aa, Entamoeba histolytica
DGGVGKSA

SEQ ID NO: 2611258 - protein, 14 aa, Entamoeba histolytica
DGHDKPLIEVEYKG

SEQ ID NO: 2611259 - protein, 8 aa, Entamoeba histolytica
DGHSEKIA

SEQ ID NO: 2611260 - protein, 7 aa, Entamoeba histolytica
DGHSGKY

SEQ ID NO: 2611261 - protein, 18 aa, Entamoeba histolytica
DGHSNGGGALSAVAATKS

SEQ ID NO: 2611262 - protein, 4 aa, Entamoeba histolytica
DGHW

SEQ ID NO: 2611263 - protein, 10 aa, Entamoeba histolytica
DGIDDNDPPC

SEQ ID NO: 2611264 - protein, 6 aa, Entamoeba histolytica
DGIEET

SEQ ID NO: 2611265 - protein, 10 aa, Entamoeba histolytica
DGIERSTEET

SEQ ID NO: 2611266 - protein, 4 aa, Entamoeba histolytica
DGIG

SEQ ID NO: 2611267 - protein, 8 aa, Entamoeba histolytica
DGIKEQNI

SEQ ID NO: 2611268 - protein, 7 aa, Entamoeba histolytica
DGINDEG

SEQ ID NO: 2611269 - protein, 7 aa, Entamoeba histolytica
DGINEEM

SEQ ID NO: 2611270 - protein, 14 aa, Entamoeba histolytica
DGINTSVESLEKKK

SEQ ID NO: 2611271 - protein, 6 aa, Entamoeba histolytica
DGIQEE

SEQ ID NO: 2611272 - protein, 5 aa, Entamoeba histolytica
DGISS

SEQ ID NO: 2611273 - protein, 4 aa, Entamoeba histolytica
DGIT

SEQ ID NO: 2611274 - protein, 6 aa, Entamoeba histolytica
DGITQL

SEQ ID NO: 2611275 - protein, 6 aa, Entamoeba histolytica
DGIYPK

SEQ ID NO: 2611276 - protein, 15 aa, Entamoeba histolytica
DGKAGSQSVTEASDL

SEQ ID NO: 2611277 - protein, 8 aa, Entamoeba histolytica
DGKATPFT

SEQ ID NO: 2611278 - protein, 4 aa, Entamoeba histolytica
DGKD

SEQ ID NO: 2611279 - protein, 11 aa, Entamoeba histolytica
DGKDENQYYGT

SEQ ID NO: 2611280 - protein, 17 aa, Entamoeba histolytica
DGKDKSTTSFNQINNNP

SEQ ID NO: 2611281 - protein, 6 aa, Entamoeba histolytica
DGKDLL

SEQ ID NO: 2611282 - protein, 4 aa, Entamoeba histolytica
DGKE

SEQ ID NO: 2611283 - protein, 7 aa, Entamoeba histolytica
DGKEPQY

SEQ ID NO: 2611284 - protein, 8 aa, Entamoeba histolytica
DGKESEDF

SEQ ID NO: 2611285 - protein, 6 aa, Entamoeba histolytica
DGKEVS

SEQ ID NO: 2611286 - protein, 7 aa, Entamoeba histolytica
DGKEYKD

SEQ ID NO: 2611287 - protein, 4 aa, Entamoeba histolytica
DGKF

SEQ ID NO: 2611288 - protein, 12 aa, Entamoeba histolytica
DGKFSSVGTKYP

SEQ ID NO: 2611289 - protein, 7 aa, Entamoeba histolytica
DGKGEFS

SEQ ID NO: 2611290 - protein, 23 aa, Entamoeba histolytica
DGKGIDSKEGNDLEENEDDVYVS

SEQ ID NO: 2611291 - protein, 7 aa, Entamoeba histolytica
DGKHQTT

SEQ ID NO: 2611292 - protein, 38 aa, Entamoeba histolytica
DGKKGGDKDNNGGKFGAFGSSNKTGKQHTYKGKQGGDN

SEQ ID NO: 2611293 - protein, 8 aa, Entamoeba histolytica
DGKKNNVQ

SEQ ID NO: 2611294 - protein, 5 aa, Entamoeba histolytica
DGKKT

SEQ ID NO: 2611295 - protein, 6 aa, Entamoeba histolytica
DGKKTF

SEQ ID NO: 2611296 - protein, 4 aa, Entamoeba histolytica
DGKM

SEQ ID NO: 2611297 - protein, 8 aa, Entamoeba histolytica
DGKNKGKE

SEQ ID NO: 2611298 - protein, 11 aa, Entamoeba histolytica
DGKNPKMIDSS

SEQ ID NO: 2611299 - protein, 9 aa, Entamoeba histolytica
DGKNYDWET

SEQ ID NO: 2611300 - protein, 9 aa, Entamoeba histolytica
DGKNYKDKI

SEQ ID NO: 2611301 - protein, 4 aa, Entamoeba histolytica
DGKP

SEQ ID NO: 2611302 - protein, 8 aa, Entamoeba histolytica
DGKPAENS

SEQ ID NO: 2611303 - protein, 14 aa, Entamoeba histolytica
DGKPIGKKQGQKLE

SEQ ID NO: 2611304 - protein, 21 aa, Entamoeba histolytica
DGKPISQDFHNSTRKPSENDY

SEQ ID NO: 2611305 - protein, 22 aa, Entamoeba histolytica
DGKPLAADYHDQNDVPSENDYS

SEQ ID NO: 2611306 - protein, 5 aa, Entamoeba histolytica
DGKPV

SEQ ID NO: 2611307 - protein, 10 aa, Entamoeba histolytica
DGKQFNKSDI

SEQ ID NO: 2611308 - protein, 9 aa, Entamoeba histolytica
DGKQNNKYT

SEQ ID NO: 2611309 - protein, 7 aa, Entamoeba histolytica
DGKQYRS

SEQ ID NO: 2611310 - protein, 6 aa, Entamoeba histolytica
DGKSGV

SEQ ID NO: 2611311 - protein, 9 aa, Entamoeba histolytica
DGKSRELDH

SEQ ID NO: 2611312 - protein, 10 aa, Entamoeba histolytica
DGKTKEFTDG

SEQ ID NO: 2611313 - protein, 5 aa, Entamoeba histolytica
DGKTL

SEQ ID NO: 2611314 - protein, 8 aa, Entamoeba histolytica
DGKTMDES

SEQ ID NO: 2611315 - protein, 7 aa, Entamoeba histolytica
DGKTPRL

SEQ ID NO: 2611316 - protein, 5 aa, Entamoeba histolytica
DGKTY

SEQ ID NO: 2611317 - protein, 16 aa, Entamoeba histolytica
DGKVEGNDGEKIKIEI

SEQ ID NO: 2611318 - protein, 14 aa, Entamoeba histolytica
DGKVKQVSSSEYVP

SEQ ID NO: 2611319 - protein, 6 aa, Entamoeba histolytica
DGKVKS

SEQ ID NO: 2611320 - protein, 8 aa, Entamoeba histolytica
DGKVTMTK

SEQ ID NO: 2611321 - protein, 11 aa, Entamoeba histolytica
DGKYNSSWTGQ

SEQ ID NO: 2611322 - protein, 8 aa, Entamoeba histolytica
DGKYTEPK

SEQ ID NO: 2611323 - protein, 16 aa, Entamoeba histolytica
DGLDNESLQSESAPQA

SEQ ID NO: 2611324 - protein, 8 aa, Entamoeba histolytica
DGLDSTKE

SEQ ID NO: 2611325 - protein, 11 aa, Entamoeba histolytica
DGLEKQTQKNI

SEQ ID NO: 2611326 - protein, 13 aa, Entamoeba histolytica
DGLLPNGNINTTT

SEQ ID NO: 2611327 - protein, 7 aa, Entamoeba histolytica
DGLNKRG

SEQ ID NO: 2611328 - protein, 7 aa, Entamoeba histolytica
DGLTARD

SEQ ID NO: 2611329 - protein, 8 aa, Entamoeba histolytica
DGLTDKQQ

SEQ ID NO: 2611330 - protein, 9 aa, Entamoeba histolytica
DGMDDESIN

SEQ ID NO: 2611331 - protein, 18 aa, Entamoeba histolytica
DGMEGEAINRTHSTPSQI

SEQ ID NO: 2611332 - protein, 6 aa, Entamoeba histolytica
DGMSSA

SEQ ID NO: 2611333 - protein, 12 aa, Entamoeba histolytica
DGMSSGDRGGIT

SEQ ID NO: 2611334 - protein, 7 aa, Entamoeba histolytica
DGNATEL

SEQ ID NO: 2611335 - protein, 6 aa, Entamoeba histolytica
DGNCTG

SEQ ID NO: 2611336 - protein, 4 aa, Entamoeba histolytica
DGNE

SEQ ID NO: 2611337 - protein, 5 aa, Entamoeba histolytica
DGNEP

SEQ ID NO: 2611338 - protein, 7 aa, Entamoeba histolytica
DGNEPAV

SEQ ID NO: 2611339 - protein, 5 aa, Entamoeba histolytica
DGNES

SEQ ID NO: 2611340 - protein, 6 aa, Entamoeba histolytica
DGNESE

SEQ ID NO: 2611341 - protein, 15 aa, Entamoeba histolytica
DGNFASTDTRERPSL

SEQ ID NO: 2611342 - protein, 6 aa, Entamoeba histolytica
DGNFDT

SEQ ID NO: 2611343 - protein, 6 aa, Entamoeba histolytica
DGNFTE

SEQ ID NO: 2611344 - protein, 6 aa, Entamoeba histolytica
DGNGEI

SEQ ID NO: 2611345 - protein, 13 aa, Entamoeba histolytica
DGNGTSDSAFKPE

SEQ ID NO: 2611346 - protein, 5 aa, Entamoeba histolytica
DGNHT

SEQ ID NO: 2611347 - protein, 4 aa, Entamoeba histolytica
DGNI

SEQ ID NO: 2611348 - protein, 8 aa, Entamoeba histolytica
DGNIGKFS

SEQ ID NO: 2611349 - protein, 10 aa, Entamoeba histolytica
DGNKESVEFP

SEQ ID NO: 2611350 - protein, 10 aa, Entamoeba histolytica
DGNKPNKCSY

SEQ ID NO: 2611351 - protein, 8 aa, Entamoeba histolytica
DGNNEIPN

SEQ ID NO: 2611352 - protein, 8 aa, Entamoeba histolytica
DGNNEKAM

SEQ ID NO: 2611353 - protein, 7 aa, Entamoeba histolytica
DGNPLGS

SEQ ID NO: 2611354 - protein, 8 aa, Entamoeba histolytica
DGNPNISS

SEQ ID NO: 2611355 - protein, 7 aa, Entamoeba histolytica
DGNPPYM

SEQ ID NO: 2611356 - protein, 5 aa, Entamoeba histolytica
DGNPQ

SEQ ID NO: 2611357 - protein, 5 aa, Entamoeba histolytica
DGNQR

SEQ ID NO: 2611358 - protein, 6 aa, Entamoeba histolytica
DGNQSH

SEQ ID NO: 2611359 - protein, 10 aa, Entamoeba histolytica
DGNTSEEHRR

SEQ ID NO: 2611360 - protein, 4 aa, Entamoeba histolytica
DGNV

SEQ ID NO: 2611361 - protein, 6 aa, Entamoeba histolytica
DGNVGK

SEQ ID NO: 2611362 - protein, 21 aa, Entamoeba histolytica
DGPAETPTQPRPENITNKQYE

SEQ ID NO: 2611363 - protein, 4 aa, Entamoeba histolytica
DGPF

SEQ ID NO: 2611364 - protein, 6 aa, Entamoeba histolytica
DGPFDK

SEQ ID NO: 2611365 - protein, 5 aa, Entamoeba histolytica
DGPFE

SEQ ID NO: 2611366 - protein, 6 aa, Entamoeba histolytica
DGPFGE

SEQ ID NO: 2611367 - protein, 5 aa, Entamoeba histolytica
DGPGN

SEQ ID NO: 2611368 - protein, 5 aa, Entamoeba histolytica
DGPIG

SEQ ID NO: 2611369 - protein, 7 aa, Entamoeba histolytica
DGPIKNG

SEQ ID NO: 2611370 - protein, 4 aa, Entamoeba histolytica
DGPN

SEQ ID NO: 2611371 - protein, 11 aa, Entamoeba histolytica
DGPPDTPYEGG

SEQ ID NO: 2611372 - protein, 10 aa, Entamoeba histolytica
DGPSSPSFAR

SEQ ID NO: 2611373 - protein, 5 aa, Entamoeba histolytica
DGQDS

SEQ ID NO: 2611374 - protein, 10 aa, Entamoeba histolytica
DGQEDYTKFE

SEQ ID NO: 2611375 - protein, 10 aa, Entamoeba histolytica
DGQGTSVEQA

SEQ ID NO: 2611376 - protein, 9 aa, Entamoeba histolytica
DGQKEENEF

SEQ ID NO: 2611377 - protein, 11 aa, Entamoeba histolytica
DGQLKEEDPLE

SEQ ID NO: 2611378 - protein, 10 aa, Entamoeba histolytica
DGQPFTQDEI

SEQ ID NO: 2611379 - protein, 12 aa, Entamoeba histolytica
DGQPIKVKFKNQ

SEQ ID NO: 2611380 - protein, 6 aa, Entamoeba histolytica
DGQQKK

SEQ ID NO: 2611381 - protein, 16 aa, Entamoeba histolytica
DGQQSSVELQSTSNLK

SEQ ID NO: 2611382 - protein, 4 aa, Entamoeba histolytica
DGQR

SEQ ID NO: 2611383 - protein, 11 aa, Entamoeba histolytica
DGQTQQEDRVE

SEQ ID NO: 2611384 - protein, 6 aa, Entamoeba histolytica
DGRARQ

SEQ ID NO: 2611385 - protein, 6 aa, Entamoeba histolytica
DGRDDK

SEQ ID NO: 2611386 - protein, 6 aa, Entamoeba histolytica
DGRDDL

SEQ ID NO: 2611387 - protein, 5 aa, Entamoeba histolytica
DGRDE

SEQ ID NO: 2611388 - protein, 6 aa, Entamoeba histolytica
DGRFSQ

SEQ ID NO: 2611389 - protein, 9 aa, Entamoeba histolytica
DGRFTEYAP

SEQ ID NO: 2611390 - protein, 6 aa, Entamoeba histolytica
DGRLKP

SEQ ID NO: 2611391 - protein, 7 aa, Entamoeba histolytica
DGRNDIS

SEQ ID NO: 2611392 - protein, 6 aa, Entamoeba histolytica
DGRNKL

SEQ ID NO: 2611393 - protein, 6 aa, Entamoeba histolytica
DGRNLN

SEQ ID NO: 2611394 - protein, 6 aa, Entamoeba histolytica
DGRNSK

SEQ ID NO: 2611395 - protein, 13 aa, Entamoeba histolytica
DGRRIVTGNEKGE

SEQ ID NO: 2611396 - protein, 8 aa, Entamoeba histolytica
DGRRTTEM

SEQ ID NO: 2611397 - protein, 15 aa, Entamoeba histolytica
DGRSPNDVKNRFFWE

SEQ ID NO: 2611398 - protein, 10 aa, Entamoeba histolytica
DGRTQETNTN

SEQ ID NO: 2611399 - protein, 9 aa, Entamoeba histolytica
DGRTTFTEY

SEQ ID NO: 2611400 - protein, 12 aa, Entamoeba histolytica
DGRYPNAPDGNT

SEQ ID NO: 2611401 - protein, 17 aa, Entamoeba histolytica
DGSDLPDGVEFPDVLLN

SEQ ID NO: 2611402 - protein, 8 aa, Entamoeba histolytica
DGSERANE

SEQ ID NO: 2611403 - protein, 10 aa, Entamoeba histolytica
DGSFNDNTLK

SEQ ID NO: 2611404 - protein, 5 aa, Entamoeba histolytica
DGSFQ

SEQ ID NO: 2611405 - protein, 4 aa, Entamoeba histolytica
DGSG

SEQ ID NO: 2611406 - protein, 9 aa, Entamoeba histolytica
DGSGADNFY

SEQ ID NO: 2611407 - protein, 8 aa, Entamoeba histolytica
DGSGNEKL

SEQ ID NO: 2611408 - protein, 8 aa, Entamoeba histolytica
DGSIDRKK

SEQ ID NO: 2611409 - protein, 5 aa, Entamoeba histolytica
DGSIK

SEQ ID NO: 2611410 - protein, 16 aa, Entamoeba histolytica
DGSIPSKCVLTKIPLA

SEQ ID NO: 2611411 - protein, 15 aa, Entamoeba histolytica
DGSISASGDENFTKT

SEQ ID NO: 2611412 - protein, 4 aa, Entamoeba histolytica
DGSK

SEQ ID NO: 2611413 - protein, 20 aa, Entamoeba histolytica
DGSKFSSSTLRSREKSMNQC

SEQ ID NO: 2611414 - protein, 22 aa, Entamoeba histolytica
DGSKFSSSTLRSRERLQNNSTQ

SEQ ID NO: 2611415 - protein, 12 aa, Entamoeba histolytica
DGSKVFESQQEV

SEQ ID NO: 2611416 - protein, 5 aa, Entamoeba histolytica
DGSLR

SEQ ID NO: 2611417 - protein, 8 aa, Entamoeba histolytica
DGSLTTAV

SEQ ID NO: 2611418 - protein, 4 aa, Entamoeba histolytica
DGSN

SEQ ID NO: 2611419 - protein, 36 aa, Entamoeba histolytica
DGSNDTIDKNQKGGSLFNTTSPLHKEEDGHDRSPIT

SEQ ID NO: 2611420 - protein, 4 aa, Entamoeba histolytica
DGSP

SEQ ID NO: 2611421 - protein, 6 aa, Entamoeba histolytica
DGSPED

SEQ ID NO: 2611422 - protein, 8 aa, Entamoeba histolytica
DGSPNMGK

SEQ ID NO: 2611423 - protein, 9 aa, Entamoeba histolytica
DGSPNTAKQ

SEQ ID NO: 2611424 - protein, 4 aa, Entamoeba histolytica
DGSQ

SEQ ID NO: 2611425 - protein, 14 aa, Entamoeba histolytica
DGSSLFKKNDKGKF

SEQ ID NO: 2611426 - protein, 7 aa, Entamoeba histolytica
DGSSQLL

SEQ ID NO: 2611427 - protein, 6 aa, Entamoeba histolytica
DGSTGC

SEQ ID NO: 2611428 - protein, 9 aa, Entamoeba histolytica
DGSTSQHNY

SEQ ID NO: 2611429 - protein, 8 aa, Entamoeba histolytica
DGSTYKSR

SEQ ID NO: 2611430 - protein, 6 aa, Entamoeba histolytica
DGSVES

SEQ ID NO: 2611431 - protein, 5 aa, Entamoeba histolytica
DGSVK

SEQ ID NO: 2611432 - protein, 13 aa, Entamoeba histolytica
DGSVRSNDRQNAI

SEQ ID NO: 2611433 - protein, 13 aa, Entamoeba histolytica
DGSYTYTSKTEEK

SEQ ID NO: 2611434 - protein, 11 aa, Entamoeba histolytica
DGTAPHTGIGD

SEQ ID NO: 2611435 - protein, 5 aa, Entamoeba histolytica
DGTDC

SEQ ID NO: 2611436 - protein, 7 aa, Entamoeba histolytica
DGTEIPH

SEQ ID NO: 2611437 - protein, 6 aa, Entamoeba histolytica
DGTENA

SEQ ID NO: 2611438 - protein, 5 aa, Entamoeba histolytica
DGTIP

SEQ ID NO: 2611439 - protein, 9 aa, Entamoeba histolytica
DGTKGMPGA

SEQ ID NO: 2611440 - protein, 5 aa, Entamoeba histolytica
DGTKQ

SEQ ID NO: 2611441 - protein, 9 aa, Entamoeba histolytica
DGTKSDRTI

SEQ ID NO: 2611442 - protein, 4 aa, Entamoeba histolytica
DGTL

SEQ ID NO: 2611443 - protein, 12 aa, Entamoeba histolytica
DGTNNKGKLGAN

SEQ ID NO: 2611444 - protein, 7 aa, Entamoeba histolytica
DGTPQTL

SEQ ID NO: 2611445 - protein, 7 aa, Entamoeba histolytica
DGTQEIH

SEQ ID NO: 2611446 - protein, 9 aa, Entamoeba histolytica
DGTRTEKDI

SEQ ID NO: 2611447 - protein, 7 aa, Entamoeba histolytica
DGTSGSI

SEQ ID NO: 2611448 - protein, 6 aa, Entamoeba histolytica
DGTSLV

SEQ ID NO: 2611449 - protein, 4 aa, Entamoeba histolytica
DGTT

SEQ ID NO: 2611450 - protein, 20 aa, Entamoeba histolytica
DGTTGYMTSTDKVRDGVGDK

SEQ ID NO: 2611451 - protein, 5 aa, Entamoeba histolytica
DGTTN

SEQ ID NO: 2611452 - protein, 71 aa, Entamoeba histolytica
DGTVESNQNEVLPEGEECNSEELESAKKKLLGSSDQLPHSSKEEEEEEALSVASDDSSEEEKPNKKHYDAA

SEQ ID NO: 2611453 - protein, 6 aa, Entamoeba histolytica
DGTYGS

SEQ ID NO: 2611454 - protein, 30 aa, Entamoeba histolytica
DGTYKEEYKEDKEQSIEEGEEDTEIKDNNN

SEQ ID NO: 2611455 - protein, 6 aa, Entamoeba histolytica
DGTYYP

SEQ ID NO: 2611456 - protein, 9 aa, Entamoeba histolytica
DGVEKDDYK

SEQ ID NO: 2611457 - protein, 8 aa, Entamoeba histolytica
DGVGEDGY

SEQ ID NO: 2611458 - protein, 6 aa, Entamoeba histolytica
DGVGKK

SEQ ID NO: 2611459 - protein, 7 aa, Entamoeba histolytica
DGVGRES

SEQ ID NO: 2611460 - protein, 10 aa, Entamoeba histolytica
DGVKEKEAKK

SEQ ID NO: 2611461 - protein, 5 aa, Entamoeba histolytica
DGVNG

SEQ ID NO: 2611462 - protein, 7 aa, Entamoeba histolytica
DGVNKGD

SEQ ID NO: 2611463 - protein, 10 aa, Entamoeba histolytica
DGVSKNLRKN

SEQ ID NO: 2611464 - protein, 6 aa, Entamoeba histolytica
DGVTDV

SEQ ID NO: 2611465 - protein, 9 aa, Entamoeba histolytica
DGVTQEEMN

SEQ ID NO: 2611466 - protein, 16 aa, Entamoeba histolytica
DGVTSARLNPNVTDGL

SEQ ID NO: 2611467 - protein, 5 aa, Entamoeba histolytica
DGYEG

SEQ ID NO: 2611468 - protein, 8 aa, Entamoeba histolytica
DGYGGHTT

SEQ ID NO: 2611469 - protein, 6 aa, Entamoeba histolytica
DGYIKP

SEQ ID NO: 2611470 - protein, 5 aa, Entamoeba histolytica
DGYKH

SEQ ID NO: 2611471 - protein, 25 aa, Entamoeba histolytica
DGYNPNVTDQHEVEKDDEAKNTMKN

SEQ ID NO: 2611472 - protein, 9 aa, Entamoeba histolytica
DGYNPQTRE

SEQ ID NO: 2611473 - protein, 7 aa, Entamoeba histolytica
DGYPNGC

SEQ ID NO: 2611474 - protein, 4 aa, Entamoeba histolytica
DHAI

SEQ ID NO: 2611475 - protein, 7 aa, Entamoeba histolytica
DHDGLIN

SEQ ID NO: 2611476 - protein, 6 aa, Entamoeba histolytica
DHDPRC

SEQ ID NO: 2611477 - protein, 6 aa, Entamoeba histolytica
DHEESR

SEQ ID NO: 2611478 - protein, 9 aa, Entamoeba histolytica
DHEGRNKTL

SEQ ID NO: 2611479 - protein, 9 aa, Entamoeba histolytica
DHEHPEDPY

SEQ ID NO: 2611480 - protein, 7 aa, Entamoeba histolytica
DHEKQKV

SEQ ID NO: 2611481 - protein, 10 aa, Entamoeba histolytica
DHERKSGRLS

SEQ ID NO: 2611482 - protein, 5 aa, Entamoeba histolytica
DHESS

SEQ ID NO: 2611483 - protein, 13 aa, Entamoeba histolytica
DHFGGYSGVGNDE

SEQ ID NO: 2611484 - protein, 5 aa, Entamoeba histolytica
DHGQY

SEQ ID NO: 2611485 - protein, 4 aa, Entamoeba histolytica
DHHE

SEQ ID NO: 2611486 - protein, 8 aa, Entamoeba histolytica
DHHHKPGQ

SEQ ID NO: 2611487 - protein, 5 aa, Entamoeba histolytica
DHHQR

SEQ ID NO: 2611488 - protein, 5 aa, Entamoeba histolytica
DHHRS

SEQ ID NO: 2611489 - protein, 6 aa, Entamoeba histolytica
DHIGAE

SEQ ID NO: 2611490 - protein, 6 aa, Entamoeba histolytica
DHKDGV

SEQ ID NO: 2611491 - protein, 8 aa, Entamoeba histolytica
DHKESESV

SEQ ID NO: 2611492 - protein, 11 aa, Entamoeba histolytica
DHKHDENTEVE

SEQ ID NO: 2611493 - protein, 13 aa, Entamoeba histolytica
DHKLSNSSSSKAH

SEQ ID NO: 2611494 - protein, 7 aa, Entamoeba histolytica
DHKNGQY

SEQ ID NO: 2611495 - protein, 28 aa, Entamoeba histolytica
DHKPSYQEDRQRIRESGNYISDQEKVNG

SEQ ID NO: 2611496 - protein, 10 aa, Entamoeba histolytica
DHKPTNPNEF

SEQ ID NO: 2611497 - protein, 8 aa, Entamoeba histolytica
DHNGHAGL

SEQ ID NO: 2611498 - protein, 7 aa, Entamoeba histolytica
DHNLYDK

SEQ ID NO: 2611499 - protein, 10 aa, Entamoeba histolytica
DHNQSPRNTY

SEQ ID NO: 2611500 - protein, 5 aa, Entamoeba histolytica
DHNSN

SEQ ID NO: 2611501 - protein, 9 aa, Entamoeba histolytica
DHNSSFKRR

SEQ ID NO: 2611502 - protein, 11 aa, Entamoeba histolytica
DHPDEAKLGTC

SEQ ID NO: 2611503 - protein, 5 aa, Entamoeba histolytica
DHPPF

SEQ ID NO: 2611504 - protein, 6 aa, Entamoeba histolytica
DHPQGQ

SEQ ID NO: 2611505 - protein, 5 aa, Entamoeba histolytica
DHPQS

SEQ ID NO: 2611506 - protein, 6 aa, Entamoeba histolytica
DHPVSY

SEQ ID NO: 2611507 - protein, 8 aa, Entamoeba histolytica
DHQHKPGQ

SEQ ID NO: 2611508 - protein, 17 aa, Entamoeba histolytica
DHQLSRKRGRKPKLTDE

SEQ ID NO: 2611509 - protein, 8 aa, Entamoeba histolytica
DHQPNQQQ

SEQ ID NO: 2611510 - protein, 13 aa, Entamoeba histolytica
DHQTRASKEGKRV

SEQ ID NO: 2611511 - protein, 15 aa, Entamoeba histolytica
DHRETDKEKLETNKQ

SEQ ID NO: 2611512 - protein, 7 aa, Entamoeba histolytica
DHRKEDV

SEQ ID NO: 2611513 - protein, 8 aa, Entamoeba histolytica
DHRKTKCK

SEQ ID NO: 2611514 - protein, 4 aa, Entamoeba histolytica
DHSG

SEQ ID NO: 2611515 - protein, 6 aa, Entamoeba histolytica
DHSGTM

SEQ ID NO: 2611516 - protein, 24 aa, Entamoeba histolytica
DHSINPQKSINSRDSSPKQERPSD

SEQ ID NO: 2611517 - protein, 17 aa, Entamoeba histolytica
DHSKPKEVKKLLPFEDD

SEQ ID NO: 2611518 - protein, 14 aa, Entamoeba histolytica
DHSKQQSDSLTSKD

SEQ ID NO: 2611519 - protein, 6 aa, Entamoeba histolytica
DHSNDF

SEQ ID NO: 2611520 - protein, 4 aa, Entamoeba histolytica
DHSS

SEQ ID NO: 2611521 - protein, 8 aa, Entamoeba histolytica
DHTEQTKT

SEQ ID NO: 2611522 - protein, 12 aa, Entamoeba histolytica
DHTGANTRRSII

SEQ ID NO: 2611523 - protein, 12 aa, Entamoeba histolytica
DHTHNKRKNSYY

SEQ ID NO: 2611524 - protein, 14 aa, Entamoeba histolytica
DHTKKRNNKKYNKT

SEQ ID NO: 2611525 - protein, 4 aa, Entamoeba histolytica
DHTS

SEQ ID NO: 2611526 - protein, 4 aa, Entamoeba histolytica
DHVD

SEQ ID NO: 2611527 - protein, 9 aa, Entamoeba histolytica
DIAGKAANV

SEQ ID NO: 2611528 - protein, 9 aa, Entamoeba histolytica
DIAKKTQPL

SEQ ID NO: 2611529 - protein, 5 aa, Entamoeba histolytica
DIAPL

SEQ ID NO: 2611530 - protein, 4 aa, Entamoeba histolytica
DIAT

SEQ ID NO: 2611531 - protein, 7 aa, Entamoeba histolytica
DIDAGQR

SEQ ID NO: 2611532 - protein, 11 aa, Entamoeba histolytica
DIDANDKDEYI

SEQ ID NO: 2611533 - protein, 8 aa, Entamoeba histolytica
DIDAQNDL

SEQ ID NO: 2611534 - protein, 7 aa, Entamoeba histolytica
DIDKEEL

SEQ ID NO: 2611535 - protein, 4 aa, Entamoeba histolytica
DIDN

SEQ ID NO: 2611536 - protein, 8 aa, Entamoeba histolytica
DIDPKKER

SEQ ID NO: 2611537 - protein, 6 aa, Entamoeba histolytica
DIDPKR

SEQ ID NO: 2611538 - protein, 5 aa, Entamoeba histolytica
DIDPT

SEQ ID NO: 2611539 - protein, 10 aa, Entamoeba histolytica
DIDQGELEDD

SEQ ID NO: 2611540 - protein, 9 aa, Entamoeba histolytica
DIEAPKDEY

SEQ ID NO: 2611541 - protein, 13 aa, Entamoeba histolytica
DIEDYKSGSNVTL

SEQ ID NO: 2611542 - protein, 4 aa, Entamoeba histolytica
DIEE

SEQ ID NO: 2611543 - protein, 18 aa, Entamoeba histolytica
DIEEDLKEYSNGSNESIT

SEQ ID NO: 2611544 - protein, 7 aa, Entamoeba histolytica
DIEEIDN

SEQ ID NO: 2611545 - protein, 6 aa, Entamoeba histolytica
DIEETL

SEQ ID NO: 2611546 - protein, 13 aa, Entamoeba histolytica
DIEGEDSNKAMKK

SEQ ID NO: 2611547 - protein, 94 aa, Entamoeba histolytica
DIEGSDDKKHKSSDSSSEEKKPKMKKDKKEKKDKKDKKDKKDKKEKKDKKNKKDKKDKKDKKDKKDKKNKKDKKNKKDKEEKKPRKTNKKINKE

SEQ ID NO: 2611548 - protein, 7 aa, Entamoeba histolytica
DIEIPST

SEQ ID NO: 2611549 - protein, 5 aa, Entamoeba histolytica
DIEKK

SEQ ID NO: 2611550 - protein, 4 aa, Entamoeba histolytica
DIEN

SEQ ID NO: 2611551 - protein, 8 aa, Entamoeba histolytica
DIENDPQN

SEQ ID NO: 2611552 - protein, 44 aa, Entamoeba histolytica
DIENEDALSGEKTLSMGSSLDRDDDDIEQFNNKKGMEEENNDIL

SEQ ID NO: 2611553 - protein, 6 aa, Entamoeba histolytica
DIENEK

SEQ ID NO: 2611554 - protein, 5 aa, Entamoeba histolytica
DIENG

SEQ ID NO: 2611555 - protein, 5 aa, Entamoeba histolytica
DIENS

SEQ ID NO: 2611556 - protein, 14 aa, Entamoeba histolytica
DIEPSDKNTSQYDT

SEQ ID NO: 2611557 - protein, 5 aa, Entamoeba histolytica
DIEQK

SEQ ID NO: 2611558 - protein, 6 aa, Entamoeba histolytica
DIESGQ

SEQ ID NO: 2611559 - protein, 12 aa, Entamoeba histolytica
DIESPIDDDGLL

SEQ ID NO: 2611560 - protein, 15 aa, Entamoeba histolytica
DIESQPKKKKDQPTV

SEQ ID NO: 2611561 - protein, 8 aa, Entamoeba histolytica
DIESQQKV

SEQ ID NO: 2611562 - protein, 8 aa, Entamoeba histolytica
DIESRETH

SEQ ID NO: 2611563 - protein, 8 aa, Entamoeba histolytica
DIESSFDA

SEQ ID NO: 2611564 - protein, 8 aa, Entamoeba histolytica
DIESTSRN

SEQ ID NO: 2611565 - protein, 5 aa, Entamoeba histolytica
DIETI

SEQ ID NO: 2611566 - protein, 5 aa, Entamoeba histolytica
DIETT

SEQ ID NO: 2611567 - protein, 16 aa, Entamoeba histolytica
DIEYYNDKNDINESIN

SEQ ID NO: 2611568 - protein, 12 aa, Entamoeba histolytica
DIFKGKYKGKTK

SEQ ID NO: 2611569 - protein, 10 aa, Entamoeba histolytica
DIGDRIDNDD

SEQ ID NO: 2611570 - protein, 7 aa, Entamoeba histolytica
DIGEASY

SEQ ID NO: 2611571 - protein, 5 aa, Entamoeba histolytica
DIGEE

SEQ ID NO: 2611572 - protein, 7 aa, Entamoeba histolytica
DIGEEEM

SEQ ID NO: 2611573 - protein, 6 aa, Entamoeba histolytica
DIGEGG

SEQ ID NO: 2611574 - protein, 4 aa, Entamoeba histolytica
DIGG

SEQ ID NO: 2611575 - protein, 15 aa, Entamoeba histolytica
DIGMKEENKKDKKKE

SEQ ID NO: 2611576 - protein, 23 aa, Entamoeba histolytica
DIGNKKSTTLPKIPEDMKTTEKR

SEQ ID NO: 2611577 - protein, 7 aa, Entamoeba histolytica
DIGSNFS

SEQ ID NO: 2611578 - protein, 5 aa, Entamoeba histolytica
DIGST

SEQ ID NO: 2611579 - protein, 6 aa, Entamoeba histolytica
DIHTGD

SEQ ID NO: 2611580 - protein, 4 aa, Entamoeba histolytica
DIIT

SEQ ID NO: 2611581 - protein, 5 aa, Entamoeba histolytica
DIITG

SEQ ID NO: 2611582 - protein, 13 aa, Entamoeba histolytica
DIITGEGKDIRTK

SEQ ID NO: 2611583 - protein, 22 aa, Entamoeba histolytica
DIKDGIGKTRIKPGKGEKSLSM

SEQ ID NO: 2611584 - protein, 6 aa, Entamoeba histolytica
DIKDGT

SEQ ID NO: 2611585 - protein, 14 aa, Entamoeba histolytica
DIKEEDLEDPERGG

SEQ ID NO: 2611586 - protein, 8 aa, Entamoeba histolytica
DIKKQERA

SEQ ID NO: 2611587 - protein, 9 aa, Entamoeba histolytica
DIKKQERAI

SEQ ID NO: 2611588 - protein, 8 aa, Entamoeba histolytica
DIKKQNSG

SEQ ID NO: 2611589 - protein, 9 aa, Entamoeba histolytica
DIKNDKDHI

SEQ ID NO: 2611590 - protein, 6 aa, Entamoeba histolytica
DIKPED

SEQ ID NO: 2611591 - protein, 12 aa, Entamoeba histolytica
DIKPNEQQQYQT

SEQ ID NO: 2611592 - protein, 27 aa, Entamoeba histolytica
DIKPRNSELSIDEGEKRLLEMKNGIDD

SEQ ID NO: 2611593 - protein, 7 aa, Entamoeba histolytica
DIKSNYK

SEQ ID NO: 2611594 - protein, 11 aa, Entamoeba histolytica
DIKSSDNQRLN

SEQ ID NO: 2611595 - protein, 10 aa, Entamoeba histolytica
DIKTGAQQGS

SEQ ID NO: 2611596 - protein, 5 aa, Entamoeba histolytica
DIKTK

SEQ ID NO: 2611597 - protein, 6 aa, Entamoeba histolytica
DIKTKY

SEQ ID NO: 2611598 - protein, 8 aa, Entamoeba histolytica
DILGSGSF

SEQ ID NO: 2611599 - protein, 7 aa, Entamoeba histolytica
DILPQEH

SEQ ID NO: 2611600 - protein, 11 aa, Entamoeba histolytica
DILSGKKNIYD

SEQ ID NO: 2611601 - protein, 4 aa, Entamoeba histolytica
DINC

SEQ ID NO: 2611602 - protein, 19 aa, Entamoeba histolytica
DINDDFEEVRKEAKSATDA

SEQ ID NO: 2611603 - protein, 10 aa, Entamoeba histolytica
DINDFEEQTP

SEQ ID NO: 2611604 - protein, 8 aa, Entamoeba histolytica
DINDISGT

SEQ ID NO: 2611605 - protein, 10 aa, Entamoeba histolytica
DINDNDPPSL

SEQ ID NO: 2611606 - protein, 6 aa, Entamoeba histolytica
DINEDD

SEQ ID NO: 2611607 - protein, 11 aa, Entamoeba histolytica
DINENTIEGDI

SEQ ID NO: 2611608 - protein, 6 aa, Entamoeba histolytica
DINESL

SEQ ID NO: 2611609 - protein, 25 aa, Entamoeba histolytica
DINESTVKEDSQKSDVSSNSQTTIK

SEQ ID NO: 2611610 - protein, 6 aa, Entamoeba histolytica
DINETI

SEQ ID NO: 2611611 - protein, 14 aa, Entamoeba histolytica
DINGNGKISKEEFK

SEQ ID NO: 2611612 - protein, 25 aa, Entamoeba histolytica
DINKSIKKTKKSIKKDIKKSKKQIK

SEQ ID NO: 2611613 - protein, 4 aa, Entamoeba histolytica
DINQ

SEQ ID NO: 2611614 - protein, 7 aa, Entamoeba histolytica
DINTTDD

SEQ ID NO: 2611615 - protein, 4 aa, Entamoeba histolytica
DIPA

SEQ ID NO: 2611616 - protein, 12 aa, Entamoeba histolytica
DIPAETQAKLQS

SEQ ID NO: 2611617 - protein, 15 aa, Entamoeba histolytica
DIPEDVTDPSQVPPM

SEQ ID NO: 2611618 - protein, 5 aa, Entamoeba histolytica
DIPEE

SEQ ID NO: 2611619 - protein, 12 aa, Entamoeba histolytica
DIPEKRTSKENL

SEQ ID NO: 2611620 - protein, 22 aa, Entamoeba histolytica
DIPENEKTESDNTETISEDFDS

SEQ ID NO: 2611621 - protein, 10 aa, Entamoeba histolytica
DIPEQPQVEE

SEQ ID NO: 2611622 - protein, 6 aa, Entamoeba histolytica
DIPGEL

SEQ ID NO: 2611623 - protein, 5 aa, Entamoeba histolytica
DIPKE

SEQ ID NO: 2611624 - protein, 16 aa, Entamoeba histolytica
DIPKGSTFENTQKYGS

SEQ ID NO: 2611625 - protein, 5 aa, Entamoeba histolytica
DIPKV

SEQ ID NO: 2611626 - protein, 6 aa, Entamoeba histolytica
DIPKVP

SEQ ID NO: 2611627 - protein, 5 aa, Entamoeba histolytica
DIPLP

SEQ ID NO: 2611628 - protein, 5 aa, Entamoeba histolytica
DIPNL

SEQ ID NO: 2611629 - protein, 11 aa, Entamoeba histolytica
DIPNSVENPLK

SEQ ID NO: 2611630 - protein, 7 aa, Entamoeba histolytica
DIPNTEC

SEQ ID NO: 2611631 - protein, 22 aa, Entamoeba histolytica
DIPNTTPIISDKPKKKKARSWI

SEQ ID NO: 2611632 - protein, 9 aa, Entamoeba histolytica
DIPPAYSGE

SEQ ID NO: 2611633 - protein, 7 aa, Entamoeba histolytica
DIPPLEE

SEQ ID NO: 2611634 - protein, 14 aa, Entamoeba histolytica
DIPPLEEQIKKPTS

SEQ ID NO: 2611635 - protein, 11 aa, Entamoeba histolytica
DIPPNQSNIEV

SEQ ID NO: 2611636 - protein, 10 aa, Entamoeba histolytica
DIPPSDDENY

SEQ ID NO: 2611637 - protein, 11 aa, Entamoeba histolytica
DIPQHPPSCPR

SEQ ID NO: 2611638 - protein, 7 aa, Entamoeba histolytica
DIPQQRV

SEQ ID NO: 2611639 - protein, 6 aa, Entamoeba histolytica
DIPSDH

SEQ ID NO: 2611640 - protein, 5 aa, Entamoeba histolytica
DIPTG

SEQ ID NO: 2611641 - protein, 54 aa, Entamoeba histolytica
DIPTQSDDSLKQKPSILQPKTSGESQTSSSITHSTNSVNNSSSNISPSLNKSTD

SEQ ID NO: 2611642 - protein, 19 aa, Entamoeba histolytica
DIPTQSKSPRSKPISSNPF

SEQ ID NO: 2611643 - protein, 6 aa, Entamoeba histolytica
DIPTRY

SEQ ID NO: 2611644 - protein, 6 aa, Entamoeba histolytica
DIPTSV

SEQ ID NO: 2611645 - protein, 9 aa, Entamoeba histolytica
DIPTSVSKL

SEQ ID NO: 2611646 - protein, 6 aa, Entamoeba histolytica
DIPTVT

SEQ ID NO: 2611647 - protein, 5 aa, Entamoeba histolytica
DIPYP

SEQ ID NO: 2611648 - protein, 4 aa, Entamoeba histolytica
DIQE

SEQ ID NO: 2611649 - protein, 7 aa, Entamoeba histolytica
DIQEQDN

SEQ ID NO: 2611650 - protein, 20 aa, Entamoeba histolytica
DIQESQTKSQDDGTTDNEPI

SEQ ID NO: 2611651 - protein, 7 aa, Entamoeba histolytica
DIQKSSG

SEQ ID NO: 2611652 - protein, 18 aa, Entamoeba histolytica
DIQPDQEEGSEDSSSEFQ

SEQ ID NO: 2611653 - protein, 7 aa, Entamoeba histolytica
DIQPGVR

SEQ ID NO: 2611654 - protein, 13 aa, Entamoeba histolytica
DIQQKQREQTLNG

SEQ ID NO: 2611655 - protein, 20 aa, Entamoeba histolytica
DIQQSTPSNNKNKPHIITPS

SEQ ID NO: 2611656 - protein, 4 aa, Entamoeba histolytica
DIQR

SEQ ID NO: 2611657 - protein, 10 aa, Entamoeba histolytica
DIQTIGPQTG

SEQ ID NO: 2611658 - protein, 6 aa, Entamoeba histolytica
DIQTKK

SEQ ID NO: 2611659 - protein, 8 aa, Entamoeba histolytica
DIQTNPEL

SEQ ID NO: 2611660 - protein, 5 aa, Entamoeba histolytica
DIRDS

SEQ ID NO: 2611661 - protein, 6 aa, Entamoeba histolytica
DIRNEK

SEQ ID NO: 2611662 - protein, 7 aa, Entamoeba histolytica
DIRNNSA

SEQ ID NO: 2611663 - protein, 6 aa, Entamoeba histolytica
DISADE

SEQ ID NO: 2611664 - protein, 11 aa, Entamoeba histolytica
DISDGVSQKTA

SEQ ID NO: 2611665 - protein, 16 aa, Entamoeba histolytica
DISDKEKINEFEKRSK

SEQ ID NO: 2611666 - protein, 6 aa, Entamoeba histolytica
DISEKK

SEQ ID NO: 2611667 - protein, 5 aa, Entamoeba histolytica
DISES

SEQ ID NO: 2611668 - protein, 4 aa, Entamoeba histolytica
DISG

SEQ ID NO: 2611669 - protein, 17 aa, Entamoeba histolytica
DISGSERSQFKFIRRNF

SEQ ID NO: 2611670 - protein, 4 aa, Entamoeba histolytica
DISK

SEQ ID NO: 2611671 - protein, 9 aa, Entamoeba histolytica
DISKTSAPI

SEQ ID NO: 2611672 - protein, 10 aa, Entamoeba histolytica
DISNNETQNN

SEQ ID NO: 2611673 - protein, 9 aa, Entamoeba histolytica
DISQDNNRE

SEQ ID NO: 2611674 - protein, 5 aa, Entamoeba histolytica
DISQE

SEQ ID NO: 2611675 - protein, 7 aa, Entamoeba histolytica
DISQKKA

SEQ ID NO: 2611676 - protein, 28 aa, Entamoeba histolytica
DISQSAVESIKRNATYNNTTKIQPSESD

SEQ ID NO: 2611677 - protein, 9 aa, Entamoeba histolytica
DISRGQSNG

SEQ ID NO: 2611678 - protein, 10 aa, Entamoeba histolytica
DISSDEELEK

SEQ ID NO: 2611679 - protein, 27 aa, Entamoeba histolytica
DISSDSNSGFDKRGDETFTPRERNRGY

SEQ ID NO: 2611680 - protein, 27 aa, Entamoeba histolytica
DISSDSNSGFDKRGDETVTLREGNRGY

SEQ ID NO: 2611681 - protein, 26 aa, Entamoeba histolytica
DISSDSNSGFDKRGDGTVTPRERNHG

SEQ ID NO: 2611682 - protein, 25 aa, Entamoeba histolytica
DISSDSNSGFDKRGDGTVTPRERNY

SEQ ID NO: 2611683 - protein, 7 aa, Entamoeba histolytica
DISSLDN

SEQ ID NO: 2611684 - protein, 16 aa, Entamoeba histolytica
DISSSEERKETSVKSV

SEQ ID NO: 2611685 - protein, 41 aa, Entamoeba histolytica
DISVEEDGTEEDEKEERKKKRPRSTRTPKSRGRKDKGKPLT

SEQ ID NO: 2611686 - protein, 24 aa, Entamoeba histolytica
DITANEKYQKLKEEISQGIKEDEF

SEQ ID NO: 2611687 - protein, 8 aa, Entamoeba histolytica
DITDTDKL

SEQ ID NO: 2611688 - protein, 10 aa, Entamoeba histolytica
DITEESTMTS

SEQ ID NO: 2611689 - protein, 6 aa, Entamoeba histolytica
DITHPI

SEQ ID NO: 2611690 - protein, 10 aa, Entamoeba histolytica
DITKGSTAKE

SEQ ID NO: 2611691 - protein, 8 aa, Entamoeba histolytica
DITPEEKE

SEQ ID NO: 2611692 - protein, 5 aa, Entamoeba histolytica
DITPK

SEQ ID NO: 2611693 - protein, 17 aa, Entamoeba histolytica
DITPQPQVNNITNQQEL

SEQ ID NO: 2611694 - protein, 5 aa, Entamoeba histolytica
DITQP

SEQ ID NO: 2611695 - protein, 6 aa, Entamoeba histolytica
DITQRI

SEQ ID NO: 2611696 - protein, 6 aa, Entamoeba histolytica
DITSNE

SEQ ID NO: 2611697 - protein, 7 aa, Entamoeba histolytica
DITSPEE

SEQ ID NO: 2611698 - protein, 12 aa, Entamoeba histolytica
DITSSIDKMKEG

SEQ ID NO: 2611699 - protein, 6 aa, Entamoeba histolytica
DITTKQ

SEQ ID NO: 2611700 - protein, 19 aa, Entamoeba histolytica
DIYDSTTYDYSSSNGLNYD

SEQ ID NO: 2611701 - protein, 6 aa, Entamoeba histolytica
DIYNDG

SEQ ID NO: 2611702 - protein, 9 aa, Entamoeba histolytica
DKAASVRES

SEQ ID NO: 2611703 - protein, 19 aa, Entamoeba histolytica
DKADDNENDDLKDSDSEGD

SEQ ID NO: 2611704 - protein, 13 aa, Entamoeba histolytica
DKAEAQSKELEEI

SEQ ID NO: 2611705 - protein, 19 aa, Entamoeba histolytica
DKAEDAKRAVEQLNGTEVD

SEQ ID NO: 2611706 - protein, 11 aa, Entamoeba histolytica
DKAEDKTTNDI

SEQ ID NO: 2611707 - protein, 4 aa, Entamoeba histolytica
DKAG

SEQ ID NO: 2611708 - protein, 10 aa, Entamoeba histolytica
DKAGITEGEI

SEQ ID NO: 2611709 - protein, 12 aa, Entamoeba histolytica
DKAKEPSLDNQT

SEQ ID NO: 2611710 - protein, 11 aa, Entamoeba histolytica
DKAKIENDEEL

SEQ ID NO: 2611711 - protein, 4 aa, Entamoeba histolytica
DKAL

SEQ ID NO: 2611712 - protein, 19 aa, Entamoeba histolytica
DKARKDLETAQDFEPDSKD

SEQ ID NO: 2611713 - protein, 6 aa, Entamoeba histolytica
DKASGL

SEQ ID NO: 2611714 - protein, 6 aa, Entamoeba histolytica
DKASGS

SEQ ID NO: 2611715 - protein, 9 aa, Entamoeba histolytica
DKASIGEQS

SEQ ID NO: 2611716 - protein, 5 aa, Entamoeba histolytica
DKASR

SEQ ID NO: 2611717 - protein, 8 aa, Entamoeba histolytica
DKATGRMK

SEQ ID NO: 2611718 - protein, 4 aa, Entamoeba histolytica
DKCG

SEQ ID NO: 2611719 - protein, 5 aa, Entamoeba histolytica
DKCQK

SEQ ID NO: 2611720 - protein, 15 aa, Entamoeba histolytica
DKCTNDPIPTRFSVV

SEQ ID NO: 2611721 - protein, 8 aa, Entamoeba histolytica
DKDARQSA

SEQ ID NO: 2611722 - protein, 9 aa, Entamoeba histolytica
DKDDVKPED

SEQ ID NO: 2611723 - protein, 5 aa, Entamoeba histolytica
DKDDW

SEQ ID NO: 2611724 - protein, 7 aa, Entamoeba histolytica
DKDEGEI

SEQ ID NO: 2611725 - protein, 7 aa, Entamoeba histolytica
DKDFTKE

SEQ ID NO: 2611726 - protein, 6 aa, Entamoeba histolytica
DKDFTP

SEQ ID NO: 2611727 - protein, 9 aa, Entamoeba histolytica
DKDGIQNET

SEQ ID NO: 2611728 - protein, 8 aa, Entamoeba histolytica
DKDGSVNV

SEQ ID NO: 2611729 - protein, 9 aa, Entamoeba histolytica
DKDGTKNTV

SEQ ID NO: 2611730 - protein, 9 aa, Entamoeba histolytica
DKDHHADEV

SEQ ID NO: 2611731 - protein, 38 aa, Entamoeba histolytica
DKDHKRKARDDERRRSERDREWERERRRGGIKGIDRRG

SEQ ID NO: 2611732 - protein, 20 aa, Entamoeba histolytica
DKDIQDEKKPKKRITRKEKK

SEQ ID NO: 2611733 - protein, 7 aa, Entamoeba histolytica
DKDKAMS

SEQ ID NO: 2611734 - protein, 7 aa, Entamoeba histolytica
DKDKDEL

SEQ ID NO: 2611735 - protein, 8 aa, Entamoeba histolytica
DKDKINDT

SEQ ID NO: 2611736 - protein, 24 aa, Entamoeba histolytica
DKDKKPKKRENKEDKAEETKAQME

SEQ ID NO: 2611737 - protein, 5 aa, Entamoeba histolytica
DKDKR

SEQ ID NO: 2611738 - protein, 11 aa, Entamoeba histolytica
DKDKSGNLDEQ

SEQ ID NO: 2611739 - protein, 7 aa, Entamoeba histolytica
DKDLKGR

SEQ ID NO: 2611740 - protein, 5 aa, Entamoeba histolytica
DKDNA

SEQ ID NO: 2611741 - protein, 18 aa, Entamoeba histolytica
DKDQRLDSSKALDEIKAG

SEQ ID NO: 2611742 - protein, 6 aa, Entamoeba histolytica
DKDSQN

SEQ ID NO: 2611743 - protein, 7 aa, Entamoeba histolytica
DKDTKCE

SEQ ID NO: 2611744 - protein, 7 aa, Entamoeba histolytica
DKDTLTP

SEQ ID NO: 2611745 - protein, 9 aa, Entamoeba histolytica
DKDTPEERE

SEQ ID NO: 2611746 - protein, 6 aa, Entamoeba histolytica
DKDYHK

SEQ ID NO: 2611747 - protein, 9 aa, Entamoeba histolytica
DKEAEKRKQ

SEQ ID NO: 2611748 - protein, 5 aa, Entamoeba histolytica
DKEAF

SEQ ID NO: 2611749 - protein, 37 aa, Entamoeba histolytica
DKEAKQYKKYSFKEKKKLKTIAGGASDIGVRPANEDT

SEQ ID NO: 2611750 - protein, 10 aa, Entamoeba histolytica
DKEARDYAAE

SEQ ID NO: 2611751 - protein, 9 aa, Entamoeba histolytica
DKECANDPY

SEQ ID NO: 2611752 - protein, 15 aa, Entamoeba histolytica
DKECKTSSDVKQYTV

SEQ ID NO: 2611753 - protein, 4 aa, Entamoeba histolytica
DKED

SEQ ID NO: 2611754 - protein, 6 aa, Entamoeba histolytica
DKEDDL

SEQ ID NO: 2611755 - protein, 7 aa, Entamoeba histolytica
DKEDIYE

SEQ ID NO: 2611756 - protein, 129 aa, Entamoeba histolytica
DKEDNDKSMEEENAIGKGMKGEAEGMGSEEEGNVKEEKEKKKEEHQEQAMEEGNDEKEEKGEEQQEEGQDVEETEKLQTLPGKEQIEEENQEEGGEDDEFKMNEEGEENMSIEEENNNENEEEEQGDQF

SEQ ID NO: 2611757 - protein, 7 aa, Entamoeba histolytica
DKEDPQL

SEQ ID NO: 2611758 - protein, 10 aa, Entamoeba histolytica
DKEDSCHSLE

SEQ ID NO: 2611759 - protein, 8 aa, Entamoeba histolytica
DKEDSTNM

SEQ ID NO: 2611760 - protein, 14 aa, Entamoeba histolytica
DKEEDKTKRNEIEF

SEQ ID NO: 2611761 - protein, 16 aa, Entamoeba histolytica
DKEEGNKALNELDKQY

SEQ ID NO: 2611762 - protein, 8 aa, Entamoeba histolytica
DKEEKNTA

SEQ ID NO: 2611763 - protein, 9 aa, Entamoeba histolytica
DKEEVDTND

SEQ ID NO: 2611764 - protein, 16 aa, Entamoeba histolytica
DKEEWGKEIEKQEELA

SEQ ID NO: 2611765 - protein, 7 aa, Entamoeba histolytica
DKEFKGN

SEQ ID NO: 2611766 - protein, 9 aa, Entamoeba histolytica
DKEGGVCSN

SEQ ID NO: 2611767 - protein, 5 aa, Entamoeba histolytica
DKEGL

SEQ ID NO: 2611768 - protein, 4 aa, Entamoeba histolytica
DKEI

SEQ ID NO: 2611769 - protein, 7 aa, Entamoeba histolytica
DKEIDEG

SEQ ID NO: 2611770 - protein, 16 aa, Entamoeba histolytica
DKEIEEMKQKNKEIED

SEQ ID NO: 2611771 - protein, 9 aa, Entamoeba histolytica
DKEIGEKEI

SEQ ID NO: 2611772 - protein, 14 aa, Entamoeba histolytica
DKEIGSMEKSLNRQ

SEQ ID NO: 2611773 - protein, 5 aa, Entamoeba histolytica
DKEIK

SEQ ID NO: 2611774 - protein, 11 aa, Entamoeba histolytica
DKEIKKQLTEL

SEQ ID NO: 2611775 - protein, 7 aa, Entamoeba histolytica
DKEIPEF

SEQ ID NO: 2611776 - protein, 9 aa, Entamoeba histolytica
DKEKECGDM

SEQ ID NO: 2611777 - protein, 9 aa, Entamoeba histolytica
DKEKERKIT

SEQ ID NO: 2611778 - protein, 8 aa, Entamoeba histolytica
DKEKLRKE

SEQ ID NO: 2611779 - protein, 9 aa, Entamoeba histolytica
DKEKNKTNR

SEQ ID NO: 2611780 - protein, 12 aa, Entamoeba histolytica
DKEKRKKHIEQE

SEQ ID NO: 2611781 - protein, 7 aa, Entamoeba histolytica
DKEKTSY

SEQ ID NO: 2611782 - protein, 10 aa, Entamoeba histolytica
DKEKYQEERI

SEQ ID NO: 2611783 - protein, 4 aa, Entamoeba histolytica
DKEL

SEQ ID NO: 2611784 - protein, 6 aa, Entamoeba histolytica
DKELTS

SEQ ID NO: 2611785 - protein, 4 aa, Entamoeba histolytica
DKEM

SEQ ID NO: 2611786 - protein, 4 aa, Entamoeba histolytica
DKEN

SEQ ID NO: 2611787 - protein, 5 aa, Entamoeba histolytica
DKEND

SEQ ID NO: 2611788 - protein, 13 aa, Entamoeba histolytica
DKENIPTYGAKIL

SEQ ID NO: 2611789 - protein, 9 aa, Entamoeba histolytica
DKENKENHI

SEQ ID NO: 2611790 - protein, 9 aa, Entamoeba histolytica
DKENKLLPN

SEQ ID NO: 2611791 - protein, 7 aa, Entamoeba histolytica
DKENPNK

SEQ ID NO: 2611792 - protein, 11 aa, Entamoeba histolytica
DKEPDNTNTKE

SEQ ID NO: 2611793 - protein, 4 aa, Entamoeba histolytica
DKEQ

SEQ ID NO: 2611794 - protein, 28 aa, Entamoeba histolytica
DKEQSTGDFKDDKTTQLDKEKKRTSSLD

SEQ ID NO: 2611795 - protein, 7 aa, Entamoeba histolytica
DKERESL

SEQ ID NO: 2611796 - protein, 9 aa, Entamoeba histolytica
DKERKYTKQ

SEQ ID NO: 2611797 - protein, 7 aa, Entamoeba histolytica
DKERNDV

SEQ ID NO: 2611798 - protein, 6 aa, Entamoeba histolytica
DKESFK

SEQ ID NO: 2611799 - protein, 23 aa, Entamoeba histolytica
DKESGEPSRMTAGVDDEAERQRI

SEQ ID NO: 2611800 - protein, 11 aa, Entamoeba histolytica
DKESHQPTKEL

SEQ ID NO: 2611801 - protein, 12 aa, Entamoeba histolytica
DKESKQISQEQQ

SEQ ID NO: 2611802 - protein, 8 aa, Entamoeba histolytica
DKESKRIV

SEQ ID NO: 2611803 - protein, 7 aa, Entamoeba histolytica
DKETDEQ

SEQ ID NO: 2611804 - protein, 5 aa, Entamoeba histolytica
DKETI

SEQ ID NO: 2611805 - protein, 35 aa, Entamoeba histolytica
DKETNKNPILPEQPKEKKHQRKRKLRSAEERKPSM

SEQ ID NO: 2611806 - protein, 9 aa, Entamoeba histolytica
DKETPPSPL

SEQ ID NO: 2611807 - protein, 7 aa, Entamoeba histolytica
DKETYDN

SEQ ID NO: 2611808 - protein, 7 aa, Entamoeba histolytica
DKEVTDN

SEQ ID NO: 2611809 - protein, 7 aa, Entamoeba histolytica
DKEWTGT

SEQ ID NO: 2611810 - protein, 13 aa, Entamoeba histolytica
DKFDDQEPSTSTN

SEQ ID NO: 2611811 - protein, 14 aa, Entamoeba histolytica
DKFDEQEPSTSTTF

SEQ ID NO: 2611812 - protein, 8 aa, Entamoeba histolytica
DKFDSRPC

SEQ ID NO: 2611813 - protein, 6 aa, Entamoeba histolytica
DKFDYQ

SEQ ID NO: 2611814 - protein, 11 aa, Entamoeba histolytica
DKFGTKQADKL

SEQ ID NO: 2611815 - protein, 9 aa, Entamoeba histolytica
DKFKQEIDE

SEQ ID NO: 2611816 - protein, 4 aa, Entamoeba histolytica
DKFQ

SEQ ID NO: 2611817 - protein, 10 aa, Entamoeba histolytica
DKFTDSSQQC

SEQ ID NO: 2611818 - protein, 6 aa, Entamoeba histolytica
DKFTKT

SEQ ID NO: 2611819 - protein, 5 aa, Entamoeba histolytica
DKFTP

SEQ ID NO: 2611820 - protein, 4 aa, Entamoeba histolytica
DKGA

SEQ ID NO: 2611821 - protein, 7 aa, Entamoeba histolytica
DKGCRDE

SEQ ID NO: 2611822 - protein, 6 aa, Entamoeba histolytica
DKGEEV

SEQ ID NO: 2611823 - protein, 6 aa, Entamoeba histolytica
DKGEIF

SEQ ID NO: 2611824 - protein, 8 aa, Entamoeba histolytica
DKGFDDRR

SEQ ID NO: 2611825 - protein, 6 aa, Entamoeba histolytica
DKGGEI

SEQ ID NO: 2611826 - protein, 7 aa, Entamoeba histolytica
DKGIDTQ

SEQ ID NO: 2611827 - protein, 6 aa, Entamoeba histolytica
DKGKGV

SEQ ID NO: 2611828 - protein, 7 aa, Entamoeba histolytica
DKGKLES

SEQ ID NO: 2611829 - protein, 8 aa, Entamoeba histolytica
DKGKPGDR

SEQ ID NO: 2611830 - protein, 9 aa, Entamoeba histolytica
DKGNEGENA

SEQ ID NO: 2611831 - protein, 8 aa, Entamoeba histolytica
DKGNPFTR

SEQ ID NO: 2611832 - protein, 13 aa, Entamoeba histolytica
DKGNSQKKSLRRE

SEQ ID NO: 2611833 - protein, 6 aa, Entamoeba histolytica
DKGQEI

SEQ ID NO: 2611834 - protein, 4 aa, Entamoeba histolytica
DKGS

SEQ ID NO: 2611835 - protein, 6 aa, Entamoeba histolytica
DKGSEG

SEQ ID NO: 2611836 - protein, 9 aa, Entamoeba histolytica
DKGSKTSKF

SEQ ID NO: 2611837 - protein, 9 aa, Entamoeba histolytica
DKGSPEDKM

SEQ ID NO: 2611838 - protein, 6 aa, Entamoeba histolytica
DKGTDA

SEQ ID NO: 2611839 - protein, 7 aa, Entamoeba histolytica
DKGTGIV

SEQ ID NO: 2611840 - protein, 8 aa, Entamoeba histolytica
DKGTSARL

SEQ ID NO: 2611841 - protein, 9 aa, Entamoeba histolytica
DKHDPDRNI

SEQ ID NO: 2611842 - protein, 27 aa, Entamoeba histolytica
DKHEEEPKKEKRINEIKEEEKKEEGIL

SEQ ID NO: 2611843 - protein, 8 aa, Entamoeba histolytica
DKHEEGQK

SEQ ID NO: 2611844 - protein, 7 aa, Entamoeba histolytica
DKHKNRI

SEQ ID NO: 2611845 - protein, 8 aa, Entamoeba histolytica
DKHPNTPQ

SEQ ID NO: 2611846 - protein, 5 aa, Entamoeba histolytica
DKIAK

SEQ ID NO: 2611847 - protein, 6 aa, Entamoeba histolytica
DKIDTV

SEQ ID NO: 2611848 - protein, 7 aa, Entamoeba histolytica
DKIENPT

SEQ ID NO: 2611849 - protein, 10 aa, Entamoeba histolytica
DKIERDEEED

SEQ ID NO: 2611850 - protein, 4 aa, Entamoeba histolytica
DKIF

SEQ ID NO: 2611851 - protein, 6 aa, Entamoeba histolytica
DKIGES

SEQ ID NO: 2611852 - protein, 10 aa, Entamoeba histolytica
DKIGKDDKLG

SEQ ID NO: 2611853 - protein, 7 aa, Entamoeba histolytica
DKIIPSD

SEQ ID NO: 2611854 - protein, 9 aa, Entamoeba histolytica
DKIISSSKD

SEQ ID NO: 2611855 - protein, 8 aa, Entamoeba histolytica
DKIKNQKW

SEQ ID NO: 2611856 - protein, 18 aa, Entamoeba histolytica
DKIKPIPKQYKKKSKKGF

SEQ ID NO: 2611857 - protein, 12 aa, Entamoeba histolytica
DKIKQKKAERIT

SEQ ID NO: 2611858 - protein, 22 aa, Entamoeba histolytica
DKINEPIQKEKKQGIKKTYSVG

SEQ ID NO: 2611859 - protein, 14 aa, Entamoeba histolytica
DKINESKGTTSPNM

SEQ ID NO: 2611860 - protein, 7 aa, Entamoeba histolytica
DKINKKE

SEQ ID NO: 2611861 - protein, 5 aa, Entamoeba histolytica
DKINV

SEQ ID NO: 2611862 - protein, 6 aa, Entamoeba histolytica
DKIPNE

SEQ ID NO: 2611863 - protein, 6 aa, Entamoeba histolytica
DKIPPD

SEQ ID NO: 2611864 - protein, 8 aa, Entamoeba histolytica
DKIPRSLN

SEQ ID NO: 2611865 - protein, 5 aa, Entamoeba histolytica
DKIPS

SEQ ID NO: 2611866 - protein, 4 aa, Entamoeba histolytica
DKIQ

SEQ ID NO: 2611867 - protein, 10 aa, Entamoeba histolytica
DKIQADKPRA

SEQ ID NO: 2611868 - protein, 19 aa, Entamoeba histolytica
DKISELESKLSAAELDKQE

SEQ ID NO: 2611869 - protein, 5 aa, Entamoeba histolytica
DKISG

SEQ ID NO: 2611870 - protein, 6 aa, Entamoeba histolytica
DKISNG

SEQ ID NO: 2611871 - protein, 8 aa, Entamoeba histolytica
DKITCDAD

SEQ ID NO: 2611872 - protein, 6 aa, Entamoeba histolytica
DKITEE

SEQ ID NO: 2611873 - protein, 18 aa, Entamoeba histolytica
DKKAEEAKNEKEKAEKMR

SEQ ID NO: 2611874 - protein, 8 aa, Entamoeba histolytica
DKKCALPS

SEQ ID NO: 2611875 - protein, 5 aa, Entamoeba histolytica
DKKDD

SEQ ID NO: 2611876 - protein, 217 aa, Entamoeba histolytica
DKKDDKDKEEKKKEEKKKDKSHHEKEESQKIKEEAKKKAEEEAKKKAEEEEAKKKAEEEAKKKAEEEAKKKAEEEAKKKAEEEAKKKAEEEEAKKKAEEEAKKKAEEEAKKKAEEEAKKKAEEEEAKKKAEEEEAKKKAEEEAKKKAEEEAKKKAEEEAKKKAEEEAKKKAEEEAKKKAEEEKKNQPQGLGLGGGLGQPQGLGLGGGLGQPQGLGLG

SEQ ID NO: 2611877 - protein, 6 aa, Entamoeba histolytica
DKKDGF

SEQ ID NO: 2611878 - protein, 5 aa, Entamoeba histolytica
DKKDL

SEQ ID NO: 2611879 - protein, 7 aa, Entamoeba histolytica
DKKEAFG

SEQ ID NO: 2611880 - protein, 9 aa, Entamoeba histolytica
DKKEEKLKE

SEQ ID NO: 2611881 - protein, 5 aa, Entamoeba histolytica
DKKEG

SEQ ID NO: 2611882 - protein, 7 aa, Entamoeba histolytica
DKKEISI

SEQ ID NO: 2611883 - protein, 9 aa, Entamoeba histolytica
DKKEKTEQA

SEQ ID NO: 2611884 - protein, 9 aa, Entamoeba histolytica
DKKEKTKNF

SEQ ID NO: 2611885 - protein, 13 aa, Entamoeba histolytica
DKKEKTKRMEEEI

SEQ ID NO: 2611886 - protein, 7 aa, Entamoeba histolytica
DKKELEN

SEQ ID NO: 2611887 - protein, 14 aa, Entamoeba histolytica
DKKELSETMNGKER

SEQ ID NO: 2611888 - protein, 8 aa, Entamoeba histolytica
DKKENKVI

SEQ ID NO: 2611889 - protein, 6 aa, Entamoeba histolytica
DKKEPA

SEQ ID NO: 2611890 - protein, 6 aa, Entamoeba histolytica
DKKEPY

SEQ ID NO: 2611891 - protein, 5 aa, Entamoeba histolytica
DKKEQ

SEQ ID NO: 2611892 - protein, 5 aa, Entamoeba histolytica
DKKER

SEQ ID NO: 2611893 - protein, 5 aa, Entamoeba histolytica
DKKEY

SEQ ID NO: 2611894 - protein, 7 aa, Entamoeba histolytica
DKKEYQK

SEQ ID NO: 2611895 - protein, 15 aa, Entamoeba histolytica
DKKGAERACSRDGSI

SEQ ID NO: 2611896 - protein, 5 aa, Entamoeba histolytica
DKKGF

SEQ ID NO: 2611897 - protein, 9 aa, Entamoeba histolytica
DKKGGEANV

SEQ ID NO: 2611898 - protein, 5 aa, Entamoeba histolytica
DKKGL

SEQ ID NO: 2611899 - protein, 17 aa, Entamoeba histolytica
DKKHSEINLSEEQVNEK

SEQ ID NO: 2611900 - protein, 7 aa, Entamoeba histolytica
DKKIEGC

SEQ ID NO: 2611901 - protein, 7 aa, Entamoeba histolytica
DKKIKPN

SEQ ID NO: 2611902 - protein, 17 aa, Entamoeba histolytica
DKKKDDKKKDKKKSKTF

SEQ ID NO: 2611903 - protein, 18 aa, Entamoeba histolytica
DKKKESKQNEKNSPTKDC

SEQ ID NO: 2611904 - protein, 10 aa, Entamoeba histolytica
DKKKEVTPTI

SEQ ID NO: 2611905 - protein, 21 aa, Entamoeba histolytica
DKKKREKNISSTNLNENNEPE

SEQ ID NO: 2611906 - protein, 11 aa, Entamoeba histolytica
DKKKSESLSLN

SEQ ID NO: 2611907 - protein, 8 aa, Entamoeba histolytica
DKKKYDVQ

SEQ ID NO: 2611908 - protein, 15 aa, Entamoeba histolytica
DKKMGDSILSWAKSW

SEQ ID NO: 2611909 - protein, 6 aa, Entamoeba histolytica
DKKNAT

SEQ ID NO: 2611910 - protein, 7 aa, Entamoeba histolytica
DKKNDRT

SEQ ID NO: 2611911 - protein, 85 aa, Entamoeba histolytica
DKKNHEIKKEEKIEKEENEAEESKKDNIDEEKEEEELVEKQRKQKEIQEQEEAARQKQLEEQQKEAATSSDKSKEKTDKAKEKSL

SEQ ID NO: 2611912 - protein, 7 aa, Entamoeba histolytica
DKKPLVR

SEQ ID NO: 2611913 - protein, 21 aa, Entamoeba histolytica
DKKPRQKKEKIEKRQEKKRSK

SEQ ID NO: 2611914 - protein, 31 aa, Entamoeba histolytica
DKKQQLKQDQRGGTYNESCEEEEKKENLEDF

SEQ ID NO: 2611915 - protein, 9 aa, Entamoeba histolytica
DKKQQTIED

SEQ ID NO: 2611916 - protein, 10 aa, Entamoeba histolytica
DKKRKRTKEV

SEQ ID NO: 2611917 - protein, 7 aa, Entamoeba histolytica
DKKRYEC

SEQ ID NO: 2611918 - protein, 8 aa, Entamoeba histolytica
DKKSDNPL

SEQ ID NO: 2611919 - protein, 8 aa, Entamoeba histolytica
DKKSDREK

SEQ ID NO: 2611920 - protein, 8 aa, Entamoeba histolytica
DKKSHQSW

SEQ ID NO: 2611921 - protein, 30 aa, Entamoeba histolytica
DKKSQEEEIEEKQQNTIDNLNEQEKKEPNK

SEQ ID NO: 2611922 - protein, 9 aa, Entamoeba histolytica
DKKSSADIS

SEQ ID NO: 2611923 - protein, 9 aa, Entamoeba histolytica
DKKTFESTK

SEQ ID NO: 2611924 - protein, 9 aa, Entamoeba histolytica
DKKTGYDAR

SEQ ID NO: 2611925 - protein, 8 aa, Entamoeba histolytica
DKKTHNPI

SEQ ID NO: 2611926 - protein, 8 aa, Entamoeba histolytica
DKKTSSLL

SEQ ID NO: 2611927 - protein, 8 aa, Entamoeba histolytica
DKKTTGIE

SEQ ID NO: 2611928 - protein, 9 aa, Entamoeba histolytica
DKKVVEETV

SEQ ID NO: 2611929 - protein, 8 aa, Entamoeba histolytica
DKKWKKRT

SEQ ID NO: 2611930 - protein, 15 aa, Entamoeba histolytica
DKKYRSLTKVGNKPV

SEQ ID NO: 2611931 - protein, 26 aa, Entamoeba histolytica
DKLAKQRNNDNQQRNNVGNDDQQRRD

SEQ ID NO: 2611932 - protein, 7 aa, Entamoeba histolytica
DKLDQTT

SEQ ID NO: 2611933 - protein, 9 aa, Entamoeba histolytica
DKLEEENPE

SEQ ID NO: 2611934 - protein, 17 aa, Entamoeba histolytica
DKLETDQTGETEEDRQK

SEQ ID NO: 2611935 - protein, 9 aa, Entamoeba histolytica
DKLKGKERW

SEQ ID NO: 2611936 - protein, 15 aa, Entamoeba histolytica
DKLKRSEIDETQKRI

SEQ ID NO: 2611937 - protein, 14 aa, Entamoeba histolytica
DKLKSENEKLRTDV

SEQ ID NO: 2611938 - protein, 5 aa, Entamoeba histolytica
DKLKT

SEQ ID NO: 2611939 - protein, 14 aa, Entamoeba histolytica
DKLNKKDKKVPLSD

SEQ ID NO: 2611940 - protein, 7 aa, Entamoeba histolytica
DKLNNYG

SEQ ID NO: 2611941 - protein, 5 aa, Entamoeba histolytica
DKLPD

SEQ ID NO: 2611942 - protein, 9 aa, Entamoeba histolytica
DKLPERPQG

SEQ ID NO: 2611943 - protein, 7 aa, Entamoeba histolytica
DKLPHSS

SEQ ID NO: 2611944 - protein, 14 aa, Entamoeba histolytica
DKLPKNEEGKVNGK

SEQ ID NO: 2611945 - protein, 16 aa, Entamoeba histolytica
DKLPNDSSVNEEIKSA

SEQ ID NO: 2611946 - protein, 19 aa, Entamoeba histolytica
DKLQQQQFDEQRKKYGKRN

SEQ ID NO: 2611947 - protein, 23 aa, Entamoeba histolytica
DKLQSDLKEEQNEGNKIKKQIDE

SEQ ID NO: 2611948 - protein, 5 aa, Entamoeba histolytica
DKLRE

SEQ ID NO: 2611949 - protein, 7 aa, Entamoeba histolytica
DKLSEVQ

SEQ ID NO: 2611950 - protein, 13 aa, Entamoeba histolytica
DKLTNEETKEFSE

SEQ ID NO: 2611951 - protein, 8 aa, Entamoeba histolytica
DKMNENEV

SEQ ID NO: 2611952 - protein, 7 aa, Entamoeba histolytica
DKNACKS

SEQ ID NO: 2611953 - protein, 5 aa, Entamoeba histolytica
DKNAF

SEQ ID NO: 2611954 - protein, 7 aa, Entamoeba histolytica
DKNDNIP

SEQ ID NO: 2611955 - protein, 8 aa, Entamoeba histolytica
DKNEPENI

SEQ ID NO: 2611956 - protein, 9 aa, Entamoeba histolytica
DKNEPQTAA

SEQ ID NO: 2611957 - protein, 14 aa, Entamoeba histolytica
DKNERGKESNEENP

SEQ ID NO: 2611958 - protein, 7 aa, Entamoeba histolytica
DKNESSL

SEQ ID NO: 2611959 - protein, 5 aa, Entamoeba histolytica
DKNEV

SEQ ID NO: 2611960 - protein, 6 aa, Entamoeba histolytica
DKNEYR

SEQ ID NO: 2611961 - protein, 4 aa, Entamoeba histolytica
DKNG

SEQ ID NO: 2611962 - protein, 5 aa, Entamoeba histolytica
DKNGD

SEQ ID NO: 2611963 - protein, 11 aa, Entamoeba histolytica
DKNGKRDKEIY

SEQ ID NO: 2611964 - protein, 8 aa, Entamoeba histolytica
DKNGVSTI

SEQ ID NO: 2611965 - protein, 6 aa, Entamoeba histolytica
DKNHQG

SEQ ID NO: 2611966 - protein, 4 aa, Entamoeba histolytica
DKNK

SEQ ID NO: 2611967 - protein, 8 aa, Entamoeba histolytica
DKNKNIRV

SEQ ID NO: 2611968 - protein, 7 aa, Entamoeba histolytica
DKNKTTH

SEQ ID NO: 2611969 - protein, 27 aa, Entamoeba histolytica
DKNLTNKDSASLTKSRKKKSDKVADAQ

SEQ ID NO: 2611970 - protein, 8 aa, Entamoeba histolytica
DKNNERIE

SEQ ID NO: 2611971 - protein, 10 aa, Entamoeba histolytica
DKNNGDDSRI

SEQ ID NO: 2611972 - protein, 7 aa, Entamoeba histolytica
DKNNGVD

SEQ ID NO: 2611973 - protein, 4 aa, Entamoeba histolytica
DKNP

SEQ ID NO: 2611974 - protein, 6 aa, Entamoeba histolytica
DKNPVD

SEQ ID NO: 2611975 - protein, 15 aa, Entamoeba histolytica
DKNQKSIGEQGYDPS

SEQ ID NO: 2611976 - protein, 7 aa, Entamoeba histolytica
DKNQSTI

SEQ ID NO: 2611977 - protein, 4 aa, Entamoeba histolytica
DKNS

SEQ ID NO: 2611978 - protein, 9 aa, Entamoeba histolytica
DKNSKPSDF

SEQ ID NO: 2611979 - protein, 9 aa, Entamoeba histolytica
DKNTGKTKG

SEQ ID NO: 2611980 - protein, 7 aa, Entamoeba histolytica
DKNTTIN

SEQ ID NO: 2611981 - protein, 7 aa, Entamoeba histolytica
DKNTTVD

SEQ ID NO: 2611982 - protein, 6 aa, Entamoeba histolytica
DKNTVC

SEQ ID NO: 2611983 - protein, 7 aa, Entamoeba histolytica
DKNVIRK

SEQ ID NO: 2611984 - protein, 5 aa, Entamoeba histolytica
DKNVK

SEQ ID NO: 2611985 - protein, 17 aa, Entamoeba histolytica
DKPASRYNSKLGGNPYL

SEQ ID NO: 2611986 - protein, 5 aa, Entamoeba histolytica
DKPCY

SEQ ID NO: 2611987 - protein, 20 aa, Entamoeba histolytica
DKPFEYGEDISEKPERQMTD

SEQ ID NO: 2611988 - protein, 5 aa, Entamoeba histolytica
DKPFT

SEQ ID NO: 2611989 - protein, 7 aa, Entamoeba histolytica
DKPGTLN

SEQ ID NO: 2611990 - protein, 11 aa, Entamoeba histolytica
DKPKERKLRRN

SEQ ID NO: 2611991 - protein, 8 aa, Entamoeba histolytica
DKPKPNNI

SEQ ID NO: 2611992 - protein, 5 aa, Entamoeba histolytica
DKPLE

SEQ ID NO: 2611993 - protein, 8 aa, Entamoeba histolytica
DKPLKERR

SEQ ID NO: 2611994 - protein, 7 aa, Entamoeba histolytica
DKPNEER

SEQ ID NO: 2611995 - protein, 6 aa, Entamoeba histolytica
DKPNLT

SEQ ID NO: 2611996 - protein, 7 aa, Entamoeba histolytica
DKPPKPS

SEQ ID NO: 2611997 - protein, 7 aa, Entamoeba histolytica
DKPPLKR

SEQ ID NO: 2611998 - protein, 10 aa, Entamoeba histolytica
DKPQPKKTPV

SEQ ID NO: 2611999 - protein, 9 aa, Entamoeba histolytica
DKPSINSVD

SEQ ID NO: 2612000 - protein, 6 aa, Entamoeba histolytica
DKPSLE

SEQ ID NO: 2612001 - protein, 6 aa, Entamoeba histolytica
DKPSVN

SEQ ID NO: 2612002 - protein, 8 aa, Entamoeba histolytica
DKPTAISQ

SEQ ID NO: 2612003 - protein, 7 aa, Entamoeba histolytica
DKPTPVI

SEQ ID NO: 2612004 - protein, 5 aa, Entamoeba histolytica
DKPVE

SEQ ID NO: 2612005 - protein, 5 aa, Entamoeba histolytica
DKQDV

SEQ ID NO: 2612006 - protein, 9 aa, Entamoeba histolytica
DKQDYEDAH

SEQ ID NO: 2612007 - protein, 17 aa, Entamoeba histolytica
DKQEESTTTVQQNTNYS

SEQ ID NO: 2612008 - protein, 11 aa, Entamoeba histolytica
DKQESQEDQEL

SEQ ID NO: 2612009 - protein, 5 aa, Entamoeba histolytica
DKQFH

SEQ ID NO: 2612010 - protein, 8 aa, Entamoeba histolytica
DKQGMDTH

SEQ ID NO: 2612011 - protein, 8 aa, Entamoeba histolytica
DKQGSDHD

SEQ ID NO: 2612012 - protein, 6 aa, Entamoeba histolytica
DKQHEQ

SEQ ID NO: 2612013 - protein, 8 aa, Entamoeba histolytica
DKQIPKDI

SEQ ID NO: 2612014 - protein, 11 aa, Entamoeba histolytica
DKQKKTTTPII

SEQ ID NO: 2612015 - protein, 5 aa, Entamoeba histolytica
DKQKQ

SEQ ID NO: 2612016 - protein, 7 aa, Entamoeba histolytica
DKQKYES

SEQ ID NO: 2612017 - protein, 8 aa, Entamoeba histolytica
DKQLKQSP

SEQ ID NO: 2612018 - protein, 5 aa, Entamoeba histolytica
DKQLN

SEQ ID NO: 2612019 - protein, 7 aa, Entamoeba histolytica
DKQNQSE

SEQ ID NO: 2612020 - protein, 18 aa, Entamoeba histolytica
DKQNRIKIEEESQKTIAE

SEQ ID NO: 2612021 - protein, 6 aa, Entamoeba histolytica
DKQNSF

SEQ ID NO: 2612022 - protein, 39 aa, Entamoeba histolytica
DKQPPKMKTPIPITKSPLPKNKPTTHKTPSPLPSPHSMP

SEQ ID NO: 2612023 - protein, 34 aa, Entamoeba histolytica
DKQPSPRSLSSTSVPPTQPKHSPSPVVGNTPQKI

SEQ ID NO: 2612024 - protein, 8 aa, Entamoeba histolytica
DKQQYNYN

SEQ ID NO: 2612025 - protein, 6 aa, Entamoeba histolytica
DKQRKV

SEQ ID NO: 2612026 - protein, 19 aa, Entamoeba histolytica
DKQSQKEEEGTEKKEEISE

SEQ ID NO: 2612027 - protein, 6 aa, Entamoeba histolytica
DKQTAE

SEQ ID NO: 2612028 - protein, 8 aa, Entamoeba histolytica
DKQTEKNK

SEQ ID NO: 2612029 - protein, 7 aa, Entamoeba histolytica
DKQTEYD

SEQ ID NO: 2612030 - protein, 6 aa, Entamoeba histolytica
DKQTFN

SEQ ID NO: 2612031 - protein, 5 aa, Entamoeba histolytica
DKQTI

SEQ ID NO: 2612032 - protein, 4 aa, Entamoeba histolytica
DKQV

SEQ ID NO: 2612033 - protein, 7 aa, Entamoeba histolytica
DKREIGK

SEQ ID NO: 2612034 - protein, 7 aa, Entamoeba histolytica
DKRETEI

SEQ ID NO: 2612035 - protein, 8 aa, Entamoeba histolytica
DKRFPPVS

SEQ ID NO: 2612036 - protein, 12 aa, Entamoeba histolytica
DKRGKDDNMGNA

SEQ ID NO: 2612037 - protein, 5 aa, Entamoeba histolytica
DKRGV

SEQ ID NO: 2612038 - protein, 9 aa, Entamoeba histolytica
DKRIKRSKS

SEQ ID NO: 2612039 - protein, 21 aa, Entamoeba histolytica
DKRKIPEKRNQSSFAPPPKRE

SEQ ID NO: 2612040 - protein, 8 aa, Entamoeba histolytica
DKRKQSQL

SEQ ID NO: 2612041 - protein, 7 aa, Entamoeba histolytica
DKRNGYI

SEQ ID NO: 2612042 - protein, 18 aa, Entamoeba histolytica
DKRNPNKKFQHSSAPELE

SEQ ID NO: 2612043 - protein, 7 aa, Entamoeba histolytica
DKRNQKY

SEQ ID NO: 2612044 - protein, 7 aa, Entamoeba histolytica
DKRQINE

SEQ ID NO: 2612045 - protein, 4 aa, Entamoeba histolytica
DKRR

SEQ ID NO: 2612046 - protein, 8 aa, Entamoeba histolytica
DKRRFQED

SEQ ID NO: 2612047 - protein, 5 aa, Entamoeba histolytica
DKRSG

SEQ ID NO: 2612048 - protein, 9 aa, Entamoeba histolytica
DKRSKKEEV

SEQ ID NO: 2612049 - protein, 8 aa, Entamoeba histolytica
DKRSNNYI

SEQ ID NO: 2612050 - protein, 7 aa, Entamoeba histolytica
DKRSSEF

SEQ ID NO: 2612051 - protein, 9 aa, Entamoeba histolytica
DKRTKEKKS

SEQ ID NO: 2612052 - protein, 8 aa, Entamoeba histolytica
DKRTQGKA

SEQ ID NO: 2612053 - protein, 9 aa, Entamoeba histolytica
DKRYPNKEL

SEQ ID NO: 2612054 - protein, 9 aa, Entamoeba histolytica
DKSDELKQA

SEQ ID NO: 2612055 - protein, 14 aa, Entamoeba histolytica
DKSDIQKEKIQENN

SEQ ID NO: 2612056 - protein, 57 aa, Entamoeba histolytica
DKSFDTEDSPSSEISISSENESFSNDNSQPKDKTINDSQEKEEKKRNICNEKGSIHE

SEQ ID NO: 2612057 - protein, 4 aa, Entamoeba histolytica
DKSG

SEQ ID NO: 2612058 - protein, 7 aa, Entamoeba histolytica
DKSGHKP

SEQ ID NO: 2612059 - protein, 6 aa, Entamoeba histolytica
DKSGSL

SEQ ID NO: 2612060 - protein, 6 aa, Entamoeba histolytica
DKSGSY

SEQ ID NO: 2612061 - protein, 8 aa, Entamoeba histolytica
DKSGYLSP

SEQ ID NO: 2612062 - protein, 7 aa, Entamoeba histolytica
DKSISNI

SEQ ID NO: 2612063 - protein, 4 aa, Entamoeba histolytica
DKSK

SEQ ID NO: 2612064 - protein, 5 aa, Entamoeba histolytica
DKSKI

SEQ ID NO: 2612065 - protein, 10 aa, Entamoeba histolytica
DKSKKQRKSV

SEQ ID NO: 2612066 - protein, 8 aa, Entamoeba histolytica
DKSKTAGW

SEQ ID NO: 2612067 - protein, 8 aa, Entamoeba histolytica
DKSKTLSY

SEQ ID NO: 2612068 - protein, 5 aa, Entamoeba histolytica
DKSLG

SEQ ID NO: 2612069 - protein, 5 aa, Entamoeba histolytica
DKSLI

SEQ ID NO: 2612070 - protein, 6 aa, Entamoeba histolytica
DKSLNV

SEQ ID NO: 2612071 - protein, 6 aa, Entamoeba histolytica
DKSLPR

SEQ ID NO: 2612072 - protein, 7 aa, Entamoeba histolytica
DKSMQWD

SEQ ID NO: 2612073 - protein, 10 aa, Entamoeba histolytica
DKSNLGECDT

SEQ ID NO: 2612074 - protein, 14 aa, Entamoeba histolytica
DKSNPDDTSKSKFM

SEQ ID NO: 2612075 - protein, 30 aa, Entamoeba histolytica
DKSNQGGNGSTKPNELTNLTDKPKDNGKGC

SEQ ID NO: 2612076 - protein, 12 aa, Entamoeba histolytica
DKSNSFSTTRQT

SEQ ID NO: 2612077 - protein, 7 aa, Entamoeba histolytica
DKSNTDT

SEQ ID NO: 2612078 - protein, 8 aa, Entamoeba histolytica
DKSPDEIK

SEQ ID NO: 2612079 - protein, 19 aa, Entamoeba histolytica
DKSPIDDSNNVELPPPGTS

SEQ ID NO: 2612080 - protein, 16 aa, Entamoeba histolytica
DKSPSELAKKYKGRLE

SEQ ID NO: 2612081 - protein, 9 aa, Entamoeba histolytica
DKSQEGAQF

SEQ ID NO: 2612082 - protein, 9 aa, Entamoeba histolytica
DKSQFGNIP

SEQ ID NO: 2612083 - protein, 8 aa, Entamoeba histolytica
DKSQIEEQ

SEQ ID NO: 2612084 - protein, 7 aa, Entamoeba histolytica
DKSQNEI

SEQ ID NO: 2612085 - protein, 9 aa, Entamoeba histolytica
DKSQNWSEE

SEQ ID NO: 2612086 - protein, 8 aa, Entamoeba histolytica
DKSQVTEV

SEQ ID NO: 2612087 - protein, 14 aa, Entamoeba histolytica
DKSRNGKKISRKKE

SEQ ID NO: 2612088 - protein, 4 aa, Entamoeba histolytica
DKSS

SEQ ID NO: 2612089 - protein, 32 aa, Entamoeba histolytica
DKSSCSSQQQPICSPKRSKTPACEEQGQTTIQ

SEQ ID NO: 2612090 - protein, 9 aa, Entamoeba histolytica
DKSSTEIGI

SEQ ID NO: 2612091 - protein, 7 aa, Entamoeba histolytica
DKSTCSL

SEQ ID NO: 2612092 - protein, 5 aa, Entamoeba histolytica
DKSYA

SEQ ID NO: 2612093 - protein, 8 aa, Entamoeba histolytica
DKSYDQTI

SEQ ID NO: 2612094 - protein, 7 aa, Entamoeba histolytica
DKSYEEL

SEQ ID NO: 2612095 - protein, 4 aa, Entamoeba histolytica
DKTA

SEQ ID NO: 2612096 - protein, 7 aa, Entamoeba histolytica
DKTAFEE

SEQ ID NO: 2612097 - protein, 8 aa, Entamoeba histolytica
DKTDAEFY

SEQ ID NO: 2612098 - protein, 13 aa, Entamoeba histolytica
DKTDGNENNNQNE

SEQ ID NO: 2612099 - protein, 5 aa, Entamoeba histolytica
DKTDI

SEQ ID NO: 2612100 - protein, 5 aa, Entamoeba histolytica
DKTDN

SEQ ID NO: 2612101 - protein, 10 aa, Entamoeba histolytica
DKTEDELDDE

SEQ ID NO: 2612102 - protein, 8 aa, Entamoeba histolytica
DKTELKKR

SEQ ID NO: 2612103 - protein, 7 aa, Entamoeba histolytica
DKTENIV

SEQ ID NO: 2612104 - protein, 12 aa, Entamoeba histolytica
DKTENKPPKRPQ

SEQ ID NO: 2612105 - protein, 6 aa, Entamoeba histolytica
DKTFKS

SEQ ID NO: 2612106 - protein, 11 aa, Entamoeba histolytica
DKTGDKVAVGE

SEQ ID NO: 2612107 - protein, 5 aa, Entamoeba histolytica
DKTGP

SEQ ID NO: 2612108 - protein, 12 aa, Entamoeba histolytica
DKTGRGKIEING

SEQ ID NO: 2612109 - protein, 8 aa, Entamoeba histolytica
DKTIEEYD

SEQ ID NO: 2612110 - protein, 5 aa, Entamoeba histolytica
DKTIP

SEQ ID NO: 2612111 - protein, 12 aa, Entamoeba histolytica
DKTIQKNEEEIK

SEQ ID NO: 2612112 - protein, 7 aa, Entamoeba histolytica
DKTIRDT

SEQ ID NO: 2612113 - protein, 20 aa, Entamoeba histolytica
DKTITTQKAKPVMNEEERTA

SEQ ID NO: 2612114 - protein, 6 aa, Entamoeba histolytica
DKTKGM

SEQ ID NO: 2612115 - protein, 8 aa, Entamoeba histolytica
DKTKKSAI

SEQ ID NO: 2612116 - protein, 9 aa, Entamoeba histolytica
DKTLPDYTI

SEQ ID NO: 2612117 - protein, 7 aa, Entamoeba histolytica
DKTMSKA

SEQ ID NO: 2612118 - protein, 6 aa, Entamoeba histolytica
DKTNEF

SEQ ID NO: 2612119 - protein, 9 aa, Entamoeba histolytica
DKTNTGKDF

SEQ ID NO: 2612120 - protein, 14 aa, Entamoeba histolytica
DKTPATIQLSSPTE

SEQ ID NO: 2612121 - protein, 9 aa, Entamoeba histolytica
DKTPETTNS

SEQ ID NO: 2612122 - protein, 9 aa, Entamoeba histolytica
DKTPQSTYE

SEQ ID NO: 2612123 - protein, 7 aa, Entamoeba histolytica
DKTQKEV

SEQ ID NO: 2612124 - protein, 7 aa, Entamoeba histolytica
DKTREPL

SEQ ID NO: 2612125 - protein, 7 aa, Entamoeba histolytica
DKTRPET

SEQ ID NO: 2612126 - protein, 10 aa, Entamoeba histolytica
DKTRTMYNNE

SEQ ID NO: 2612127 - protein, 9 aa, Entamoeba histolytica
DKTSKKTKI

SEQ ID NO: 2612128 - protein, 8 aa, Entamoeba histolytica
DKTSQDLQ

SEQ ID NO: 2612129 - protein, 4 aa, Entamoeba histolytica
DKTT

SEQ ID NO: 2612130 - protein, 8 aa, Entamoeba histolytica
DKTTEKTR

SEQ ID NO: 2612131 - protein, 7 aa, Entamoeba histolytica
DKTTHET

SEQ ID NO: 2612132 - protein, 7 aa, Entamoeba histolytica
DKTTNKY

SEQ ID NO: 2612133 - protein, 6 aa, Entamoeba histolytica
DKTTNQ

SEQ ID NO: 2612134 - protein, 8 aa, Entamoeba histolytica
DKVDQTNV

SEQ ID NO: 2612135 - protein, 7 aa, Entamoeba histolytica
DKVGKKV

SEQ ID NO: 2612136 - protein, 4 aa, Entamoeba histolytica
DKVI

SEQ ID NO: 2612137 - protein, 8 aa, Entamoeba histolytica
DKVKDNEN

SEQ ID NO: 2612138 - protein, 7 aa, Entamoeba histolytica
DKVKNNE

SEQ ID NO: 2612139 - protein, 19 aa, Entamoeba histolytica
DKVLEPKLASEERKSCPFP

SEQ ID NO: 2612140 - protein, 9 aa, Entamoeba histolytica
DKVNKNENF

SEQ ID NO: 2612141 - protein, 7 aa, Entamoeba histolytica
DKVPPEC

SEQ ID NO: 2612142 - protein, 6 aa, Entamoeba histolytica
DKVTQD

SEQ ID NO: 2612143 - protein, 5 aa, Entamoeba histolytica
DKYAT

SEQ ID NO: 2612144 - protein, 7 aa, Entamoeba histolytica
DKYDTQN

SEQ ID NO: 2612145 - protein, 6 aa, Entamoeba histolytica
DKYEDN

SEQ ID NO: 2612146 - protein, 4 aa, Entamoeba histolytica
DKYG

SEQ ID NO: 2612147 - protein, 6 aa, Entamoeba histolytica
DKYGDL

SEQ ID NO: 2612148 - protein, 12 aa, Entamoeba histolytica
DKYNSKLNEQMN

SEQ ID NO: 2612149 - protein, 7 aa, Entamoeba histolytica
DKYPDTY

SEQ ID NO: 2612150 - protein, 6 aa, Entamoeba histolytica
DKYPEF

SEQ ID NO: 2612151 - protein, 16 aa, Entamoeba histolytica
DKYQLKTKTVDERTEW

SEQ ID NO: 2612152 - protein, 12 aa, Entamoeba histolytica
DKYTIGRSGNND

SEQ ID NO: 2612153 - protein, 5 aa, Entamoeba histolytica
DLADE

SEQ ID NO: 2612154 - protein, 5 aa, Entamoeba histolytica
DLASA

SEQ ID NO: 2612155 - protein, 21 aa, Entamoeba histolytica
DLASKREVSREEAESYAKTKN

SEQ ID NO: 2612156 - protein, 11 aa, Entamoeba histolytica
DLDASTDDGEI

SEQ ID NO: 2612157 - protein, 18 aa, Entamoeba histolytica
DLDDERAVTVEQGQELAN

SEQ ID NO: 2612158 - protein, 9 aa, Entamoeba histolytica
DLDDGLRKE

SEQ ID NO: 2612159 - protein, 8 aa, Entamoeba histolytica
DLDESEKL

SEQ ID NO: 2612160 - protein, 8 aa, Entamoeba histolytica
DLDGKTEN

SEQ ID NO: 2612161 - protein, 31 aa, Entamoeba histolytica
DLDKENSNSINEMNQKSNVFESNEDEEDDYE

SEQ ID NO: 2612162 - protein, 5 aa, Entamoeba histolytica
DLDNS

SEQ ID NO: 2612163 - protein, 6 aa, Entamoeba histolytica
DLDNSN

SEQ ID NO: 2612164 - protein, 5 aa, Entamoeba histolytica
DLDTF

SEQ ID NO: 2612165 - protein, 15 aa, Entamoeba histolytica
DLEDERDSNESLKNK

SEQ ID NO: 2612166 - protein, 24 aa, Entamoeba histolytica
DLEEKYKNIEDVTDDQEEVNNQPI

SEQ ID NO: 2612167 - protein, 7 aa, Entamoeba histolytica
DLEENDS

SEQ ID NO: 2612168 - protein, 6 aa, Entamoeba histolytica
DLEESF

SEQ ID NO: 2612169 - protein, 6 aa, Entamoeba histolytica
DLEETM

SEQ ID NO: 2612170 - protein, 5 aa, Entamoeba histolytica
DLEEW

SEQ ID NO: 2612171 - protein, 4 aa, Entamoeba histolytica
DLEF

SEQ ID NO: 2612172 - protein, 9 aa, Entamoeba histolytica
DLEKNDNSL

SEQ ID NO: 2612173 - protein, 13 aa, Entamoeba histolytica
DLEKTPTQQPPDM

SEQ ID NO: 2612174 - protein, 15 aa, Entamoeba histolytica
DLENASDEDIEKDSI

SEQ ID NO: 2612175 - protein, 22 aa, Entamoeba histolytica
DLENDARAVTTAEGQQFASEGG

SEQ ID NO: 2612176 - protein, 10 aa, Entamoeba histolytica
DLENEETSIE

SEQ ID NO: 2612177 - protein, 18 aa, Entamoeba histolytica
DLENERQVETAEAKKLAD

SEQ ID NO: 2612178 - protein, 5 aa, Entamoeba histolytica
DLENN

SEQ ID NO: 2612179 - protein, 13 aa, Entamoeba histolytica
DLENQHKSGSDEQ

SEQ ID NO: 2612180 - protein, 6 aa, Entamoeba histolytica
DLENTR

SEQ ID NO: 2612181 - protein, 5 aa, Entamoeba histolytica
DLEPK

SEQ ID NO: 2612182 - protein, 4 aa, Entamoeba histolytica
DLEQ

SEQ ID NO: 2612183 - protein, 8 aa, Entamoeba histolytica
DLESDNQN

SEQ ID NO: 2612184 - protein, 11 aa, Entamoeba histolytica
DLESEQQKEKT

SEQ ID NO: 2612185 - protein, 18 aa, Entamoeba histolytica
DLESERQVQTNEAKNLAE

SEQ ID NO: 2612186 - protein, 5 aa, Entamoeba histolytica
DLESQ

SEQ ID NO: 2612187 - protein, 5 aa, Entamoeba histolytica
DLETK

SEQ ID NO: 2612188 - protein, 10 aa, Entamoeba histolytica
DLETKQSINT

SEQ ID NO: 2612189 - protein, 19 aa, Entamoeba histolytica
DLGAKTEVEEKKQDQPKQI

SEQ ID NO: 2612190 - protein, 7 aa, Entamoeba histolytica
DLGAPQG

SEQ ID NO: 2612191 - protein, 4 aa, Entamoeba histolytica
DLGD

SEQ ID NO: 2612192 - protein, 21 aa, Entamoeba histolytica
DLGEEKRKLAEESVKDKEDLA

SEQ ID NO: 2612193 - protein, 17 aa, Entamoeba histolytica
DLGEKRINKREKEKLSK

SEQ ID NO: 2612194 - protein, 6 aa, Entamoeba histolytica
DLGENS

SEQ ID NO: 2612195 - protein, 6 aa, Entamoeba histolytica
DLGESG

SEQ ID NO: 2612196 - protein, 9 aa, Entamoeba histolytica
DLGGTSDGY

SEQ ID NO: 2612197 - protein, 7 aa, Entamoeba histolytica
DLGKDAE

SEQ ID NO: 2612198 - protein, 6 aa, Entamoeba histolytica
DLGKRG

SEQ ID NO: 2612199 - protein, 7 aa, Entamoeba histolytica
DLGPYQS

SEQ ID NO: 2612200 - protein, 7 aa, Entamoeba histolytica
DLGRGTQ

SEQ ID NO: 2612201 - protein, 9 aa, Entamoeba histolytica
DLGTNTITP

SEQ ID NO: 2612202 - protein, 13 aa, Entamoeba histolytica
DLHPDDYENGTFY

SEQ ID NO: 2612203 - protein, 10 aa, Entamoeba histolytica
DLIDKNDEEC

SEQ ID NO: 2612204 - protein, 12 aa, Entamoeba histolytica
DLIEDDTGTTVG

SEQ ID NO: 2612205 - protein, 8 aa, Entamoeba histolytica
DLKDERHA

SEQ ID NO: 2612206 - protein, 10 aa, Entamoeba histolytica
DLKEDTVTTG

SEQ ID NO: 2612207 - protein, 7 aa, Entamoeba histolytica
DLKETDV

SEQ ID NO: 2612208 - protein, 6 aa, Entamoeba histolytica
DLKEYE

SEQ ID NO: 2612209 - protein, 15 aa, Entamoeba histolytica
DLKGEKDDAERNKKK

SEQ ID NO: 2612210 - protein, 16 aa, Entamoeba histolytica
DLKKKRSSIGSPSSLR

SEQ ID NO: 2612211 - protein, 19 aa, Entamoeba histolytica
DLKKPKTRNTRKSTKKTTK

SEQ ID NO: 2612212 - protein, 10 aa, Entamoeba histolytica
DLKKSTPIQY

SEQ ID NO: 2612213 - protein, 7 aa, Entamoeba histolytica
DLKPGDL

SEQ ID NO: 2612214 - protein, 10 aa, Entamoeba histolytica
DLKPGEYATN

SEQ ID NO: 2612215 - protein, 23 aa, Entamoeba histolytica
DLKQEKNYQVNGQRSCNSNDPNV

SEQ ID NO: 2612216 - protein, 15 aa, Entamoeba histolytica
DLKQHKDQSKSQTSQ

SEQ ID NO: 2612217 - protein, 5 aa, Entamoeba histolytica
DLKQN

SEQ ID NO: 2612218 - protein, 13 aa, Entamoeba histolytica
DLKQSKSSKNEVL

SEQ ID NO: 2612219 - protein, 14 aa, Entamoeba histolytica
DLKQYGDQSISQRS

SEQ ID NO: 2612220 - protein, 7 aa, Entamoeba histolytica
DLKRSDP

SEQ ID NO: 2612221 - protein, 8 aa, Entamoeba histolytica
DLKRSNKE

SEQ ID NO: 2612222 - protein, 13 aa, Entamoeba histolytica
DLKRTKSVNALNE

SEQ ID NO: 2612223 - protein, 17 aa, Entamoeba histolytica
DLNDKPLGSKFKTPAKR

SEQ ID NO: 2612224 - protein, 4 aa, Entamoeba histolytica
DLNE

SEQ ID NO: 2612225 - protein, 5 aa, Entamoeba histolytica
DLNEN

SEQ ID NO: 2612226 - protein, 9 aa, Entamoeba histolytica
DLNEPNFNG

SEQ ID NO: 2612227 - protein, 6 aa, Entamoeba histolytica
DLNESK

SEQ ID NO: 2612228 - protein, 8 aa, Entamoeba histolytica
DLNGQTEV

SEQ ID NO: 2612229 - protein, 8 aa, Entamoeba histolytica
DLNGTDAG

SEQ ID NO: 2612230 - protein, 4 aa, Entamoeba histolytica
DLNI

SEQ ID NO: 2612231 - protein, 6 aa, Entamoeba histolytica
DLNKEE

SEQ ID NO: 2612232 - protein, 7 aa, Entamoeba histolytica
DLNKPWG

SEQ ID NO: 2612233 - protein, 17 aa, Entamoeba histolytica
DLNNELRTAVEKSGRHL

SEQ ID NO: 2612234 - protein, 31 aa, Entamoeba histolytica
DLNNTDEKIEGLKSEINKMKSAKKENKTDDI

SEQ ID NO: 2612235 - protein, 6 aa, Entamoeba histolytica
DLNPRS

SEQ ID NO: 2612236 - protein, 6 aa, Entamoeba histolytica
DLNPTA

SEQ ID NO: 2612237 - protein, 8 aa, Entamoeba histolytica
DLNPTPAI

SEQ ID NO: 2612238 - protein, 6 aa, Entamoeba histolytica
DLNYPN

SEQ ID NO: 2612239 - protein, 30 aa, Entamoeba histolytica
DLPAPKAKVTKQKVTKKTLTQEEEDELAEL

SEQ ID NO: 2612240 - protein, 11 aa, Entamoeba histolytica
DLPDDDDVEEQ

SEQ ID NO: 2612241 - protein, 6 aa, Entamoeba histolytica
DLPDER

SEQ ID NO: 2612242 - protein, 18 aa, Entamoeba histolytica
DLPDRQVTKEEGEAFAKE

SEQ ID NO: 2612243 - protein, 5 aa, Entamoeba histolytica
DLPEE

SEQ ID NO: 2612244 - protein, 9 aa, Entamoeba histolytica
DLPENEQKQ

SEQ ID NO: 2612245 - protein, 9 aa, Entamoeba histolytica
DLPHAKSVS

SEQ ID NO: 2612246 - protein, 4 aa, Entamoeba histolytica
DLPK

SEQ ID NO: 2612247 - protein, 12 aa, Entamoeba histolytica
DLPKPIEDTEKN

SEQ ID NO: 2612248 - protein, 6 aa, Entamoeba histolytica
DLPKTV

SEQ ID NO: 2612249 - protein, 9 aa, Entamoeba histolytica
DLPNDEPMP

SEQ ID NO: 2612250 - protein, 6 aa, Entamoeba histolytica
DLPPET

SEQ ID NO: 2612251 - protein, 20 aa, Entamoeba histolytica
DLPPQEDDDDESEIDSGIDD

SEQ ID NO: 2612252 - protein, 6 aa, Entamoeba histolytica
DLPQSP

SEQ ID NO: 2612253 - protein, 4 aa, Entamoeba histolytica
DLPR

SEQ ID NO: 2612254 - protein, 21 aa, Entamoeba histolytica
DLPRDENIPKKKITPPKSYTW

SEQ ID NO: 2612255 - protein, 13 aa, Entamoeba histolytica
DLPSAAKKALEFG

SEQ ID NO: 2612256 - protein, 21 aa, Entamoeba histolytica
DLPSKVTNEQADAAAKEQGYQ

SEQ ID NO: 2612257 - protein, 32 aa, Entamoeba histolytica
DLPSMKIGGKSKDKRKDQKRKNKKKGKGGCFL

SEQ ID NO: 2612258 - protein, 9 aa, Entamoeba histolytica
DLPSNSPKV

SEQ ID NO: 2612259 - protein, 4 aa, Entamoeba histolytica
DLPT

SEQ ID NO: 2612260 - protein, 6 aa, Entamoeba histolytica
DLPTED

SEQ ID NO: 2612261 - protein, 12 aa, Entamoeba histolytica
DLQAPQTNPNYP

SEQ ID NO: 2612262 - protein, 5 aa, Entamoeba histolytica
DLQFG

SEQ ID NO: 2612263 - protein, 19 aa, Entamoeba histolytica
DLQNAANKGLTKKSRSETF

SEQ ID NO: 2612264 - protein, 5 aa, Entamoeba histolytica
DLQPG

SEQ ID NO: 2612265 - protein, 7 aa, Entamoeba histolytica
DLQPGVR

SEQ ID NO: 2612266 - protein, 12 aa, Entamoeba histolytica
DLQSDAKRFQEI

SEQ ID NO: 2612267 - protein, 6 aa, Entamoeba histolytica
DLQSDF

SEQ ID NO: 2612268 - protein, 7 aa, Entamoeba histolytica
DLRDSVE

SEQ ID NO: 2612269 - protein, 6 aa, Entamoeba histolytica
DLRGTS

SEQ ID NO: 2612270 - protein, 8 aa, Entamoeba histolytica
DLRKERNA

SEQ ID NO: 2612271 - protein, 7 aa, Entamoeba histolytica
DLRPKEN

SEQ ID NO: 2612272 - protein, 4 aa, Entamoeba histolytica
DLRR

SEQ ID NO: 2612273 - protein, 9 aa, Entamoeba histolytica
DLRSPKKNK

SEQ ID NO: 2612274 - protein, 5 aa, Entamoeba histolytica
DLSAS

SEQ ID NO: 2612275 - protein, 8 aa, Entamoeba histolytica
DLSDDQKE

SEQ ID NO: 2612276 - protein, 8 aa, Entamoeba histolytica
DLSDEYQN

SEQ ID NO: 2612277 - protein, 14 aa, Entamoeba histolytica
DLSDNGLDDSNTSI

SEQ ID NO: 2612278 - protein, 11 aa, Entamoeba histolytica
DLSDPHGTHRK

SEQ ID NO: 2612279 - protein, 9 aa, Entamoeba histolytica
DLSDSTDDV

SEQ ID NO: 2612280 - protein, 11 aa, Entamoeba histolytica
DLSEGARDTLT

SEQ ID NO: 2612281 - protein, 9 aa, Entamoeba histolytica
DLSETEPRP

SEQ ID NO: 2612282 - protein, 9 aa, Entamoeba histolytica
DLSGPTSFA

SEQ ID NO: 2612283 - protein, 10 aa, Entamoeba histolytica
DLSKEQQKEY

SEQ ID NO: 2612284 - protein, 9 aa, Entamoeba histolytica
DLSKSNVQN

SEQ ID NO: 2612285 - protein, 29 aa, Entamoeba histolytica
DLSNGNDGLSKLNEEIETINKEKEGIRKE

SEQ ID NO: 2612286 - protein, 16 aa, Entamoeba histolytica
DLSPPQYSQLARSFAG

SEQ ID NO: 2612287 - protein, 9 aa, Entamoeba histolytica
DLSPSASNA

SEQ ID NO: 2612288 - protein, 6 aa, Entamoeba histolytica
DLSQAQ

SEQ ID NO: 2612289 - protein, 12 aa, Entamoeba histolytica
DLSQNIQPSLLS

SEQ ID NO: 2612290 - protein, 19 aa, Entamoeba histolytica
DLSQTREVQTSEGEELAKK

SEQ ID NO: 2612291 - protein, 9 aa, Entamoeba histolytica
DLSSQESVS

SEQ ID NO: 2612292 - protein, 10 aa, Entamoeba histolytica
DLSSQMNRTQ

SEQ ID NO: 2612293 - protein, 90 aa, Entamoeba histolytica
DLSSQSLKKVQQSQQLSSSELPPHSSTTKQKSLRQETSITTSESFDNSTDKKEIQPIKKENNNTTIPQQPIKRAQPSLPQRQPSNSNIQR

SEQ ID NO: 2612294 - protein, 7 aa, Entamoeba histolytica
DLSSTKP

SEQ ID NO: 2612295 - protein, 22 aa, Entamoeba histolytica
DLSSTTTSKTKQDKNNDTTQHL

SEQ ID NO: 2612296 - protein, 4 aa, Entamoeba histolytica
DLST

SEQ ID NO: 2612297 - protein, 6 aa, Entamoeba histolytica
DLSTQK

SEQ ID NO: 2612298 - protein, 7 aa, Entamoeba histolytica
DLSTSDV

SEQ ID NO: 2612299 - protein, 6 aa, Entamoeba histolytica
DLTDQQ

SEQ ID NO: 2612300 - protein, 6 aa, Entamoeba histolytica
DLTETD

SEQ ID NO: 2612301 - protein, 7 aa, Entamoeba histolytica
DLTGEEV

SEQ ID NO: 2612302 - protein, 5 aa, Entamoeba histolytica
DLTGR

SEQ ID NO: 2612303 - protein, 11 aa, Entamoeba histolytica
DLTKNKDFNDR

SEQ ID NO: 2612304 - protein, 9 aa, Entamoeba histolytica
DLTNNNTAF

SEQ ID NO: 2612305 - protein, 6 aa, Entamoeba histolytica
DLTNTN

SEQ ID NO: 2612306 - protein, 10 aa, Entamoeba histolytica
DLTPRHNKQM

SEQ ID NO: 2612307 - protein, 5 aa, Entamoeba histolytica
DLTPT

SEQ ID NO: 2612308 - protein, 5 aa, Entamoeba histolytica
DLTSK

SEQ ID NO: 2612309 - protein, 4 aa, Entamoeba histolytica
DLTT

SEQ ID NO: 2612310 - protein, 8 aa, Entamoeba histolytica
DLTTDTED

SEQ ID NO: 2612311 - protein, 12 aa, Entamoeba histolytica
DLTTQPGSNTFK

SEQ ID NO: 2612312 - protein, 6 aa, Entamoeba histolytica
DLVPSN

SEQ ID NO: 2612313 - protein, 9 aa, Entamoeba histolytica
DMDETDGTK

SEQ ID NO: 2612314 - protein, 6 aa, Entamoeba histolytica
DMDPQD

SEQ ID NO: 2612315 - protein, 12 aa, Entamoeba histolytica
DMDRGSSKQVKR

SEQ ID NO: 2612316 - protein, 14 aa, Entamoeba histolytica
DMEDGGIADRPGDC

SEQ ID NO: 2612317 - protein, 11 aa, Entamoeba histolytica
DMEEDEIESEM

SEQ ID NO: 2612318 - protein, 10 aa, Entamoeba histolytica
DMEKDEQSAY

SEQ ID NO: 2612319 - protein, 5 aa, Entamoeba histolytica
DMEKP

SEQ ID NO: 2612320 - protein, 5 aa, Entamoeba histolytica
DMEKV

SEQ ID NO: 2612321 - protein, 16 aa, Entamoeba histolytica
DMESDRQVNTSEVKQI

SEQ ID NO: 2612322 - protein, 11 aa, Entamoeba histolytica
DMGATPPRQTD

SEQ ID NO: 2612323 - protein, 15 aa, Entamoeba histolytica
DMGTYSTERCDYPDF

SEQ ID NO: 2612324 - protein, 7 aa, Entamoeba histolytica
DMIEETK

SEQ ID NO: 2612325 - protein, 13 aa, Entamoeba histolytica
DMKDAIRKYRSKK

SEQ ID NO: 2612326 - protein, 17 aa, Entamoeba histolytica
DMKGDETKTESEGEKGL

SEQ ID NO: 2612327 - protein, 8 aa, Entamoeba histolytica
DMKKTESE

SEQ ID NO: 2612328 - protein, 8 aa, Entamoeba histolytica
DMNKQSEM

SEQ ID NO: 2612329 - protein, 9 aa, Entamoeba histolytica
DMNSSGNGR

SEQ ID NO: 2612330 - protein, 13 aa, Entamoeba histolytica
DMNTPENSPSGNI

SEQ ID NO: 2612331 - protein, 11 aa, Entamoeba histolytica
DMNVESKTLNE

SEQ ID NO: 2612332 - protein, 6 aa, Entamoeba histolytica
DMPDPV

SEQ ID NO: 2612333 - protein, 17 aa, Entamoeba histolytica
DMPESQTTEETSPTEHQ

SEQ ID NO: 2612334 - protein, 10 aa, Entamoeba histolytica
DMPFTESGMT

SEQ ID NO: 2612335 - protein, 14 aa, Entamoeba histolytica
DMPKQVSTEEGQSF

SEQ ID NO: 2612336 - protein, 6 aa, Entamoeba histolytica
DMPQSS

SEQ ID NO: 2612337 - protein, 5 aa, Entamoeba histolytica
DMRNS

SEQ ID NO: 2612338 - protein, 11 aa, Entamoeba histolytica
DMRPGESEEQF

SEQ ID NO: 2612339 - protein, 99 aa, Entamoeba histolytica
DMSEDEDDNGEFAEEGDEEEDDEDEKPVEAPKKVEPKKEEKKPQQPKKEEKKPQQPPKKETKPQQHQQPKKEEKKPQQPPKKEFNKKEGKKMNKKNNKK

SEQ ID NO: 2612340 - protein, 9 aa, Entamoeba histolytica
DMSTQSTPY

SEQ ID NO: 2612341 - protein, 6 aa, Entamoeba histolytica
DMTNEI

SEQ ID NO: 2612342 - protein, 5 aa, Entamoeba histolytica
DMTPG

SEQ ID NO: 2612343 - protein, 5 aa, Entamoeba histolytica
DMTSN

SEQ ID NO: 2612344 - protein, 4 aa, Entamoeba histolytica
DNAE

SEQ ID NO: 2612345 - protein, 29 aa, Entamoeba histolytica
DNAFKNKSQEEQKSSEFDFGSDNHESSNS

SEQ ID NO: 2612346 - protein, 18 aa, Entamoeba histolytica
DNAIKKAKAEGKPNPYPF

SEQ ID NO: 2612347 - protein, 6 aa, Entamoeba histolytica
DNAIPT

SEQ ID NO: 2612348 - protein, 8 aa, Entamoeba histolytica
DNAKPDDI

SEQ ID NO: 2612349 - protein, 11 aa, Entamoeba histolytica
DNALPRTPRRH

SEQ ID NO: 2612350 - protein, 7 aa, Entamoeba histolytica
DNAPTDK

SEQ ID NO: 2612351 - protein, 8 aa, Entamoeba histolytica
DNAQNLGG

SEQ ID NO: 2612352 - protein, 9 aa, Entamoeba histolytica
DNAQSNQWY

SEQ ID NO: 2612353 - protein, 6 aa, Entamoeba histolytica
DNARTE

SEQ ID NO: 2612354 - protein, 8 aa, Entamoeba histolytica
DNASQKPT

SEQ ID NO: 2612355 - protein, 5 aa, Entamoeba histolytica
DNATH

SEQ ID NO: 2612356 - protein, 5 aa, Entamoeba histolytica
DNCDM

SEQ ID NO: 2612357 - protein, 4 aa, Entamoeba histolytica
DNCK

SEQ ID NO: 2612358 - protein, 9 aa, Entamoeba histolytica
DNCPPEQLP

SEQ ID NO: 2612359 - protein, 8 aa, Entamoeba histolytica
DNDCNGDV

SEQ ID NO: 2612360 - protein, 7 aa, Entamoeba histolytica
DNDEENI

SEQ ID NO: 2612361 - protein, 5 aa, Entamoeba histolytica
DNDFS

SEQ ID NO: 2612362 - protein, 7 aa, Entamoeba histolytica
DNDFTTN

SEQ ID NO: 2612363 - protein, 7 aa, Entamoeba histolytica
DNDGKIP

SEQ ID NO: 2612364 - protein, 11 aa, Entamoeba histolytica
DNDKEEEEFEE

SEQ ID NO: 2612365 - protein, 6 aa, Entamoeba histolytica
DNDKTE

SEQ ID NO: 2612366 - protein, 7 aa, Entamoeba histolytica
DNDLEPG

SEQ ID NO: 2612367 - protein, 9 aa, Entamoeba histolytica
DNDNALNQK

SEQ ID NO: 2612368 - protein, 13 aa, Entamoeba histolytica
DNDNPKNTTKKYK

SEQ ID NO: 2612369 - protein, 6 aa, Entamoeba histolytica
DNDPDT

SEQ ID NO: 2612370 - protein, 7 aa, Entamoeba histolytica
DNDPSIS

SEQ ID NO: 2612371 - protein, 5 aa, Entamoeba histolytica
DNDQV

SEQ ID NO: 2612372 - protein, 4 aa, Entamoeba histolytica
DNDR

SEQ ID NO: 2612373 - protein, 8 aa, Entamoeba histolytica
DNDSFDNP

SEQ ID NO: 2612374 - protein, 5 aa, Entamoeba histolytica
DNDSY

SEQ ID NO: 2612375 - protein, 8 aa, Entamoeba histolytica
DNDTDKMT

SEQ ID NO: 2612376 - protein, 6 aa, Entamoeba histolytica
DNDTDN

SEQ ID NO: 2612377 - protein, 6 aa, Entamoeba histolytica
DNDVEQ

SEQ ID NO: 2612378 - protein, 5 aa, Entamoeba histolytica
DNDYN

SEQ ID NO: 2612379 - protein, 13 aa, Entamoeba histolytica
DNECDEPTSVENI

SEQ ID NO: 2612380 - protein, 7 aa, Entamoeba histolytica
DNEDAQT

SEQ ID NO: 2612381 - protein, 5 aa, Entamoeba histolytica
DNEDD

SEQ ID NO: 2612382 - protein, 8 aa, Entamoeba histolytica
DNEENNEI

SEQ ID NO: 2612383 - protein, 5 aa, Entamoeba histolytica
DNEES

SEQ ID NO: 2612384 - protein, 8 aa, Entamoeba histolytica
DNEEVNPS

SEQ ID NO: 2612385 - protein, 11 aa, Entamoeba histolytica
DNEFYEKRDQS

SEQ ID NO: 2612386 - protein, 8 aa, Entamoeba histolytica
DNEGKTPL

SEQ ID NO: 2612387 - protein, 7 aa, Entamoeba histolytica
DNEHITQ

SEQ ID NO: 2612388 - protein, 12 aa, Entamoeba histolytica
DNEIKQSVSNPT

SEQ ID NO: 2612389 - protein, 7 aa, Entamoeba histolytica
DNEIKQT

SEQ ID NO: 2612390 - protein, 20 aa, Entamoeba histolytica
DNEIQKEKEIGKKQQKEIEM

SEQ ID NO: 2612391 - protein, 11 aa, Entamoeba histolytica
DNEISEQSKVS

SEQ ID NO: 2612392 - protein, 5 aa, Entamoeba histolytica
DNEKE

SEQ ID NO: 2612393 - protein, 11 aa, Entamoeba histolytica
DNEKEKIRRTE

SEQ ID NO: 2612394 - protein, 8 aa, Entamoeba histolytica
DNEKIKDG

SEQ ID NO: 2612395 - protein, 10 aa, Entamoeba histolytica
DNEKKRKNEL

SEQ ID NO: 2612396 - protein, 10 aa, Entamoeba histolytica
DNEKNRKRIT

SEQ ID NO: 2612397 - protein, 6 aa, Entamoeba histolytica
DNELDI

SEQ ID NO: 2612398 - protein, 5 aa, Entamoeba histolytica
DNELI

SEQ ID NO: 2612399 - protein, 8 aa, Entamoeba histolytica
DNENEESI

SEQ ID NO: 2612400 - protein, 13 aa, Entamoeba histolytica
DNEQPIGGDSGET

SEQ ID NO: 2612401 - protein, 7 aa, Entamoeba histolytica
DNERLRQ

SEQ ID NO: 2612402 - protein, 6 aa, Entamoeba histolytica
DNESKS

SEQ ID NO: 2612403 - protein, 10 aa, Entamoeba histolytica
DNESNGTEKT

SEQ ID NO: 2612404 - protein, 6 aa, Entamoeba histolytica
DNESTV

SEQ ID NO: 2612405 - protein, 8 aa, Entamoeba histolytica
DNETDTGY

SEQ ID NO: 2612406 - protein, 12 aa, Entamoeba histolytica
DNETDVKPKAPW

SEQ ID NO: 2612407 - protein, 10 aa, Entamoeba histolytica
DNETKKIRQE

SEQ ID NO: 2612408 - protein, 16 aa, Entamoeba histolytica
DNETLPKNIPNCQDYG

SEQ ID NO: 2612409 - protein, 8 aa, Entamoeba histolytica
DNETNSTL

SEQ ID NO: 2612410 - protein, 6 aa, Entamoeba histolytica
DNETST

SEQ ID NO: 2612411 - protein, 14 aa, Entamoeba histolytica
DNETYSEAFKRGEG

SEQ ID NO: 2612412 - protein, 65 aa, Entamoeba histolytica
DNEVEESDEEPENKETKEKEVKEENKKGKEISGNTEEEKKENKKVLSKREIEKKKMKEMEERRRE

SEQ ID NO: 2612413 - protein, 5 aa, Entamoeba histolytica
DNEVI

SEQ ID NO: 2612414 - protein, 12 aa, Entamoeba histolytica
DNEVNERNESDV

SEQ ID NO: 2612415 - protein, 9 aa, Entamoeba histolytica
DNEVRGAQY

SEQ ID NO: 2612416 - protein, 6 aa, Entamoeba histolytica
DNEVRK

SEQ ID NO: 2612417 - protein, 6 aa, Entamoeba histolytica
DNEYSV

SEQ ID NO: 2612418 - protein, 7 aa, Entamoeba histolytica
DNFEGSR

SEQ ID NO: 2612419 - protein, 6 aa, Entamoeba histolytica
DNFGDE

SEQ ID NO: 2612420 - protein, 4 aa, Entamoeba histolytica
DNFQ

SEQ ID NO: 2612421 - protein, 10 aa, Entamoeba histolytica
DNFQRDPKMT

SEQ ID NO: 2612422 - protein, 9 aa, Entamoeba histolytica
DNFTGDRNG

SEQ ID NO: 2612423 - protein, 7 aa, Entamoeba histolytica
DNFTPKY

SEQ ID NO: 2612424 - protein, 27 aa, Entamoeba histolytica
DNGDEEDPSGLPAAHIPPTRPVPVYHS

SEQ ID NO: 2612425 - protein, 5 aa, Entamoeba histolytica
DNGER

SEQ ID NO: 2612426 - protein, 11 aa, Entamoeba histolytica
DNGEVKENKVG

SEQ ID NO: 2612427 - protein, 13 aa, Entamoeba histolytica
DNGFIQSSAYNPS

SEQ ID NO: 2612428 - protein, 5 aa, Entamoeba histolytica
DNGFK

SEQ ID NO: 2612429 - protein, 11 aa, Entamoeba histolytica
DNGGEISNKKD

SEQ ID NO: 2612430 - protein, 4 aa, Entamoeba histolytica
DNGH

SEQ ID NO: 2612431 - protein, 9 aa, Entamoeba histolytica
DNGKGDEEF

SEQ ID NO: 2612432 - protein, 15 aa, Entamoeba histolytica
DNGKMYTKSEVQDSM

SEQ ID NO: 2612433 - protein, 4 aa, Entamoeba histolytica
DNGN

SEQ ID NO: 2612434 - protein, 8 aa, Entamoeba histolytica
DNGNEEKI

SEQ ID NO: 2612435 - protein, 9 aa, Entamoeba histolytica
DNGSGINEE

SEQ ID NO: 2612436 - protein, 5 aa, Entamoeba histolytica
DNGSQ

SEQ ID NO: 2612437 - protein, 10 aa, Entamoeba histolytica
DNGSVLSSDQ

SEQ ID NO: 2612438 - protein, 10 aa, Entamoeba histolytica
DNGTEEAKKS

SEQ ID NO: 2612439 - protein, 8 aa, Entamoeba histolytica
DNGTEEVP

SEQ ID NO: 2612440 - protein, 10 aa, Entamoeba histolytica
DNGTTRSNDP

SEQ ID NO: 2612441 - protein, 12 aa, Entamoeba histolytica
DNHDEESQDDIP

SEQ ID NO: 2612442 - protein, 8 aa, Entamoeba histolytica
DNHEISEK

SEQ ID NO: 2612443 - protein, 7 aa, Entamoeba histolytica
DNHGECQ

SEQ ID NO: 2612444 - protein, 8 aa, Entamoeba histolytica
DNHKPGDV

SEQ ID NO: 2612445 - protein, 6 aa, Entamoeba histolytica
DNHQAR

SEQ ID NO: 2612446 - protein, 6 aa, Entamoeba histolytica
DNHTGK

SEQ ID NO: 2612447 - protein, 10 aa, Entamoeba histolytica
DNIAAKTSEI

SEQ ID NO: 2612448 - protein, 13 aa, Entamoeba histolytica
DNIDKNPISSPRS

SEQ ID NO: 2612449 - protein, 23 aa, Entamoeba histolytica
DNIENEKEQYNNNVKERNSDIPY

SEQ ID NO: 2612450 - protein, 8 aa, Entamoeba histolytica
DNIKKEKN

SEQ ID NO: 2612451 - protein, 4 aa, Entamoeba histolytica
DNIN

SEQ ID NO: 2612452 - protein, 10 aa, Entamoeba histolytica
DNINNNLQPP

SEQ ID NO: 2612453 - protein, 5 aa, Entamoeba histolytica
DNINR

SEQ ID NO: 2612454 - protein, 12 aa, Entamoeba histolytica
DNINTSDNETYN

SEQ ID NO: 2612455 - protein, 10 aa, Entamoeba histolytica
DNIPKDKATL

SEQ ID NO: 2612456 - protein, 10 aa, Entamoeba histolytica
DNIPNKGAEQ

SEQ ID NO: 2612457 - protein, 4 aa, Entamoeba histolytica
DNIQ

SEQ ID NO: 2612458 - protein, 24 aa, Entamoeba histolytica
DNIRNEKEFQKEFKEADRKKQEML

SEQ ID NO: 2612459 - protein, 5 aa, Entamoeba histolytica
DNKDD

SEQ ID NO: 2612460 - protein, 7 aa, Entamoeba histolytica
DNKDISC

SEQ ID NO: 2612461 - protein, 4 aa, Entamoeba histolytica
DNKE

SEQ ID NO: 2612462 - protein, 15 aa, Entamoeba histolytica
DNKEKITFKTTSTAA

SEQ ID NO: 2612463 - protein, 8 aa, Entamoeba histolytica
DNKEKKNI

SEQ ID NO: 2612464 - protein, 9 aa, Entamoeba histolytica
DNKEKQSAA

SEQ ID NO: 2612465 - protein, 6 aa, Entamoeba histolytica
DNKESN

SEQ ID NO: 2612466 - protein, 16 aa, Entamoeba histolytica
DNKGRPKEKEERKKLT

SEQ ID NO: 2612467 - protein, 5 aa, Entamoeba histolytica
DNKKE

SEQ ID NO: 2612468 - protein, 19 aa, Entamoeba histolytica
DNKKSFDKNEWKTKEKINK

SEQ ID NO: 2612469 - protein, 59 aa, Entamoeba histolytica
DNKKSKKKHSNKSEHSADEEENKEKDKPTDNKDNQSNQQELQQTPINQPNYGYENPQQN

SEQ ID NO: 2612470 - protein, 7 aa, Entamoeba histolytica
DNKMRSS

SEQ ID NO: 2612471 - protein, 31 aa, Entamoeba histolytica
DNKNENQLDEDDSKLKALQKRKEKRQRRRQR

SEQ ID NO: 2612472 - protein, 12 aa, Entamoeba histolytica
DNKNRSKTRGQH

SEQ ID NO: 2612473 - protein, 6 aa, Entamoeba histolytica
DNKNSI

SEQ ID NO: 2612474 - protein, 6 aa, Entamoeba histolytica
DNKPFG

SEQ ID NO: 2612475 - protein, 7 aa, Entamoeba histolytica
DNKQKEL

SEQ ID NO: 2612476 - protein, 5 aa, Entamoeba histolytica
DNKQL

SEQ ID NO: 2612477 - protein, 7 aa, Entamoeba histolytica
DNKSAEH

SEQ ID NO: 2612478 - protein, 8 aa, Entamoeba histolytica
DNKSDEQY

SEQ ID NO: 2612479 - protein, 10 aa, Entamoeba histolytica
DNKSKETREA

SEQ ID NO: 2612480 - protein, 8 aa, Entamoeba histolytica
DNKSLKKK

SEQ ID NO: 2612481 - protein, 13 aa, Entamoeba histolytica
DNKSNEKKQLEQR

SEQ ID NO: 2612482 - protein, 20 aa, Entamoeba histolytica
DNKSNLYNPTIDNETNEFNE

SEQ ID NO: 2612483 - protein, 6 aa, Entamoeba histolytica
DNKSNT

SEQ ID NO: 2612484 - protein, 4 aa, Entamoeba histolytica
DNKT

SEQ ID NO: 2612485 - protein, 5 aa, Entamoeba histolytica
DNKTD

SEQ ID NO: 2612486 - protein, 10 aa, Entamoeba histolytica
DNKTSKTKSF

SEQ ID NO: 2612487 - protein, 8 aa, Entamoeba histolytica
DNKYPEPF

SEQ ID NO: 2612488 - protein, 13 aa, Entamoeba histolytica
DNLDESSKDRGKT

SEQ ID NO: 2612489 - protein, 19 aa, Entamoeba histolytica
DNLEPQTRGFSPNEIQPEL

SEQ ID NO: 2612490 - protein, 6 aa, Entamoeba histolytica
DNLGAI

SEQ ID NO: 2612491 - protein, 9 aa, Entamoeba histolytica
DNLNKDDLQ

SEQ ID NO: 2612492 - protein, 16 aa, Entamoeba histolytica
DNLNRQNEKTKTLNGS

SEQ ID NO: 2612493 - protein, 16 aa, Entamoeba histolytica
DNLQQEKKQTKKSFDE

SEQ ID NO: 2612494 - protein, 6 aa, Entamoeba histolytica
DNLQTD

SEQ ID NO: 2612495 - protein, 7 aa, Entamoeba histolytica
DNLTRRS

SEQ ID NO: 2612496 - protein, 13 aa, Entamoeba histolytica
DNMESSDKGMVDG

SEQ ID NO: 2612497 - protein, 13 aa, Entamoeba histolytica
DNMNDAQKVQSLQ

SEQ ID NO: 2612498 - protein, 14 aa, Entamoeba histolytica
DNMNNKQYNRTREA

SEQ ID NO: 2612499 - protein, 6 aa, Entamoeba histolytica
DNMRKD

SEQ ID NO: 2612500 - protein, 4 aa, Entamoeba histolytica
DNND

SEQ ID NO: 2612501 - protein, 8 aa, Entamoeba histolytica
DNNDGTYS

SEQ ID NO: 2612502 - protein, 6 aa, Entamoeba histolytica
DNNDTF

SEQ ID NO: 2612503 - protein, 10 aa, Entamoeba histolytica
DNNEFAGNGD

SEQ ID NO: 2612504 - protein, 6 aa, Entamoeba histolytica
DNNEIE

SEQ ID NO: 2612505 - protein, 5 aa, Entamoeba histolytica
DNNEQ

SEQ ID NO: 2612506 - protein, 7 aa, Entamoeba histolytica
DNNEQTL

SEQ ID NO: 2612507 - protein, 5 aa, Entamoeba histolytica
DNNFT

SEQ ID NO: 2612508 - protein, 16 aa, Entamoeba histolytica
DNNGGDAFVAFLNSAF

SEQ ID NO: 2612509 - protein, 7 aa, Entamoeba histolytica
DNNGGTD

SEQ ID NO: 2612510 - protein, 6 aa, Entamoeba histolytica
DNNGLK

SEQ ID NO: 2612511 - protein, 8 aa, Entamoeba histolytica
DNNGLKQN

SEQ ID NO: 2612512 - protein, 10 aa, Entamoeba histolytica
DNNGNNKNCL

SEQ ID NO: 2612513 - protein, 5 aa, Entamoeba histolytica
DNNGT

SEQ ID NO: 2612514 - protein, 6 aa, Entamoeba histolytica
DNNISK

SEQ ID NO: 2612515 - protein, 12 aa, Entamoeba histolytica
DNNKKNITSSIN

SEQ ID NO: 2612516 - protein, 6 aa, Entamoeba histolytica
DNNKRL

SEQ ID NO: 2612517 - protein, 10 aa, Entamoeba histolytica
DNNKTIEKQS

SEQ ID NO: 2612518 - protein, 4 aa, Entamoeba histolytica
DNNN

SEQ ID NO: 2612519 - protein, 7 aa, Entamoeba histolytica
DNNPFPQ

SEQ ID NO: 2612520 - protein, 7 aa, Entamoeba histolytica
DNNPKAE

SEQ ID NO: 2612521 - protein, 16 aa, Entamoeba histolytica
DNNQNGSKEEYEKKKE

SEQ ID NO: 2612522 - protein, 8 aa, Entamoeba histolytica
DNNSCKVG

SEQ ID NO: 2612523 - protein, 5 aa, Entamoeba histolytica
DNNST

SEQ ID NO: 2612524 - protein, 9 aa, Entamoeba histolytica
DNNTEIGEN

SEQ ID NO: 2612525 - protein, 26 aa, Entamoeba histolytica
DNNTNTPSQNSQINEVNSQQPLPSSN

SEQ ID NO: 2612526 - protein, 5 aa, Entamoeba histolytica
DNNTY

SEQ ID NO: 2612527 - protein, 4 aa, Entamoeba histolytica
DNNV

SEQ ID NO: 2612528 - protein, 7 aa, Entamoeba histolytica
DNNVTPV

SEQ ID NO: 2612529 - protein, 7 aa, Entamoeba histolytica
DNPDGTT

SEQ ID NO: 2612530 - protein, 6 aa, Entamoeba histolytica
DNPEDC

SEQ ID NO: 2612531 - protein, 4 aa, Entamoeba histolytica
DNPF

SEQ ID NO: 2612532 - protein, 6 aa, Entamoeba histolytica
DNPGME

SEQ ID NO: 2612533 - protein, 12 aa, Entamoeba histolytica
DNPIKTNEIQPS

SEQ ID NO: 2612534 - protein, 21 aa, Entamoeba histolytica
DNPISDIRGANSMKTESPYNY

SEQ ID NO: 2612535 - protein, 28 aa, Entamoeba histolytica
DNPKDCGLPGEEWSDDNSIQIEKRKQEL

SEQ ID NO: 2612536 - protein, 15 aa, Entamoeba histolytica
DNPLEDKGSVSETRQ

SEQ ID NO: 2612537 - protein, 6 aa, Entamoeba histolytica
DNPNEI

SEQ ID NO: 2612538 - protein, 7 aa, Entamoeba histolytica
DNPNEIG

SEQ ID NO: 2612539 - protein, 14 aa, Entamoeba histolytica
DNPNKESPAQQRAN

SEQ ID NO: 2612540 - protein, 8 aa, Entamoeba histolytica
DNPNLGPP

SEQ ID NO: 2612541 - protein, 7 aa, Entamoeba histolytica
DNPPAKL

SEQ ID NO: 2612542 - protein, 12 aa, Entamoeba histolytica
DNPPKKGLFPEY

SEQ ID NO: 2612543 - protein, 10 aa, Entamoeba histolytica
DNPQSSVSPL

SEQ ID NO: 2612544 - protein, 7 aa, Entamoeba histolytica
DNPSASK

SEQ ID NO: 2612545 - protein, 7 aa, Entamoeba histolytica
DNPSAWK

SEQ ID NO: 2612546 - protein, 9 aa, Entamoeba histolytica
DNPSTSFGD

SEQ ID NO: 2612547 - protein, 16 aa, Entamoeba histolytica
DNPSYVPKYPKEGDNI

SEQ ID NO: 2612548 - protein, 5 aa, Entamoeba histolytica
DNPTK

SEQ ID NO: 2612549 - protein, 4 aa, Entamoeba histolytica
DNPV

SEQ ID NO: 2612550 - protein, 5 aa, Entamoeba histolytica
DNPYT

SEQ ID NO: 2612551 - protein, 5 aa, Entamoeba histolytica
DNQEL

SEQ ID NO: 2612552 - protein, 8 aa, Entamoeba histolytica
DNQEYGIE

SEQ ID NO: 2612553 - protein, 4 aa, Entamoeba histolytica
DNQF

SEQ ID NO: 2612554 - protein, 4 aa, Entamoeba histolytica
DNQG

SEQ ID NO: 2612555 - protein, 9 aa, Entamoeba histolytica
DNQGNISNN

SEQ ID NO: 2612556 - protein, 7 aa, Entamoeba histolytica
DNQGPDA

SEQ ID NO: 2612557 - protein, 10 aa, Entamoeba histolytica
DNQIKAKGLQ

SEQ ID NO: 2612558 - protein, 7 aa, Entamoeba histolytica
DNQIKDK

SEQ ID NO: 2612559 - protein, 5 aa, Entamoeba histolytica
DNQIR

SEQ ID NO: 2612560 - protein, 6 aa, Entamoeba histolytica
DNQIRN

SEQ ID NO: 2612561 - protein, 9 aa, Entamoeba histolytica
DNQKKENIE

SEQ ID NO: 2612562 - protein, 8 aa, Entamoeba histolytica
DNQKSIEL

SEQ ID NO: 2612563 - protein, 7 aa, Entamoeba histolytica
DNQNDYI

SEQ ID NO: 2612564 - protein, 7 aa, Entamoeba histolytica
DNQPSPL

SEQ ID NO: 2612565 - protein, 8 aa, Entamoeba histolytica
DNQQKQEN

SEQ ID NO: 2612566 - protein, 6 aa, Entamoeba histolytica
DNQRHN

SEQ ID NO: 2612567 - protein, 8 aa, Entamoeba histolytica
DNQRSINN

SEQ ID NO: 2612568 - protein, 5 aa, Entamoeba histolytica
DNQST

SEQ ID NO: 2612569 - protein, 22 aa, Entamoeba histolytica
DNQTDNNTFSTDFNETKGSSVL

SEQ ID NO: 2612570 - protein, 5 aa, Entamoeba histolytica
DNQTE

SEQ ID NO: 2612571 - protein, 17 aa, Entamoeba histolytica
DNQTHKPKEEQEKKEIT

SEQ ID NO: 2612572 - protein, 5 aa, Entamoeba histolytica
DNQTN

SEQ ID NO: 2612573 - protein, 6 aa, Entamoeba histolytica
DNQYNE

SEQ ID NO: 2612574 - protein, 9 aa, Entamoeba histolytica
DNRDFEDAQ

SEQ ID NO: 2612575 - protein, 6 aa, Entamoeba histolytica
DNRDKL

SEQ ID NO: 2612576 - protein, 7 aa, Entamoeba histolytica
DNREKEI

SEQ ID NO: 2612577 - protein, 34 aa, Entamoeba histolytica
DNRKEDNEVEEDNEVEDDDEVEEDDESTKEDDEV

SEQ ID NO: 2612578 - protein, 11 aa, Entamoeba histolytica
DNRLKTDDGRY

SEQ ID NO: 2612579 - protein, 12 aa, Entamoeba histolytica
DNRSHFAEDEPA

SEQ ID NO: 2612580 - protein, 6 aa, Entamoeba histolytica
DNRSSF

SEQ ID NO: 2612581 - protein, 4 aa, Entamoeba histolytica
DNRY

SEQ ID NO: 2612582 - protein, 8 aa, Entamoeba histolytica
DNSDEPFI

SEQ ID NO: 2612583 - protein, 27 aa, Entamoeba histolytica
DNSDNKSIESKYQGNITETMKQGRSSP

SEQ ID NO: 2612584 - protein, 4 aa, Entamoeba histolytica
DNSE

SEQ ID NO: 2612585 - protein, 7 aa, Entamoeba histolytica
DNSENGL

SEQ ID NO: 2612586 - protein, 4 aa, Entamoeba histolytica
DNSF

SEQ ID NO: 2612587 - protein, 7 aa, Entamoeba histolytica
DNSFISP

SEQ ID NO: 2612588 - protein, 5 aa, Entamoeba histolytica
DNSFN

SEQ ID NO: 2612589 - protein, 6 aa, Entamoeba histolytica
DNSGCT

SEQ ID NO: 2612590 - protein, 7 aa, Entamoeba histolytica
DNSGCTS

SEQ ID NO: 2612591 - protein, 6 aa, Entamoeba histolytica
DNSGDE

SEQ ID NO: 2612592 - protein, 11 aa, Entamoeba histolytica
DNSGDEKEIDR

SEQ ID NO: 2612593 - protein, 16 aa, Entamoeba histolytica
DNSGNVEIKAEEKELK

SEQ ID NO: 2612594 - protein, 8 aa, Entamoeba histolytica
DNSHRNKV

SEQ ID NO: 2612595 - protein, 4 aa, Entamoeba histolytica
DNSK

SEQ ID NO: 2612596 - protein, 6 aa, Entamoeba histolytica
DNSNEI

SEQ ID NO: 2612597 - protein, 8 aa, Entamoeba histolytica
DNSNFVDS

SEQ ID NO: 2612598 - protein, 8 aa, Entamoeba histolytica
DNSNPLSI

SEQ ID NO: 2612599 - protein, 14 aa, Entamoeba histolytica
DNSNSLTSEEGSHF

SEQ ID NO: 2612600 - protein, 13 aa, Entamoeba histolytica
DNSPKKKIINSTY

SEQ ID NO: 2612601 - protein, 8 aa, Entamoeba histolytica
DNSPYKRK

SEQ ID NO: 2612602 - protein, 5 aa, Entamoeba histolytica
DNSQI

SEQ ID NO: 2612603 - protein, 10 aa, Entamoeba histolytica
DNSQKDRTKK

SEQ ID NO: 2612604 - protein, 9 aa, Entamoeba histolytica
DNSRSNTNL

SEQ ID NO: 2612605 - protein, 13 aa, Entamoeba histolytica
DNSSLSQINRSEL

SEQ ID NO: 2612606 - protein, 17 aa, Entamoeba histolytica
DNSTSHEKDSENNCTAN

SEQ ID NO: 2612607 - protein, 16 aa, Entamoeba histolytica
DNTDFSKPENWGGNSS

SEQ ID NO: 2612608 - protein, 5 aa, Entamoeba histolytica
DNTDS

SEQ ID NO: 2612609 - protein, 9 aa, Entamoeba histolytica
DNTHCKNNE

SEQ ID NO: 2612610 - protein, 7 aa, Entamoeba histolytica
DNTKEPF

SEQ ID NO: 2612611 - protein, 5 aa, Entamoeba histolytica
DNTKF

SEQ ID NO: 2612612 - protein, 5 aa, Entamoeba histolytica
DNTKN

SEQ ID NO: 2612613 - protein, 7 aa, Entamoeba histolytica
DNTLGED

SEQ ID NO: 2612614 - protein, 7 aa, Entamoeba histolytica
DNTLKNE

SEQ ID NO: 2612615 - protein, 6 aa, Entamoeba histolytica
DNTMPG

SEQ ID NO: 2612616 - protein, 6 aa, Entamoeba histolytica
DNTMTK

SEQ ID NO: 2612617 - protein, 4 aa, Entamoeba histolytica
DNTN

SEQ ID NO: 2612618 - protein, 8 aa, Entamoeba histolytica
DNTNGKAI

SEQ ID NO: 2612619 - protein, 6 aa, Entamoeba histolytica
DNTNYF

SEQ ID NO: 2612620 - protein, 13 aa, Entamoeba histolytica
DNTQKTDTTLENQ

SEQ ID NO: 2612621 - protein, 11 aa, Entamoeba histolytica
DNTQPEEAAPN

SEQ ID NO: 2612622 - protein, 8 aa, Entamoeba histolytica
DNTQRNKR

SEQ ID NO: 2612623 - protein, 9 aa, Entamoeba histolytica
DNTQRQKEL

SEQ ID NO: 2612624 - protein, 6 aa, Entamoeba histolytica
DNTQVK

SEQ ID NO: 2612625 - protein, 8 aa, Entamoeba histolytica
DNTRKRKG

SEQ ID NO: 2612626 - protein, 7 aa, Entamoeba histolytica
DNTSFPS

SEQ ID NO: 2612627 - protein, 8 aa, Entamoeba histolytica
DNTSGSAM

SEQ ID NO: 2612628 - protein, 97 aa, Entamoeba histolytica
DNTSNLKESGDNDSENTKDVNGSDYQVTEINGSEQLKQPGDTSDFSTNKVQSENSNSLESSQTDDNTNPPSEPTHTPSMSMDESPNEKTTSFTNMEE

SEQ ID NO: 2612629 - protein, 9 aa, Entamoeba histolytica
DNTSYNGKD

SEQ ID NO: 2612630 - protein, 7 aa, Entamoeba histolytica
DNTTLSA

SEQ ID NO: 2612631 - protein, 16 aa, Entamoeba histolytica
DNTTTQQLPTLSSVGL

SEQ ID NO: 2612632 - protein, 6 aa, Entamoeba histolytica
DNTVNK

SEQ ID NO: 2612633 - protein, 7 aa, Entamoeba histolytica
DNVDYTE

SEQ ID NO: 2612634 - protein, 12 aa, Entamoeba histolytica
DNVEDDVEEKED

SEQ ID NO: 2612635 - protein, 10 aa, Entamoeba histolytica
DNVEDPKDKN

SEQ ID NO: 2612636 - protein, 10 aa, Entamoeba histolytica
DNVNDDKYAN

SEQ ID NO: 2612637 - protein, 7 aa, Entamoeba histolytica
DNVPMSP

SEQ ID NO: 2612638 - protein, 9 aa, Entamoeba histolytica
DNVPSQYRK

SEQ ID NO: 2612639 - protein, 6 aa, Entamoeba histolytica
DNVRDN

SEQ ID NO: 2612640 - protein, 21 aa, Entamoeba histolytica
DNVSDDEDEFKQDEVTPSQQE

SEQ ID NO: 2612641 - protein, 14 aa, Entamoeba histolytica
DNVSDTPLSSSPLK

SEQ ID NO: 2612642 - protein, 7 aa, Entamoeba histolytica
DNVTSGR

SEQ ID NO: 2612643 - protein, 6 aa, Entamoeba histolytica
DNWGTV

SEQ ID NO: 2612644 - protein, 4 aa, Entamoeba histolytica
DNWN

SEQ ID NO: 2612645 - protein, 6 aa, Entamoeba histolytica
DNYDNV

SEQ ID NO: 2612646 - protein, 7 aa, Entamoeba histolytica
DNYNKTT

SEQ ID NO: 2612647 - protein, 7 aa, Entamoeba histolytica
DNYRRKG

SEQ ID NO: 2612648 - protein, 7 aa, Entamoeba histolytica
DNYRSEE

SEQ ID NO: 2612649 - protein, 5 aa, Entamoeba histolytica
DPAAA

SEQ ID NO: 2612650 - protein, 5 aa, Entamoeba histolytica
DPACP

SEQ ID NO: 2612651 - protein, 7 aa, Entamoeba histolytica
DPADLNP

SEQ ID NO: 2612652 - protein, 9 aa, Entamoeba histolytica
DPAHNTSDA

SEQ ID NO: 2612653 - protein, 4 aa, Entamoeba histolytica
DPAI

SEQ ID NO: 2612654 - protein, 12 aa, Entamoeba histolytica
DPAIDKQSSRYK

SEQ ID NO: 2612655 - protein, 5 aa, Entamoeba histolytica
DPAIQ

SEQ ID NO: 2612656 - protein, 7 aa, Entamoeba histolytica
DPAKYDK

SEQ ID NO: 2612657 - protein, 7 aa, Entamoeba histolytica
DPASGKY

SEQ ID NO: 2612658 - protein, 9 aa, Entamoeba histolytica
DPATNKPHP

SEQ ID NO: 2612659 - protein, 5 aa, Entamoeba histolytica
DPDDG

SEQ ID NO: 2612660 - protein, 7 aa, Entamoeba histolytica
DPDDTFQ

SEQ ID NO: 2612661 - protein, 8 aa, Entamoeba histolytica
DPDENQLE

SEQ ID NO: 2612662 - protein, 15 aa, Entamoeba histolytica
DPDENVEGMKPSMRG

SEQ ID NO: 2612663 - protein, 8 aa, Entamoeba histolytica
DPDESGIR

SEQ ID NO: 2612664 - protein, 9 aa, Entamoeba histolytica
DPDESVEGM

SEQ ID NO: 2612665 - protein, 5 aa, Entamoeba histolytica
DPDIE

SEQ ID NO: 2612666 - protein, 15 aa, Entamoeba histolytica
DPDISDDDSTFDENE

SEQ ID NO: 2612667 - protein, 11 aa, Entamoeba histolytica
DPDKDECSADS

SEQ ID NO: 2612668 - protein, 11 aa, Entamoeba histolytica
DPDKKRKTSIV

SEQ ID NO: 2612669 - protein, 9 aa, Entamoeba histolytica
DPDNAPPEN

SEQ ID NO: 2612670 - protein, 6 aa, Entamoeba histolytica
DPDNKY

SEQ ID NO: 2612671 - protein, 6 aa, Entamoeba histolytica
DPDNLE

SEQ ID NO: 2612672 - protein, 18 aa, Entamoeba histolytica
DPDPATNDWKSSPRGAGH

SEQ ID NO: 2612673 - protein, 11 aa, Entamoeba histolytica
DPDSPLGESQG

SEQ ID NO: 2612674 - protein, 6 aa, Entamoeba histolytica
DPDSYN

SEQ ID NO: 2612675 - protein, 10 aa, Entamoeba histolytica
DPEDEKNKQI

SEQ ID NO: 2612676 - protein, 15 aa, Entamoeba histolytica
DPEEKAGWEQSPRGA

SEQ ID NO: 2612677 - protein, 13 aa, Entamoeba histolytica
DPEEKGVIDSKEL

SEQ ID NO: 2612678 - protein, 20 aa, Entamoeba histolytica
DPEGNEIPIEQKDNGDGTYD

SEQ ID NO: 2612679 - protein, 12 aa, Entamoeba histolytica
DPEKRLTDPNRI

SEQ ID NO: 2612680 - protein, 4 aa, Entamoeba histolytica
DPEN

SEQ ID NO: 2612681 - protein, 14 aa, Entamoeba histolytica
DPENLKGPIVHYEE

SEQ ID NO: 2612682 - protein, 9 aa, Entamoeba histolytica
DPENPNNIY

SEQ ID NO: 2612683 - protein, 9 aa, Entamoeba histolytica
DPENPNTIY

SEQ ID NO: 2612684 - protein, 17 aa, Entamoeba histolytica
DPEPEVDTWRPSNRGAG

SEQ ID NO: 2612685 - protein, 4 aa, Entamoeba histolytica
DPER

SEQ ID NO: 2612686 - protein, 8 aa, Entamoeba histolytica
DPEREATY

SEQ ID NO: 2612687 - protein, 8 aa, Entamoeba histolytica
DPERVPKA

SEQ ID NO: 2612688 - protein, 8 aa, Entamoeba histolytica
DPESDEMT

SEQ ID NO: 2612689 - protein, 9 aa, Entamoeba histolytica
DPESRWTAK

SEQ ID NO: 2612690 - protein, 6 aa, Entamoeba histolytica
DPESTN

SEQ ID NO: 2612691 - protein, 8 aa, Entamoeba histolytica
DPETGNKE

SEQ ID NO: 2612692 - protein, 10 aa, Entamoeba histolytica
DPETRRKKQI

SEQ ID NO: 2612693 - protein, 4 aa, Entamoeba histolytica
DPEV

SEQ ID NO: 2612694 - protein, 5 aa, Entamoeba histolytica
DPFAE

SEQ ID NO: 2612695 - protein, 5 aa, Entamoeba histolytica
DPFDE

SEQ ID NO: 2612696 - protein, 4 aa, Entamoeba histolytica
DPFK

SEQ ID NO: 2612697 - protein, 23 aa, Entamoeba histolytica
DPFKGRASEPPKDTSSSKEFEEL

SEQ ID NO: 2612698 - protein, 4 aa, Entamoeba histolytica
DPFL

SEQ ID NO: 2612699 - protein, 5 aa, Entamoeba histolytica
DPFYS

SEQ ID NO: 2612700 - protein, 21 aa, Entamoeba histolytica
DPGEEEVKITQQTEDTDGGCV

SEQ ID NO: 2612701 - protein, 6 aa, Entamoeba histolytica
DPGKGA

SEQ ID NO: 2612702 - protein, 7 aa, Entamoeba histolytica
DPGLGKS

SEQ ID NO: 2612703 - protein, 9 aa, Entamoeba histolytica
DPGSLDTRT

SEQ ID NO: 2612704 - protein, 8 aa, Entamoeba histolytica
DPGTGKSQ

SEQ ID NO: 2612705 - protein, 8 aa, Entamoeba histolytica
DPGTSKSQ

SEQ ID NO: 2612706 - protein, 6 aa, Entamoeba histolytica
DPGTVN

SEQ ID NO: 2612707 - protein, 6 aa, Entamoeba histolytica
DPHASN

SEQ ID NO: 2612708 - protein, 12 aa, Entamoeba histolytica
DPHKSLEQNEVY

SEQ ID NO: 2612709 - protein, 4 aa, Entamoeba histolytica
DPHM

SEQ ID NO: 2612710 - protein, 4 aa, Entamoeba histolytica
DPHS

SEQ ID NO: 2612711 - protein, 12 aa, Entamoeba histolytica
DPHVKEAKPNPQ

SEQ ID NO: 2612712 - protein, 6 aa, Entamoeba histolytica
DPHYQR

SEQ ID NO: 2612713 - protein, 4 aa, Entamoeba histolytica
DPIE

SEQ ID NO: 2612714 - protein, 26 aa, Entamoeba histolytica
DPIESLKEETESKKTKDKSKKQSGLF

SEQ ID NO: 2612715 - protein, 5 aa, Entamoeba histolytica
DPIGV

SEQ ID NO: 2612716 - protein, 34 aa, Entamoeba histolytica
DPIKTETPLNTSENDHQTNTSEKQCKEEEERNNE

SEQ ID NO: 2612717 - protein, 8 aa, Entamoeba histolytica
DPINQQKV

SEQ ID NO: 2612718 - protein, 16 aa, Entamoeba histolytica
DPIQQDNNYSTPTSDN

SEQ ID NO: 2612719 - protein, 4 aa, Entamoeba histolytica
DPIS

SEQ ID NO: 2612720 - protein, 11 aa, Entamoeba histolytica
DPISGEINESS

SEQ ID NO: 2612721 - protein, 4 aa, Entamoeba histolytica
DPIT

SEQ ID NO: 2612722 - protein, 12 aa, Entamoeba histolytica
DPITQKTEEPST

SEQ ID NO: 2612723 - protein, 5 aa, Entamoeba histolytica
DPITR

SEQ ID NO: 2612724 - protein, 13 aa, Entamoeba histolytica
DPIYTSEVSENGE

SEQ ID NO: 2612725 - protein, 11 aa, Entamoeba histolytica
DPKDPNARTLK

SEQ ID NO: 2612726 - protein, 33 aa, Entamoeba histolytica; identical to SEQ ID NO: 2417155

SEQ ID NO: 2612727 - protein, 4 aa, Entamoeba histolytica
DPKG

SEQ ID NO: 2612728 - protein, 4 aa, Entamoeba histolytica
DPKI

SEQ ID NO: 2612729 - protein, 5 aa, Entamoeba histolytica
DPKIQ

SEQ ID NO: 2612730 - protein, 8 aa, Entamoeba histolytica
DPKKINKI

SEQ ID NO: 2612731 - protein, 13 aa, Entamoeba histolytica
DPKKLSEKNEETS

SEQ ID NO: 2612732 - protein, 10 aa, Entamoeba histolytica
DPKKRPDANQ

SEQ ID NO: 2612733 - protein, 8 aa, Entamoeba histolytica
DPKLEGPT

SEQ ID NO: 2612734 - protein, 8 aa, Entamoeba histolytica
DPKQKKVT

SEQ ID NO: 2612735 - protein, 8 aa, Entamoeba histolytica
DPKRSAEI

SEQ ID NO: 2612736 - protein, 10 aa, Entamoeba histolytica
DPKSKSKTHY

SEQ ID NO: 2612737 - protein, 8 aa, Entamoeba histolytica
DPKTDKTE

SEQ ID NO: 2612738 - protein, 11 aa, Entamoeba histolytica
DPKTENDLKTL

SEQ ID NO: 2612739 - protein, 13 aa, Entamoeba histolytica
DPKTLAPIAGTEY

SEQ ID NO: 2612740 - protein, 8 aa, Entamoeba histolytica
DPKTNKTE

SEQ ID NO: 2612741 - protein, 9 aa, Entamoeba histolytica
DPKVDQRHG

SEQ ID NO: 2612742 - protein, 6 aa, Entamoeba histolytica
DPKVGP

SEQ ID NO: 2612743 - protein, 8 aa, Entamoeba histolytica
DPKVPNPQ

SEQ ID NO: 2612744 - protein, 5 aa, Entamoeba histolytica
DPKVT

SEQ ID NO: 2612745 - protein, 5 aa, Entamoeba histolytica
DPLLN

SEQ ID NO: 2612746 - protein, 5 aa, Entamoeba histolytica
DPLLR

SEQ ID NO: 2612747 - protein, 5 aa, Entamoeba histolytica
DPLST

SEQ ID NO: 2612748 - protein, 6 aa, Entamoeba histolytica
DPLTSL

SEQ ID NO: 2612749 - protein, 6 aa, Entamoeba histolytica
DPMKYQ

SEQ ID NO: 2612750 - protein, 4 aa, Entamoeba histolytica
DPMR

SEQ ID NO: 2612751 - protein, 5 aa, Entamoeba histolytica
DPNAE

SEQ ID NO: 2612752 - protein, 7 aa, Entamoeba histolytica
DPNASIK

SEQ ID NO: 2612753 - protein, 7 aa, Entamoeba histolytica
DPNCPQV

SEQ ID NO: 2612754 - protein, 9 aa, Entamoeba histolytica
DPNDDIDEN

SEQ ID NO: 2612755 - protein, 6 aa, Entamoeba histolytica
DPNDFV

SEQ ID NO: 2612756 - protein, 7 aa, Entamoeba histolytica
DPNDYSY

SEQ ID NO: 2612757 - protein, 4 aa, Entamoeba histolytica
DPNE

SEQ ID NO: 2612758 - protein, 10 aa, Entamoeba histolytica
DPNEAKEPRF

SEQ ID NO: 2612759 - protein, 10 aa, Entamoeba histolytica
DPNEDTTVEG

SEQ ID NO: 2612760 - protein, 15 aa, Entamoeba histolytica
DPNEKSPSELPKPRK

SEQ ID NO: 2612761 - protein, 5 aa, Entamoeba histolytica
DPNEQ

SEQ ID NO: 2612762 - protein, 4 aa, Entamoeba histolytica
DPNF

SEQ ID NO: 2612763 - protein, 5 aa, Entamoeba histolytica
DPNFE

SEQ ID NO: 2612764 - protein, 4 aa, Entamoeba histolytica
DPNG

SEQ ID NO: 2612765 - protein, 11 aa, Entamoeba histolytica
DPNGTKTTLEQ

SEQ ID NO: 2612766 - protein, 7 aa, Entamoeba histolytica
DPNKIDG

SEQ ID NO: 2612767 - protein, 27 aa, Entamoeba histolytica
DPNNKPAFTKTQTFTSDGKITSSIRTQ

SEQ ID NO: 2612768 - protein, 6 aa, Entamoeba histolytica
DPNNRH

SEQ ID NO: 2612769 - protein, 20 aa, Entamoeba histolytica
DPNNTTNAQQYEAKKPVKSS

SEQ ID NO: 2612770 - protein, 6 aa, Entamoeba histolytica
DPNPFN

SEQ ID NO: 2612771 - protein, 6 aa, Entamoeba histolytica
DPNPRV

SEQ ID NO: 2612772 - protein, 10 aa, Entamoeba histolytica
DPNQRPTSEQ

SEQ ID NO: 2612773 - protein, 8 aa, Entamoeba histolytica
DPNSAPVK

SEQ ID NO: 2612774 - protein, 8 aa, Entamoeba histolytica
DPNSFGGS

SEQ ID NO: 2612775 - protein, 7 aa, Entamoeba histolytica
DPNSGSL

SEQ ID NO: 2612776 - protein, 10 aa, Entamoeba histolytica
DPNSSEPEPM

SEQ ID NO: 2612777 - protein, 6 aa, Entamoeba histolytica
DPNSSI

SEQ ID NO: 2612778 - protein, 6 aa, Entamoeba histolytica
DPNSTL

SEQ ID NO: 2612779 - protein, 7 aa, Entamoeba histolytica
DPNVESK

SEQ ID NO: 2612780 - protein, 5 aa, Entamoeba histolytica
DPNVN

SEQ ID NO: 2612781 - protein, 7 aa, Entamoeba histolytica
DPPASQS

SEQ ID NO: 2612782 - protein, 27 aa, Entamoeba histolytica
DPPEDSFLSPSPQTDGLSNISKTKPKI

SEQ ID NO: 2612783 - protein, 7 aa, Entamoeba histolytica
DPPESEL

SEQ ID NO: 2612784 - protein, 8 aa, Entamoeba histolytica
DPPGETSE

SEQ ID NO: 2612785 - protein, 11 aa, Entamoeba histolytica
DPPKKLTKQQM

SEQ ID NO: 2612786 - protein, 4 aa, Entamoeba histolytica
DPPL

SEQ ID NO: 2612787 - protein, 8 aa, Entamoeba histolytica
DPPQDPKT

SEQ ID NO: 2612788 - protein, 5 aa, Entamoeba histolytica
DPPRR

SEQ ID NO: 2612789 - protein, 13 aa, Entamoeba histolytica
DPPVGISSGPIDE

SEQ ID NO: 2612790 - protein, 21 aa, Entamoeba histolytica
DPPYGIREGAKKVGKRKPDMV

SEQ ID NO: 2612791 - protein, 10 aa, Entamoeba histolytica
DPQEEVDQDD

SEQ ID NO: 2612792 - protein, 8 aa, Entamoeba histolytica
DPQHSQLT

SEQ ID NO: 2612793 - protein, 9 aa, Entamoeba histolytica
DPQKDEGSI

SEQ ID NO: 2612794 - protein, 5 aa, Entamoeba histolytica
DPQMT

SEQ ID NO: 2612795 - protein, 7 aa, Entamoeba histolytica
DPQQQIE

SEQ ID NO: 2612796 - protein, 8 aa, Entamoeba histolytica
DPQQRSQT

SEQ ID NO: 2612797 - protein, 19 aa, Entamoeba histolytica
DPQRENGKAIEIKSNADIS

SEQ ID NO: 2612798 - protein, 9 aa, Entamoeba histolytica
DPQSGTKVG

SEQ ID NO: 2612799 - protein, 14 aa, Entamoeba histolytica
DPQTSNGSSPSIRG

SEQ ID NO: 2612800 - protein, 20 aa, Entamoeba histolytica
DPQVNQQSTQQNVLSKGPAK

SEQ ID NO: 2612801 - protein, 7 aa, Entamoeba histolytica
DPQVSRK

SEQ ID NO: 2612802 - protein, 6 aa, Entamoeba histolytica
DPRASG

SEQ ID NO: 2612803 - protein, 5 aa, Entamoeba histolytica
DPRDD

SEQ ID NO: 2612804 - protein, 6 aa, Entamoeba histolytica
DPRDKN

SEQ ID NO: 2612805 - protein, 17 aa, Entamoeba histolytica
DPRDPADIEEADDDDEV

SEQ ID NO: 2612806 - protein, 8 aa, Entamoeba histolytica
DPRDRPSC

SEQ ID NO: 2612807 - protein, 7 aa, Entamoeba histolytica
DPRESQI

SEQ ID NO: 2612808 - protein, 9 aa, Entamoeba histolytica
DPRFGTKND

SEQ ID NO: 2612809 - protein, 5 aa, Entamoeba histolytica
DPRGS

SEQ ID NO: 2612810 - protein, 6 aa, Entamoeba histolytica
DPRGSI

SEQ ID NO: 2612811 - protein, 24 aa, Entamoeba histolytica
DPRMGPFEKGEECQTCRGTRTECP

SEQ ID NO: 2612812 - protein, 6 aa, Entamoeba histolytica
DPRPNT

SEQ ID NO: 2612813 - protein, 8 aa, Entamoeba histolytica
DPRPPQQR

SEQ ID NO: 2612814 - protein, 6 aa, Entamoeba histolytica
DPRQAL

SEQ ID NO: 2612815 - protein, 4 aa, Entamoeba histolytica
DPRS

SEQ ID NO: 2612816 - protein, 6 aa, Entamoeba histolytica
DPRTLR

SEQ ID NO: 2612817 - protein, 4 aa, Entamoeba histolytica
DPRY

SEQ ID NO: 2612818 - protein, 6 aa, Entamoeba histolytica
DPSDNL

SEQ ID NO: 2612819 - protein, 8 aa, Entamoeba histolytica
DPSFEPLD

SEQ ID NO: 2612820 - protein, 9 aa, Entamoeba histolytica
DPSFNGEKE

SEQ ID NO: 2612821 - protein, 7 aa, Entamoeba histolytica
DPSGTER

SEQ ID NO: 2612822 - protein, 8 aa, Entamoeba histolytica
DPSIDSSL

SEQ ID NO: 2612823 - protein, 6 aa, Entamoeba histolytica
DPSIPI

SEQ ID NO: 2612824 - protein, 12 aa, Entamoeba histolytica
DPSKINSFNGSD

SEQ ID NO: 2612825 - protein, 8 aa, Entamoeba histolytica
DPSKPNGL

SEQ ID NO: 2612826 - protein, 8 aa, Entamoeba histolytica
DPSKQIQH

SEQ ID NO: 2612827 - protein, 8 aa, Entamoeba histolytica
DPSKRNCD

SEQ ID NO: 2612828 - protein, 8 aa, Entamoeba histolytica
DPSKRPSA

SEQ ID NO: 2612829 - protein, 11 aa, Entamoeba histolytica
DPSKYWDDYDD

SEQ ID NO: 2612830 - protein, 4 aa, Entamoeba histolytica
DPSL

SEQ ID NO: 2612831 - protein, 5 aa, Entamoeba histolytica
DPSNA

SEQ ID NO: 2612832 - protein, 5 aa, Entamoeba histolytica
DPSPY

SEQ ID NO: 2612833 - protein, 18 aa, Entamoeba histolytica
DPSREASKQKLRKQTRKI

SEQ ID NO: 2612834 - protein, 8 aa, Entamoeba histolytica
DPSSLHDK

SEQ ID NO: 2612835 - protein, 5 aa, Entamoeba histolytica
DPSSN

SEQ ID NO: 2612836 - protein, 7 aa, Entamoeba histolytica
DPSSNKI

SEQ ID NO: 2612837 - protein, 9 aa, Entamoeba histolytica
DPSSQPTTF

SEQ ID NO: 2612838 - protein, 4 aa, Entamoeba histolytica
DPST

SEQ ID NO: 2612839 - protein, 6 aa, Entamoeba histolytica
DPSTAC

SEQ ID NO: 2612840 - protein, 8 aa, Entamoeba histolytica
DPSTDTFG

SEQ ID NO: 2612841 - protein, 4 aa, Entamoeba histolytica
DPSV

SEQ ID NO: 2612842 - protein, 6 aa, Entamoeba histolytica
DPSVIG

SEQ ID NO: 2612843 - protein, 5 aa, Entamoeba histolytica
DPSVT

SEQ ID NO: 2612844 - protein, 4 aa, Entamoeba histolytica
DPSW

SEQ ID NO: 2612845 - protein, 4 aa, Entamoeba histolytica
DPTD

SEQ ID NO: 2612846 - protein, 10 aa, Entamoeba histolytica
DPTDKKPAIP

SEQ ID NO: 2612847 - protein, 4 aa, Entamoeba histolytica
DPTI

SEQ ID NO: 2612848 - protein, 4 aa, Entamoeba histolytica
DPTK

SEQ ID NO: 2612849 - protein, 5 aa, Entamoeba histolytica
DPTKR

SEQ ID NO: 2612850 - protein, 14 aa, Entamoeba histolytica
DPTKRPDCEELDKD

SEQ ID NO: 2612851 - protein, 5 aa, Entamoeba histolytica
DPTLD

SEQ ID NO: 2612852 - protein, 5 aa, Entamoeba histolytica
DPTLE

SEQ ID NO: 2612853 - protein, 5 aa, Entamoeba histolytica
DPTLT

SEQ ID NO: 2612854 - protein, 11 aa, Entamoeba histolytica
DPTMENPPSRA

SEQ ID NO: 2612855 - protein, 4 aa, Entamoeba histolytica
DPTN

SEQ ID NO: 2612856 - protein, 8 aa, Entamoeba histolytica
DPTNTNDI

SEQ ID NO: 2612857 - protein, 6 aa, Entamoeba histolytica
DPTPNF

SEQ ID NO: 2612858 - protein, 8 aa, Entamoeba histolytica
DPTQAENE

SEQ ID NO: 2612859 - protein, 5 aa, Entamoeba histolytica
DPTQN

SEQ ID NO: 2612860 - protein, 7 aa, Entamoeba histolytica
DPTSDSF

SEQ ID NO: 2612861 - protein, 15 aa, Entamoeba histolytica
DPTSPIESRKELYQG

SEQ ID NO: 2612862 - protein, 7 aa, Entamoeba histolytica
DPTTPPI

SEQ ID NO: 2612863 - protein, 4 aa, Entamoeba histolytica
DPTV

SEQ ID NO: 2612864 - protein, 7 aa, Entamoeba histolytica
DPVEKDK

SEQ ID NO: 2612865 - protein, 4 aa, Entamoeba histolytica
DPVF

SEQ ID NO: 2612866 - protein, 12 aa, Entamoeba histolytica
DPVNEVNESAQT

SEQ ID NO: 2612867 - protein, 7 aa, Entamoeba histolytica
DPVQPQE

SEQ ID NO: 2612868 - protein, 8 aa, Entamoeba histolytica
DPVTTEAS

SEQ ID NO: 2612869 - protein, 13 aa, Entamoeba histolytica
DPYCSQTTPVTEK

SEQ ID NO: 2612870 - protein, 16 aa, Entamoeba histolytica
DPYDDPKGFVKPKAPE

SEQ ID NO: 2612871 - protein, 6 aa, Entamoeba histolytica
DPYDES

SEQ ID NO: 2612872 - protein, 9 aa, Entamoeba histolytica
DPYDSSLPS

SEQ ID NO: 2612873 - protein, 6 aa, Entamoeba histolytica
DPYERE

SEQ ID NO: 2612874 - protein, 4 aa, Entamoeba histolytica
DPYP

SEQ ID NO: 2612875 - protein, 4 aa, Entamoeba histolytica
DPYY

SEQ ID NO: 2612876 - protein, 4 aa, Entamoeba histolytica
DQAE

SEQ ID NO: 2612877 - protein, 18 aa, Entamoeba histolytica
DQAITKNPTQPQGNIPNS

SEQ ID NO: 2612878 - protein, 10 aa, Entamoeba histolytica
DQAKEKVYTQ

SEQ ID NO: 2612879 - protein, 23 aa, Entamoeba histolytica
DQAKNAEKMYQSPDNTETPEEAK

SEQ ID NO: 2612880 - protein, 6 aa, Entamoeba histolytica
DQCTEE

SEQ ID NO: 2612881 - protein, 14 aa, Entamoeba histolytica
DQDDEESDDSKQKT

SEQ ID NO: 2612882 - protein, 15 aa, Entamoeba histolytica
DQDGFKISSDDEQSL

SEQ ID NO: 2612883 - protein, 12 aa, Entamoeba histolytica
DQDKLKEIENEL

SEQ ID NO: 2612884 - protein, 11 aa, Entamoeba histolytica
DQDPGKDDKIG

SEQ ID NO: 2612885 - protein, 6 aa, Entamoeba histolytica
DQDPSV

SEQ ID NO: 2612886 - protein, 10 aa, Entamoeba histolytica
DQDQSKRPRF

SEQ ID NO: 2612887 - protein, 9 aa, Entamoeba histolytica
DQDSDENTN

SEQ ID NO: 2612888 - protein, 7 aa, Entamoeba histolytica
DQDSPLY

SEQ ID NO: 2612889 - protein, 4 aa, Entamoeba histolytica
DQDV

SEQ ID NO: 2612890 - protein, 16 aa, Entamoeba histolytica
DQEEKKVKQGTSKGGY

SEQ ID NO: 2612891 - protein, 9 aa, Entamoeba histolytica
DQEFKSEAD

SEQ ID NO: 2612892 - protein, 4 aa, Entamoeba histolytica
DQEG

SEQ ID NO: 2612893 - protein, 8 aa, Entamoeba histolytica
DQEGDYNS

SEQ ID NO: 2612894 - protein, 15 aa, Entamoeba histolytica
DQEGFKISSDDEQSL

SEQ ID NO: 2612895 - protein, 8 aa, Entamoeba histolytica
DQEGNTPF

SEQ ID NO: 2612896 - protein, 6 aa, Entamoeba histolytica
DQEKNF

SEQ ID NO: 2612897 - protein, 7 aa, Entamoeba histolytica
DQELTDE

SEQ ID NO: 2612898 - protein, 9 aa, Entamoeba histolytica
DQEQDNKYS

SEQ ID NO: 2612899 - protein, 8 aa, Entamoeba histolytica
DQERKSNE

SEQ ID NO: 2612900 - protein, 7 aa, Entamoeba histolytica
DQETGDE

SEQ ID NO: 2612901 - protein, 8 aa, Entamoeba histolytica
DQETSTDI

SEQ ID NO: 2612902 - protein, 19 aa, Entamoeba histolytica
DQFDRSGKLAKKNPPFLRS

SEQ ID NO: 2612903 - protein, 16 aa, Entamoeba histolytica
DQFGNKKNRKEHRGFR

SEQ ID NO: 2612904 - protein, 21 aa, Entamoeba histolytica
DQFNENKNQINCDESPPQKRY

SEQ ID NO: 2612905 - protein, 13 aa, Entamoeba histolytica
DQFPNQRITQTPG

SEQ ID NO: 2612906 - protein, 25 aa, Entamoeba histolytica
DQFQSAKDYIDQSNSQEEEAKNVTT

SEQ ID NO: 2612907 - protein, 6 aa, Entamoeba histolytica
DQGAKY

SEQ ID NO: 2612908 - protein, 8 aa, Entamoeba histolytica
DQGEGEKL

SEQ ID NO: 2612909 - protein, 5 aa, Entamoeba histolytica
DQGHN

SEQ ID NO: 2612910 - protein, 5 aa, Entamoeba histolytica
DQGHS

SEQ ID NO: 2612911 - protein, 9 aa, Entamoeba histolytica
DQGKDAEKF

SEQ ID NO: 2612912 - protein, 10 aa, Entamoeba histolytica
DQGKIGAPEL

SEQ ID NO: 2612913 - protein, 7 aa, Entamoeba histolytica
DQGNNAH

SEQ ID NO: 2612914 - protein, 10 aa, Entamoeba histolytica
DQHKEFANDD

SEQ ID NO: 2612915 - protein, 12 aa, Entamoeba histolytica
DQHQPGPLQNSL

SEQ ID NO: 2612916 - protein, 7 aa, Entamoeba histolytica
DQHSEQN

SEQ ID NO: 2612917 - protein, 6 aa, Entamoeba histolytica
DQIDEE

SEQ ID NO: 2612918 - protein, 5 aa, Entamoeba histolytica
DQIED

SEQ ID NO: 2612919 - protein, 6 aa, Entamoeba histolytica
DQIEGK

SEQ ID NO: 2612920 - protein, 10 aa, Entamoeba histolytica
DQIKDVSNAC

SEQ ID NO: 2612921 - protein, 5 aa, Entamoeba histolytica
DQIKE

SEQ ID NO: 2612922 - protein, 8 aa, Entamoeba histolytica
DQINQKEM

SEQ ID NO: 2612923 - protein, 5 aa, Entamoeba histolytica
DQIPP

SEQ ID NO: 2612924 - protein, 4 aa, Entamoeba histolytica
DQIQ

SEQ ID NO: 2612925 - protein, 7 aa, Entamoeba histolytica
DQIQGEN

SEQ ID NO: 2612926 - protein, 6 aa, Entamoeba histolytica
DQIQQM

SEQ ID NO: 2612927 - protein, 6 aa, Entamoeba histolytica
DQITEL

SEQ ID NO: 2612928 - protein, 11 aa, Entamoeba histolytica
DQIVEKQKGFD

SEQ ID NO: 2612929 - protein, 4 aa, Entamoeba histolytica
DQKC

SEQ ID NO: 2612930 - protein, 10 aa, Entamoeba histolytica
DQKEGRERNV

SEQ ID NO: 2612931 - protein, 5 aa, Entamoeba histolytica
DQKEI

SEQ ID NO: 2612932 - protein, 9 aa, Entamoeba histolytica
DQKEIDKSN

SEQ ID NO: 2612933 - protein, 7 aa, Entamoeba histolytica
DQKEKRR

SEQ ID NO: 2612934 - protein, 5 aa, Entamoeba histolytica
DQKEV

SEQ ID NO: 2612935 - protein, 21 aa, Entamoeba histolytica
DQKGASPTIKEYSSSDSMDEE

SEQ ID NO: 2612936 - protein, 5 aa, Entamoeba histolytica
DQKGF

SEQ ID NO: 2612937 - protein, 5 aa, Entamoeba histolytica
DQKID

SEQ ID NO: 2612938 - protein, 5 aa, Entamoeba histolytica
DQKIQ

SEQ ID NO: 2612939 - protein, 9 aa, Entamoeba histolytica
DQKMGSLQK

SEQ ID NO: 2612940 - protein, 33 aa, Entamoeba histolytica
DQKNEENKIKQPNKKEDNEKNEKKKLSVDPKRI

SEQ ID NO: 2612941 - protein, 7 aa, Entamoeba histolytica
DQKNEQE

SEQ ID NO: 2612942 - protein, 8 aa, Entamoeba histolytica
DQKNRSNF

SEQ ID NO: 2612943 - protein, 13 aa, Entamoeba histolytica
DQKPPIIGESPED

SEQ ID NO: 2612944 - protein, 7 aa, Entamoeba histolytica
DQKQHQP

SEQ ID NO: 2612945 - protein, 9 aa, Entamoeba histolytica
DQKQKCEEI

SEQ ID NO: 2612946 - protein, 7 aa, Entamoeba histolytica
DQKRNFK

SEQ ID NO: 2612947 - protein, 9 aa, Entamoeba histolytica
DQKTSQKDV

SEQ ID NO: 2612948 - protein, 7 aa, Entamoeba histolytica
DQKVKEQ

SEQ ID NO: 2612949 - protein, 4 aa, Entamoeba histolytica
DQLE

SEQ ID NO: 2612950 - protein, 20 aa, Entamoeba histolytica
DQLEADSAARQEEMKRQMEE

SEQ ID NO: 2612951 - protein, 10 aa, Entamoeba histolytica
DQLKVQQKHN

SEQ ID NO: 2612952 - protein, 22 aa, Entamoeba histolytica
DQLNNEDISPAAVAWRKKIIAA

SEQ ID NO: 2612953 - protein, 9 aa, Entamoeba histolytica
DQLNTSKAK

SEQ ID NO: 2612954 - protein, 6 aa, Entamoeba histolytica
DQLPEE

SEQ ID NO: 2612955 - protein, 6 aa, Entamoeba histolytica
DQLQQT

SEQ ID NO: 2612956 - protein, 6 aa, Entamoeba histolytica
DQLYEK

SEQ ID NO: 2612957 - protein, 8 aa, Entamoeba histolytica
DQMENDEV

SEQ ID NO: 2612958 - protein, 4 aa, Entamoeba histolytica
DQMI

SEQ ID NO: 2612959 - protein, 21 aa, Entamoeba histolytica
DQMNNSKGENHVQAKQKYERS

SEQ ID NO: 2612960 - protein, 9 aa, Entamoeba histolytica
DQMPPGYNQ

SEQ ID NO: 2612961 - protein, 7 aa, Entamoeba histolytica
DQNDLKR

SEQ ID NO: 2612962 - protein, 11 aa, Entamoeba histolytica
DQNDNNNVNDT

SEQ ID NO: 2612963 - protein, 10 aa, Entamoeba histolytica
DQNEIKEDQE

SEQ ID NO: 2612964 - protein, 6 aa, Entamoeba histolytica
DQNETL

SEQ ID NO: 2612965 - protein, 7 aa, Entamoeba histolytica
DQNGIKP

SEQ ID NO: 2612966 - protein, 5 aa, Entamoeba histolytica
DQNGQ

SEQ ID NO: 2612967 - protein, 8 aa, Entamoeba histolytica
DQNKRPNI

SEQ ID NO: 2612968 - protein, 5 aa, Entamoeba histolytica
DQNND

SEQ ID NO: 2612969 - protein, 6 aa, Entamoeba histolytica
DQNRAT

SEQ ID NO: 2612970 - protein, 6 aa, Entamoeba histolytica
DQNSFE

SEQ ID NO: 2612971 - protein, 8 aa, Entamoeba histolytica
DQNSSDTL

SEQ ID NO: 2612972 - protein, 12 aa, Entamoeba histolytica
DQPADTTTLPGK

SEQ ID NO: 2612973 - protein, 11 aa, Entamoeba histolytica
DQPERKSDQTV

SEQ ID NO: 2612974 - protein, 6 aa, Entamoeba histolytica
DQPEVS

SEQ ID NO: 2612975 - protein, 7 aa, Entamoeba histolytica
DQPISKQ

SEQ ID NO: 2612976 - protein, 14 aa, Entamoeba histolytica
DQPKQPSKTSQTFD

SEQ ID NO: 2612977 - protein, 4 aa, Entamoeba histolytica
DQPL

SEQ ID NO: 2612978 - protein, 8 aa, Entamoeba histolytica
DQPPQVNV

SEQ ID NO: 2612979 - protein, 26 aa, Entamoeba histolytica
DQPQQYDDTFTTTQNDDTLPNVTHST

SEQ ID NO: 2612980 - protein, 12 aa, Entamoeba histolytica
DQPSVRETKDGQ

SEQ ID NO: 2612981 - protein, 6 aa, Entamoeba histolytica
DQPTMS

SEQ ID NO: 2612982 - protein, 5 aa, Entamoeba histolytica
DQQEF

SEQ ID NO: 2612983 - protein, 5 aa, Entamoeba histolytica
DQQEN

SEQ ID NO: 2612984 - protein, 6 aa, Entamoeba histolytica
DQQFED

SEQ ID NO: 2612985 - protein, 5 aa, Entamoeba histolytica
DQQKN

SEQ ID NO: 2612986 - protein, 6 aa, Entamoeba histolytica
DQQNAR

SEQ ID NO: 2612987 - protein, 7 aa, Entamoeba histolytica
DQQNRNK

SEQ ID NO: 2612988 - protein, 7 aa, Entamoeba histolytica
DQQNRTE

SEQ ID NO: 2612989 - protein, 5 aa, Entamoeba histolytica
DQQPF

SEQ ID NO: 2612990 - protein, 10 aa, Entamoeba histolytica
DQQQTELSSL

SEQ ID NO: 2612991 - protein, 12 aa, Entamoeba histolytica
DQQTGQPSQETM

SEQ ID NO: 2612992 - protein, 6 aa, Entamoeba histolytica
DQQTKA

SEQ ID NO: 2612993 - protein, 6 aa, Entamoeba histolytica
DQRSPG

SEQ ID NO: 2612994 - protein, 6 aa, Entamoeba histolytica
DQRYVP

SEQ ID NO: 2612995 - protein, 10 aa, Entamoeba histolytica
DQSDRNRTSP

SEQ ID NO: 2612996 - protein, 10 aa, Entamoeba histolytica
DQSDSTVIKS

SEQ ID NO: 2612997 - protein, 13 aa, Entamoeba histolytica
DQSEHEPRYENDT

SEQ ID NO: 2612998 - protein, 11 aa, Entamoeba histolytica
DQSGKSSATQR

SEQ ID NO: 2612999 - protein, 8 aa, Entamoeba histolytica
DQSGLEKD

SEQ ID NO: 2613000 - protein, 6 aa, Entamoeba histolytica
DQSGTI

SEQ ID NO: 2613001 - protein, 9 aa, Entamoeba histolytica
DQSLDSNER

SEQ ID NO: 2613002 - protein, 7 aa, Entamoeba histolytica
DQSNDSI

SEQ ID NO: 2613003 - protein, 8 aa, Entamoeba histolytica
DQSNTSFY

SEQ ID NO: 2613004 - protein, 13 aa, Entamoeba histolytica
DQSPADPNEFTEE

SEQ ID NO: 2613005 - protein, 11 aa, Entamoeba histolytica
DQSPNKTPLPL

SEQ ID NO: 2613006 - protein, 6 aa, Entamoeba histolytica
DQSQIN

SEQ ID NO: 2613007 - protein, 6 aa, Entamoeba histolytica
DQSSLD

SEQ ID NO: 2613008 - protein, 8 aa, Entamoeba histolytica
DQSVHENL

SEQ ID NO: 2613009 - protein, 7 aa, Entamoeba histolytica
DQSVKGY

SEQ ID NO: 2613010 - protein, 27 aa, Entamoeba histolytica
DQTASEEIEMDNEESESDSTTSISNDS

SEQ ID NO: 2613011 - protein, 5 aa, Entamoeba histolytica
DQTEL

SEQ ID NO: 2613012 - protein, 6 aa, Entamoeba histolytica
DQTENV

SEQ ID NO: 2613013 - protein, 4 aa, Entamoeba histolytica
DQTI

SEQ ID NO: 2613014 - protein, 11 aa, Entamoeba histolytica
DQTIDKPVRER

SEQ ID NO: 2613015 - protein, 6 aa, Entamoeba histolytica
DQTISQ

SEQ ID NO: 2613016 - protein, 8 aa, Entamoeba histolytica
DQTKQSGE

SEQ ID NO: 2613017 - protein, 6 aa, Entamoeba histolytica
DQTKTY

SEQ ID NO: 2613018 - protein, 4 aa, Entamoeba histolytica
DQTN

SEQ ID NO: 2613019 - protein, 5 aa, Entamoeba histolytica
DQTNQ

SEQ ID NO: 2613020 - protein, 8 aa, Entamoeba histolytica
DQTPNTII

SEQ ID NO: 2613021 - protein, 44 aa, Entamoeba histolytica
DQTQKEEKEIDKHEINEEKDSSKTIEKQKEIKEQVKEQQVPFTD

SEQ ID NO: 2613022 - protein, 21 aa, Entamoeba histolytica
DQTQKKSQEILSSIEQDGIYF

SEQ ID NO: 2613023 - protein, 6 aa, Entamoeba histolytica
DQTQQK

SEQ ID NO: 2613024 - protein, 10 aa, Entamoeba histolytica
DQTQTEDEIK

SEQ ID NO: 2613025 - protein, 57 aa, Entamoeba histolytica
DQTSYNEQLNQETFSHDNQQCEPPPLPPKPKRLQKEEHPIQESTNVNSLQEKETQES

SEQ ID NO: 2613026 - protein, 4 aa, Entamoeba histolytica
DQTT

SEQ ID NO: 2613027 - protein, 7 aa, Entamoeba histolytica
DQTTDIL

SEQ ID NO: 2613028 - protein, 5 aa, Entamoeba histolytica
DQTTN

SEQ ID NO: 2613029 - protein, 22 aa, Entamoeba histolytica
DQTVYSPNKNDDIREAAGLTAD

SEQ ID NO: 2613030 - protein, 5 aa, Entamoeba histolytica
DQTYN

SEQ ID NO: 2613031 - protein, 11 aa, Entamoeba histolytica
DQVAASSSFSK

SEQ ID NO: 2613032 - protein, 24 aa, Entamoeba histolytica
DQVEKKENDNNSSNNNENDSSTEL

SEQ ID NO: 2613033 - protein, 12 aa, Entamoeba histolytica
DQVEKKRKAISK

SEQ ID NO: 2613034 - protein, 7 aa, Entamoeba histolytica
DQVPSNW

SEQ ID NO: 2613035 - protein, 4 aa, Entamoeba histolytica
DQVV

SEQ ID NO: 2613036 - protein, 7 aa, Entamoeba histolytica
DQYEDDD

SEQ ID NO: 2613037 - protein, 4 aa, Entamoeba histolytica
DQYG

SEQ ID NO: 2613038 - protein, 9 aa, Entamoeba histolytica
DQYGEEIPR

SEQ ID NO: 2613039 - protein, 5 aa, Entamoeba histolytica
DQYGN

SEQ ID NO: 2613040 - protein, 7 aa, Entamoeba histolytica
DQYNNQG

SEQ ID NO: 2613041 - protein, 6 aa, Entamoeba histolytica
DRASFD

SEQ ID NO: 2613042 - protein, 17 aa, Entamoeba histolytica
DRDCSNIRDDDPCIGSP

SEQ ID NO: 2613043 - protein, 5 aa, Entamoeba histolytica
DRDEA

SEQ ID NO: 2613044 - protein, 6 aa, Entamoeba histolytica
DRDEMQ

SEQ ID NO: 2613045 - protein, 6 aa, Entamoeba histolytica
DRDGIH

SEQ ID NO: 2613046 - protein, 12 aa, Entamoeba histolytica
DRDPIKRQNKKM

SEQ ID NO: 2613047 - protein, 7 aa, Entamoeba histolytica
DRDRNNR

SEQ ID NO: 2613048 - protein, 10 aa, Entamoeba histolytica
DRDTNKSKGY

SEQ ID NO: 2613049 - protein, 16 aa, Entamoeba histolytica
DRDVSEKEGKDKAAEL

SEQ ID NO: 2613050 - protein, 7 aa, Entamoeba histolytica
DRDYNGN

SEQ ID NO: 2613051 - protein, 18 aa, Entamoeba histolytica
DREAYLAKKAESRKSYKD

SEQ ID NO: 2613052 - protein, 8 aa, Entamoeba histolytica
DREHVNEA

SEQ ID NO: 2613053 - protein, 28 aa, Entamoeba histolytica
DREKEIKEKERKSIEKVKGEIENEAKQI

SEQ ID NO: 2613054 - protein, 22 aa, Entamoeba histolytica
DREKMKKSKKNSRIETEDEQRR

SEQ ID NO: 2613055 - protein, 9 aa, Entamoeba histolytica
DREKNKDQY

SEQ ID NO: 2613056 - protein, 17 aa, Entamoeba histolytica
DRELDGSAKTMLNDESR

SEQ ID NO: 2613057 - protein, 8 aa, Entamoeba histolytica
DRENFEKA

SEQ ID NO: 2613058 - protein, 5 aa, Entamoeba histolytica
DREPI

SEQ ID NO: 2613059 - protein, 7 aa, Entamoeba histolytica
DRETAQS

SEQ ID NO: 2613060 - protein, 6 aa, Entamoeba histolytica
DRETEE

SEQ ID NO: 2613061 - protein, 9 aa, Entamoeba histolytica
DRETQQNIF

SEQ ID NO: 2613062 - protein, 8 aa, Entamoeba histolytica
DREVPPPV

SEQ ID NO: 2613063 - protein, 6 aa, Entamoeba histolytica
DRFAGG

SEQ ID NO: 2613064 - protein, 4 aa, Entamoeba histolytica
DRFE

SEQ ID NO: 2613065 - protein, 6 aa, Entamoeba histolytica
DRFPEE

SEQ ID NO: 2613066 - protein, 5 aa, Entamoeba histolytica
DRGDY

SEQ ID NO: 2613067 - protein, 6 aa, Entamoeba histolytica
DRGDYS

SEQ ID NO: 2613068 - protein, 5 aa, Entamoeba histolytica
DRGEY

SEQ ID NO: 2613069 - protein, 7 aa, Entamoeba histolytica
DRGKNGV

SEQ ID NO: 2613070 - protein, 7 aa, Entamoeba histolytica
DRGKNSI

SEQ ID NO: 2613071 - protein, 7 aa, Entamoeba histolytica
DRGKNSV

SEQ ID NO: 2613072 - protein, 5 aa, Entamoeba histolytica
DRGKY

SEQ ID NO: 2613073 - protein, 4 aa, Entamoeba histolytica
DRGN

SEQ ID NO: 2613074 - protein, 11 aa, Entamoeba histolytica
DRGRLGDRDLS

SEQ ID NO: 2613075 - protein, 6 aa, Entamoeba histolytica
DRGSRG

SEQ ID NO: 2613076 - protein, 5 aa, Entamoeba histolytica
DRGTH

SEQ ID NO: 2613077 - protein, 5 aa, Entamoeba histolytica
DRGTM

SEQ ID NO: 2613078 - protein, 8 aa, Entamoeba histolytica
DRGYTQDD

SEQ ID NO: 2613079 - protein, 9 aa, Entamoeba histolytica
DRHKTKKNG

SEQ ID NO: 2613080 - protein, 5 aa, Entamoeba histolytica
DRHND

SEQ ID NO: 2613081 - protein, 5 aa, Entamoeba histolytica
DRHNG

SEQ ID NO: 2613082 - protein, 9 aa, Entamoeba histolytica
DRHNGKYDV

SEQ ID NO: 2613083 - protein, 5 aa, Entamoeba histolytica
DRHPQ

SEQ ID NO: 2613084 - protein, 5 aa, Entamoeba histolytica
DRHPS

SEQ ID NO: 2613085 - protein, 17 aa, Entamoeba histolytica
DRIEEGTKIPESGRFDE

SEQ ID NO: 2613086 - protein, 5 aa, Entamoeba histolytica
DRIEK

SEQ ID NO: 2613087 - protein, 11 aa, Entamoeba histolytica
DRIKRGRIDNN

SEQ ID NO: 2613088 - protein, 18 aa, Entamoeba histolytica
DRINNELAKKEVKTTKDI

SEQ ID NO: 2613089 - protein, 5 aa, Entamoeba histolytica
DRIRT

SEQ ID NO: 2613090 - protein, 11 aa, Entamoeba histolytica
DRISSERERDH

SEQ ID NO: 2613091 - protein, 4 aa, Entamoeba histolytica
DRIT

SEQ ID NO: 2613092 - protein, 11 aa, Entamoeba histolytica
DRITDDETSVT

SEQ ID NO: 2613093 - protein, 20 aa, Entamoeba histolytica
DRKDNIPESTISRRVQERRR

SEQ ID NO: 2613094 - protein, 16 aa, Entamoeba histolytica
DRKDTQIKEQPLNTEV

SEQ ID NO: 2613095 - protein, 7 aa, Entamoeba histolytica
DRKEMNA

SEQ ID NO: 2613096 - protein, 10 aa, Entamoeba histolytica
DRKETSPIGL

SEQ ID NO: 2613097 - protein, 10 aa, Entamoeba histolytica
DRKIEKTNRP

SEQ ID NO: 2613098 - protein, 9 aa, Entamoeba histolytica
DRKKERKKV

SEQ ID NO: 2613099 - protein, 6 aa, Entamoeba histolytica
DRKKSQ

SEQ ID NO: 2613100 - protein, 4 aa, Entamoeba histolytica
DRKQ

SEQ ID NO: 2613101 - protein, 9 aa, Entamoeba histolytica
DRKSKKSLG

SEQ ID NO: 2613102 - protein, 6 aa, Entamoeba histolytica
DRKSLR

SEQ ID NO: 2613103 - protein, 5 aa, Entamoeba histolytica
DRKSY

SEQ ID NO: 2613104 - protein, 21 aa, Entamoeba histolytica
DRKTGELKTKIQQKTENKGIK

SEQ ID NO: 2613105 - protein, 9 aa, Entamoeba histolytica
DRLEEDLSN

SEQ ID NO: 2613106 - protein, 9 aa, Entamoeba histolytica
DRLKDGGYG

SEQ ID NO: 2613107 - protein, 8 aa, Entamoeba histolytica
DRLSQSTS

SEQ ID NO: 2613108 - protein, 6 aa, Entamoeba histolytica
DRMRDD

SEQ ID NO: 2613109 - protein, 7 aa, Entamoeba histolytica
DRNASNR

SEQ ID NO: 2613110 - protein, 7 aa, Entamoeba histolytica
DRNDEDL

SEQ ID NO: 2613111 - protein, 7 aa, Entamoeba histolytica
DRNDFSS

SEQ ID NO: 2613112 - protein, 10 aa, Entamoeba histolytica
DRNEKFPDKR

SEQ ID NO: 2613113 - protein, 5 aa, Entamoeba histolytica
DRNEL

SEQ ID NO: 2613114 - protein, 6 aa, Entamoeba histolytica
DRNERF

SEQ ID NO: 2613115 - protein, 12 aa, Entamoeba histolytica
DRNESQIKRRPK

SEQ ID NO: 2613116 - protein, 15 aa, Entamoeba histolytica
DRNINNQQEASEKFK

SEQ ID NO: 2613117 - protein, 6 aa, Entamoeba histolytica
DRNISH

SEQ ID NO: 2613118 - protein, 5 aa, Entamoeba histolytica
DRNNH

SEQ ID NO: 2613119 - protein, 8 aa, Entamoeba histolytica
DRNNPIKE

SEQ ID NO: 2613120 - protein, 6 aa, Entamoeba histolytica
DRNPQK

SEQ ID NO: 2613121 - protein, 5 aa, Entamoeba histolytica
DRNQS

SEQ ID NO: 2613122 - protein, 8 aa, Entamoeba histolytica
DRNSERQV

SEQ ID NO: 2613123 - protein, 7 aa, Entamoeba histolytica
DRNSFES

SEQ ID NO: 2613124 - protein, 6 aa, Entamoeba histolytica
DRNTFE

SEQ ID NO: 2613125 - protein, 4 aa, Entamoeba histolytica
DRPA

SEQ ID NO: 2613126 - protein, 7 aa, Entamoeba histolytica
DRPAGKG

SEQ ID NO: 2613127 - protein, 5 aa, Entamoeba histolytica
DRPDE

SEQ ID NO: 2613128 - protein, 4 aa, Entamoeba histolytica
DRPE

SEQ ID NO: 2613129 - protein, 12 aa, Entamoeba histolytica
DRPEDAAKALRE

SEQ ID NO: 2613130 - protein, 5 aa, Entamoeba histolytica
DRPES

SEQ ID NO: 2613131 - protein, 34 aa, Entamoeba histolytica
DRPPIERDPRLNTDIHDRSERIDRSDRSGAEKKR

SEQ ID NO: 2613132 - protein, 5 aa, Entamoeba histolytica
DRPTE

SEQ ID NO: 2613133 - protein, 6 aa, Entamoeba histolytica
DRPTFQ

SEQ ID NO: 2613134 - protein, 8 aa, Entamoeba histolytica
DRQKTANK

SEQ ID NO: 2613135 - protein, 5 aa, Entamoeba histolytica
DRQLQ

SEQ ID NO: 2613136 - protein, 9 aa, Entamoeba histolytica
DRQNDLNEL

SEQ ID NO: 2613137 - protein, 7 aa, Entamoeba histolytica
DRQTLKK

SEQ ID NO: 2613138 - protein, 11 aa, Entamoeba histolytica
DRREYSPRDRI

SEQ ID NO: 2613139 - protein, 5 aa, Entamoeba histolytica
DRRIE

SEQ ID NO: 2613140 - protein, 14 aa, Entamoeba histolytica
DRRNLQKDEINERH

SEQ ID NO: 2613141 - protein, 45 aa, Entamoeba histolytica
DRRPPPTPIARSSPRTAAPTTPAVATAPVPAAPADIPPPPPPTAP

SEQ ID NO: 2613142 - protein, 6 aa, Entamoeba histolytica
DRRQQY

SEQ ID NO: 2613143 - protein, 9 aa, Entamoeba histolytica
DRRRYGNNI

SEQ ID NO: 2613144 - protein, 15 aa, Entamoeba histolytica
DRRTITKSEKATLNK

SEQ ID NO: 2613145 - protein, 7 aa, Entamoeba histolytica
DRRTQPL

SEQ ID NO: 2613146 - protein, 7 aa, Entamoeba histolytica
DRRYKNR

SEQ ID NO: 2613147 - protein, 17 aa, Entamoeba histolytica
DRSCGNDTSNITNIDGL

SEQ ID NO: 2613148 - protein, 8 aa, Entamoeba histolytica
DRSDEVKR

SEQ ID NO: 2613149 - protein, 5 aa, Entamoeba histolytica
DRSKR

SEQ ID NO: 2613150 - protein, 21 aa, Entamoeba histolytica
DRSNKTKTATPSVSPDNTLRE

SEQ ID NO: 2613151 - protein, 8 aa, Entamoeba histolytica
DRSRVEAQ

SEQ ID NO: 2613152 - protein, 16 aa, Entamoeba histolytica
DRTDSKYQIPKERGDQ

SEQ ID NO: 2613153 - protein, 7 aa, Entamoeba histolytica
DRTDSNS

SEQ ID NO: 2613154 - protein, 6 aa, Entamoeba histolytica
DRTEEE

SEQ ID NO: 2613155 - protein, 8 aa, Entamoeba histolytica
DRTENDPP

SEQ ID NO: 2613156 - protein, 10 aa, Entamoeba histolytica
DRTEPLGEQE

SEQ ID NO: 2613157 - protein, 7 aa, Entamoeba histolytica
DRTGAGT

SEQ ID NO: 2613158 - protein, 8 aa, Entamoeba histolytica
DRTGESKA

SEQ ID NO: 2613159 - protein, 6 aa, Entamoeba histolytica
DRTGKY

SEQ ID NO: 2613160 - protein, 5 aa, Entamoeba histolytica
DRTLQ

SEQ ID NO: 2613161 - protein, 4 aa, Entamoeba histolytica
DRTN

SEQ ID NO: 2613162 - protein, 7 aa, Entamoeba histolytica
DRTNDGF

SEQ ID NO: 2613163 - protein, 9 aa, Entamoeba histolytica
DRTNNSPIK

SEQ ID NO: 2613164 - protein, 5 aa, Entamoeba histolytica
DRTPQ

SEQ ID NO: 2613165 - protein, 6 aa, Entamoeba histolytica
DRTQRI

SEQ ID NO: 2613166 - protein, 5 aa, Entamoeba histolytica
DRTTY

SEQ ID NO: 2613167 - protein, 14 aa, Entamoeba histolytica
DRVEIESKSGKKTM

SEQ ID NO: 2613168 - protein, 9 aa, Entamoeba histolytica
DRVERDDED

SEQ ID NO: 2613169 - protein, 10 aa, Entamoeba histolytica
DRVGAKKCSS

SEQ ID NO: 2613170 - protein, 11 aa, Entamoeba histolytica
DRVPSDLSSMT

SEQ ID NO: 2613171 - protein, 7 aa, Entamoeba histolytica
DRVPVGG

SEQ ID NO: 2613172 - protein, 24 aa, Entamoeba histolytica
DRVSSHSYSAYNSNQNSKEESYLT

SEQ ID NO: 2613173 - protein, 5 aa, Entamoeba histolytica
DRYEQ

SEQ ID NO: 2613174 - protein, 8 aa, Entamoeba histolytica
DRYNSRRI

SEQ ID NO: 2613175 - protein, 28 aa, Entamoeba histolytica
DRYRNDLKRADSNLALSQKKLKAQPTEL

SEQ ID NO: 2613176 - protein, 5 aa, Entamoeba histolytica
DSADS

SEQ ID NO: 2613177 - protein, 11 aa, Entamoeba histolytica
DSAEKDQEDKV

SEQ ID NO: 2613178 - protein, 13 aa, Entamoeba histolytica
DSAENKTNSVDSI

SEQ ID NO: 2613179 - protein, 4 aa, Entamoeba histolytica
DSAI

SEQ ID NO: 2613180 - protein, 10 aa, Entamoeba histolytica
DSAKPGDRIE

SEQ ID NO: 2613181 - protein, 12 aa, Entamoeba histolytica
DSAKVDEKAMRQ

SEQ ID NO: 2613182 - protein, 31 aa, Entamoeba histolytica; identical to SEQ ID NO: 2417646

SEQ ID NO: 2613183 - protein, 15 aa, Entamoeba histolytica
DSAMPKLTQELLSEL

SEQ ID NO: 2613184 - protein, 8 aa, Entamoeba histolytica
DSANDQTI

SEQ ID NO: 2613185 - protein, 7 aa, Entamoeba histolytica
DSAPIKK

SEQ ID NO: 2613186 - protein, 10 aa, Entamoeba histolytica
DSAPSTPRVE

SEQ ID NO: 2613187 - protein, 8 aa, Entamoeba histolytica
DSCGGDDY

SEQ ID NO: 2613188 - protein, 9 aa, Entamoeba histolytica
DSCKARKKI

SEQ ID NO: 2613189 - protein, 4 aa, Entamoeba histolytica
DSCP

SEQ ID NO: 2613190 - protein, 9 aa, Entamoeba histolytica
DSCSEDGAD

SEQ ID NO: 2613191 - protein, 5 aa, Entamoeba histolytica
DSCSV

SEQ ID NO: 2613192 - protein, 9 aa, Entamoeba histolytica
DSCVSSKQP

SEQ ID NO: 2613193 - protein, 6 aa, Entamoeba histolytica
DSDALD

SEQ ID NO: 2613194 - protein, 15 aa, Entamoeba histolytica
DSDALTAKNQQLEKR

SEQ ID NO: 2613195 - protein, 12 aa, Entamoeba histolytica
DSDASSAKKSSI

SEQ ID NO: 2613196 - protein, 9 aa, Entamoeba histolytica
DSDDKTSAT

SEQ ID NO: 2613197 - protein, 4 aa, Entamoeba histolytica
DSDE

SEQ ID NO: 2613198 - protein, 8 aa, Entamoeba histolytica
DSDELPVE

SEQ ID NO: 2613199 - protein, 9 aa, Entamoeba histolytica
DSDELYDSQ

SEQ ID NO: 2613200 - protein, 15 aa, Entamoeba histolytica
DSDETEENEQPRENV

SEQ ID NO: 2613201 - protein, 19 aa, Entamoeba histolytica
DSDFEYSTQSYTGYEPTSM

SEQ ID NO: 2613202 - protein, 4 aa, Entamoeba histolytica
DSDG

SEQ ID NO: 2613203 - protein, 8 aa, Entamoeba histolytica
DSDGDNEL

SEQ ID NO: 2613204 - protein, 14 aa, Entamoeba histolytica
DSDGNASLSAEEIT

SEQ ID NO: 2613205 - protein, 9 aa, Entamoeba histolytica
DSDGQESPI

SEQ ID NO: 2613206 - protein, 5 aa, Entamoeba histolytica
DSDID

SEQ ID NO: 2613207 - protein, 7 aa, Entamoeba histolytica
DSDISPF

SEQ ID NO: 2613208 - protein, 7 aa, Entamoeba histolytica
DSDNDIQ

SEQ ID NO: 2613209 - protein, 10 aa, Entamoeba histolytica
DSDNEKLKTK

SEQ ID NO: 2613210 - protein, 8 aa, Entamoeba histolytica
DSDPVRQA

SEQ ID NO: 2613211 - protein, 7 aa, Entamoeba histolytica
DSDSDTI

SEQ ID NO: 2613212 - protein, 7 aa, Entamoeba histolytica
DSDSGYV

SEQ ID NO: 2613213 - protein, 6 aa, Entamoeba histolytica
DSDSLS

SEQ ID NO: 2613214 - protein, 10 aa, Entamoeba histolytica
DSDSNIGDES

SEQ ID NO: 2613215 - protein, 6 aa, Entamoeba histolytica
DSDTQF

SEQ ID NO: 2613216 - protein, 9 aa, Entamoeba histolytica
DSDTTADDE

SEQ ID NO: 2613217 - protein, 4 aa, Entamoeba histolytica
DSDW

SEQ ID NO: 2613218 - protein, 6 aa, Entamoeba histolytica
DSDYKR

SEQ ID NO: 2613219 - protein, 13 aa, Entamoeba histolytica
DSECTKPTGFVED

SEQ ID NO: 2613220 - protein, 7 aa, Entamoeba histolytica
DSEDDSY

SEQ ID NO: 2613221 - protein, 9 aa, Entamoeba histolytica
DSEDEDIVK

SEQ ID NO: 2613222 - protein, 10 aa, Entamoeba histolytica
DSEDGKRWSK

SEQ ID NO: 2613223 - protein, 25 aa, Entamoeba histolytica
DSEEDAAEKGKQLRSYEKVQRKMGQ

SEQ ID NO: 2613224 - protein, 25 aa, Entamoeba histolytica
DSEEEGLGYSDDEIKEEQEQDEEIN

SEQ ID NO: 2613225 - protein, 20 aa, Entamoeba histolytica
DSEEKLERIKRNKESSQGIY

SEQ ID NO: 2613226 - protein, 11 aa, Entamoeba histolytica
DSEEQEPNRSC

SEQ ID NO: 2613227 - protein, 7 aa, Entamoeba histolytica
DSEERSI

SEQ ID NO: 2613228 - protein, 5 aa, Entamoeba histolytica
DSEFN

SEQ ID NO: 2613229 - protein, 5 aa, Entamoeba histolytica
DSEGE

SEQ ID NO: 2613230 - protein, 7 aa, Entamoeba histolytica
DSEGNEE

SEQ ID NO: 2613231 - protein, 9 aa, Entamoeba histolytica
DSEGNSIDK

SEQ ID NO: 2613232 - protein, 7 aa, Entamoeba histolytica
DSEGNVL

SEQ ID NO: 2613233 - protein, 7 aa, Entamoeba histolytica
DSEGSEF

SEQ ID NO: 2613234 - protein, 6 aa, Entamoeba histolytica
DSEHPE

SEQ ID NO: 2613235 - protein, 9 aa, Entamoeba histolytica
DSEHPSETL

SEQ ID NO: 2613236 - protein, 8 aa, Entamoeba histolytica
DSEHSQVH

SEQ ID NO: 2613237 - protein, 12 aa, Entamoeba histolytica
DSEKELDKKGKC

SEQ ID NO: 2613238 - protein, 6 aa, Entamoeba histolytica
DSEKIP

SEQ ID NO: 2613239 - protein, 10 aa, Entamoeba histolytica
DSEKKKYSEI

SEQ ID NO: 2613240 - protein, 4 aa, Entamoeba histolytica
DSEL

SEQ ID NO: 2613241 - protein, 26 aa, Entamoeba histolytica
DSELENDHESESEEEEEEEEEEDADL

SEQ ID NO: 2613242 - protein, 7 aa, Entamoeba histolytica
DSENDIT

SEQ ID NO: 2613243 - protein, 14 aa, Entamoeba histolytica
DSENIGSEKSNANF

SEQ ID NO: 2613244 - protein, 12 aa, Entamoeba histolytica
DSENSIKAEKEL

SEQ ID NO: 2613245 - protein, 7 aa, Entamoeba histolytica
DSENTNT

SEQ ID NO: 2613246 - protein, 9 aa, Entamoeba histolytica
DSEQLDKNK

SEQ ID NO: 2613247 - protein, 9 aa, Entamoeba histolytica
DSEQQETKK

SEQ ID NO: 2613248 - protein, 4 aa, Entamoeba histolytica
DSER

SEQ ID NO: 2613249 - protein, 5 aa, Entamoeba histolytica
DSERL

SEQ ID NO: 2613250 - protein, 5 aa, Entamoeba histolytica
DSESL

SEQ ID NO: 2613251 - protein, 6 aa, Entamoeba histolytica
DSESNK

SEQ ID NO: 2613252 - protein, 7 aa, Entamoeba histolytica
DSESQSL

SEQ ID NO: 2613253 - protein, 6 aa, Entamoeba histolytica
DSETET

SEQ ID NO: 2613254 - protein, 5 aa, Entamoeba histolytica
DSETI

SEQ ID NO: 2613255 - protein, 6 aa, Entamoeba histolytica
DSETYG

SEQ ID NO: 2613256 - protein, 7 aa, Entamoeba histolytica
DSETYGK

SEQ ID NO: 2613257 - protein, 14 aa, Entamoeba histolytica
DSEVIDKTTPQENE

SEQ ID NO: 2613258 - protein, 29 aa, Entamoeba histolytica
DSEVIPKETKMEEENIKDVNDQHQSTKME

SEQ ID NO: 2613259 - protein, 5 aa, Entamoeba histolytica
DSEVR

SEQ ID NO: 2613260 - protein, 4 aa, Entamoeba histolytica
DSEY

SEQ ID NO: 2613261 - protein, 7 aa, Entamoeba histolytica
DSFDSTP

SEQ ID NO: 2613262 - protein, 19 aa, Entamoeba histolytica
DSFNENKEKNNSQNQVEEI

SEQ ID NO: 2613263 - protein, 8 aa, Entamoeba histolytica
DSFNNKAV

SEQ ID NO: 2613264 - protein, 6 aa, Entamoeba histolytica
DSFNRK

SEQ ID NO: 2613265 - protein, 6 aa, Entamoeba histolytica
DSFPKD

SEQ ID NO: 2613266 - protein, 16 aa, Entamoeba histolytica
DSFQEDITNQKESHYQ

SEQ ID NO: 2613267 - protein, 8 aa, Entamoeba histolytica
DSFRPSQE

SEQ ID NO: 2613268 - protein, 4 aa, Entamoeba histolytica
DSFS

SEQ ID NO: 2613269 - protein, 13 aa, Entamoeba histolytica
DSFSSRTKEQALR

SEQ ID NO: 2613270 - protein, 8 aa, Entamoeba histolytica
DSFTKEQD

SEQ ID NO: 2613271 - protein, 5 aa, Entamoeba histolytica
DSFTT

SEQ ID NO: 2613272 - protein, 6 aa, Entamoeba histolytica
DSFVGS

SEQ ID NO: 2613273 - protein, 14 aa, Entamoeba histolytica
DSGADKKARNVQHR

SEQ ID NO: 2613274 - protein, 6 aa, Entamoeba histolytica
DSGDGV

SEQ ID NO: 2613275 - protein, 7 aa, Entamoeba histolytica
DSGDIDT

SEQ ID NO: 2613276 - protein, 6 aa, Entamoeba histolytica
DSGESI

SEQ ID NO: 2613277 - protein, 6 aa, Entamoeba histolytica
DSGEVA

SEQ ID NO: 2613278 - protein, 4 aa, Entamoeba histolytica
DSGI

SEQ ID NO: 2613279 - protein, 9 aa, Entamoeba histolytica
DSGKNGSLN

SEQ ID NO: 2613280 - protein, 9 aa, Entamoeba histolytica
DSGKSTTVG

SEQ ID NO: 2613281 - protein, 10 aa, Entamoeba histolytica
DSGKTDDAKW

SEQ ID NO: 2613282 - protein, 5 aa, Entamoeba histolytica
DSGND

SEQ ID NO: 2613283 - protein, 12 aa, Entamoeba histolytica
DSGNDPKSSFKK

SEQ ID NO: 2613284 - protein, 5 aa, Entamoeba histolytica
DSGNN

SEQ ID NO: 2613285 - protein, 6 aa, Entamoeba histolytica
DSGNNR

SEQ ID NO: 2613286 - protein, 9 aa, Entamoeba histolytica
DSGNVYEGD

SEQ ID NO: 2613287 - protein, 17 aa, Entamoeba histolytica
DSGRKKSRYYDTKSGIS

SEQ ID NO: 2613288 - protein, 18 aa, Entamoeba histolytica
DSGSMAAQQIQGTESSSH

SEQ ID NO: 2613289 - protein, 7 aa, Entamoeba histolytica
DSGSTVT

SEQ ID NO: 2613290 - protein, 7 aa, Entamoeba histolytica
DSGVGKS

SEQ ID NO: 2613291 - protein, 8 aa, Entamoeba histolytica
DSGVGKSS

SEQ ID NO: 2613292 - protein, 8 aa, Entamoeba histolytica
DSGVGKTS

SEQ ID NO: 2613293 - protein, 7 aa, Entamoeba histolytica
DSHLPPK

SEQ ID NO: 2613294 - protein, 4 aa, Entamoeba histolytica
DSHS

SEQ ID NO: 2613295 - protein, 8 aa, Entamoeba histolytica
DSHSDNAC

SEQ ID NO: 2613296 - protein, 18 aa, Entamoeba histolytica
DSHSISNQVQSNNQPQIS

SEQ ID NO: 2613297 - protein, 4 aa, Entamoeba histolytica
DSIA

SEQ ID NO: 2613298 - protein, 10 aa, Entamoeba histolytica
DSIDEESSNM

SEQ ID NO: 2613299 - protein, 7 aa, Entamoeba histolytica
DSIDKTA

SEQ ID NO: 2613300 - protein, 7 aa, Entamoeba histolytica
DSIDPQN

SEQ ID NO: 2613301 - protein, 6 aa, Entamoeba histolytica
DSIDSN

SEQ ID NO: 2613302 - protein, 4 aa, Entamoeba histolytica
DSIE

SEQ ID NO: 2613303 - protein, 14 aa, Entamoeba histolytica
DSIEEEKQKNRFEQ

SEQ ID NO: 2613304 - protein, 5 aa, Entamoeba histolytica
DSIEG

SEQ ID NO: 2613305 - protein, 13 aa, Entamoeba histolytica
DSIEGMNNAEYEE

SEQ ID NO: 2613306 - protein, 6 aa, Entamoeba histolytica
DSIEKY

SEQ ID NO: 2613307 - protein, 7 aa, Entamoeba histolytica
DSIGNEN

SEQ ID NO: 2613308 - protein, 19 aa, Entamoeba histolytica
DSIGSSRMEGESGGDSEVQ

SEQ ID NO: 2613309 - protein, 7 aa, Entamoeba histolytica
DSIKAQK

SEQ ID NO: 2613310 - protein, 7 aa, Entamoeba histolytica
DSIKATK

SEQ ID NO: 2613311 - protein, 10 aa, Entamoeba histolytica
DSIKESLSQS

SEQ ID NO: 2613312 - protein, 5 aa, Entamoeba histolytica
DSIKN

SEQ ID NO: 2613313 - protein, 8 aa, Entamoeba histolytica
DSIKNNKI

SEQ ID NO: 2613314 - protein, 19 aa, Entamoeba histolytica
DSIKNSVKQIAEKGETDNV

SEQ ID NO: 2613315 - protein, 12 aa, Entamoeba histolytica
DSIKQLNKFFKI

SEQ ID NO: 2613316 - protein, 9 aa, Entamoeba histolytica
DSIKREESL

SEQ ID NO: 2613317 - protein, 5 aa, Entamoeba histolytica
DSIKW

SEQ ID NO: 2613318 - protein, 6 aa, Entamoeba histolytica
DSIPDC

SEQ ID NO: 2613319 - protein, 7 aa, Entamoeba histolytica
DSIPEPK

SEQ ID NO: 2613320 - protein, 12 aa, Entamoeba histolytica
DSIPNDPSSYIS

SEQ ID NO: 2613321 - protein, 6 aa, Entamoeba histolytica
DSIQKS

SEQ ID NO: 2613322 - protein, 7 aa, Entamoeba histolytica
DSIQQAV

SEQ ID NO: 2613323 - protein, 11 aa, Entamoeba histolytica
DSIQSVTNSKY

SEQ ID NO: 2613324 - protein, 9 aa, Entamoeba histolytica
DSISGESKK

SEQ ID NO: 2613325 - protein, 7 aa, Entamoeba histolytica
DSISSQV

SEQ ID NO: 2613326 - protein, 8 aa, Entamoeba histolytica
DSKAGKTA

SEQ ID NO: 2613327 - protein, 8 aa, Entamoeba histolytica
DSKAGKTS

SEQ ID NO: 2613328 - protein, 5 aa, Entamoeba histolytica
DSKAL

SEQ ID NO: 2613329 - protein, 10 aa, Entamoeba histolytica
DSKDSDVSMK

SEQ ID NO: 2613330 - protein, 6 aa, Entamoeba histolytica
DSKEVE

SEQ ID NO: 2613331 - protein, 10 aa, Entamoeba histolytica
DSKGKGTTLS

SEQ ID NO: 2613332 - protein, 9 aa, Entamoeba histolytica
DSKGKNEVS

SEQ ID NO: 2613333 - protein, 9 aa, Entamoeba histolytica
DSKGKRAIE

SEQ ID NO: 2613334 - protein, 16 aa, Entamoeba histolytica
DSKGSKDYEEKYGKSV

SEQ ID NO: 2613335 - protein, 7 aa, Entamoeba histolytica
DSKHPEY

SEQ ID NO: 2613336 - protein, 8 aa, Entamoeba histolytica
DSKHQQNA

SEQ ID NO: 2613337 - protein, 15 aa, Entamoeba histolytica
DSKINDKKGKSKEEM

SEQ ID NO: 2613338 - protein, 7 aa, Entamoeba histolytica
DSKIPNL

SEQ ID NO: 2613339 - protein, 23 aa, Entamoeba histolytica
DSKIPTISSPTEKPKKKRKASVG

SEQ ID NO: 2613340 - protein, 4 aa, Entamoeba histolytica
DSKK

SEQ ID NO: 2613341 - protein, 10 aa, Entamoeba histolytica
DSKKELGRGS

SEQ ID NO: 2613342 - protein, 8 aa, Entamoeba histolytica
DSKKGELA

SEQ ID NO: 2613343 - protein, 11 aa, Entamoeba histolytica
DSKKHEKRMQE

SEQ ID NO: 2613344 - protein, 7 aa, Entamoeba histolytica
DSKKIAY

SEQ ID NO: 2613345 - protein, 12 aa, Entamoeba histolytica
DSKKKKEKKKQS

SEQ ID NO: 2613346 - protein, 6 aa, Entamoeba histolytica
DSKKLG

SEQ ID NO: 2613347 - protein, 10 aa, Entamoeba histolytica
DSKKNEQQKE

SEQ ID NO: 2613348 - protein, 8 aa, Entamoeba histolytica
DSKKNFTT

SEQ ID NO: 2613349 - protein, 11 aa, Entamoeba histolytica
DSKKNGLYSED

SEQ ID NO: 2613350 - protein, 9 aa, Entamoeba histolytica
DSKKRQTGM

SEQ ID NO: 2613351 - protein, 8 aa, Entamoeba histolytica
DSKLNREI

SEQ ID NO: 2613352 - protein, 17 aa, Entamoeba histolytica
DSKLQSKYSQPPPSRAA

SEQ ID NO: 2613353 - protein, 7 aa, Entamoeba histolytica
DSKMTLK

SEQ ID NO: 2613354 - protein, 8 aa, Entamoeba histolytica
DSKNELHE

SEQ ID NO: 2613355 - protein, 9 aa, Entamoeba histolytica
DSKNGRTGE

SEQ ID NO: 2613356 - protein, 7 aa, Entamoeba histolytica
DSKNKIL

SEQ ID NO: 2613357 - protein, 10 aa, Entamoeba histolytica
DSKNVQEEKV

SEQ ID NO: 2613358 - protein, 6 aa, Entamoeba histolytica
DSKNYR

SEQ ID NO: 2613359 - protein, 11 aa, Entamoeba histolytica
DSKPDNFEGSI

SEQ ID NO: 2613360 - protein, 25 aa, Entamoeba histolytica
DSKPVESKPIEKKPVEIDPIKPKSI

SEQ ID NO: 2613361 - protein, 19 aa, Entamoeba histolytica
DSKQKENKTIKTQKTHDDS

SEQ ID NO: 2613362 - protein, 19 aa, Entamoeba histolytica
DSKREDIEGNNEDEEKEEK

SEQ ID NO: 2613363 - protein, 10 aa, Entamoeba histolytica
DSKRKKGIKV

SEQ ID NO: 2613364 - protein, 11 aa, Entamoeba histolytica
DSKSNLGPKAT

SEQ ID NO: 2613365 - protein, 4 aa, Entamoeba histolytica
DSKT

SEQ ID NO: 2613366 - protein, 8 aa, Entamoeba histolytica
DSKTDGCN

SEQ ID NO: 2613367 - protein, 8 aa, Entamoeba histolytica
DSKTGDRS

SEQ ID NO: 2613368 - protein, 6 aa, Entamoeba histolytica
DSKTKN

SEQ ID NO: 2613369 - protein, 8 aa, Entamoeba histolytica
DSKTLEFQ

SEQ ID NO: 2613370 - protein, 11 aa, Entamoeba histolytica
DSKTLSLEKDE

SEQ ID NO: 2613371 - protein, 17 aa, Entamoeba histolytica
DSKTRIERMSSSPETER

SEQ ID NO: 2613372 - protein, 7 aa, Entamoeba histolytica
DSKYPQE

SEQ ID NO: 2613373 - protein, 8 aa, Entamoeba histolytica
DSLAETDK

SEQ ID NO: 2613374 - protein, 4 aa, Entamoeba histolytica
DSLE

SEQ ID NO: 2613375 - protein, 7 aa, Entamoeba histolytica
DSLEGID

SEQ ID NO: 2613376 - protein, 7 aa, Entamoeba histolytica
DSLEQKG

SEQ ID NO: 2613377 - protein, 6 aa, Entamoeba histolytica
DSLESK

SEQ ID NO: 2613378 - protein, 6 aa, Entamoeba histolytica
DSLGQS

SEQ ID NO: 2613379 - protein, 4 aa, Entamoeba histolytica
DSLK

SEQ ID NO: 2613380 - protein, 10 aa, Entamoeba histolytica
DSLNEKSMGK

SEQ ID NO: 2613381 - protein, 7 aa, Entamoeba histolytica
DSLNGDR

SEQ ID NO: 2613382 - protein, 10 aa, Entamoeba histolytica
DSLNKNKATF

SEQ ID NO: 2613383 - protein, 9 aa, Entamoeba histolytica
DSLNSQYEQ

SEQ ID NO: 2613384 - protein, 10 aa, Entamoeba histolytica
DSLPLKSNTT

SEQ ID NO: 2613385 - protein, 6 aa, Entamoeba histolytica
DSLPNG

SEQ ID NO: 2613386 - protein, 16 aa, Entamoeba histolytica
DSLPTTGNKGGRAYRD

SEQ ID NO: 2613387 - protein, 4 aa, Entamoeba histolytica
DSLQ

SEQ ID NO: 2613388 - protein, 8 aa, Entamoeba histolytica
DSLQSPFG

SEQ ID NO: 2613389 - protein, 4 aa, Entamoeba histolytica
DSLS

SEQ ID NO: 2613390 - protein, 6 aa, Entamoeba histolytica
DSLSDQ

SEQ ID NO: 2613391 - protein, 12 aa, Entamoeba histolytica
DSLSFTWKSVTL

SEQ ID NO: 2613392 - protein, 7 aa, Entamoeba histolytica
DSLSNAL

SEQ ID NO: 2613393 - protein, 7 aa, Entamoeba histolytica
DSLSPCT

SEQ ID NO: 2613394 - protein, 9 aa, Entamoeba histolytica
DSLTKGEQI

SEQ ID NO: 2613395 - protein, 9 aa, Entamoeba histolytica
DSLTPGNER

SEQ ID NO: 2613396 - protein, 9 aa, Entamoeba histolytica
DSLTQKEEI

SEQ ID NO: 2613397 - protein, 8 aa, Entamoeba histolytica
DSLVGSQT

SEQ ID NO: 2613398 - protein, 8 aa, Entamoeba histolytica
DSMSNSPV

SEQ ID NO: 2613399 - protein, 8 aa, Entamoeba histolytica
DSMTEQQV

SEQ ID NO: 2613400 - protein, 7 aa, Entamoeba histolytica
DSNAQKD

SEQ ID NO: 2613401 - protein, 7 aa, Entamoeba histolytica
DSNARDC

SEQ ID NO: 2613402 - protein, 4 aa, Entamoeba histolytica
DSND

SEQ ID NO: 2613403 - protein, 6 aa, Entamoeba histolytica
DSNDTL

SEQ ID NO: 2613404 - protein, 9 aa, Entamoeba histolytica
DSNDTSDND

SEQ ID NO: 2613405 - protein, 4 aa, Entamoeba histolytica
DSNE

SEQ ID NO: 2613406 - protein, 5 aa, Entamoeba histolytica
DSNEL

SEQ ID NO: 2613407 - protein, 7 aa, Entamoeba histolytica
DSNETLA

SEQ ID NO: 2613408 - protein, 18 aa, Entamoeba histolytica
DSNGKITISSPLEAHKSN

SEQ ID NO: 2613409 - protein, 5 aa, Entamoeba histolytica
DSNGQ

SEQ ID NO: 2613410 - protein, 5 aa, Entamoeba histolytica
DSNHR

SEQ ID NO: 2613411 - protein, 15 aa, Entamoeba histolytica
DSNKTNKLTKQEKDE

SEQ ID NO: 2613412 - protein, 11 aa, Entamoeba histolytica
DSNKTQEVDPS

SEQ ID NO: 2613413 - protein, 8 aa, Entamoeba histolytica
DSNLEDKI

SEQ ID NO: 2613414 - protein, 6 aa, Entamoeba histolytica
DSNNDR

SEQ ID NO: 2613415 - protein, 16 aa, Entamoeba histolytica
DSNPKSKYAMKEADKS

SEQ ID NO: 2613416 - protein, 15 aa, Entamoeba histolytica
DSNPYNKTKRQGEAE

SEQ ID NO: 2613417 - protein, 13 aa, Entamoeba histolytica
DSNQISFDGPSAI

SEQ ID NO: 2613418 - protein, 7 aa, Entamoeba histolytica
DSNRANE

SEQ ID NO: 2613419 - protein, 8 aa, Entamoeba histolytica
DSNRREVT

SEQ ID NO: 2613420 - protein, 8 aa, Entamoeba histolytica
DSNSKEPE

SEQ ID NO: 2613421 - protein, 10 aa, Entamoeba histolytica
DSNSNRDLVE

SEQ ID NO: 2613422 - protein, 9 aa, Entamoeba histolytica
DSNSREKIT

SEQ ID NO: 2613423 - protein, 4 aa, Entamoeba histolytica
DSNT

SEQ ID NO: 2613424 - protein, 9 aa, Entamoeba histolytica
DSNTDSKLA

SEQ ID NO: 2613425 - protein, 9 aa, Entamoeba histolytica
DSNTEEEDL

SEQ ID NO: 2613426 - protein, 8 aa, Entamoeba histolytica
DSNTGICN

SEQ ID NO: 2613427 - protein, 7 aa, Entamoeba histolytica
DSNTHED

SEQ ID NO: 2613428 - protein, 4 aa, Entamoeba histolytica
DSNY

SEQ ID NO: 2613429 - protein, 6 aa, Entamoeba histolytica
DSNYQD

SEQ ID NO: 2613430 - protein, 6 aa, Entamoeba histolytica
DSPAEE

SEQ ID NO: 2613431 - protein, 9 aa, Entamoeba histolytica
DSPAPLTLS

SEQ ID NO: 2613432 - protein, 5 aa, Entamoeba histolytica
DSPAY

SEQ ID NO: 2613433 - protein, 16 aa, Entamoeba histolytica
DSPCLDDTDNEKESKL

SEQ ID NO: 2613434 - protein, 7 aa, Entamoeba histolytica
DSPDNAY

SEQ ID NO: 2613435 - protein, 23 aa, Entamoeba histolytica
DSPDQPPEKLDITDDERQHPRHQ

SEQ ID NO: 2613436 - protein, 8 aa, Entamoeba histolytica
DSPEGVKT

SEQ ID NO: 2613437 - protein, 7 aa, Entamoeba histolytica
DSPEPEL

SEQ ID NO: 2613438 - protein, 9 aa, Entamoeba histolytica
DSPESVKTA

SEQ ID NO: 2613439 - protein, 7 aa, Entamoeba histolytica
DSPGNIK

SEQ ID NO: 2613440 - protein, 9 aa, Entamoeba histolytica
DSPGNQEYR

SEQ ID NO: 2613441 - protein, 134 aa, Entamoeba histolytica
DSPIKHKSKRISKRSLDSSEDDSSEDEPKRRHHRRRRRYSTSDSSSEESSSSEDDRRKRKRKHKRSHSRHSKRKHHRKTKDSFSSSEEEEQRRRRKRKERKRYSRSSSRSSRTSSTSTSEERHKRRKTKKIEQM

SEQ ID NO: 2613442 - protein, 10 aa, Entamoeba histolytica
DSPKAKVCST

SEQ ID NO: 2613443 - protein, 15 aa, Entamoeba histolytica
DSPKDPILPQSNPED

SEQ ID NO: 2613444 - protein, 5 aa, Entamoeba histolytica
DSPKN

SEQ ID NO: 2613445 - protein, 6 aa, Entamoeba histolytica
DSPKSH

SEQ ID NO: 2613446 - protein, 14 aa, Entamoeba histolytica
DSPMHTHTTKEPLV

SEQ ID NO: 2613447 - protein, 6 aa, Entamoeba histolytica
DSPMPE

SEQ ID NO: 2613448 - protein, 11 aa, Entamoeba histolytica
DSPNRSENPGL

SEQ ID NO: 2613449 - protein, 7 aa, Entamoeba histolytica
DSPNSSD

SEQ ID NO: 2613450 - protein, 6 aa, Entamoeba histolytica
DSPPEI

SEQ ID NO: 2613451 - protein, 6 aa, Entamoeba histolytica
DSPPSV

SEQ ID NO: 2613452 - protein, 14 aa, Entamoeba histolytica
DSPSKRRVMTPIFS

SEQ ID NO: 2613453 - protein, 9 aa, Entamoeba histolytica
DSPSLSKRS

SEQ ID NO: 2613454 - protein, 7 aa, Entamoeba histolytica
DSPSSEL

SEQ ID NO: 2613455 - protein, 6 aa, Entamoeba histolytica
DSPTEN

SEQ ID NO: 2613456 - protein, 5 aa, Entamoeba histolytica
DSPTT

SEQ ID NO: 2613457 - protein, 7 aa, Entamoeba histolytica
DSPTYST

SEQ ID NO: 2613458 - protein, 6 aa, Entamoeba histolytica
DSPVGY

SEQ ID NO: 2613459 - protein, 9 aa, Entamoeba histolytica
DSQESTSYN

SEQ ID NO: 2613460 - protein, 22 aa, Entamoeba histolytica
DSQHQKYQSTSQQQDQSIPNTT

SEQ ID NO: 2613461 - protein, 6 aa, Entamoeba histolytica
DSQKNK

SEQ ID NO: 2613462 - protein, 11 aa, Entamoeba histolytica
DSQKNKNITCN

SEQ ID NO: 2613463 - protein, 7 aa, Entamoeba histolytica
DSQLRKS

SEQ ID NO: 2613464 - protein, 7 aa, Entamoeba histolytica
DSQNSLS

SEQ ID NO: 2613465 - protein, 4 aa, Entamoeba histolytica
DSQP

SEQ ID NO: 2613466 - protein, 16 aa, Entamoeba histolytica
DSQPDERCDNRISENE

SEQ ID NO: 2613467 - protein, 32 aa, Entamoeba histolytica
DSQQSDKTTPTSPRSLRVSETRDSQIKRQKTP

SEQ ID NO: 2613468 - protein, 8 aa, Entamoeba histolytica
DSQRKSEM

SEQ ID NO: 2613469 - protein, 6 aa, Entamoeba histolytica
DSQRPK

SEQ ID NO: 2613470 - protein, 13 aa, Entamoeba histolytica
DSQRQATKDAGTI

SEQ ID NO: 2613471 - protein, 11 aa, Entamoeba histolytica
DSQSSNENHEE

SEQ ID NO: 2613472 - protein, 9 aa, Entamoeba histolytica
DSQSTSPVF

SEQ ID NO: 2613473 - protein, 9 aa, Entamoeba histolytica
DSQTEQDII

SEQ ID NO: 2613474 - protein, 5 aa, Entamoeba histolytica
DSQYP

SEQ ID NO: 2613475 - protein, 7 aa, Entamoeba histolytica
DSRAPPE

SEQ ID NO: 2613476 - protein, 6 aa, Entamoeba histolytica
DSRFDT

SEQ ID NO: 2613477 - protein, 8 aa, Entamoeba histolytica
DSRGNPTI

SEQ ID NO: 2613478 - protein, 5 aa, Entamoeba histolytica
DSRHT

SEQ ID NO: 2613479 - protein, 7 aa, Entamoeba histolytica
DSRNIKS

SEQ ID NO: 2613480 - protein, 6 aa, Entamoeba histolytica
DSRPDF

SEQ ID NO: 2613481 - protein, 9 aa, Entamoeba histolytica
DSRRSGNKM

SEQ ID NO: 2613482 - protein, 5 aa, Entamoeba histolytica
DSRSE

SEQ ID NO: 2613483 - protein, 6 aa, Entamoeba histolytica
DSRSEI

SEQ ID NO: 2613484 - protein, 9 aa, Entamoeba histolytica
DSRSRFENN

SEQ ID NO: 2613485 - protein, 4 aa, Entamoeba histolytica
DSRT

SEQ ID NO: 2613486 - protein, 110 aa, Entamoeba histolytica
DSSAKTSSPSSIATPPPPPPTLSMPPPPPPTLSMPPPPPPTLSMPPPPPPTLSMPPPPPPTLSMPPPPPPTLSMPPPPPPTLSMPPPPPPTLNVTSSPTTTMTPSSGATL

SEQ ID NO: 2613487 - protein, 8 aa, Entamoeba histolytica
DSSALDRR

SEQ ID NO: 2613488 - protein, 14 aa, Entamoeba histolytica
DSSASNLSRTRSPL

SEQ ID NO: 2613489 - protein, 8 aa, Entamoeba histolytica
DSSATTEG

SEQ ID NO: 2613490 - protein, 4 aa, Entamoeba histolytica
DSSC

SEQ ID NO: 2613491 - protein, 22 aa, Entamoeba histolytica
DSSDDFSSSELDSSESQEETIE

SEQ ID NO: 2613492 - protein, 6 aa, Entamoeba histolytica
DSSDDL

SEQ ID NO: 2613493 - protein, 8 aa, Entamoeba histolytica
DSSDLNPL

SEQ ID NO: 2613494 - protein, 16 aa, Entamoeba histolytica
DSSEDVISRPSSTKEI

SEQ ID NO: 2613495 - protein, 20 aa, Entamoeba histolytica
DSSERREEAAPTEQPQEEVH

SEQ ID NO: 2613496 - protein, 37 aa, Entamoeba histolytica
DSSFKQNTFPVQQQSTSHSSHSSSSESSEDDSEIENK

SEQ ID NO: 2613497 - protein, 5 aa, Entamoeba histolytica
DSSFP

SEQ ID NO: 2613498 - protein, 9 aa, Entamoeba histolytica
DSSFRTSSE

SEQ ID NO: 2613499 - protein, 6 aa, Entamoeba histolytica
DSSFTD

SEQ ID NO: 2613500 - protein, 7 aa, Entamoeba histolytica
DSSGIPD

SEQ ID NO: 2613501 - protein, 8 aa, Entamoeba histolytica
DSSGNITS

SEQ ID NO: 2613502 - protein, 43 aa, Entamoeba histolytica
DSSGNPILSSSPRVSSEKQEQETQVISEEQQKEQQQDEQTTKK

SEQ ID NO: 2613503 - protein, 8 aa, Entamoeba histolytica
DSSHATCD

SEQ ID NO: 2613504 - protein, 18 aa, Entamoeba histolytica
DSSHDKVIQTSQDDFIDE

SEQ ID NO: 2613505 - protein, 24 aa, Entamoeba histolytica
DSSHKKKKKLSKKKVNKSKPPRLP

SEQ ID NO: 2613506 - protein, 6 aa, Entamoeba histolytica
DSSINT

SEQ ID NO: 2613507 - protein, 12 aa, Entamoeba histolytica
DSSITDKSDEIT

SEQ ID NO: 2613508 - protein, 5 aa, Entamoeba histolytica
DSSKE

SEQ ID NO: 2613509 - protein, 7 aa, Entamoeba histolytica
DSSKEGM

SEQ ID NO: 2613510 - protein, 8 aa, Entamoeba histolytica
DSSLAEPK

SEQ ID NO: 2613511 - protein, 6 aa, Entamoeba histolytica
DSSLFN

SEQ ID NO: 2613512 - protein, 5 aa, Entamoeba histolytica
DSSLK

SEQ ID NO: 2613513 - protein, 7 aa, Entamoeba histolytica
DSSLKAS

SEQ ID NO: 2613514 - protein, 9 aa, Entamoeba histolytica
DSSLPRPSL

SEQ ID NO: 2613515 - protein, 13 aa, Entamoeba histolytica
DSSLSGNSQSNNF

SEQ ID NO: 2613516 - protein, 7 aa, Entamoeba histolytica
DSSNEPV

SEQ ID NO: 2613517 - protein, 17 aa, Entamoeba histolytica
DSSNTSDDIHKFSFTCH

SEQ ID NO: 2613518 - protein, 4 aa, Entamoeba histolytica
DSSP

SEQ ID NO: 2613519 - protein, 22 aa, Entamoeba histolytica
DSSPEKIKSKQNYDNNTTSTQY

SEQ ID NO: 2613520 - protein, 6 aa, Entamoeba histolytica
DSSPIS

SEQ ID NO: 2613521 - protein, 15 aa, Entamoeba histolytica
DSSPSEQSNEKPVQS

SEQ ID NO: 2613522 - protein, 6 aa, Entamoeba histolytica
DSSQLS

SEQ ID NO: 2613523 - protein, 12 aa, Entamoeba histolytica
DSSQQTSQLPWK

SEQ ID NO: 2613524 - protein, 9 aa, Entamoeba histolytica
DSSQSLPTM

SEQ ID NO: 2613525 - protein, 8 aa, Entamoeba histolytica
DSSRLKRT

SEQ ID NO: 2613526 - protein, 5 aa, Entamoeba histolytica
DSSSD

SEQ ID NO: 2613527 - protein, 14 aa, Entamoeba histolytica
DSSSDETSLNQQIN

SEQ ID NO: 2613528 - protein, 8 aa, Entamoeba histolytica
DSSSENIS

SEQ ID NO: 2613529 - protein, 5 aa, Entamoeba histolytica
DSSSI

SEQ ID NO: 2613530 - protein, 5 aa, Entamoeba histolytica
DSSSR

SEQ ID NO: 2613531 - protein, 9 aa, Entamoeba histolytica
DSSTKNSSL

SEQ ID NO: 2613532 - protein, 7 aa, Entamoeba histolytica
DSSVGKS

SEQ ID NO: 2613533 - protein, 7 aa, Entamoeba histolytica
DSSVGKT

SEQ ID NO: 2613534 - protein, 4 aa, Entamoeba histolytica
DSSY

SEQ ID NO: 2613535 - protein, 7 aa, Entamoeba histolytica
DSSYPGI

SEQ ID NO: 2613536 - protein, 9 aa, Entamoeba histolytica
DSTAKPNKL

SEQ ID NO: 2613537 - protein, 8 aa, Entamoeba histolytica
DSTALDRS

SEQ ID NO: 2613538 - protein, 12 aa, Entamoeba histolytica
DSTATDEEIKKA

SEQ ID NO: 2613539 - protein, 7 aa, Entamoeba histolytica
DSTDDTL

SEQ ID NO: 2613540 - protein, 9 aa, Entamoeba histolytica
DSTDNSQRL

SEQ ID NO: 2613541 - protein, 5 aa, Entamoeba histolytica
DSTDP

SEQ ID NO: 2613542 - protein, 9 aa, Entamoeba histolytica
DSTDPTPSL

SEQ ID NO: 2613543 - protein, 7 aa, Entamoeba histolytica
DSTDTFD

SEQ ID NO: 2613544 - protein, 8 aa, Entamoeba histolytica
DSTEENIE

SEQ ID NO: 2613545 - protein, 31 aa, Entamoeba histolytica
DSTEFSNSTSLISPSLPSPSSLSSSITPSIS

SEQ ID NO: 2613546 - protein, 7 aa, Entamoeba histolytica
DSTEGLS

SEQ ID NO: 2613547 - protein, 6 aa, Entamoeba histolytica
DSTERL

SEQ ID NO: 2613548 - protein, 5 aa, Entamoeba histolytica
DSTFQ

SEQ ID NO: 2613549 - protein, 4 aa, Entamoeba histolytica
DSTG

SEQ ID NO: 2613550 - protein, 5 aa, Entamoeba histolytica
DSTGS

SEQ ID NO: 2613551 - protein, 6 aa, Entamoeba histolytica
DSTGSL

SEQ ID NO: 2613552 - protein, 5 aa, Entamoeba histolytica
DSTIK

SEQ ID NO: 2613553 - protein, 5 aa, Entamoeba histolytica
DSTIN

SEQ ID NO: 2613554 - protein, 9 aa, Entamoeba histolytica
DSTISETKE

SEQ ID NO: 2613555 - protein, 7 aa, Entamoeba histolytica
DSTKKYP

SEQ ID NO: 2613556 - protein, 4 aa, Entamoeba histolytica
DSTL

SEQ ID NO: 2613557 - protein, 5 aa, Entamoeba histolytica
DSTLK

SEQ ID NO: 2613558 - protein, 15 aa, Entamoeba histolytica
DSTLSDESKKGRVVF

SEQ ID NO: 2613559 - protein, 28 aa, Entamoeba histolytica
DSTMSNSSEDYQYHKKREEKKPKRNHGL

SEQ ID NO: 2613560 - protein, 4 aa, Entamoeba histolytica
DSTN

SEQ ID NO: 2613561 - protein, 7 aa, Entamoeba histolytica
DSTNEEI

SEQ ID NO: 2613562 - protein, 5 aa, Entamoeba histolytica
DSTNK

SEQ ID NO: 2613563 - protein, 8 aa, Entamoeba histolytica
DSTNKNYI

SEQ ID NO: 2613564 - protein, 10 aa, Entamoeba histolytica
DSTNQGESVG

SEQ ID NO: 2613565 - protein, 36 aa, Entamoeba histolytica
DSTPEDSEDNSNGFQYDEDDDFDGVGDDVDDEIVGS

SEQ ID NO: 2613566 - protein, 6 aa, Entamoeba histolytica
DSTPIK

SEQ ID NO: 2613567 - protein, 14 aa, Entamoeba histolytica
DSTPINKSARIVII

SEQ ID NO: 2613568 - protein, 15 aa, Entamoeba histolytica
DSTPIPLETPENEEY

SEQ ID NO: 2613569 - protein, 14 aa, Entamoeba histolytica
DSTPIPPEIPEDEE

SEQ ID NO: 2613570 - protein, 17 aa, Entamoeba histolytica
DSTPSQPSQQKPLQTST

SEQ ID NO: 2613571 - protein, 8 aa, Entamoeba histolytica
DSTQISQE

SEQ ID NO: 2613572 - protein, 11 aa, Entamoeba histolytica
DSTQNNQTEEQ

SEQ ID NO: 2613573 - protein, 10 aa, Entamoeba histolytica
DSTRKDGFSR

SEQ ID NO: 2613574 - protein, 10 aa, Entamoeba histolytica
DSTRKSVERQ

SEQ ID NO: 2613575 - protein, 5 aa, Entamoeba histolytica
DSTRM

SEQ ID NO: 2613576 - protein, 12 aa, Entamoeba histolytica
DSTRSLIETPRR

SEQ ID NO: 2613577 - protein, 5 aa, Entamoeba histolytica
DSTSN

SEQ ID NO: 2613578 - protein, 9 aa, Entamoeba histolytica
DSTSQDIND

SEQ ID NO: 2613579 - protein, 6 aa, Entamoeba histolytica
DSTSTR

SEQ ID NO: 2613580 - protein, 9 aa, Entamoeba histolytica
DSTSTTTSL

SEQ ID NO: 2613581 - protein, 5 aa, Entamoeba histolytica
DSTTL

SEQ ID NO: 2613582 - protein, 7 aa, Entamoeba histolytica
DSTTNRL

SEQ ID NO: 2613583 - protein, 6 aa, Entamoeba histolytica
DSTTQV

SEQ ID NO: 2613584 - protein, 7 aa, Entamoeba histolytica
DSTWTRD

SEQ ID NO: 2613585 - protein, 8 aa, Entamoeba histolytica
DSTYNSNS

SEQ ID NO: 2613586 - protein, 11 aa, Entamoeba histolytica
DSTYTKNLGST

SEQ ID NO: 2613587 - protein, 7 aa, Entamoeba histolytica
DSVDGHE

SEQ ID NO: 2613588 - protein, 13 aa, Entamoeba histolytica
DSVEGKDLEGSSF

SEQ ID NO: 2613589 - protein, 9 aa, Entamoeba histolytica
DSVKEKSNF

SEQ ID NO: 2613590 - protein, 7 aa, Entamoeba histolytica
DSVLQET

SEQ ID NO: 2613591 - protein, 10 aa, Entamoeba histolytica
DSVNNESLDQ

SEQ ID NO: 2613592 - protein, 6 aa, Entamoeba histolytica
DSVNNT

SEQ ID NO: 2613593 - protein, 7 aa, Entamoeba histolytica
DSVNPFP

SEQ ID NO: 2613594 - protein, 12 aa, Entamoeba histolytica
DSVNSSSQELTI

SEQ ID NO: 2613595 - protein, 7 aa, Entamoeba histolytica
DSVPNKE

SEQ ID NO: 2613596 - protein, 23 aa, Entamoeba histolytica
DSVPSSPHNTPALRERSGSATAK

SEQ ID NO: 2613597 - protein, 8 aa, Entamoeba histolytica
DSVPTKNN

SEQ ID NO: 2613598 - protein, 8 aa, Entamoeba histolytica
DSVQMKPE

SEQ ID NO: 2613599 - protein, 10 aa, Entamoeba histolytica
DSVQNVNDSS

SEQ ID NO: 2613600 - protein, 4 aa, Entamoeba histolytica
DSVS

SEQ ID NO: 2613601 - protein, 5 aa, Entamoeba histolytica
DSVSE

SEQ ID NO: 2613602 - protein, 27 aa, Entamoeba histolytica
DSVSNFNEKEVSKTIDVSKQSTKQYSQ

SEQ ID NO: 2613603 - protein, 6 aa, Entamoeba histolytica
DSVTKD

SEQ ID NO: 2613604 - protein, 12 aa, Entamoeba histolytica
DSVVNDGISGSA

SEQ ID NO: 2613605 - protein, 16 aa, Entamoeba histolytica
DSWNKGEELDEDAADL

SEQ ID NO: 2613606 - protein, 8 aa, Entamoeba histolytica
DSWNSGNE

SEQ ID NO: 2613607 - protein, 11 aa, Entamoeba histolytica
DSWSSNVATNR

SEQ ID NO: 2613608 - protein, 8 aa, Entamoeba histolytica
DSWTSRSA

SEQ ID NO: 2613609 - protein, 7 aa, Entamoeba histolytica
DSYESSI

SEQ ID NO: 2613610 - protein, 4 aa, Entamoeba histolytica
DSYF

SEQ ID NO: 2613611 - protein, 5 aa, Entamoeba histolytica
DSYIG

SEQ ID NO: 2613612 - protein, 5 aa, Entamoeba histolytica
DSYIT

SEQ ID NO: 2613613 - protein, 7 aa, Entamoeba histolytica
DSYKEPP

SEQ ID NO: 2613614 - protein, 6 aa, Entamoeba histolytica
DSYKLT

SEQ ID NO: 2613615 - protein, 5 aa, Entamoeba histolytica
DSYPY

SEQ ID NO: 2613616 - protein, 4 aa, Entamoeba histolytica
DSYQ

SEQ ID NO: 2613617 - protein, 8 aa, Entamoeba histolytica
DSYQDYKE

SEQ ID NO: 2613618 - protein, 9 aa, Entamoeba histolytica
DSYQDYSEL

SEQ ID NO: 2613619 - protein, 6 aa, Entamoeba histolytica
DSYQEE

SEQ ID NO: 2613620 - protein, 8 aa, Entamoeba histolytica
DSYRDYKE

SEQ ID NO: 2613621 - protein, 8 aa, Entamoeba histolytica
DSYSPQLS

SEQ ID NO: 2613622 - protein, 9 aa, Entamoeba histolytica
DSYSTKQKR

SEQ ID NO: 2613623 - protein, 9 aa, Entamoeba histolytica
DTAEKGAIE

SEQ ID NO: 2613624 - protein, 7 aa, Entamoeba histolytica
DTAGNER

SEQ ID NO: 2613625 - protein, 7 aa, Entamoeba histolytica
DTAGQER

SEQ ID NO: 2613626 - protein, 12 aa, Entamoeba histolytica
DTAGSPSSFSAS

SEQ ID NO: 2613627 - protein, 9 aa, Entamoeba histolytica
DTAGSPSYF

SEQ ID NO: 2613628 - protein, 7 aa, Entamoeba histolytica
DTAKTAQ

SEQ ID NO: 2613629 - protein, 5 aa, Entamoeba histolytica
DTAKV

SEQ ID NO: 2613630 - protein, 7 aa, Entamoeba histolytica
DTALQSR

SEQ ID NO: 2613631 - protein, 11 aa, Entamoeba histolytica
DTANQQISAPT

SEQ ID NO: 2613632 - protein, 6 aa, Entamoeba histolytica
DTAPPD

SEQ ID NO: 2613633 - protein, 7 aa, Entamoeba histolytica
DTAQLSQ

SEQ ID NO: 2613634 - protein, 13 aa, Entamoeba histolytica
DTAQPDKKPLLPV

SEQ ID NO: 2613635 - protein, 7 aa, Entamoeba histolytica
DTAVNST

SEQ ID NO: 2613636 - protein, 7 aa, Entamoeba histolytica
DTCKDDP

SEQ ID NO: 2613637 - protein, 9 aa, Entamoeba histolytica
DTCSDEPKK

SEQ ID NO: 2613638 - protein, 13 aa, Entamoeba histolytica
DTDDDNPNVAGTI

SEQ ID NO: 2613639 - protein, 34 aa, Entamoeba histolytica
DTDDGDDYPVKRKYTTQEEQEDDESLKDENTELL

SEQ ID NO: 2613640 - protein, 5 aa, Entamoeba histolytica
DTDDS

SEQ ID NO: 2613641 - protein, 6 aa, Entamoeba histolytica
DTDFED

SEQ ID NO: 2613642 - protein, 8 aa, Entamoeba histolytica
DTDGSGKG

SEQ ID NO: 2613643 - protein, 10 aa, Entamoeba histolytica
DTDGSYLPNT

SEQ ID NO: 2613644 - protein, 9 aa, Entamoeba histolytica
DTDKNGSLD

SEQ ID NO: 2613645 - protein, 62 aa, Entamoeba histolytica
DTDKQEEVDDNTKKDEQQDINNEEIKKDGKEEKLGGNNTIEQQDENNDDNEKKENKEEELPQ

SEQ ID NO: 2613646 - protein, 4 aa, Entamoeba histolytica
DTDL

SEQ ID NO: 2613647 - protein, 4 aa, Entamoeba histolytica
DTDP

SEQ ID NO: 2613648 - protein, 9 aa, Entamoeba histolytica
DTDPTVEPG

SEQ ID NO: 2613649 - protein, 7 aa, Entamoeba histolytica
DTDSSVQ

SEQ ID NO: 2613650 - protein, 10 aa, Entamoeba histolytica
DTDSTKKTKI

SEQ ID NO: 2613651 - protein, 7 aa, Entamoeba histolytica
DTDTAAQ

SEQ ID NO: 2613652 - protein, 5 aa, Entamoeba histolytica
DTDTY

SEQ ID NO: 2613653 - protein, 4 aa, Entamoeba histolytica
DTDV

SEQ ID NO: 2613654 - protein, 11 aa, Entamoeba histolytica
DTDYTSKSVDE

SEQ ID NO: 2613655 - protein, 4 aa, Entamoeba histolytica
DTED

SEQ ID NO: 2613656 - protein, 10 aa, Entamoeba histolytica
DTEDSLNAGK

SEQ ID NO: 2613657 - protein, 5 aa, Entamoeba histolytica
DTEEE

SEQ ID NO: 2613658 - protein, 17 aa, Entamoeba histolytica
DTEEHAAAAKKALTGRY

SEQ ID NO: 2613659 - protein, 17 aa, Entamoeba histolytica
DTEESAQKALREGNNEM

SEQ ID NO: 2613660 - protein, 7 aa, Entamoeba histolytica
DTEESYV

SEQ ID NO: 2613661 - protein, 6 aa, Entamoeba histolytica
DTEFPY

SEQ ID NO: 2613662 - protein, 6 aa, Entamoeba histolytica
DTEGRD

SEQ ID NO: 2613663 - protein, 5 aa, Entamoeba histolytica
DTEIK

SEQ ID NO: 2613664 - protein, 4 aa, Entamoeba histolytica
DTEK

SEQ ID NO: 2613665 - protein, 10 aa, Entamoeba histolytica
DTEKELNRGV

SEQ ID NO: 2613666 - protein, 8 aa, Entamoeba histolytica
DTEKINQS

SEQ ID NO: 2613667 - protein, 5 aa, Entamoeba histolytica
DTELS

SEQ ID NO: 2613668 - protein, 4 aa, Entamoeba histolytica
DTEN

SEQ ID NO: 2613669 - protein, 6 aa, Entamoeba histolytica
DTENDR

SEQ ID NO: 2613670 - protein, 5 aa, Entamoeba histolytica
DTENK

SEQ ID NO: 2613671 - protein, 4 aa, Entamoeba histolytica
DTEP

SEQ ID NO: 2613672 - protein, 6 aa, Entamoeba histolytica
DTEPSI

SEQ ID NO: 2613673 - protein, 4 aa, Entamoeba histolytica
DTER

SEQ ID NO: 2613674 - protein, 6 aa, Entamoeba histolytica
DTERGT

SEQ ID NO: 2613675 - protein, 4 aa, Entamoeba histolytica
DTES

SEQ ID NO: 2613676 - protein, 28 aa, Entamoeba histolytica
DTETAHETSKLAKSKSRSRTKSVKRGRD

SEQ ID NO: 2613677 - protein, 6 aa, Entamoeba histolytica
DTETRD

SEQ ID NO: 2613678 - protein, 12 aa, Entamoeba histolytica
DTEYDDLPPNMS

SEQ ID NO: 2613679 - protein, 7 aa, Entamoeba histolytica
DTEYDET

SEQ ID NO: 2613680 - protein, 10 aa, Entamoeba histolytica
DTEYYKNKGI

SEQ ID NO: 2613681 - protein, 11 aa, Entamoeba histolytica
DTFDQTEEQRK

SEQ ID NO: 2613682 - protein, 6 aa, Entamoeba histolytica
DTFEST

SEQ ID NO: 2613683 - protein, 14 aa, Entamoeba histolytica
DTFNPTNWNKSVNP

SEQ ID NO: 2613684 - protein, 8 aa, Entamoeba histolytica
DTFTQEEA

SEQ ID NO: 2613685 - protein, 16 aa, Entamoeba histolytica
DTGCQDNNNEEIQKEP

SEQ ID NO: 2613686 - protein, 11 aa, Entamoeba histolytica
DTGKDEAERKK

SEQ ID NO: 2613687 - protein, 10 aa, Entamoeba histolytica
DTGKPNTKNR

SEQ ID NO: 2613688 - protein, 6 aa, Entamoeba histolytica
DTGKTK

SEQ ID NO: 2613689 - protein, 5 aa, Entamoeba histolytica
DTGND

SEQ ID NO: 2613690 - protein, 9 aa, Entamoeba histolytica
DTGNNNKPL

SEQ ID NO: 2613691 - protein, 5 aa, Entamoeba histolytica
DTGNS

SEQ ID NO: 2613692 - protein, 17 aa, Entamoeba histolytica
DTGSQCENSEDIEVISS

SEQ ID NO: 2613693 - protein, 6 aa, Entamoeba histolytica
DTHDQL

SEQ ID NO: 2613694 - protein, 15 aa, Entamoeba histolytica
DTHEPKQQQTQVKSQ

SEQ ID NO: 2613695 - protein, 5 aa, Entamoeba histolytica
DTHGI

SEQ ID NO: 2613696 - protein, 7 aa, Entamoeba histolytica
DTHHKTK

SEQ ID NO: 2613697 - protein, 4 aa, Entamoeba histolytica
DTHP

SEQ ID NO: 2613698 - protein, 6 aa, Entamoeba histolytica
DTHPTV

SEQ ID NO: 2613699 - protein, 30 aa, Entamoeba histolytica
DTIAKNDEEHDKLESDINNNEKTIKQLQNA

SEQ ID NO: 2613700 - protein, 6 aa, Entamoeba histolytica
DTIDNR

SEQ ID NO: 2613701 - protein, 4 aa, Entamoeba histolytica
DTIE

SEQ ID NO: 2613702 - protein, 5 aa, Entamoeba histolytica
DTIEN

SEQ ID NO: 2613703 - protein, 4 aa, Entamoeba histolytica
DTIK

SEQ ID NO: 2613704 - protein, 7 aa, Entamoeba histolytica
DTIKEIP

SEQ ID NO: 2613705 - protein, 10 aa, Entamoeba histolytica
DTIKNNVKEG

SEQ ID NO: 2613706 - protein, 5 aa, Entamoeba histolytica
DTIKQ

SEQ ID NO: 2613707 - protein, 8 aa, Entamoeba histolytica
DTIKSLEN

SEQ ID NO: 2613708 - protein, 5 aa, Entamoeba histolytica
DTINE

SEQ ID NO: 2613709 - protein, 6 aa, Entamoeba histolytica
DTIPSP

SEQ ID NO: 2613710 - protein, 11 aa, Entamoeba histolytica
DTIPTQNQNHE

SEQ ID NO: 2613711 - protein, 10 aa, Entamoeba histolytica
DTIQKTANDL

SEQ ID NO: 2613712 - protein, 4 aa, Entamoeba histolytica
DTIR

SEQ ID NO: 2613713 - protein, 4 aa, Entamoeba histolytica
DTIS

SEQ ID NO: 2613714 - protein, 8 aa, Entamoeba histolytica
DTITQSNI

SEQ ID NO: 2613715 - protein, 9 aa, Entamoeba histolytica
DTITSQGTT

SEQ ID NO: 2613716 - protein, 4 aa, Entamoeba histolytica
DTKC

SEQ ID NO: 2613717 - protein, 10 aa, Entamoeba histolytica
DTKDGLSEES

SEQ ID NO: 2613718 - protein, 10 aa, Entamoeba histolytica
DTKDMTPLND

SEQ ID NO: 2613719 - protein, 4 aa, Entamoeba histolytica
DTKE

SEQ ID NO: 2613720 - protein, 7 aa, Entamoeba histolytica
DTKEREM

SEQ ID NO: 2613721 - protein, 7 aa, Entamoeba histolytica
DTKFHRE

SEQ ID NO: 2613722 - protein, 5 aa, Entamoeba histolytica
DTKGM

SEQ ID NO: 2613723 - protein, 9 aa, Entamoeba histolytica
DTKKKSSIT

SEQ ID NO: 2613724 - protein, 14 aa, Entamoeba histolytica
DTKKPKPQKSTYSH

SEQ ID NO: 2613725 - protein, 7 aa, Entamoeba histolytica
DTKKRTV

SEQ ID NO: 2613726 - protein, 5 aa, Entamoeba histolytica
DTKKS

SEQ ID NO: 2613727 - protein, 22 aa, Entamoeba histolytica
DTKLDPDALNSPELENHKESMD

SEQ ID NO: 2613728 - protein, 25 aa, Entamoeba histolytica
DTKPKRGLHRTTSSSSNIFSFDENA

SEQ ID NO: 2613729 - protein, 8 aa, Entamoeba histolytica
DTKQQVDD

SEQ ID NO: 2613730 - protein, 14 aa, Entamoeba histolytica
DTKRRNTQKFGEGE

SEQ ID NO: 2613731 - protein, 8 aa, Entamoeba histolytica
DTKSRTIK

SEQ ID NO: 2613732 - protein, 6 aa, Entamoeba histolytica
DTKTAR

SEQ ID NO: 2613733 - protein, 41 aa, Entamoeba histolytica
DTKTKEDEEKKRLEEHESITKKSSKKQRDGKKFYKKIGCSV

SEQ ID NO: 2613734 - protein, 7 aa, Entamoeba histolytica
DTKTNKT

SEQ ID NO: 2613735 - protein, 43 aa, Entamoeba histolytica
DTKVEDAKQVPTNERKTKDLLESTQVNDIKKEGEKKQEQTKKI

SEQ ID NO: 2613736 - protein, 18 aa, Entamoeba histolytica
DTLDKNSENSTSSSTRQY

SEQ ID NO: 2613737 - protein, 27 aa, Entamoeba histolytica
DTLDSEINAKTQTQKNTKEFEELQQKD

SEQ ID NO: 2613738 - protein, 5 aa, Entamoeba histolytica
DTLNE

SEQ ID NO: 2613739 - protein, 14 aa, Entamoeba histolytica
DTLNEEDKKVPLSD

SEQ ID NO: 2613740 - protein, 4 aa, Entamoeba histolytica
DTLP

SEQ ID NO: 2613741 - protein, 7 aa, Entamoeba histolytica
DTLSECP

SEQ ID NO: 2613742 - protein, 9 aa, Entamoeba histolytica
DTLSKSPLH

SEQ ID NO: 2613743 - protein, 7 aa, Entamoeba histolytica
DTLTEEQ

SEQ ID NO: 2613744 - protein, 12 aa, Entamoeba histolytica
DTLTSDDHLGDA

SEQ ID NO: 2613745 - protein, 17 aa, Entamoeba histolytica
DTLTSGAEDENDEDSIK

SEQ ID NO: 2613746 - protein, 6 aa, Entamoeba histolytica
DTMKKE

SEQ ID NO: 2613747 - protein, 8 aa, Entamoeba histolytica
DTNDASLE

SEQ ID NO: 2613748 - protein, 10 aa, Entamoeba histolytica
DTNDDEDWSE

SEQ ID NO: 2613749 - protein, 8 aa, Entamoeba histolytica
DTNDVPKS

SEQ ID NO: 2613750 - protein, 6 aa, Entamoeba histolytica
DTNELF

SEQ ID NO: 2613751 - protein, 8 aa, Entamoeba histolytica
DTNEMHKP

SEQ ID NO: 2613752 - protein, 11 aa, Entamoeba histolytica
DTNEQKRNSAL

SEQ ID NO: 2613753 - protein, 9 aa, Entamoeba histolytica
DTNESINTT

SEQ ID NO: 2613754 - protein, 5 aa, Entamoeba histolytica
DTNEV

SEQ ID NO: 2613755 - protein, 4 aa, Entamoeba histolytica
DTNG

SEQ ID NO: 2613756 - protein, 7 aa, Entamoeba histolytica
DTNGITT

SEQ ID NO: 2613757 - protein, 13 aa, Entamoeba histolytica
DTNHKSNDTNPLT

SEQ ID NO: 2613758 - protein, 35 aa, Entamoeba histolytica
DTNINKSSIPIHSTNSSIEQSNGINISGNQPKTIK

SEQ ID NO: 2613759 - protein, 5 aa, Entamoeba histolytica
DTNKL

SEQ ID NO: 2613760 - protein, 27 aa, Entamoeba histolytica
DTNKQEKTPVIEEKEEIESMGNNDKQI

SEQ ID NO: 2613761 - protein, 9 aa, Entamoeba histolytica
DTNKTKRTV

SEQ ID NO: 2613762 - protein, 5 aa, Entamoeba histolytica
DTNLP

SEQ ID NO: 2613763 - protein, 9 aa, Entamoeba histolytica
DTNLTQPIQ

SEQ ID NO: 2613764 - protein, 9 aa, Entamoeba histolytica
DTNNIKYNS

SEQ ID NO: 2613765 - protein, 9 aa, Entamoeba histolytica
DTNPEKETH

SEQ ID NO: 2613766 - protein, 7 aa, Entamoeba histolytica
DTNQEVV

SEQ ID NO: 2613767 - protein, 16 aa, Entamoeba histolytica
DTNQTEECCSLIIELS

SEQ ID NO: 2613768 - protein, 13 aa, Entamoeba histolytica
DTNQTKQAKGSPL

SEQ ID NO: 2613769 - protein, 7 aa, Entamoeba histolytica
DTNYPRN

SEQ ID NO: 2613770 - protein, 6 aa, Entamoeba histolytica
DTPCNG

SEQ ID NO: 2613771 - protein, 5 aa, Entamoeba histolytica
DTPDK

SEQ ID NO: 2613772 - protein, 8 aa, Entamoeba histolytica
DTPELESS

SEQ ID NO: 2613773 - protein, 12 aa, Entamoeba histolytica
DTPENRTPNKYP

SEQ ID NO: 2613774 - protein, 6 aa, Entamoeba histolytica
DTPEQL

SEQ ID NO: 2613775 - protein, 7 aa, Entamoeba histolytica
DTPGNVK

SEQ ID NO: 2613776 - protein, 6 aa, Entamoeba histolytica
DTPGYA

SEQ ID NO: 2613777 - protein, 9 aa, Entamoeba histolytica
DTPHSEPKL

SEQ ID NO: 2613778 - protein, 7 aa, Entamoeba histolytica
DTPITLS

SEQ ID NO: 2613779 - protein, 12 aa, Entamoeba histolytica
DTPKHKSTTNSV

SEQ ID NO: 2613780 - protein, 7 aa, Entamoeba histolytica
DTPKQEA

SEQ ID NO: 2613781 - protein, 21 aa, Entamoeba histolytica
DTPKSINEEKKEASKKEMSTV

SEQ ID NO: 2613782 - protein, 14 aa, Entamoeba histolytica
DTPLNNGLRQPQLR

SEQ ID NO: 2613783 - protein, 11 aa, Entamoeba histolytica
DTPLPPTPKDF

SEQ ID NO: 2613784 - protein, 12 aa, Entamoeba histolytica
DTPLPPTPKDFA

SEQ ID NO: 2613785 - protein, 5 aa, Entamoeba histolytica
DTPLY

SEQ ID NO: 2613786 - protein, 10 aa, Entamoeba histolytica
DTPPGTSDEH

SEQ ID NO: 2613787 - protein, 7 aa, Entamoeba histolytica
DTPPQSN

SEQ ID NO: 2613788 - protein, 12 aa, Entamoeba histolytica
DTPPRKSDATIA

SEQ ID NO: 2613789 - protein, 13 aa, Entamoeba histolytica
DTPQRGTRYGRRR

SEQ ID NO: 2613790 - protein, 5 aa, Entamoeba histolytica
DTPSY

SEQ ID NO: 2613791 - protein, 4 aa, Entamoeba histolytica
DTPT

SEQ ID NO: 2613792 - protein, 6 aa, Entamoeba histolytica
DTPTSY

SEQ ID NO: 2613793 - protein, 5 aa, Entamoeba histolytica
DTQEA

SEQ ID NO: 2613794 - protein, 7 aa, Entamoeba histolytica
DTQEALT

SEQ ID NO: 2613795 - protein, 10 aa, Entamoeba histolytica
DTQGDPFFSN

SEQ ID NO: 2613796 - protein, 6 aa, Entamoeba histolytica
DTQHVV

SEQ ID NO: 2613797 - protein, 6 aa, Entamoeba histolytica
DTQKQP

SEQ ID NO: 2613798 - protein, 5 aa, Entamoeba histolytica
DTQLQ

SEQ ID NO: 2613799 - protein, 6 aa, Entamoeba histolytica
DTQLRG

SEQ ID NO: 2613800 - protein, 7 aa, Entamoeba histolytica
DTQRDEI

SEQ ID NO: 2613801 - protein, 6 aa, Entamoeba histolytica
DTQSHK

SEQ ID NO: 2613802 - protein, 13 aa, Entamoeba histolytica
DTQTTLSTKTQLT

SEQ ID NO: 2613803 - protein, 10 aa, Entamoeba histolytica
DTRAINGVRN

SEQ ID NO: 2613804 - protein, 6 aa, Entamoeba histolytica
DTRGEP

SEQ ID NO: 2613805 - protein, 7 aa, Entamoeba histolytica
DTRHPKI

SEQ ID NO: 2613806 - protein, 5 aa, Entamoeba histolytica
DTRMS

SEQ ID NO: 2613807 - protein, 9 aa, Entamoeba histolytica
DTRNPSPLT

SEQ ID NO: 2613808 - protein, 11 aa, Entamoeba histolytica
DTRQILPPANE

SEQ ID NO: 2613809 - protein, 32 aa, Entamoeba histolytica
DTRRNDYDDTCDSRRRYVDEDDQLPSRRGDRR

SEQ ID NO: 2613810 - protein, 4 aa, Entamoeba histolytica
DTRT

SEQ ID NO: 2613811 - protein, 6 aa, Entamoeba histolytica
DTRTER

SEQ ID NO: 2613812 - protein, 4 aa, Entamoeba histolytica
DTSA

SEQ ID NO: 2613813 - protein, 5 aa, Entamoeba histolytica
DTSAK

SEQ ID NO: 2613814 - protein, 11 aa, Entamoeba histolytica
DTSCDSPSDDF

SEQ ID NO: 2613815 - protein, 6 aa, Entamoeba histolytica
DTSGRN

SEQ ID NO: 2613816 - protein, 9 aa, Entamoeba histolytica
DTSGSDPNE

SEQ ID NO: 2613817 - protein, 13 aa, Entamoeba histolytica
DTSIQCTTDFKVF

SEQ ID NO: 2613818 - protein, 6 aa, Entamoeba histolytica
DTSITS

SEQ ID NO: 2613819 - protein, 9 aa, Entamoeba histolytica
DTSKGKLTI

SEQ ID NO: 2613820 - protein, 9 aa, Entamoeba histolytica
DTSKKMQTY

SEQ ID NO: 2613821 - protein, 8 aa, Entamoeba histolytica
DTSKPNDI

SEQ ID NO: 2613822 - protein, 11 aa, Entamoeba histolytica
DTSKRTLRPTK

SEQ ID NO: 2613823 - protein, 15 aa, Entamoeba histolytica
DTSLEEGGQQTHPDL

SEQ ID NO: 2613824 - protein, 19 aa, Entamoeba histolytica
DTSLSKDDSEIKLPTEEEI

SEQ ID NO: 2613825 - protein, 11 aa, Entamoeba histolytica
DTSNDAPGKNI

SEQ ID NO: 2613826 - protein, 10 aa, Entamoeba histolytica
DTSNDNDAMK

SEQ ID NO: 2613827 - protein, 16 aa, Entamoeba histolytica
DTSNSKTENSNPKTEI

SEQ ID NO: 2613828 - protein, 9 aa, Entamoeba histolytica
DTSNVGGGR

SEQ ID NO: 2613829 - protein, 18 aa, Entamoeba histolytica
DTSPDGKKFVTGGGDGKV

SEQ ID NO: 2613830 - protein, 41 aa, Entamoeba histolytica
DTSPNNTKTEETDASPSNTDVSEPNIPIEGSKRLKSHENGK

SEQ ID NO: 2613831 - protein, 10 aa, Entamoeba histolytica
DTSPSNDSLL

SEQ ID NO: 2613832 - protein, 10 aa, Entamoeba histolytica
DTSSNGTFLN

SEQ ID NO: 2613833 - protein, 8 aa, Entamoeba histolytica
DTSSPIPK

SEQ ID NO: 2613834 - protein, 8 aa, Entamoeba histolytica
DTSSYQNL

SEQ ID NO: 2613835 - protein, 4 aa, Entamoeba histolytica
DTST

SEQ ID NO: 2613836 - protein, 20 aa, Entamoeba histolytica
DTSTNGTYVNGEKVGRGKTV

SEQ ID NO: 2613837 - protein, 8 aa, Entamoeba histolytica
DTSVPKKQ

SEQ ID NO: 2613838 - protein, 5 aa, Entamoeba histolytica
DTTAF

SEQ ID NO: 2613839 - protein, 39 aa, Entamoeba histolytica
DTTATNNPIKKEKNVNHSTSGITDTSLQRQVSDDTPDKQ

SEQ ID NO: 2613840 - protein, 6 aa, Entamoeba histolytica
DTTEIK

SEQ ID NO: 2613841 - protein, 6 aa, Entamoeba histolytica
DTTGFG

SEQ ID NO: 2613842 - protein, 8 aa, Entamoeba histolytica
DTTGKGAD

SEQ ID NO: 2613843 - protein, 12 aa, Entamoeba histolytica
DTTKREWEPTTY

SEQ ID NO: 2613844 - protein, 5 aa, Entamoeba histolytica
DTTLP

SEQ ID NO: 2613845 - protein, 12 aa, Entamoeba histolytica
DTTMGKGGNSFE

SEQ ID NO: 2613846 - protein, 15 aa, Entamoeba histolytica
DTTMTTEIEQKEKKS

SEQ ID NO: 2613847 - protein, 6 aa, Entamoeba histolytica
DTTNGF

SEQ ID NO: 2613848 - protein, 7 aa, Entamoeba histolytica
DTTNPSN

SEQ ID NO: 2613849 - protein, 21 aa, Entamoeba histolytica
DTTNTETDDQEQSYKTPSLPK

SEQ ID NO: 2613850 - protein, 5 aa, Entamoeba histolytica
DTTPS

SEQ ID NO: 2613851 - protein, 13 aa, Entamoeba histolytica
DTTSIHENNTTTH

SEQ ID NO: 2613852 - protein, 15 aa, Entamoeba histolytica
DTTSQTDLDESNRIQ

SEQ ID NO: 2613853 - protein, 8 aa, Entamoeba histolytica
DTTSSGRL

SEQ ID NO: 2613854 - protein, 4 aa, Entamoeba histolytica
DTTT

SEQ ID NO: 2613855 - protein, 10 aa, Entamoeba histolytica
DTTTKRSRGF

SEQ ID NO: 2613856 - protein, 18 aa, Entamoeba histolytica
DTTTNDSLEKQTDLEEQK

SEQ ID NO: 2613857 - protein, 11 aa, Entamoeba histolytica
DTTVDSTPSVH

SEQ ID NO: 2613858 - protein, 7 aa, Entamoeba histolytica
DTTVTNI

SEQ ID NO: 2613859 - protein, 6 aa, Entamoeba histolytica
DTTYKG

SEQ ID NO: 2613860 - protein, 5 aa, Entamoeba histolytica
DTVDG

SEQ ID NO: 2613861 - protein, 6 aa, Entamoeba histolytica
DTVGDK

SEQ ID NO: 2613862 - protein, 6 aa, Entamoeba histolytica
DTVNSQ

SEQ ID NO: 2613863 - protein, 6 aa, Entamoeba histolytica
DTVNTL

SEQ ID NO: 2613864 - protein, 4 aa, Entamoeba histolytica
DTVS

SEQ ID NO: 2613865 - protein, 8 aa, Entamoeba histolytica
DTYDDDQN

SEQ ID NO: 2613866 - protein, 7 aa, Entamoeba histolytica
DTYDDEQ

SEQ ID NO: 2613867 - protein, 4 aa, Entamoeba histolytica
DTYE

SEQ ID NO: 2613868 - protein, 5 aa, Entamoeba histolytica
DTYGE

SEQ ID NO: 2613869 - protein, 13 aa, Entamoeba histolytica
DTYKRIDNKRKEF

SEQ ID NO: 2613870 - protein, 16 aa, Entamoeba histolytica
DTYSSYDELEPSVQEN

SEQ ID NO: 2613871 - protein, 6 aa, Entamoeba histolytica
DTYTDT

SEQ ID NO: 2613872 - protein, 4 aa, Entamoeba histolytica
DVAP

SEQ ID NO: 2613873 - protein, 7 aa, Entamoeba histolytica
DVASGGN

SEQ ID NO: 2613874 - protein, 11 aa, Entamoeba histolytica
DVDEKEKRESK

SEQ ID NO: 2613875 - protein, 5 aa, Entamoeba histolytica
DVDEM

SEQ ID NO: 2613876 - protein, 6 aa, Entamoeba histolytica
DVDGES

SEQ ID NO: 2613877 - protein, 7 aa, Entamoeba histolytica
DVDGRGH

SEQ ID NO: 2613878 - protein, 9 aa, Entamoeba histolytica
DVDKDKREI

SEQ ID NO: 2613879 - protein, 7 aa, Entamoeba histolytica
DVDKQRS

SEQ ID NO: 2613880 - protein, 5 aa, Entamoeba histolytica
DVDPS

SEQ ID NO: 2613881 - protein, 5 aa, Entamoeba histolytica
DVDSD

SEQ ID NO: 2613882 - protein, 6 aa, Entamoeba histolytica
DVDTKQ

SEQ ID NO: 2613883 - protein, 5 aa, Entamoeba histolytica
DVDTT

SEQ ID NO: 2613884 - protein, 9 aa, Entamoeba histolytica
DVEEEQQTI

SEQ ID NO: 2613885 - protein, 13 aa, Entamoeba histolytica
DVEEGKEESSGVN

SEQ ID NO: 2613886 - protein, 77 aa, Entamoeba histolytica
DVEENTTEKKKKEDRKEKKERKRKVLEEEEEADGENKVSYKRKERVNEKKMEEEKKEDNIEEKKENHSIEQSDDVVS

SEQ ID NO: 2613887 - protein, 11 aa, Entamoeba histolytica
DVEFKGNNPMN

SEQ ID NO: 2613888 - protein, 7 aa, Entamoeba histolytica
DVEGDEF

SEQ ID NO: 2613889 - protein, 14 aa, Entamoeba histolytica
DVEHSNSSSTMTTH

SEQ ID NO: 2613890 - protein, 11 aa, Entamoeba histolytica
DVEKSLPPKKE

SEQ ID NO: 2613891 - protein, 9 aa, Entamoeba histolytica
DVENKGEEY

SEQ ID NO: 2613892 - protein, 21 aa, Entamoeba histolytica
DVENSKDESMTKKQKRFSSQL

SEQ ID NO: 2613893 - protein, 9 aa, Entamoeba histolytica
DVEPKYGSQ

SEQ ID NO: 2613894 - protein, 9 aa, Entamoeba histolytica
DVEPPEQKM

SEQ ID NO: 2613895 - protein, 6 aa, Entamoeba histolytica
DVEQQV

SEQ ID NO: 2613896 - protein, 20 aa, Entamoeba histolytica
DVEQVGENEWQTTIEDEHHS

SEQ ID NO: 2613897 - protein, 4 aa, Entamoeba histolytica
DVER

SEQ ID NO: 2613898 - protein, 5 aa, Entamoeba histolytica
DVESS

SEQ ID NO: 2613899 - protein, 6 aa, Entamoeba histolytica
DVGDND

SEQ ID NO: 2613900 - protein, 4 aa, Entamoeba histolytica
DVGG

SEQ ID NO: 2613901 - protein, 8 aa, Entamoeba histolytica
DVGKDKNL

SEQ ID NO: 2613902 - protein, 15 aa, Entamoeba histolytica
DVGKGCAESLRGQGA

SEQ ID NO: 2613903 - protein, 10 aa, Entamoeba histolytica
DVGKKDDENG

SEQ ID NO: 2613904 - protein, 10 aa, Entamoeba histolytica
DVGRPKSEVA

SEQ ID NO: 2613905 - protein, 10 aa, Entamoeba histolytica
DVGSDESEVG

SEQ ID NO: 2613906 - protein, 10 aa, Entamoeba histolytica
DVGSVRGNLE

SEQ ID NO: 2613907 - protein, 14 aa, Entamoeba histolytica
DVHEVKPKLPNSLQ

SEQ ID NO: 2613908 - protein, 10 aa, Entamoeba histolytica
DVIDANDEEC

SEQ ID NO: 2613909 - protein, 4 aa, Entamoeba histolytica
DVIG

SEQ ID NO: 2613910 - protein, 10 aa, Entamoeba histolytica
DVKDRKVKQR

SEQ ID NO: 2613911 - protein, 9 aa, Entamoeba histolytica
DVKDYSKGK

SEQ ID NO: 2613912 - protein, 10 aa, Entamoeba histolytica
DVKEADLQAQ

SEQ ID NO: 2613913 - protein, 10 aa, Entamoeba histolytica
DVKKGSKVTE

SEQ ID NO: 2613914 - protein, 17 aa, Entamoeba histolytica
DVKNGRPTDLIFEVIPK

SEQ ID NO: 2613915 - protein, 4 aa, Entamoeba histolytica
DVKP

SEQ ID NO: 2613916 - protein, 11 aa, Entamoeba histolytica
DVKPYSEKAQQ

SEQ ID NO: 2613917 - protein, 7 aa, Entamoeba histolytica
DVKSTAI

SEQ ID NO: 2613918 - protein, 19 aa, Entamoeba histolytica
DVKTTGGRLGPVEGEYPEL

SEQ ID NO: 2613919 - protein, 5 aa, Entamoeba histolytica
DVLPT

SEQ ID NO: 2613920 - protein, 10 aa, Entamoeba histolytica
DVNDEDATGR

SEQ ID NO: 2613921 - protein, 10 aa, Entamoeba histolytica
DVNDPYASAY

SEQ ID NO: 2613922 - protein, 6 aa, Entamoeba histolytica
DVNEFQ

SEQ ID NO: 2613923 - protein, 10 aa, Entamoeba histolytica
DVNEKCTKSY

SEQ ID NO: 2613924 - protein, 6 aa, Entamoeba histolytica
DVNKTA

SEQ ID NO: 2613925 - protein, 5 aa, Entamoeba histolytica
DVNSA

SEQ ID NO: 2613926 - protein, 12 aa, Entamoeba histolytica
DVNTEDNNGYSI

SEQ ID NO: 2613927 - protein, 5 aa, Entamoeba histolytica
DVNTF

SEQ ID NO: 2613928 - protein, 7 aa, Entamoeba histolytica
DVPDAKT

SEQ ID NO: 2613929 - protein, 5 aa, Entamoeba histolytica
DVPID

SEQ ID NO: 2613930 - protein, 6 aa, Entamoeba histolytica
DVPKGL

SEQ ID NO: 2613931 - protein, 5 aa, Entamoeba histolytica
DVPNA

SEQ ID NO: 2613932 - protein, 6 aa, Entamoeba histolytica
DVPPIP

SEQ ID NO: 2613933 - protein, 14 aa, Entamoeba histolytica
DVPPPLPEKRLSQS

SEQ ID NO: 2613934 - protein, 7 aa, Entamoeba histolytica
DVPPWDY

SEQ ID NO: 2613935 - protein, 12 aa, Entamoeba histolytica
DVPSEDGKSHEK

SEQ ID NO: 2613936 - protein, 8 aa, Entamoeba histolytica
DVPSIQGS

SEQ ID NO: 2613937 - protein, 4 aa, Entamoeba histolytica
DVPT

SEQ ID NO: 2613938 - protein, 6 aa, Entamoeba histolytica
DVPTND

SEQ ID NO: 2613939 - protein, 4 aa, Entamoeba histolytica
DVQE

SEQ ID NO: 2613940 - protein, 15 aa, Entamoeba histolytica
DVQEQYKNAKTGEEV

SEQ ID NO: 2613941 - protein, 9 aa, Entamoeba histolytica
DVQKELPPK

SEQ ID NO: 2613942 - protein, 18 aa, Entamoeba histolytica
DVQQPSWVNDPSTDSVHN

SEQ ID NO: 2613943 - protein, 36 aa, Entamoeba histolytica
DVRKRKDAISSRASQIDTINKEPSGDDKLSVPPQME

SEQ ID NO: 2613944 - protein, 13 aa, Entamoeba histolytica
DVRNKLKAKDPVK

SEQ ID NO: 2613945 - protein, 11 aa, Entamoeba histolytica
DVSAHSSKSVE

SEQ ID NO: 2613946 - protein, 7 aa, Entamoeba histolytica
DVSDDCK

SEQ ID NO: 2613947 - protein, 9 aa, Entamoeba histolytica
DVSEKIKTN

SEQ ID NO: 2613948 - protein, 27 aa, Entamoeba histolytica
DVSEPSTTTSFLGSPNNSTIPGNSLTN

SEQ ID NO: 2613949 - protein, 5 aa, Entamoeba histolytica
DVSET

SEQ ID NO: 2613950 - protein, 10 aa, Entamoeba histolytica
DVSGTSVDED

SEQ ID NO: 2613951 - protein, 4 aa, Entamoeba histolytica
DVSK

SEQ ID NO: 2613952 - protein, 4 aa, Entamoeba histolytica
DVSR

SEQ ID NO: 2613953 - protein, 8 aa, Entamoeba histolytica
DVSSKSDG

SEQ ID NO: 2613954 - protein, 4 aa, Entamoeba histolytica
DVSV

SEQ ID NO: 2613955 - protein, 5 aa, Entamoeba histolytica
DVSVQ

SEQ ID NO: 2613956 - protein, 4 aa, Entamoeba histolytica
DVSY

SEQ ID NO: 2613957 - protein, 8 aa, Entamoeba histolytica
DVTNQREK

SEQ ID NO: 2613958 - protein, 11 aa, Entamoeba histolytica
DVTNSLTKEHE

SEQ ID NO: 2613959 - protein, 6 aa, Entamoeba histolytica
DVTPEI

SEQ ID NO: 2613960 - protein, 10 aa, Entamoeba histolytica
DVTPSADLTQ

SEQ ID NO: 2613961 - protein, 10 aa, Entamoeba histolytica
DVTQKDNLED

SEQ ID NO: 2613962 - protein, 5 aa, Entamoeba histolytica
DVTTR

SEQ ID NO: 2613963 - protein, 7 aa, Entamoeba histolytica
DVTTTDK

SEQ ID NO: 2613964 - protein, 7 aa, Entamoeba histolytica
DVTTTNK

SEQ ID NO: 2613965 - protein, 8 aa, Entamoeba histolytica
DVYDPKEV

SEQ ID NO: 2613966 - protein, 10 aa, Entamoeba histolytica
DVYGDEEKSI

SEQ ID NO: 2613967 - protein, 8 aa, Entamoeba histolytica
DVYGNENV

SEQ ID NO: 2613968 - protein, 10 aa, Entamoeba histolytica
DWEAEKRDEM

SEQ ID NO: 2613969 - protein, 12 aa, Entamoeba histolytica
DWEKEKATHEKE

SEQ ID NO: 2613970 - protein, 5 aa, Entamoeba histolytica
DWGAD

SEQ ID NO: 2613971 - protein, 15 aa, Entamoeba histolytica
DWGTGNDVDITPSQG

SEQ ID NO: 2613972 - protein, 8 aa, Entamoeba histolytica
DWKPTTSI

SEQ ID NO: 2613973 - protein, 9 aa, Entamoeba histolytica
DWNPQSDIQ

SEQ ID NO: 2613974 - protein, 4 aa, Entamoeba histolytica
DWPT

SEQ ID NO: 2613975 - protein, 7 aa, Entamoeba histolytica
DWQESTR

SEQ ID NO: 2613976 - protein, 12 aa, Entamoeba histolytica
DWRDEDKKGYWG

SEQ ID NO: 2613977 - protein, 6 aa, Entamoeba histolytica
DWVPQR

SEQ ID NO: 2613978 - protein, 5 aa, Entamoeba histolytica
DWYES

SEQ ID NO: 2613979 - protein, 5 aa, Entamoeba histolytica
DYAAQ

SEQ ID NO: 2613980 - protein, 13 aa, Entamoeba histolytica
DYASRPDKISGAE

SEQ ID NO: 2613981 - protein, 8 aa, Entamoeba histolytica
DYATPNDI

SEQ ID NO: 2613982 - protein, 7 aa, Entamoeba histolytica
DYCEDDG

SEQ ID NO: 2613983 - protein, 6 aa, Entamoeba histolytica
DYDEEE

SEQ ID NO: 2613984 - protein, 13 aa, Entamoeba histolytica
DYDEFKDKSRTEI

SEQ ID NO: 2613985 - protein, 31 aa, Entamoeba histolytica
DYDEKKNECDYDYDEKKIEEEKSRKEDGAIK

SEQ ID NO: 2613986 - protein, 6 aa, Entamoeba histolytica
DYDGKI

SEQ ID NO: 2613987 - protein, 12 aa, Entamoeba histolytica
DYDPEEEEHKEK

SEQ ID NO: 2613988 - protein, 8 aa, Entamoeba histolytica
DYDPKEKA

SEQ ID NO: 2613989 - protein, 6 aa, Entamoeba histolytica
DYDTNE

SEQ ID NO: 2613990 - protein, 4 aa, Entamoeba histolytica
DYDY

SEQ ID NO: 2613991 - protein, 5 aa, Entamoeba histolytica
DYEDN

SEQ ID NO: 2613992 - protein, 7 aa, Entamoeba histolytica
DYEDVQN

SEQ ID NO: 2613993 - protein, 11 aa, Entamoeba histolytica
DYEEDEEQTED

SEQ ID NO: 2613994 - protein, 21 aa, Entamoeba histolytica
DYEEKEEKGKTIEETKSSITY

SEQ ID NO: 2613995 - protein, 5 aa, Entamoeba histolytica
DYEGA

SEQ ID NO: 2613996 - protein, 7 aa, Entamoeba histolytica
DYEGNKI

SEQ ID NO: 2613997 - protein, 7 aa, Entamoeba histolytica
DYEGSRI

SEQ ID NO: 2613998 - protein, 45 aa, Entamoeba histolytica
DYEIKKKPHNTNSTKEVEKLENENENQKRKSQKKKITKKSSLKIE

SEQ ID NO: 2613999 - protein, 8 aa, Entamoeba histolytica
DYEKNGNK

SEQ ID NO: 2614000 - protein, 9 aa, Entamoeba histolytica
DYEKQLQRE

SEQ ID NO: 2614001 - protein, 16 aa, Entamoeba histolytica
DYEQLTEDDKAYNEHE

SEQ ID NO: 2614002 - protein, 6 aa, Entamoeba histolytica
DYETTD

SEQ ID NO: 2614003 - protein, 4 aa, Entamoeba histolytica
DYFE

SEQ ID NO: 2614004 - protein, 15 aa, Entamoeba histolytica
DYFQNKSNESQETSY

SEQ ID NO: 2614005 - protein, 9 aa, Entamoeba histolytica
DYGDENEPI

SEQ ID NO: 2614006 - protein, 10 aa, Entamoeba histolytica
DYGDGKHPKW

SEQ ID NO: 2614007 - protein, 9 aa, Entamoeba histolytica
DYGGESNMK

SEQ ID NO: 2614008 - protein, 13 aa, Entamoeba histolytica
DYGNTCNSSLGEA

SEQ ID NO: 2614009 - protein, 6 aa, Entamoeba histolytica
DYHDKD

SEQ ID NO: 2614010 - protein, 8 aa, Entamoeba histolytica
DYHEELPN

SEQ ID NO: 2614011 - protein, 29 aa, Entamoeba histolytica
DYKANNGNKPVPQQGGMLGGQQNGFGQQQ

SEQ ID NO: 2614012 - protein, 10 aa, Entamoeba histolytica
DYKEKEIQRI

SEQ ID NO: 2614013 - protein, 7 aa, Entamoeba histolytica
DYKGTVP

SEQ ID NO: 2614014 - protein, 4 aa, Entamoeba histolytica
DYKK

SEQ ID NO: 2614015 - protein, 10 aa, Entamoeba histolytica
DYKKAQTKQI

SEQ ID NO: 2614016 - protein, 7 aa, Entamoeba histolytica
DYKNEAL

SEQ ID NO: 2614017 - protein, 13 aa, Entamoeba histolytica
DYKQSNGKGYRSA

SEQ ID NO: 2614018 - protein, 4 aa, Entamoeba histolytica
DYKT

SEQ ID NO: 2614019 - protein, 17 aa, Entamoeba histolytica
DYLKKQKQQSRTQEAAL

SEQ ID NO: 2614020 - protein, 4 aa, Entamoeba histolytica
DYNE

SEQ ID NO: 2614021 - protein, 10 aa, Entamoeba histolytica
DYNGALQTRT

SEQ ID NO: 2614022 - protein, 13 aa, Entamoeba histolytica
DYNGDPIKEGGAK

SEQ ID NO: 2614023 - protein, 7 aa, Entamoeba histolytica
DYNKNVE

SEQ ID NO: 2614024 - protein, 6 aa, Entamoeba histolytica
DYNLTQ

SEQ ID NO: 2614025 - protein, 7 aa, Entamoeba histolytica
DYNMPKE

SEQ ID NO: 2614026 - protein, 7 aa, Entamoeba histolytica
DYNNERI

SEQ ID NO: 2614027 - protein, 6 aa, Entamoeba histolytica
DYNRLE

SEQ ID NO: 2614028 - protein, 6 aa, Entamoeba histolytica
DYNSED

SEQ ID NO: 2614029 - protein, 8 aa, Entamoeba histolytica
DYNTRDGT

SEQ ID NO: 2614030 - protein, 10 aa, Entamoeba histolytica
DYNTTTEYSD

SEQ ID NO: 2614031 - protein, 13 aa, Entamoeba histolytica
DYPLPESGNERRI

SEQ ID NO: 2614032 - protein, 9 aa, Entamoeba histolytica
DYPNNPPKV

SEQ ID NO: 2614033 - protein, 64 aa, Entamoeba histolytica
DYPNRNDNGSRNRSHSRHRKESHHYQKSYDRYNQRYSQPQKRQSSIQLKPNKPLPSSKKSEKIV

SEQ ID NO: 2614034 - protein, 8 aa, Entamoeba histolytica
DYPPFPST

SEQ ID NO: 2614035 - protein, 8 aa, Entamoeba histolytica
DYQKGSFE

SEQ ID NO: 2614036 - protein, 5 aa, Entamoeba histolytica
DYQTC

SEQ ID NO: 2614037 - protein, 10 aa, Entamoeba histolytica
DYQTKSCNEV

SEQ ID NO: 2614038 - protein, 32 aa, Entamoeba histolytica
DYRKRTNDMLPKKSLKSSSYAQTHPIGPQGPI

SEQ ID NO: 2614039 - protein, 5 aa, Entamoeba histolytica
DYRKT

SEQ ID NO: 2614040 - protein, 11 aa, Entamoeba histolytica
DYSAQETNELT

SEQ ID NO: 2614041 - protein, 5 aa, Entamoeba histolytica
DYSEE

SEQ ID NO: 2614042 - protein, 4 aa, Entamoeba histolytica
DYSP

SEQ ID NO: 2614043 - protein, 13 aa, Entamoeba histolytica
DYSPETKEKHSRL

SEQ ID NO: 2614044 - protein, 11 aa, Entamoeba histolytica
DYSPSYSGRGD

SEQ ID NO: 2614045 - protein, 7 aa, Entamoeba histolytica
DYSRALD

SEQ ID NO: 2614046 - protein, 10 aa, Entamoeba histolytica
DYTEDKIEEI

SEQ ID NO: 2614047 - protein, 7 aa, Entamoeba histolytica
DYTEEEL

SEQ ID NO: 2614048 - protein, 10 aa, Entamoeba histolytica
DYTKNKNETI

SEQ ID NO: 2614049 - protein, 8 aa, Entamoeba histolytica
DYTKRPNI

SEQ ID NO: 2614050 - protein, 10 aa, Entamoeba histolytica
DYTQKLSSEL

SEQ ID NO: 2614051 - protein, 7 aa, Entamoeba histolytica
DYTQSKI

SEQ ID NO: 2614052 - protein, 8 aa, Entamoeba histolytica
DYTQTKEL

SEQ ID NO: 2614053 - protein, 12 aa, Entamoeba histolytica
DYTSKNENLKSM

SEQ ID NO: 2614054 - protein, 7 aa, Entamoeba histolytica
DYTSTAG

SEQ ID NO: 2614055 - protein, 24 aa, Entamoeba histolytica
DYVDKKDNELEISSEEEDDEEEER

SEQ ID NO: 2614056 - protein, 36 aa, Entamoeba histolytica
DYVPEEQSHKEQDQKSKQTSTRTSQRKPKAQQGQMS

SEQ ID NO: 2614057 - protein, 11 aa, Entamoeba histolytica
DYVREKKEPLS

SEQ ID NO: 2614058 - protein, 7 aa, Entamoeba histolytica
DYYDNDK

SEQ ID NO: 2614059 - protein, 5 aa, Entamoeba histolytica
DYYET

SEQ ID NO: 2614060 - protein, 6 aa, Entamoeba histolytica
DYYSKS

SEQ ID NO: 2614061 - protein, 8 aa, Entamoeba histolytica
EAAAQDEL

SEQ ID NO: 2614062 - protein, 4 aa, Entamoeba histolytica
EAAE

SEQ ID NO: 2614063 - protein, 10 aa, Entamoeba histolytica
EAAECRTDAE

SEQ ID NO: 2614064 - protein, 7 aa, Entamoeba histolytica
EAAEFNK

SEQ ID NO: 2614065 - protein, 7 aa, Entamoeba histolytica
EAAEITN

SEQ ID NO: 2614066 - protein, 16 aa, Entamoeba histolytica
EAAEKAKKEALPSGPI

SEQ ID NO: 2614067 - protein, 19 aa, Entamoeba histolytica
EAAGYESVDDAIKNHAERI

SEQ ID NO: 2614068 - protein, 37 aa, Entamoeba histolytica
EAAKEKEQKELKAQGKVSISKQEKPVDLVGEEDEDII

SEQ ID NO: 2614069 - protein, 11 aa, Entamoeba histolytica
EAAKKTEGKKA

SEQ ID NO: 2614070 - protein, 8 aa, Entamoeba histolytica
EAAKQSGF

SEQ ID NO: 2614071 - protein, 16 aa, Entamoeba histolytica
EAAQPEEQHHEEEHPL

SEQ ID NO: 2614072 - protein, 8 aa, Entamoeba histolytica
EAASKNIS

SEQ ID NO: 2614073 - protein, 8 aa, Entamoeba histolytica
EACDKNQL

SEQ ID NO: 2614074 - protein, 4 aa, Entamoeba histolytica
EACG

SEQ ID NO: 2614075 - protein, 16 aa, Entamoeba histolytica
EACQKKNETENAAELD

SEQ ID NO: 2614076 - protein, 4 aa, Entamoeba histolytica
EADA

SEQ ID NO: 2614077 - protein, 6 aa, Entamoeba histolytica
EADDPE

SEQ ID NO: 2614078 - protein, 7 aa, Entamoeba histolytica
EADDSKL

SEQ ID NO: 2614079 - protein, 5 aa, Entamoeba histolytica
EADEE

SEQ ID NO: 2614080 - protein, 16 aa, Entamoeba histolytica
EADEEAETKCYITTIS

SEQ ID NO: 2614081 - protein, 7 aa, Entamoeba histolytica
EADGQMK

SEQ ID NO: 2614082 - protein, 11 aa, Entamoeba histolytica
EADKDRDGKIS

SEQ ID NO: 2614083 - protein, 7 aa, Entamoeba histolytica
EADKTYK

SEQ ID NO: 2614084 - protein, 8 aa, Entamoeba histolytica
EADNNQGF

SEQ ID NO: 2614085 - protein, 6 aa, Entamoeba histolytica
EADNVS

SEQ ID NO: 2614086 - protein, 5 aa, Entamoeba histolytica
EADPQ

SEQ ID NO: 2614087 - protein, 5 aa, Entamoeba histolytica
EADRC

SEQ ID NO: 2614088 - protein, 12 aa, Entamoeba histolytica
EADRQKRESEHL

SEQ ID NO: 2614089 - protein, 9 aa, Entamoeba histolytica
EAEAATAAV

SEQ ID NO: 2614090 - protein, 13 aa, Entamoeba histolytica
EAEAYAKEMSTEK

SEQ ID NO: 2614091 - protein, 6 aa, Entamoeba histolytica
EAEERN

SEQ ID NO: 2614092 - protein, 11 aa, Entamoeba histolytica
EAEGNEDASSS

SEQ ID NO: 2614093 - protein, 15 aa, Entamoeba histolytica
EAEGPEEMSVKRGDT

SEQ ID NO: 2614094 - protein, 13 aa, Entamoeba histolytica
EAEKAAQPEDQKM

SEQ ID NO: 2614095 - protein, 10 aa, Entamoeba histolytica
EAEKAKQNLE

SEQ ID NO: 2614096 - protein, 12 aa, Entamoeba histolytica
EAEKCTDNLSDE

SEQ ID NO: 2614097 - protein, 17 aa, Entamoeba histolytica
EAEKDKFINSKPTFKEN

SEQ ID NO: 2614098 - protein, 11 aa, Entamoeba histolytica
EAEKIGSIPSS

SEQ ID NO: 2614099 - protein, 5 aa, Entamoeba histolytica
EAELS

SEQ ID NO: 2614100 - protein, 4 aa, Entamoeba histolytica
EAEM

SEQ ID NO: 2614101 - protein, 12 aa, Entamoeba histolytica
EAENAPKSYTKT

SEQ ID NO: 2614102 - protein, 15 aa, Entamoeba histolytica
EAENASTKANENKKK

SEQ ID NO: 2614103 - protein, 7 aa, Entamoeba histolytica
EAENEFE

SEQ ID NO: 2614104 - protein, 8 aa, Entamoeba histolytica
EAENYSGA

SEQ ID NO: 2614105 - protein, 8 aa, Entamoeba histolytica
EAENYSNW

SEQ ID NO: 2614106 - protein, 8 aa, Entamoeba histolytica
EAEPQYIK

SEQ ID NO: 2614107 - protein, 4 aa, Entamoeba histolytica
EAER

SEQ ID NO: 2614108 - protein, 6 aa, Entamoeba histolytica
EAERAT

SEQ ID NO: 2614109 - protein, 20 aa, Entamoeba histolytica
EAERIEQEKIRKAKEEEERI

SEQ ID NO: 2614110 - protein, 6 aa, Entamoeba histolytica
EAESQG

SEQ ID NO: 2614111 - protein, 7 aa, Entamoeba histolytica
EAESYNG

SEQ ID NO: 2614112 - protein, 7 aa, Entamoeba histolytica
EAFNNGD

SEQ ID NO: 2614113 - protein, 6 aa, Entamoeba histolytica
EAFPPI

SEQ ID NO: 2614114 - protein, 4 aa, Entamoeba histolytica
EAGG

SEQ ID NO: 2614115 - protein, 6 aa, Entamoeba histolytica
EAGGRN

SEQ ID NO: 2614116 - protein, 12 aa, Entamoeba histolytica
EAGIGGGNKSSG

SEQ ID NO: 2614117 - protein, 8 aa, Entamoeba histolytica
EAGKDAEN

SEQ ID NO: 2614118 - protein, 6 aa, Entamoeba histolytica
EAGKKI

SEQ ID NO: 2614119 - protein, 10 aa, Entamoeba histolytica
EAGKVENEGK

SEQ ID NO: 2614120 - protein, 10 aa, Entamoeba histolytica
EAGNVPEDIG

SEQ ID NO: 2614121 - protein, 9 aa, Entamoeba histolytica
EAGPHPNSE

SEQ ID NO: 2614122 - protein, 13 aa, Entamoeba histolytica
EAGPRIEKVSKEE

SEQ ID NO: 2614123 - protein, 5 aa, Entamoeba histolytica
EAGRG

SEQ ID NO: 2614124 - protein, 7 aa, Entamoeba histolytica
EAGRSTI

SEQ ID NO: 2614125 - protein, 5 aa, Entamoeba histolytica
EAGSN

SEQ ID NO: 2614126 - protein, 9 aa, Entamoeba histolytica
EAGTPVGAL

SEQ ID NO: 2614127 - protein, 7 aa, Entamoeba histolytica
EAHENRN

SEQ ID NO: 2614128 - protein, 6 aa, Entamoeba histolytica
EAHKNG

SEQ ID NO: 2614129 - protein, 6 aa, Entamoeba histolytica
EAHPEG

SEQ ID NO: 2614130 - protein, 12 aa, Entamoeba histolytica
EAHRSHGAAATR

SEQ ID NO: 2614131 - protein, 44 aa, Entamoeba histolytica
EAIAKEKDAKKKKELEEAKKKVQESIAEAKKATKKALDTNNDED

SEQ ID NO: 2614132 - protein, 6 aa, Entamoeba histolytica
EAIDKR

SEQ ID NO: 2614133 - protein, 6 aa, Entamoeba histolytica
EAIDSS

SEQ ID NO: 2614134 - protein, 9 aa, Entamoeba histolytica
EAIDSVTKN

SEQ ID NO: 2614135 - protein, 7 aa, Entamoeba histolytica
EAIKGTY

SEQ ID NO: 2614136 - protein, 7 aa, Entamoeba histolytica
EAINKSH

SEQ ID NO: 2614137 - protein, 10 aa, Entamoeba histolytica
EAINSQTTEL

SEQ ID NO: 2614138 - protein, 6 aa, Entamoeba histolytica
EAIPES

SEQ ID NO: 2614139 - protein, 5 aa, Entamoeba histolytica
EAIPS

SEQ ID NO: 2614140 - protein, 6 aa, Entamoeba histolytica
EAIQNY

SEQ ID NO: 2614141 - protein, 6 aa, Entamoeba histolytica
EAKATL

SEQ ID NO: 2614142 - protein, 4 aa, Entamoeba histolytica
EAKD

SEQ ID NO: 2614143 - protein, 5 aa, Entamoeba histolytica
EAKEE

SEQ ID NO: 2614144 - protein, 9 aa, Entamoeba histolytica
EAKEIAQKQ

SEQ ID NO: 2614145 - protein, 11 aa, Entamoeba histolytica
EAKEKDQNDID

SEQ ID NO: 2614146 - protein, 20 aa, Entamoeba histolytica
EAKEKEENEKNRLKEINEQK

SEQ ID NO: 2614147 - protein, 7 aa, Entamoeba histolytica
EAKESNE

SEQ ID NO: 2614148 - protein, 8 aa, Entamoeba histolytica
EAKGSDNQ

SEQ ID NO: 2614149 - protein, 11 aa, Entamoeba histolytica
EAKIKEEQTKE

SEQ ID NO: 2614150 - protein, 6 aa, Entamoeba histolytica
EAKIPD

SEQ ID NO: 2614151 - protein, 10 aa, Entamoeba histolytica
EAKKENENLK

SEQ ID NO: 2614152 - protein, 10 aa, Entamoeba histolytica
EAKKLNRSNV

SEQ ID NO: 2614153 - protein, 5 aa, Entamoeba histolytica
EAKKP

SEQ ID NO: 2614154 - protein, 7 aa, Entamoeba histolytica
EAKKRCK

SEQ ID NO: 2614155 - protein, 8 aa, Entamoeba histolytica
EAKNGTID

SEQ ID NO: 2614156 - protein, 9 aa, Entamoeba histolytica
EAKPPTPGM

SEQ ID NO: 2614157 - protein, 12 aa, Entamoeba histolytica
EAKQERGQSTVQ

SEQ ID NO: 2614158 - protein, 9 aa, Entamoeba histolytica
EAKQGSVTE

SEQ ID NO: 2614159 - protein, 26 aa, Entamoeba histolytica
EAKQIQGERKLKKDFNAGKKPEMKKA

SEQ ID NO: 2614160 - protein, 13 aa, Entamoeba histolytica
EAKQWTNDQVYHM

SEQ ID NO: 2614161 - protein, 9 aa, Entamoeba histolytica
EAKSAKNGV

SEQ ID NO: 2614162 - protein, 8 aa, Entamoeba histolytica
EAKSLPKI

SEQ ID NO: 2614163 - protein, 11 aa, Entamoeba histolytica
EAKTKKNWLSD

SEQ ID NO: 2614164 - protein, 7 aa, Entamoeba histolytica
EAKTPMR

SEQ ID NO: 2614165 - protein, 5 aa, Entamoeba histolytica
EAKYR

SEQ ID NO: 2614166 - protein, 6 aa, Entamoeba histolytica
EALNPS

SEQ ID NO: 2614167 - protein, 7 aa, Entamoeba histolytica
EALPKDN

SEQ ID NO: 2614168 - protein, 13 aa, Entamoeba histolytica
EALQGSKAKLEGF

SEQ ID NO: 2614169 - protein, 20 aa, Entamoeba histolytica
EALTKEKEDFQKGAGNRQIE

SEQ ID NO: 2614170 - protein, 6 aa, Entamoeba histolytica
EAMDQS

SEQ ID NO: 2614171 - protein, 27 aa, Entamoeba histolytica
EAMDSTTKKKKKTPEEMRAEGLKRKAE

SEQ ID NO: 2614172 - protein, 8 aa, Entamoeba histolytica
EAMSTKGK

SEQ ID NO: 2614173 - protein, 6 aa, Entamoeba histolytica
EAMTPP

SEQ ID NO: 2614174 - protein, 6 aa, Entamoeba histolytica
EANDAG

SEQ ID NO: 2614175 - protein, 8 aa, Entamoeba histolytica
EANDEQHL

SEQ ID NO: 2614176 - protein, 6 aa, Entamoeba histolytica
EANDES

SEQ ID NO: 2614177 - protein, 25 aa, Entamoeba histolytica
EANDNQENMKEQINQPNLSSTTEHS

SEQ ID NO: 2614178 - protein, 4 aa, Entamoeba histolytica
EANE

SEQ ID NO: 2614179 - protein, 6 aa, Entamoeba histolytica
EANERR

SEQ ID NO: 2614180 - protein, 10 aa, Entamoeba histolytica
EANESDKSSQ

SEQ ID NO: 2614181 - protein, 5 aa, Entamoeba histolytica
EANGM

SEQ ID NO: 2614182 - protein, 7 aa, Entamoeba histolytica
EANIGRS

SEQ ID NO: 2614183 - protein, 7 aa, Entamoeba histolytica
EANKISR

SEQ ID NO: 2614184 - protein, 7 aa, Entamoeba histolytica
EANNEQN

SEQ ID NO: 2614185 - protein, 11 aa, Entamoeba histolytica
EANNRNNPNNL

SEQ ID NO: 2614186 - protein, 10 aa, Entamoeba histolytica
EANNSISMGQ

SEQ ID NO: 2614187 - protein, 12 aa, Entamoeba histolytica
EANNTLGHPEPT

SEQ ID NO: 2614188 - protein, 8 aa, Entamoeba histolytica
EANPDAFN

SEQ ID NO: 2614189 - protein, 9 aa, Entamoeba histolytica
EANPKTRIP

SEQ ID NO: 2614190 - protein, 9 aa, Entamoeba histolytica
EANPTHETC

SEQ ID NO: 2614191 - protein, 5 aa, Entamoeba histolytica
EANQD

SEQ ID NO: 2614192 - protein, 6 aa, Entamoeba histolytica
EANQEL

SEQ ID NO: 2614193 - protein, 7 aa, Entamoeba histolytica
EANQMVG

SEQ ID NO: 2614194 - protein, 8 aa, Entamoeba histolytica
EANQPNTA

SEQ ID NO: 2614195 - protein, 8 aa, Entamoeba histolytica
EANRGRQA

SEQ ID NO: 2614196 - protein, 9 aa, Entamoeba histolytica
EAPADRQYS

SEQ ID NO: 2614197 - protein, 12 aa, Entamoeba histolytica
EAPEPNEEAKNE

SEQ ID NO: 2614198 - protein, 7 aa, Entamoeba histolytica
EAPEVVG

SEQ ID NO: 2614199 - protein, 6 aa, Entamoeba histolytica
EAPKDC

SEQ ID NO: 2614200 - protein, 10 aa, Entamoeba histolytica
EAPKEPQKKW

SEQ ID NO: 2614201 - protein, 11 aa, Entamoeba histolytica
EAPKKMSTSEA

SEQ ID NO: 2614202 - protein, 21 aa, Entamoeba histolytica
EAPLQSKISPSQSKKETPSLM

SEQ ID NO: 2614203 - protein, 12 aa, Entamoeba histolytica
EAPNDNNSPPIG

SEQ ID NO: 2614204 - protein, 9 aa, Entamoeba histolytica
EAPPQEPNL

SEQ ID NO: 2614205 - protein, 5 aa, Entamoeba histolytica
EAPQT

SEQ ID NO: 2614206 - protein, 6 aa, Entamoeba histolytica
EAPTPT

SEQ ID NO: 2614207 - protein, 6 aa, Entamoeba histolytica
EAQAKY

SEQ ID NO: 2614208 - protein, 13 aa, Entamoeba histolytica
EAQANERKEDIRK

SEQ ID NO: 2614209 - protein, 8 aa, Entamoeba histolytica
EAQEETNT

SEQ ID NO: 2614210 - protein, 6 aa, Entamoeba histolytica
EAQGRK

SEQ ID NO: 2614211 - protein, 22 aa, Entamoeba histolytica
EAQKTQKDNANEVEKRRDNTEL

SEQ ID NO: 2614212 - protein, 9 aa, Entamoeba histolytica
EAQNKNLET

SEQ ID NO: 2614213 - protein, 9 aa, Entamoeba histolytica
EAQSEPNVN

SEQ ID NO: 2614214 - protein, 15 aa, Entamoeba histolytica
EAQTSKRNRRQKATM

SEQ ID NO: 2614215 - protein, 4 aa, Entamoeba histolytica
EARA

SEQ ID NO: 2614216 - protein, 13 aa, Entamoeba histolytica
EARDNQTPSYTRP

SEQ ID NO: 2614217 - protein, 8 aa, Entamoeba histolytica
EARGRIEE

SEQ ID NO: 2614218 - protein, 14 aa, Entamoeba histolytica
EARKISKEDKLGCK

SEQ ID NO: 2614219 - protein, 17 aa, Entamoeba histolytica
EARNTTGIANELSKEQI

SEQ ID NO: 2614220 - protein, 8 aa, Entamoeba histolytica
EARRRIKE

SEQ ID NO: 2614221 - protein, 13 aa, Entamoeba histolytica
EARSDSEKMLNEE

SEQ ID NO: 2614222 - protein, 5 aa, Entamoeba histolytica
EARTI

SEQ ID NO: 2614223 - protein, 10 aa, Entamoeba histolytica
EASDDDIKKA

SEQ ID NO: 2614224 - protein, 8 aa, Entamoeba histolytica
EASDYAAD

SEQ ID NO: 2614225 - protein, 7 aa, Entamoeba histolytica
EASEVSS

SEQ ID NO: 2614226 - protein, 5 aa, Entamoeba histolytica
EASGC

SEQ ID NO: 2614227 - protein, 8 aa, Entamoeba histolytica
EASKAKVA

SEQ ID NO: 2614228 - protein, 7 aa, Entamoeba histolytica
EASKHCK

SEQ ID NO: 2614229 - protein, 11 aa, Entamoeba histolytica
EASKKPLENEY

SEQ ID NO: 2614230 - protein, 4 aa, Entamoeba histolytica
EASL

SEQ ID NO: 2614231 - protein, 13 aa, Entamoeba histolytica
EASMTKHCNLLGR

SEQ ID NO: 2614232 - protein, 9 aa, Entamoeba histolytica
EASNPGNVD

SEQ ID NO: 2614233 - protein, 5 aa, Entamoeba histolytica
EASNR

SEQ ID NO: 2614234 - protein, 12 aa, Entamoeba histolytica
EASRANKEDKLS

SEQ ID NO: 2614235 - protein, 7 aa, Entamoeba histolytica
EASRRDQ

SEQ ID NO: 2614236 - protein, 8 aa, Entamoeba histolytica
EASSPEEY

SEQ ID NO: 2614237 - protein, 19 aa, Entamoeba histolytica
EASVRKAQKSGGDGESPAG

SEQ ID NO: 2614238 - protein, 6 aa, Entamoeba histolytica
EASYGN

SEQ ID NO: 2614239 - protein, 6 aa, Entamoeba histolytica
EASYSI

SEQ ID NO: 2614240 - protein, 6 aa, Entamoeba histolytica
EATAAG

SEQ ID NO: 2614241 - protein, 5 aa, Entamoeba histolytica
EATAK

SEQ ID NO: 2614242 - protein, 49 aa, Entamoeba histolytica
EATAPTEEKKEETPVEEEKKEETPIEEEKKEVPTEEEKKEETPVEEQKT

SEQ ID NO: 2614243 - protein, 6 aa, Entamoeba histolytica
EATCPT

SEQ ID NO: 2614244 - protein, 6 aa, Entamoeba histolytica
EATENV

SEQ ID NO: 2614245 - protein, 7 aa, Entamoeba histolytica
EATGNSE

SEQ ID NO: 2614246 - protein, 10 aa, Entamoeba histolytica
EATGQPSAED

SEQ ID NO: 2614247 - protein, 11 aa, Entamoeba histolytica
EATGRRNQKVQ

SEQ ID NO: 2614248 - protein, 4 aa, Entamoeba histolytica
EATI

SEQ ID NO: 2614249 - protein, 12 aa, Entamoeba histolytica
EATINEASKMSN

SEQ ID NO: 2614250 - protein, 5 aa, Entamoeba histolytica
EATKN

SEQ ID NO: 2614251 - protein, 20 aa, Entamoeba histolytica
EATKPKKNDLPIPNSATQRK

SEQ ID NO: 2614252 - protein, 6 aa, Entamoeba histolytica
EATKTY

SEQ ID NO: 2614253 - protein, 9 aa, Entamoeba histolytica
EATNDSEIK

SEQ ID NO: 2614254 - protein, 5 aa, Entamoeba histolytica
EATPY

SEQ ID NO: 2614255 - protein, 8 aa, Entamoeba histolytica
EATQKEGS

SEQ ID NO: 2614256 - protein, 12 aa, Entamoeba histolytica
EATQQYVKDNYN

SEQ ID NO: 2614257 - protein, 17 aa, Entamoeba histolytica
EATREVQTSDGQSFADQ

SEQ ID NO: 2614258 - protein, 7 aa, Entamoeba histolytica
EATRNRT

SEQ ID NO: 2614259 - protein, 18 aa, Entamoeba histolytica
EATSNENLSQSYQGWCPY

SEQ ID NO: 2614260 - protein, 6 aa, Entamoeba histolytica
EATVNK

SEQ ID NO: 2614261 - protein, 9 aa, Entamoeba histolytica
EATVVPKNE

SEQ ID NO: 2614262 - protein, 14 aa, Entamoeba histolytica
EAVEKRKASEAALE

SEQ ID NO: 2614263 - protein, 8 aa, Entamoeba histolytica
EAVETEES

SEQ ID NO: 2614264 - protein, 10 aa, Entamoeba histolytica
EAVKNTDVEY

SEQ ID NO: 2614265 - protein, 5 aa, Entamoeba histolytica
EAVKQ

SEQ ID NO: 2614266 - protein, 9 aa, Entamoeba histolytica
EAVKQGSAV

SEQ ID NO: 2614267 - protein, 11 aa, Entamoeba histolytica
EAVKTLTKEEE

SEQ ID NO: 2614268 - protein, 4 aa, Entamoeba histolytica
EAVM

SEQ ID NO: 2614269 - protein, 7 aa, Entamoeba histolytica
EAVNRNK

SEQ ID NO: 2614270 - protein, 10 aa, Entamoeba histolytica
EAVPNEVTAG

SEQ ID NO: 2614271 - protein, 4 aa, Entamoeba histolytica
EAVT

SEQ ID NO: 2614272 - protein, 24 aa, Entamoeba histolytica
EAVTGRKRTKKERTKKAKGGDCVL

SEQ ID NO: 2614273 - protein, 10 aa, Entamoeba histolytica
EAYKTLKTEV

SEQ ID NO: 2614274 - protein, 9 aa, Entamoeba histolytica
EAYQNEQIA

SEQ ID NO: 2614275 - protein, 6 aa, Entamoeba histolytica
ECAEKI

SEQ ID NO: 2614276 - protein, 11 aa, Entamoeba histolytica
ECAKKSTYNEM

SEQ ID NO: 2614277 - protein, 14 aa, Entamoeba histolytica
ECDEMQKTTFEAKE

SEQ ID NO: 2614278 - protein, 6 aa, Entamoeba histolytica
ECDERE

SEQ ID NO: 2614279 - protein, 7 aa, Entamoeba histolytica
ECDGGME

SEQ ID NO: 2614280 - protein, 8 aa, Entamoeba histolytica
ECDPERKE

SEQ ID NO: 2614281 - protein, 14 aa, Entamoeba histolytica
ECDQRKGMKEEELK

SEQ ID NO: 2614282 - protein, 5 aa, Entamoeba histolytica
ECDTG

SEQ ID NO: 2614283 - protein, 7 aa, Entamoeba histolytica
ECDYQSD

SEQ ID NO: 2614284 - protein, 5 aa, Entamoeba histolytica
ECEKE

SEQ ID NO: 2614285 - protein, 5 aa, Entamoeba histolytica
ECEKY

SEQ ID NO: 2614286 - protein, 6 aa, Entamoeba histolytica
ECGGDI

SEQ ID NO: 2614287 - protein, 7 aa, Entamoeba histolytica
ECGYGQG

SEQ ID NO: 2614288 - protein, 18 aa, Entamoeba histolytica
ECHGNDGNEGGCEGGFKS

SEQ ID NO: 2614289 - protein, 9 aa, Entamoeba histolytica
ECKATPDEM

SEQ ID NO: 2614290 - protein, 20 aa, Entamoeba histolytica
ECKEDGQVCEQQSNNDDSII

SEQ ID NO: 2614291 - protein, 5 aa, Entamoeba histolytica
ECKEK

SEQ ID NO: 2614292 - protein, 25 aa, Entamoeba histolytica
ECKNPSEQQDRSETVERSVETPNRF

SEQ ID NO: 2614293 - protein, 7 aa, Entamoeba histolytica
ECNIPET

SEQ ID NO: 2614294 - protein, 7 aa, Entamoeba histolytica
ECNPAKV

SEQ ID NO: 2614295 - protein, 6 aa, Entamoeba histolytica
ECNSCE

SEQ ID NO: 2614296 - protein, 5 aa, Entamoeba histolytica
ECNTT

SEQ ID NO: 2614297 - protein, 7 aa, Entamoeba histolytica
ECPAENI

SEQ ID NO: 2614298 - protein, 9 aa, Entamoeba histolytica
ECPDTVNPS

SEQ ID NO: 2614299 - protein, 7 aa, Entamoeba histolytica
ECPETVN

SEQ ID NO: 2614300 - protein, 6 aa, Entamoeba histolytica
ECPGYK

SEQ ID NO: 2614301 - protein, 12 aa, Entamoeba histolytica
ECPPTDNPSYYK

SEQ ID NO: 2614302 - protein, 5 aa, Entamoeba histolytica
ECPTP

SEQ ID NO: 2614303 - protein, 4 aa, Entamoeba histolytica
ECQD

SEQ ID NO: 2614304 - protein, 6 aa, Entamoeba histolytica
ECQGYG

SEQ ID NO: 2614305 - protein, 12 aa, Entamoeba histolytica
ECQKTKKNEQDL

SEQ ID NO: 2614306 - protein, 7 aa, Entamoeba histolytica
ECQNDEQ

SEQ ID NO: 2614307 - protein, 7 aa, Entamoeba histolytica
ECQVNSK

SEQ ID NO: 2614308 - protein, 6 aa, Entamoeba histolytica
ECRKAS

SEQ ID NO: 2614309 - protein, 10 aa, Entamoeba histolytica
ECSAANQNGL

SEQ ID NO: 2614310 - protein, 15 aa, Entamoeba histolytica
ECSDDESIKQKESHF

SEQ ID NO: 2614311 - protein, 14 aa, Entamoeba histolytica
ECSEKAGDLVKPYD

SEQ ID NO: 2614312 - protein, 8 aa, Entamoeba histolytica
ECSENNEM

SEQ ID NO: 2614313 - protein, 10 aa, Entamoeba histolytica
ECSGKGNGTI

SEQ ID NO: 2614314 - protein, 8 aa, Entamoeba histolytica
ECSKKNEI

SEQ ID NO: 2614315 - protein, 10 aa, Entamoeba histolytica
ECSNEIPSGC

SEQ ID NO: 2614316 - protein, 11 aa, Entamoeba histolytica
ECSNTGAPKQF

SEQ ID NO: 2614317 - protein, 11 aa, Entamoeba histolytica
ECSRTNKGDIK

SEQ ID NO: 2614318 - protein, 5 aa, Entamoeba histolytica
ECSSG

SEQ ID NO: 2614319 - protein, 14 aa, Entamoeba histolytica
ECSTKEDEERENTH

SEQ ID NO: 2614320 - protein, 7 aa, Entamoeba histolytica
ECTDPNQ

SEQ ID NO: 2614321 - protein, 7 aa, Entamoeba histolytica
ECTEKTV

SEQ ID NO: 2614322 - protein, 5 aa, Entamoeba histolytica
ECTGK

SEQ ID NO: 2614323 - protein, 7 aa, Entamoeba histolytica
ECTGNEW

SEQ ID NO: 2614324 - protein, 6 aa, Entamoeba histolytica
ECTKTS

SEQ ID NO: 2614325 - protein, 9 aa, Entamoeba histolytica
ECTPEESQA

SEQ ID NO: 2614326 - protein, 6 aa, Entamoeba histolytica
ECTPPY

SEQ ID NO: 2614327 - protein, 4 aa, Entamoeba histolytica
ECTV

SEQ ID NO: 2614328 - protein, 8 aa, Entamoeba histolytica
ECYETPID

SEQ ID NO: 2614329 - protein, 22 aa, Entamoeba histolytica
ECYKPKQQNIKSQQMTEKSVSK

SEQ ID NO: 2614330 - protein, 12 aa, Entamoeba histolytica
ECYNEQEPQEKM

SEQ ID NO: 2614331 - protein, 6 aa, Entamoeba histolytica
ECYTTA

SEQ ID NO: 2614332 - protein, 11 aa, Entamoeba histolytica
EDAALGSGGLG

SEQ ID NO: 2614333 - protein, 10 aa, Entamoeba histolytica
EDADADESGV

SEQ ID NO: 2614334 - protein, 8 aa, Entamoeba histolytica
EDADKNTT

SEQ ID NO: 2614335 - protein, 7 aa, Entamoeba histolytica
EDADLPG

SEQ ID NO: 2614336 - protein, 21 aa, Entamoeba histolytica
EDAEKRRKTMKTDRYENTKFQ

SEQ ID NO: 2614337 - protein, 6 aa, Entamoeba histolytica
EDAETA

SEQ ID NO: 2614338 - protein, 7 aa, Entamoeba histolytica
EDAETAK

SEQ ID NO: 2614339 - protein, 4 aa, Entamoeba histolytica
EDAI

SEQ ID NO: 2614340 - protein, 9 aa, Entamoeba histolytica
EDAKDEIAK

SEQ ID NO: 2614341 - protein, 19 aa, Entamoeba histolytica
EDAKKDPSLLHPKTKRKSY

SEQ ID NO: 2614342 - protein, 9 aa, Entamoeba histolytica
EDAKMEKIA

SEQ ID NO: 2614343 - protein, 6 aa, Entamoeba histolytica
EDAKRA

SEQ ID NO: 2614344 - protein, 5 aa, Entamoeba histolytica
EDAMT

SEQ ID NO: 2614345 - protein, 6 aa, Entamoeba histolytica
EDAQKK

SEQ ID NO: 2614346 - protein, 5 aa, Entamoeba histolytica
EDARL

SEQ ID NO: 2614347 - protein, 7 aa, Entamoeba histolytica
EDASDSL

SEQ ID NO: 2614348 - protein, 9 aa, Entamoeba histolytica
EDASEKNMN

SEQ ID NO: 2614349 - protein, 7 aa, Entamoeba histolytica
EDASSID

SEQ ID NO: 2614350 - protein, 10 aa, Entamoeba histolytica
EDCPSGNIHE

SEQ ID NO: 2614351 - protein, 15 aa, Entamoeba histolytica
EDCSEEKTNVGDKNQ

SEQ ID NO: 2614352 - protein, 6 aa, Entamoeba histolytica
EDCTYK

SEQ ID NO: 2614353 - protein, 12 aa, Entamoeba histolytica
EDDDGKPGKQID

SEQ ID NO: 2614354 - protein, 9 aa, Entamoeba histolytica
EDDDPHPVV

SEQ ID NO: 2614355 - protein, 11 aa, Entamoeba histolytica
EDDDSDEELQR

SEQ ID NO: 2614356 - protein, 29 aa, Entamoeba histolytica
EDDDTNEYREEYEEEDDDDDIGEEEIDKE

SEQ ID NO: 2614357 - protein, 7 aa, Entamoeba histolytica
EDDEEHE

SEQ ID NO: 2614358 - protein, 25 aa, Entamoeba histolytica
EDDEKDNKNEEPKEKNKNEDLEEKE

SEQ ID NO: 2614359 - protein, 19 aa, Entamoeba histolytica
EDDEPPKVKSEIKNDRDTA

SEQ ID NO: 2614360 - protein, 10 aa, Entamoeba histolytica
EDDESDEDKM

SEQ ID NO: 2614361 - protein, 8 aa, Entamoeba histolytica
EDDFGTPQ

SEQ ID NO: 2614362 - protein, 4 aa, Entamoeba histolytica
EDDG

SEQ ID NO: 2614363 - protein, 7 aa, Entamoeba histolytica
EDDGDDW

SEQ ID NO: 2614364 - protein, 6 aa, Entamoeba histolytica
EDDGQF

SEQ ID NO: 2614365 - protein, 41 aa, Entamoeba histolytica
EDDIDDLKKEIKDLKRENSNNNKTNLRNSIATTQPSTKEIQ

SEQ ID NO: 2614366 - protein, 5 aa, Entamoeba histolytica
EDDIR

SEQ ID NO: 2614367 - protein, 9 aa, Entamoeba histolytica
EDDKPIQPY

SEQ ID NO: 2614368 - protein, 6 aa, Entamoeba histolytica
EDDLED

SEQ ID NO: 2614369 - protein, 19 aa, Entamoeba histolytica
EDDLNEEQPTIIESNELYD

SEQ ID NO: 2614370 - protein, 7 aa, Entamoeba histolytica
EDDLRQD

SEQ ID NO: 2614371 - protein, 7 aa, Entamoeba histolytica
EDDNSSP

SEQ ID NO: 2614372 - protein, 9 aa, Entamoeba histolytica
EDDNTAQEY

SEQ ID NO: 2614373 - protein, 43 aa, Entamoeba histolytica
EDDNTNEYREEYEEYEDDDIGEEEIDKEIKERLSNIKGENQIK

SEQ ID NO: 2614374 - protein, 21 aa, Entamoeba histolytica
EDDNTTKEQQNQTKQEATTLI

SEQ ID NO: 2614375 - protein, 7 aa, Entamoeba histolytica
EDDNYTR

SEQ ID NO: 2614376 - protein, 10 aa, Entamoeba histolytica
EDDPSDETHN

SEQ ID NO: 2614377 - protein, 16 aa, Entamoeba histolytica
EDDRKYGAVDAYSSSN

SEQ ID NO: 2614378 - protein, 10 aa, Entamoeba histolytica
EDDSETTLDN

SEQ ID NO: 2614379 - protein, 9 aa, Entamoeba histolytica
EDDSFNNCP

SEQ ID NO: 2614380 - protein, 4 aa, Entamoeba histolytica
EDDT

SEQ ID NO: 2614381 - protein, 24 aa, Entamoeba histolytica
EDDTTQIESNSFDYSDKSSDTTTL

SEQ ID NO: 2614382 - protein, 15 aa, Entamoeba histolytica
EDDVEEKPVNINNPK

SEQ ID NO: 2614383 - protein, 7 aa, Entamoeba histolytica
EDDVKKE

SEQ ID NO: 2614384 - protein, 13 aa, Entamoeba histolytica
EDDVQKPSKPVTS

SEQ ID NO: 2614385 - protein, 5 aa, Entamoeba histolytica
EDEAK

SEQ ID NO: 2614386 - protein, 4 aa, Entamoeba histolytica
EDED

SEQ ID NO: 2614387 - protein, 9 aa, Entamoeba histolytica
EDEDDQDIN

SEQ ID NO: 2614388 - protein, 8 aa, Entamoeba histolytica
EDEDEGEF

SEQ ID NO: 2614389 - protein, 5 aa, Entamoeba histolytica
EDEDF

SEQ ID NO: 2614390 - protein, 8 aa, Entamoeba histolytica
EDEDKERM

SEQ ID NO: 2614391 - protein, 8 aa, Entamoeba histolytica
EDEDNKKQ

SEQ ID NO: 2614392 - protein, 7 aa, Entamoeba histolytica
EDEDSLE

SEQ ID NO: 2614393 - protein, 8 aa, Entamoeba histolytica
EDEEDDDG

SEQ ID NO: 2614394 - protein, 21 aa, Entamoeba histolytica
EDEEEEKKKEESVIEKNQGFT

SEQ ID NO: 2614395 - protein, 10 aa, Entamoeba histolytica
EDEEINDVEK

SEQ ID NO: 2614396 - protein, 20 aa, Entamoeba histolytica
EDEEKKKQTEEETDKDEKKI

SEQ ID NO: 2614397 - protein, 6 aa, Entamoeba histolytica
EDEEKT

SEQ ID NO: 2614398 - protein, 8 aa, Entamoeba histolytica
EDEENTNG

SEQ ID NO: 2614399 - protein, 8 aa, Entamoeba histolytica
EDEERGTI

SEQ ID NO: 2614400 - protein, 9 aa, Entamoeba histolytica
EDEETENEW

SEQ ID NO: 2614401 - protein, 13 aa, Entamoeba histolytica
EDEETEPQKIFKN

SEQ ID NO: 2614402 - protein, 7 aa, Entamoeba histolytica
EDEETSN

SEQ ID NO: 2614403 - protein, 8 aa, Entamoeba histolytica
EDEEVKKK

SEQ ID NO: 2614404 - protein, 68 aa, Entamoeba histolytica
EDEEYDEDDESDDNKKEVSDDESGEYDPNAGEYDEEDSEEEENTDSSDEENNEEASREENESSVKEEE

SEQ ID NO: 2614405 - protein, 4 aa, Entamoeba histolytica
EDEF

SEQ ID NO: 2614406 - protein, 20 aa, Entamoeba histolytica
EDEGKPIKETEKTQNKVDED

SEQ ID NO: 2614407 - protein, 6 aa, Entamoeba histolytica
EDEGMD

SEQ ID NO: 2614408 - protein, 8 aa, Entamoeba histolytica
EDEGRTIA

SEQ ID NO: 2614409 - protein, 7 aa, Entamoeba histolytica
EDEGRVD

SEQ ID NO: 2614410 - protein, 4 aa, Entamoeba histolytica
EDEI

SEQ ID NO: 2614411 - protein, 5 aa, Entamoeba histolytica
EDEIQ

SEQ ID NO: 2614412 - protein, 17 aa, Entamoeba histolytica
EDEIQQQLNSSRQYTLT

SEQ ID NO: 2614413 - protein, 4 aa, Entamoeba histolytica
EDEK

SEQ ID NO: 2614414 - protein, 11 aa, Entamoeba histolytica
EDEKENKGHQF

SEQ ID NO: 2614415 - protein, 7 aa, Entamoeba histolytica
EDEKKKN

SEQ ID NO: 2614416 - protein, 5 aa, Entamoeba histolytica
EDEKM

SEQ ID NO: 2614417 - protein, 7 aa, Entamoeba histolytica
EDEKQTI

SEQ ID NO: 2614418 - protein, 38 aa, Entamoeba histolytica
EDEKREELNQAKQKKEELLEEKSRLEKEVQESSQDIKE

SEQ ID NO: 2614419 - protein, 8 aa, Entamoeba histolytica
EDEKRRNI

SEQ ID NO: 2614420 - protein, 13 aa, Entamoeba histolytica
EDELNKSQKTIED

SEQ ID NO: 2614421 - protein, 12 aa, Entamoeba histolytica
EDELSTDQVGSD

SEQ ID NO: 2614422 - protein, 13 aa, Entamoeba histolytica
EDEMGKTNEAFSE

SEQ ID NO: 2614423 - protein, 15 aa, Entamoeba histolytica
EDEMKTKTTKEYSGG

SEQ ID NO: 2614424 - protein, 10 aa, Entamoeba histolytica
EDEMSECTTS

SEQ ID NO: 2614425 - protein, 8 aa, Entamoeba histolytica
EDENNIQE

SEQ ID NO: 2614426 - protein, 7 aa, Entamoeba histolytica
EDENVGK

SEQ ID NO: 2614427 - protein, 7 aa, Entamoeba histolytica
EDENVKP

SEQ ID NO: 2614428 - protein, 8 aa, Entamoeba histolytica
EDENYASA

SEQ ID NO: 2614429 - protein, 15 aa, Entamoeba histolytica
EDENYKKHIKQGNED

SEQ ID NO: 2614430 - protein, 7 aa, Entamoeba histolytica
EDEPNFK

SEQ ID NO: 2614431 - protein, 5 aa, Entamoeba histolytica
EDEPP

SEQ ID NO: 2614432 - protein, 17 aa, Entamoeba histolytica
EDEPVSEVSISNITRSM

SEQ ID NO: 2614433 - protein, 5 aa, Entamoeba histolytica
EDEQD

SEQ ID NO: 2614434 - protein, 24 aa, Entamoeba histolytica
EDEQDNNNKISDESQEELTGDYIK

SEQ ID NO: 2614435 - protein, 6 aa, Entamoeba histolytica
EDEQEK

SEQ ID NO: 2614436 - protein, 14 aa, Entamoeba histolytica
EDEQLKDDGNEEVV

SEQ ID NO: 2614437 - protein, 9 aa, Entamoeba histolytica
EDEQTKKKY

SEQ ID NO: 2614438 - protein, 4 aa, Entamoeba histolytica
EDER

SEQ ID NO: 2614439 - protein, 22 aa, Entamoeba histolytica
EDESRDINSYGEDNYIKQGNRI

SEQ ID NO: 2614440 - protein, 8 aa, Entamoeba histolytica
EDETCENN

SEQ ID NO: 2614441 - protein, 8 aa, Entamoeba histolytica
EDETGNGF

SEQ ID NO: 2614442 - protein, 7 aa, Entamoeba histolytica
EDETMET

SEQ ID NO: 2614443 - protein, 4 aa, Entamoeba histolytica
EDEV

SEQ ID NO: 2614444 - protein, 6 aa, Entamoeba histolytica
EDEVEL

SEQ ID NO: 2614445 - protein, 6 aa, Entamoeba histolytica
EDEVQK

SEQ ID NO: 2614446 - protein, 6 aa, Entamoeba histolytica
EDEYDK

SEQ ID NO: 2614447 - protein, 16 aa, Entamoeba histolytica
EDEYDKIQTEHYDKEQ

SEQ ID NO: 2614448 - protein, 9 aa, Entamoeba histolytica
EDFDSDEVQ

SEQ ID NO: 2614449 - protein, 4 aa, Entamoeba histolytica
EDFE

SEQ ID NO: 2614450 - protein, 17 aa, Entamoeba histolytica
EDFEDDRNEFPMLPFAL

SEQ ID NO: 2614451 - protein, 5 aa, Entamoeba histolytica
EDFEG

SEQ ID NO: 2614452 - protein, 22 aa, Entamoeba histolytica
EDFEPENKAPKDQYKAAISSKV

SEQ ID NO: 2614453 - protein, 6 aa, Entamoeba histolytica
EDFKGD

SEQ ID NO: 2614454 - protein, 5 aa, Entamoeba histolytica
EDFNS

SEQ ID NO: 2614455 - protein, 8 aa, Entamoeba histolytica
EDFREEEY

SEQ ID NO: 2614456 - protein, 10 aa, Entamoeba histolytica
EDGDDDMKRT

SEQ ID NO: 2614457 - protein, 6 aa, Entamoeba histolytica
EDGDME

SEQ ID NO: 2614458 - protein, 5 aa, Entamoeba histolytica
EDGEQ

SEQ ID NO: 2614459 - protein, 8 aa, Entamoeba histolytica
EDGGESPL

SEQ ID NO: 2614460 - protein, 6 aa, Entamoeba histolytica
EDGKAI

SEQ ID NO: 2614461 - protein, 12 aa, Entamoeba histolytica
EDGKDLNVAIEI

SEQ ID NO: 2614462 - protein, 12 aa, Entamoeba histolytica
EDGKEIEIEGDT

SEQ ID NO: 2614463 - protein, 9 aa, Entamoeba histolytica
EDGKGIKQI

SEQ ID NO: 2614464 - protein, 6 aa, Entamoeba histolytica
EDGKNW

SEQ ID NO: 2614465 - protein, 6 aa, Entamoeba histolytica
EDGKPI

SEQ ID NO: 2614466 - protein, 10 aa, Entamoeba histolytica
EDGKPKEQQI

SEQ ID NO: 2614467 - protein, 7 aa, Entamoeba histolytica
EDGNQKI

SEQ ID NO: 2614468 - protein, 10 aa, Entamoeba histolytica
EDGNTSRLTE

SEQ ID NO: 2614469 - protein, 5 aa, Entamoeba histolytica
EDGRA

SEQ ID NO: 2614470 - protein, 4 aa, Entamoeba histolytica
EDGS

SEQ ID NO: 2614471 - protein, 6 aa, Entamoeba histolytica
EDGSFK

SEQ ID NO: 2614472 - protein, 7 aa, Entamoeba histolytica
EDGSGWT

SEQ ID NO: 2614473 - protein, 21 aa, Entamoeba histolytica
EDGSKGIKKEQSHQKSITSTE

SEQ ID NO: 2614474 - protein, 28 aa, Entamoeba histolytica
EDGSSSDSIISEEEEEDAEREKNKNEYN

SEQ ID NO: 2614475 - protein, 7 aa, Entamoeba histolytica
EDGTGFS

SEQ ID NO: 2614476 - protein, 6 aa, Entamoeba histolytica
EDGTNK

SEQ ID NO: 2614477 - protein, 38 aa, Entamoeba histolytica
EDGTTLKSEESKETITPINQTENNESIQTINDKKGSLD

SEQ ID NO: 2614478 - protein, 6 aa, Entamoeba histolytica
EDGTTT

SEQ ID NO: 2614479 - protein, 20 aa, Entamoeba histolytica
EDGTYGKRKKGDITKRKEEY

SEQ ID NO: 2614480 - protein, 8 aa, Entamoeba histolytica
EDGVEEGT

SEQ ID NO: 2614481 - protein, 9 aa, Entamoeba histolytica
EDGVVDPKD

SEQ ID NO: 2614482 - protein, 5 aa, Entamoeba histolytica
EDGWA

SEQ ID NO: 2614483 - protein, 11 aa, Entamoeba histolytica
EDGYGTVSNSL

SEQ ID NO: 2614484 - protein, 6 aa, Entamoeba histolytica
EDHEMD

SEQ ID NO: 2614485 - protein, 5 aa, Entamoeba histolytica
EDHES

SEQ ID NO: 2614486 - protein, 5 aa, Entamoeba histolytica
EDHQI

SEQ ID NO: 2614487 - protein, 13 aa, Entamoeba histolytica
EDHSSLKDLNGFN

SEQ ID NO: 2614488 - protein, 9 aa, Entamoeba histolytica
EDHSSSPTL

SEQ ID NO: 2614489 - protein, 4 aa, Entamoeba histolytica
EDHT

SEQ ID NO: 2614490 - protein, 6 aa, Entamoeba histolytica
EDHTAG

SEQ ID NO: 2614491 - protein, 20 aa, Entamoeba histolytica
EDIDDDGLGSFGENLSPEEI

SEQ ID NO: 2614492 - protein, 24 aa, Entamoeba histolytica
EDIDDDSNDSNDSNNSSDDERSLS

SEQ ID NO: 2614493 - protein, 21 aa, Entamoeba histolytica
EDIDDDSNDSNNSSDDERSLS

SEQ ID NO: 2614494 - protein, 7 aa, Entamoeba histolytica
EDIDKNH

SEQ ID NO: 2614495 - protein, 24 aa, Entamoeba histolytica
EDIDPAKLSDKSTQIESEEKEREK

SEQ ID NO: 2614496 - protein, 12 aa, Entamoeba histolytica
EDIEDGGFEMNT

SEQ ID NO: 2614497 - protein, 8 aa, Entamoeba histolytica
EDIEKQNK

SEQ ID NO: 2614498 - protein, 6 aa, Entamoeba histolytica
EDIERS

SEQ ID NO: 2614499 - protein, 10 aa, Entamoeba histolytica
EDIESSTEKD

SEQ ID NO: 2614500 - protein, 8 aa, Entamoeba histolytica
EDIGTSTP

SEQ ID NO: 2614501 - protein, 7 aa, Entamoeba histolytica
EDIKESE

SEQ ID NO: 2614502 - protein, 34 aa, Entamoeba histolytica
EDIKKEEKKEKQKEQNNQIEGKEKKIKEKVYPQK

SEQ ID NO: 2614503 - protein, 15 aa, Entamoeba histolytica
EDIKKSLSGNTSYST

SEQ ID NO: 2614504 - protein, 7 aa, Entamoeba histolytica
EDIKNGL

SEQ ID NO: 2614505 - protein, 12 aa, Entamoeba histolytica
EDIKNSEKPQIN

SEQ ID NO: 2614506 - protein, 11 aa, Entamoeba histolytica
EDIKQKEEIDV

SEQ ID NO: 2614507 - protein, 5 aa, Entamoeba histolytica
EDINE

SEQ ID NO: 2614508 - protein, 28 aa, Entamoeba histolytica
EDINEKKKEEQTKEIKKIEDGSDEIEET

SEQ ID NO: 2614509 - protein, 9 aa, Entamoeba histolytica
EDINKDTAI

SEQ ID NO: 2614510 - protein, 39 aa, Entamoeba histolytica
EDINPQNNIQETKMEEEKTETKNQHEVTNENSLNSLPQN

SEQ ID NO: 2614511 - protein, 16 aa, Entamoeba histolytica
EDINSKTLDLKSGGDV

SEQ ID NO: 2614512 - protein, 4 aa, Entamoeba histolytica
EDIP

SEQ ID NO: 2614513 - protein, 5 aa, Entamoeba histolytica
EDIQK

SEQ ID NO: 2614514 - protein, 10 aa, Entamoeba histolytica
EDIQKEGRKL

SEQ ID NO: 2614515 - protein, 20 aa, Entamoeba histolytica
EDIQPDKEEDGSEDSSSEFQ

SEQ ID NO: 2614516 - protein, 20 aa, Entamoeba histolytica
EDIQSDKEDEQSEDSSSEFQ

SEQ ID NO: 2614517 - protein, 5 aa, Entamoeba histolytica
EDIRK

SEQ ID NO: 2614518 - protein, 13 aa, Entamoeba histolytica
EDISEIDNKTDQT

SEQ ID NO: 2614519 - protein, 26 aa, Entamoeba histolytica
EDISKSSLPQITDTSPQRKITKPPRL

SEQ ID NO: 2614520 - protein, 34 aa, Entamoeba histolytica
EDISKVTEEPSNPSGQKQAEGQNAQTKVDQPTNS

SEQ ID NO: 2614521 - protein, 8 aa, Entamoeba histolytica
EDITKKGI

SEQ ID NO: 2614522 - protein, 22 aa, Entamoeba histolytica
EDITNEKITPPSFKTNTIPPQI

SEQ ID NO: 2614523 - protein, 8 aa, Entamoeba histolytica
EDITPKTK

SEQ ID NO: 2614524 - protein, 7 aa, Entamoeba histolytica
EDKATLP

SEQ ID NO: 2614525 - protein, 4 aa, Entamoeba histolytica
EDKE

SEQ ID NO: 2614526 - protein, 7 aa, Entamoeba histolytica
EDKEAEY

SEQ ID NO: 2614527 - protein, 8 aa, Entamoeba histolytica
EDKEATQR

SEQ ID NO: 2614528 - protein, 7 aa, Entamoeba histolytica
EDKEKEQ

SEQ ID NO: 2614529 - protein, 11 aa, Entamoeba histolytica
EDKENENGSTI

SEQ ID NO: 2614530 - protein, 5 aa, Entamoeba histolytica
EDKGV

SEQ ID NO: 2614531 - protein, 4 aa, Entamoeba histolytica
EDKI

SEQ ID NO: 2614532 - protein, 16 aa, Entamoeba histolytica
EDKIEEQKQDSDIRYK

SEQ ID NO: 2614533 - protein, 7 aa, Entamoeba histolytica
EDKINQE

SEQ ID NO: 2614534 - protein, 8 aa, Entamoeba histolytica
EDKIPSEI

SEQ ID NO: 2614535 - protein, 8 aa, Entamoeba histolytica
EDKIQKKV

SEQ ID NO: 2614536 - protein, 7 aa, Entamoeba histolytica
EDKIRPK

SEQ ID NO: 2614537 - protein, 6 aa, Entamoeba histolytica
EDKITT

SEQ ID NO: 2614538 - protein, 7 aa, Entamoeba histolytica
EDKKEAC

SEQ ID NO: 2614539 - protein, 7 aa, Entamoeba histolytica
EDKKEIT

SEQ ID NO: 2614540 - protein, 17 aa, Entamoeba histolytica
EDKKQMKINKQKERTRL

SEQ ID NO: 2614541 - protein, 5 aa, Entamoeba histolytica
EDKLV

SEQ ID NO: 2614542 - protein, 11 aa, Entamoeba histolytica
EDKNGKKEEEL

SEQ ID NO: 2614543 - protein, 9 aa, Entamoeba histolytica
EDKNLKTSL

SEQ ID NO: 2614544 - protein, 4 aa, Entamoeba histolytica
EDKP

SEQ ID NO: 2614545 - protein, 8 aa, Entamoeba histolytica
EDKPSTEI

SEQ ID NO: 2614546 - protein, 9 aa, Entamoeba histolytica
EDKQPSVKK

SEQ ID NO: 2614547 - protein, 21 aa, Entamoeba histolytica
EDKQQPQQKEEGKCNDSVADK

SEQ ID NO: 2614548 - protein, 19 aa, Entamoeba histolytica
EDKQSVKRKTPLPTEEEIN

SEQ ID NO: 2614549 - protein, 5 aa, Entamoeba histolytica
EDKRI

SEQ ID NO: 2614550 - protein, 10 aa, Entamoeba histolytica
EDKSGRKSPS

SEQ ID NO: 2614551 - protein, 8 aa, Entamoeba histolytica
EDKSTDTC

SEQ ID NO: 2614552 - protein, 16 aa, Entamoeba histolytica
EDKSYIGSASGEQLNR

SEQ ID NO: 2614553 - protein, 4 aa, Entamoeba histolytica
EDKT

SEQ ID NO: 2614554 - protein, 6 aa, Entamoeba histolytica
EDKTIN

SEQ ID NO: 2614555 - protein, 6 aa, Entamoeba histolytica
EDKTKI

SEQ ID NO: 2614556 - protein, 16 aa, Entamoeba histolytica
EDKTKKTNKNNSSINR

SEQ ID NO: 2614557 - protein, 5 aa, Entamoeba histolytica
EDKTL

SEQ ID NO: 2614558 - protein, 5 aa, Entamoeba histolytica
EDKTN

SEQ ID NO: 2614559 - protein, 66 aa, Entamoeba histolytica
EDKTSEIKDKTNEIIEDKPNEIKDTKEAFSNTITSSQKEGTTEINVQETPKTAEENLEKNNDINTS

SEQ ID NO: 2614560 - protein, 12 aa, Entamoeba histolytica
EDKTSMKKGDLA

SEQ ID NO: 2614561 - protein, 11 aa, Entamoeba histolytica
EDKTSNYSETE

SEQ ID NO: 2614562 - protein, 4 aa, Entamoeba histolytica
EDKV

SEQ ID NO: 2614563 - protein, 15 aa, Entamoeba histolytica
EDKYDEVPSSFISIP

SEQ ID NO: 2614564 - protein, 5 aa, Entamoeba histolytica
EDLDD

SEQ ID NO: 2614565 - protein, 10 aa, Entamoeba histolytica
EDLDDSIGDR

SEQ ID NO: 2614566 - protein, 52 aa, Entamoeba histolytica
EDLEGQLEKAKGSAAAAGASDLKSKIKDLQDEIEDVNQKLSSEKEKSSRLQR

SEQ ID NO: 2614567 - protein, 10 aa, Entamoeba histolytica
EDLEQLNNNQ

SEQ ID NO: 2614568 - protein, 7 aa, Entamoeba histolytica
EDLETNT

SEQ ID NO: 2614569 - protein, 7 aa, Entamoeba histolytica
EDLGKEE

SEQ ID NO: 2614570 - protein, 16 aa, Entamoeba histolytica
EDLKDKSSKEKKTYLD

SEQ ID NO: 2614571 - protein, 8 aa, Entamoeba histolytica
EDLKQTAN

SEQ ID NO: 2614572 - protein, 5 aa, Entamoeba histolytica
EDLKT

SEQ ID NO: 2614573 - protein, 4 aa, Entamoeba histolytica
EDLL

SEQ ID NO: 2614574 - protein, 5 aa, Entamoeba histolytica
EDLNK

SEQ ID NO: 2614575 - protein, 7 aa, Entamoeba histolytica
EDLPSEL

SEQ ID NO: 2614576 - protein, 20 aa, Entamoeba histolytica
EDLPTDGESQKQEKPPIKEQ

SEQ ID NO: 2614577 - protein, 6 aa, Entamoeba histolytica
EDLQKV

SEQ ID NO: 2614578 - protein, 4 aa, Entamoeba histolytica
EDLR

SEQ ID NO: 2614579 - protein, 4 aa, Entamoeba histolytica
EDLS

SEQ ID NO: 2614580 - protein, 6 aa, Entamoeba histolytica
EDLSEQ

SEQ ID NO: 2614581 - protein, 7 aa, Entamoeba histolytica
EDLSKRN

SEQ ID NO: 2614582 - protein, 17 aa, Entamoeba histolytica
EDLTEPQDIAEDPDVDR

SEQ ID NO: 2614583 - protein, 6 aa, Entamoeba histolytica
EDLTKY

SEQ ID NO: 2614584 - protein, 6 aa, Entamoeba histolytica
EDMAEN

SEQ ID NO: 2614585 - protein, 17 aa, Entamoeba histolytica
EDMDEVNEKKEPRPSNV

SEQ ID NO: 2614586 - protein, 4 aa, Entamoeba histolytica
EDMK

SEQ ID NO: 2614587 - protein, 8 aa, Entamoeba histolytica
EDMKSSGI

SEQ ID NO: 2614588 - protein, 8 aa, Entamoeba histolytica
EDMSEDVE

SEQ ID NO: 2614589 - protein, 14 aa, Entamoeba histolytica
EDMSESNLKSNGQV

SEQ ID NO: 2614590 - protein, 28 aa, Entamoeba histolytica
EDNAKSNQSKEEKKEENDDKKMEEDKKN

SEQ ID NO: 2614591 - protein, 16 aa, Entamoeba histolytica
EDNDQKKEDEASRRDQ

SEQ ID NO: 2614592 - protein, 8 aa, Entamoeba histolytica
EDNEAKSV

SEQ ID NO: 2614593 - protein, 18 aa, Entamoeba histolytica
EDNEENKLKNNINEEVEE

SEQ ID NO: 2614594 - protein, 15 aa, Entamoeba histolytica
EDNEGENLEKSLNED

SEQ ID NO: 2614595 - protein, 12 aa, Entamoeba histolytica
EDNEGLEGGASD

SEQ ID NO: 2614596 - protein, 11 aa, Entamoeba histolytica
EDNEKKPKGVT

SEQ ID NO: 2614597 - protein, 5 aa, Entamoeba histolytica
EDNET

SEQ ID NO: 2614598 - protein, 5 aa, Entamoeba histolytica
EDNEW

SEQ ID NO: 2614599 - protein, 4 aa, Entamoeba histolytica
EDNG

SEQ ID NO: 2614600 - protein, 4 aa, Entamoeba histolytica
EDNI

SEQ ID NO: 2614601 - protein, 5 aa, Entamoeba histolytica
EDNIE

SEQ ID NO: 2614602 - protein, 8 aa, Entamoeba histolytica
EDNKQTIR

SEQ ID NO: 2614603 - protein, 9 aa, Entamoeba histolytica
EDNKQTQFK

SEQ ID NO: 2614604 - protein, 8 aa, Entamoeba histolytica
EDNNDDLD

SEQ ID NO: 2614605 - protein, 9 aa, Entamoeba histolytica
EDNNDINNR

SEQ ID NO: 2614606 - protein, 6 aa, Entamoeba histolytica
EDNNEL

SEQ ID NO: 2614607 - protein, 7 aa, Entamoeba histolytica
EDNNGKI

SEQ ID NO: 2614608 - protein, 6 aa, Entamoeba histolytica
EDNNSK

SEQ ID NO: 2614609 - protein, 5 aa, Entamoeba histolytica
EDNPL

SEQ ID NO: 2614610 - protein, 18 aa, Entamoeba histolytica
EDNPNTTSICSDDSSFID

SEQ ID NO: 2614611 - protein, 7 aa, Entamoeba histolytica
EDNPTNT

SEQ ID NO: 2614612 - protein, 6 aa, Entamoeba histolytica
EDNPVV

SEQ ID NO: 2614613 - protein, 9 aa, Entamoeba histolytica
EDNQINPEQ

SEQ ID NO: 2614614 - protein, 5 aa, Entamoeba histolytica
EDNQP

SEQ ID NO: 2614615 - protein, 8 aa, Entamoeba histolytica
EDNQSKKQ

SEQ ID NO: 2614616 - protein, 4 aa, Entamoeba histolytica
EDNR

SEQ ID NO: 2614617 - protein, 10 aa, Entamoeba histolytica
EDNSGSIEGE

SEQ ID NO: 2614618 - protein, 5 aa, Entamoeba histolytica
EDNSL

SEQ ID NO: 2614619 - protein, 8 aa, Entamoeba histolytica
EDNSSRSA

SEQ ID NO: 2614620 - protein, 6 aa, Entamoeba histolytica
EDNTNI

SEQ ID NO: 2614621 - protein, 31 aa, Entamoeba histolytica
EDNTNYDEDENEEDYEYGDEEDEEVEYYDED

SEQ ID NO: 2614622 - protein, 6 aa, Entamoeba histolytica
EDNYSD

SEQ ID NO: 2614623 - protein, 8 aa, Entamoeba histolytica
EDPCREQT

SEQ ID NO: 2614624 - protein, 11 aa, Entamoeba histolytica
EDPCSQRGNEL

SEQ ID NO: 2614625 - protein, 5 aa, Entamoeba histolytica
EDPEN

SEQ ID NO: 2614626 - protein, 10 aa, Entamoeba histolytica
EDPGKAAKIR

SEQ ID NO: 2614627 - protein, 5 aa, Entamoeba histolytica
EDPHE

SEQ ID NO: 2614628 - protein, 5 aa, Entamoeba histolytica
EDPIE

SEQ ID NO: 2614629 - protein, 9 aa, Entamoeba histolytica
EDPKEAIAD

SEQ ID NO: 2614630 - protein, 8 aa, Entamoeba histolytica
EDPKKTLE

SEQ ID NO: 2614631 - protein, 7 aa, Entamoeba histolytica
EDPKKYY

SEQ ID NO: 2614632 - protein, 5 aa, Entamoeba histolytica
EDPKV

SEQ ID NO: 2614633 - protein, 9 aa, Entamoeba histolytica
EDPLVEQSK

SEQ ID NO: 2614634 - protein, 4 aa, Entamoeba histolytica
EDPN

SEQ ID NO: 2614635 - protein, 9 aa, Entamoeba histolytica
EDPQSKWQQ

SEQ ID NO: 2614636 - protein, 10 aa, Entamoeba histolytica
EDPRQKNREL

SEQ ID NO: 2614637 - protein, 121 aa, Entamoeba histolytica
EDPSEKELKETEERLKREAEEAERKRKEEEERLAAEEAERKRKEEEERLRKEEEERLKKEEEERLKKEEEERLRKEEEERLRKEEEERLAAEEAERKRKELEAAKTPSPTPEEEKKKEKEL

SEQ ID NO: 2614638 - protein, 28 aa, Entamoeba histolytica
EDPSIEKRKNNKKGARRSIQDEEDTDIE

SEQ ID NO: 2614639 - protein, 6 aa, Entamoeba histolytica
EDPTDV

SEQ ID NO: 2614640 - protein, 8 aa, Entamoeba histolytica
EDPTKERD

SEQ ID NO: 2614641 - protein, 8 aa, Entamoeba histolytica
EDPTKKID

SEQ ID NO: 2614642 - protein, 4 aa, Entamoeba histolytica
EDPY

SEQ ID NO: 2614643 - protein, 6 aa, Entamoeba histolytica
EDQANQ

SEQ ID NO: 2614644 - protein, 16 aa, Entamoeba histolytica
EDQDGFKISSDDEQSL

SEQ ID NO: 2614645 - protein, 7 aa, Entamoeba histolytica
EDQKESL

SEQ ID NO: 2614646 - protein, 14 aa, Entamoeba histolytica
EDQKNQLSFGIDLS

SEQ ID NO: 2614647 - protein, 14 aa, Entamoeba histolytica
EDQNGGDRKWRTKE

SEQ ID NO: 2614648 - protein, 7 aa, Entamoeba histolytica
EDQNGNH

SEQ ID NO: 2614649 - protein, 7 aa, Entamoeba histolytica
EDQNVKN

SEQ ID NO: 2614650 - protein, 7 aa, Entamoeba histolytica
EDQPTEG

SEQ ID NO: 2614651 - protein, 9 aa, Entamoeba histolytica
EDQQDFNDV

SEQ ID NO: 2614652 - protein, 6 aa, Entamoeba histolytica
EDQRAY

SEQ ID NO: 2614653 - protein, 7 aa, Entamoeba histolytica
EDQTKPF

SEQ ID NO: 2614654 - protein, 5 aa, Entamoeba histolytica
EDQTN

SEQ ID NO: 2614655 - protein, 5 aa, Entamoeba histolytica
EDQTR

SEQ ID NO: 2614656 - protein, 7 aa, Entamoeba histolytica
EDQTSIP

SEQ ID NO: 2614657 - protein, 8 aa, Entamoeba histolytica
EDRAKASK

SEQ ID NO: 2614658 - protein, 5 aa, Entamoeba histolytica
EDRDP

SEQ ID NO: 2614659 - protein, 5 aa, Entamoeba histolytica
EDREE

SEQ ID NO: 2614660 - protein, 14 aa, Entamoeba histolytica
EDREKYGNEIPTEV

SEQ ID NO: 2614661 - protein, 13 aa, Entamoeba histolytica
EDRFGTDGSSFPI

SEQ ID NO: 2614662 - protein, 5 aa, Entamoeba histolytica
EDRGA

SEQ ID NO: 2614663 - protein, 11 aa, Entamoeba histolytica
EDRGMSNSNVV

SEQ ID NO: 2614664 - protein, 5 aa, Entamoeba histolytica
EDRHE

SEQ ID NO: 2614665 - protein, 11 aa, Entamoeba histolytica
EDRIESEESQI

SEQ ID NO: 2614666 - protein, 6 aa, Entamoeba histolytica
EDRKKD

SEQ ID NO: 2614667 - protein, 7 aa, Entamoeba histolytica
EDRKKGY

SEQ ID NO: 2614668 - protein, 7 aa, Entamoeba histolytica
EDRKLEQ

SEQ ID NO: 2614669 - protein, 12 aa, Entamoeba histolytica
EDRTILKPQFLK

SEQ ID NO: 2614670 - protein, 7 aa, Entamoeba histolytica
EDRTKPI

SEQ ID NO: 2614671 - protein, 6 aa, Entamoeba histolytica
EDRTSS

SEQ ID NO: 2614672 - protein, 5 aa, Entamoeba histolytica
EDRYH

SEQ ID NO: 2614673 - protein, 8 aa, Entamoeba histolytica
EDSALYEG

SEQ ID NO: 2614674 - protein, 6 aa, Entamoeba histolytica
EDSDKV

SEQ ID NO: 2614675 - protein, 8 aa, Entamoeba histolytica
EDSDNGIS

SEQ ID NO: 2614676 - protein, 13 aa, Entamoeba histolytica
EDSDTEQDNQNDL

SEQ ID NO: 2614677 - protein, 6 aa, Entamoeba histolytica
EDSFER

SEQ ID NO: 2614678 - protein, 8 aa, Entamoeba histolytica
EDSGKTGY

SEQ ID NO: 2614679 - protein, 6 aa, Entamoeba histolytica
EDSGSN

SEQ ID NO: 2614680 - protein, 12 aa, Entamoeba histolytica
EDSHELKENEHA

SEQ ID NO: 2614681 - protein, 5 aa, Entamoeba histolytica
EDSIK

SEQ ID NO: 2614682 - protein, 8 aa, Entamoeba histolytica
EDSKEPVG

SEQ ID NO: 2614683 - protein, 13 aa, Entamoeba histolytica
EDSKITSNANESL

SEQ ID NO: 2614684 - protein, 5 aa, Entamoeba histolytica
EDSKS

SEQ ID NO: 2614685 - protein, 7 aa, Entamoeba histolytica
EDSKSEI

SEQ ID NO: 2614686 - protein, 8 aa, Entamoeba histolytica
EDSKVEKD

SEQ ID NO: 2614687 - protein, 7 aa, Entamoeba histolytica
EDSNVNK

SEQ ID NO: 2614688 - protein, 8 aa, Entamoeba histolytica
EDSPMDAG

SEQ ID NO: 2614689 - protein, 9 aa, Entamoeba histolytica
EDSPRVLSD

SEQ ID NO: 2614690 - protein, 20 aa, Entamoeba histolytica
EDSPYSNESEEYSSQEDEYE

SEQ ID NO: 2614691 - protein, 14 aa, Entamoeba histolytica
EDSQEGDISGFQTG

SEQ ID NO: 2614692 - protein, 7 aa, Entamoeba histolytica
EDSQNKG

SEQ ID NO: 2614693 - protein, 8 aa, Entamoeba histolytica
EDSRKPLK

SEQ ID NO: 2614694 - protein, 9 aa, Entamoeba histolytica
EDSSDLDRR

SEQ ID NO: 2614695 - protein, 6 aa, Entamoeba histolytica
EDSSIV

SEQ ID NO: 2614696 - protein, 11 aa, Entamoeba histolytica
EDSSKKIREPF

SEQ ID NO: 2614697 - protein, 6 aa, Entamoeba histolytica
EDSSSL

SEQ ID NO: 2614698 - protein, 7 aa, Entamoeba histolytica
EDSSYDV

SEQ ID NO: 2614699 - protein, 4 aa, Entamoeba histolytica
EDST

SEQ ID NO: 2614700 - protein, 9 aa, Entamoeba histolytica
EDSTKRSDY

SEQ ID NO: 2614701 - protein, 4 aa, Entamoeba histolytica
EDSV

SEQ ID NO: 2614702 - protein, 12 aa, Entamoeba histolytica
EDSVEDNDYSKM

SEQ ID NO: 2614703 - protein, 9 aa, Entamoeba histolytica
EDSVEEKKD

SEQ ID NO: 2614704 - protein, 8 aa, Entamoeba histolytica
EDSVKAQS

SEQ ID NO: 2614705 - protein, 9 aa, Entamoeba histolytica
EDSWDKGIP

SEQ ID NO: 2614706 - protein, 10 aa, Entamoeba histolytica
EDSYGKTNVG

SEQ ID NO: 2614707 - protein, 8 aa, Entamoeba histolytica
EDTAKRLP

SEQ ID NO: 2614708 - protein, 5 aa, Entamoeba histolytica
EDTAS

SEQ ID NO: 2614709 - protein, 4 aa, Entamoeba histolytica
EDTC

SEQ ID NO: 2614710 - protein, 4 aa, Entamoeba histolytica
EDTE

SEQ ID NO: 2614711 - protein, 8 aa, Entamoeba histolytica
EDTFKTNQ

SEQ ID NO: 2614712 - protein, 4 aa, Entamoeba histolytica
EDTI

SEQ ID NO: 2614713 - protein, 14 aa, Entamoeba histolytica
EDTIDDKEEGDSIK

SEQ ID NO: 2614714 - protein, 6 aa, Entamoeba histolytica
EDTNGE

SEQ ID NO: 2614715 - protein, 7 aa, Entamoeba histolytica
EDTNTTR

SEQ ID NO: 2614716 - protein, 4 aa, Entamoeba histolytica
EDTP

SEQ ID NO: 2614717 - protein, 7 aa, Entamoeba histolytica
EDTPQKT

SEQ ID NO: 2614718 - protein, 23 aa, Entamoeba histolytica
EDTPTSELAKTARALSSNQNPEL

SEQ ID NO: 2614719 - protein, 6 aa, Entamoeba histolytica
EDTQMD

SEQ ID NO: 2614720 - protein, 5 aa, Entamoeba histolytica
EDTQT

SEQ ID NO: 2614721 - protein, 4 aa, Entamoeba histolytica
EDTR

SEQ ID NO: 2614722 - protein, 13 aa, Entamoeba histolytica
EDTSERNKKENYY

SEQ ID NO: 2614723 - protein, 9 aa, Entamoeba histolytica
EDTSPELSR

SEQ ID NO: 2614724 - protein, 10 aa, Entamoeba histolytica
EDTSTTEGGC

SEQ ID NO: 2614725 - protein, 7 aa, Entamoeba histolytica
EDTTAKK

SEQ ID NO: 2614726 - protein, 15 aa, Entamoeba histolytica
EDTTGDKRDSQTKRV

SEQ ID NO: 2614727 - protein, 10 aa, Entamoeba histolytica
EDTTGNTKNI

SEQ ID NO: 2614728 - protein, 7 aa, Entamoeba histolytica
EDTTNGS

SEQ ID NO: 2614729 - protein, 15 aa, Entamoeba histolytica
EDTVDKTSSKDIITP

SEQ ID NO: 2614730 - protein, 16 aa, Entamoeba histolytica
EDTYKINNNYQPQHTV

SEQ ID NO: 2614731 - protein, 6 aa, Entamoeba histolytica
EDVDDD

SEQ ID NO: 2614732 - protein, 10 aa, Entamoeba histolytica
EDVDDSDSFE

SEQ ID NO: 2614733 - protein, 6 aa, Entamoeba histolytica
EDVDPN

SEQ ID NO: 2614734 - protein, 14 aa, Entamoeba histolytica
EDVEEEVKAKCGSV

SEQ ID NO: 2614735 - protein, 13 aa, Entamoeba histolytica
EDVEGKWSTSSSV

SEQ ID NO: 2614736 - protein, 14 aa, Entamoeba histolytica
EDVENGIPDNQLPT

SEQ ID NO: 2614737 - protein, 8 aa, Entamoeba histolytica
EDVEQKRS

SEQ ID NO: 2614738 - protein, 14 aa, Entamoeba histolytica
EDVHEARKKRIQEE

SEQ ID NO: 2614739 - protein, 6 aa, Entamoeba histolytica
EDVIPS

SEQ ID NO: 2614740 - protein, 9 aa, Entamoeba histolytica
EDVKRNTKV

SEQ ID NO: 2614741 - protein, 4 aa, Entamoeba histolytica
EDVL

SEQ ID NO: 2614742 - protein, 15 aa, Entamoeba histolytica
EDVNSKTLDLKSGGE

SEQ ID NO: 2614743 - protein, 13 aa, Entamoeba histolytica
EDVPNQKKRSIDE

SEQ ID NO: 2614744 - protein, 24 aa, Entamoeba histolytica
EDVPTGVDNTKKKKAVPKVSQTAQ

SEQ ID NO: 2614745 - protein, 11 aa, Entamoeba histolytica
EDVSDHSDPSL

SEQ ID NO: 2614746 - protein, 6 aa, Entamoeba histolytica
EDVSKE

SEQ ID NO: 2614747 - protein, 5 aa, Entamoeba histolytica
EDYDG

SEQ ID NO: 2614748 - protein, 24 aa, Entamoeba histolytica
EDYDGYGIDPNITRQEFEEECEKR

SEQ ID NO: 2614749 - protein, 14 aa, Entamoeba histolytica
EDYDGYGIEPTITR

SEQ ID NO: 2614750 - protein, 15 aa, Entamoeba histolytica
EDYERSEESEYDDPN

SEQ ID NO: 2614751 - protein, 7 aa, Entamoeba histolytica
EDYKKGI

SEQ ID NO: 2614752 - protein, 22 aa, Entamoeba histolytica
EDYNKLKRDQNEIQKSQHDIDE

SEQ ID NO: 2614753 - protein, 6 aa, Entamoeba histolytica
EDYNTQ

SEQ ID NO: 2614754 - protein, 7 aa, Entamoeba histolytica
EDYPETH

SEQ ID NO: 2614755 - protein, 5 aa, Entamoeba histolytica
EDYQT

SEQ ID NO: 2614756 - protein, 9 aa, Entamoeba histolytica
EDYSNVADN

SEQ ID NO: 2614757 - protein, 17 aa, Entamoeba histolytica
EDYTDVPSTIKKQRDAL

SEQ ID NO: 2614758 - protein, 10 aa, Entamoeba histolytica
EDYTSHELSD

SEQ ID NO: 2614759 - protein, 8 aa, Entamoeba histolytica
EDYYNSGV

SEQ ID NO: 2614760 - protein, 4 aa, Entamoeba histolytica
EEAC

SEQ ID NO: 2614761 - protein, 6 aa, Entamoeba histolytica
EEADEK

SEQ ID NO: 2614762 - protein, 9 aa, Entamoeba histolytica
EEADSVRSG

SEQ ID NO: 2614763 - protein, 8 aa, Entamoeba histolytica
EEAEKNSP

SEQ ID NO: 2614764 - protein, 7 aa, Entamoeba histolytica
EEAENSI

SEQ ID NO: 2614765 - protein, 244 aa, Entamoeba histolytica
EEAGATSGEDTATTSQKESNTADKQNTQGATQPGTKDNQKTQNGVDSATGQSTATTAHTGYSTATDKQSDKSNGKGNTVQDGTTQNGQVTAGEGQKDEKGENTQTSGQDEKETAGGKSGQGSGEEGNSQKQTNGEGTEEKKEGKDSKNEQGDNFVDGAGKEPGTKSKDEQSGKPTSGTTETKDNTETTKGQDGKDKSEEKQQINQEEKKNNTTNTTDTSSENKTDDKTNNSHDEQNEQHNMDNA

SEQ ID NO: 2614766 - protein, 10 aa, Entamoeba histolytica
EEAGEPIKNI

SEQ ID NO: 2614767 - protein, 10 aa, Entamoeba histolytica
EEAGKYARNT

SEQ ID NO: 2614768 - protein, 6 aa, Entamoeba histolytica
EEAGVE

SEQ ID NO: 2614769 - protein, 4 aa, Entamoeba histolytica
EEAI

SEQ ID NO: 2614770 - protein, 5 aa, Entamoeba histolytica
EEAIN

SEQ ID NO: 2614771 - protein, 6 aa, Entamoeba histolytica
EEAKKE

SEQ ID NO: 2614772 - protein, 19 aa, Entamoeba histolytica
EEAKKNGKIEAVNQTNNGD

SEQ ID NO: 2614773 - protein, 13 aa, Entamoeba histolytica
EEAKKVDREQRQK

SEQ ID NO: 2614774 - protein, 15 aa, Entamoeba histolytica
EEAKKYKPQKKGGVA

SEQ ID NO: 2614775 - protein, 4 aa, Entamoeba histolytica
EEAL

SEQ ID NO: 2614776 - protein, 5 aa, Entamoeba histolytica
EEALQ

SEQ ID NO: 2614777 - protein, 7 aa, Entamoeba histolytica
EEAPGTS

SEQ ID NO: 2614778 - protein, 23 aa, Entamoeba histolytica
EEAQNESLNQNTSQQNQTPPPGF

SEQ ID NO: 2614779 - protein, 18 aa, Entamoeba histolytica
EEAQVEDDMVKDGKNTIE

SEQ ID NO: 2614780 - protein, 5 aa, Entamoeba histolytica
EEAQY

SEQ ID NO: 2614781 - protein, 5 aa, Entamoeba histolytica
EEARR

SEQ ID NO: 2614782 - protein, 7 aa, Entamoeba histolytica
EEASNRL

SEQ ID NO: 2614783 - protein, 7 aa, Entamoeba histolytica
EEASSVS

SEQ ID NO: 2614784 - protein, 4 aa, Entamoeba histolytica
EEAT

SEQ ID NO: 2614785 - protein, 9 aa, Entamoeba histolytica
EEATGDKAT

SEQ ID NO: 2614786 - protein, 7 aa, Entamoeba histolytica
EEAYEAE

SEQ ID NO: 2614787 - protein, 4 aa, Entamoeba histolytica
EECA

SEQ ID NO: 2614788 - protein, 18 aa, Entamoeba histolytica
EECAKEQERRKKAHLEER

SEQ ID NO: 2614789 - protein, 10 aa, Entamoeba histolytica
EECEKETFKE

SEQ ID NO: 2614790 - protein, 6 aa, Entamoeba histolytica
EECGNS

SEQ ID NO: 2614791 - protein, 10 aa, Entamoeba histolytica
EECKNETLKN

SEQ ID NO: 2614792 - protein, 7 aa, Entamoeba histolytica
EECNDEK

SEQ ID NO: 2614793 - protein, 4 aa, Entamoeba histolytica
EECP

SEQ ID NO: 2614794 - protein, 6 aa, Entamoeba histolytica
EECQNN

SEQ ID NO: 2614795 - protein, 5 aa, Entamoeba histolytica
EECRT

SEQ ID NO: 2614796 - protein, 5 aa, Entamoeba histolytica
EECSD

SEQ ID NO: 2614797 - protein, 13 aa, Entamoeba histolytica
EEDADGKYESNGY

SEQ ID NO: 2614798 - protein, 6 aa, Entamoeba histolytica
EEDADK

SEQ ID NO: 2614799 - protein, 6 aa, Entamoeba histolytica
EEDAKE

SEQ ID NO: 2614800 - protein, 7 aa, Entamoeba histolytica
EEDAQEI

SEQ ID NO: 2614801 - protein, 15 aa, Entamoeba histolytica
EEDATKALNSPTENV

SEQ ID NO: 2614802 - protein, 6 aa, Entamoeba histolytica
EEDCTE

SEQ ID NO: 2614803 - protein, 7 aa, Entamoeba histolytica
EEDDETV

SEQ ID NO: 2614804 - protein, 13 aa, Entamoeba histolytica
EEDDGNDEEWEDG

SEQ ID NO: 2614805 - protein, 12 aa, Entamoeba histolytica
EEDDNDEIHAQG

SEQ ID NO: 2614806 - protein, 26 aa, Entamoeba histolytica
EEDDTTTQTTSGTTATNTNDHQRRRY

SEQ ID NO: 2614807 - protein, 26 aa, Entamoeba histolytica
EEDECEKPISITKPQEIPRDNSSLGE

SEQ ID NO: 2614808 - protein, 12 aa, Entamoeba histolytica
EEDEDNEKNVES

SEQ ID NO: 2614809 - protein, 8 aa, Entamoeba histolytica
EEDEHEEI

SEQ ID NO: 2614810 - protein, 10 aa, Entamoeba histolytica
EEDEKDYQYL

SEQ ID NO: 2614811 - protein, 11 aa, Entamoeba histolytica
EEDEKVYDPEE

SEQ ID NO: 2614812 - protein, 8 aa, Entamoeba histolytica
EEDETSFS

SEQ ID NO: 2614813 - protein, 11 aa, Entamoeba histolytica
EEDEVNTLEEE

SEQ ID NO: 2614814 - protein, 12 aa, Entamoeba histolytica
EEDFKDQKQMEL

SEQ ID NO: 2614815 - protein, 10 aa, Entamoeba histolytica
EEDGDFEDPE

SEQ ID NO: 2614816 - protein, 8 aa, Entamoeba histolytica
EEDGIKSV

SEQ ID NO: 2614817 - protein, 9 aa, Entamoeba histolytica
EEDGNQEYK

SEQ ID NO: 2614818 - protein, 4 aa, Entamoeba histolytica
EEDI

SEQ ID NO: 2614819 - protein, 21 aa, Entamoeba histolytica
EEDKDEPNELNDQDFEELLKL

SEQ ID NO: 2614820 - protein, 5 aa, Entamoeba histolytica
EEDKE

SEQ ID NO: 2614821 - protein, 11 aa, Entamoeba histolytica
EEDKEEEIKEV

SEQ ID NO: 2614822 - protein, 9 aa, Entamoeba histolytica
EEDKERNEY

SEQ ID NO: 2614823 - protein, 11 aa, Entamoeba histolytica
EEDKESDIDGA

SEQ ID NO: 2614824 - protein, 5 aa, Entamoeba histolytica
EEDKK

SEQ ID NO: 2614825 - protein, 11 aa, Entamoeba histolytica
EEDKKEVESRF

SEQ ID NO: 2614826 - protein, 9 aa, Entamoeba histolytica
EEDKKSIQF

SEQ ID NO: 2614827 - protein, 45 aa, Entamoeba histolytica
EEDKQEAKSQINTEIKDKQIQGVSPNKSEEQDKYSSPEESTIKEE

SEQ ID NO: 2614828 - protein, 5 aa, Entamoeba histolytica
EEDKW

SEQ ID NO: 2614829 - protein, 13 aa, Entamoeba histolytica
EEDLENNEEIRKG

SEQ ID NO: 2614830 - protein, 6 aa, Entamoeba histolytica
EEDLSS

SEQ ID NO: 2614831 - protein, 8 aa, Entamoeba histolytica
EEDPTDPK

SEQ ID NO: 2614832 - protein, 8 aa, Entamoeba histolytica
EEDQQTAE

SEQ ID NO: 2614833 - protein, 9 aa, Entamoeba histolytica
EEDQTRQKE

SEQ ID NO: 2614834 - protein, 7 aa, Entamoeba histolytica
EEDQYDD

SEQ ID NO: 2614835 - protein, 5 aa, Entamoeba histolytica
EEDRS

SEQ ID NO: 2614836 - protein, 11 aa, Entamoeba histolytica
EEDSDKADSVY

SEQ ID NO: 2614837 - protein, 12 aa, Entamoeba histolytica
EEDSTIHKSQPI

SEQ ID NO: 2614838 - protein, 21 aa, Entamoeba histolytica
EEDTEDTEEEKTDMTKKGRYA

SEQ ID NO: 2614839 - protein, 21 aa, Entamoeba histolytica
EEDTFHPNEIKERSQSSISKN

SEQ ID NO: 2614840 - protein, 6 aa, Entamoeba histolytica
EEDTKL

SEQ ID NO: 2614841 - protein, 17 aa, Entamoeba histolytica
EEDTNDVVEKEKVNEQY

SEQ ID NO: 2614842 - protein, 19 aa, Entamoeba histolytica
EEDVDEEVFTEKNKEQPVE

SEQ ID NO: 2614843 - protein, 5 aa, Entamoeba histolytica
EEDVE

SEQ ID NO: 2614844 - protein, 6 aa, Entamoeba histolytica
EEDVNN

SEQ ID NO: 2614845 - protein, 5 aa, Entamoeba histolytica
EEDVS

SEQ ID NO: 2614846 - protein, 4 aa, Entamoeba histolytica
EEDY

SEQ ID NO: 2614847 - protein, 7 aa, Entamoeba histolytica
EEEAAPV

SEQ ID NO: 2614848 - protein, 8 aa, Entamoeba histolytica
EEEAQQLE

SEQ ID NO: 2614849 - protein, 6 aa, Entamoeba histolytica
EEECNE

SEQ ID NO: 2614850 - protein, 15 aa, Entamoeba histolytica
EEECNKEAKGYSPEE

SEQ ID NO: 2614851 - protein, 6 aa, Entamoeba histolytica
EEECNV

SEQ ID NO: 2614852 - protein, 6 aa, Entamoeba histolytica
EEEDFS

SEQ ID NO: 2614853 - protein, 11 aa, Entamoeba histolytica
EEEDKEEYGEV

SEQ ID NO: 2614854 - protein, 12 aa, Entamoeba histolytica
EEEDQSVKIPPI

SEQ ID NO: 2614855 - protein, 10 aa, Entamoeba histolytica
EEEDSNELET

SEQ ID NO: 2614856 - protein, 10 aa, Entamoeba histolytica
EEEDYKSSLP

SEQ ID NO: 2614857 - protein, 9 aa, Entamoeba histolytica
EEEEARDTM

SEQ ID NO: 2614858 - protein, 55 aa, Entamoeba histolytica
EEEEEIEDEEEEEVEEGVEDEEEEEDESDEEVDEKDDEEEVEEEEEEEEEDSVEE

SEQ ID NO: 2614859 - protein, 7 aa, Entamoeba histolytica
EEEEEKI

SEQ ID NO: 2614860 - protein, 8 aa, Entamoeba histolytica
EEEEEKMA

SEQ ID NO: 2614861 - protein, 26 aa, Entamoeba histolytica
EEEEEPPEQIDGIDSEKRKGVKQQQM

SEQ ID NO: 2614862 - protein, 7 aa, Entamoeba histolytica
EEEEEQI

SEQ ID NO: 2614863 - protein, 12 aa, Entamoeba histolytica
EEEEIKENTKGE

SEQ ID NO: 2614864 - protein, 9 aa, Entamoeba histolytica
EEEEITPTA

SEQ ID NO: 2614865 - protein, 23 aa, Entamoeba histolytica
EEEEKEREKEIKELEGGDEQKEI

SEQ ID NO: 2614866 - protein, 12 aa, Entamoeba histolytica
EEEEKKIEEQED

SEQ ID NO: 2614867 - protein, 15 aa, Entamoeba histolytica
EEEEKPKKETIVEEQ

SEQ ID NO: 2614868 - protein, 34 aa, Entamoeba histolytica
EEEEKVEKEEEDSTIQKDKKTNEENKESLKEVTS

SEQ ID NO: 2614869 - protein, 19 aa, Entamoeba histolytica
EEEENLSQIPTDIQDDCNS

SEQ ID NO: 2614870 - protein, 14 aa, Entamoeba histolytica
EEEENQQSDEEANI

SEQ ID NO: 2614871 - protein, 8 aa, Entamoeba histolytica
EEEEPING

SEQ ID NO: 2614872 - protein, 6 aa, Entamoeba histolytica
EEEEQI

SEQ ID NO: 2614873 - protein, 49 aa, Entamoeba histolytica
EEEEREAKRLEEKRKKEQKKQQKEEAKAAKKKEKEIEAQLKKAKKAEKK

SEQ ID NO: 2614874 - protein, 6 aa, Entamoeba histolytica
EEEERK

SEQ ID NO: 2614875 - protein, 13 aa, Entamoeba histolytica
EEEERRKKENEII

SEQ ID NO: 2614876 - protein, 7 aa, Entamoeba histolytica
EEEESQY

SEQ ID NO: 2614877 - protein, 9 aa, Entamoeba histolytica
EEEETNGDE

SEQ ID NO: 2614878 - protein, 7 aa, Entamoeba histolytica
EEEGCDV

SEQ ID NO: 2614879 - protein, 25 aa, Entamoeba histolytica
EEEGEAPTPKEEKKEKYKETKADAL

SEQ ID NO: 2614880 - protein, 8 aa, Entamoeba histolytica
EEEGGGKK

SEQ ID NO: 2614881 - protein, 5 aa, Entamoeba histolytica
EEEGI

SEQ ID NO: 2614882 - protein, 8 aa, Entamoeba histolytica
EEEGKMQN

SEQ ID NO: 2614883 - protein, 5 aa, Entamoeba histolytica
EEEGN

SEQ ID NO: 2614884 - protein, 5 aa, Entamoeba histolytica
EEEGT

SEQ ID NO: 2614885 - protein, 4 aa, Entamoeba histolytica
EEEH

SEQ ID NO: 2614886 - protein, 6 aa, Entamoeba histolytica
EEEHNK

SEQ ID NO: 2614887 - protein, 15 aa, Entamoeba histolytica
EEEIDDTKENILQED

SEQ ID NO: 2614888 - protein, 16 aa, Entamoeba histolytica
EEEIPDHLQNPPDCNA

SEQ ID NO: 2614889 - protein, 21 aa, Entamoeba histolytica
EEEISGYDCSESVDSLKKSKE

SEQ ID NO: 2614890 - protein, 8 aa, Entamoeba histolytica
EEEITEIE

SEQ ID NO: 2614891 - protein, 24 aa, Entamoeba histolytica
EEEKDDLEQDRADVSATKDDIAKK

SEQ ID NO: 2614892 - protein, 5 aa, Entamoeba histolytica
EEEKE

SEQ ID NO: 2614893 - protein, 14 aa, Entamoeba histolytica
EEEKENKMEEEKKY

SEQ ID NO: 2614894 - protein, 7 aa, Entamoeba histolytica
EEEKESA

SEQ ID NO: 2614895 - protein, 16 aa, Entamoeba histolytica
EEEKETKLNTIKPGFS

SEQ ID NO: 2614896 - protein, 15 aa, Entamoeba histolytica
EEEKIDGNGLQELGK

SEQ ID NO: 2614897 - protein, 21 aa, Entamoeba histolytica
EEEKIKTPEELDNENRKKVYE

SEQ ID NO: 2614898 - protein, 11 aa, Entamoeba histolytica
EEEKITEENQE

SEQ ID NO: 2614899 - protein, 8 aa, Entamoeba histolytica
EEEKKEKE

SEQ ID NO: 2614900 - protein, 19 aa, Entamoeba histolytica
EEEKKEKESISNEFEETKE

SEQ ID NO: 2614901 - protein, 7 aa, Entamoeba histolytica
EEEKKEM

SEQ ID NO: 2614902 - protein, 10 aa, Entamoeba histolytica
EEEKKQEQEV

SEQ ID NO: 2614903 - protein, 12 aa, Entamoeba histolytica
EEELKKNETIPK

SEQ ID NO: 2614904 - protein, 4 aa, Entamoeba histolytica
EEEM

SEQ ID NO: 2614905 - protein, 11 aa, Entamoeba histolytica
EEEMDFSEQGN

SEQ ID NO: 2614906 - protein, 6 aa, Entamoeba histolytica
EEEMEI

SEQ ID NO: 2614907 - protein, 5 aa, Entamoeba histolytica
EEEMK

SEQ ID NO: 2614908 - protein, 7 aa, Entamoeba histolytica
EEEMKKG

SEQ ID NO: 2614909 - protein, 22 aa, Entamoeba histolytica
EEENDEAQRKRINKPDNYPLKR

SEQ ID NO: 2614910 - protein, 10 aa, Entamoeba histolytica
EEENDKEKIE

SEQ ID NO: 2614911 - protein, 5 aa, Entamoeba histolytica
EEENE

SEQ ID NO: 2614912 - protein, 6 aa, Entamoeba histolytica
EEENEE

SEQ ID NO: 2614913 - protein, 18 aa, Entamoeba histolytica
EEENEEHVNETDEERTNR

SEQ ID NO: 2614914 - protein, 7 aa, Entamoeba histolytica
EEENEEY

SEQ ID NO: 2614915 - protein, 8 aa, Entamoeba histolytica
EEENKQLT

SEQ ID NO: 2614916 - protein, 8 aa, Entamoeba histolytica
EEENNQKL

SEQ ID NO: 2614917 - protein, 5 aa, Entamoeba histolytica
EEENS

SEQ ID NO: 2614918 - protein, 13 aa, Entamoeba histolytica
EEEPADENIEHNE

SEQ ID NO: 2614919 - protein, 12 aa, Entamoeba histolytica
EEEPETDETHTY

SEQ ID NO: 2614920 - protein, 7 aa, Entamoeba histolytica
EEEPISQ

SEQ ID NO: 2614921 - protein, 5 aa, Entamoeba histolytica
EEEPK

SEQ ID NO: 2614922 - protein, 6 aa, Entamoeba histolytica
EEEPME

SEQ ID NO: 2614923 - protein, 7 aa, Entamoeba histolytica
EEEQEEI

SEQ ID NO: 2614924 - protein, 14 aa, Entamoeba histolytica
EEEQLEYDEEKEVL

SEQ ID NO: 2614925 - protein, 14 aa, Entamoeba histolytica
EEEQQNPNQTEIPQ

SEQ ID NO: 2614926 - protein, 6 aa, Entamoeba histolytica
EEEQRS

SEQ ID NO: 2614927 - protein, 5 aa, Entamoeba histolytica
EEEQV

SEQ ID NO: 2614928 - protein, 31 aa, Entamoeba histolytica
EEERDEIDYENSTECTSSSTTSDSINESTFI

SEQ ID NO: 2614929 - protein, 10 aa, Entamoeba histolytica
EEERELSNTY

SEQ ID NO: 2614930 - protein, 17 aa, Entamoeba histolytica
EEERTNKKINKGVGDGY

SEQ ID NO: 2614931 - protein, 6 aa, Entamoeba histolytica
EEERTS

SEQ ID NO: 2614932 - protein, 8 aa, Entamoeba histolytica
EEERYSED

SEQ ID NO: 2614933 - protein, 11 aa, Entamoeba histolytica
EEESAQQVNEA

SEQ ID NO: 2614934 - protein, 13 aa, Entamoeba histolytica
EEESGASKEKKQL

SEQ ID NO: 2614935 - protein, 7 aa, Entamoeba histolytica
EEESKEL

SEQ ID NO: 2614936 - protein, 7 aa, Entamoeba histolytica
EEESKKL

SEQ ID NO: 2614937 - protein, 45 aa, Entamoeba histolytica
EEETDDKRGRSNSRKRSRSNSLIRKGEEHSMPRQEMRDKAERLRR

SEQ ID NO: 2614938 - protein, 6 aa, Entamoeba histolytica
EEETDK

SEQ ID NO: 2614939 - protein, 5 aa, Entamoeba histolytica
EEETE

SEQ ID NO: 2614940 - protein, 16 aa, Entamoeba histolytica
EEETKKSPETNKKEIM

SEQ ID NO: 2614941 - protein, 7 aa, Entamoeba histolytica
EEETQVP

SEQ ID NO: 2614942 - protein, 6 aa, Entamoeba histolytica
EEETRE

SEQ ID NO: 2614943 - protein, 10 aa, Entamoeba histolytica
EEETRFESTE

SEQ ID NO: 2614944 - protein, 15 aa, Entamoeba histolytica
EEETRKEDVETIPKT

SEQ ID NO: 2614945 - protein, 12 aa, Entamoeba histolytica
EEETRRQEEELK

SEQ ID NO: 2614946 - protein, 7 aa, Entamoeba histolytica
EEETSPI

SEQ ID NO: 2614947 - protein, 14 aa, Entamoeba histolytica
EEETSQVDKTTQNL

SEQ ID NO: 2614948 - protein, 8 aa, Entamoeba histolytica
EEEVEEGD

SEQ ID NO: 2614949 - protein, 7 aa, Entamoeba histolytica
EEEVEEK

SEQ ID NO: 2614950 - protein, 18 aa, Entamoeba histolytica
EEEVNEEEDVDADDVEAP

SEQ ID NO: 2614951 - protein, 8 aa, Entamoeba histolytica
EEEVSENC

SEQ ID NO: 2614952 - protein, 17 aa, Entamoeba histolytica
EEEVSKYGDGREAQIKE

SEQ ID NO: 2614953 - protein, 14 aa, Entamoeba histolytica
EEEVSNEVKKEQEI

SEQ ID NO: 2614954 - protein, 10 aa, Entamoeba histolytica
EEEWKNETLK

SEQ ID NO: 2614955 - protein, 4 aa, Entamoeba histolytica
EEEY

SEQ ID NO: 2614956 - protein, 6 aa, Entamoeba histolytica
EEEYGY

SEQ ID NO: 2614957 - protein, 6 aa, Entamoeba histolytica
EEEYKQ

SEQ ID NO: 2614958 - protein, 15 aa, Entamoeba histolytica
EEEYPFDEPQPVSIP

SEQ ID NO: 2614959 - protein, 13 aa, Entamoeba histolytica
EEEYSTNQGPDPI

SEQ ID NO: 2614960 - protein, 13 aa, Entamoeba histolytica
EEFEGTENGLNQL

SEQ ID NO: 2614961 - protein, 13 aa, Entamoeba histolytica
EEFENNKGDDIKT

SEQ ID NO: 2614962 - protein, 13 aa, Entamoeba histolytica
EEFERKKRSVEER

SEQ ID NO: 2614963 - protein, 5 aa, Entamoeba histolytica
EEFKN

SEQ ID NO: 2614964 - protein, 5 aa, Entamoeba histolytica
EEFKS

SEQ ID NO: 2614965 - protein, 14 aa, Entamoeba histolytica
EEFQQEKQKLEAEI

SEQ ID NO: 2614966 - protein, 9 aa, Entamoeba histolytica
EEFSNSNNL

SEQ ID NO: 2614967 - protein, 8 aa, Entamoeba histolytica
EEFSQETL

SEQ ID NO: 2614968 - protein, 12 aa, Entamoeba histolytica
EEFTKKTKTLTE

SEQ ID NO: 2614969 - protein, 6 aa, Entamoeba histolytica
EEFTKQ

SEQ ID NO: 2614970 - protein, 5 aa, Entamoeba histolytica
EEGAE

SEQ ID NO: 2614971 - protein, 15 aa, Entamoeba histolytica
EEGAIDSTEETETFE

SEQ ID NO: 2614972 - protein, 7 aa, Entamoeba histolytica
EEGAKKG

SEQ ID NO: 2614973 - protein, 10 aa, Entamoeba histolytica
EEGASEEDKK

SEQ ID NO: 2614974 - protein, 13 aa, Entamoeba histolytica
EEGCRNKGNSDSR

SEQ ID NO: 2614975 - protein, 10 aa, Entamoeba histolytica
EEGDENKYEI

SEQ ID NO: 2614976 - protein, 8 aa, Entamoeba histolytica
EEGDGGEL

SEQ ID NO: 2614977 - protein, 5 aa, Entamoeba histolytica
EEGEI

SEQ ID NO: 2614978 - protein, 8 aa, Entamoeba histolytica
EEGEKKQL

SEQ ID NO: 2614979 - protein, 14 aa, Entamoeba histolytica
EEGFSVKSNNSGFN

SEQ ID NO: 2614980 - protein, 5 aa, Entamoeba histolytica
EEGGG

SEQ ID NO: 2614981 - protein, 4 aa, Entamoeba histolytica
EEGI

SEQ ID NO: 2614982 - protein, 5 aa, Entamoeba histolytica
EEGIQ

SEQ ID NO: 2614983 - protein, 7 aa, Entamoeba histolytica
EEGITDE

SEQ ID NO: 2614984 - protein, 8 aa, Entamoeba histolytica
EEGKGIEM

SEQ ID NO: 2614985 - protein, 8 aa, Entamoeba histolytica
EEGKNLSI

SEQ ID NO: 2614986 - protein, 6 aa, Entamoeba histolytica
EEGKQC

SEQ ID NO: 2614987 - protein, 4 aa, Entamoeba histolytica
EEGM

SEQ ID NO: 2614988 - protein, 4 aa, Entamoeba histolytica
EEGN

SEQ ID NO: 2614989 - protein, 7 aa, Entamoeba histolytica
EEGNAEI

SEQ ID NO: 2614990 - protein, 8 aa, Entamoeba histolytica
EEGNESEE

SEQ ID NO: 2614991 - protein, 9 aa, Entamoeba histolytica
EEGNKFGGY

SEQ ID NO: 2614992 - protein, 14 aa, Entamoeba histolytica
EEGNQKEFKTRESE

SEQ ID NO: 2614993 - protein, 14 aa, Entamoeba histolytica
EEGNQTNEELNEDD

SEQ ID NO: 2614994 - protein, 9 aa, Entamoeba histolytica
EEGNSSQEL

SEQ ID NO: 2614995 - protein, 10 aa, Entamoeba histolytica
EEGPHSKKPM

SEQ ID NO: 2614996 - protein, 14 aa, Entamoeba histolytica
EEGPKLKKYEPKKA

SEQ ID NO: 2614997 - protein, 5 aa, Entamoeba histolytica
EEGQF

SEQ ID NO: 2614998 - protein, 7 aa, Entamoeba histolytica
EEGQKNI

SEQ ID NO: 2614999 - protein, 4 aa, Entamoeba histolytica
EEGS

SEQ ID NO: 2615000 - protein, 6 aa, Entamoeba histolytica
EEGTLE

SEQ ID NO: 2615001 - protein, 5 aa, Entamoeba histolytica
EEGTR

SEQ ID NO: 2615002 - protein, 6 aa, Entamoeba histolytica
EEGVDT

SEQ ID NO: 2615003 - protein, 6 aa, Entamoeba histolytica
EEGVGN

SEQ ID NO: 2615004 - protein, 19 aa, Entamoeba histolytica
EEGYSIKKKKNDGMKRKEE

SEQ ID NO: 2615005 - protein, 28 aa, Entamoeba histolytica
EEHAGGAIARPSYDLGESCDASKYAEGY

SEQ ID NO: 2615006 - protein, 8 aa, Entamoeba histolytica
EEHDVDNK

SEQ ID NO: 2615007 - protein, 9 aa, Entamoeba histolytica
EEHGEYSKA

SEQ ID NO: 2615008 - protein, 6 aa, Entamoeba histolytica
EEHGKE

SEQ ID NO: 2615009 - protein, 8 aa, Entamoeba histolytica
EEHGKNIE

SEQ ID NO: 2615010 - protein, 6 aa, Entamoeba histolytica
EEHIQP

SEQ ID NO: 2615011 - protein, 6 aa, Entamoeba histolytica
EEHKEE

SEQ ID NO: 2615012 - protein, 5 aa, Entamoeba histolytica
EEHKG

SEQ ID NO: 2615013 - protein, 8 aa, Entamoeba histolytica
EEHKTYPL

SEQ ID NO: 2615014 - protein, 16 aa, Entamoeba histolytica
EEHPDIHSTGGGKEGI

SEQ ID NO: 2615015 - protein, 11 aa, Entamoeba histolytica
EEHQGEEVDGR

SEQ ID NO: 2615016 - protein, 5 aa, Entamoeba histolytica
EEIAY

SEQ ID NO: 2615017 - protein, 5 aa, Entamoeba histolytica
EEIDL

SEQ ID NO: 2615018 - protein, 11 aa, Entamoeba histolytica
EEIDNENEEIT

SEQ ID NO: 2615019 - protein, 5 aa, Entamoeba histolytica
EEIDS

SEQ ID NO: 2615020 - protein, 26 aa, Entamoeba histolytica
EEIDTKKIKAETVGDVNELDGDTKEL

SEQ ID NO: 2615021 - protein, 12 aa, Entamoeba histolytica
EEIDTNDAVPGS

SEQ ID NO: 2615022 - protein, 17 aa, Entamoeba histolytica
EEIEEEENEEEDTEETL

SEQ ID NO: 2615023 - protein, 6 aa, Entamoeba histolytica
EEIEEI

SEQ ID NO: 2615024 - protein, 6 aa, Entamoeba histolytica
EEIEEN

SEQ ID NO: 2615025 - protein, 10 aa, Entamoeba histolytica
EEIEGKTNEE

SEQ ID NO: 2615026 - protein, 13 aa, Entamoeba histolytica
EEIEGNSRLDPDN

SEQ ID NO: 2615027 - protein, 19 aa, Entamoeba histolytica
EEIEKKRENNQKIIEENEE

SEQ ID NO: 2615028 - protein, 7 aa, Entamoeba histolytica
EEIEKTP

SEQ ID NO: 2615029 - protein, 20 aa, Entamoeba histolytica
EEIENEESKLKYRQNVEENV

SEQ ID NO: 2615030 - protein, 22 aa, Entamoeba histolytica
EEIENKNEESTNQNNVKDDKVI

SEQ ID NO: 2615031 - protein, 5 aa, Entamoeba histolytica
EEIEQ

SEQ ID NO: 2615032 - protein, 21 aa, Entamoeba histolytica
EEIEQEKESNEIKKKEELQEL

SEQ ID NO: 2615033 - protein, 12 aa, Entamoeba histolytica
EEIESDQDFEDD

SEQ ID NO: 2615034 - protein, 6 aa, Entamoeba histolytica
EEIESY

SEQ ID NO: 2615035 - protein, 8 aa, Entamoeba histolytica
EEIETIPA

SEQ ID NO: 2615036 - protein, 7 aa, Entamoeba histolytica
EEIGEKR

SEQ ID NO: 2615037 - protein, 6 aa, Entamoeba histolytica
EEIGGL

SEQ ID NO: 2615038 - protein, 5 aa, Entamoeba histolytica
EEIGR

SEQ ID NO: 2615039 - protein, 12 aa, Entamoeba histolytica
EEIGSTNRRGAN

SEQ ID NO: 2615040 - protein, 4 aa, Entamoeba histolytica
EEIK

SEQ ID NO: 2615041 - protein, 5 aa, Entamoeba histolytica
EEIKE

SEQ ID NO: 2615042 - protein, 36 aa, Entamoeba histolytica
EEIKEEIKDEIKEETVDDINNSECSETYDPDEEDHQ

SEQ ID NO: 2615043 - protein, 11 aa, Entamoeba histolytica
EEIKEKKKEVI

SEQ ID NO: 2615044 - protein, 16 aa, Entamoeba histolytica
EEIKKDDGRKPSKKDY

SEQ ID NO: 2615045 - protein, 11 aa, Entamoeba histolytica
EEIKKDSPQRV

SEQ ID NO: 2615046 - protein, 18 aa, Entamoeba histolytica
EEIKKENGENKKEKGKIE

SEQ ID NO: 2615047 - protein, 28 aa, Entamoeba histolytica
EEIKKNEEKYLKEKEEMEKKIGGKDVRE

SEQ ID NO: 2615048 - protein, 23 aa, Entamoeba histolytica
EEIKKSEPILPKRKDKKTNYLSD

SEQ ID NO: 2615049 - protein, 5 aa, Entamoeba histolytica
EEIKP

SEQ ID NO: 2615050 - protein, 26 aa, Entamoeba histolytica
EEIKPIKNDNEIAKKKFKQAKEKYEA

SEQ ID NO: 2615051 - protein, 5 aa, Entamoeba histolytica
EEIKR

SEQ ID NO: 2615052 - protein, 10 aa, Entamoeba histolytica
EEIKRQQEKM

SEQ ID NO: 2615053 - protein, 10 aa, Entamoeba histolytica
EEIKSNKEDA

SEQ ID NO: 2615054 - protein, 6 aa, Entamoeba histolytica
EEIKSP

SEQ ID NO: 2615055 - protein, 13 aa, Entamoeba histolytica
EEIKTDKEQNAAF

SEQ ID NO: 2615056 - protein, 12 aa, Entamoeba histolytica
EEILESKEAKEC

SEQ ID NO: 2615057 - protein, 5 aa, Entamoeba histolytica
EEILT

SEQ ID NO: 2615058 - protein, 14 aa, Entamoeba histolytica
EEINEEERLEENNI

SEQ ID NO: 2615059 - protein, 17 aa, Entamoeba histolytica
EEINKEEVQTPNKKKST

SEQ ID NO: 2615060 - protein, 23 aa, Entamoeba histolytica
EEINKEKEEFEKNNEKNNNTINE

SEQ ID NO: 2615061 - protein, 8 aa, Entamoeba histolytica
EEINKSPA

SEQ ID NO: 2615062 - protein, 26 aa, Entamoeba histolytica
EEINNEKNNLSPEEVEEKLKEMKEKY

SEQ ID NO: 2615063 - protein, 12 aa, Entamoeba histolytica
EEINNSTSNGIR

SEQ ID NO: 2615064 - protein, 19 aa, Entamoeba histolytica
EEINNTEKEKEKKENQITR

SEQ ID NO: 2615065 - protein, 5 aa, Entamoeba histolytica
EEINY

SEQ ID NO: 2615066 - protein, 4 aa, Entamoeba histolytica
EEIP

SEQ ID NO: 2615067 - protein, 9 aa, Entamoeba histolytica
EEIPDTDQR

SEQ ID NO: 2615068 - protein, 5 aa, Entamoeba histolytica
EEIPG

SEQ ID NO: 2615069 - protein, 5 aa, Entamoeba histolytica
EEIPN

SEQ ID NO: 2615070 - protein, 8 aa, Entamoeba histolytica
EEIPRNDS

SEQ ID NO: 2615071 - protein, 21 aa, Entamoeba histolytica
EEIPSEEKKVLRKKEKKEIVT

SEQ ID NO: 2615072 - protein, 21 aa, Entamoeba histolytica
EEIQENKERIEKMKKEEKYKE

SEQ ID NO: 2615073 - protein, 15 aa, Entamoeba histolytica
EEIQKGKDVETQKIK

SEQ ID NO: 2615074 - protein, 92 aa, Entamoeba histolytica
EEIQKQEEEKNRLEEEEKRKLEEEIQKQKEEIQRQEEEIQKQEEEKMKLEEEKNRLEEEIQKQEEERQKQEEEKNKLEEEIQKQEEEKRMLE

SEQ ID NO: 2615075 - protein, 7 aa, Entamoeba histolytica
EEIQNQI

SEQ ID NO: 2615076 - protein, 13 aa, Entamoeba histolytica
EEIQQKQDTFDTP

SEQ ID NO: 2615077 - protein, 20 aa, Entamoeba histolytica
EEIQRRESIKSQRKLNEKSP

SEQ ID NO: 2615078 - protein, 11 aa, Entamoeba histolytica
EEIQSNPNTIN

SEQ ID NO: 2615079 - protein, 11 aa, Entamoeba histolytica
EEIRNEKYDPQ

SEQ ID NO: 2615080 - protein, 18 aa, Entamoeba histolytica
EEIRSKSFSQQPTENELG

SEQ ID NO: 2615081 - protein, 4 aa, Entamoeba histolytica
EEIS

SEQ ID NO: 2615082 - protein, 8 aa, Entamoeba histolytica
EEISPDGI

SEQ ID NO: 2615083 - protein, 8 aa, Entamoeba histolytica
EEISSRQI

SEQ ID NO: 2615084 - protein, 4 aa, Entamoeba histolytica
EEIT

SEQ ID NO: 2615085 - protein, 13 aa, Entamoeba histolytica
EEITEKDNDIKNL

SEQ ID NO: 2615086 - protein, 8 aa, Entamoeba histolytica
EEITGNDK

SEQ ID NO: 2615087 - protein, 52 aa, Entamoeba histolytica
EEITNEKSELTNEEDNQEHVTEKTEEGEETEETEETLEEDEDVKELNEEGKR

SEQ ID NO: 2615088 - protein, 11 aa, Entamoeba histolytica
EEITSSKPMDI

SEQ ID NO: 2615089 - protein, 8 aa, Entamoeba histolytica
EEITTMPE

SEQ ID NO: 2615090 - protein, 10 aa, Entamoeba histolytica
EEKAEKQAYD

SEQ ID NO: 2615091 - protein, 11 aa, Entamoeba histolytica
EEKAPHNTYRQ

SEQ ID NO: 2615092 - protein, 6 aa, Entamoeba histolytica
EEKATI

SEQ ID NO: 2615093 - protein, 13 aa, Entamoeba histolytica
EEKDCDKVNEIYE

SEQ ID NO: 2615094 - protein, 36 aa, Entamoeba histolytica
EEKDDEEEKDTRMEEAPNELSQNTTTEIKENDNQNI

SEQ ID NO: 2615095 - protein, 6 aa, Entamoeba histolytica
EEKDEM

SEQ ID NO: 2615096 - protein, 10 aa, Entamoeba histolytica
EEKDEMEQKV

SEQ ID NO: 2615097 - protein, 13 aa, Entamoeba histolytica
EEKDIKNNINTQR

SEQ ID NO: 2615098 - protein, 9 aa, Entamoeba histolytica
EEKDRKRAA

SEQ ID NO: 2615099 - protein, 15 aa, Entamoeba histolytica
EEKDTKLMENEQTIN

SEQ ID NO: 2615100 - protein, 13 aa, Entamoeba histolytica
EEKEEEKEVIESP

SEQ ID NO: 2615101 - protein, 6 aa, Entamoeba histolytica
EEKEEG

SEQ ID NO: 2615102 - protein, 8 aa, Entamoeba histolytica
EEKEEKIA

SEQ ID NO: 2615103 - protein, 10 aa, Entamoeba histolytica
EEKEEKKEMK

SEQ ID NO: 2615104 - protein, 19 aa, Entamoeba histolytica
EEKEENSQNNITNQPTTTI

SEQ ID NO: 2615105 - protein, 13 aa, Entamoeba histolytica
EEKEEREEAINET

SEQ ID NO: 2615106 - protein, 13 aa, Entamoeba histolytica
EEKEGNEEINEEY

SEQ ID NO: 2615107 - protein, 8 aa, Entamoeba histolytica
EEKEGSLR

SEQ ID NO: 2615108 - protein, 8 aa, Entamoeba histolytica
EEKEKGNR

SEQ ID NO: 2615109 - protein, 12 aa, Entamoeba histolytica
EEKEKKTKRKWL

SEQ ID NO: 2615110 - protein, 6 aa, Entamoeba histolytica
EEKEKP

SEQ ID NO: 2615111 - protein, 23 aa, Entamoeba histolytica
EEKEKQNENNNTIISRSSRKVAN

SEQ ID NO: 2615112 - protein, 20 aa, Entamoeba histolytica
EEKEKRKSAELELENKKDDI

SEQ ID NO: 2615113 - protein, 18 aa, Entamoeba histolytica
EEKENESESDDNEETKSQ

SEQ ID NO: 2615114 - protein, 18 aa, Entamoeba histolytica
EEKEQPEEEVEESNSVNE

SEQ ID NO: 2615115 - protein, 10 aa, Entamoeba histolytica
EEKEQPKGHK

SEQ ID NO: 2615116 - protein, 6 aa, Entamoeba histolytica
EEKEQT

SEQ ID NO: 2615117 - protein, 13 aa, Entamoeba histolytica
EEKERQKIVGEQQ

SEQ ID NO: 2615118 - protein, 24 aa, Entamoeba histolytica
EEKETKSPKTPKSIREPKREKKTQ

SEQ ID NO: 2615119 - protein, 5 aa, Entamoeba histolytica
EEKEV

SEQ ID NO: 2615120 - protein, 8 aa, Entamoeba histolytica
EEKEYKKA

SEQ ID NO: 2615121 - protein, 7 aa, Entamoeba histolytica
EEKGKGM

SEQ ID NO: 2615122 - protein, 6 aa, Entamoeba histolytica
EEKGTQ

SEQ ID NO: 2615123 - protein, 5 aa, Entamoeba histolytica
EEKGV

SEQ ID NO: 2615124 - protein, 7 aa, Entamoeba histolytica
EEKHKPK

SEQ ID NO: 2615125 - protein, 8 aa, Entamoeba histolytica
EEKIEGYS

SEQ ID NO: 2615126 - protein, 39 aa, Entamoeba histolytica
EEKIKEKEFTEEERENLKKELESKESLKKQNQKKEEELK

SEQ ID NO: 2615127 - protein, 14 aa, Entamoeba histolytica
EEKIKNKALQEELT

SEQ ID NO: 2615128 - protein, 30 aa, Entamoeba histolytica
EEKILNNEDDEDRSTNQQEEEEQKQQPIQE

SEQ ID NO: 2615129 - protein, 7 aa, Entamoeba histolytica
EEKINTQ

SEQ ID NO: 2615130 - protein, 15 aa, Entamoeba histolytica
EEKIPENERKTKSTA

SEQ ID NO: 2615131 - protein, 6 aa, Entamoeba histolytica
EEKIRK

SEQ ID NO: 2615132 - protein, 14 aa, Entamoeba histolytica
EEKITNKEKEMEEL

SEQ ID NO: 2615133 - protein, 15 aa, Entamoeba histolytica
EEKKDKEKQEEIQTQ

SEQ ID NO: 2615134 - protein, 39 aa, Entamoeba histolytica
EEKKEEVEKKPKKQQKQEKKEAKKAKKEAKKQAKGEEKI

SEQ ID NO: 2615135 - protein, 8 aa, Entamoeba histolytica
EEKKEGNI

SEQ ID NO: 2615136 - protein, 46 aa, Entamoeba histolytica
EEKKEQETKIGEDKEEQEEEKKVKDIEEKKEEFDRKEYYKKKNSET

SEQ ID NO: 2615137 - protein, 11 aa, Entamoeba histolytica
EEKKEQPSYPI

SEQ ID NO: 2615138 - protein, 22 aa, Entamoeba histolytica
EEKKERQNERRQLKRKEKKERI

SEQ ID NO: 2615139 - protein, 16 aa, Entamoeba histolytica
EEKKGDNQTKNKKNKE

SEQ ID NO: 2615140 - protein, 14 aa, Entamoeba histolytica
EEKKGVKPKESSDI

SEQ ID NO: 2615141 - protein, 5 aa, Entamoeba histolytica
EEKKI

SEQ ID NO: 2615142 - protein, 12 aa, Entamoeba histolytica
EEKKIGVKQPEN

SEQ ID NO: 2615143 - protein, 5 aa, Entamoeba histolytica
EEKKK

SEQ ID NO: 2615144 - protein, 9 aa, Entamoeba histolytica
EEKKKEVDI

SEQ ID NO: 2615145 - protein, 11 aa, Entamoeba histolytica
EEKKKRGRKRK

SEQ ID NO: 2615146 - protein, 22 aa, Entamoeba histolytica
EEKKKVAREQAFKKKQSKRADL

SEQ ID NO: 2615147 - protein, 9 aa, Entamoeba histolytica
EEKKNELKE

SEQ ID NO: 2615148 - protein, 25 aa, Entamoeba histolytica
EEKKPRTKKTESKDNKKKKNAKKDK

SEQ ID NO: 2615149 - protein, 8 aa, Entamoeba histolytica
EEKKRKNQ

SEQ ID NO: 2615150 - protein, 16 aa, Entamoeba histolytica
EEKKRLGAKGSEEVKN

SEQ ID NO: 2615151 - protein, 13 aa, Entamoeba histolytica
EEKKSSSDKELKK

SEQ ID NO: 2615152 - protein, 18 aa, Entamoeba histolytica
EEKKTEKIKEEIKTKEEQ

SEQ ID NO: 2615153 - protein, 8 aa, Entamoeba histolytica
EEKKTQLA

SEQ ID NO: 2615154 - protein, 4 aa, Entamoeba histolytica
EEKL

SEQ ID NO: 2615155 - protein, 9 aa, Entamoeba histolytica
EEKLENNAV

SEQ ID NO: 2615156 - protein, 10 aa, Entamoeba histolytica
EEKLKNENWN

SEQ ID NO: 2615157 - protein, 10 aa, Entamoeba histolytica
EEKLSNEEET

SEQ ID NO: 2615158 - protein, 9 aa, Entamoeba histolytica
EEKNEEITR

SEQ ID NO: 2615159 - protein, 6 aa, Entamoeba histolytica
EEKNEG

SEQ ID NO: 2615160 - protein, 6 aa, Entamoeba histolytica
EEKNKR

SEQ ID NO: 2615161 - protein, 12 aa, Entamoeba histolytica
EEKNNDSQTEDF

SEQ ID NO: 2615162 - protein, 6 aa, Entamoeba histolytica
EEKNQY

SEQ ID NO: 2615163 - protein, 7 aa, Entamoeba histolytica
EEKNRIK

SEQ ID NO: 2615164 - protein, 7 aa, Entamoeba histolytica
EEKPSFQ

SEQ ID NO: 2615165 - protein, 6 aa, Entamoeba histolytica
EEKPYC

SEQ ID NO: 2615166 - protein, 4 aa, Entamoeba histolytica
EEKQ

SEQ ID NO: 2615167 - protein, 7 aa, Entamoeba histolytica
EEKQDDR

SEQ ID NO: 2615168 - protein, 26 aa, Entamoeba histolytica
EEKQKEEANELSKQIKNCKDAQEREK

SEQ ID NO: 2615169 - protein, 35 aa, Entamoeba histolytica
EEKQKKEREEFEQKQLQEKNNLRKTISKKSNDIKD

SEQ ID NO: 2615170 - protein, 9 aa, Entamoeba histolytica
EEKQKQLNE

SEQ ID NO: 2615171 - protein, 7 aa, Entamoeba histolytica
EEKQPKE

SEQ ID NO: 2615172 - protein, 10 aa, Entamoeba histolytica
EEKQPKKALE

SEQ ID NO: 2615173 - protein, 53 aa, Entamoeba histolytica
EEKQRKKEEKEKKKLEKEQEKLKKKEEKEKKKKKESQTKEEKYAPKKDRSKRR

SEQ ID NO: 2615174 - protein, 20 aa, Entamoeba histolytica
EEKQRQRTNEVKKHGNTRPI

SEQ ID NO: 2615175 - protein, 6 aa, Entamoeba histolytica
EEKQSF

SEQ ID NO: 2615176 - protein, 60 aa, Entamoeba histolytica
EEKREMKKIKQKAEGKIKKEGKKLRNTESKKTKEKEEKQEKKIERKGLSREEKEELHKED

SEQ ID NO: 2615177 - protein, 9 aa, Entamoeba histolytica
EEKRESLLQ

SEQ ID NO: 2615178 - protein, 12 aa, Entamoeba histolytica
EEKRGEMNSELE

SEQ ID NO: 2615179 - protein, 11 aa, Entamoeba histolytica
EEKRIKGASID

SEQ ID NO: 2615180 - protein, 25 aa, Entamoeba histolytica
EEKRQNKLNNTKKKIEGVKSNKQKI

SEQ ID NO: 2615181 - protein, 15 aa, Entamoeba histolytica
EEKRSELERKYRPSY

SEQ ID NO: 2615182 - protein, 9 aa, Entamoeba histolytica
EEKSGLSVA

SEQ ID NO: 2615183 - protein, 11 aa, Entamoeba histolytica
EEKSRPTASER

SEQ ID NO: 2615184 - protein, 15 aa, Entamoeba histolytica
EEKTDGLKAPPVSVE

SEQ ID NO: 2615185 - protein, 23 aa, Entamoeba histolytica
EEKTKKENKDIVETKKDETKEDS

SEQ ID NO: 2615186 - protein, 7 aa, Entamoeba histolytica
EEKTKKP

SEQ ID NO: 2615187 - protein, 54 aa, Entamoeba histolytica
EEKTNSKDPQKKPKPSLPSRKQNLPPKKESITTKPPSTNEHKPKVPEKKEEPIT

SEQ ID NO: 2615188 - protein, 9 aa, Entamoeba histolytica
EEKTRMNAS

SEQ ID NO: 2615189 - protein, 13 aa, Entamoeba histolytica
EEKTSETSEDVKA

SEQ ID NO: 2615190 - protein, 8 aa, Entamoeba histolytica
EEKVKKGE

SEQ ID NO: 2615191 - protein, 4 aa, Entamoeba histolytica
EEKY

SEQ ID NO: 2615192 - protein, 11 aa, Entamoeba histolytica
EEKYKEDTVED

SEQ ID NO: 2615193 - protein, 10 aa, Entamoeba histolytica
EEKYKEEKKK

SEQ ID NO: 2615194 - protein, 8 aa, Entamoeba histolytica
EEKYPKDE

SEQ ID NO: 2615195 - protein, 8 aa, Entamoeba histolytica
EEKYSKLA

SEQ ID NO: 2615196 - protein, 7 aa, Entamoeba histolytica
EELDEVN

SEQ ID NO: 2615197 - protein, 8 aa, Entamoeba histolytica
EELDGSIE

SEQ ID NO: 2615198 - protein, 7 aa, Entamoeba histolytica
EELDQNE

SEQ ID NO: 2615199 - protein, 4 aa, Entamoeba histolytica
EELE

SEQ ID NO: 2615200 - protein, 5 aa, Entamoeba histolytica
EELEA

SEQ ID NO: 2615201 - protein, 10 aa, Entamoeba histolytica
EELEDEPTAV

SEQ ID NO: 2615202 - protein, 5 aa, Entamoeba histolytica
EELEE

SEQ ID NO: 2615203 - protein, 12 aa, Entamoeba histolytica
EELEELKKKNEV

SEQ ID NO: 2615204 - protein, 49 aa, Entamoeba histolytica
EELEKEKRKQAEKAEKNLPETETTVTGQPPINKDNKTKKSKSTKMSPEL

SEQ ID NO: 2615205 - protein, 28 aa, Entamoeba histolytica
EELENQSDDETEEAQYQQPLDQYGSNDL

SEQ ID NO: 2615206 - protein, 12 aa, Entamoeba histolytica
EELETLKNQKNI

SEQ ID NO: 2615207 - protein, 29 aa, Entamoeba histolytica
EELETQHTHETKYPSSVLTNTNQSTTSQI

SEQ ID NO: 2615208 - protein, 5 aa, Entamoeba histolytica
EELFK

SEQ ID NO: 2615209 - protein, 14 aa, Entamoeba histolytica
EELHRKENELQGNT

SEQ ID NO: 2615210 - protein, 23 aa, Entamoeba histolytica
EELKAEGQRAKKLRDMKKEELEC

SEQ ID NO: 2615211 - protein, 89 aa, Entamoeba histolytica
EELKDNEELKEELKDSEVKDTTQEESNKKEISSLESNQIDSKLAEEENQNNKEPKSTDQQNECQVEEKTIKTSNDQLTKNQIDKKHSNV

SEQ ID NO: 2615212 - protein, 16 aa, Entamoeba histolytica
EELKEENNKKERELAE

SEQ ID NO: 2615213 - protein, 16 aa, Entamoeba histolytica
EELKEKCPTETQINKD

SEQ ID NO: 2615214 - protein, 12 aa, Entamoeba histolytica
EELKESANKMNK

SEQ ID NO: 2615215 - protein, 12 aa, Entamoeba histolytica
EELKKKGINSNQ

SEQ ID NO: 2615216 - protein, 20 aa, Entamoeba histolytica
EELKKNKKIPKYCFEESFEE

SEQ ID NO: 2615217 - protein, 15 aa, Entamoeba histolytica
EELKKNKQIPKYCFE

SEQ ID NO: 2615218 - protein, 10 aa, Entamoeba histolytica
EELKKNKSIP

SEQ ID NO: 2615219 - protein, 15 aa, Entamoeba histolytica
EELKKNKSIPKNCFK

SEQ ID NO: 2615220 - protein, 20 aa, Entamoeba histolytica
EELKKNKSIPKYCFKECFEE

SEQ ID NO: 2615221 - protein, 15 aa, Entamoeba histolytica
EELKKNKTIPENCFY

SEQ ID NO: 2615222 - protein, 13 aa, Entamoeba histolytica
EELKKNKTIPEYC

SEQ ID NO: 2615223 - protein, 17 aa, Entamoeba histolytica
EELKKNKTIPKYCFEEY

SEQ ID NO: 2615224 - protein, 18 aa, Entamoeba histolytica
EELKKNKTIPKYCFEKYQ

SEQ ID NO: 2615225 - protein, 26 aa, Entamoeba histolytica
EELKKRVDELTKQISSIKKEANEGID

SEQ ID NO: 2615226 - protein, 10 aa, Entamoeba histolytica
EELKPTKELE

SEQ ID NO: 2615227 - protein, 15 aa, Entamoeba histolytica
EELKRNTSIPRECFE

SEQ ID NO: 2615228 - protein, 36 aa, Entamoeba histolytica
EELLESEENLKEKEKVNEEEHEEEEEEEEEEENAAV

SEQ ID NO: 2615229 - protein, 4 aa, Entamoeba histolytica
EELN

SEQ ID NO: 2615230 - protein, 11 aa, Entamoeba histolytica
EELNKKNEELN

SEQ ID NO: 2615231 - protein, 34 aa, Entamoeba histolytica
EELNNEKEKVINETKKQEDLFNSKTEEKEQEISN

SEQ ID NO: 2615232 - protein, 7 aa, Entamoeba histolytica
EELPKEY

SEQ ID NO: 2615233 - protein, 5 aa, Entamoeba histolytica
EELQN

SEQ ID NO: 2615234 - protein, 8 aa, Entamoeba histolytica
EELSEQKK

SEQ ID NO: 2615235 - protein, 6 aa, Entamoeba histolytica
EELSKN

SEQ ID NO: 2615236 - protein, 8 aa, Entamoeba histolytica
EELSSEQE

SEQ ID NO: 2615237 - protein, 14 aa, Entamoeba histolytica
EELTNGLQDKPSTL

SEQ ID NO: 2615238 - protein, 11 aa, Entamoeba histolytica
EELTPYQKSRR

SEQ ID NO: 2615239 - protein, 6 aa, Entamoeba histolytica
EELTQE

SEQ ID NO: 2615240 - protein, 7 aa, Entamoeba histolytica
EELTQEN

SEQ ID NO: 2615241 - protein, 15 aa, Entamoeba histolytica
EELTQIKNEKESINN

SEQ ID NO: 2615242 - protein, 9 aa, Entamoeba histolytica
EEMEADRKK

SEQ ID NO: 2615243 - protein, 20 aa, Entamoeba histolytica
EEMEEENKQLKEENKELKEQ

SEQ ID NO: 2615244 - protein, 5 aa, Entamoeba histolytica
EEMIN

SEQ ID NO: 2615245 - protein, 6 aa, Entamoeba histolytica
EEMINN

SEQ ID NO: 2615246 - protein, 14 aa, Entamoeba histolytica
EEMKEEEEKKEKMI

SEQ ID NO: 2615247 - protein, 6 aa, Entamoeba histolytica
EEMKRD

SEQ ID NO: 2615248 - protein, 5 aa, Entamoeba histolytica
EEMNE

SEQ ID NO: 2615249 - protein, 14 aa, Entamoeba histolytica
EEMNEKNKKLRNDI

SEQ ID NO: 2615250 - protein, 7 aa, Entamoeba histolytica
EEMPKEI

SEQ ID NO: 2615251 - protein, 4 aa, Entamoeba histolytica
EEMR

SEQ ID NO: 2615252 - protein, 10 aa, Entamoeba histolytica
EEMSEDDDHL

SEQ ID NO: 2615253 - protein, 8 aa, Entamoeba histolytica
EENADGTI

SEQ ID NO: 2615254 - protein, 9 aa, Entamoeba histolytica
EENAGTDKL

SEQ ID NO: 2615255 - protein, 5 aa, Entamoeba histolytica
EENAI

SEQ ID NO: 2615256 - protein, 18 aa, Entamoeba histolytica
EENAKQVVEKAKAEKVQK

SEQ ID NO: 2615257 - protein, 10 aa, Entamoeba histolytica
EENCQNQERA

SEQ ID NO: 2615258 - protein, 7 aa, Entamoeba histolytica
EENCTSL

SEQ ID NO: 2615259 - protein, 14 aa, Entamoeba histolytica
EENDEKAKKYEEKL

SEQ ID NO: 2615260 - protein, 13 aa, Entamoeba histolytica
EENDLSSGQVQRS

SEQ ID NO: 2615261 - protein, 18 aa, Entamoeba histolytica
EENDNTNKEIKNEVNEIE

SEQ ID NO: 2615262 - protein, 23 aa, Entamoeba histolytica
EENDRFKDIDEEEIKKEVKEEDV

SEQ ID NO: 2615263 - protein, 6 aa, Entamoeba histolytica
EENDTA

SEQ ID NO: 2615264 - protein, 4 aa, Entamoeba histolytica
EENE

SEQ ID NO: 2615265 - protein, 6 aa, Entamoeba histolytica
EENEDK

SEQ ID NO: 2615266 - protein, 8 aa, Entamoeba histolytica
EENEEQNT

SEQ ID NO: 2615267 - protein, 12 aa, Entamoeba histolytica
EENEIFKVAKKK

SEQ ID NO: 2615268 - protein, 6 aa, Entamoeba histolytica
EENEKI

SEQ ID NO: 2615269 - protein, 13 aa, Entamoeba histolytica
EENEKQCKNEIDE

SEQ ID NO: 2615270 - protein, 6 aa, Entamoeba histolytica
EENEKY

SEQ ID NO: 2615271 - protein, 15 aa, Entamoeba histolytica
EENELLENKNKENIQ

SEQ ID NO: 2615272 - protein, 9 aa, Entamoeba histolytica
EENENESKR

SEQ ID NO: 2615273 - protein, 16 aa, Entamoeba histolytica
EENERISCEDKEKKEH

SEQ ID NO: 2615274 - protein, 38 aa, Entamoeba histolytica
EENETIKSEKEENQQIKTSTPLQTTKEIEPQQSSQEEI

SEQ ID NO: 2615275 - protein, 16 aa, Entamoeba histolytica
EENETLKKTVENFTQD

SEQ ID NO: 2615276 - protein, 14 aa, Entamoeba histolytica
EENFQEDPEDGVLP

SEQ ID NO: 2615277 - protein, 18 aa, Entamoeba histolytica
EENGDDEKKMKRLESKVQ

SEQ ID NO: 2615278 - protein, 5 aa, Entamoeba histolytica
EENGE

SEQ ID NO: 2615279 - protein, 13 aa, Entamoeba histolytica
EENGELKSTKEGT

SEQ ID NO: 2615280 - protein, 6 aa, Entamoeba histolytica
EENGKY

SEQ ID NO: 2615281 - protein, 6 aa, Entamoeba histolytica
EENGNE

SEQ ID NO: 2615282 - protein, 8 aa, Entamoeba histolytica
EENGPNGI

SEQ ID NO: 2615283 - protein, 8 aa, Entamoeba histolytica
EENGQELK

SEQ ID NO: 2615284 - protein, 6 aa, Entamoeba histolytica
EENGSM

SEQ ID NO: 2615285 - protein, 8 aa, Entamoeba histolytica
EENGSVGD

SEQ ID NO: 2615286 - protein, 6 aa, Entamoeba histolytica
EENGTF

SEQ ID NO: 2615287 - protein, 6 aa, Entamoeba histolytica
EENGTY

SEQ ID NO: 2615288 - protein, 9 aa, Entamoeba histolytica
EENGVDGGG

SEQ ID NO: 2615289 - protein, 12 aa, Entamoeba histolytica
EENHHQSIGKQK

SEQ ID NO: 2615290 - protein, 10 aa, Entamoeba histolytica
EENITTNYDT

SEQ ID NO: 2615291 - protein, 4 aa, Entamoeba histolytica
EENK

SEQ ID NO: 2615292 - protein, 8 aa, Entamoeba histolytica
EENKEKYD

SEQ ID NO: 2615293 - protein, 9 aa, Entamoeba histolytica
EENKHQTPI

SEQ ID NO: 2615294 - protein, 9 aa, Entamoeba histolytica
EENKQEKEV

SEQ ID NO: 2615295 - protein, 15 aa, Entamoeba histolytica
EENKQNSNGTEDEGY

SEQ ID NO: 2615296 - protein, 9 aa, Entamoeba histolytica
EENKRINED

SEQ ID NO: 2615297 - protein, 6 aa, Entamoeba histolytica
EENKSF

SEQ ID NO: 2615298 - protein, 24 aa, Entamoeba histolytica
EENKTLKETMEKQIKEKSDELEKM

SEQ ID NO: 2615299 - protein, 4 aa, Entamoeba histolytica
EENL

SEQ ID NO: 2615300 - protein, 14 aa, Entamoeba histolytica
EENLQQQESAKESL

SEQ ID NO: 2615301 - protein, 5 aa, Entamoeba histolytica
EENLS

SEQ ID NO: 2615302 - protein, 7 aa, Entamoeba histolytica
EENLSAE

SEQ ID NO: 2615303 - protein, 4 aa, Entamoeba histolytica
EENN

SEQ ID NO: 2615304 - protein, 6 aa, Entamoeba histolytica
EENNEH

SEQ ID NO: 2615305 - protein, 8 aa, Entamoeba histolytica
EENNGNYE

SEQ ID NO: 2615306 - protein, 8 aa, Entamoeba histolytica
EENNIESQ

SEQ ID NO: 2615307 - protein, 8 aa, Entamoeba histolytica
EENNTAQI

SEQ ID NO: 2615308 - protein, 5 aa, Entamoeba histolytica
EENPQ

SEQ ID NO: 2615309 - protein, 15 aa, Entamoeba histolytica
EENPSTLQPEKQKKH

SEQ ID NO: 2615310 - protein, 5 aa, Entamoeba histolytica
EENPT

SEQ ID NO: 2615311 - protein, 24 aa, Entamoeba histolytica
EENPTLSRKKIDNSLQPDDKTKKG

SEQ ID NO: 2615312 - protein, 16 aa, Entamoeba histolytica
EENQEIQSRRIERGGS

SEQ ID NO: 2615313 - protein, 6 aa, Entamoeba histolytica
EENQRK

SEQ ID NO: 2615314 - protein, 18 aa, Entamoeba histolytica
EENRKSYAKEFARFEMED

SEQ ID NO: 2615315 - protein, 10 aa, Entamoeba histolytica
EENRNENYDS

SEQ ID NO: 2615316 - protein, 9 aa, Entamoeba histolytica
EENRTTRDL

SEQ ID NO: 2615317 - protein, 11 aa, Entamoeba histolytica
EENSKEERSIV

SEQ ID NO: 2615318 - protein, 5 aa, Entamoeba histolytica
EENSS

SEQ ID NO: 2615319 - protein, 7 aa, Entamoeba histolytica
EENTFSD

SEQ ID NO: 2615320 - protein, 7 aa, Entamoeba histolytica
EENTIAK

SEQ ID NO: 2615321 - protein, 8 aa, Entamoeba histolytica
EENTKEDV

SEQ ID NO: 2615322 - protein, 7 aa, Entamoeba histolytica
EENTNEI

SEQ ID NO: 2615323 - protein, 5 aa, Entamoeba histolytica
EENTT

SEQ ID NO: 2615324 - protein, 6 aa, Entamoeba histolytica
EENTTL

SEQ ID NO: 2615325 - protein, 15 aa, Entamoeba histolytica
EENVDDDIDAPEEIG

SEQ ID NO: 2615326 - protein, 9 aa, Entamoeba histolytica
EENVFPESQ

SEQ ID NO: 2615327 - protein, 10 aa, Entamoeba histolytica
EENVPEKYED

SEQ ID NO: 2615328 - protein, 15 aa, Entamoeba histolytica
EENVQEIEEDEVEEV

SEQ ID NO: 2615329 - protein, 8 aa, Entamoeba histolytica
EENYGGTS

SEQ ID NO: 2615330 - protein, 9 aa, Entamoeba histolytica
EEPAPSEAI

SEQ ID NO: 2615331 - protein, 4 aa, Entamoeba histolytica
EEPD

SEQ ID NO: 2615332 - protein, 5 aa, Entamoeba histolytica
EEPDD

SEQ ID NO: 2615333 - protein, 38 aa, Entamoeba histolytica
EEPDIKEEKKEIKKPIRGANVSGRPWKEAYKKRSIKDN

SEQ ID NO: 2615334 - protein, 26 aa, Entamoeba histolytica
EEPEHTSADDDSNDDDEKLKEKREWD

SEQ ID NO: 2615335 - protein, 5 aa, Entamoeba histolytica
EEPGL

SEQ ID NO: 2615336 - protein, 13 aa, Entamoeba histolytica
EEPHSPPKKEEYN

SEQ ID NO: 2615337 - protein, 8 aa, Entamoeba histolytica
EEPINTSN

SEQ ID NO: 2615338 - protein, 5 aa, Entamoeba histolytica
EEPIP

SEQ ID NO: 2615339 - protein, 9 aa, Entamoeba histolytica
EEPIPASER

SEQ ID NO: 2615340 - protein, 19 aa, Entamoeba histolytica
EEPKDKKGIEELSKYSYIP

SEQ ID NO: 2615341 - protein, 13 aa, Entamoeba histolytica
EEPKEMKNEEEMK

SEQ ID NO: 2615342 - protein, 14 aa, Entamoeba histolytica
EEPKPVEENREKRK

SEQ ID NO: 2615343 - protein, 6 aa, Entamoeba histolytica
EEPLKE

SEQ ID NO: 2615344 - protein, 9 aa, Entamoeba histolytica
EEPLKGSSG

SEQ ID NO: 2615345 - protein, 6 aa, Entamoeba histolytica
EEPNFS

SEQ ID NO: 2615346 - protein, 60 aa, Entamoeba histolytica
EEPNKEKKSNEEKKEEVVKKQEEEKQEENKGESKEENKEEKQEENKGESKEENKEEKQEE

SEQ ID NO: 2615347 - protein, 17 aa, Entamoeba histolytica
EEPNQDTPLHKTKYGKT

SEQ ID NO: 2615348 - protein, 4 aa, Entamoeba histolytica
EEPT

SEQ ID NO: 2615349 - protein, 5 aa, Entamoeba histolytica
EEPTA

SEQ ID NO: 2615350 - protein, 8 aa, Entamoeba histolytica
EEPTFSST

SEQ ID NO: 2615351 - protein, 8 aa, Entamoeba histolytica
EEPTGKDS

SEQ ID NO: 2615352 - protein, 4 aa, Entamoeba histolytica
EEPV

SEQ ID NO: 2615353 - protein, 91 aa, Entamoeba histolytica
EEPVKENIEEEQIKEEQIKEEQIKEESVKEESVKEESVKEESVKEESVKEESVKEESVKEESVKEESVKEEPVKEEPVKEEQIKESIEEDE

SEQ ID NO: 2615354 - protein, 6 aa, Entamoeba histolytica
EEPYIE

SEQ ID NO: 2615355 - protein, 31 aa, Entamoeba histolytica
EEQAKEEVVRKEDKEEKQNDKEESQKKISRD

SEQ ID NO: 2615356 - protein, 13 aa, Entamoeba histolytica
EEQAKQEQPIQES

SEQ ID NO: 2615357 - protein, 7 aa, Entamoeba histolytica
EEQDFDK

SEQ ID NO: 2615358 - protein, 6 aa, Entamoeba histolytica
EEQDQS

SEQ ID NO: 2615359 - protein, 6 aa, Entamoeba histolytica
EEQEEV

SEQ ID NO: 2615360 - protein, 6 aa, Entamoeba histolytica
EEQGEN

SEQ ID NO: 2615361 - protein, 4 aa, Entamoeba histolytica
EEQI

SEQ ID NO: 2615362 - protein, 5 aa, Entamoeba histolytica
EEQID

SEQ ID NO: 2615363 - protein, 45 aa, Entamoeba histolytica
EEQISQLQKNTQVIEKQKEEIEEVKQENKELQKSIERANTEIEKQ

SEQ ID NO: 2615364 - protein, 4 aa, Entamoeba histolytica
EEQK

SEQ ID NO: 2615365 - protein, 5 aa, Entamoeba histolytica
EEQKE

SEQ ID NO: 2615366 - protein, 8 aa, Entamoeba histolytica
EEQKKYDT

SEQ ID NO: 2615367 - protein, 5 aa, Entamoeba histolytica
EEQKL

SEQ ID NO: 2615368 - protein, 9 aa, Entamoeba histolytica
EEQKMEEEP

SEQ ID NO: 2615369 - protein, 18 aa, Entamoeba histolytica
EEQKQKKKLYKEENEQLR

SEQ ID NO: 2615370 - protein, 7 aa, Entamoeba histolytica
EEQMQKG

SEQ ID NO: 2615371 - protein, 7 aa, Entamoeba histolytica
EEQNDDI

SEQ ID NO: 2615372 - protein, 8 aa, Entamoeba histolytica
EEQNDTII

SEQ ID NO: 2615373 - protein, 20 aa, Entamoeba histolytica
EEQNECSTEDTTKTKKITKK

SEQ ID NO: 2615374 - protein, 9 aa, Entamoeba histolytica
EEQNEEITG

SEQ ID NO: 2615375 - protein, 10 aa, Entamoeba histolytica
EEQNETQTKV

SEQ ID NO: 2615376 - protein, 10 aa, Entamoeba histolytica
EEQNKENEQM

SEQ ID NO: 2615377 - protein, 7 aa, Entamoeba histolytica
EEQNQVK

SEQ ID NO: 2615378 - protein, 43 aa, Entamoeba histolytica
EEQNSKEEMKKLEENEKISGNQTQTTSTSIEEDVSMNEEDFEE

SEQ ID NO: 2615379 - protein, 14 aa, Entamoeba histolytica
EEQPQTLSKQNSLH

SEQ ID NO: 2615380 - protein, 15 aa, Entamoeba histolytica
EEQPTLSDELKESAQ

SEQ ID NO: 2615381 - protein, 8 aa, Entamoeba histolytica
EEQQIGKE

SEQ ID NO: 2615382 - protein, 5 aa, Entamoeba histolytica
EEQQK

SEQ ID NO: 2615383 - protein, 15 aa, Entamoeba histolytica
EEQQPKSILPRNIFF

SEQ ID NO: 2615384 - protein, 18 aa, Entamoeba histolytica
EEQQQKKEPEQKQENKKI

SEQ ID NO: 2615385 - protein, 8 aa, Entamoeba histolytica
EEQQTTIQ

SEQ ID NO: 2615386 - protein, 6 aa, Entamoeba histolytica
EEQQVN

SEQ ID NO: 2615387 - protein, 43 aa, Entamoeba histolytica; identical to SEQ ID NO: 2419771

SEQ ID NO: 2615388 - protein, 9 aa, Entamoeba histolytica
EEQRREAKN

SEQ ID NO: 2615389 - protein, 9 aa, Entamoeba histolytica
EEQSECEKR

SEQ ID NO: 2615390 - protein, 16 aa, Entamoeba histolytica
EEQSHKRVNYGGSSYR

SEQ ID NO: 2615391 - protein, 7 aa, Entamoeba histolytica
EEQTNKL

SEQ ID NO: 2615392 - protein, 42 aa, Entamoeba histolytica
EEQTQSIKEEQVQEEVDENYAEPIKEETKESTSEEPIQEKVK

SEQ ID NO: 2615393 - protein, 8 aa, Entamoeba histolytica
EEQTSDRL

SEQ ID NO: 2615394 - protein, 4 aa, Entamoeba histolytica
EEQV

SEQ ID NO: 2615395 - protein, 5 aa, Entamoeba histolytica
EEQVI

SEQ ID NO: 2615396 - protein, 10 aa, Entamoeba histolytica
EEQYDATPFD

SEQ ID NO: 2615397 - protein, 7 aa, Entamoeba histolytica
EEQYTQY

SEQ ID NO: 2615398 - protein, 4 aa, Entamoeba histolytica
EERA

SEQ ID NO: 2615399 - protein, 7 aa, Entamoeba histolytica
EERDEAM

SEQ ID NO: 2615400 - protein, 7 aa, Entamoeba histolytica
EERDGAF

SEQ ID NO: 2615401 - protein, 7 aa, Entamoeba histolytica
EERDKNE

SEQ ID NO: 2615402 - protein, 4 aa, Entamoeba histolytica
EERE

SEQ ID NO: 2615403 - protein, 8 aa, Entamoeba histolytica
EEREDKTI

SEQ ID NO: 2615404 - protein, 8 aa, Entamoeba histolytica
EEREEEYE

SEQ ID NO: 2615405 - protein, 77 aa, Entamoeba histolytica
EEREEMGKMKEEKATEEEKNIIDEEKKEKSKKDKEEEGTKAKKIGKGGKNSLKGLRNEMNRKKRIRKTSRVIWIEEE

SEQ ID NO: 2615406 - protein, 9 aa, Entamoeba histolytica
EEREMNNDK

SEQ ID NO: 2615407 - protein, 5 aa, Entamoeba histolytica
EERGD

SEQ ID NO: 2615408 - protein, 5 aa, Entamoeba histolytica
EERGL

SEQ ID NO: 2615409 - protein, 5 aa, Entamoeba histolytica
EERGP

SEQ ID NO: 2615410 - protein, 5 aa, Entamoeba histolytica
EERHH

SEQ ID NO: 2615411 - protein, 4 aa, Entamoeba histolytica
EERI

SEQ ID NO: 2615412 - protein, 17 aa, Entamoeba histolytica
EERIKYGNNIPSGVNKI

SEQ ID NO: 2615413 - protein, 4 aa, Entamoeba histolytica
EERK

SEQ ID NO: 2615414 - protein, 7 aa, Entamoeba histolytica
EERKDEN

SEQ ID NO: 2615415 - protein, 5 aa, Entamoeba histolytica
EERKE

SEQ ID NO: 2615416 - protein, 8 aa, Entamoeba histolytica
EERKEEER

SEQ ID NO: 2615417 - protein, 14 aa, Entamoeba histolytica
EERKKEQRVESERN

SEQ ID NO: 2615418 - protein, 12 aa, Entamoeba histolytica
EERKKRSSKRNL

SEQ ID NO: 2615419 - protein, 6 aa, Entamoeba histolytica
EERKKY

SEQ ID NO: 2615420 - protein, 14 aa, Entamoeba histolytica
EERLAEEGRREDEA

SEQ ID NO: 2615421 - protein, 17 aa, Entamoeba histolytica
EERLKKQNRRQRFNNAF

SEQ ID NO: 2615422 - protein, 6 aa, Entamoeba histolytica
EERLKN

SEQ ID NO: 2615423 - protein, 7 aa, Entamoeba histolytica
EERLSPD

SEQ ID NO: 2615424 - protein, 4 aa, Entamoeba histolytica
EERN

SEQ ID NO: 2615425 - protein, 7 aa, Entamoeba histolytica
EERNTWA

SEQ ID NO: 2615426 - protein, 5 aa, Entamoeba histolytica
EERPM

SEQ ID NO: 2615427 - protein, 9 aa, Entamoeba histolytica
EERPTVKKQ

SEQ ID NO: 2615428 - protein, 8 aa, Entamoeba histolytica
EERRGDDL

SEQ ID NO: 2615429 - protein, 9 aa, Entamoeba histolytica
EERSEESRV

SEQ ID NO: 2615430 - protein, 14 aa, Entamoeba histolytica
EERSRSKSSLAATK

SEQ ID NO: 2615431 - protein, 10 aa, Entamoeba histolytica
EERSTQQQFP

SEQ ID NO: 2615432 - protein, 6 aa, Entamoeba histolytica
EERTPA

SEQ ID NO: 2615433 - protein, 24 aa, Entamoeba histolytica
EERVQQEYQRKSEEEEKRKSEEAR

SEQ ID NO: 2615434 - protein, 6 aa, Entamoeba histolytica
EERYDG

SEQ ID NO: 2615435 - protein, 16 aa, Entamoeba histolytica
EERYESDKEVVEEEEK

SEQ ID NO: 2615436 - protein, 5 aa, Entamoeba histolytica
EERYS

SEQ ID NO: 2615437 - protein, 20 aa, Entamoeba histolytica
EESAKEAKEELNGTTYGGTT

SEQ ID NO: 2615438 - protein, 5 aa, Entamoeba histolytica
EESAQ

SEQ ID NO: 2615439 - protein, 4 aa, Entamoeba histolytica
EESD

SEQ ID NO: 2615440 - protein, 12 aa, Entamoeba histolytica
EESDERANDPHQ

SEQ ID NO: 2615441 - protein, 20 aa, Entamoeba histolytica
EESDTSSSSPTPSVKYTPSP

SEQ ID NO: 2615442 - protein, 15 aa, Entamoeba histolytica
EESEALTGLSDPYQA

SEQ ID NO: 2615443 - protein, 8 aa, Entamoeba histolytica
EESEEVIK

SEQ ID NO: 2615444 - protein, 6 aa, Entamoeba histolytica
EESEIY

SEQ ID NO: 2615445 - protein, 10 aa, Entamoeba histolytica
EESESQAGRK

SEQ ID NO: 2615446 - protein, 6 aa, Entamoeba histolytica
EESEYR

SEQ ID NO: 2615447 - protein, 5 aa, Entamoeba histolytica
EESFE

SEQ ID NO: 2615448 - protein, 5 aa, Entamoeba histolytica
EESFG

SEQ ID NO: 2615449 - protein, 4 aa, Entamoeba histolytica
EESG

SEQ ID NO: 2615450 - protein, 11 aa, Entamoeba histolytica
EESGAGGYDAS

SEQ ID NO: 2615451 - protein, 8 aa, Entamoeba histolytica
EESGGKRR

SEQ ID NO: 2615452 - protein, 11 aa, Entamoeba histolytica
EESGIGGYDAE

SEQ ID NO: 2615453 - protein, 4 aa, Entamoeba histolytica
EESH

SEQ ID NO: 2615454 - protein, 42 aa, Entamoeba histolytica
EESHVEKKKTNKSTEEKEQNPDQEIQSQTEKKESNLSTNQEI

SEQ ID NO: 2615455 - protein, 5 aa, Entamoeba histolytica
EESID

SEQ ID NO: 2615456 - protein, 11 aa, Entamoeba histolytica
EESINQMSQER

SEQ ID NO: 2615457 - protein, 15 aa, Entamoeba histolytica
EESISEEDDYGEEYD

SEQ ID NO: 2615458 - protein, 6 aa, Entamoeba histolytica
EESITS

SEQ ID NO: 2615459 - protein, 8 aa, Entamoeba histolytica
EESKEQQR

SEQ ID NO: 2615460 - protein, 9 aa, Entamoeba histolytica
EESKEYSYD

SEQ ID NO: 2615461 - protein, 9 aa, Entamoeba histolytica
EESKFNNDI

SEQ ID NO: 2615462 - protein, 5 aa, Entamoeba histolytica
EESKK

SEQ ID NO: 2615463 - protein, 6 aa, Entamoeba histolytica
EESKKD

SEQ ID NO: 2615464 - protein, 11 aa, Entamoeba histolytica
EESKKPLKNEY

SEQ ID NO: 2615465 - protein, 7 aa, Entamoeba histolytica
EESKNVL

SEQ ID NO: 2615466 - protein, 9 aa, Entamoeba histolytica
EESKQQIKE

SEQ ID NO: 2615467 - protein, 10 aa, Entamoeba histolytica
EESKSKNIGA

SEQ ID NO: 2615468 - protein, 9 aa, Entamoeba histolytica
EESLAGDKK

SEQ ID NO: 2615469 - protein, 7 aa, Entamoeba histolytica
EESMPPP

SEQ ID NO: 2615470 - protein, 8 aa, Entamoeba histolytica
EESMPPPV

SEQ ID NO: 2615471 - protein, 9 aa, Entamoeba histolytica
EESMPPPVT

SEQ ID NO: 2615472 - protein, 10 aa, Entamoeba histolytica
EESMSRERTV

SEQ ID NO: 2615473 - protein, 4 aa, Entamoeba histolytica
EESN

SEQ ID NO: 2615474 - protein, 9 aa, Entamoeba histolytica
EESNALNET

SEQ ID NO: 2615475 - protein, 6 aa, Entamoeba histolytica
EESNEC

SEQ ID NO: 2615476 - protein, 23 aa, Entamoeba histolytica
EESNEESVPASETETTEEKKSKT

SEQ ID NO: 2615477 - protein, 7 aa, Entamoeba histolytica
EESNNDA

SEQ ID NO: 2615478 - protein, 24 aa, Entamoeba histolytica
EESNNEQSTSVDVENMNNNEQPLE

SEQ ID NO: 2615479 - protein, 8 aa, Entamoeba histolytica
EESNPKRI

SEQ ID NO: 2615480 - protein, 8 aa, Entamoeba histolytica
EESNSINK

SEQ ID NO: 2615481 - protein, 10 aa, Entamoeba histolytica
EESPKGVDPQ

SEQ ID NO: 2615482 - protein, 8 aa, Entamoeba histolytica
EESPRGAG

SEQ ID NO: 2615483 - protein, 7 aa, Entamoeba histolytica
EESPRSQ

SEQ ID NO: 2615484 - protein, 8 aa, Entamoeba histolytica
EESPTEGG

SEQ ID NO: 2615485 - protein, 7 aa, Entamoeba histolytica
EESQQEM

SEQ ID NO: 2615486 - protein, 8 aa, Entamoeba histolytica
EESRQTES

SEQ ID NO: 2615487 - protein, 69 aa, Entamoeba histolytica
EESSEESEEMSEEMSEENKEESEDKEEEERKDDKNNKEEEIKIKTEEKGKEERKDNKEEVKMKEGKNKR

SEQ ID NO: 2615488 - protein, 16 aa, Entamoeba histolytica
EESSESSEEDDNKFDD

SEQ ID NO: 2615489 - protein, 8 aa, Entamoeba histolytica
EESSKYNS

SEQ ID NO: 2615490 - protein, 6 aa, Entamoeba histolytica
EESSLD

SEQ ID NO: 2615491 - protein, 15 aa, Entamoeba histolytica
EESSMTEDEKKKIKK

SEQ ID NO: 2615492 - protein, 10 aa, Entamoeba histolytica
EESSNDQKIN

SEQ ID NO: 2615493 - protein, 4 aa, Entamoeba histolytica
EEST

SEQ ID NO: 2615494 - protein, 8 aa, Entamoeba histolytica
EESTEKNN

SEQ ID NO: 2615495 - protein, 9 aa, Entamoeba histolytica
EESTEYPEV

SEQ ID NO: 2615496 - protein, 5 aa, Entamoeba histolytica
EESTK

SEQ ID NO: 2615497 - protein, 7 aa, Entamoeba histolytica
EESTKTV

SEQ ID NO: 2615498 - protein, 7 aa, Entamoeba histolytica
EESTNIS

SEQ ID NO: 2615499 - protein, 8 aa, Entamoeba histolytica
EESTPKRL

SEQ ID NO: 2615500 - protein, 5 aa, Entamoeba histolytica
EESTR

SEQ ID NO: 2615501 - protein, 4 aa, Entamoeba histolytica
EESV

SEQ ID NO: 2615502 - protein, 9 aa, Entamoeba histolytica
EESVPANDL

SEQ ID NO: 2615503 - protein, 4 aa, Entamoeba histolytica
EESY

SEQ ID NO: 2615504 - protein, 8 aa, Entamoeba histolytica
EESYSNRM

SEQ ID NO: 2615505 - protein, 6 aa, Entamoeba histolytica
EETDGS

SEQ ID NO: 2615506 - protein, 9 aa, Entamoeba histolytica
EETEEVRET

SEQ ID NO: 2615507 - protein, 11 aa, Entamoeba histolytica
EETEGNVGPSM

SEQ ID NO: 2615508 - protein, 7 aa, Entamoeba histolytica
EETEMKG

SEQ ID NO: 2615509 - protein, 11 aa, Entamoeba histolytica
EETENKEVPSP

SEQ ID NO: 2615510 - protein, 4 aa, Entamoeba histolytica
EETF

SEQ ID NO: 2615511 - protein, 7 aa, Entamoeba histolytica
EETFKKT

SEQ ID NO: 2615512 - protein, 8 aa, Entamoeba histolytica
EETGFSEQ

SEQ ID NO: 2615513 - protein, 7 aa, Entamoeba histolytica
EETGQME

SEQ ID NO: 2615514 - protein, 4 aa, Entamoeba histolytica
EETI

SEQ ID NO: 2615515 - protein, 17 aa, Entamoeba histolytica
EETIEEKMKRSAAEINE

SEQ ID NO: 2615516 - protein, 7 aa, Entamoeba histolytica
EETIETR

SEQ ID NO: 2615517 - protein, 11 aa, Entamoeba histolytica
EETITNASTTG

SEQ ID NO: 2615518 - protein, 6 aa, Entamoeba histolytica
EETKDG

SEQ ID NO: 2615519 - protein, 9 aa, Entamoeba histolytica
EETKEEREK

SEQ ID NO: 2615520 - protein, 11 aa, Entamoeba histolytica
EETKERIKEVE

SEQ ID NO: 2615521 - protein, 12 aa, Entamoeba histolytica
EETKKNNEINTI

SEQ ID NO: 2615522 - protein, 5 aa, Entamoeba histolytica
EETKS

SEQ ID NO: 2615523 - protein, 10 aa, Entamoeba histolytica
EETLKGKGSI

SEQ ID NO: 2615524 - protein, 10 aa, Entamoeba histolytica
EETMEDTQSS

SEQ ID NO: 2615525 - protein, 5 aa, Entamoeba histolytica
EETMQ

SEQ ID NO: 2615526 - protein, 5 aa, Entamoeba histolytica
EETMS

SEQ ID NO: 2615527 - protein, 9 aa, Entamoeba histolytica
EETNEKSLY

SEQ ID NO: 2615528 - protein, 6 aa, Entamoeba histolytica
EETNLK

SEQ ID NO: 2615529 - protein, 5 aa, Entamoeba histolytica
EETNM

SEQ ID NO: 2615530 - protein, 9 aa, Entamoeba histolytica
EETNQEEQQ

SEQ ID NO: 2615531 - protein, 12 aa, Entamoeba histolytica
EETNSEKITQEL

SEQ ID NO: 2615532 - protein, 5 aa, Entamoeba histolytica
EETNV

SEQ ID NO: 2615533 - protein, 7 aa, Entamoeba histolytica
EETPDSE

SEQ ID NO: 2615534 - protein, 6 aa, Entamoeba histolytica
EETPEK

SEQ ID NO: 2615535 - protein, 5 aa, Entamoeba histolytica
EETPH

SEQ ID NO: 2615536 - protein, 5 aa, Entamoeba histolytica
EETPK

SEQ ID NO: 2615537 - protein, 14 aa, Entamoeba histolytica
EETPLKEYEEENNK

SEQ ID NO: 2615538 - protein, 9 aa, Entamoeba histolytica
EETQQQRNK

SEQ ID NO: 2615539 - protein, 8 aa, Entamoeba histolytica
EETRDEQQ

SEQ ID NO: 2615540 - protein, 9 aa, Entamoeba histolytica
EETRGKLDA

SEQ ID NO: 2615541 - protein, 7 aa, Entamoeba histolytica
EETRNSD

SEQ ID NO: 2615542 - protein, 9 aa, Entamoeba histolytica
EETRQITRK

SEQ ID NO: 2615543 - protein, 9 aa, Entamoeba histolytica
EETRRKKRK

SEQ ID NO: 2615544 - protein, 9 aa, Entamoeba histolytica
EETRSGNIQ

SEQ ID NO: 2615545 - protein, 17 aa, Entamoeba histolytica
EETSDMKNFNESVPDMK

SEQ ID NO: 2615546 - protein, 5 aa, Entamoeba histolytica
EETSN

SEQ ID NO: 2615547 - protein, 12 aa, Entamoeba histolytica
EETSNDDGSSIR

SEQ ID NO: 2615548 - protein, 10 aa, Entamoeba histolytica
EETSNEKKKL

SEQ ID NO: 2615549 - protein, 4 aa, Entamoeba histolytica
EETT

SEQ ID NO: 2615550 - protein, 7 aa, Entamoeba histolytica
EETTEEI

SEQ ID NO: 2615551 - protein, 10 aa, Entamoeba histolytica
EETTGENDDI

SEQ ID NO: 2615552 - protein, 7 aa, Entamoeba histolytica
EETTIKK

SEQ ID NO: 2615553 - protein, 14 aa, Entamoeba histolytica
EETTKMTKIGEEHG

SEQ ID NO: 2615554 - protein, 5 aa, Entamoeba histolytica
EETTM

SEQ ID NO: 2615555 - protein, 9 aa, Entamoeba histolytica
EETTNNNTK

SEQ ID NO: 2615556 - protein, 7 aa, Entamoeba histolytica
EETTNTL

SEQ ID NO: 2615557 - protein, 8 aa, Entamoeba histolytica
EETTQPIQ

SEQ ID NO: 2615558 - protein, 6 aa, Entamoeba histolytica
EETTYK

SEQ ID NO: 2615559 - protein, 6 aa, Entamoeba histolytica
EETVSN

SEQ ID NO: 2615560 - protein, 6 aa, Entamoeba histolytica
EETVTD

SEQ ID NO: 2615561 - protein, 12 aa, Entamoeba histolytica
EEVAEKNNVEKT

SEQ ID NO: 2615562 - protein, 6 aa, Entamoeba histolytica
EEVDEC

SEQ ID NO: 2615563 - protein, 73 aa, Entamoeba histolytica
EEVDGSDDTRVKKKEYQSEEERYSNFSDNYGDDEDDFNEKNDKTASDDSDDEEKKEAKSRKRLSSSSQPAPRK

SEQ ID NO: 2615564 - protein, 4 aa, Entamoeba histolytica
EEVE

SEQ ID NO: 2615565 - protein, 7 aa, Entamoeba histolytica
EEVEENS

SEQ ID NO: 2615566 - protein, 10 aa, Entamoeba histolytica
EEVEGAKQEE

SEQ ID NO: 2615567 - protein, 12 aa, Entamoeba histolytica
EEVEKEAKEQAE

SEQ ID NO: 2615568 - protein, 13 aa, Entamoeba histolytica
EEVENKQTNHNST

SEQ ID NO: 2615569 - protein, 5 aa, Entamoeba histolytica
EEVGD

SEQ ID NO: 2615570 - protein, 12 aa, Entamoeba histolytica
EEVGSTNRRGAQ

SEQ ID NO: 2615571 - protein, 5 aa, Entamoeba histolytica
EEVGV

SEQ ID NO: 2615572 - protein, 14 aa, Entamoeba histolytica
EEVKAANPDLPSKE

SEQ ID NO: 2615573 - protein, 36 aa, Entamoeba histolytica
EEVKEENEKLKRERGGDEGREMKEQEVERLRERKEE

SEQ ID NO: 2615574 - protein, 49 aa, Entamoeba histolytica
EEVKEEPKAPVQAETEKKEEPKAPVQAETEKKEEPKKMEEEKPKEEKKV

SEQ ID NO: 2615575 - protein, 119 aa, Entamoeba histolytica
EEVKEEVKEEVEKKDKKDKKDKKEKKEKKEKKDKKEKKEKKHKKDKKEKKEHKHHHHSKKEEEEKKEEEEEKKEESKMEEEHSKEEKEDESHSEEEKEENQSEEEKEKKEEKKDNETKE

SEQ ID NO: 2615576 - protein, 23 aa, Entamoeba histolytica
EEVKEKRKQQPNPLSKKSMKKRK

SEQ ID NO: 2615577 - protein, 14 aa, Entamoeba histolytica
EEVKENKPNKEIEE

SEQ ID NO: 2615578 - protein, 13 aa, Entamoeba histolytica
EEVKKKAKEVDSN

SEQ ID NO: 2615579 - protein, 8 aa, Entamoeba histolytica
EEVKKTYQ

SEQ ID NO: 2615580 - protein, 12 aa, Entamoeba histolytica
EEVKPNQPQQPR

SEQ ID NO: 2615581 - protein, 25 aa, Entamoeba histolytica
EEVNETENNSTENIPKTEKESIKEE

SEQ ID NO: 2615582 - protein, 4 aa, Entamoeba histolytica
EEVQ

SEQ ID NO: 2615583 - protein, 8 aa, Entamoeba histolytica
EEVQGERH

SEQ ID NO: 2615584 - protein, 14 aa, Entamoeba histolytica
EEVQKDENQAMEED

SEQ ID NO: 2615585 - protein, 6 aa, Entamoeba histolytica
EEVQKE

SEQ ID NO: 2615586 - protein, 6 aa, Entamoeba histolytica
EEVRKQ

SEQ ID NO: 2615587 - protein, 10 aa, Entamoeba histolytica
EEVSKDHPVE

SEQ ID NO: 2615588 - protein, 11 aa, Entamoeba histolytica
EEVSPLPPEKF

SEQ ID NO: 2615589 - protein, 4 aa, Entamoeba histolytica
EEVT

SEQ ID NO: 2615590 - protein, 8 aa, Entamoeba histolytica
EEVTESKI

SEQ ID NO: 2615591 - protein, 25 aa, Entamoeba histolytica
EEVVPGEKEEKKDVLDPKDFPDIPP

SEQ ID NO: 2615592 - protein, 6 aa, Entamoeba histolytica
EEWHKK

SEQ ID NO: 2615593 - protein, 9 aa, Entamoeba histolytica
EEWSGYSKP

SEQ ID NO: 2615594 - protein, 4 aa, Entamoeba histolytica
EEWT

SEQ ID NO: 2615595 - protein, 4 aa, Entamoeba histolytica
EEYC

SEQ ID NO: 2615596 - protein, 5 aa, Entamoeba histolytica
EEYDE

SEQ ID NO: 2615597 - protein, 65 aa, Entamoeba histolytica
EEYEEENEEENENIENEEENEEENEEENEEENEEKQERTNKEEINQNKTKSKEENEEKTKGTTSS

SEQ ID NO: 2615598 - protein, 12 aa, Entamoeba histolytica
EEYEGGERKEFG

SEQ ID NO: 2615599 - protein, 5 aa, Entamoeba histolytica
EEYEN

SEQ ID NO: 2615600 - protein, 9 aa, Entamoeba histolytica
EEYENSGMK

SEQ ID NO: 2615601 - protein, 7 aa, Entamoeba histolytica
EEYGNTI

SEQ ID NO: 2615602 - protein, 17 aa, Entamoeba histolytica
EEYHKKQQEINEKKEKI

SEQ ID NO: 2615603 - protein, 4 aa, Entamoeba histolytica
EEYK

SEQ ID NO: 2615604 - protein, 6 aa, Entamoeba histolytica
EEYKQY

SEQ ID NO: 2615605 - protein, 7 aa, Entamoeba histolytica
EEYNEGL

SEQ ID NO: 2615606 - protein, 9 aa, Entamoeba histolytica
EEYNKKVKD

SEQ ID NO: 2615607 - protein, 7 aa, Entamoeba histolytica
EEYPQES

SEQ ID NO: 2615608 - protein, 7 aa, Entamoeba histolytica
EEYPTTG

SEQ ID NO: 2615609 - protein, 6 aa, Entamoeba histolytica
EEYQEA

SEQ ID NO: 2615610 - protein, 12 aa, Entamoeba histolytica
EEYQKTKNKAIE

SEQ ID NO: 2615611 - protein, 11 aa, Entamoeba histolytica
EEYQPQNVKTI

SEQ ID NO: 2615612 - protein, 11 aa, Entamoeba histolytica
EEYQQTEQEHT

SEQ ID NO: 2615613 - protein, 7 aa, Entamoeba histolytica
EEYSLPP

SEQ ID NO: 2615614 - protein, 8 aa, Entamoeba histolytica
EEYTSSNR

SEQ ID NO: 2615615 - protein, 9 aa, Entamoeba histolytica
EEYYSDQKT

SEQ ID NO: 2615616 - protein, 7 aa, Entamoeba histolytica
EEYYTPN

SEQ ID NO: 2615617 - protein, 5 aa, Entamoeba histolytica
EFAEE

SEQ ID NO: 2615618 - protein, 13 aa, Entamoeba histolytica
EFAEQTKATIGVG

SEQ ID NO: 2615619 - protein, 6 aa, Entamoeba histolytica
EFAPKS

SEQ ID NO: 2615620 - protein, 10 aa, Entamoeba histolytica
EFASEKIGDS

SEQ ID NO: 2615621 - protein, 13 aa, Entamoeba histolytica
EFATKERKPIPGS

SEQ ID NO: 2615622 - protein, 5 aa, Entamoeba histolytica
EFATT

SEQ ID NO: 2615623 - protein, 10 aa, Entamoeba histolytica
EFDAEKRSTI

SEQ ID NO: 2615624 - protein, 18 aa, Entamoeba histolytica
EFDDGDENESVNEEEEEM

SEQ ID NO: 2615625 - protein, 8 aa, Entamoeba histolytica
EFDKTCNE

SEQ ID NO: 2615626 - protein, 5 aa, Entamoeba histolytica
EFDNE

SEQ ID NO: 2615627 - protein, 10 aa, Entamoeba histolytica
EFDPDKRSTI

SEQ ID NO: 2615628 - protein, 12 aa, Entamoeba histolytica
EFDPEKKSTIGV

SEQ ID NO: 2615629 - protein, 12 aa, Entamoeba histolytica
EFDPENHADGCS

SEQ ID NO: 2615630 - protein, 11 aa, Entamoeba histolytica
EFDSDLSSEEW

SEQ ID NO: 2615631 - protein, 21 aa, Entamoeba histolytica
EFDSRPQKETGCTQPTYEGYD

SEQ ID NO: 2615632 - protein, 8 aa, Entamoeba histolytica
EFEASPDG

SEQ ID NO: 2615633 - protein, 11 aa, Entamoeba histolytica
EFEDGKKQKRY

SEQ ID NO: 2615634 - protein, 8 aa, Entamoeba histolytica
EFEEDEDP

SEQ ID NO: 2615635 - protein, 25 aa, Entamoeba histolytica
EFEEENQQEIEQIQKEENNKTLDLS

SEQ ID NO: 2615636 - protein, 8 aa, Entamoeba histolytica
EFEEETNK

SEQ ID NO: 2615637 - protein, 14 aa, Entamoeba histolytica
EFEEGSNDDDFDSF

SEQ ID NO: 2615638 - protein, 5 aa, Entamoeba histolytica
EFEER

SEQ ID NO: 2615639 - protein, 9 aa, Entamoeba histolytica
EFEGKETEA

SEQ ID NO: 2615640 - protein, 41 aa, Entamoeba histolytica
EFEKQTGISADPFYTTDSLRNDNKDNSQQSQYTDYQTDITG

SEQ ID NO: 2615641 - protein, 15 aa, Entamoeba histolytica
EFENELKKSSESLSK

SEQ ID NO: 2615642 - protein, 4 aa, Entamoeba histolytica
EFEP

SEQ ID NO: 2615643 - protein, 20 aa, Entamoeba histolytica
EFEQEIKNEREEQIKEKEDE

SEQ ID NO: 2615644 - protein, 9 aa, Entamoeba histolytica
EFEQNERKW

SEQ ID NO: 2615645 - protein, 5 aa, Entamoeba histolytica
EFEQQ

SEQ ID NO: 2615646 - protein, 10 aa, Entamoeba histolytica
EFERKTKVPG

SEQ ID NO: 2615647 - protein, 7 aa, Entamoeba histolytica
EFESQQE

SEQ ID NO: 2615648 - protein, 4 aa, Entamoeba histolytica
EFFE

SEQ ID NO: 2615649 - protein, 10 aa, Entamoeba histolytica
EFGAKAANQE

SEQ ID NO: 2615650 - protein, 9 aa, Entamoeba histolytica
EFGEKPPKK

SEQ ID NO: 2615651 - protein, 5 aa, Entamoeba histolytica
EFGGK

SEQ ID NO: 2615652 - protein, 10 aa, Entamoeba histolytica
EFGKQNSDSL

SEQ ID NO: 2615653 - protein, 9 aa, Entamoeba histolytica
EFGNSKGQL

SEQ ID NO: 2615654 - protein, 5 aa, Entamoeba histolytica
EFGQK

SEQ ID NO: 2615655 - protein, 8 aa, Entamoeba histolytica
EFGQSDSC

SEQ ID NO: 2615656 - protein, 7 aa, Entamoeba histolytica
EFGQTPA

SEQ ID NO: 2615657 - protein, 4 aa, Entamoeba histolytica
EFGT

SEQ ID NO: 2615658 - protein, 8 aa, Entamoeba histolytica
EFGTEEVE

SEQ ID NO: 2615659 - protein, 26 aa, Entamoeba histolytica
EFHTRKRASTISDISTKSKIKPNEPL

SEQ ID NO: 2615660 - protein, 19 aa, Entamoeba histolytica
EFIGDSAKQQQRRNRSMAW

SEQ ID NO: 2615661 - protein, 9 aa, Entamoeba histolytica
EFKDTAADK

SEQ ID NO: 2615662 - protein, 8 aa, Entamoeba histolytica
EFKEEKEF

SEQ ID NO: 2615663 - protein, 18 aa, Entamoeba histolytica
EFKKEESTISEGKEITRK

SEQ ID NO: 2615664 - protein, 14 aa, Entamoeba histolytica
EFKPKEIKQEEVNN

SEQ ID NO: 2615665 - protein, 5 aa, Entamoeba histolytica
EFKQK

SEQ ID NO: 2615666 - protein, 7 aa, Entamoeba histolytica
EFNDSEL

SEQ ID NO: 2615667 - protein, 10 aa, Entamoeba histolytica
EFNENYKEQL

SEQ ID NO: 2615668 - protein, 5 aa, Entamoeba histolytica
EFNGP

SEQ ID NO: 2615669 - protein, 8 aa, Entamoeba histolytica
EFNGPSED

SEQ ID NO: 2615670 - protein, 7 aa, Entamoeba histolytica
EFPKKGP

SEQ ID NO: 2615671 - protein, 4 aa, Entamoeba histolytica
EFPS

SEQ ID NO: 2615672 - protein, 5 aa, Entamoeba histolytica
EFPSN

SEQ ID NO: 2615673 - protein, 13 aa, Entamoeba histolytica
EFQEEQKQIQKEF

SEQ ID NO: 2615674 - protein, 14 aa, Entamoeba histolytica
EFQEPYKSSYTEQK

SEQ ID NO: 2615675 - protein, 8 aa, Entamoeba histolytica
EFQGVENP

SEQ ID NO: 2615676 - protein, 41 aa, Entamoeba histolytica
EFQSQGINEPKEEIKTVKQDEVNKETVTPPILPKPENMTPL

SEQ ID NO: 2615677 - protein, 7 aa, Entamoeba histolytica
EFREESG

SEQ ID NO: 2615678 - protein, 14 aa, Entamoeba histolytica
EFREKDSKEAREYE

SEQ ID NO: 2615679 - protein, 11 aa, Entamoeba histolytica
EFRKDDPSSFN

SEQ ID NO: 2615680 - protein, 22 aa, Entamoeba histolytica
EFRPRAEKIAQKQKNKKTSQKV

SEQ ID NO: 2615681 - protein, 5 aa, Entamoeba histolytica
EFRSK

SEQ ID NO: 2615682 - protein, 8 aa, Entamoeba histolytica
EFSEKANT

SEQ ID NO: 2615683 - protein, 16 aa, Entamoeba histolytica
EFSENEYEELVKELEK

SEQ ID NO: 2615684 - protein, 7 aa, Entamoeba histolytica
EFSETKI

SEQ ID NO: 2615685 - protein, 8 aa, Entamoeba histolytica
EFSNQTGY

SEQ ID NO: 2615686 - protein, 6 aa, Entamoeba histolytica
EFSPYD

SEQ ID NO: 2615687 - protein, 10 aa, Entamoeba histolytica
EFSSQRTSSD

SEQ ID NO: 2615688 - protein, 7 aa, Entamoeba histolytica
EFSSTTK

SEQ ID NO: 2615689 - protein, 12 aa, Entamoeba histolytica
EFTEDTSDSVDA

SEQ ID NO: 2615690 - protein, 6 aa, Entamoeba histolytica
EFTEKN

SEQ ID NO: 2615691 - protein, 9 aa, Entamoeba histolytica
EFTEQKRKA

SEQ ID NO: 2615692 - protein, 9 aa, Entamoeba histolytica
EFTEQRAKD

SEQ ID NO: 2615693 - protein, 20 aa, Entamoeba histolytica
EFTGETKPSRSNKVGTGSTC

SEQ ID NO: 2615694 - protein, 8 aa, Entamoeba histolytica
EFTGGSSI

SEQ ID NO: 2615695 - protein, 5 aa, Entamoeba histolytica
EFTKE

SEQ ID NO: 2615696 - protein, 7 aa, Entamoeba histolytica
EFTKTPS

SEQ ID NO: 2615697 - protein, 9 aa, Entamoeba histolytica
EFTNDPKAN

SEQ ID NO: 2615698 - protein, 9 aa, Entamoeba histolytica
EFTNKSTKE

SEQ ID NO: 2615699 - protein, 8 aa, Entamoeba histolytica
EFTNNKTP

SEQ ID NO: 2615700 - protein, 9 aa, Entamoeba histolytica
EFTPSTEIY

SEQ ID NO: 2615701 - protein, 4 aa, Entamoeba histolytica
EFTQ

SEQ ID NO: 2615702 - protein, 5 aa, Entamoeba histolytica
EFTSD

SEQ ID NO: 2615703 - protein, 6 aa, Entamoeba histolytica
EFTSTP

SEQ ID NO: 2615704 - protein, 5 aa, Entamoeba histolytica
EGADA

SEQ ID NO: 2615705 - protein, 5 aa, Entamoeba histolytica
EGADE

SEQ ID NO: 2615706 - protein, 12 aa, Entamoeba histolytica
EGADGSVNNFPG

SEQ ID NO: 2615707 - protein, 9 aa, Entamoeba histolytica
EGAKQKRSS

SEQ ID NO: 2615708 - protein, 7 aa, Entamoeba histolytica
EGAKTIG

SEQ ID NO: 2615709 - protein, 39 aa, Entamoeba histolytica
EGALQKEIGENKEKGQKLQDEKEEFRKANEEMKITTQEL

SEQ ID NO: 2615710 - protein, 5 aa, Entamoeba histolytica
EGAPN

SEQ ID NO: 2615711 - protein, 6 aa, Entamoeba histolytica
EGAQKI

SEQ ID NO: 2615712 - protein, 4 aa, Entamoeba histolytica
EGCE

SEQ ID NO: 2615713 - protein, 13 aa, Entamoeba histolytica
EGCEISTDKEKSL

SEQ ID NO: 2615714 - protein, 5 aa, Entamoeba histolytica
EGCNE

SEQ ID NO: 2615715 - protein, 16 aa, Entamoeba histolytica
EGCSAQPVGTQEGNCT

SEQ ID NO: 2615716 - protein, 7 aa, Entamoeba histolytica
EGCTSRP

SEQ ID NO: 2615717 - protein, 10 aa, Entamoeba histolytica
EGDAPKCIKS

SEQ ID NO: 2615718 - protein, 7 aa, Entamoeba histolytica
EGDCNHY

SEQ ID NO: 2615719 - protein, 8 aa, Entamoeba histolytica
EGDDGEAR

SEQ ID NO: 2615720 - protein, 11 aa, Entamoeba histolytica
EGDDKEAISKG

SEQ ID NO: 2615721 - protein, 5 aa, Entamoeba histolytica
EGDDL

SEQ ID NO: 2615722 - protein, 8 aa, Entamoeba histolytica
EGDEDRQS

SEQ ID NO: 2615723 - protein, 5 aa, Entamoeba histolytica
EGDIK

SEQ ID NO: 2615724 - protein, 11 aa, Entamoeba histolytica
EGDLSNEQTEY

SEQ ID NO: 2615725 - protein, 5 aa, Entamoeba histolytica
EGDMR

SEQ ID NO: 2615726 - protein, 8 aa, Entamoeba histolytica
EGDNRPDA

SEQ ID NO: 2615727 - protein, 6 aa, Entamoeba histolytica
EGDPCD

SEQ ID NO: 2615728 - protein, 6 aa, Entamoeba histolytica
EGDPPY

SEQ ID NO: 2615729 - protein, 7 aa, Entamoeba histolytica
EGDPPYM

SEQ ID NO: 2615730 - protein, 13 aa, Entamoeba histolytica
EGDPQRKHGRKLH

SEQ ID NO: 2615731 - protein, 11 aa, Entamoeba histolytica
EGDQESTAPID

SEQ ID NO: 2615732 - protein, 7 aa, Entamoeba histolytica
EGDQKTS

SEQ ID NO: 2615733 - protein, 9 aa, Entamoeba histolytica
EGDSAKTLA

SEQ ID NO: 2615734 - protein, 12 aa, Entamoeba histolytica
EGDSENYNRPSR

SEQ ID NO: 2615735 - protein, 4 aa, Entamoeba histolytica
EGDV

SEQ ID NO: 2615736 - protein, 4 aa, Entamoeba histolytica
EGDW

SEQ ID NO: 2615737 - protein, 9 aa, Entamoeba histolytica
EGDYPDGQE

SEQ ID NO: 2615738 - protein, 13 aa, Entamoeba histolytica
EGEEQAEKVEKEW

SEQ ID NO: 2615739 - protein, 7 aa, Entamoeba histolytica
EGEEVKR

SEQ ID NO: 2615740 - protein, 6 aa, Entamoeba histolytica
EGEFDE

SEQ ID NO: 2615741 - protein, 11 aa, Entamoeba histolytica
EGEFDEEKTET

SEQ ID NO: 2615742 - protein, 8 aa, Entamoeba histolytica
EGEFEEPK

SEQ ID NO: 2615743 - protein, 6 aa, Entamoeba histolytica
EGEIGE

SEQ ID NO: 2615744 - protein, 6 aa, Entamoeba histolytica
EGEINE

SEQ ID NO: 2615745 - protein, 8 aa, Entamoeba histolytica
EGEKEADA

SEQ ID NO: 2615746 - protein, 5 aa, Entamoeba histolytica
EGEKG

SEQ ID NO: 2615747 - protein, 5 aa, Entamoeba histolytica
EGEKM

SEQ ID NO: 2615748 - protein, 10 aa, Entamoeba histolytica
EGEKPSEVKY

SEQ ID NO: 2615749 - protein, 8 aa, Entamoeba histolytica
EGEKSKNI

SEQ ID NO: 2615750 - protein, 11 aa, Entamoeba histolytica
EGEKTSNEGEL

SEQ ID NO: 2615751 - protein, 4 aa, Entamoeba histolytica
EGEL

SEQ ID NO: 2615752 - protein, 5 aa, Entamoeba histolytica
EGELK

SEQ ID NO: 2615753 - protein, 8 aa, Entamoeba histolytica
EGENDGNR

SEQ ID NO: 2615754 - protein, 9 aa, Entamoeba histolytica
EGENKTYKF

SEQ ID NO: 2615755 - protein, 4 aa, Entamoeba histolytica
EGEP

SEQ ID NO: 2615756 - protein, 4 aa, Entamoeba histolytica
EGER

SEQ ID NO: 2615757 - protein, 5 aa, Entamoeba histolytica
EGESK

SEQ ID NO: 2615758 - protein, 13 aa, Entamoeba histolytica
EGESVDKQAPQFT

SEQ ID NO: 2615759 - protein, 4 aa, Entamoeba histolytica
EGET

SEQ ID NO: 2615760 - protein, 8 aa, Entamoeba histolytica
EGETASVE

SEQ ID NO: 2615761 - protein, 16 aa, Entamoeba histolytica
EGETGTCGVRKNTNGN

SEQ ID NO: 2615762 - protein, 9 aa, Entamoeba histolytica
EGETNPPGI

SEQ ID NO: 2615763 - protein, 15 aa, Entamoeba histolytica
EGETTETTEGFNRYA

SEQ ID NO: 2615764 - protein, 14 aa, Entamoeba histolytica
EGFDPKRRSGQTYG

SEQ ID NO: 2615765 - protein, 22 aa, Entamoeba histolytica
EGFERRKSNLAASIPKKASKIT

SEQ ID NO: 2615766 - protein, 8 aa, Entamoeba histolytica
EGFKKEEI

SEQ ID NO: 2615767 - protein, 10 aa, Entamoeba histolytica
EGFKQEGGIE

SEQ ID NO: 2615768 - protein, 4 aa, Entamoeba histolytica
EGGD

SEQ ID NO: 2615769 - protein, 6 aa, Entamoeba histolytica
EGGDQI

SEQ ID NO: 2615770 - protein, 26 aa, Entamoeba histolytica
EGGEDELNEKEEENNNQEMSEEQSYD

SEQ ID NO: 2615771 - protein, 8 aa, Entamoeba histolytica
EGGEESNP

SEQ ID NO: 2615772 - protein, 16 aa, Entamoeba histolytica
EGGGNDLEKTHSDELT

SEQ ID NO: 2615773 - protein, 6 aa, Entamoeba histolytica
EGGGSY

SEQ ID NO: 2615774 - protein, 8 aa, Entamoeba histolytica
EGGKQGKY

SEQ ID NO: 2615775 - protein, 6 aa, Entamoeba histolytica
EGGKTC

SEQ ID NO: 2615776 - protein, 6 aa, Entamoeba histolytica
EGGMTD

SEQ ID NO: 2615777 - protein, 6 aa, Entamoeba histolytica
EGGNTV

SEQ ID NO: 2615778 - protein, 11 aa, Entamoeba histolytica
EGGQNYSVEGQ

SEQ ID NO: 2615779 - protein, 4 aa, Entamoeba histolytica
EGGS

SEQ ID NO: 2615780 - protein, 8 aa, Entamoeba histolytica
EGGSGGAL

SEQ ID NO: 2615781 - protein, 4 aa, Entamoeba histolytica
EGGV

SEQ ID NO: 2615782 - protein, 6 aa, Entamoeba histolytica
EGGYNY

SEQ ID NO: 2615783 - protein, 5 aa, Entamoeba histolytica
EGHEG

SEQ ID NO: 2615784 - protein, 6 aa, Entamoeba histolytica
EGHESE

SEQ ID NO: 2615785 - protein, 7 aa, Entamoeba histolytica
EGHQDDK

SEQ ID NO: 2615786 - protein, 18 aa, Entamoeba histolytica
EGHRELEKTTTSSHDSYG

SEQ ID NO: 2615787 - protein, 9 aa, Entamoeba histolytica
EGHSAACKQ

SEQ ID NO: 2615788 - protein, 12 aa, Entamoeba histolytica
EGIAEESGDIIP

SEQ ID NO: 2615789 - protein, 6 aa, Entamoeba histolytica
EGIASS

SEQ ID NO: 2615790 - protein, 6 aa, Entamoeba histolytica
EGIDET

SEQ ID NO: 2615791 - protein, 5 aa, Entamoeba histolytica
EGIDP

SEQ ID NO: 2615792 - protein, 10 aa, Entamoeba histolytica
EGIDTSPQEV

SEQ ID NO: 2615793 - protein, 11 aa, Entamoeba histolytica
EGIDYNDPPST

SEQ ID NO: 2615794 - protein, 4 aa, Entamoeba histolytica
EGIE

SEQ ID NO: 2615795 - protein, 6 aa, Entamoeba histolytica
EGIEAN

SEQ ID NO: 2615796 - protein, 21 aa, Entamoeba histolytica
EGIEKKVKKSKEEKKPHKRKN

SEQ ID NO: 2615797 - protein, 14 aa, Entamoeba histolytica
EGIESPNRNNSLEK

SEQ ID NO: 2615798 - protein, 12 aa, Entamoeba histolytica
EGIKEEKENDEC

SEQ ID NO: 2615799 - protein, 8 aa, Entamoeba histolytica
EGIKKPKL

SEQ ID NO: 2615800 - protein, 7 aa, Entamoeba histolytica
EGINEEV

SEQ ID NO: 2615801 - protein, 8 aa, Entamoeba histolytica
EGINKPRQ

SEQ ID NO: 2615802 - protein, 7 aa, Entamoeba histolytica
EGINKTE

SEQ ID NO: 2615803 - protein, 7 aa, Entamoeba histolytica
EGINTPV

SEQ ID NO: 2615804 - protein, 16 aa, Entamoeba histolytica
EGIPEPKNSKSSKEFK

SEQ ID NO: 2615805 - protein, 13 aa, Entamoeba histolytica
EGIPGSPEKPLSD

SEQ ID NO: 2615806 - protein, 4 aa, Entamoeba histolytica
EGIQ

SEQ ID NO: 2615807 - protein, 5 aa, Entamoeba histolytica
EGIQQ

SEQ ID NO: 2615808 - protein, 19 aa, Entamoeba histolytica
EGIRSSSTSVINENEQCGS

SEQ ID NO: 2615809 - protein, 9 aa, Entamoeba histolytica
EGIRTKQFE

SEQ ID NO: 2615810 - protein, 12 aa, Entamoeba histolytica
EGISGLKGKQAK

SEQ ID NO: 2615811 - protein, 5 aa, Entamoeba histolytica
EGISK

SEQ ID NO: 2615812 - protein, 10 aa, Entamoeba histolytica
EGISKYSNGR

SEQ ID NO: 2615813 - protein, 6 aa, Entamoeba histolytica
EGISNE

SEQ ID NO: 2615814 - protein, 11 aa, Entamoeba histolytica
EGKAKPIITSP

SEQ ID NO: 2615815 - protein, 8 aa, Entamoeba histolytica
EGKALGDI

SEQ ID NO: 2615816 - protein, 6 aa, Entamoeba histolytica
EGKAQN

SEQ ID NO: 2615817 - protein, 6 aa, Entamoeba histolytica
EGKAQW

SEQ ID NO: 2615818 - protein, 11 aa, Entamoeba histolytica
EGKDSNEEEKK

SEQ ID NO: 2615819 - protein, 5 aa, Entamoeba histolytica
EGKDY

SEQ ID NO: 2615820 - protein, 4 aa, Entamoeba histolytica
EGKE

SEQ ID NO: 2615821 - protein, 11 aa, Entamoeba histolytica
EGKEISKSSLE

SEQ ID NO: 2615822 - protein, 7 aa, Entamoeba histolytica
EGKEPEA

SEQ ID NO: 2615823 - protein, 6 aa, Entamoeba histolytica
EGKEVL

SEQ ID NO: 2615824 - protein, 4 aa, Entamoeba histolytica
EGKF

SEQ ID NO: 2615825 - protein, 7 aa, Entamoeba histolytica
EGKGNGI

SEQ ID NO: 2615826 - protein, 9 aa, Entamoeba histolytica
EGKGPQGDY

SEQ ID NO: 2615827 - protein, 8 aa, Entamoeba histolytica
EGKHETED

SEQ ID NO: 2615828 - protein, 9 aa, Entamoeba histolytica
EGKHQQGEV

SEQ ID NO: 2615829 - protein, 7 aa, Entamoeba histolytica
EGKIDKA

SEQ ID NO: 2615830 - protein, 8 aa, Entamoeba histolytica
EGKIGGTC

SEQ ID NO: 2615831 - protein, 8 aa, Entamoeba histolytica
EGKKCQPG

SEQ ID NO: 2615832 - protein, 7 aa, Entamoeba histolytica
EGKKISP

SEQ ID NO: 2615833 - protein, 10 aa, Entamoeba histolytica
EGKKKVTQDD

SEQ ID NO: 2615834 - protein, 7 aa, Entamoeba histolytica
EGKKLKT

SEQ ID NO: 2615835 - protein, 8 aa, Entamoeba histolytica
EGKKPNTI

SEQ ID NO: 2615836 - protein, 20 aa, Entamoeba histolytica
EGKKVTEINEEEVQKRVEEE

SEQ ID NO: 2615837 - protein, 4 aa, Entamoeba histolytica
EGKL

SEQ ID NO: 2615838 - protein, 5 aa, Entamoeba histolytica
EGKLG

SEQ ID NO: 2615839 - protein, 8 aa, Entamoeba histolytica
EGKLPSVQ

SEQ ID NO: 2615840 - protein, 5 aa, Entamoeba histolytica
EGKMP

SEQ ID NO: 2615841 - protein, 5 aa, Entamoeba histolytica
EGKMS

SEQ ID NO: 2615842 - protein, 14 aa, Entamoeba histolytica
EGKNEVNSLTNTLN

SEQ ID NO: 2615843 - protein, 5 aa, Entamoeba histolytica
EGKNK

SEQ ID NO: 2615844 - protein, 11 aa, Entamoeba histolytica
EGKNTQKERME

SEQ ID NO: 2615845 - protein, 7 aa, Entamoeba histolytica
EGKPIGK

SEQ ID NO: 2615846 - protein, 9 aa, Entamoeba histolytica
EGKQKEELA

SEQ ID NO: 2615847 - protein, 10 aa, Entamoeba histolytica
EGKQKEKKFQ

SEQ ID NO: 2615848 - protein, 7 aa, Entamoeba histolytica
EGKQPTI

SEQ ID NO: 2615849 - protein, 27 aa, Entamoeba histolytica
EGKQVQEKIQQEKERRIEKIEKRKKQI

SEQ ID NO: 2615850 - protein, 7 aa, Entamoeba histolytica
EGKRAGV

SEQ ID NO: 2615851 - protein, 5 aa, Entamoeba histolytica
EGKRR

SEQ ID NO: 2615852 - protein, 7 aa, Entamoeba histolytica
EGKSMEQ

SEQ ID NO: 2615853 - protein, 7 aa, Entamoeba histolytica
EGKSNLI

SEQ ID NO: 2615854 - protein, 10 aa, Entamoeba histolytica
EGKSNSDEWK

SEQ ID NO: 2615855 - protein, 8 aa, Entamoeba histolytica
EGKSYEYS

SEQ ID NO: 2615856 - protein, 4 aa, Entamoeba histolytica
EGKT

SEQ ID NO: 2615857 - protein, 11 aa, Entamoeba histolytica
EGKTFTPINTP

SEQ ID NO: 2615858 - protein, 9 aa, Entamoeba histolytica
EGKTLPDHF

SEQ ID NO: 2615859 - protein, 8 aa, Entamoeba histolytica
EGKTNEEI

SEQ ID NO: 2615860 - protein, 13 aa, Entamoeba histolytica
EGKVNSDDEEVPK

SEQ ID NO: 2615861 - protein, 4 aa, Entamoeba histolytica
EGKY

SEQ ID NO: 2615862 - protein, 6 aa, Entamoeba histolytica
EGKYPK

SEQ ID NO: 2615863 - protein, 6 aa, Entamoeba histolytica
EGLKEA

SEQ ID NO: 2615864 - protein, 7 aa, Entamoeba histolytica
EGLKEKL

SEQ ID NO: 2615865 - protein, 20 aa, Entamoeba histolytica
EGLKKNETIPEYCFEESFYE

SEQ ID NO: 2615866 - protein, 11 aa, Entamoeba histolytica
EGLNQSNEETE

SEQ ID NO: 2615867 - protein, 7 aa, Entamoeba histolytica
EGLPDKN

SEQ ID NO: 2615868 - protein, 10 aa, Entamoeba histolytica
EGLPKNQSEI

SEQ ID NO: 2615869 - protein, 10 aa, Entamoeba histolytica
EGLPPSHSTP

SEQ ID NO: 2615870 - protein, 9 aa, Entamoeba histolytica
EGLPSNPTE

SEQ ID NO: 2615871 - protein, 6 aa, Entamoeba histolytica
EGLSNT

SEQ ID NO: 2615872 - protein, 4 aa, Entamoeba histolytica
EGLT

SEQ ID NO: 2615873 - protein, 10 aa, Entamoeba histolytica
EGLTPTTYTD

SEQ ID NO: 2615874 - protein, 12 aa, Entamoeba histolytica
EGMEESEFEEAE

SEQ ID NO: 2615875 - protein, 13 aa, Entamoeba histolytica
EGMEESEFSEATA

SEQ ID NO: 2615876 - protein, 6 aa, Entamoeba histolytica
EGMEPE

SEQ ID NO: 2615877 - protein, 15 aa, Entamoeba histolytica
EGMKDEFEKDEEGNV

SEQ ID NO: 2615878 - protein, 4 aa, Entamoeba histolytica
EGMN

SEQ ID NO: 2615879 - protein, 16 aa, Entamoeba histolytica
EGMSEEEKLKTEQQNI

SEQ ID NO: 2615880 - protein, 6 aa, Entamoeba histolytica
EGMTKK

SEQ ID NO: 2615881 - protein, 4 aa, Entamoeba histolytica
EGNA

SEQ ID NO: 2615882 - protein, 7 aa, Entamoeba histolytica
EGNASPN

SEQ ID NO: 2615883 - protein, 10 aa, Entamoeba histolytica
EGNATATPSF

SEQ ID NO: 2615884 - protein, 6 aa, Entamoeba histolytica
EGNDRQ

SEQ ID NO: 2615885 - protein, 5 aa, Entamoeba histolytica
EGNDT

SEQ ID NO: 2615886 - protein, 9 aa, Entamoeba histolytica
EGNDTFSVA

SEQ ID NO: 2615887 - protein, 4 aa, Entamoeba histolytica
EGNE

SEQ ID NO: 2615888 - protein, 12 aa, Entamoeba histolytica
EGNEDKNENGDV

SEQ ID NO: 2615889 - protein, 12 aa, Entamoeba histolytica
EGNEEIGKKQGD

SEQ ID NO: 2615890 - protein, 7 aa, Entamoeba histolytica
EGNEHSV

SEQ ID NO: 2615891 - protein, 12 aa, Entamoeba histolytica
EGNEPKVKNEDG

SEQ ID NO: 2615892 - protein, 10 aa, Entamoeba histolytica
EGNERTYDKD

SEQ ID NO: 2615893 - protein, 7 aa, Entamoeba histolytica
EGNETTE

SEQ ID NO: 2615894 - protein, 4 aa, Entamoeba histolytica
EGNG

SEQ ID NO: 2615895 - protein, 7 aa, Entamoeba histolytica
EGNGNLK

SEQ ID NO: 2615896 - protein, 12 aa, Entamoeba histolytica
EGNGTSKRRKEI

SEQ ID NO: 2615897 - protein, 7 aa, Entamoeba histolytica
EGNITTD

SEQ ID NO: 2615898 - protein, 15 aa, Entamoeba histolytica
EGNLTPPNLGSGKSG

SEQ ID NO: 2615899 - protein, 16 aa, Entamoeba histolytica
EGNNDEEFEISSRTSV

SEQ ID NO: 2615900 - protein, 7 aa, Entamoeba histolytica
EGNNEGI

SEQ ID NO: 2615901 - protein, 5 aa, Entamoeba histolytica
EGNNP

SEQ ID NO: 2615902 - protein, 8 aa, Entamoeba histolytica
EGNNRNEA

SEQ ID NO: 2615903 - protein, 9 aa, Entamoeba histolytica
EGNPPNRHV

SEQ ID NO: 2615904 - protein, 8 aa, Entamoeba histolytica
EGNPPYKE

SEQ ID NO: 2615905 - protein, 74 aa, Entamoeba histolytica
EGNSQKEEVKEEPKKEMKEEPKEEPKEEMKEEMKEEVKEDIKEKAEEKKPESKKEKRNKKRSYKREHEEEQIEE

SEQ ID NO: 2615906 - protein, 7 aa, Entamoeba histolytica
EGNTSYI

SEQ ID NO: 2615907 - protein, 4 aa, Entamoeba histolytica
EGNV

SEQ ID NO: 2615908 - protein, 7 aa, Entamoeba histolytica
EGNVDSK

SEQ ID NO: 2615909 - protein, 5 aa, Entamoeba histolytica
EGNVN

SEQ ID NO: 2615910 - protein, 5 aa, Entamoeba histolytica
EGNVS

SEQ ID NO: 2615911 - protein, 5 aa, Entamoeba histolytica
EGNYP

SEQ ID NO: 2615912 - protein, 8 aa, Entamoeba histolytica
EGNYSDDT

SEQ ID NO: 2615913 - protein, 10 aa, Entamoeba histolytica
EGPGVEGGCK

SEQ ID NO: 2615914 - protein, 6 aa, Entamoeba histolytica
EGPKCK

SEQ ID NO: 2615915 - protein, 7 aa, Entamoeba histolytica
EGPKSKK

SEQ ID NO: 2615916 - protein, 9 aa, Entamoeba histolytica
EGPPTLNPE

SEQ ID NO: 2615917 - protein, 5 aa, Entamoeba histolytica
EGPSP

SEQ ID NO: 2615918 - protein, 10 aa, Entamoeba histolytica
EGPYKGYQGT

SEQ ID NO: 2615919 - protein, 8 aa, Entamoeba histolytica
EGQDPHKI

SEQ ID NO: 2615920 - protein, 7 aa, Entamoeba histolytica
EGQEMAQ

SEQ ID NO: 2615921 - protein, 7 aa, Entamoeba histolytica
EGQEYGQ

SEQ ID NO: 2615922 - protein, 12 aa, Entamoeba histolytica
EGQRGRNPEELK

SEQ ID NO: 2615923 - protein, 7 aa, Entamoeba histolytica
EGRDEEM

SEQ ID NO: 2615924 - protein, 16 aa, Entamoeba histolytica
EGRDPKLEQINDPSNP

SEQ ID NO: 2615925 - protein, 7 aa, Entamoeba histolytica
EGRIDEQ

SEQ ID NO: 2615926 - protein, 7 aa, Entamoeba histolytica
EGRINEK

SEQ ID NO: 2615927 - protein, 5 aa, Entamoeba histolytica
EGRLH

SEQ ID NO: 2615928 - protein, 10 aa, Entamoeba histolytica
EGRRRNREGA

SEQ ID NO: 2615929 - protein, 8 aa, Entamoeba histolytica
EGRTVNQL

SEQ ID NO: 2615930 - protein, 13 aa, Entamoeba histolytica
EGSAREVKESDEL

SEQ ID NO: 2615931 - protein, 10 aa, Entamoeba histolytica
EGSGSIKPKI

SEQ ID NO: 2615932 - protein, 10 aa, Entamoeba histolytica
EGSKAEAHTH

SEQ ID NO: 2615933 - protein, 21 aa, Entamoeba histolytica
EGSKTIEDINEENKETEESLT

SEQ ID NO: 2615934 - protein, 8 aa, Entamoeba histolytica
EGSKYESA

SEQ ID NO: 2615935 - protein, 6 aa, Entamoeba histolytica
EGSLQQ

SEQ ID NO: 2615936 - protein, 8 aa, Entamoeba histolytica
EGSMDDRN

SEQ ID NO: 2615937 - protein, 7 aa, Entamoeba histolytica
EGSNVKS

SEQ ID NO: 2615938 - protein, 8 aa, Entamoeba histolytica
EGSPPYRE

SEQ ID NO: 2615939 - protein, 9 aa, Entamoeba histolytica
EGSRNGLSY

SEQ ID NO: 2615940 - protein, 8 aa, Entamoeba histolytica
EGSSIEDS

SEQ ID NO: 2615941 - protein, 12 aa, Entamoeba histolytica
EGSSSVDDGAID

SEQ ID NO: 2615942 - protein, 6 aa, Entamoeba histolytica
EGSSYD

SEQ ID NO: 2615943 - protein, 17 aa, Entamoeba histolytica
EGSTENIRHKPDTRALT

SEQ ID NO: 2615944 - protein, 6 aa, Entamoeba histolytica
EGSTFS

SEQ ID NO: 2615945 - protein, 6 aa, Entamoeba histolytica
EGSVGK

SEQ ID NO: 2615946 - protein, 5 aa, Entamoeba histolytica
EGSYT

SEQ ID NO: 2615947 - protein, 7 aa, Entamoeba histolytica
EGTFAPE

SEQ ID NO: 2615948 - protein, 6 aa, Entamoeba histolytica
EGTFKG

SEQ ID NO: 2615949 - protein, 5 aa, Entamoeba histolytica
EGTGG

SEQ ID NO: 2615950 - protein, 20 aa, Entamoeba histolytica
EGTHQTEEDVNKQLNDKERI

SEQ ID NO: 2615951 - protein, 4 aa, Entamoeba histolytica
EGTI

SEQ ID NO: 2615952 - protein, 8 aa, Entamoeba histolytica
EGTKEELQ

SEQ ID NO: 2615953 - protein, 7 aa, Entamoeba histolytica
EGTLNNT

SEQ ID NO: 2615954 - protein, 5 aa, Entamoeba histolytica
EGTLT

SEQ ID NO: 2615955 - protein, 5 aa, Entamoeba histolytica
EGTNL

SEQ ID NO: 2615956 - protein, 9 aa, Entamoeba histolytica
EGTNNSIPI

SEQ ID NO: 2615957 - protein, 24 aa, Entamoeba histolytica
EGTNPFGEDNSDVISEEEPNQIET

SEQ ID NO: 2615958 - protein, 4 aa, Entamoeba histolytica
EGTT

SEQ ID NO: 2615959 - protein, 4 aa, Entamoeba histolytica
EGTY

SEQ ID NO: 2615960 - protein, 6 aa, Entamoeba histolytica
EGTYNM

SEQ ID NO: 2615961 - protein, 7 aa, Entamoeba histolytica
EGVGSAY

SEQ ID NO: 2615962 - protein, 10 aa, Entamoeba histolytica
EGVNTYETRI

SEQ ID NO: 2615963 - protein, 8 aa, Entamoeba histolytica
EGVQIKEY

SEQ ID NO: 2615964 - protein, 6 aa, Entamoeba histolytica
EGVQNN

SEQ ID NO: 2615965 - protein, 14 aa, Entamoeba histolytica
EGVRSKAKSQIEES

SEQ ID NO: 2615966 - protein, 5 aa, Entamoeba histolytica
EGVTD

SEQ ID NO: 2615967 - protein, 10 aa, Entamoeba histolytica
EGWDEDPFRR

SEQ ID NO: 2615968 - protein, 15 aa, Entamoeba histolytica
EGYCKSESAHATQTK

SEQ ID NO: 2615969 - protein, 5 aa, Entamoeba histolytica
EGYEE

SEQ ID NO: 2615970 - protein, 6 aa, Entamoeba histolytica
EGYHDK

SEQ ID NO: 2615971 - protein, 10 aa, Entamoeba histolytica
EGYIDSNAGE

SEQ ID NO: 2615972 - protein, 7 aa, Entamoeba histolytica
EGYKSRR

SEQ ID NO: 2615973 - protein, 5 aa, Entamoeba histolytica
EGYQQ

SEQ ID NO: 2615974 - protein, 17 aa, Entamoeba histolytica
EGYSSTNKEDDKGTVVR

SEQ ID NO: 2615975 - protein, 7 aa, Entamoeba histolytica
EGYTNSH

SEQ ID NO: 2615976 - protein, 17 aa, Entamoeba histolytica
EHANPAQVAQSSQDRVQ

SEQ ID NO: 2615977 - protein, 6 aa, Entamoeba histolytica
EHAPVG

SEQ ID NO: 2615978 - protein, 5 aa, Entamoeba histolytica
EHATT

SEQ ID NO: 2615979 - protein, 9 aa, Entamoeba histolytica
EHDKAPVDK

SEQ ID NO: 2615980 - protein, 11 aa, Entamoeba histolytica
EHDNSGTQATQ

SEQ ID NO: 2615981 - protein, 4 aa, Entamoeba histolytica
EHDY

SEQ ID NO: 2615982 - protein, 4 aa, Entamoeba histolytica
EHED

SEQ ID NO: 2615983 - protein, 13 aa, Entamoeba histolytica
EHEEEDDDDIFGD

SEQ ID NO: 2615984 - protein, 30 aa, Entamoeba histolytica
EHEEQRKRKIEEENQRKKEEEEKEQQRRME

SEQ ID NO: 2615985 - protein, 4 aa, Entamoeba histolytica
EHEF

SEQ ID NO: 2615986 - protein, 9 aa, Entamoeba histolytica
EHEKAPVEK

SEQ ID NO: 2615987 - protein, 9 aa, Entamoeba histolytica
EHEKDENYF

SEQ ID NO: 2615988 - protein, 9 aa, Entamoeba histolytica
EHEKRGNYV

SEQ ID NO: 2615989 - protein, 19 aa, Entamoeba histolytica
EHEMPASSSEIEEAKEEGV

SEQ ID NO: 2615990 - protein, 29 aa, Entamoeba histolytica
EHERENHERMKTPSEKKRIKKEKNDKIIE

SEQ ID NO: 2615991 - protein, 8 aa, Entamoeba histolytica
EHETGKIY

SEQ ID NO: 2615992 - protein, 8 aa, Entamoeba histolytica
EHEVNRDR

SEQ ID NO: 2615993 - protein, 15 aa, Entamoeba histolytica
EHFNPSTNYSPSTTV

SEQ ID NO: 2615994 - protein, 5 aa, Entamoeba histolytica
EHGEK

SEQ ID NO: 2615995 - protein, 12 aa, Entamoeba histolytica
EHGLSSDGVFQG

SEQ ID NO: 2615996 - protein, 7 aa, Entamoeba histolytica
EHGPYQK

SEQ ID NO: 2615997 - protein, 5 aa, Entamoeba histolytica
EHGYT

SEQ ID NO: 2615998 - protein, 7 aa, Entamoeba histolytica
EHHNQSS

SEQ ID NO: 2615999 - protein, 6 aa, Entamoeba histolytica
EHHQKA

SEQ ID NO: 2616000 - protein, 8 aa, Entamoeba histolytica
EHIDSNGK

SEQ ID NO: 2616001 - protein, 6 aa, Entamoeba histolytica
EHKDNG

SEQ ID NO: 2616002 - protein, 7 aa, Entamoeba histolytica
EHKEAPI

SEQ ID NO: 2616003 - protein, 5 aa, Entamoeba histolytica
EHKEE

SEQ ID NO: 2616004 - protein, 5 aa, Entamoeba histolytica
EHKEK

SEQ ID NO: 2616005 - protein, 8 aa, Entamoeba histolytica
EHKEYKGS

SEQ ID NO: 2616006 - protein, 7 aa, Entamoeba histolytica
EHKPMNE

SEQ ID NO: 2616007 - protein, 4 aa, Entamoeba histolytica
EHKQ

SEQ ID NO: 2616008 - protein, 22 aa, Entamoeba histolytica
EHNEGVDEIEARRKADEEIDRR

SEQ ID NO: 2616009 - protein, 8 aa, Entamoeba histolytica
EHNEQTKP

SEQ ID NO: 2616010 - protein, 10 aa, Entamoeba histolytica
EHNGDESNIG

SEQ ID NO: 2616011 - protein, 6 aa, Entamoeba histolytica
EHNGKG

SEQ ID NO: 2616012 - protein, 11 aa, Entamoeba histolytica
EHNQEDNGFSM

SEQ ID NO: 2616013 - protein, 5 aa, Entamoeba histolytica
EHPAV

SEQ ID NO: 2616014 - protein, 15 aa, Entamoeba histolytica
EHPDYPANSKEFTRA

SEQ ID NO: 2616015 - protein, 5 aa, Entamoeba histolytica
EHPEK

SEQ ID NO: 2616016 - protein, 5 aa, Entamoeba histolytica
EHPKN

SEQ ID NO: 2616017 - protein, 6 aa, Entamoeba histolytica
EHPNRK

SEQ ID NO: 2616018 - protein, 4 aa, Entamoeba histolytica
EHPQ

SEQ ID NO: 2616019 - protein, 7 aa, Entamoeba histolytica
EHPSQEG

SEQ ID NO: 2616020 - protein, 4 aa, Entamoeba histolytica
EHPT

SEQ ID NO: 2616021 - protein, 13 aa, Entamoeba histolytica
EHPTETKQNQSFL

SEQ ID NO: 2616022 - protein, 6 aa, Entamoeba histolytica
EHPTHM

SEQ ID NO: 2616023 - protein, 9 aa, Entamoeba histolytica
EHQPESSQI

SEQ ID NO: 2616024 - protein, 6 aa, Entamoeba histolytica
EHQPKE

SEQ ID NO: 2616025 - protein, 10 aa, Entamoeba histolytica
EHQPKLQPFD

SEQ ID NO: 2616026 - protein, 11 aa, Entamoeba histolytica
EHQQNKSQAKE

SEQ ID NO: 2616027 - protein, 7 aa, Entamoeba histolytica
EHQTNNI

SEQ ID NO: 2616028 - protein, 5 aa, Entamoeba histolytica
EHRDP

SEQ ID NO: 2616029 - protein, 10 aa, Entamoeba histolytica
EHREGKHPTI

SEQ ID NO: 2616030 - protein, 8 aa, Entamoeba histolytica
EHRTQTYK

SEQ ID NO: 2616031 - protein, 7 aa, Entamoeba histolytica
EHSEWDE

SEQ ID NO: 2616032 - protein, 7 aa, Entamoeba histolytica
EHSKESK

SEQ ID NO: 2616033 - protein, 19 aa, Entamoeba histolytica
EHSKKEEHKKQRRQTGDVF

SEQ ID NO: 2616034 - protein, 6 aa, Entamoeba histolytica
EHSKPV

SEQ ID NO: 2616035 - protein, 4 aa, Entamoeba histolytica
EHSP

SEQ ID NO: 2616036 - protein, 10 aa, Entamoeba histolytica
EHSPTTPAPF

SEQ ID NO: 2616037 - protein, 7 aa, Entamoeba histolytica
EHSQEET

SEQ ID NO: 2616038 - protein, 8 aa, Entamoeba histolytica
EHSRDNYE

SEQ ID NO: 2616039 - protein, 4 aa, Entamoeba histolytica
EHTD

SEQ ID NO: 2616040 - protein, 8 aa, Entamoeba histolytica
EHTDYKKA

SEQ ID NO: 2616041 - protein, 23 aa, Entamoeba histolytica
EHTEENPQTQEEHNENKIESQVK

SEQ ID NO: 2616042 - protein, 5 aa, Entamoeba histolytica
EHTER

SEQ ID NO: 2616043 - protein, 18 aa, Entamoeba histolytica
EHTGSSRQSQVQSPTKLQ

SEQ ID NO: 2616044 - protein, 4 aa, Entamoeba histolytica
EHTK

SEQ ID NO: 2616045 - protein, 8 aa, Entamoeba histolytica
EHTNGNIK

SEQ ID NO: 2616046 - protein, 8 aa, Entamoeba histolytica
EHTNTERG

SEQ ID NO: 2616047 - protein, 10 aa, Entamoeba histolytica
EHTPSNPQEF

SEQ ID NO: 2616048 - protein, 14 aa, Entamoeba histolytica
EHTQNSLKTLTSSN

SEQ ID NO: 2616049 - protein, 12 aa, Entamoeba histolytica
EHTTKKDSNEIK

SEQ ID NO: 2616050 - protein, 9 aa, Entamoeba histolytica
EHTTPEGIT

SEQ ID NO: 2616051 - protein, 9 aa, Entamoeba histolytica
EHVDDSVTN

SEQ ID NO: 2616052 - protein, 7 aa, Entamoeba histolytica
EHVQGKK

SEQ ID NO: 2616053 - protein, 4 aa, Entamoeba histolytica
EIAD

SEQ ID NO: 2616054 - protein, 16 aa, Entamoeba histolytica
EIADRKKKWEFSHNVI

SEQ ID NO: 2616055 - protein, 11 aa, Entamoeba histolytica
EIAENGGEASA

SEQ ID NO: 2616056 - protein, 5 aa, Entamoeba histolytica
EIAGE

SEQ ID NO: 2616057 - protein, 4 aa, Entamoeba histolytica
EIAQ

SEQ ID NO: 2616058 - protein, 5 aa, Entamoeba histolytica
EIATP

SEQ ID NO: 2616059 - protein, 11 aa, Entamoeba histolytica
EICGNSSLNKK

SEQ ID NO: 2616060 - protein, 4 aa, Entamoeba histolytica
EIDE

SEQ ID NO: 2616061 - protein, 20 aa, Entamoeba histolytica
EIDEARKVGKTGIESINFRK

SEQ ID NO: 2616062 - protein, 10 aa, Entamoeba histolytica
EIDEDAKKSI

SEQ ID NO: 2616063 - protein, 7 aa, Entamoeba histolytica
EIDETKA

SEQ ID NO: 2616064 - protein, 5 aa, Entamoeba histolytica
EIDGM

SEQ ID NO: 2616065 - protein, 5 aa, Entamoeba histolytica
EIDGT

SEQ ID NO: 2616066 - protein, 11 aa, Entamoeba histolytica
EIDKDSNIKEN

SEQ ID NO: 2616067 - protein, 17 aa, Entamoeba histolytica
EIDKEKAEESYKRKKYR

SEQ ID NO: 2616068 - protein, 10 aa, Entamoeba histolytica
EIDLPTPAYL

SEQ ID NO: 2616069 - protein, 5 aa, Entamoeba histolytica
EIDPR

SEQ ID NO: 2616070 - protein, 7 aa, Entamoeba histolytica
EIDQQKN

SEQ ID NO: 2616071 - protein, 11 aa, Entamoeba histolytica
EIDQYTKSSAL

SEQ ID NO: 2616072 - protein, 6 aa, Entamoeba histolytica
EIDRTQ

SEQ ID NO: 2616073 - protein, 4 aa, Entamoeba histolytica
EIDS

SEQ ID NO: 2616074 - protein, 6 aa, Entamoeba histolytica
EIDTGR

SEQ ID NO: 2616075 - protein, 12 aa, Entamoeba histolytica
EIDTQKKKIVNE

SEQ ID NO: 2616076 - protein, 17 aa, Entamoeba histolytica
EIDTTIEEEFSSSNKIN

SEQ ID NO: 2616077 - protein, 5 aa, Entamoeba histolytica
EIEDE

SEQ ID NO: 2616078 - protein, 28 aa, Entamoeba histolytica
EIEDGKEDVDLDEDQKAVDAEDDFEAEQ

SEQ ID NO: 2616079 - protein, 6 aa, Entamoeba histolytica
EIEDKQ

SEQ ID NO: 2616080 - protein, 6 aa, Entamoeba histolytica
EIEDSS

SEQ ID NO: 2616081 - protein, 9 aa, Entamoeba histolytica
EIEEAERSR

SEQ ID NO: 2616082 - protein, 5 aa, Entamoeba histolytica
EIEED

SEQ ID NO: 2616083 - protein, 11 aa, Entamoeba histolytica
EIEEDGKECHS

SEQ ID NO: 2616084 - protein, 11 aa, Entamoeba histolytica
EIEEDYRKKEI

SEQ ID NO: 2616085 - protein, 15 aa, Entamoeba histolytica
EIEEENKRYGQGNLE

SEQ ID NO: 2616086 - protein, 58 aa, Entamoeba histolytica
EIEEGDDSNDNEDDEEKNDMSEENEEEIPTEKMEEEKEEAGEIEYAEEGLDAEDEKKK

SEQ ID NO: 2616087 - protein, 15 aa, Entamoeba histolytica
EIEEGMTEEENNYEQ

SEQ ID NO: 2616088 - protein, 5 aa, Entamoeba histolytica
EIEEH

SEQ ID NO: 2616089 - protein, 6 aa, Entamoeba histolytica
EIEEIR

SEQ ID NO: 2616090 - protein, 9 aa, Entamoeba histolytica
EIEEKKEEN

SEQ ID NO: 2616091 - protein, 17 aa, Entamoeba histolytica
EIEEKKEVHKEIATTKG

SEQ ID NO: 2616092 - protein, 15 aa, Entamoeba histolytica
EIEEKYKSYEDQITK

SEQ ID NO: 2616093 - protein, 8 aa, Entamoeba histolytica
EIEENDKF

SEQ ID NO: 2616094 - protein, 8 aa, Entamoeba histolytica
EIEEPKTY

SEQ ID NO: 2616095 - protein, 6 aa, Entamoeba histolytica
EIEEQA

SEQ ID NO: 2616096 - protein, 6 aa, Entamoeba histolytica
EIEERE

SEQ ID NO: 2616097 - protein, 16 aa, Entamoeba histolytica
EIEERGKKEEETAAQF

SEQ ID NO: 2616098 - protein, 16 aa, Entamoeba histolytica
EIEETEVGKEENEKEI

SEQ ID NO: 2616099 - protein, 20 aa, Entamoeba histolytica
EIEETKRKGEEGKKEIKEQQ

SEQ ID NO: 2616100 - protein, 7 aa, Entamoeba histolytica
EIEEYNK

SEQ ID NO: 2616101 - protein, 5 aa, Entamoeba histolytica
EIEIP

SEQ ID NO: 2616102 - protein, 4 aa, Entamoeba histolytica
EIEK

SEQ ID NO: 2616103 - protein, 23 aa, Entamoeba histolytica
EIEKEEENKRAEFEATKTEEIKT

SEQ ID NO: 2616104 - protein, 5 aa, Entamoeba histolytica
EIEKF

SEQ ID NO: 2616105 - protein, 8 aa, Entamoeba histolytica
EIEKKDKK

SEQ ID NO: 2616106 - protein, 15 aa, Entamoeba histolytica
EIEKKEKELDNNQTE

SEQ ID NO: 2616107 - protein, 13 aa, Entamoeba histolytica
EIEKKKEKYVPNK

SEQ ID NO: 2616108 - protein, 5 aa, Entamoeba histolytica
EIEKR

SEQ ID NO: 2616109 - protein, 13 aa, Entamoeba histolytica
EIEKTEKSIKKKI

SEQ ID NO: 2616110 - protein, 11 aa, Entamoeba histolytica
EIEKTKQEKAL

SEQ ID NO: 2616111 - protein, 11 aa, Entamoeba histolytica
EIELQEGEEIK

SEQ ID NO: 2616112 - protein, 24 aa, Entamoeba histolytica
EIENCQREEEEENKNESNEDIKKS

SEQ ID NO: 2616113 - protein, 16 aa, Entamoeba histolytica
EIENEGKEEDKNLTQK

SEQ ID NO: 2616114 - protein, 24 aa, Entamoeba histolytica
EIENENNNVEKKEEDKEDKIHEES

SEQ ID NO: 2616115 - protein, 12 aa, Entamoeba histolytica
EIENKIDSVSSQ

SEQ ID NO: 2616116 - protein, 20 aa, Entamoeba histolytica
EIENNTKEEHNKEKKIQIEE

SEQ ID NO: 2616117 - protein, 4 aa, Entamoeba histolytica
EIEP

SEQ ID NO: 2616118 - protein, 5 aa, Entamoeba histolytica
EIEQE

SEQ ID NO: 2616119 - protein, 12 aa, Entamoeba histolytica
EIEQPSQNDFNK

SEQ ID NO: 2616120 - protein, 5 aa, Entamoeba histolytica
EIEQQ

SEQ ID NO: 2616121 - protein, 8 aa, Entamoeba histolytica
EIEQSKMK

SEQ ID NO: 2616122 - protein, 21 aa, Entamoeba histolytica
EIEQTRKQFYDNREKVKKNQD

SEQ ID NO: 2616123 - protein, 16 aa, Entamoeba histolytica
EIEQYEKRVSASKRNN

SEQ ID NO: 2616124 - protein, 8 aa, Entamoeba histolytica
EIERGSQY

SEQ ID NO: 2616125 - protein, 7 aa, Entamoeba histolytica
EIERSKG

SEQ ID NO: 2616126 - protein, 14 aa, Entamoeba histolytica
EIERYEKASEESME

SEQ ID NO: 2616127 - protein, 13 aa, Entamoeba histolytica
EIESDESDEESDI

SEQ ID NO: 2616128 - protein, 10 aa, Entamoeba histolytica
EIESLQPNVS

SEQ ID NO: 2616129 - protein, 11 aa, Entamoeba histolytica
EIESPKEPKLM

SEQ ID NO: 2616130 - protein, 9 aa, Entamoeba histolytica
EIESSQNSW

SEQ ID NO: 2616131 - protein, 7 aa, Entamoeba histolytica
EIESVGN

SEQ ID NO: 2616132 - protein, 15 aa, Entamoeba histolytica
EIETEEEDSYSSDYS

SEQ ID NO: 2616133 - protein, 5 aa, Entamoeba histolytica
EIETG

SEQ ID NO: 2616134 - protein, 9 aa, Entamoeba histolytica
EIETGGSLE

SEQ ID NO: 2616135 - protein, 9 aa, Entamoeba histolytica
EIETPPSVD

SEQ ID NO: 2616136 - protein, 24 aa, Entamoeba histolytica
EIEVEDEKEEKNKNPIMYYYLNNT

SEQ ID NO: 2616137 - protein, 4 aa, Entamoeba histolytica
EIFE

SEQ ID NO: 2616138 - protein, 23 aa, Entamoeba histolytica
EIGDIGNEADDCLDGDGAMTERK

SEQ ID NO: 2616139 - protein, 5 aa, Entamoeba histolytica
EIGES

SEQ ID NO: 2616140 - protein, 5 aa, Entamoeba histolytica
EIGEV

SEQ ID NO: 2616141 - protein, 17 aa, Entamoeba histolytica
EIGGSPSASSSPDIPPV

SEQ ID NO: 2616142 - protein, 10 aa, Entamoeba histolytica
EIGKDAHEKA

SEQ ID NO: 2616143 - protein, 8 aa, Entamoeba histolytica
EIGKDDTG

SEQ ID NO: 2616144 - protein, 9 aa, Entamoeba histolytica
EIGKENEVV

SEQ ID NO: 2616145 - protein, 5 aa, Entamoeba histolytica
EIGKS

SEQ ID NO: 2616146 - protein, 24 aa, Entamoeba histolytica
EIGKSSNKISPSKKVEVTQPSFQK

SEQ ID NO: 2616147 - protein, 10 aa, Entamoeba histolytica
EIGNEKKKDL

SEQ ID NO: 2616148 - protein, 6 aa, Entamoeba histolytica
EIGNIE

SEQ ID NO: 2616149 - protein, 5 aa, Entamoeba histolytica
EIGNR

SEQ ID NO: 2616150 - protein, 7 aa, Entamoeba histolytica
EIGQTLS

SEQ ID NO: 2616151 - protein, 10 aa, Entamoeba histolytica
EIGRNGNINQ

SEQ ID NO: 2616152 - protein, 14 aa, Entamoeba histolytica
EIGSYQKGIRNEMP

SEQ ID NO: 2616153 - protein, 4 aa, Entamoeba histolytica
EIGT

SEQ ID NO: 2616154 - protein, 8 aa, Entamoeba histolytica
EIGTKVNE

SEQ ID NO: 2616155 - protein, 5 aa, Entamoeba histolytica
EIGTT

SEQ ID NO: 2616156 - protein, 9 aa, Entamoeba histolytica
EIHKKEEND

SEQ ID NO: 2616157 - protein, 4 aa, Entamoeba histolytica
EIID

SEQ ID NO: 2616158 - protein, 4 aa, Entamoeba histolytica
EIIE

SEQ ID NO: 2616159 - protein, 22 aa, Entamoeba histolytica
EIIEGKEYQEETKKSGGSVGSD

SEQ ID NO: 2616160 - protein, 7 aa, Entamoeba histolytica
EIIENEK

SEQ ID NO: 2616161 - protein, 5 aa, Entamoeba histolytica
EIIPD

SEQ ID NO: 2616162 - protein, 4 aa, Entamoeba histolytica
EIIS

SEQ ID NO: 2616163 - protein, 8 aa, Entamoeba histolytica
EIKDENKI

SEQ ID NO: 2616164 - protein, 4 aa, Entamoeba histolytica
EIKE

SEQ ID NO: 2616165 - protein, 32 aa, Entamoeba histolytica
EIKEAKQELEEEKNKTIEEKTNLQQELNENKK

SEQ ID NO: 2616166 - protein, 5 aa, Entamoeba histolytica
EIKEE

SEQ ID NO: 2616167 - protein, 12 aa, Entamoeba histolytica
EIKEEEKERREK

SEQ ID NO: 2616168 - protein, 9 aa, Entamoeba histolytica
EIKEEENER

SEQ ID NO: 2616169 - protein, 21 aa, Entamoeba histolytica
EIKEEVKERKRRKEEKTSSKV

SEQ ID NO: 2616170 - protein, 33 aa, Entamoeba histolytica
EIKEEVKERKRRKEELEQEGEKKEKEIKELNAQ

SEQ ID NO: 2616171 - protein, 17 aa, Entamoeba histolytica
EIKEKEYKNNDNKINTQ

SEQ ID NO: 2616172 - protein, 22 aa, Entamoeba histolytica
EIKELENSKAPYYPDKYPQGTT

SEQ ID NO: 2616173 - protein, 9 aa, Entamoeba histolytica
EIKENYKTE

SEQ ID NO: 2616174 - protein, 5 aa, Entamoeba histolytica
EIKEV

SEQ ID NO: 2616175 - protein, 6 aa, Entamoeba histolytica
EIKKDI

SEQ ID NO: 2616176 - protein, 10 aa, Entamoeba histolytica
EIKKDSEATV

SEQ ID NO: 2616177 - protein, 19 aa, Entamoeba histolytica
EIKKEEVKEKIKETTTSET

SEQ ID NO: 2616178 - protein, 9 aa, Entamoeba histolytica
EIKKGNIQG

SEQ ID NO: 2616179 - protein, 7 aa, Entamoeba histolytica
EIKKGNT

SEQ ID NO: 2616180 - protein, 11 aa, Entamoeba histolytica
EIKKKEYNGLS

SEQ ID NO: 2616181 - protein, 9 aa, Entamoeba histolytica
EIKKQEDDL

SEQ ID NO: 2616182 - protein, 12 aa, Entamoeba histolytica
EIKKQRKENIEN

SEQ ID NO: 2616183 - protein, 4 aa, Entamoeba histolytica
EIKN

SEQ ID NO: 2616184 - protein, 9 aa, Entamoeba histolytica
EIKNDKRRE

SEQ ID NO: 2616185 - protein, 8 aa, Entamoeba histolytica
EIKNEQKR

SEQ ID NO: 2616186 - protein, 17 aa, Entamoeba histolytica
EIKNSRVATHKDGASKG

SEQ ID NO: 2616187 - protein, 4 aa, Entamoeba histolytica
EIKP

SEQ ID NO: 2616188 - protein, 17 aa, Entamoeba histolytica
EIKPIKPKSIEIKPSNE

SEQ ID NO: 2616189 - protein, 6 aa, Entamoeba histolytica
EIKPRS

SEQ ID NO: 2616190 - protein, 8 aa, Entamoeba histolytica
EIKPTEEN

SEQ ID NO: 2616191 - protein, 15 aa, Entamoeba histolytica
EIKQEDENEKEELQE

SEQ ID NO: 2616192 - protein, 17 aa, Entamoeba histolytica
EIKQKRKEAQEEEKASR

SEQ ID NO: 2616193 - protein, 14 aa, Entamoeba histolytica
EIKQNSVSKKEVEE

SEQ ID NO: 2616194 - protein, 17 aa, Entamoeba histolytica
EIKQTNNINDKSLETKK

SEQ ID NO: 2616195 - protein, 11 aa, Entamoeba histolytica
EIKRESKSFEA

SEQ ID NO: 2616196 - protein, 12 aa, Entamoeba histolytica
EIKSETQKEILL

SEQ ID NO: 2616197 - protein, 10 aa, Entamoeba histolytica
EIKTNERITE

SEQ ID NO: 2616198 - protein, 8 aa, Entamoeba histolytica
EIKTTQKL

SEQ ID NO: 2616199 - protein, 8 aa, Entamoeba histolytica
EIKTTVKS

SEQ ID NO: 2616200 - protein, 5 aa, Entamoeba histolytica
EILPT

SEQ ID NO: 2616201 - protein, 5 aa, Entamoeba histolytica
EILSD

SEQ ID NO: 2616202 - protein, 4 aa, Entamoeba histolytica
EINA

SEQ ID NO: 2616203 - protein, 14 aa, Entamoeba histolytica
EINDKTKKEQEIEE

SEQ ID NO: 2616204 - protein, 10 aa, Entamoeba histolytica
EINDNDNDDD

SEQ ID NO: 2616205 - protein, 8 aa, Entamoeba histolytica
EINDTLPE

SEQ ID NO: 2616206 - protein, 13 aa, Entamoeba histolytica
EINEKEKAELNEL

SEQ ID NO: 2616207 - protein, 7 aa, Entamoeba histolytica
EINENKC

SEQ ID NO: 2616208 - protein, 15 aa, Entamoeba histolytica
EINEREEKKRQEKLE

SEQ ID NO: 2616209 - protein, 5 aa, Entamoeba histolytica
EINES

SEQ ID NO: 2616210 - protein, 6 aa, Entamoeba histolytica
EINETI

SEQ ID NO: 2616211 - protein, 10 aa, Entamoeba histolytica
EINGGRKATV

SEQ ID NO: 2616212 - protein, 6 aa, Entamoeba histolytica
EINGNE

SEQ ID NO: 2616213 - protein, 9 aa, Entamoeba histolytica
EINHENASN

SEQ ID NO: 2616214 - protein, 4 aa, Entamoeba histolytica
EINI

SEQ ID NO: 2616215 - protein, 4 aa, Entamoeba histolytica
EINK

SEQ ID NO: 2616216 - protein, 12 aa, Entamoeba histolytica
EINKKRREEESK

SEQ ID NO: 2616217 - protein, 35 aa, Entamoeba histolytica
EINKKSNHVPRKPLPSPKVPVPTRSLSSSPEVSDR

SEQ ID NO: 2616218 - protein, 4 aa, Entamoeba histolytica
EINN

SEQ ID NO: 2616219 - protein, 5 aa, Entamoeba histolytica
EINNE

SEQ ID NO: 2616220 - protein, 13 aa, Entamoeba histolytica
EINPQKESENAVD

SEQ ID NO: 2616221 - protein, 5 aa, Entamoeba histolytica
EINQL

SEQ ID NO: 2616222 - protein, 4 aa, Entamoeba histolytica
EINR

SEQ ID NO: 2616223 - protein, 12 aa, Entamoeba histolytica
EINRRTSHNSDQ

SEQ ID NO: 2616224 - protein, 6 aa, Entamoeba histolytica
EINSDK

SEQ ID NO: 2616225 - protein, 13 aa, Entamoeba histolytica
EINSNKGMKGDPS

SEQ ID NO: 2616226 - protein, 5 aa, Entamoeba histolytica
EINSR

SEQ ID NO: 2616227 - protein, 6 aa, Entamoeba histolytica
EINSSH

SEQ ID NO: 2616228 - protein, 7 aa, Entamoeba histolytica
EINTKDN

SEQ ID NO: 2616229 - protein, 5 aa, Entamoeba histolytica
EINTL

SEQ ID NO: 2616230 - protein, 4 aa, Entamoeba histolytica
EIPE

SEQ ID NO: 2616231 - protein, 8 aa, Entamoeba histolytica
EIPEAEKK

SEQ ID NO: 2616232 - protein, 5 aa, Entamoeba histolytica
EIPEL

SEQ ID NO: 2616233 - protein, 5 aa, Entamoeba histolytica
EIPES

SEQ ID NO: 2616234 - protein, 30 aa, Entamoeba histolytica
EIPETKKPQQPDTLKKENDIITSGKSQKKL

SEQ ID NO: 2616235 - protein, 5 aa, Entamoeba histolytica
EIPEV

SEQ ID NO: 2616236 - protein, 7 aa, Entamoeba histolytica
EIPGKGR

SEQ ID NO: 2616237 - protein, 5 aa, Entamoeba histolytica
EIPKN

SEQ ID NO: 2616238 - protein, 25 aa, Entamoeba histolytica
EIPKQQVTQTTQSDVELNDEPDTKL

SEQ ID NO: 2616239 - protein, 5 aa, Entamoeba histolytica
EIPKT

SEQ ID NO: 2616240 - protein, 5 aa, Entamoeba histolytica
EIPND

SEQ ID NO: 2616241 - protein, 7 aa, Entamoeba histolytica
EIPPQTK

SEQ ID NO: 2616242 - protein, 5 aa, Entamoeba histolytica
EIPPR

SEQ ID NO: 2616243 - protein, 4 aa, Entamoeba histolytica
EIPQ

SEQ ID NO: 2616244 - protein, 14 aa, Entamoeba histolytica
EIPQTNSLSSTTSH

SEQ ID NO: 2616245 - protein, 4 aa, Entamoeba histolytica
EIPR

SEQ ID NO: 2616246 - protein, 5 aa, Entamoeba histolytica
EIPSK

SEQ ID NO: 2616247 - protein, 5 aa, Entamoeba histolytica
EIPSN

SEQ ID NO: 2616248 - protein, 8 aa, Entamoeba histolytica
EIPSNTSH

SEQ ID NO: 2616249 - protein, 12 aa, Entamoeba histolytica
EIPSNTTNRHNS

SEQ ID NO: 2616250 - protein, 7 aa, Entamoeba histolytica
EIPSPKH

SEQ ID NO: 2616251 - protein, 22 aa, Entamoeba histolytica
EIPSTISNEESIESSKEKEEII

SEQ ID NO: 2616252 - protein, 7 aa, Entamoeba histolytica
EIPSTKI

SEQ ID NO: 2616253 - protein, 4 aa, Entamoeba histolytica
EIPT

SEQ ID NO: 2616254 - protein, 5 aa, Entamoeba histolytica
EIPTN

SEQ ID NO: 2616255 - protein, 5 aa, Entamoeba histolytica
EIPTQ

SEQ ID NO: 2616256 - protein, 9 aa, Entamoeba histolytica
EIQAPPHEA

SEQ ID NO: 2616257 - protein, 4 aa, Entamoeba histolytica
EIQD

SEQ ID NO: 2616258 - protein, 10 aa, Entamoeba histolytica
EIQEDKKTRI

SEQ ID NO: 2616259 - protein, 5 aa, Entamoeba histolytica
EIQES

SEQ ID NO: 2616260 - protein, 12 aa, Entamoeba histolytica
EIQGTQSEQTAF

SEQ ID NO: 2616261 - protein, 9 aa, Entamoeba histolytica
EIQKESSLD

SEQ ID NO: 2616262 - protein, 6 aa, Entamoeba histolytica
EIQKEV

SEQ ID NO: 2616263 - protein, 32 aa, Entamoeba histolytica
EIQKKKKSKHRHYSAYEGSDIQSIQRQRRRSM

SEQ ID NO: 2616264 - protein, 24 aa, Entamoeba histolytica
EIQNTSVGLNQKEYQTLKEKYNNA

SEQ ID NO: 2616265 - protein, 8 aa, Entamoeba histolytica
EIQPKETI

SEQ ID NO: 2616266 - protein, 6 aa, Entamoeba histolytica
EIQQNE

SEQ ID NO: 2616267 - protein, 5 aa, Entamoeba histolytica
EIQRY

SEQ ID NO: 2616268 - protein, 7 aa, Entamoeba histolytica
EIQSNGI

SEQ ID NO: 2616269 - protein, 5 aa, Entamoeba histolytica
EIQSR

SEQ ID NO: 2616270 - protein, 15 aa, Entamoeba histolytica
EIQSTEKEEAKEEQE

SEQ ID NO: 2616271 - protein, 5 aa, Entamoeba histolytica
EIQSV

SEQ ID NO: 2616272 - protein, 6 aa, Entamoeba histolytica
EIQTGE

SEQ ID NO: 2616273 - protein, 7 aa, Entamoeba histolytica
EIRANEN

SEQ ID NO: 2616274 - protein, 4 aa, Entamoeba histolytica
EIRC

SEQ ID NO: 2616275 - protein, 18 aa, Entamoeba histolytica
EIREKNGIKKGSVTAKEQ

SEQ ID NO: 2616276 - protein, 10 aa, Entamoeba histolytica
EIRETPNKKH

SEQ ID NO: 2616277 - protein, 9 aa, Entamoeba histolytica
EIRETPSRK

SEQ ID NO: 2616278 - protein, 4 aa, Entamoeba histolytica
EIRG

SEQ ID NO: 2616279 - protein, 6 aa, Entamoeba histolytica
EIRNPS

SEQ ID NO: 2616280 - protein, 5 aa, Entamoeba histolytica
EIRQE

SEQ ID NO: 2616281 - protein, 8 aa, Entamoeba histolytica
EIRQQEEA

SEQ ID NO: 2616282 - protein, 4 aa, Entamoeba histolytica
EIRR

SEQ ID NO: 2616283 - protein, 26 aa, Entamoeba histolytica
EIRSKDDNNINENVNENKTPEISEEE

SEQ ID NO: 2616284 - protein, 20 aa, Entamoeba histolytica
EIRTRQAEEEAKRKEARKQA

SEQ ID NO: 2616285 - protein, 13 aa, Entamoeba histolytica
EIRTSTSNSSITS

SEQ ID NO: 2616286 - protein, 15 aa, Entamoeba histolytica
EISASDHVPLIIHIK

SEQ ID NO: 2616287 - protein, 4 aa, Entamoeba histolytica
EISD

SEQ ID NO: 2616288 - protein, 16 aa, Entamoeba histolytica
EISDEDAKKYAEEKEN

SEQ ID NO: 2616289 - protein, 8 aa, Entamoeba histolytica
EISDNDDI

SEQ ID NO: 2616290 - protein, 14 aa, Entamoeba histolytica
EISEDTEEENEEEM

SEQ ID NO: 2616291 - protein, 9 aa, Entamoeba histolytica
EISESERRC

SEQ ID NO: 2616292 - protein, 19 aa, Entamoeba histolytica
EISETSTINLSQEQETITP

SEQ ID NO: 2616293 - protein, 5 aa, Entamoeba histolytica
EISGG

SEQ ID NO: 2616294 - protein, 4 aa, Entamoeba histolytica
EISH

SEQ ID NO: 2616295 - protein, 31 aa, Entamoeba histolytica
EISKGSLKETKPKKTTPLKSQQKGEAKSDID

SEQ ID NO: 2616296 - protein, 6 aa, Entamoeba histolytica
EISKKL

SEQ ID NO: 2616297 - protein, 7 aa, Entamoeba histolytica
EISNDTI

SEQ ID NO: 2616298 - protein, 5 aa, Entamoeba histolytica
EISNF

SEQ ID NO: 2616299 - protein, 15 aa, Entamoeba histolytica
EISNSLGKVTEPMTD

SEQ ID NO: 2616300 - protein, 4 aa, Entamoeba histolytica
EISP

SEQ ID NO: 2616301 - protein, 5 aa, Entamoeba histolytica
EISPI

SEQ ID NO: 2616302 - protein, 7 aa, Entamoeba histolytica
EISPNDI

SEQ ID NO: 2616303 - protein, 5 aa, Entamoeba histolytica
EISQK

SEQ ID NO: 2616304 - protein, 6 aa, Entamoeba histolytica
EISQSK

SEQ ID NO: 2616305 - protein, 8 aa, Entamoeba histolytica
EISRNKKG

SEQ ID NO: 2616306 - protein, 5 aa, Entamoeba histolytica
EISRR

SEQ ID NO: 2616307 - protein, 11 aa, Entamoeba histolytica
EISSEHLDQET

SEQ ID NO: 2616308 - protein, 23 aa, Entamoeba histolytica
EISSEKAMQKGIGQSEGIILQFA

SEQ ID NO: 2616309 - protein, 10 aa, Entamoeba histolytica
EISSNQLNSL

SEQ ID NO: 2616310 - protein, 6 aa, Entamoeba histolytica
EISSPA

SEQ ID NO: 2616311 - protein, 7 aa, Entamoeba histolytica
EISSRTC

SEQ ID NO: 2616312 - protein, 21 aa, Entamoeba histolytica
EISSSDSSYVSEDYGRVPEQD

SEQ ID NO: 2616313 - protein, 28 aa, Entamoeba histolytica
EISSSEPQGLQEEKEIKEEIKEHKLMQE

SEQ ID NO: 2616314 - protein, 7 aa, Entamoeba histolytica
EISTPVT

SEQ ID NO: 2616315 - protein, 19 aa, Entamoeba histolytica
EISVEGKRVRSIKNPSEAI

SEQ ID NO: 2616316 - protein, 5 aa, Entamoeba histolytica
EISYE

SEQ ID NO: 2616317 - protein, 4 aa, Entamoeba histolytica
EITA

SEQ ID NO: 2616318 - protein, 30 aa, Entamoeba histolytica
EITDDEQSENSFERREKTTPNEINEEEQKM

SEQ ID NO: 2616319 - protein, 5 aa, Entamoeba histolytica
EITDY

SEQ ID NO: 2616320 - protein, 5 aa, Entamoeba histolytica
EITED

SEQ ID NO: 2616321 - protein, 534 aa, Entamoeba histolytica
EITEEKKLETIQNTDEQIIDEKKDEQKSENATEEKKEINEETKTCESDESTTKTEEVISSEKKEEEEKEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARQEAEEKARLEAEEKARLEAEEKARLEAEEKAKKEAEVAITTSASSVPIKEEKADTAINV

SEQ ID NO: 2616322 - protein, 7 aa, Entamoeba histolytica
EITEENE

SEQ ID NO: 2616323 - protein, 24 aa, Entamoeba histolytica
EITENDEQNVLKEKGSNSSSGALT

SEQ ID NO: 2616324 - protein, 13 aa, Entamoeba histolytica
EITENENEQEERK

SEQ ID NO: 2616325 - protein, 12 aa, Entamoeba histolytica
EITENSDNEDLV

SEQ ID NO: 2616326 - protein, 5 aa, Entamoeba histolytica
EITEV

SEQ ID NO: 2616327 - protein, 11 aa, Entamoeba histolytica
EITGETDDDLL

SEQ ID NO: 2616328 - protein, 6 aa, Entamoeba histolytica
EITGKK

SEQ ID NO: 2616329 - protein, 90 aa, Entamoeba histolytica
EITGTEKEKTYERGRVEHQRDSSRYSRSHSRRRRSKSKGHYSRSRSRDRYLRNRSKSHYSRSRSRSSDKYYSRTRRSRSRRRSGSRRRRH

SEQ ID NO: 2616330 - protein, 7 aa, Entamoeba histolytica
EITKAES

SEQ ID NO: 2616331 - protein, 4 aa, Entamoeba histolytica
EITN

SEQ ID NO: 2616332 - protein, 5 aa, Entamoeba histolytica
EITNE

SEQ ID NO: 2616333 - protein, 5 aa, Entamoeba histolytica
EITNK

SEQ ID NO: 2616334 - protein, 5 aa, Entamoeba histolytica
EITNQ

SEQ ID NO: 2616335 - protein, 17 aa, Entamoeba histolytica
EITNSTIDKENNQNEKN

SEQ ID NO: 2616336 - protein, 20 aa, Entamoeba histolytica
EITNSVPEAEKQSVFVMSSL

SEQ ID NO: 2616337 - protein, 9 aa, Entamoeba histolytica
EITPPPHLG

SEQ ID NO: 2616338 - protein, 8 aa, Entamoeba histolytica
EITPRTTD

SEQ ID NO: 2616339 - protein, 5 aa, Entamoeba histolytica
EITPS

SEQ ID NO: 2616340 - protein, 15 aa, Entamoeba histolytica
EITPSREKLKKDAEA

SEQ ID NO: 2616341 - protein, 14 aa, Entamoeba histolytica
EITPSVQMSGPTNF

SEQ ID NO: 2616342 - protein, 30 aa, Entamoeba histolytica
EITQKDSSIEKSVKKAKEKFVNEHKDENIT

SEQ ID NO: 2616343 - protein, 10 aa, Entamoeba histolytica
EITQNSNNFK

SEQ ID NO: 2616344 - protein, 15 aa, Entamoeba histolytica
EITQPTDPQQPSLTP

SEQ ID NO: 2616345 - protein, 12 aa, Entamoeba histolytica
EITQRKGYKKGN

SEQ ID NO: 2616346 - protein, 17 aa, Entamoeba histolytica
EITRETERTCPGRNVSS

SEQ ID NO: 2616347 - protein, 7 aa, Entamoeba histolytica
EITSSKG

SEQ ID NO: 2616348 - protein, 6 aa, Entamoeba histolytica
EITSTR

SEQ ID NO: 2616349 - protein, 12 aa, Entamoeba histolytica
EITTDQKDEQID

SEQ ID NO: 2616350 - protein, 50 aa, Entamoeba histolytica
EITTEQQINEESKGEEIKQNNQENKLKENDNKQDSTEEYKIEDEKSQERN

SEQ ID NO: 2616351 - protein, 9 aa, Entamoeba histolytica
EITTSEETY

SEQ ID NO: 2616352 - protein, 15 aa, Entamoeba histolytica
EITVDTAGKEGAPTL

SEQ ID NO: 2616353 - protein, 10 aa, Entamoeba histolytica
EIVASGPKGL

SEQ ID NO: 2616354 - protein, 11 aa, Entamoeba histolytica
EIVEEKTTNNY

SEQ ID NO: 2616355 - protein, 19 aa, Entamoeba histolytica
EIVQRSSSAERKSSDKKES

SEQ ID NO: 2616356 - protein, 13 aa, Entamoeba histolytica
EIYEEDKQNPWDS

SEQ ID NO: 2616357 - protein, 7 aa, Entamoeba histolytica
EIYGPTD

SEQ ID NO: 2616358 - protein, 12 aa, Entamoeba histolytica
EKAAGPSFAPPE

SEQ ID NO: 2616359 - protein, 7 aa, Entamoeba histolytica
EKAEQED

SEQ ID NO: 2616360 - protein, 11 aa, Entamoeba histolytica
EKAFETNSYNN

SEQ ID NO: 2616361 - protein, 79 aa, Entamoeba histolytica
EKAGEVNRTDKKSNKEEEIKEDKSERRKHHQHRDYSRSERRHHSRERRDRSYSRSRSSSRRRRDTSKKNSRSYKEREYR

SEQ ID NO: 2616362 - protein, 7 aa, Entamoeba histolytica
EKAGGYP

SEQ ID NO: 2616363 - protein, 11 aa, Entamoeba histolytica
EKAGITGYPPQ

SEQ ID NO: 2616364 - protein, 5 aa, Entamoeba histolytica
EKAGN

SEQ ID NO: 2616365 - protein, 18 aa, Entamoeba histolytica
EKAGRAKAQKQKQAYEKK

SEQ ID NO: 2616366 - protein, 6 aa, Entamoeba histolytica
EKAKDL

SEQ ID NO: 2616367 - protein, 5 aa, Entamoeba histolytica
EKAKE

SEQ ID NO: 2616368 - protein, 52 aa, Entamoeba histolytica
EKAKERVAKSQEIVKKQQEALNAQTAAQNASIDEKIKNSKPIVPKEEQVKTG

SEQ ID NO: 2616369 - protein, 10 aa, Entamoeba histolytica
EKAKIELSSN

SEQ ID NO: 2616370 - protein, 12 aa, Entamoeba histolytica
EKAKKLSPKDGM

SEQ ID NO: 2616371 - protein, 9 aa, Entamoeba histolytica
EKAKLTPQQ

SEQ ID NO: 2616372 - protein, 5 aa, Entamoeba histolytica
EKAKN

SEQ ID NO: 2616373 - protein, 6 aa, Entamoeba histolytica
EKALTE

SEQ ID NO: 2616374 - protein, 17 aa, Entamoeba histolytica
EKANKKMEQKLKKTTDW

SEQ ID NO: 2616375 - protein, 18 aa, Entamoeba histolytica
EKANQKKLEPFKTEKECN

SEQ ID NO: 2616376 - protein, 8 aa, Entamoeba histolytica
EKAPAKEA

SEQ ID NO: 2616377 - protein, 4 aa, Entamoeba histolytica
EKAQ

SEQ ID NO: 2616378 - protein, 12 aa, Entamoeba histolytica
EKAQHATPETLN

SEQ ID NO: 2616379 - protein, 20 aa, Entamoeba histolytica
EKAQQIQAQNKEQEQQKRLE

SEQ ID NO: 2616380 - protein, 4 aa, Entamoeba histolytica
EKAR

SEQ ID NO: 2616381 - protein, 8 aa, Entamoeba histolytica
EKASAQKY

SEQ ID NO: 2616382 - protein, 7 aa, Entamoeba histolytica
EKASEES

SEQ ID NO: 2616383 - protein, 9 aa, Entamoeba histolytica
EKASGKKIN

SEQ ID NO: 2616384 - protein, 7 aa, Entamoeba histolytica
EKASTFT

SEQ ID NO: 2616385 - protein, 6 aa, Entamoeba histolytica
EKAVER

SEQ ID NO: 2616386 - protein, 6 aa, Entamoeba histolytica
EKCDDE

SEQ ID NO: 2616387 - protein, 8 aa, Entamoeba histolytica
EKCGKTSL

SEQ ID NO: 2616388 - protein, 14 aa, Entamoeba histolytica
EKCNGEKSKASLAM

SEQ ID NO: 2616389 - protein, 14 aa, Entamoeba histolytica
EKCNGSGRVSETTE

SEQ ID NO: 2616390 - protein, 18 aa, Entamoeba histolytica
EKCPSQNSLTINDSKEQL

SEQ ID NO: 2616391 - protein, 14 aa, Entamoeba histolytica
EKDAEEIRKTNELM

SEQ ID NO: 2616392 - protein, 5 aa, Entamoeba histolytica
EKDAS

SEQ ID NO: 2616393 - protein, 14 aa, Entamoeba histolytica
EKDDAPFPSALDLI

SEQ ID NO: 2616394 - protein, 11 aa, Entamoeba histolytica
EKDDDEPKETV

SEQ ID NO: 2616395 - protein, 19 aa, Entamoeba histolytica
EKDDEIEPIKKKKEQAAID

SEQ ID NO: 2616396 - protein, 7 aa, Entamoeba histolytica
EKDEAVP

SEQ ID NO: 2616397 - protein, 5 aa, Entamoeba histolytica
EKDEE

SEQ ID NO: 2616398 - protein, 13 aa, Entamoeba histolytica
EKDEKNEDVLLYL

SEQ ID NO: 2616399 - protein, 8 aa, Entamoeba histolytica
EKDENGFK

SEQ ID NO: 2616400 - protein, 7 aa, Entamoeba histolytica
EKDENRL

SEQ ID NO: 2616401 - protein, 28 aa, Entamoeba histolytica
EKDEREAEAKRIAEEEEEQKRKEEEQKA

SEQ ID NO: 2616402 - protein, 10 aa, Entamoeba histolytica
EKDETTTHYS

SEQ ID NO: 2616403 - protein, 5 aa, Entamoeba histolytica
EKDFR

SEQ ID NO: 2616404 - protein, 8 aa, Entamoeba histolytica
EKDGDDKI

SEQ ID NO: 2616405 - protein, 5 aa, Entamoeba histolytica
EKDGE

SEQ ID NO: 2616406 - protein, 8 aa, Entamoeba histolytica
EKDGEEVG

SEQ ID NO: 2616407 - protein, 5 aa, Entamoeba histolytica
EKDGF

SEQ ID NO: 2616408 - protein, 7 aa, Entamoeba histolytica
EKDGIRK

SEQ ID NO: 2616409 - protein, 8 aa, Entamoeba histolytica
EKDGNNGI

SEQ ID NO: 2616410 - protein, 13 aa, Entamoeba histolytica
EKDGQSFSCSQSE

SEQ ID NO: 2616411 - protein, 6 aa, Entamoeba histolytica
EKDICP

SEQ ID NO: 2616412 - protein, 26 aa, Entamoeba histolytica
EKDIEEGKDQEKDEKVEKKNKENEEM

SEQ ID NO: 2616413 - protein, 6 aa, Entamoeba histolytica
EKDIEQ

SEQ ID NO: 2616414 - protein, 7 aa, Entamoeba histolytica
EKDIQNN

SEQ ID NO: 2616415 - protein, 4 aa, Entamoeba histolytica
EKDK

SEQ ID NO: 2616416 - protein, 5 aa, Entamoeba histolytica
EKDKC

SEQ ID NO: 2616417 - protein, 9 aa, Entamoeba histolytica
EKDKEKKKQ

SEQ ID NO: 2616418 - protein, 6 aa, Entamoeba histolytica
EKDKFG

SEQ ID NO: 2616419 - protein, 6 aa, Entamoeba histolytica
EKDKLK

SEQ ID NO: 2616420 - protein, 10 aa, Entamoeba histolytica
EKDKNTLKDR

SEQ ID NO: 2616421 - protein, 7 aa, Entamoeba histolytica
EKDNANS

SEQ ID NO: 2616422 - protein, 16 aa, Entamoeba histolytica
EKDNENSTTTDTIKSQ

SEQ ID NO: 2616423 - protein, 7 aa, Entamoeba histolytica
EKDNKNI

SEQ ID NO: 2616424 - protein, 8 aa, Entamoeba histolytica
EKDNKQKY

SEQ ID NO: 2616425 - protein, 7 aa, Entamoeba histolytica
EKDNNRP

SEQ ID NO: 2616426 - protein, 8 aa, Entamoeba histolytica
EKDPNNPA

SEQ ID NO: 2616427 - protein, 13 aa, Entamoeba histolytica
EKDPSLGYLLQPE

SEQ ID NO: 2616428 - protein, 6 aa, Entamoeba histolytica
EKDQEI

SEQ ID NO: 2616429 - protein, 8 aa, Entamoeba histolytica
EKDRDGCP

SEQ ID NO: 2616430 - protein, 32 aa, Entamoeba histolytica
EKDRKSESKQIVEEEKAITSNEPRKMEEEELK

SEQ ID NO: 2616431 - protein, 7 aa, Entamoeba histolytica
EKDRMES

SEQ ID NO: 2616432 - protein, 8 aa, Entamoeba histolytica
EKDRTKPL

SEQ ID NO: 2616433 - protein, 9 aa, Entamoeba histolytica
EKDSHPKPL

SEQ ID NO: 2616434 - protein, 5 aa, Entamoeba histolytica
EKDSI

SEQ ID NO: 2616435 - protein, 9 aa, Entamoeba histolytica
EKDSTETCK

SEQ ID NO: 2616436 - protein, 8 aa, Entamoeba histolytica
EKDTEKQT

SEQ ID NO: 2616437 - protein, 5 aa, Entamoeba histolytica
EKDTI

SEQ ID NO: 2616438 - protein, 8 aa, Entamoeba histolytica
EKDTKSNE

SEQ ID NO: 2616439 - protein, 29 aa, Entamoeba histolytica
EKDTNDGLIDREETNERRSVKRSIPTMGK

SEQ ID NO: 2616440 - protein, 6 aa, Entamoeba histolytica
EKDTSL

SEQ ID NO: 2616441 - protein, 9 aa, Entamoeba histolytica
EKDVEQNVE

SEQ ID NO: 2616442 - protein, 18 aa, Entamoeba histolytica
EKDVTGIDDGLNNLGKEN

SEQ ID NO: 2616443 - protein, 4 aa, Entamoeba histolytica
EKDY

SEQ ID NO: 2616444 - protein, 10 aa, Entamoeba histolytica
EKEADPEEFK

SEQ ID NO: 2616445 - protein, 10 aa, Entamoeba histolytica
EKEAEEERKR

SEQ ID NO: 2616446 - protein, 6 aa, Entamoeba histolytica
EKEAEI

SEQ ID NO: 2616447 - protein, 8 aa, Entamoeba histolytica
EKEAHAET

SEQ ID NO: 2616448 - protein, 10 aa, Entamoeba histolytica
EKEAKENQRE

SEQ ID NO: 2616449 - protein, 10 aa, Entamoeba histolytica
EKEAKETRMK

SEQ ID NO: 2616450 - protein, 9 aa, Entamoeba histolytica
EKEAPDTEG

SEQ ID NO: 2616451 - protein, 7 aa, Entamoeba histolytica
EKEATSR

SEQ ID NO: 2616452 - protein, 7 aa, Entamoeba histolytica
EKECEAR

SEQ ID NO: 2616453 - protein, 5 aa, Entamoeba histolytica
EKEDI

SEQ ID NO: 2616454 - protein, 9 aa, Entamoeba histolytica
EKEDKENMH

SEQ ID NO: 2616455 - protein, 7 aa, Entamoeba histolytica
EKEDKLD

SEQ ID NO: 2616456 - protein, 17 aa, Entamoeba histolytica
EKEDNNDNIGSKNTPIT

SEQ ID NO: 2616457 - protein, 16 aa, Entamoeba histolytica
EKEDNQQDLSDSITTP

SEQ ID NO: 2616458 - protein, 6 aa, Entamoeba histolytica
EKEDQD

SEQ ID NO: 2616459 - protein, 6 aa, Entamoeba histolytica
EKEDTI

SEQ ID NO: 2616460 - protein, 9 aa, Entamoeba histolytica
EKEDTSERC

SEQ ID NO: 2616461 - protein, 9 aa, Entamoeba histolytica
EKEEDITNT

SEQ ID NO: 2616462 - protein, 6 aa, Entamoeba histolytica
EKEEDL

SEQ ID NO: 2616463 - protein, 5 aa, Entamoeba histolytica
EKEEE

SEQ ID NO: 2616464 - protein, 18 aa, Entamoeba histolytica
EKEEEAIEEEDNDEDLGL

SEQ ID NO: 2616465 - protein, 8 aa, Entamoeba histolytica
EKEEEINA

SEQ ID NO: 2616466 - protein, 6 aa, Entamoeba histolytica
EKEEFT

SEQ ID NO: 2616467 - protein, 10 aa, Entamoeba histolytica
EKEEGIPEDF

SEQ ID NO: 2616468 - protein, 14 aa, Entamoeba histolytica
EKEEIGKGEEFEKS

SEQ ID NO: 2616469 - protein, 15 aa, Entamoeba histolytica
EKEEPELAEEIRDNP

SEQ ID NO: 2616470 - protein, 19 aa, Entamoeba histolytica
EKEEQYAPLPQPQRIDGHT

SEQ ID NO: 2616471 - protein, 12 aa, Entamoeba histolytica
EKEEREQHNTYE

SEQ ID NO: 2616472 - protein, 4 aa, Entamoeba histolytica
EKEG

SEQ ID NO: 2616473 - protein, 8 aa, Entamoeba histolytica
EKEGGIEA

SEQ ID NO: 2616474 - protein, 6 aa, Entamoeba histolytica
EKEGLE

SEQ ID NO: 2616475 - protein, 5 aa, Entamoeba histolytica
EKEGM

SEQ ID NO: 2616476 - protein, 5 aa, Entamoeba histolytica
EKEGR

SEQ ID NO: 2616477 - protein, 15 aa, Entamoeba histolytica
EKEGRKLPWRETTDK

SEQ ID NO: 2616478 - protein, 5 aa, Entamoeba histolytica
EKEGY

SEQ ID NO: 2616479 - protein, 9 aa, Entamoeba histolytica
EKEHENKMK

SEQ ID NO: 2616480 - protein, 5 aa, Entamoeba histolytica
EKEHI

SEQ ID NO: 2616481 - protein, 19 aa, Entamoeba histolytica
EKEHKEGKRGKEGSPEELA

SEQ ID NO: 2616482 - protein, 14 aa, Entamoeba histolytica
EKEIANPDDPESYA

SEQ ID NO: 2616483 - protein, 13 aa, Entamoeba histolytica
EKEIKGDDRTTTR

SEQ ID NO: 2616484 - protein, 13 aa, Entamoeba histolytica
EKEIKKKHSSTIS

SEQ ID NO: 2616485 - protein, 5 aa, Entamoeba histolytica
EKEIL

SEQ ID NO: 2616486 - protein, 12 aa, Entamoeba histolytica
EKEINQNEDRYD

SEQ ID NO: 2616487 - protein, 5 aa, Entamoeba histolytica
EKEIP

SEQ ID NO: 2616488 - protein, 39 aa, Entamoeba histolytica
EKEIQPTDSLTLSSEDKKESKVNNLSERPSEKGRLTYEQ

SEQ ID NO: 2616489 - protein, 14 aa, Entamoeba histolytica
EKEISSTKTGTPLL

SEQ ID NO: 2616490 - protein, 4 aa, Entamoeba histolytica
EKEK

SEQ ID NO: 2616491 - protein, 11 aa, Entamoeba histolytica
EKEKAKKDREL

SEQ ID NO: 2616492 - protein, 7 aa, Entamoeba histolytica
EKEKDRP

SEQ ID NO: 2616493 - protein, 65 aa, Entamoeba histolytica
EKEKELADLTNRKEEAINERKRMEGGQGEAVKKELQNKIEEEKGKLDKISKEIKRAEEQTRKREI

SEQ ID NO: 2616494 - protein, 9 aa, Entamoeba histolytica
EKEKENYRM

SEQ ID NO: 2616495 - protein, 5 aa, Entamoeba histolytica
EKEKF

SEQ ID NO: 2616496 - protein, 9 aa, Entamoeba histolytica
EKEKGKIEL

SEQ ID NO: 2616497 - protein, 6 aa, Entamoeba histolytica
EKEKIQ

SEQ ID NO: 2616498 - protein, 5 aa, Entamoeba histolytica
EKEKK

SEQ ID NO: 2616499 - protein, 7 aa, Entamoeba histolytica
EKEKKDI

SEQ ID NO: 2616500 - protein, 8 aa, Entamoeba histolytica
EKEKKEIQ

SEQ ID NO: 2616501 - protein, 6 aa, Entamoeba histolytica
EKEKKN

SEQ ID NO: 2616502 - protein, 14 aa, Entamoeba histolytica
EKEKNWKRTENEIK

SEQ ID NO: 2616503 - protein, 7 aa, Entamoeba histolytica
EKEKQDA

SEQ ID NO: 2616504 - protein, 22 aa, Entamoeba histolytica
EKEKQEEKQEEKQEEKQEEIND

SEQ ID NO: 2616505 - protein, 11 aa, Entamoeba histolytica
EKEKQRKKREI

SEQ ID NO: 2616506 - protein, 7 aa, Entamoeba histolytica
EKEKQRY

SEQ ID NO: 2616507 - protein, 18 aa, Entamoeba histolytica
EKEKSQKRIQRSKEAEVN

SEQ ID NO: 2616508 - protein, 16 aa, Entamoeba histolytica
EKEKTAEEKAKEEQEN

SEQ ID NO: 2616509 - protein, 9 aa, Entamoeba histolytica
EKELEEVPS

SEQ ID NO: 2616510 - protein, 13 aa, Entamoeba histolytica
EKELERKEERQVE

SEQ ID NO: 2616511 - protein, 7 aa, Entamoeba histolytica
EKELETK

SEQ ID NO: 2616512 - protein, 24 aa, Entamoeba histolytica
EKELKEELGNVNNEIDAVKEEKRE

SEQ ID NO: 2616513 - protein, 20 aa, Entamoeba histolytica
EKELQEQTKEVKEQNQQQNI

SEQ ID NO: 2616514 - protein, 11 aa, Entamoeba histolytica
EKELQKKDQEI

SEQ ID NO: 2616515 - protein, 14 aa, Entamoeba histolytica
EKELRPVQRHPRYK

SEQ ID NO: 2616516 - protein, 4 aa, Entamoeba histolytica
EKEM

SEQ ID NO: 2616517 - protein, 24 aa, Entamoeba histolytica
EKEMKDMGNLSQSLQQVEKTGNNI

SEQ ID NO: 2616518 - protein, 9 aa, Entamoeba histolytica
EKEMKNKEI

SEQ ID NO: 2616519 - protein, 25 aa, Entamoeba histolytica
EKEMNGMSEINNDEQMKQDSQPSNI

SEQ ID NO: 2616520 - protein, 29 aa, Entamoeba histolytica
EKENEEKKVKTEDDIKTEDDIKVEEEDDE

SEQ ID NO: 2616521 - protein, 6 aa, Entamoeba histolytica
EKENEP

SEQ ID NO: 2616522 - protein, 8 aa, Entamoeba histolytica
EKENGNEC

SEQ ID NO: 2616523 - protein, 10 aa, Entamoeba histolytica
EKENGSSFYG

SEQ ID NO: 2616524 - protein, 18 aa, Entamoeba histolytica
EKENKIQQQQQEEQQREL

SEQ ID NO: 2616525 - protein, 17 aa, Entamoeba histolytica
EKENKLNELKEERIEEK

SEQ ID NO: 2616526 - protein, 10 aa, Entamoeba histolytica
EKENKPIDYR

SEQ ID NO: 2616527 - protein, 10 aa, Entamoeba histolytica
EKENNDSALN

SEQ ID NO: 2616528 - protein, 11 aa, Entamoeba histolytica
EKENNQMKSNI

SEQ ID NO: 2616529 - protein, 13 aa, Entamoeba histolytica
EKENPIDSYSPEF

SEQ ID NO: 2616530 - protein, 5 aa, Entamoeba histolytica
EKEPL

SEQ ID NO: 2616531 - protein, 8 aa, Entamoeba histolytica
EKEPPTRI

SEQ ID NO: 2616532 - protein, 8 aa, Entamoeba histolytica
EKEPQIES

SEQ ID NO: 2616533 - protein, 9 aa, Entamoeba histolytica
EKEPQYQTQ

SEQ ID NO: 2616534 - protein, 10 aa, Entamoeba histolytica
EKEQCSTLGD

SEQ ID NO: 2616535 - protein, 14 aa, Entamoeba histolytica
EKEQEDDEDDADDQ

SEQ ID NO: 2616536 - protein, 7 aa, Entamoeba histolytica
EKEQEIQ

SEQ ID NO: 2616537 - protein, 10 aa, Entamoeba histolytica
EKEQEQTQQA

SEQ ID NO: 2616538 - protein, 8 aa, Entamoeba histolytica
EKEQKEFT

SEQ ID NO: 2616539 - protein, 10 aa, Entamoeba histolytica
EKEQKIKELE

SEQ ID NO: 2616540 - protein, 9 aa, Entamoeba histolytica
EKEQNGSSV

SEQ ID NO: 2616541 - protein, 14 aa, Entamoeba histolytica
EKEQNHDKYSFDKK

SEQ ID NO: 2616542 - protein, 13 aa, Entamoeba histolytica
EKEQQKQKVREEE

SEQ ID NO: 2616543 - protein, 11 aa, Entamoeba histolytica
EKEQRTTLGSD

SEQ ID NO: 2616544 - protein, 11 aa, Entamoeba histolytica
EKEQTENIAKQ

SEQ ID NO: 2616545 - protein, 4 aa, Entamoeba histolytica
EKER

SEQ ID NO: 2616546 - protein, 7 aa, Entamoeba histolytica
EKERDRV

SEQ ID NO: 2616547 - protein, 5 aa, Entamoeba histolytica
EKERG

SEQ ID NO: 2616548 - protein, 6 aa, Entamoeba histolytica
EKERKE

SEQ ID NO: 2616549 - protein, 6 aa, Entamoeba histolytica
EKERKV

SEQ ID NO: 2616550 - protein, 6 aa, Entamoeba histolytica
EKERRL

SEQ ID NO: 2616551 - protein, 9 aa, Entamoeba histolytica
EKERRRECV

SEQ ID NO: 2616552 - protein, 9 aa, Entamoeba histolytica
EKERRYAPY

SEQ ID NO: 2616553 - protein, 8 aa, Entamoeba histolytica
EKERSALS

SEQ ID NO: 2616554 - protein, 8 aa, Entamoeba histolytica
EKERTKYY

SEQ ID NO: 2616555 - protein, 9 aa, Entamoeba histolytica
EKESEEDLI

SEQ ID NO: 2616556 - protein, 8 aa, Entamoeba histolytica
EKESGVSD

SEQ ID NO: 2616557 - protein, 8 aa, Entamoeba histolytica
EKESIKEE

SEQ ID NO: 2616558 - protein, 7 aa, Entamoeba histolytica
EKESKEQ

SEQ ID NO: 2616559 - protein, 5 aa, Entamoeba histolytica
EKESL

SEQ ID NO: 2616560 - protein, 5 aa, Entamoeba histolytica
EKESM

SEQ ID NO: 2616561 - protein, 12 aa, Entamoeba histolytica
EKESNSTPQKIN

SEQ ID NO: 2616562 - protein, 12 aa, Entamoeba histolytica
EKESTKPKFNSI

SEQ ID NO: 2616563 - protein, 6 aa, Entamoeba histolytica
EKESTQ

SEQ ID NO: 2616564 - protein, 8 aa, Entamoeba histolytica
EKETHPTD

SEQ ID NO: 2616565 - protein, 6 aa, Entamoeba histolytica
EKETIT

SEQ ID NO: 2616566 - protein, 9 aa, Entamoeba histolytica
EKETKEEIK

SEQ ID NO: 2616567 - protein, 6 aa, Entamoeba histolytica
EKETKW

SEQ ID NO: 2616568 - protein, 7 aa, Entamoeba histolytica
EKETQEE

SEQ ID NO: 2616569 - protein, 23 aa, Entamoeba histolytica
EKEVNELTEEQKTLEEKKRGITQ

SEQ ID NO: 2616570 - protein, 19 aa, Entamoeba histolytica
EKEVSQKSSNEKKGIKEEE

SEQ ID NO: 2616571 - protein, 25 aa, Entamoeba histolytica
EKEWKEQVEENQKEKEESEENKNQM

SEQ ID NO: 2616572 - protein, 6 aa, Entamoeba histolytica
EKEYET

SEQ ID NO: 2616573 - protein, 7 aa, Entamoeba histolytica
EKEYGIG

SEQ ID NO: 2616574 - protein, 5 aa, Entamoeba histolytica
EKFEG

SEQ ID NO: 2616575 - protein, 5 aa, Entamoeba histolytica
EKFGG

SEQ ID NO: 2616576 - protein, 7 aa, Entamoeba histolytica
EKFGGNR

SEQ ID NO: 2616577 - protein, 7 aa, Entamoeba histolytica
EKFGKPI

SEQ ID NO: 2616578 - protein, 19 aa, Entamoeba histolytica
EKFKAEDDKMKQRVEAKNK

SEQ ID NO: 2616579 - protein, 4 aa, Entamoeba histolytica
EKFN

SEQ ID NO: 2616580 - protein, 8 aa, Entamoeba histolytica
EKFNPKDF

SEQ ID NO: 2616581 - protein, 8 aa, Entamoeba histolytica
EKFNTNNV

SEQ ID NO: 2616582 - protein, 5 aa, Entamoeba histolytica
EKFPE

SEQ ID NO: 2616583 - protein, 13 aa, Entamoeba histolytica
EKFQKRKKTIISQ

SEQ ID NO: 2616584 - protein, 10 aa, Entamoeba histolytica
EKFSKEVTTT

SEQ ID NO: 2616585 - protein, 5 aa, Entamoeba histolytica
EKGDR

SEQ ID NO: 2616586 - protein, 5 aa, Entamoeba histolytica
EKGDT

SEQ ID NO: 2616587 - protein, 15 aa, Entamoeba histolytica
EKGDWNPCKSKDNAK

SEQ ID NO: 2616588 - protein, 12 aa, Entamoeba histolytica
EKGEEARAKGSA

SEQ ID NO: 2616589 - protein, 5 aa, Entamoeba histolytica
EKGEK

SEQ ID NO: 2616590 - protein, 9 aa, Entamoeba histolytica
EKGEKEETI

SEQ ID NO: 2616591 - protein, 9 aa, Entamoeba histolytica
EKGEKNEIV

SEQ ID NO: 2616592 - protein, 21 aa, Entamoeba histolytica
EKGEVAKKKDLKEAFGKTNED

SEQ ID NO: 2616593 - protein, 7 aa, Entamoeba histolytica
EKGFDYE

SEQ ID NO: 2616594 - protein, 7 aa, Entamoeba histolytica
EKGFNDD

SEQ ID NO: 2616595 - protein, 11 aa, Entamoeba histolytica
EKGGETQNERG

SEQ ID NO: 2616596 - protein, 8 aa, Entamoeba histolytica
EKGGFTSE

SEQ ID NO: 2616597 - protein, 7 aa, Entamoeba histolytica
EKGGRTI

SEQ ID NO: 2616598 - protein, 5 aa, Entamoeba histolytica
EKGIE

SEQ ID NO: 2616599 - protein, 6 aa, Entamoeba histolytica
EKGIEE

SEQ ID NO: 2616600 - protein, 8 aa, Entamoeba histolytica
EKGINRPK

SEQ ID NO: 2616601 - protein, 5 aa, Entamoeba histolytica
EKGIR

SEQ ID NO: 2616602 - protein, 5 aa, Entamoeba histolytica
EKGIS

SEQ ID NO: 2616603 - protein, 8 aa, Entamoeba histolytica
EKGISRGT

SEQ ID NO: 2616604 - protein, 14 aa, Entamoeba histolytica
EKGIYPKKDEEPFG

SEQ ID NO: 2616605 - protein, 7 aa, Entamoeba histolytica
EKGKIDD

SEQ ID NO: 2616606 - protein, 11 aa, Entamoeba histolytica
EKGKLKKGRWS

SEQ ID NO: 2616607 - protein, 11 aa, Entamoeba histolytica
EKGKNSNKYQL

SEQ ID NO: 2616608 - protein, 7 aa, Entamoeba histolytica
EKGLNEN

SEQ ID NO: 2616609 - protein, 5 aa, Entamoeba histolytica
EKGLR

SEQ ID NO: 2616610 - protein, 17 aa, Entamoeba histolytica
EKGMEEIKENEIPKIDE

SEQ ID NO: 2616611 - protein, 11 aa, Entamoeba histolytica
EKGNEFGQNRD

SEQ ID NO: 2616612 - protein, 7 aa, Entamoeba histolytica
EKGNEGE

SEQ ID NO: 2616613 - protein, 7 aa, Entamoeba histolytica
EKGNETV

SEQ ID NO: 2616614 - protein, 7 aa, Entamoeba histolytica
EKGNNKL

SEQ ID NO: 2616615 - protein, 51 aa, Entamoeba histolytica
EKGNYDEGFGYTKRSSNWEKKEEEHHIEPKKEEYHIEPKKEEATFSPETKT

SEQ ID NO: 2616616 - protein, 8 aa, Entamoeba histolytica
EKGPQLNG

SEQ ID NO: 2616617 - protein, 6 aa, Entamoeba histolytica
EKGQNI

SEQ ID NO: 2616618 - protein, 9 aa, Entamoeba histolytica
EKGQSQNSS

SEQ ID NO: 2616619 - protein, 11 aa, Entamoeba histolytica
EKGQTEIDQQQ

SEQ ID NO: 2616620 - protein, 6 aa, Entamoeba histolytica
EKGRTD

SEQ ID NO: 2616621 - protein, 10 aa, Entamoeba histolytica
EKGRTVNGSM

SEQ ID NO: 2616622 - protein, 16 aa, Entamoeba histolytica
EKGSFSQPNVGSTTSR

SEQ ID NO: 2616623 - protein, 8 aa, Entamoeba histolytica
EKGSGSQI

SEQ ID NO: 2616624 - protein, 17 aa, Entamoeba histolytica
EKGSKDNVSVIVSLLKW

SEQ ID NO: 2616625 - protein, 7 aa, Entamoeba histolytica
EKGSTIK

SEQ ID NO: 2616626 - protein, 8 aa, Entamoeba histolytica
EKGTKNYD

SEQ ID NO: 2616627 - protein, 10 aa, Entamoeba histolytica
EKGTSQRKNI

SEQ ID NO: 2616628 - protein, 8 aa, Entamoeba histolytica
EKGTYQGK

SEQ ID NO: 2616629 - protein, 33 aa, Entamoeba histolytica
EKGVAENKPSNNTQEEHDDDSDGMSEDLEEDDD

SEQ ID NO: 2616630 - protein, 6 aa, Entamoeba histolytica
EKGVID

SEQ ID NO: 2616631 - protein, 7 aa, Entamoeba histolytica
EKGVSPS

SEQ ID NO: 2616632 - protein, 8 aa, Entamoeba histolytica
EKGYGKRV

SEQ ID NO: 2616633 - protein, 5 aa, Entamoeba histolytica
EKGYN

SEQ ID NO: 2616634 - protein, 7 aa, Entamoeba histolytica
EKGYTVK

SEQ ID NO: 2616635 - protein, 4 aa, Entamoeba histolytica
EKHE

SEQ ID NO: 2616636 - protein, 16 aa, Entamoeba histolytica
EKHEHPVSCGTKGGYC

SEQ ID NO: 2616637 - protein, 15 aa, Entamoeba histolytica
EKHKAQPKKHEREIK

SEQ ID NO: 2616638 - protein, 8 aa, Entamoeba histolytica
EKHQATER

SEQ ID NO: 2616639 - protein, 5 aa, Entamoeba histolytica
EKHQK

SEQ ID NO: 2616640 - protein, 16 aa, Entamoeba histolytica
EKHSEREGLRQNRRQT

SEQ ID NO: 2616641 - protein, 4 aa, Entamoeba histolytica
EKHT

SEQ ID NO: 2616642 - protein, 6 aa, Entamoeba histolytica
EKHTSY

SEQ ID NO: 2616643 - protein, 6 aa, Entamoeba histolytica
EKIDDG

SEQ ID NO: 2616644 - protein, 12 aa, Entamoeba histolytica
EKIDDKSKIDEY

SEQ ID NO: 2616645 - protein, 11 aa, Entamoeba histolytica
EKIDDSCNKLT

SEQ ID NO: 2616646 - protein, 8 aa, Entamoeba histolytica
EKIDSGKC

SEQ ID NO: 2616647 - protein, 4 aa, Entamoeba histolytica
EKIE

SEQ ID NO: 2616648 - protein, 11 aa, Entamoeba histolytica
EKIEDQSPEDI

SEQ ID NO: 2616649 - protein, 14 aa, Entamoeba histolytica
EKIEEEKKRIEEEI

SEQ ID NO: 2616650 - protein, 18 aa, Entamoeba histolytica
EKIEKSKSKVDLKTTNDI

SEQ ID NO: 2616651 - protein, 14 aa, Entamoeba histolytica
EKIEPKKDVKVASE

SEQ ID NO: 2616652 - protein, 6 aa, Entamoeba histolytica
EKIERI

SEQ ID NO: 2616653 - protein, 31 aa, Entamoeba histolytica
EKIESDNNSNKQDEEQTTQSTPSTPKQSGVS

SEQ ID NO: 2616654 - protein, 12 aa, Entamoeba histolytica
EKIETSKSVESI

SEQ ID NO: 2616655 - protein, 21 aa, Entamoeba histolytica
EKIGEEEKRNKNEFKERKQKL

SEQ ID NO: 2616656 - protein, 9 aa, Entamoeba histolytica
EKIGEKNAH

SEQ ID NO: 2616657 - protein, 9 aa, Entamoeba histolytica
EKIGENDKC

SEQ ID NO: 2616658 - protein, 7 aa, Entamoeba histolytica
EKIGKTS

SEQ ID NO: 2616659 - protein, 4 aa, Entamoeba histolytica
EKII

SEQ ID NO: 2616660 - protein, 15 aa, Entamoeba histolytica
EKIKAGDIGGTSTLS

SEQ ID NO: 2616661 - protein, 13 aa, Entamoeba histolytica
EKIKEKNLNDVSS

SEQ ID NO: 2616662 - protein, 17 aa, Entamoeba histolytica
EKIKKLDEERDLAKTVE

SEQ ID NO: 2616663 - protein, 6 aa, Entamoeba histolytica
EKIKNT

SEQ ID NO: 2616664 - protein, 24 aa, Entamoeba histolytica
EKIKQQEERAESKQHQEHKKQQHK

SEQ ID NO: 2616665 - protein, 10 aa, Entamoeba histolytica
EKIKQSNKKI

SEQ ID NO: 2616666 - protein, 4 aa, Entamoeba histolytica
EKIL

SEQ ID NO: 2616667 - protein, 4 aa, Entamoeba histolytica
EKIN

SEQ ID NO: 2616668 - protein, 22 aa, Entamoeba histolytica
EKINEEEKKEENDSTQQTTNNV

SEQ ID NO: 2616669 - protein, 12 aa, Entamoeba histolytica
EKIPEEKKEPIH

SEQ ID NO: 2616670 - protein, 7 aa, Entamoeba histolytica
EKIPHDK

SEQ ID NO: 2616671 - protein, 45 aa, Entamoeba histolytica; identical to SEQ ID NO: 2421122

SEQ ID NO: 2616672 - protein, 49 aa, Entamoeba histolytica
EKIPPIEPENNKEENNKEENGDKNMKEDGDTENKKEKKDEKEEKKKERK

SEQ ID NO: 2616673 - protein, 11 aa, Entamoeba histolytica
EKIQENGGIEK

SEQ ID NO: 2616674 - protein, 5 aa, Entamoeba histolytica
EKISD

SEQ ID NO: 2616675 - protein, 7 aa, Entamoeba histolytica
EKISGSD

SEQ ID NO: 2616676 - protein, 5 aa, Entamoeba histolytica
EKISN

SEQ ID NO: 2616677 - protein, 8 aa, Entamoeba histolytica
EKISSSLS

SEQ ID NO: 2616678 - protein, 7 aa, Entamoeba histolytica
EKISTRG

SEQ ID NO: 2616679 - protein, 18 aa, Entamoeba histolytica
EKITDDNNKLNEEIDSLD

SEQ ID NO: 2616680 - protein, 12 aa, Entamoeba histolytica
EKITPNTPNHQY

SEQ ID NO: 2616681 - protein, 16 aa, Entamoeba histolytica
EKITTVKGIEDEKDGS

SEQ ID NO: 2616682 - protein, 9 aa, Entamoeba histolytica
EKKAEVGKV

SEQ ID NO: 2616683 - protein, 9 aa, Entamoeba histolytica
EKKAEYDEA

SEQ ID NO: 2616684 - protein, 9 aa, Entamoeba histolytica
EKKAPEYQP

SEQ ID NO: 2616685 - protein, 19 aa, Entamoeba histolytica
EKKCPQTVKQEKNTTTASV

SEQ ID NO: 2616686 - protein, 18 aa, Entamoeba histolytica
EKKDEENQKDQNNQITSH

SEQ ID NO: 2616687 - protein, 25 aa, Entamoeba histolytica
EKKDETTILDQQKNDTTMAEDKEET

SEQ ID NO: 2616688 - protein, 6 aa, Entamoeba histolytica
EKKDGA

SEQ ID NO: 2616689 - protein, 10 aa, Entamoeba histolytica
EKKDKGDGDD

SEQ ID NO: 2616690 - protein, 21 aa, Entamoeba histolytica
EKKDKKDSASQQDSFNSHDSE

SEQ ID NO: 2616691 - protein, 8 aa, Entamoeba histolytica
EKKDKMAK

SEQ ID NO: 2616692 - protein, 6 aa, Entamoeba histolytica
EKKDRI

SEQ ID NO: 2616693 - protein, 7 aa, Entamoeba histolytica
EKKDSHN

SEQ ID NO: 2616694 - protein, 9 aa, Entamoeba histolytica
EKKDSKLKE

SEQ ID NO: 2616695 - protein, 7 aa, Entamoeba histolytica
EKKDSSC

SEQ ID NO: 2616696 - protein, 15 aa, Entamoeba histolytica
EKKDTNKQKKEDDLD

SEQ ID NO: 2616697 - protein, 8 aa, Entamoeba histolytica
EKKDVAEE

SEQ ID NO: 2616698 - protein, 12 aa, Entamoeba histolytica
EKKEEAEKAERE

SEQ ID NO: 2616699 - protein, 21 aa, Entamoeba histolytica
EKKEEKKPKVITNNSNQTTPS

SEQ ID NO: 2616700 - protein, 8 aa, Entamoeba histolytica
EKKEGLVQ

SEQ ID NO: 2616701 - protein, 43 aa, Entamoeba histolytica
EKKEGTNAKQSMEEEVKATEEIKENDDISEEKEEEKQSEIDPS

SEQ ID NO: 2616702 - protein, 5 aa, Entamoeba histolytica
EKKEI

SEQ ID NO: 2616703 - protein, 16 aa, Entamoeba histolytica
EKKEKEEKQKKENWKS

SEQ ID NO: 2616704 - protein, 13 aa, Entamoeba histolytica
EKKEKNKENPIGT

SEQ ID NO: 2616705 - protein, 8 aa, Entamoeba histolytica
EKKEKNNI

SEQ ID NO: 2616706 - protein, 19 aa, Entamoeba histolytica
EKKEKRKETKEEEKKIQEI

SEQ ID NO: 2616707 - protein, 40 aa, Entamoeba histolytica
EKKEQEKEGGRNKKREVEEERTREEIKEELERRKEVERGI

SEQ ID NO: 2616708 - protein, 16 aa, Entamoeba histolytica
EKKEQMRKEDERKNGI

SEQ ID NO: 2616709 - protein, 8 aa, Entamoeba histolytica
EKKERGCS

SEQ ID NO: 2616710 - protein, 9 aa, Entamoeba histolytica
EKKESDVVS

SEQ ID NO: 2616711 - protein, 8 aa, Entamoeba histolytica
EKKESFGK

SEQ ID NO: 2616712 - protein, 54 aa, Entamoeba histolytica
EKKESSDDNMSEEEDDNGVQEEMNNKEEDMNKEEDSPNDGDADECSSDEEIDDN

SEQ ID NO: 2616713 - protein, 5 aa, Entamoeba histolytica
EKKEV

SEQ ID NO: 2616714 - protein, 7 aa, Entamoeba histolytica
EKKEYKN

SEQ ID NO: 2616715 - protein, 14 aa, Entamoeba histolytica
EKKFNPCTEKEKDV

SEQ ID NO: 2616716 - protein, 117 aa, Entamoeba histolytica
EKKGIDDATLAKNQEIKEITNRAKAVDAETDLERRKRERRERREREEREAAAKEKAGSSTSRVERVSSSADTAEEAREKRRLERQRQREEEKRRLAEEERKAQEEREARRKKREEEL

SEQ ID NO: 2616717 - protein, 12 aa, Entamoeba histolytica
EKKGKKNGNELF

SEQ ID NO: 2616718 - protein, 5 aa, Entamoeba histolytica
EKKGQ

SEQ ID NO: 2616719 - protein, 8 aa, Entamoeba histolytica
EKKGQIIK

SEQ ID NO: 2616720 - protein, 27 aa, Entamoeba histolytica
EKKGSKETTQNKEVSGSLLPESSEDEM

SEQ ID NO: 2616721 - protein, 9 aa, Entamoeba histolytica
EKKIQDGMQ

SEQ ID NO: 2616722 - protein, 21 aa, Entamoeba histolytica
EKKIQEIKDDKEKVEKSESNI

SEQ ID NO: 2616723 - protein, 15 aa, Entamoeba histolytica
EKKITKKIEDIKKEE

SEQ ID NO: 2616724 - protein, 8 aa, Entamoeba histolytica
EKKIYEST

SEQ ID NO: 2616725 - protein, 11 aa, Entamoeba histolytica
EKKKDDNKDGP

SEQ ID NO: 2616726 - protein, 9 aa, Entamoeba histolytica
EKKKELELK

SEQ ID NO: 2616727 - protein, 9 aa, Entamoeba histolytica
EKKKENVPT

SEQ ID NO: 2616728 - protein, 9 aa, Entamoeba histolytica
EKKKERTRD

SEQ ID NO: 2616729 - protein, 7 aa, Entamoeba histolytica
EKKKGFE

SEQ ID NO: 2616730 - protein, 7 aa, Entamoeba histolytica
EKKKIEN

SEQ ID NO: 2616731 - protein, 11 aa, Entamoeba histolytica
EKKKKKATKAL

SEQ ID NO: 2616732 - protein, 10 aa, Entamoeba histolytica
EKKKKKENVF

SEQ ID NO: 2616733 - protein, 6 aa, Entamoeba histolytica
EKKKND

SEQ ID NO: 2616734 - protein, 16 aa, Entamoeba histolytica
EKKKNDIKNGVSEKTA

SEQ ID NO: 2616735 - protein, 6 aa, Entamoeba histolytica
EKKKQV

SEQ ID NO: 2616736 - protein, 9 aa, Entamoeba histolytica
EKKKTTPKM

SEQ ID NO: 2616737 - protein, 12 aa, Entamoeba histolytica
EKKLDDYNGTGI

SEQ ID NO: 2616738 - protein, 8 aa, Entamoeba histolytica
EKKLEKQM

SEQ ID NO: 2616739 - protein, 8 aa, Entamoeba histolytica
EKKMEEEP

SEQ ID NO: 2616740 - protein, 7 aa, Entamoeba histolytica
EKKMKES

SEQ ID NO: 2616741 - protein, 6 aa, Entamoeba histolytica
EKKMTV

SEQ ID NO: 2616742 - protein, 6 aa, Entamoeba histolytica
EKKNAT

SEQ ID NO: 2616743 - protein, 18 aa, Entamoeba histolytica
EKKNEEESSEEEEKMIEE

SEQ ID NO: 2616744 - protein, 14 aa, Entamoeba histolytica
EKKNRCSEIPTDNI

SEQ ID NO: 2616745 - protein, 10 aa, Entamoeba histolytica
EKKNRSQSVA

SEQ ID NO: 2616746 - protein, 5 aa, Entamoeba histolytica
EKKNV

SEQ ID NO: 2616747 - protein, 11 aa, Entamoeba histolytica
EKKPAQTDGEP

SEQ ID NO: 2616748 - protein, 10 aa, Entamoeba histolytica
EKKPKKLNTK

SEQ ID NO: 2616749 - protein, 11 aa, Entamoeba histolytica
EKKPLDNKGKV

SEQ ID NO: 2616750 - protein, 6 aa, Entamoeba histolytica
EKKPMK

SEQ ID NO: 2616751 - protein, 11 aa, Entamoeba histolytica
EKKPNKRHNEE

SEQ ID NO: 2616752 - protein, 10 aa, Entamoeba histolytica
EKKPQIPSSV

SEQ ID NO: 2616753 - protein, 8 aa, Entamoeba histolytica
EKKPRISS

SEQ ID NO: 2616754 - protein, 5 aa, Entamoeba histolytica
EKKPV

SEQ ID NO: 2616755 - protein, 7 aa, Entamoeba histolytica
EKKPYDQ

SEQ ID NO: 2616756 - protein, 4 aa, Entamoeba histolytica
EKKQ

SEQ ID NO: 2616757 - protein, 14 aa, Entamoeba histolytica
EKKQLDSKVGKGKD

SEQ ID NO: 2616758 - protein, 40 aa, Entamoeba histolytica
EKKQNIQDDIQRSKQKISKLASQAAINEEEIERKNKEINL

SEQ ID NO: 2616759 - protein, 5 aa, Entamoeba histolytica
EKKQP

SEQ ID NO: 2616760 - protein, 8 aa, Entamoeba histolytica
EKKQQQIN

SEQ ID NO: 2616761 - protein, 10 aa, Entamoeba histolytica
EKKQTRRKKA

SEQ ID NO: 2616762 - protein, 16 aa, Entamoeba histolytica
EKKREEKETPEEKEYK

SEQ ID NO: 2616763 - protein, 7 aa, Entamoeba histolytica
EKKREKY

SEQ ID NO: 2616764 - protein, 11 aa, Entamoeba histolytica
EKKRENKSYEA

SEQ ID NO: 2616765 - protein, 6 aa, Entamoeba histolytica
EKKRIK

SEQ ID NO: 2616766 - protein, 11 aa, Entamoeba histolytica
EKKRKEDLEKL

SEQ ID NO: 2616767 - protein, 16 aa, Entamoeba histolytica
EKKRKHQLDTKLNKRS

SEQ ID NO: 2616768 - protein, 21 aa, Entamoeba histolytica
EKKRKKITVKEKNERREGELT

SEQ ID NO: 2616769 - protein, 30 aa, Entamoeba histolytica
EKKRLEEGEEIPIRKKREKKTKKSHSTFGE

SEQ ID NO: 2616770 - protein, 8 aa, Entamoeba histolytica
EKKRNEAM

SEQ ID NO: 2616771 - protein, 21 aa, Entamoeba histolytica
EKKRQMEKALKQGAAAGGVKK

SEQ ID NO: 2616772 - protein, 14 aa, Entamoeba histolytica
EKKSEIKDQDKLDE

SEQ ID NO: 2616773 - protein, 22 aa, Entamoeba histolytica
EKKSFEDNTIKHDEKDDIDQQL

SEQ ID NO: 2616774 - protein, 8 aa, Entamoeba histolytica
EKKSKEVT

SEQ ID NO: 2616775 - protein, 9 aa, Entamoeba histolytica
EKKSKKTEQ

SEQ ID NO: 2616776 - protein, 8 aa, Entamoeba histolytica
EKKSQTLN

SEQ ID NO: 2616777 - protein, 20 aa, Entamoeba histolytica
EKKSSQGAIRKSTSSTKGRL

SEQ ID NO: 2616778 - protein, 7 aa, Entamoeba histolytica
EKKTELT

SEQ ID NO: 2616779 - protein, 6 aa, Entamoeba histolytica
EKKTEV

SEQ ID NO: 2616780 - protein, 14 aa, Entamoeba histolytica
EKKTTRDISGIEEN

SEQ ID NO: 2616781 - protein, 4 aa, Entamoeba histolytica
EKKV

SEQ ID NO: 2616782 - protein, 25 aa, Entamoeba histolytica
EKKVEATKDIDPKEKKSKEIDGTTL

SEQ ID NO: 2616783 - protein, 6 aa, Entamoeba histolytica
EKKVGE

SEQ ID NO: 2616784 - protein, 8 aa, Entamoeba histolytica
EKKVKNEM

SEQ ID NO: 2616785 - protein, 8 aa, Entamoeba histolytica
EKKVTETP

SEQ ID NO: 2616786 - protein, 4 aa, Entamoeba histolytica
EKKY

SEQ ID NO: 2616787 - protein, 7 aa, Entamoeba histolytica
EKKYCGE

SEQ ID NO: 2616788 - protein, 8 aa, Entamoeba histolytica
EKKYEDVE

SEQ ID NO: 2616789 - protein, 14 aa, Entamoeba histolytica
EKKYKTSYETKQTQ

SEQ ID NO: 2616790 - protein, 15 aa, Entamoeba histolytica
EKKYSQSGSLSSPSL

SEQ ID NO: 2616791 - protein, 4 aa, Entamoeba histolytica
EKLD

SEQ ID NO: 2616792 - protein, 23 aa, Entamoeba histolytica
EKLDETEVEKEDAEKKKKEIEKE

SEQ ID NO: 2616793 - protein, 21 aa, Entamoeba histolytica
EKLDTTATVKQQKRNDEAKFA

SEQ ID NO: 2616794 - protein, 4 aa, Entamoeba histolytica
EKLE

SEQ ID NO: 2616795 - protein, 14 aa, Entamoeba histolytica
EKLEKEKKERKIRE

SEQ ID NO: 2616796 - protein, 7 aa, Entamoeba histolytica
EKLGSEN

SEQ ID NO: 2616797 - protein, 10 aa, Entamoeba histolytica
EKLKDSDPTV

SEQ ID NO: 2616798 - protein, 11 aa, Entamoeba histolytica
EKLKEEVDGWQ

SEQ ID NO: 2616799 - protein, 16 aa, Entamoeba histolytica
EKLKEKFDDNETDKIS

SEQ ID NO: 2616800 - protein, 18 aa, Entamoeba histolytica
EKLKGGKTKGSKKSSVAD

SEQ ID NO: 2616801 - protein, 16 aa, Entamoeba histolytica
EKLKKNKKIPKYCFKK

SEQ ID NO: 2616802 - protein, 7 aa, Entamoeba histolytica
EKLKQEI

SEQ ID NO: 2616803 - protein, 21 aa, Entamoeba histolytica
EKLKQSVTKENDKNITIQRTP

SEQ ID NO: 2616804 - protein, 9 aa, Entamoeba histolytica
EKLNEEAEK

SEQ ID NO: 2616805 - protein, 14 aa, Entamoeba histolytica
EKLNSSKDDVRTEA

SEQ ID NO: 2616806 - protein, 11 aa, Entamoeba histolytica
EKLNTKKKEGV

SEQ ID NO: 2616807 - protein, 5 aa, Entamoeba histolytica
EKLPL

SEQ ID NO: 2616808 - protein, 6 aa, Entamoeba histolytica
EKLPSQ

SEQ ID NO: 2616809 - protein, 7 aa, Entamoeba histolytica
EKLQERV

SEQ ID NO: 2616810 - protein, 13 aa, Entamoeba histolytica
EKLQPTEDKTEEL

SEQ ID NO: 2616811 - protein, 7 aa, Entamoeba histolytica
EKLRSGK

SEQ ID NO: 2616812 - protein, 13 aa, Entamoeba histolytica
EKLSEYKEEIEPL

SEQ ID NO: 2616813 - protein, 10 aa, Entamoeba histolytica
EKLSKEIKKR

SEQ ID NO: 2616814 - protein, 12 aa, Entamoeba histolytica
EKLSPNKIEQNE

SEQ ID NO: 2616815 - protein, 8 aa, Entamoeba histolytica
EKLSPSFK

SEQ ID NO: 2616816 - protein, 8 aa, Entamoeba histolytica
EKLSSNKG

SEQ ID NO: 2616817 - protein, 26 aa, Entamoeba histolytica
EKLSTSLDLSKTSQEIERLIEHFQKF

SEQ ID NO: 2616818 - protein, 9 aa, Entamoeba histolytica
EKLTSSDIE

SEQ ID NO: 2616819 - protein, 5 aa, Entamoeba histolytica
EKLTT

SEQ ID NO: 2616820 - protein, 22 aa, Entamoeba histolytica
EKMEKKQEKKLQKIEKKGEPRT

SEQ ID NO: 2616821 - protein, 5 aa, Entamoeba histolytica
EKMER

SEQ ID NO: 2616822 - protein, 6 aa, Entamoeba histolytica
EKMKEI

SEQ ID NO: 2616823 - protein, 14 aa, Entamoeba histolytica
EKMKPNKYNDSPIE

SEQ ID NO: 2616824 - protein, 11 aa, Entamoeba histolytica
EKMNENELPEE

SEQ ID NO: 2616825 - protein, 12 aa, Entamoeba histolytica
EKMNRNESKYQS

SEQ ID NO: 2616826 - protein, 24 aa, Entamoeba histolytica
EKMPGEEEEEVEEDLKMKEESEEE

SEQ ID NO: 2616827 - protein, 16 aa, Entamoeba histolytica
EKMSESDIEDADKNTT

SEQ ID NO: 2616828 - protein, 9 aa, Entamoeba histolytica
EKMSVGQGA

SEQ ID NO: 2616829 - protein, 4 aa, Entamoeba histolytica
EKNA

SEQ ID NO: 2616830 - protein, 5 aa, Entamoeba histolytica
EKNAL

SEQ ID NO: 2616831 - protein, 5 aa, Entamoeba histolytica
EKNAQ

SEQ ID NO: 2616832 - protein, 12 aa, Entamoeba histolytica
EKNDENPSPEQL

SEQ ID NO: 2616833 - protein, 14 aa, Entamoeba histolytica
EKNDKSIVKYIVQF

SEQ ID NO: 2616834 - protein, 7 aa, Entamoeba histolytica
EKNDNQL

SEQ ID NO: 2616835 - protein, 9 aa, Entamoeba histolytica
EKNDSEVNL

SEQ ID NO: 2616836 - protein, 5 aa, Entamoeba histolytica
EKNEC

SEQ ID NO: 2616837 - protein, 15 aa, Entamoeba histolytica
EKNEDGVYKPTTIAG

SEQ ID NO: 2616838 - protein, 7 aa, Entamoeba histolytica
EKNEDVD

SEQ ID NO: 2616839 - protein, 9 aa, Entamoeba histolytica
EKNEENISR

SEQ ID NO: 2616840 - protein, 7 aa, Entamoeba histolytica
EKNEEPI

SEQ ID NO: 2616841 - protein, 8 aa, Entamoeba histolytica
EKNEHYHK

SEQ ID NO: 2616842 - protein, 6 aa, Entamoeba histolytica
EKNEIN

SEQ ID NO: 2616843 - protein, 9 aa, Entamoeba histolytica
EKNEKEKVG

SEQ ID NO: 2616844 - protein, 8 aa, Entamoeba histolytica
EKNEKNPL

SEQ ID NO: 2616845 - protein, 5 aa, Entamoeba histolytica
EKNEL

SEQ ID NO: 2616846 - protein, 14 aa, Entamoeba histolytica
EKNELEKISANDPT

SEQ ID NO: 2616847 - protein, 6 aa, Entamoeba histolytica
EKNEMN

SEQ ID NO: 2616848 - protein, 7 aa, Entamoeba histolytica
EKNEMNE

SEQ ID NO: 2616849 - protein, 7 aa, Entamoeba histolytica
EKNENGF

SEQ ID NO: 2616850 - protein, 9 aa, Entamoeba histolytica
EKNEPTELS

SEQ ID NO: 2616851 - protein, 9 aa, Entamoeba histolytica
EKNEPWSSF

SEQ ID NO: 2616852 - protein, 15 aa, Entamoeba histolytica
EKNETRVIGNDGNNV

SEQ ID NO: 2616853 - protein, 20 aa, Entamoeba histolytica
EKNEVNNNKNVGENLEEIGN

SEQ ID NO: 2616854 - protein, 7 aa, Entamoeba histolytica
EKNEYKV

SEQ ID NO: 2616855 - protein, 4 aa, Entamoeba histolytica
EKNF

SEQ ID NO: 2616856 - protein, 7 aa, Entamoeba histolytica
EKNGFSR

SEQ ID NO: 2616857 - protein, 9 aa, Entamoeba histolytica
EKNGGPLST

SEQ ID NO: 2616858 - protein, 7 aa, Entamoeba histolytica
EKNGNEI

SEQ ID NO: 2616859 - protein, 9 aa, Entamoeba histolytica
EKNGTDSEL

SEQ ID NO: 2616860 - protein, 10 aa, Entamoeba histolytica
EKNGTSSLKA

SEQ ID NO: 2616861 - protein, 8 aa, Entamoeba histolytica
EKNGYISA

SEQ ID NO: 2616862 - protein, 18 aa, Entamoeba histolytica
EKNHKKKLSDNVIPNTEQ

SEQ ID NO: 2616863 - protein, 4 aa, Entamoeba histolytica
EKNI

SEQ ID NO: 2616864 - protein, 11 aa, Entamoeba histolytica
EKNIERCSEQS

SEQ ID NO: 2616865 - protein, 16 aa, Entamoeba histolytica
EKNIKKEGGFNESINE

SEQ ID NO: 2616866 - protein, 26 aa, Entamoeba histolytica
EKNILKKEGLKQKESSSFKKEEELKT

SEQ ID NO: 2616867 - protein, 7 aa, Entamoeba histolytica
EKNKDVV

SEQ ID NO: 2616868 - protein, 12 aa, Entamoeba histolytica
EKNKENLNNNDK

SEQ ID NO: 2616869 - protein, 17 aa, Entamoeba histolytica
EKNKEQLPPHHRTQTIF

SEQ ID NO: 2616870 - protein, 9 aa, Entamoeba histolytica
EKNKGKGKL

SEQ ID NO: 2616871 - protein, 9 aa, Entamoeba histolytica
EKNKNPETL

SEQ ID NO: 2616872 - protein, 10 aa, Entamoeba histolytica
EKNKPPRPEM

SEQ ID NO: 2616873 - protein, 10 aa, Entamoeba histolytica
EKNKSKTYDE

SEQ ID NO: 2616874 - protein, 10 aa, Entamoeba histolytica
EKNKSSKSEF

SEQ ID NO: 2616875 - protein, 7 aa, Entamoeba histolytica
EKNKYKE

SEQ ID NO: 2616876 - protein, 4 aa, Entamoeba histolytica
EKNL

SEQ ID NO: 2616877 - protein, 7 aa, Entamoeba histolytica
EKNNEHY

SEQ ID NO: 2616878 - protein, 8 aa, Entamoeba histolytica
EKNNENFD

SEQ ID NO: 2616879 - protein, 17 aa, Entamoeba histolytica
EKNNKVLEKGEGGIGST

SEQ ID NO: 2616880 - protein, 8 aa, Entamoeba histolytica
EKNNQPLK

SEQ ID NO: 2616881 - protein, 7 aa, Entamoeba histolytica
EKNNQTS

SEQ ID NO: 2616882 - protein, 5 aa, Entamoeba histolytica
EKNNS

SEQ ID NO: 2616883 - protein, 4 aa, Entamoeba histolytica
EKNP

SEQ ID NO: 2616884 - protein, 6 aa, Entamoeba histolytica
EKNPDY

SEQ ID NO: 2616885 - protein, 7 aa, Entamoeba histolytica
EKNPNVP

SEQ ID NO: 2616886 - protein, 19 aa, Entamoeba histolytica
EKNQMRDDLNEQEKWAGRG

SEQ ID NO: 2616887 - protein, 5 aa, Entamoeba histolytica
EKNQP

SEQ ID NO: 2616888 - protein, 5 aa, Entamoeba histolytica
EKNQS

SEQ ID NO: 2616889 - protein, 4 aa, Entamoeba histolytica
EKNR

SEQ ID NO: 2616890 - protein, 9 aa, Entamoeba histolytica
EKNSGEIEE

SEQ ID NO: 2616891 - protein, 8 aa, Entamoeba histolytica
EKNSPDNI

SEQ ID NO: 2616892 - protein, 38 aa, Entamoeba histolytica
EKNSSNQEQTVPNPITSQKTQPLEPIPNTKQEEKVSSG

SEQ ID NO: 2616893 - protein, 14 aa, Entamoeba histolytica
EKNTALKNNKTVPL

SEQ ID NO: 2616894 - protein, 5 aa, Entamoeba histolytica
EKNTD

SEQ ID NO: 2616895 - protein, 6 aa, Entamoeba histolytica
EKNTKV

SEQ ID NO: 2616896 - protein, 9 aa, Entamoeba histolytica
EKNTTKKIS

SEQ ID NO: 2616897 - protein, 10 aa, Entamoeba histolytica
EKNVKVETTI

SEQ ID NO: 2616898 - protein, 8 aa, Entamoeba histolytica
EKNVNEKA

SEQ ID NO: 2616899 - protein, 4 aa, Entamoeba histolytica
EKPA

SEQ ID NO: 2616900 - protein, 9 aa, Entamoeba histolytica
EKPATKPKI

SEQ ID NO: 2616901 - protein, 7 aa, Entamoeba histolytica
EKPEELG

SEQ ID NO: 2616902 - protein, 7 aa, Entamoeba histolytica
EKPEKVN

SEQ ID NO: 2616903 - protein, 7 aa, Entamoeba histolytica
EKPELQK

SEQ ID NO: 2616904 - protein, 8 aa, Entamoeba histolytica
EKPERAKQ

SEQ ID NO: 2616905 - protein, 12 aa, Entamoeba histolytica
EKPETPLAQPAE

SEQ ID NO: 2616906 - protein, 5 aa, Entamoeba histolytica
EKPFL

SEQ ID NO: 2616907 - protein, 8 aa, Entamoeba histolytica
EKPFPPAR

SEQ ID NO: 2616908 - protein, 8 aa, Entamoeba histolytica
EKPGAEES

SEQ ID NO: 2616909 - protein, 4 aa, Entamoeba histolytica
EKPH

SEQ ID NO: 2616910 - protein, 13 aa, Entamoeba histolytica
EKPIDQPASTPLI

SEQ ID NO: 2616911 - protein, 12 aa, Entamoeba histolytica
EKPIEKATQQDV

SEQ ID NO: 2616912 - protein, 15 aa, Entamoeba histolytica
EKPKEQVQPPKDLEE

SEQ ID NO: 2616913 - protein, 5 aa, Entamoeba histolytica
EKPKI

SEQ ID NO: 2616914 - protein, 13 aa, Entamoeba histolytica
EKPKKEKGCCLIY

SEQ ID NO: 2616915 - protein, 10 aa, Entamoeba histolytica
EKPKNAEDAS

SEQ ID NO: 2616916 - protein, 8 aa, Entamoeba histolytica
EKPKNRKD

SEQ ID NO: 2616917 - protein, 11 aa, Entamoeba histolytica
EKPKSFAKRDE

SEQ ID NO: 2616918 - protein, 7 aa, Entamoeba histolytica
EKPKYVS

SEQ ID NO: 2616919 - protein, 6 aa, Entamoeba histolytica
EKPLDS

SEQ ID NO: 2616920 - protein, 7 aa, Entamoeba histolytica
EKPLPSI

SEQ ID NO: 2616921 - protein, 10 aa, Entamoeba histolytica
EKPNTPRDES

SEQ ID NO: 2616922 - protein, 5 aa, Entamoeba histolytica
EKPNV

SEQ ID NO: 2616923 - protein, 6 aa, Entamoeba histolytica
EKPNVE

SEQ ID NO: 2616924 - protein, 7 aa, Entamoeba histolytica
EKPNVPK

SEQ ID NO: 2616925 - protein, 18 aa, Entamoeba histolytica
EKPPFLNQSQEPKETPIV

SEQ ID NO: 2616926 - protein, 8 aa, Entamoeba histolytica
EKPQDFDQ

SEQ ID NO: 2616927 - protein, 9 aa, Entamoeba histolytica
EKPRRKTKT

SEQ ID NO: 2616928 - protein, 6 aa, Entamoeba histolytica
EKPRRR

SEQ ID NO: 2616929 - protein, 8 aa, Entamoeba histolytica
EKPSAIQQ

SEQ ID NO: 2616930 - protein, 8 aa, Entamoeba histolytica
EKPSGDGE

SEQ ID NO: 2616931 - protein, 17 aa, Entamoeba histolytica
EKPSIIPKTPYKKEETR

SEQ ID NO: 2616932 - protein, 4 aa, Entamoeba histolytica
EKPT

SEQ ID NO: 2616933 - protein, 7 aa, Entamoeba histolytica
EKPTMDI

SEQ ID NO: 2616934 - protein, 17 aa, Entamoeba histolytica
EKPTNERSETQPPQIEE

SEQ ID NO: 2616935 - protein, 10 aa, Entamoeba histolytica
EKPTSKPEII

SEQ ID NO: 2616936 - protein, 29 aa, Entamoeba histolytica
EKPTYEETPSQNLATEENIETEKQPKEEV

SEQ ID NO: 2616937 - protein, 7 aa, Entamoeba histolytica
EKPTYNG

SEQ ID NO: 2616938 - protein, 7 aa, Entamoeba histolytica
EKPVDND

SEQ ID NO: 2616939 - protein, 13 aa, Entamoeba histolytica
EKPVKLEKRQCVI

SEQ ID NO: 2616940 - protein, 10 aa, Entamoeba histolytica
EKPYDGEHKI

SEQ ID NO: 2616941 - protein, 9 aa, Entamoeba histolytica
EKQADSNTN

SEQ ID NO: 2616942 - protein, 5 aa, Entamoeba histolytica
EKQAP

SEQ ID NO: 2616943 - protein, 9 aa, Entamoeba histolytica
EKQDAHTND

SEQ ID NO: 2616944 - protein, 28 aa, Entamoeba histolytica
EKQDEKELFSDNDDMTGAYNTKAGNVTQ

SEQ ID NO: 2616945 - protein, 4 aa, Entamoeba histolytica
EKQE

SEQ ID NO: 2616946 - protein, 7 aa, Entamoeba histolytica
EKQEGPI

SEQ ID NO: 2616947 - protein, 6 aa, Entamoeba histolytica
EKQEIC

SEQ ID NO: 2616948 - protein, 8 aa, Entamoeba histolytica
EKQEIETK

SEQ ID NO: 2616949 - protein, 7 aa, Entamoeba histolytica
EKQEINN

SEQ ID NO: 2616950 - protein, 11 aa, Entamoeba histolytica
EKQEREEAINE

SEQ ID NO: 2616951 - protein, 32 aa, Entamoeba histolytica
EKQEREEAINETKIEHPQNEALNEKEEVQNNE

SEQ ID NO: 2616952 - protein, 5 aa, Entamoeba histolytica
EKQFN

SEQ ID NO: 2616953 - protein, 7 aa, Entamoeba histolytica
EKQGNGF

SEQ ID NO: 2616954 - protein, 15 aa, Entamoeba histolytica
EKQIENEENEFKQNE

SEQ ID NO: 2616955 - protein, 7 aa, Entamoeba histolytica
EKQINKE

SEQ ID NO: 2616956 - protein, 12 aa, Entamoeba histolytica
EKQIRSPTSDIG

SEQ ID NO: 2616957 - protein, 8 aa, Entamoeba histolytica
EKQITSSF

SEQ ID NO: 2616958 - protein, 39 aa, Entamoeba histolytica
EKQKKERKEREEKLKREREERLKKEQEEKDKKIQEMKEK

SEQ ID NO: 2616959 - protein, 11 aa, Entamoeba histolytica
EKQKKNYTTYT

SEQ ID NO: 2616960 - protein, 9 aa, Entamoeba histolytica
EKQKQAAIQ

SEQ ID NO: 2616961 - protein, 47 aa, Entamoeba histolytica
EKQLEKERKKEEKQRKKEEKKAGKAHSRGSSKEQSIERTEEKPKNLI

SEQ ID NO: 2616962 - protein, 8 aa, Entamoeba histolytica
EKQLGKDI

SEQ ID NO: 2616963 - protein, 8 aa, Entamoeba histolytica
EKQNAELG

SEQ ID NO: 2616964 - protein, 12 aa, Entamoeba histolytica
EKQNENTLESSK

SEQ ID NO: 2616965 - protein, 10 aa, Entamoeba histolytica
EKQNKGNDYM

SEQ ID NO: 2616966 - protein, 9 aa, Entamoeba histolytica
EKQNNIERI

SEQ ID NO: 2616967 - protein, 6 aa, Entamoeba histolytica
EKQPKF

SEQ ID NO: 2616968 - protein, 9 aa, Entamoeba histolytica
EKQPSSGKI

SEQ ID NO: 2616969 - protein, 5 aa, Entamoeba histolytica
EKQQV

SEQ ID NO: 2616970 - protein, 8 aa, Entamoeba histolytica
EKQRPKNL

SEQ ID NO: 2616971 - protein, 5 aa, Entamoeba histolytica
EKQRS

SEQ ID NO: 2616972 - protein, 15 aa, Entamoeba histolytica
EKQSKLQYQQIAESM

SEQ ID NO: 2616973 - protein, 20 aa, Entamoeba histolytica
EKQSKQDQEKSRTEEEKNEE

SEQ ID NO: 2616974 - protein, 6 aa, Entamoeba histolytica
EKQSPM

SEQ ID NO: 2616975 - protein, 8 aa, Entamoeba histolytica
EKQSRIEA

SEQ ID NO: 2616976 - protein, 17 aa, Entamoeba histolytica
EKQSSFNQTNRNTQTEI

SEQ ID NO: 2616977 - protein, 7 aa, Entamoeba histolytica
EKQTAQE

SEQ ID NO: 2616978 - protein, 9 aa, Entamoeba histolytica
EKQTGEQEL

SEQ ID NO: 2616979 - protein, 5 aa, Entamoeba histolytica
EKQTM

SEQ ID NO: 2616980 - protein, 7 aa, Entamoeba histolytica
EKQTSDK

SEQ ID NO: 2616981 - protein, 18 aa, Entamoeba histolytica
EKQTTAEAQQWIIKKISL

SEQ ID NO: 2616982 - protein, 9 aa, Entamoeba histolytica
EKQTTLPKG

SEQ ID NO: 2616983 - protein, 16 aa, Entamoeba histolytica
EKQVKQKQKQKEEDKV

SEQ ID NO: 2616984 - protein, 13 aa, Entamoeba histolytica
EKQVSSSSDNAPL

SEQ ID NO: 2616985 - protein, 9 aa, Entamoeba histolytica
EKQYQESEK

SEQ ID NO: 2616986 - protein, 10 aa, Entamoeba histolytica
EKRANDYEKI

SEQ ID NO: 2616987 - protein, 12 aa, Entamoeba histolytica
EKRDEITEKEKR

SEQ ID NO: 2616988 - protein, 13 aa, Entamoeba histolytica
EKRDEVLTKIKKS

SEQ ID NO: 2616989 - protein, 5 aa, Entamoeba histolytica
EKRDG

SEQ ID NO: 2616990 - protein, 7 aa, Entamoeba histolytica
EKRDKGL

SEQ ID NO: 2616991 - protein, 10 aa, Entamoeba histolytica
EKRDKIEKEP

SEQ ID NO: 2616992 - protein, 18 aa, Entamoeba histolytica
EKRDTFDPIEDDSESWSD

SEQ ID NO: 2616993 - protein, 12 aa, Entamoeba histolytica
EKRDWDISSSER

SEQ ID NO: 2616994 - protein, 5 aa, Entamoeba histolytica
EKRED

SEQ ID NO: 2616995 - protein, 20 aa, Entamoeba histolytica
EKREEVKAANPDLKPKEITS

SEQ ID NO: 2616996 - protein, 9 aa, Entamoeba histolytica
EKREQRNAI

SEQ ID NO: 2616997 - protein, 5 aa, Entamoeba histolytica
EKRER

SEQ ID NO: 2616998 - protein, 7 aa, Entamoeba histolytica
EKRFTSE

SEQ ID NO: 2616999 - protein, 8 aa, Entamoeba histolytica
EKRGEAVK

SEQ ID NO: 2617000 - protein, 12 aa, Entamoeba histolytica
EKRGKELKGRNS

SEQ ID NO: 2617001 - protein, 8 aa, Entamoeba histolytica
EKRGNKLS

SEQ ID NO: 2617002 - protein, 6 aa, Entamoeba histolytica
EKRGSI

SEQ ID NO: 2617003 - protein, 12 aa, Entamoeba histolytica
EKRGYSGKYQYE

SEQ ID NO: 2617004 - protein, 10 aa, Entamoeba histolytica
EKRIETASDY

SEQ ID NO: 2617005 - protein, 28 aa, Entamoeba histolytica
EKRIKEEAKKKHGNTEDLSLGQRRERDA

SEQ ID NO: 2617006 - protein, 9 aa, Entamoeba histolytica
EKRISDAQK

SEQ ID NO: 2617007 - protein, 13 aa, Entamoeba histolytica
EKRISQEKEEIEK

SEQ ID NO: 2617008 - protein, 6 aa, Entamoeba histolytica
EKRKEL

SEQ ID NO: 2617009 - protein, 6 aa, Entamoeba histolytica
EKRKEV

SEQ ID NO: 2617010 - protein, 5 aa, Entamoeba histolytica
EKRKF

SEQ ID NO: 2617011 - protein, 5 aa, Entamoeba histolytica
EKRKI

SEQ ID NO: 2617012 - protein, 26 aa, Entamoeba histolytica
EKRKKPTKTYKTAKTLKPISSSEDIQ

SEQ ID NO: 2617013 - protein, 13 aa, Entamoeba histolytica
EKRKTSKKMKQQR

SEQ ID NO: 2617014 - protein, 7 aa, Entamoeba histolytica
EKRMEER

SEQ ID NO: 2617015 - protein, 6 aa, Entamoeba histolytica
EKRMGR

SEQ ID NO: 2617016 - protein, 10 aa, Entamoeba histolytica
EKRNARDEVE

SEQ ID NO: 2617017 - protein, 9 aa, Entamoeba histolytica
EKRNLNKRN

SEQ ID NO: 2617018 - protein, 13 aa, Entamoeba histolytica
EKRNNNKDINNKT

SEQ ID NO: 2617019 - protein, 8 aa, Entamoeba histolytica
EKRNPGLN

SEQ ID NO: 2617020 - protein, 17 aa, Entamoeba histolytica
EKRNSDKRAKSTGDGIR

SEQ ID NO: 2617021 - protein, 11 aa, Entamoeba histolytica
EKRPDKNIRTI

SEQ ID NO: 2617022 - protein, 5 aa, Entamoeba histolytica
EKRPT

SEQ ID NO: 2617023 - protein, 5 aa, Entamoeba histolytica
EKRQI

SEQ ID NO: 2617024 - protein, 7 aa, Entamoeba histolytica
EKRQKGI

SEQ ID NO: 2617025 - protein, 9 aa, Entamoeba histolytica
EKRQTEENP

SEQ ID NO: 2617026 - protein, 5 aa, Entamoeba histolytica
EKRRD

SEQ ID NO: 2617027 - protein, 13 aa, Entamoeba histolytica
EKRREEEQEAETY

SEQ ID NO: 2617028 - protein, 9 aa, Entamoeba histolytica
EKRSIKPSL

SEQ ID NO: 2617029 - protein, 5 aa, Entamoeba histolytica
EKRSV

SEQ ID NO: 2617030 - protein, 9 aa, Entamoeba histolytica
EKRTAFDGE

SEQ ID NO: 2617031 - protein, 7 aa, Entamoeba histolytica
EKRTAKE

SEQ ID NO: 2617032 - protein, 9 aa, Entamoeba histolytica
EKRTAKGLS

SEQ ID NO: 2617033 - protein, 6 aa, Entamoeba histolytica
EKRTRG

SEQ ID NO: 2617034 - protein, 4 aa, Entamoeba histolytica
EKRY

SEQ ID NO: 2617035 - protein, 7 aa, Entamoeba histolytica
EKRYSEA

SEQ ID NO: 2617036 - protein, 5 aa, Entamoeba histolytica
EKRYT

SEQ ID NO: 2617037 - protein, 9 aa, Entamoeba histolytica
EKSAKPITT

SEQ ID NO: 2617038 - protein, 12 aa, Entamoeba histolytica
EKSAQVIDKKNT

SEQ ID NO: 2617039 - protein, 4 aa, Entamoeba histolytica
EKSD

SEQ ID NO: 2617040 - protein, 26 aa, Entamoeba histolytica
EKSDNENVCSNTTAVSDQNKQRLSED

SEQ ID NO: 2617041 - protein, 20 aa, Entamoeba histolytica
EKSEAKKLDEQAQKLKEENK

SEQ ID NO: 2617042 - protein, 10 aa, Entamoeba histolytica
EKSEDIEQTA

SEQ ID NO: 2617043 - protein, 7 aa, Entamoeba histolytica
EKSESNK

SEQ ID NO: 2617044 - protein, 9 aa, Entamoeba histolytica
EKSEVPYKT

SEQ ID NO: 2617045 - protein, 12 aa, Entamoeba histolytica
EKSFNDKSFPKK

SEQ ID NO: 2617046 - protein, 7 aa, Entamoeba histolytica
EKSGAVE

SEQ ID NO: 2617047 - protein, 8 aa, Entamoeba histolytica
EKSIDTDF

SEQ ID NO: 2617048 - protein, 17 aa, Entamoeba histolytica
EKSIDTTSIPTIPNSYP

SEQ ID NO: 2617049 - protein, 5 aa, Entamoeba histolytica
EKSIK

SEQ ID NO: 2617050 - protein, 7 aa, Entamoeba histolytica
EKSIRDK

SEQ ID NO: 2617051 - protein, 5 aa, Entamoeba histolytica
EKSIS

SEQ ID NO: 2617052 - protein, 10 aa, Entamoeba histolytica
EKSKDFDKTI

SEQ ID NO: 2617053 - protein, 8 aa, Entamoeba histolytica
EKSKENYH

SEQ ID NO: 2617054 - protein, 8 aa, Entamoeba histolytica
EKSKEVLR

SEQ ID NO: 2617055 - protein, 9 aa, Entamoeba histolytica
EKSKGLTDI

SEQ ID NO: 2617056 - protein, 9 aa, Entamoeba histolytica
EKSKTEELQ

SEQ ID NO: 2617057 - protein, 27 aa, Entamoeba histolytica
EKSLKESKSVEKQQTQPIESPPTSQPI

SEQ ID NO: 2617058 - protein, 5 aa, Entamoeba histolytica
EKSLL

SEQ ID NO: 2617059 - protein, 4 aa, Entamoeba histolytica
EKSM

SEQ ID NO: 2617060 - protein, 9 aa, Entamoeba histolytica
EKSPQGART

SEQ ID NO: 2617061 - protein, 8 aa, Entamoeba histolytica
EKSPVSSA

SEQ ID NO: 2617062 - protein, 17 aa, Entamoeba histolytica
EKSQSPTPSQIPTQIEE

SEQ ID NO: 2617063 - protein, 6 aa, Entamoeba histolytica
EKSRAK

SEQ ID NO: 2617064 - protein, 7 aa, Entamoeba histolytica
EKSRYGN

SEQ ID NO: 2617065 - protein, 4 aa, Entamoeba histolytica
EKSS

SEQ ID NO: 2617066 - protein, 7 aa, Entamoeba histolytica
EKSSEIN

SEQ ID NO: 2617067 - protein, 6 aa, Entamoeba histolytica
EKSSEP

SEQ ID NO: 2617068 - protein, 12 aa, Entamoeba histolytica
EKSSIYSFKSQL

SEQ ID NO: 2617069 - protein, 11 aa, Entamoeba histolytica
EKSSLANKEYN

SEQ ID NO: 2617070 - protein, 6 aa, Entamoeba histolytica
EKSSLL

SEQ ID NO: 2617071 - protein, 7 aa, Entamoeba histolytica
EKSSTVE

SEQ ID NO: 2617072 - protein, 4 aa, Entamoeba histolytica
EKST

SEQ ID NO: 2617073 - protein, 5 aa, Entamoeba histolytica
EKSTA

SEQ ID NO: 2617074 - protein, 11 aa, Entamoeba histolytica
EKSTGKSNPEI

SEQ ID NO: 2617075 - protein, 6 aa, Entamoeba histolytica
EKSTKP

SEQ ID NO: 2617076 - protein, 7 aa, Entamoeba histolytica
EKSTMRK

SEQ ID NO: 2617077 - protein, 8 aa, Entamoeba histolytica
EKSTYVEE

SEQ ID NO: 2617078 - protein, 17 aa, Entamoeba histolytica
EKSVHEKHEQERRQTRL

SEQ ID NO: 2617079 - protein, 6 aa, Entamoeba histolytica
EKSVTA

SEQ ID NO: 2617080 - protein, 8 aa, Entamoeba histolytica
EKSVTIEK

SEQ ID NO: 2617081 - protein, 4 aa, Entamoeba histolytica
EKSY

SEQ ID NO: 2617082 - protein, 11 aa, Entamoeba histolytica
EKSYNETSGRG

SEQ ID NO: 2617083 - protein, 7 aa, Entamoeba histolytica
EKSYNRD

SEQ ID NO: 2617084 - protein, 7 aa, Entamoeba histolytica
EKSYSSL

SEQ ID NO: 2617085 - protein, 5 aa, Entamoeba histolytica
EKSYV

SEQ ID NO: 2617086 - protein, 11 aa, Entamoeba histolytica
EKTANGDLSTF

SEQ ID NO: 2617087 - protein, 6 aa, Entamoeba histolytica
EKTANK

SEQ ID NO: 2617088 - protein, 8 aa, Entamoeba histolytica
EKTDGESP

SEQ ID NO: 2617089 - protein, 5 aa, Entamoeba histolytica
EKTDI

SEQ ID NO: 2617090 - protein, 7 aa, Entamoeba histolytica
EKTDKRK

SEQ ID NO: 2617091 - protein, 13 aa, Entamoeba histolytica
EKTEEDQKTEEDL

SEQ ID NO: 2617092 - protein, 6 aa, Entamoeba histolytica
EKTEEI

SEQ ID NO: 2617093 - protein, 12 aa, Entamoeba histolytica
EKTEKEYKEKKQ

SEQ ID NO: 2617094 - protein, 12 aa, Entamoeba histolytica
EKTEKKKELFSS

SEQ ID NO: 2617095 - protein, 10 aa, Entamoeba histolytica
EKTEKRMNKP

SEQ ID NO: 2617096 - protein, 6 aa, Entamoeba histolytica
EKTELS

SEQ ID NO: 2617097 - protein, 21 aa, Entamoeba histolytica
EKTEQTSSQENSVSSFSSFSY

SEQ ID NO: 2617098 - protein, 9 aa, Entamoeba histolytica
EKTEQTTPS

SEQ ID NO: 2617099 - protein, 8 aa, Entamoeba histolytica
EKTETLTC

SEQ ID NO: 2617100 - protein, 7 aa, Entamoeba histolytica
EKTGDEK

SEQ ID NO: 2617101 - protein, 6 aa, Entamoeba histolytica
EKTGEI

SEQ ID NO: 2617102 - protein, 7 aa, Entamoeba histolytica
EKTGFEE

SEQ ID NO: 2617103 - protein, 39 aa, Entamoeba histolytica
EKTGGEEYAEKYKELRDQLNDERKEWKEEKEELKQKEEQ

SEQ ID NO: 2617104 - protein, 11 aa, Entamoeba histolytica
EKTGGFGGNIG

SEQ ID NO: 2617105 - protein, 12 aa, Entamoeba histolytica
EKTGHSGTLDPA

SEQ ID NO: 2617106 - protein, 8 aa, Entamoeba histolytica
EKTGINNE

SEQ ID NO: 2617107 - protein, 6 aa, Entamoeba histolytica
EKTGIP

SEQ ID NO: 2617108 - protein, 8 aa, Entamoeba histolytica
EKTGMARD

SEQ ID NO: 2617109 - protein, 16 aa, Entamoeba histolytica
EKTHDSDLKTAKERVI

SEQ ID NO: 2617110 - protein, 12 aa, Entamoeba histolytica
EKTIQQKTEEHY

SEQ ID NO: 2617111 - protein, 5 aa, Entamoeba histolytica
EKTIT

SEQ ID NO: 2617112 - protein, 7 aa, Entamoeba histolytica
EKTITET

SEQ ID NO: 2617113 - protein, 14 aa, Entamoeba histolytica
EKTKEKMTKENDGN

SEQ ID NO: 2617114 - protein, 6 aa, Entamoeba histolytica
EKTKNT

SEQ ID NO: 2617115 - protein, 8 aa, Entamoeba histolytica
EKTKNYNP

SEQ ID NO: 2617116 - protein, 18 aa, Entamoeba histolytica
EKTKQEIDKQRKDDQSAQ

SEQ ID NO: 2617117 - protein, 15 aa, Entamoeba histolytica
EKTKQKILEALQLLE

SEQ ID NO: 2617118 - protein, 6 aa, Entamoeba histolytica
EKTKRP

SEQ ID NO: 2617119 - protein, 7 aa, Entamoeba histolytica
EKTLNTT

SEQ ID NO: 2617120 - protein, 5 aa, Entamoeba histolytica
EKTNE

SEQ ID NO: 2617121 - protein, 9 aa, Entamoeba histolytica
EKTNETITI

SEQ ID NO: 2617122 - protein, 12 aa, Entamoeba histolytica
EKTNGYSGSDMK

SEQ ID NO: 2617123 - protein, 7 aa, Entamoeba histolytica
EKTNTTV

SEQ ID NO: 2617124 - protein, 4 aa, Entamoeba histolytica
EKTP

SEQ ID NO: 2617125 - protein, 6 aa, Entamoeba histolytica
EKTPIV

SEQ ID NO: 2617126 - protein, 27 aa, Entamoeba histolytica
EKTPKYSPKTSPSTYKNSSNMELSPAI

SEQ ID NO: 2617127 - protein, 6 aa, Entamoeba histolytica
EKTPQS

SEQ ID NO: 2617128 - protein, 7 aa, Entamoeba histolytica
EKTPSEF

SEQ ID NO: 2617129 - protein, 9 aa, Entamoeba histolytica
EKTQKEKPL

SEQ ID NO: 2617130 - protein, 4 aa, Entamoeba histolytica
EKTR

SEQ ID NO: 2617131 - protein, 8 aa, Entamoeba histolytica
EKTRERMT

SEQ ID NO: 2617132 - protein, 8 aa, Entamoeba histolytica
EKTSATIG

SEQ ID NO: 2617133 - protein, 6 aa, Entamoeba histolytica
EKTSER

SEQ ID NO: 2617134 - protein, 8 aa, Entamoeba histolytica
EKTSNDIE

SEQ ID NO: 2617135 - protein, 8 aa, Entamoeba histolytica
EKTSPHSM

SEQ ID NO: 2617136 - protein, 4 aa, Entamoeba histolytica
EKTT

SEQ ID NO: 2617137 - protein, 8 aa, Entamoeba histolytica
EKTTDSGW

SEQ ID NO: 2617138 - protein, 8 aa, Entamoeba histolytica
EKTTGNNF

SEQ ID NO: 2617139 - protein, 15 aa, Entamoeba histolytica
EKTTIMKGEPTPISP

SEQ ID NO: 2617140 - protein, 6 aa, Entamoeba histolytica
EKTTMR

SEQ ID NO: 2617141 - protein, 10 aa, Entamoeba histolytica
EKTTTTQPEE

SEQ ID NO: 2617142 - protein, 4 aa, Entamoeba histolytica
EKTV

SEQ ID NO: 2617143 - protein, 8 aa, Entamoeba histolytica
EKTVEEKT

SEQ ID NO: 2617144 - protein, 4 aa, Entamoeba histolytica
EKTY

SEQ ID NO: 2617145 - protein, 7 aa, Entamoeba histolytica
EKTYYTP

SEQ ID NO: 2617146 - protein, 6 aa, Entamoeba histolytica
EKVAEI

SEQ ID NO: 2617147 - protein, 16 aa, Entamoeba histolytica
EKVDCVDETTSSLQKK

SEQ ID NO: 2617148 - protein, 5 aa, Entamoeba histolytica
EKVDK

SEQ ID NO: 2617149 - protein, 6 aa, Entamoeba histolytica
EKVDSN

SEQ ID NO: 2617150 - protein, 9 aa, Entamoeba histolytica
EKVEEGGII

SEQ ID NO: 2617151 - protein, 5 aa, Entamoeba histolytica
EKVGN

SEQ ID NO: 2617152 - protein, 13 aa, Entamoeba histolytica
EKVIQPEVKGRGI

SEQ ID NO: 2617153 - protein, 8 aa, Entamoeba histolytica
EKVKNNEN

SEQ ID NO: 2617154 - protein, 9 aa, Entamoeba histolytica
EKVKNNENF

SEQ ID NO: 2617155 - protein, 7 aa, Entamoeba histolytica
EKVNEIE

SEQ ID NO: 2617156 - protein, 9 aa, Entamoeba histolytica
EKVNQKTLQ

SEQ ID NO: 2617157 - protein, 5 aa, Entamoeba histolytica
EKVPS

SEQ ID NO: 2617158 - protein, 10 aa, Entamoeba histolytica
EKVQQQPTEP

SEQ ID NO: 2617159 - protein, 8 aa, Entamoeba histolytica
EKVSAYPE

SEQ ID NO: 2617160 - protein, 33 aa, Entamoeba histolytica
EKVSEEKKPKKVDNKKGTKKEKDELVLNIFFDD

SEQ ID NO: 2617161 - protein, 10 aa, Entamoeba histolytica
EKVTPNSGNH

SEQ ID NO: 2617162 - protein, 4 aa, Entamoeba histolytica
EKYD

SEQ ID NO: 2617163 - protein, 7 aa, Entamoeba histolytica
EKYDDTV

SEQ ID NO: 2617164 - protein, 6 aa, Entamoeba histolytica
EKYDTK

SEQ ID NO: 2617165 - protein, 7 aa, Entamoeba histolytica
EKYEIDE

SEQ ID NO: 2617166 - protein, 5 aa, Entamoeba histolytica
EKYEQ

SEQ ID NO: 2617167 - protein, 8 aa, Entamoeba histolytica
EKYESSYN

SEQ ID NO: 2617168 - protein, 5 aa, Entamoeba histolytica
EKYGA

SEQ ID NO: 2617169 - protein, 6 aa, Entamoeba histolytica
EKYGEE

SEQ ID NO: 2617170 - protein, 14 aa, Entamoeba histolytica
EKYGKEHALQGARI

SEQ ID NO: 2617171 - protein, 9 aa, Entamoeba histolytica
EKYGSSEDI

SEQ ID NO: 2617172 - protein, 14 aa, Entamoeba histolytica
EKYIKRKKEERKQE

SEQ ID NO: 2617173 - protein, 14 aa, Entamoeba histolytica
EKYKAEKEKEGQNV

SEQ ID NO: 2617174 - protein, 10 aa, Entamoeba histolytica
EKYKAKETME

SEQ ID NO: 2617175 - protein, 11 aa, Entamoeba histolytica
EKYKAKGKDIY

SEQ ID NO: 2617176 - protein, 5 aa, Entamoeba histolytica
EKYKD

SEQ ID NO: 2617177 - protein, 11 aa, Entamoeba histolytica
EKYKDQRQNLQ

SEQ ID NO: 2617178 - protein, 13 aa, Entamoeba histolytica
EKYKREDKTQSIT

SEQ ID NO: 2617179 - protein, 6 aa, Entamoeba histolytica
EKYKTK

SEQ ID NO: 2617180 - protein, 28 aa, Entamoeba histolytica
EKYLSNDPTTKAESTSQQKQNEEIPPVN

SEQ ID NO: 2617181 - protein, 4 aa, Entamoeba histolytica
EKYN

SEQ ID NO: 2617182 - protein, 11 aa, Entamoeba histolytica
EKYNESVNEEK

SEQ ID NO: 2617183 - protein, 7 aa, Entamoeba histolytica
EKYNGNV

SEQ ID NO: 2617184 - protein, 7 aa, Entamoeba histolytica
EKYNHTS

SEQ ID NO: 2617185 - protein, 8 aa, Entamoeba histolytica
EKYNRPDI

SEQ ID NO: 2617186 - protein, 12 aa, Entamoeba histolytica
EKYNSPSAKKYK

SEQ ID NO: 2617187 - protein, 11 aa, Entamoeba histolytica
EKYNTDSDGDL

SEQ ID NO: 2617188 - protein, 9 aa, Entamoeba histolytica
EKYPDKEAM

SEQ ID NO: 2617189 - protein, 5 aa, Entamoeba histolytica
EKYPE

SEQ ID NO: 2617190 - protein, 10 aa, Entamoeba histolytica
EKYPQYKKQF

SEQ ID NO: 2617191 - protein, 7 aa, Entamoeba histolytica
EKYQPQT

SEQ ID NO: 2617192 - protein, 9 aa, Entamoeba histolytica
EKYQTDPTN

SEQ ID NO: 2617193 - protein, 4 aa, Entamoeba histolytica
EKYR

SEQ ID NO: 2617194 - protein, 13 aa, Entamoeba histolytica
EKYRNKTGSLEEQ

SEQ ID NO: 2617195 - protein, 11 aa, Entamoeba histolytica
EKYRQSLPEVP

SEQ ID NO: 2617196 - protein, 6 aa, Entamoeba histolytica
EKYRSL

SEQ ID NO: 2617197 - protein, 6 aa, Entamoeba histolytica
EKYSAR

SEQ ID NO: 2617198 - protein, 5 aa, Entamoeba histolytica
EKYSE

SEQ ID NO: 2617199 - protein, 7 aa, Entamoeba histolytica
EKYTGAG

SEQ ID NO: 2617200 - protein, 11 aa, Entamoeba histolytica
EKYTKDRESYR

SEQ ID NO: 2617201 - protein, 4 aa, Entamoeba histolytica
EKYV

SEQ ID NO: 2617202 - protein, 4 aa, Entamoeba histolytica
EKYW

SEQ ID NO: 2617203 - protein, 4 aa, Entamoeba histolytica
EKYY

SEQ ID NO: 2617204 - protein, 5 aa, Entamoeba histolytica
ELAAG

SEQ ID NO: 2617205 - protein, 6 aa, Entamoeba histolytica
ELADGF

SEQ ID NO: 2617206 - protein, 12 aa, Entamoeba histolytica
ELADKKGDYDPL

SEQ ID NO: 2617207 - protein, 4 aa, Entamoeba histolytica
ELAE

SEQ ID NO: 2617208 - protein, 8 aa, Entamoeba histolytica
ELAEGKFD

SEQ ID NO: 2617209 - protein, 18 aa, Entamoeba histolytica
ELAEQEVDEEEVKKSEED

SEQ ID NO: 2617210 - protein, 5 aa, Entamoeba histolytica
ELAGP

SEQ ID NO: 2617211 - protein, 12 aa, Entamoeba histolytica
ELAKEKESLTKH

SEQ ID NO: 2617212 - protein, 28 aa, Entamoeba histolytica
ELAKSSQEDAQKSIRHTSSSKRVSKTFG

SEQ ID NO: 2617213 - protein, 14 aa, Entamoeba histolytica
ELANAEQQRNNHQK

SEQ ID NO: 2617214 - protein, 8 aa, Entamoeba histolytica
ELAPGSYS

SEQ ID NO: 2617215 - protein, 8 aa, Entamoeba histolytica
ELAPTYPS

SEQ ID NO: 2617216 - protein, 10 aa, Entamoeba histolytica
ELAQNIKSNF

SEQ ID NO: 2617217 - protein, 9 aa, Entamoeba histolytica
ELATSSWDK

SEQ ID NO: 2617218 - protein, 7 aa, Entamoeba histolytica
ELDDDDV

SEQ ID NO: 2617219 - protein, 13 aa, Entamoeba histolytica
ELDDKGTVSTFDK

SEQ ID NO: 2617220 - protein, 10 aa, Entamoeba histolytica
ELDDKKCKTI

SEQ ID NO: 2617221 - protein, 5 aa, Entamoeba histolytica
ELDEE

SEQ ID NO: 2617222 - protein, 15 aa, Entamoeba histolytica
ELDEEKKSSSEKTLK

SEQ ID NO: 2617223 - protein, 9 aa, Entamoeba histolytica
ELDESEREE

SEQ ID NO: 2617224 - protein, 8 aa, Entamoeba histolytica
ELDGAQDE

SEQ ID NO: 2617225 - protein, 48 aa, Entamoeba histolytica
ELDNSDSEEIITRKNDQEKEEEKKKKQRLKEKYQRLKEQKEEEEKSEE

SEQ ID NO: 2617226 - protein, 6 aa, Entamoeba histolytica
ELDNTP

SEQ ID NO: 2617227 - protein, 15 aa, Entamoeba histolytica
ELDPPIEIKGEGRAT

SEQ ID NO: 2617228 - protein, 6 aa, Entamoeba histolytica
ELDPSD

SEQ ID NO: 2617229 - protein, 12 aa, Entamoeba histolytica
ELDRLDDNTDIK

SEQ ID NO: 2617230 - protein, 13 aa, Entamoeba histolytica
ELDSHESNKQATP

SEQ ID NO: 2617231 - protein, 4 aa, Entamoeba histolytica
ELDT

SEQ ID NO: 2617232 - protein, 17 aa, Entamoeba histolytica
ELEDKEDYRGDSFDEDE

SEQ ID NO: 2617233 - protein, 20 aa, Entamoeba histolytica
ELEDNDAEELEYHPNDPIDY

SEQ ID NO: 2617234 - protein, 8 aa, Entamoeba histolytica
ELEEDKLN

SEQ ID NO: 2617235 - protein, 6 aa, Entamoeba histolytica
ELEEEG

SEQ ID NO: 2617236 - protein, 17 aa, Entamoeba histolytica
ELEEENQKLKNQIASST

SEQ ID NO: 2617237 - protein, 37 aa, Entamoeba histolytica
ELEEERQKNQQTQQSEPKENPEKEYPENSEEKKEIEE

SEQ ID NO: 2617238 - protein, 14 aa, Entamoeba histolytica
ELEEESKKEGFNKN

SEQ ID NO: 2617239 - protein, 12 aa, Entamoeba histolytica
ELEEGNKYNTNK

SEQ ID NO: 2617240 - protein, 5 aa, Entamoeba histolytica
ELEEN

SEQ ID NO: 2617241 - protein, 32 aa, Entamoeba histolytica
ELEEQKKELNNWKKKEEEWNEYKKNKELENET

SEQ ID NO: 2617242 - protein, 13 aa, Entamoeba histolytica
ELEERRKKMDKIK

SEQ ID NO: 2617243 - protein, 5 aa, Entamoeba histolytica
ELEES

SEQ ID NO: 2617244 - protein, 6 aa, Entamoeba histolytica
ELEESK

SEQ ID NO: 2617245 - protein, 9 aa, Entamoeba histolytica
ELEGENKEL

SEQ ID NO: 2617246 - protein, 6 aa, Entamoeba histolytica
ELEKAQ

SEQ ID NO: 2617247 - protein, 5 aa, Entamoeba histolytica
ELEKE

SEQ ID NO: 2617248 - protein, 6 aa, Entamoeba histolytica
ELEKES

SEQ ID NO: 2617249 - protein, 6 aa, Entamoeba histolytica
ELEKEV

SEQ ID NO: 2617250 - protein, 16 aa, Entamoeba histolytica
ELEKQRPVEYQTNSID

SEQ ID NO: 2617251 - protein, 32 aa, Entamoeba histolytica
ELEKQSKGLISDGNKMTKAIESQKDVLKKEKE

SEQ ID NO: 2617252 - protein, 8 aa, Entamoeba histolytica
ELEKTEDK

SEQ ID NO: 2617253 - protein, 11 aa, Entamoeba histolytica
ELENDTRNTYQ

SEQ ID NO: 2617254 - protein, 6 aa, Entamoeba histolytica
ELENED

SEQ ID NO: 2617255 - protein, 6 aa, Entamoeba histolytica
ELENEI

SEQ ID NO: 2617256 - protein, 18 aa, Entamoeba histolytica
ELENEKKNNQKDRINEEQ

SEQ ID NO: 2617257 - protein, 7 aa, Entamoeba histolytica
ELENGPY

SEQ ID NO: 2617258 - protein, 6 aa, Entamoeba histolytica
ELENKK

SEQ ID NO: 2617259 - protein, 6 aa, Entamoeba histolytica
ELENNG

SEQ ID NO: 2617260 - protein, 5 aa, Entamoeba histolytica
ELENQ

SEQ ID NO: 2617261 - protein, 4 aa, Entamoeba histolytica
ELEP

SEQ ID NO: 2617262 - protein, 6 aa, Entamoeba histolytica
ELEPDK

SEQ ID NO: 2617263 - protein, 5 aa, Entamoeba histolytica
ELEPR

SEQ ID NO: 2617264 - protein, 5 aa, Entamoeba histolytica
ELEPS

SEQ ID NO: 2617265 - protein, 25 aa, Entamoeba histolytica
ELEPTQTQSEISKEKKKILEKSSKR

SEQ ID NO: 2617266 - protein, 22 aa, Entamoeba histolytica
ELEQEQKNQLKEKLEEQENQIE

SEQ ID NO: 2617267 - protein, 20 aa, Entamoeba histolytica
ELEQKEEVIQKEDETKQKEI

SEQ ID NO: 2617268 - protein, 28 aa, Entamoeba histolytica
ELEQKENEESTEEFSSGDEYGGKDEFEA

SEQ ID NO: 2617269 - protein, 5 aa, Entamoeba histolytica
ELERR

SEQ ID NO: 2617270 - protein, 5 aa, Entamoeba histolytica
ELESK

SEQ ID NO: 2617271 - protein, 15 aa, Entamoeba histolytica
ELESSQRKQMEKDPY

SEQ ID NO: 2617272 - protein, 33 aa, Entamoeba histolytica
ELETEEDKIGEQIEEINGNNSELTEKRQRCEKE

SEQ ID NO: 2617273 - protein, 7 aa, Entamoeba histolytica
ELETKEI

SEQ ID NO: 2617274 - protein, 8 aa, Entamoeba histolytica
ELFGSTSA

SEQ ID NO: 2617275 - protein, 14 aa, Entamoeba histolytica
ELFSSEKKQFDEET

SEQ ID NO: 2617276 - protein, 4 aa, Entamoeba histolytica
ELGD

SEQ ID NO: 2617277 - protein, 7 aa, Entamoeba histolytica
ELGEDTH

SEQ ID NO: 2617278 - protein, 7 aa, Entamoeba histolytica
ELGEKKR

SEQ ID NO: 2617279 - protein, 11 aa, Entamoeba histolytica
ELGLPTSDEID

SEQ ID NO: 2617280 - protein, 7 aa, Entamoeba histolytica
ELGPLDR

SEQ ID NO: 2617281 - protein, 13 aa, Entamoeba histolytica
ELGSNSSSPDIHK

SEQ ID NO: 2617282 - protein, 5 aa, Entamoeba histolytica
ELGTR

SEQ ID NO: 2617283 - protein, 9 aa, Entamoeba histolytica
ELHNPEDDK

SEQ ID NO: 2617284 - protein, 11 aa, Entamoeba histolytica
ELHQQGEFEPS

SEQ ID NO: 2617285 - protein, 16 aa, Entamoeba histolytica
ELHSGDIDRSIDPEEE

SEQ ID NO: 2617286 - protein, 6 aa, Entamoeba histolytica
ELIPKG

SEQ ID NO: 2617287 - protein, 17 aa, Entamoeba histolytica
ELKEEKHNGIENEEKIK

SEQ ID NO: 2617288 - protein, 15 aa, Entamoeba histolytica
ELKEEVDKQTYGDQL

SEQ ID NO: 2617289 - protein, 22 aa, Entamoeba histolytica
ELKEGEKTTTDKLFEKLRKEFS

SEQ ID NO: 2617290 - protein, 12 aa, Entamoeba histolytica
ELKEKGELSTRL

SEQ ID NO: 2617291 - protein, 10 aa, Entamoeba histolytica
ELKEKKKTLK

SEQ ID NO: 2617292 - protein, 9 aa, Entamoeba histolytica
ELKEKTATG

SEQ ID NO: 2617293 - protein, 11 aa, Entamoeba histolytica
ELKENEGEPPL

SEQ ID NO: 2617294 - protein, 9 aa, Entamoeba histolytica
ELKEREGLI

SEQ ID NO: 2617295 - protein, 8 aa, Entamoeba histolytica
ELKETTGF

SEQ ID NO: 2617296 - protein, 5 aa, Entamoeba histolytica
ELKGD

SEQ ID NO: 2617297 - protein, 6 aa, Entamoeba histolytica
ELKGDE

SEQ ID NO: 2617298 - protein, 12 aa, Entamoeba histolytica
ELKGDKKEQINQ

SEQ ID NO: 2617299 - protein, 12 aa, Entamoeba histolytica
ELKIEQSNGEMK

SEQ ID NO: 2617300 - protein, 30 aa, Entamoeba histolytica
ELKKEKKEEENKKEELKKQLEEEQKEKSNI

SEQ ID NO: 2617301 - protein, 12 aa, Entamoeba histolytica
ELKKGGKPLTNV

SEQ ID NO: 2617302 - protein, 13 aa, Entamoeba histolytica
ELKKGNQLNKSID

SEQ ID NO: 2617303 - protein, 14 aa, Entamoeba histolytica
ELKKNETIPKYCFE

SEQ ID NO: 2617304 - protein, 14 aa, Entamoeba histolytica
ELKKNKTIPESRFK

SEQ ID NO: 2617305 - protein, 14 aa, Entamoeba histolytica
ELKKNKTIPEYCFE

SEQ ID NO: 2617306 - protein, 14 aa, Entamoeba histolytica
ELKKNKTIPKNCFY

SEQ ID NO: 2617307 - protein, 19 aa, Entamoeba histolytica
ELKNDGKTTEVNETNKGTY

SEQ ID NO: 2617308 - protein, 13 aa, Entamoeba histolytica
ELKNGKKQLKERN

SEQ ID NO: 2617309 - protein, 8 aa, Entamoeba histolytica
ELKNKRNE

SEQ ID NO: 2617310 - protein, 9 aa, Entamoeba histolytica
ELKNNTPIA

SEQ ID NO: 2617311 - protein, 9 aa, Entamoeba histolytica
ELKNSNEEL

SEQ ID NO: 2617312 - protein, 25 aa, Entamoeba histolytica
ELKPKNLAAQLPTKADAFKEDTSDL

SEQ ID NO: 2617313 - protein, 12 aa, Entamoeba histolytica
ELKQKYKELAKQ

SEQ ID NO: 2617314 - protein, 18 aa, Entamoeba histolytica
ELKQNKEVEEKNRKIEEL

SEQ ID NO: 2617315 - protein, 9 aa, Entamoeba histolytica
ELKRKKEVI

SEQ ID NO: 2617316 - protein, 12 aa, Entamoeba histolytica
ELKRREKGIAEL

SEQ ID NO: 2617317 - protein, 16 aa, Entamoeba histolytica
ELKRRQKNLNQLRTKR

SEQ ID NO: 2617318 - protein, 7 aa, Entamoeba histolytica
ELKSAQE

SEQ ID NO: 2617319 - protein, 8 aa, Entamoeba histolytica
ELKSGTSY

SEQ ID NO: 2617320 - protein, 10 aa, Entamoeba histolytica
ELKSTKEMKE

SEQ ID NO: 2617321 - protein, 10 aa, Entamoeba histolytica
ELKSTTEEHS

SEQ ID NO: 2617322 - protein, 6 aa, Entamoeba histolytica
ELKTSP

SEQ ID NO: 2617323 - protein, 4 aa, Entamoeba histolytica
ELKY

SEQ ID NO: 2617324 - protein, 14 aa, Entamoeba histolytica
ELLSTDQVGNNPEV

SEQ ID NO: 2617325 - protein, 13 aa, Entamoeba histolytica
ELLTEENKELLGN

SEQ ID NO: 2617326 - protein, 9 aa, Entamoeba histolytica
ELLTESSGM

SEQ ID NO: 2617327 - protein, 5 aa, Entamoeba histolytica
ELNDE

SEQ ID NO: 2617328 - protein, 6 aa, Entamoeba histolytica
ELNDEL

SEQ ID NO: 2617329 - protein, 11 aa, Entamoeba histolytica
ELNDKEKEELI

SEQ ID NO: 2617330 - protein, 14 aa, Entamoeba histolytica
ELNDKEVIPMLVPP

SEQ ID NO: 2617331 - protein, 4 aa, Entamoeba histolytica
ELNE

SEQ ID NO: 2617332 - protein, 10 aa, Entamoeba histolytica
ELNEEEQKRI

SEQ ID NO: 2617333 - protein, 10 aa, Entamoeba histolytica
ELNEENEQLK

SEQ ID NO: 2617334 - protein, 9 aa, Entamoeba histolytica
ELNEKQKEL

SEQ ID NO: 2617335 - protein, 5 aa, Entamoeba histolytica
ELNEL

SEQ ID NO: 2617336 - protein, 19 aa, Entamoeba histolytica
ELNEQNSTGNFSPRKRHNS

SEQ ID NO: 2617337 - protein, 7 aa, Entamoeba histolytica
ELNESTI

SEQ ID NO: 2617338 - protein, 6 aa, Entamoeba histolytica
ELNKED

SEQ ID NO: 2617339 - protein, 7 aa, Entamoeba histolytica
ELNKSIT

SEQ ID NO: 2617340 - protein, 15 aa, Entamoeba histolytica
ELNKTKEDVNTAKSD

SEQ ID NO: 2617341 - protein, 7 aa, Entamoeba histolytica
ELNNETI

SEQ ID NO: 2617342 - protein, 8 aa, Entamoeba histolytica
ELNNPKSL

SEQ ID NO: 2617343 - protein, 9 aa, Entamoeba histolytica
ELNPNASIK

SEQ ID NO: 2617344 - protein, 5 aa, Entamoeba histolytica
ELNPW

SEQ ID NO: 2617345 - protein, 6 aa, Entamoeba histolytica
ELNQPQ

SEQ ID NO: 2617346 - protein, 8 aa, Entamoeba histolytica
ELNSNEKT

SEQ ID NO: 2617347 - protein, 13 aa, Entamoeba histolytica
ELNTKDINNFSSS

SEQ ID NO: 2617348 - protein, 7 aa, Entamoeba histolytica
ELNTSRN

SEQ ID NO: 2617349 - protein, 16 aa, Entamoeba histolytica
ELNTTDRGTNGFGSTG

SEQ ID NO: 2617350 - protein, 13 aa, Entamoeba histolytica
ELNTTSKPMDTTP

SEQ ID NO: 2617351 - protein, 8 aa, Entamoeba histolytica
ELNTTSPD

SEQ ID NO: 2617352 - protein, 5 aa, Entamoeba histolytica
ELPAE

SEQ ID NO: 2617353 - protein, 7 aa, Entamoeba histolytica
ELPDKER

SEQ ID NO: 2617354 - protein, 13 aa, Entamoeba histolytica
ELPDSPQKHLKYG

SEQ ID NO: 2617355 - protein, 5 aa, Entamoeba histolytica
ELPDT

SEQ ID NO: 2617356 - protein, 4 aa, Entamoeba histolytica
ELPE

SEQ ID NO: 2617357 - protein, 6 aa, Entamoeba histolytica
ELPEDT

SEQ ID NO: 2617358 - protein, 7 aa, Entamoeba histolytica
ELPEEEF

SEQ ID NO: 2617359 - protein, 6 aa, Entamoeba histolytica
ELPEGY

SEQ ID NO: 2617360 - protein, 8 aa, Entamoeba histolytica
ELPGKGRG

SEQ ID NO: 2617361 - protein, 7 aa, Entamoeba histolytica
ELPHSQT

SEQ ID NO: 2617362 - protein, 10 aa, Entamoeba histolytica
ELPKESATKL

SEQ ID NO: 2617363 - protein, 8 aa, Entamoeba histolytica
ELPLSTKG

SEQ ID NO: 2617364 - protein, 4 aa, Entamoeba histolytica
ELPN

SEQ ID NO: 2617365 - protein, 12 aa, Entamoeba histolytica
ELPNLKSSTKLG

SEQ ID NO: 2617366 - protein, 6 aa, Entamoeba histolytica
ELPNNN

SEQ ID NO: 2617367 - protein, 8 aa, Entamoeba histolytica
ELPPKELA

SEQ ID NO: 2617368 - protein, 8 aa, Entamoeba histolytica
ELPPKEQA

SEQ ID NO: 2617369 - protein, 9 aa, Entamoeba histolytica
ELPPKEQAR

SEQ ID NO: 2617370 - protein, 8 aa, Entamoeba histolytica
ELPPNEDG

SEQ ID NO: 2617371 - protein, 8 aa, Entamoeba histolytica
ELPTNEDY

SEQ ID NO: 2617372 - protein, 6 aa, Entamoeba histolytica
ELPTSN

SEQ ID NO: 2617373 - protein, 5 aa, Entamoeba histolytica
ELQED

SEQ ID NO: 2617374 - protein, 23 aa, Entamoeba histolytica
ELQEEQEELNRYEELDKKRRGIE

SEQ ID NO: 2617375 - protein, 5 aa, Entamoeba histolytica
ELQES

SEQ ID NO: 2617376 - protein, 13 aa, Entamoeba histolytica
ELQKDSLHTQNDL

SEQ ID NO: 2617377 - protein, 11 aa, Entamoeba histolytica
ELQKEKVKGID

SEQ ID NO: 2617378 - protein, 13 aa, Entamoeba histolytica
ELQKEPTIERKEI

SEQ ID NO: 2617379 - protein, 6 aa, Entamoeba histolytica
ELQKST

SEQ ID NO: 2617380 - protein, 4 aa, Entamoeba histolytica
ELQN

SEQ ID NO: 2617381 - protein, 7 aa, Entamoeba histolytica
ELQNQLD

SEQ ID NO: 2617382 - protein, 4 aa, Entamoeba histolytica
ELQP

SEQ ID NO: 2617383 - protein, 6 aa, Entamoeba histolytica
ELQPSK

SEQ ID NO: 2617384 - protein, 9 aa, Entamoeba histolytica
ELQQNEKKI

SEQ ID NO: 2617385 - protein, 7 aa, Entamoeba histolytica
ELQQQKP

SEQ ID NO: 2617386 - protein, 22 aa, Entamoeba histolytica
ELQQQLEEEERKKKELEEQEKM

SEQ ID NO: 2617387 - protein, 10 aa, Entamoeba histolytica
ELQREEDEQY

SEQ ID NO: 2617388 - protein, 12 aa, Entamoeba histolytica
ELQSENEQLQRE

SEQ ID NO: 2617389 - protein, 8 aa, Entamoeba histolytica
ELRASSNN

SEQ ID NO: 2617390 - protein, 5 aa, Entamoeba histolytica
ELRDI

SEQ ID NO: 2617391 - protein, 7 aa, Entamoeba histolytica
ELREAGP

SEQ ID NO: 2617392 - protein, 12 aa, Entamoeba histolytica
ELRENNEKSHEI

SEQ ID NO: 2617393 - protein, 4 aa, Entamoeba histolytica
ELRI

SEQ ID NO: 2617394 - protein, 15 aa, Entamoeba histolytica
ELRKESEEGFKKEAN

SEQ ID NO: 2617395 - protein, 12 aa, Entamoeba histolytica
ELRKNHSNQITK

SEQ ID NO: 2617396 - protein, 15 aa, Entamoeba histolytica
ELRNNKRFNNESAEV

SEQ ID NO: 2617397 - protein, 10 aa, Entamoeba histolytica
ELRQRNRRYG

SEQ ID NO: 2617398 - protein, 4 aa, Entamoeba histolytica
ELRR

SEQ ID NO: 2617399 - protein, 7 aa, Entamoeba histolytica
ELRTAPD

SEQ ID NO: 2617400 - protein, 46 aa, Entamoeba histolytica
ELSDASSNGSIQSPNPESETKGTELGTEDTLTSDESENKTDVTNET

SEQ ID NO: 2617401 - protein, 10 aa, Entamoeba histolytica
ELSDMSEEEL

SEQ ID NO: 2617402 - protein, 8 aa, Entamoeba histolytica
ELSDSTNI

SEQ ID NO: 2617403 - protein, 16 aa, Entamoeba histolytica
ELSEDDEAQDASTKID

SEQ ID NO: 2617404 - protein, 5 aa, Entamoeba histolytica
ELSEE

SEQ ID NO: 2617405 - protein, 5 aa, Entamoeba histolytica
ELSER

SEQ ID NO: 2617406 - protein, 17 aa, Entamoeba histolytica
ELSESKVSRKDIENAKQ

SEQ ID NO: 2617407 - protein, 5 aa, Entamoeba histolytica
ELSEY

SEQ ID NO: 2617408 - protein, 11 aa, Entamoeba histolytica
ELSIKQKERIE

SEQ ID NO: 2617409 - protein, 5 aa, Entamoeba histolytica
ELSIP

SEQ ID NO: 2617410 - protein, 9 aa, Entamoeba histolytica
ELSISNTKT

SEQ ID NO: 2617411 - protein, 4 aa, Entamoeba histolytica
ELSK

SEQ ID NO: 2617412 - protein, 13 aa, Entamoeba histolytica
ELSKGYRTKRNEF

SEQ ID NO: 2617413 - protein, 11 aa, Entamoeba histolytica
ELSKPGKNPNN

SEQ ID NO: 2617414 - protein, 12 aa, Entamoeba histolytica
ELSKQQQEQQNT

SEQ ID NO: 2617415 - protein, 7 aa, Entamoeba histolytica
ELSNDKC

SEQ ID NO: 2617416 - protein, 10 aa, Entamoeba histolytica
ELSNEGNEGD

SEQ ID NO: 2617417 - protein, 5 aa, Entamoeba histolytica
ELSNG

SEQ ID NO: 2617418 - protein, 12 aa, Entamoeba histolytica
ELSNGNDGISKL

SEQ ID NO: 2617419 - protein, 29 aa, Entamoeba histolytica
ELSNGSDGVSKLNEELTQTKQEKEEINNE

SEQ ID NO: 2617420 - protein, 7 aa, Entamoeba histolytica
ELSNQGE

SEQ ID NO: 2617421 - protein, 7 aa, Entamoeba histolytica
ELSPAPD

SEQ ID NO: 2617422 - protein, 9 aa, Entamoeba histolytica
ELSPEHPPR

SEQ ID NO: 2617423 - protein, 7 aa, Entamoeba histolytica
ELSPEKV

SEQ ID NO: 2617424 - protein, 6 aa, Entamoeba histolytica
ELSPNG

SEQ ID NO: 2617425 - protein, 7 aa, Entamoeba histolytica
ELSPNNE

SEQ ID NO: 2617426 - protein, 26 aa, Entamoeba histolytica
ELSPPSKSNSLSPSFQEPQISQPTKR

SEQ ID NO: 2617427 - protein, 11 aa, Entamoeba histolytica
ELSQKLSEQID

SEQ ID NO: 2617428 - protein, 7 aa, Entamoeba histolytica
ELSRQIP

SEQ ID NO: 2617429 - protein, 7 aa, Entamoeba histolytica
ELSRTDV

SEQ ID NO: 2617430 - protein, 4 aa, Entamoeba histolytica
ELSS

SEQ ID NO: 2617431 - protein, 15 aa, Entamoeba histolytica
ELSSGFNPKNRQNPG

SEQ ID NO: 2617432 - protein, 9 aa, Entamoeba histolytica
ELSSKEETD

SEQ ID NO: 2617433 - protein, 9 aa, Entamoeba histolytica
ELSSKESIS

SEQ ID NO: 2617434 - protein, 8 aa, Entamoeba histolytica
ELSSKGHY

SEQ ID NO: 2617435 - protein, 11 aa, Entamoeba histolytica
ELSSKSVTASI

SEQ ID NO: 2617436 - protein, 9 aa, Entamoeba histolytica
ELSSNEESV

SEQ ID NO: 2617437 - protein, 11 aa, Entamoeba histolytica
ELSTIRNENER

SEQ ID NO: 2617438 - protein, 10 aa, Entamoeba histolytica
ELSTKDDENS

SEQ ID NO: 2617439 - protein, 6 aa, Entamoeba histolytica
ELSTSL

SEQ ID NO: 2617440 - protein, 8 aa, Entamoeba histolytica
ELSTTAVE

SEQ ID NO: 2617441 - protein, 4 aa, Entamoeba histolytica
ELTD

SEQ ID NO: 2617442 - protein, 5 aa, Entamoeba histolytica
ELTEE

SEQ ID NO: 2617443 - protein, 5 aa, Entamoeba histolytica
ELTEF

SEQ ID NO: 2617444 - protein, 8 aa, Entamoeba histolytica
ELTENKEE

SEQ ID NO: 2617445 - protein, 12 aa, Entamoeba histolytica
ELTETEKKELQR

SEQ ID NO: 2617446 - protein, 7 aa, Entamoeba histolytica
ELTETPT

SEQ ID NO: 2617447 - protein, 5 aa, Entamoeba histolytica
ELTGF

SEQ ID NO: 2617448 - protein, 6 aa, Entamoeba histolytica
ELTGQQ

SEQ ID NO: 2617449 - protein, 5 aa, Entamoeba histolytica
ELTIE

SEQ ID NO: 2617450 - protein, 4 aa, Entamoeba histolytica
ELTK

SEQ ID NO: 2617451 - protein, 9 aa, Entamoeba histolytica
ELTKNPVDG

SEQ ID NO: 2617452 - protein, 16 aa, Entamoeba histolytica
ELTPEEGDCYRQRGSA

SEQ ID NO: 2617453 - protein, 10 aa, Entamoeba histolytica
ELTPNPGNDK

SEQ ID NO: 2617454 - protein, 6 aa, Entamoeba histolytica
ELTQPG

SEQ ID NO: 2617455 - protein, 5 aa, Entamoeba histolytica
ELTQT

SEQ ID NO: 2617456 - protein, 15 aa, Entamoeba histolytica
ELTQTKQEKEEINNE

SEQ ID NO: 2617457 - protein, 7 aa, Entamoeba histolytica
ELTRAEP

SEQ ID NO: 2617458 - protein, 25 aa, Entamoeba histolytica
ELTSGNPFSITSTAAPKKTGESRSL

SEQ ID NO: 2617459 - protein, 31 aa, Entamoeba histolytica; identical to SEQ ID NO: 2421932

SEQ ID NO: 2617460 - protein, 21 aa, Entamoeba histolytica
ELTTSKEEQNESLDQEDKTNY

SEQ ID NO: 2617461 - protein, 14 aa, Entamoeba histolytica
ELTTTSQAPKTSSN

SEQ ID NO: 2617462 - protein, 10 aa, Entamoeba histolytica
ELVKEEEKSE

SEQ ID NO: 2617463 - protein, 8 aa, Entamoeba histolytica
ELVKPGEQ

SEQ ID NO: 2617464 - protein, 6 aa, Entamoeba histolytica
ELVRPT

SEQ ID NO: 2617465 - protein, 5 aa, Entamoeba histolytica
ELVSG

SEQ ID NO: 2617466 - protein, 11 aa, Entamoeba histolytica
ELYGNNIPDGV

SEQ ID NO: 2617467 - protein, 24 aa, Entamoeba histolytica
EMDEDENEESLTKKKKVKKEELSI

SEQ ID NO: 2617468 - protein, 5 aa, Entamoeba histolytica
EMDKI

SEQ ID NO: 2617469 - protein, 26 aa, Entamoeba histolytica
EMEALQGDVEKNQAQLELEAKSKDDL

SEQ ID NO: 2617470 - protein, 37 aa, Entamoeba histolytica
EMEEAQKTHKSVRVKSKKVEKQDEAGLNEQESKKIVE

SEQ ID NO: 2617471 - protein, 8 aa, Entamoeba histolytica
EMEEPENQ

SEQ ID NO: 2617472 - protein, 13 aa, Entamoeba histolytica
EMEESNKDGLHTP

SEQ ID NO: 2617473 - protein, 4 aa, Entamoeba histolytica
EMEN

SEQ ID NO: 2617474 - protein, 8 aa, Entamoeba histolytica
EMESRPTA

SEQ ID NO: 2617475 - protein, 7 aa, Entamoeba histolytica
EMETSSQ

SEQ ID NO: 2617476 - protein, 5 aa, Entamoeba histolytica
EMETT

SEQ ID NO: 2617477 - protein, 8 aa, Entamoeba histolytica
EMGDKELD

SEQ ID NO: 2617478 - protein, 12 aa, Entamoeba histolytica
EMGKTQEYPNPV

SEQ ID NO: 2617479 - protein, 6 aa, Entamoeba histolytica
EMGQSD

SEQ ID NO: 2617480 - protein, 49 aa, Entamoeba histolytica
EMINENKEEMINEKKEEITNGNKEEMTNEKKEIERRIEEEARKEKEWGK

SEQ ID NO: 2617481 - protein, 10 aa, Entamoeba histolytica
EMIPPSPQRS

SEQ ID NO: 2617482 - protein, 13 aa, Entamoeba histolytica
EMKEKQGITTNKR

SEQ ID NO: 2617483 - protein, 10 aa, Entamoeba histolytica
EMKENGKKFE

SEQ ID NO: 2617484 - protein, 12 aa, Entamoeba histolytica
EMKESQPTEEEY

SEQ ID NO: 2617485 - protein, 27 aa, Entamoeba histolytica
EMKGDQNNQLQATNKELKAKNNDLTSK

SEQ ID NO: 2617486 - protein, 9 aa, Entamoeba histolytica
EMKKQSSLI

SEQ ID NO: 2617487 - protein, 40 aa, Entamoeba histolytica
EMKNQNKNTLIPTDEKKEENEIPEKIQKENEECKTNANNE

SEQ ID NO: 2617488 - protein, 11 aa, Entamoeba histolytica
EMKSKELNIDQ

SEQ ID NO: 2617489 - protein, 5 aa, Entamoeba histolytica
EMKTA

SEQ ID NO: 2617490 - protein, 10 aa, Entamoeba histolytica
EMMEESSRRV

SEQ ID NO: 2617491 - protein, 16 aa, Entamoeba histolytica
EMNDKESEQQNEKGLN

SEQ ID NO: 2617492 - protein, 9 aa, Entamoeba histolytica
EMNDTQTKN

SEQ ID NO: 2617493 - protein, 14 aa, Entamoeba histolytica
EMNEEANVKETRIK

SEQ ID NO: 2617494 - protein, 11 aa, Entamoeba histolytica
EMNEKQQNQTF

SEQ ID NO: 2617495 - protein, 7 aa, Entamoeba histolytica
EMNESIE

SEQ ID NO: 2617496 - protein, 4 aa, Entamoeba histolytica
EMNK

SEQ ID NO: 2617497 - protein, 9 aa, Entamoeba histolytica
EMNKESELD

SEQ ID NO: 2617498 - protein, 7 aa, Entamoeba histolytica
EMNKGNT

SEQ ID NO: 2617499 - protein, 9 aa, Entamoeba histolytica
EMNKGSQQQ

SEQ ID NO: 2617500 - protein, 10 aa, Entamoeba histolytica
EMNKKSLNEL

SEQ ID NO: 2617501 - protein, 4 aa, Entamoeba histolytica
EMNN

SEQ ID NO: 2617502 - protein, 8 aa, Entamoeba histolytica
EMNRESEF

SEQ ID NO: 2617503 - protein, 10 aa, Entamoeba histolytica
EMPADSGYPA

SEQ ID NO: 2617504 - protein, 4 aa, Entamoeba histolytica
EMPF

SEQ ID NO: 2617505 - protein, 6 aa, Entamoeba histolytica
EMPNTL

SEQ ID NO: 2617506 - protein, 5 aa, Entamoeba histolytica
EMPQE

SEQ ID NO: 2617507 - protein, 7 aa, Entamoeba histolytica
EMPQQER

SEQ ID NO: 2617508 - protein, 11 aa, Entamoeba histolytica
EMPSQSTNKME

SEQ ID NO: 2617509 - protein, 10 aa, Entamoeba histolytica
EMQDSEDPFE

SEQ ID NO: 2617510 - protein, 4 aa, Entamoeba histolytica
EMQR

SEQ ID NO: 2617511 - protein, 6 aa, Entamoeba histolytica
EMQRQN

SEQ ID NO: 2617512 - protein, 5 aa, Entamoeba histolytica
EMQRS

SEQ ID NO: 2617513 - protein, 9 aa, Entamoeba histolytica
EMRKYEKDH

SEQ ID NO: 2617514 - protein, 12 aa, Entamoeba histolytica
EMRTTQSNNKIT

SEQ ID NO: 2617515 - protein, 16 aa, Entamoeba histolytica
EMSGDSSLTKKELEET

SEQ ID NO: 2617516 - protein, 11 aa, Entamoeba histolytica
EMSKEEKYQKI

SEQ ID NO: 2617517 - protein, 5 aa, Entamoeba histolytica
EMSNS

SEQ ID NO: 2617518 - protein, 13 aa, Entamoeba histolytica
EMSNTQTLKRDDL

SEQ ID NO: 2617519 - protein, 10 aa, Entamoeba histolytica
EMSPKKKEGY

SEQ ID NO: 2617520 - protein, 4 aa, Entamoeba histolytica
EMTG

SEQ ID NO: 2617521 - protein, 5 aa, Entamoeba histolytica
EMTST

SEQ ID NO: 2617522 - protein, 4 aa, Entamoeba histolytica
EMTT

SEQ ID NO: 2617523 - protein, 6 aa, Entamoeba histolytica
ENAARH

SEQ ID NO: 2617524 - protein, 6 aa, Entamoeba histolytica
ENADKK

SEQ ID NO: 2617525 - protein, 8 aa, Entamoeba histolytica
ENAEEAKV

SEQ ID NO: 2617526 - protein, 7 aa, Entamoeba histolytica
ENAETAA

SEQ ID NO: 2617527 - protein, 9 aa, Entamoeba histolytica
ENAGTNESF

SEQ ID NO: 2617528 - protein, 4 aa, Entamoeba histolytica
ENAI

SEQ ID NO: 2617529 - protein, 5 aa, Entamoeba histolytica
ENAIE

SEQ ID NO: 2617530 - protein, 8 aa, Entamoeba histolytica
ENAKEKLE

SEQ ID NO: 2617531 - protein, 11 aa, Entamoeba histolytica
ENAKKGNDSAL

SEQ ID NO: 2617532 - protein, 6 aa, Entamoeba histolytica
ENALKS

SEQ ID NO: 2617533 - protein, 8 aa, Entamoeba histolytica
ENANPNSF

SEQ ID NO: 2617534 - protein, 8 aa, Entamoeba histolytica
ENAPECKD

SEQ ID NO: 2617535 - protein, 7 aa, Entamoeba histolytica
ENASNKL

SEQ ID NO: 2617536 - protein, 8 aa, Entamoeba histolytica
ENASPQYK

SEQ ID NO: 2617537 - protein, 9 aa, Entamoeba histolytica
ENASSQSLK

SEQ ID NO: 2617538 - protein, 27 aa, Entamoeba histolytica
ENATEEIKQKYQAAEKEAKKEKKARWT

SEQ ID NO: 2617539 - protein, 7 aa, Entamoeba histolytica
ENATYEI

SEQ ID NO: 2617540 - protein, 9 aa, Entamoeba histolytica
ENAVGPASV

SEQ ID NO: 2617541 - protein, 10 aa, Entamoeba histolytica
ENAVKQSPEF

SEQ ID NO: 2617542 - protein, 7 aa, Entamoeba histolytica
ENCENDH

SEQ ID NO: 2617543 - protein, 8 aa, Entamoeba histolytica
ENCNYNNR

SEQ ID NO: 2617544 - protein, 6 aa, Entamoeba histolytica
ENCQKQ

SEQ ID NO: 2617545 - protein, 4 aa, Entamoeba histolytica
ENCS

SEQ ID NO: 2617546 - protein, 4 aa, Entamoeba histolytica
ENCT

SEQ ID NO: 2617547 - protein, 39 aa, Entamoeba histolytica
ENCTRDKEAALRKKEQVETDLKEKSEEYDALNEKQRELN

SEQ ID NO: 2617548 - protein, 6 aa, Entamoeba histolytica
ENDATD

SEQ ID NO: 2617549 - protein, 5 aa, Entamoeba histolytica
ENDAY

SEQ ID NO: 2617550 - protein, 5 aa, Entamoeba histolytica
ENDDD

SEQ ID NO: 2617551 - protein, 24 aa, Entamoeba histolytica
ENDENSINEIENTQIENGEDEESV

SEQ ID NO: 2617552 - protein, 7 aa, Entamoeba histolytica
ENDENYD

SEQ ID NO: 2617553 - protein, 5 aa, Entamoeba histolytica
ENDEQ

SEQ ID NO: 2617554 - protein, 4 aa, Entamoeba histolytica
ENDG

SEQ ID NO: 2617555 - protein, 12 aa, Entamoeba histolytica
ENDGDEELNGGN

SEQ ID NO: 2617556 - protein, 7 aa, Entamoeba histolytica
ENDGKEV

SEQ ID NO: 2617557 - protein, 6 aa, Entamoeba histolytica
ENDGKK

SEQ ID NO: 2617558 - protein, 8 aa, Entamoeba histolytica
ENDGLNDL

SEQ ID NO: 2617559 - protein, 6 aa, Entamoeba histolytica
ENDIEK

SEQ ID NO: 2617560 - protein, 6 aa, Entamoeba histolytica
ENDIRK

SEQ ID NO: 2617561 - protein, 8 aa, Entamoeba histolytica
ENDKENFR

SEQ ID NO: 2617562 - protein, 10 aa, Entamoeba histolytica
ENDKNGEELL

SEQ ID NO: 2617563 - protein, 67 aa, Entamoeba histolytica
ENDKQTPSSTHGTLPPPPGRKPLTSSTGKQVPSRKPPAPPNKKLPTPPQGKGKPIPPPKPDNRNVPS

SEQ ID NO: 2617564 - protein, 7 aa, Entamoeba histolytica
ENDKTTF

SEQ ID NO: 2617565 - protein, 8 aa, Entamoeba histolytica
ENDLDTKN

SEQ ID NO: 2617566 - protein, 6 aa, Entamoeba histolytica
ENDLEQ

SEQ ID NO: 2617567 - protein, 7 aa, Entamoeba histolytica
ENDLSES

SEQ ID NO: 2617568 - protein, 4 aa, Entamoeba histolytica
ENDM

SEQ ID NO: 2617569 - protein, 4 aa, Entamoeba histolytica
ENDN

SEQ ID NO: 2617570 - protein, 7 aa, Entamoeba histolytica
ENDNEME

SEQ ID NO: 2617571 - protein, 6 aa, Entamoeba histolytica
ENDNKT

SEQ ID NO: 2617572 - protein, 5 aa, Entamoeba histolytica
ENDNN

SEQ ID NO: 2617573 - protein, 5 aa, Entamoeba histolytica
ENDQK

SEQ ID NO: 2617574 - protein, 6 aa, Entamoeba histolytica
ENDQSV

SEQ ID NO: 2617575 - protein, 28 aa, Entamoeba histolytica
ENDQTIRAPTPKNITKRKEIDKEKELKR

SEQ ID NO: 2617576 - protein, 9 aa, Entamoeba histolytica
ENDSDNDRI

SEQ ID NO: 2617577 - protein, 9 aa, Entamoeba histolytica
ENDSEFTKH

SEQ ID NO: 2617578 - protein, 9 aa, Entamoeba histolytica
ENDSNETDA

SEQ ID NO: 2617579 - protein, 7 aa, Entamoeba histolytica
ENDSQIA

SEQ ID NO: 2617580 - protein, 10 aa, Entamoeba histolytica
ENDSSYDEVE

SEQ ID NO: 2617581 - protein, 7 aa, Entamoeba histolytica
ENDSVIE

SEQ ID NO: 2617582 - protein, 9 aa, Entamoeba histolytica
ENDTASSLD

SEQ ID NO: 2617583 - protein, 5 aa, Entamoeba histolytica
ENDTD

SEQ ID NO: 2617584 - protein, 10 aa, Entamoeba histolytica
ENDTEIDMTN

SEQ ID NO: 2617585 - protein, 12 aa, Entamoeba histolytica
ENDVPDIKEPEN

SEQ ID NO: 2617586 - protein, 5 aa, Entamoeba histolytica
ENDYY

SEQ ID NO: 2617587 - protein, 16 aa, Entamoeba histolytica
ENEANQIKKEAEERLE

SEQ ID NO: 2617588 - protein, 5 aa, Entamoeba histolytica
ENEDC

SEQ ID NO: 2617589 - protein, 9 aa, Entamoeba histolytica
ENEDDDFEE

SEQ ID NO: 2617590 - protein, 5 aa, Entamoeba histolytica
ENEDK

SEQ ID NO: 2617591 - protein, 7 aa, Entamoeba histolytica
ENEECKG

SEQ ID NO: 2617592 - protein, 8 aa, Entamoeba histolytica
ENEEEKKL

SEQ ID NO: 2617593 - protein, 17 aa, Entamoeba histolytica
ENEEEYLDEEAEQYLWK

SEQ ID NO: 2617594 - protein, 34 aa, Entamoeba histolytica; identical to SEQ ID NO: 2422056

SEQ ID NO: 2617595 - protein, 10 aa, Entamoeba histolytica
ENEEGLTERQ

SEQ ID NO: 2617596 - protein, 8 aa, Entamoeba histolytica
ENEEKANA

SEQ ID NO: 2617597 - protein, 6 aa, Entamoeba histolytica
ENEEKK

SEQ ID NO: 2617598 - protein, 6 aa, Entamoeba histolytica
ENEELE

SEQ ID NO: 2617599 - protein, 9 aa, Entamoeba histolytica
ENEELTEKL

SEQ ID NO: 2617600 - protein, 7 aa, Entamoeba histolytica
ENEEPLN

SEQ ID NO: 2617601 - protein, 10 aa, Entamoeba histolytica
ENEEQSGNSL

SEQ ID NO: 2617602 - protein, 8 aa, Entamoeba histolytica
ENEETKTK

SEQ ID NO: 2617603 - protein, 6 aa, Entamoeba histolytica
ENEEVK

SEQ ID NO: 2617604 - protein, 13 aa, Entamoeba histolytica
ENEFYNNKEASPY

SEQ ID NO: 2617605 - protein, 6 aa, Entamoeba histolytica
ENEGEF

SEQ ID NO: 2617606 - protein, 6 aa, Entamoeba histolytica
ENEHEE

SEQ ID NO: 2617607 - protein, 4 aa, Entamoeba histolytica
ENEI

SEQ ID NO: 2617608 - protein, 17 aa, Entamoeba histolytica
ENEIEFDGNDREYPFNE

SEQ ID NO: 2617609 - protein, 75 aa, Entamoeba histolytica
ENEIEKENTEVENKKIEEENKKIEEENKKIEEENKVENEKVEEENKVENEKMEEENERNEGDIKNQSDEQQKPDN

SEQ ID NO: 2617610 - protein, 19 aa, Entamoeba histolytica
ENEIKRKEEELKKQEEIRK

SEQ ID NO: 2617611 - protein, 5 aa, Entamoeba histolytica
ENEIS

SEQ ID NO: 2617612 - protein, 5 aa, Entamoeba histolytica
ENEIT

SEQ ID NO: 2617613 - protein, 7 aa, Entamoeba histolytica
ENEKDRL

SEQ ID NO: 2617614 - protein, 6 aa, Entamoeba histolytica
ENEKGY

SEQ ID NO: 2617615 - protein, 8 aa, Entamoeba histolytica
ENEKIEKT

SEQ ID NO: 2617616 - protein, 20 aa, Entamoeba histolytica
ENEKKEKACSKKQNSNNNVI

SEQ ID NO: 2617617 - protein, 11 aa, Entamoeba histolytica
ENEKKRATTFQ

SEQ ID NO: 2617618 - protein, 9 aa, Entamoeba histolytica
ENEKRIEEQ

SEQ ID NO: 2617619 - protein, 9 aa, Entamoeba histolytica
ENEKTKISL

SEQ ID NO: 2617620 - protein, 8 aa, Entamoeba histolytica
ENEKTTIN

SEQ ID NO: 2617621 - protein, 4 aa, Entamoeba histolytica
ENEL

SEQ ID NO: 2617622 - protein, 8 aa, Entamoeba histolytica
ENELEKST

SEQ ID NO: 2617623 - protein, 7 aa, Entamoeba histolytica
ENELIEK

SEQ ID NO: 2617624 - protein, 12 aa, Entamoeba histolytica
ENELKQHQLQKE

SEQ ID NO: 2617625 - protein, 5 aa, Entamoeba histolytica
ENELN

SEQ ID NO: 2617626 - protein, 9 aa, Entamoeba histolytica
ENELNQKDI

SEQ ID NO: 2617627 - protein, 4 aa, Entamoeba histolytica
ENEM

SEQ ID NO: 2617628 - protein, 7 aa, Entamoeba histolytica
ENEMQEV

SEQ ID NO: 2617629 - protein, 4 aa, Entamoeba histolytica
ENEN

SEQ ID NO: 2617630 - protein, 5 aa, Entamoeba histolytica
ENENI

SEQ ID NO: 2617631 - protein, 22 aa, Entamoeba histolytica
ENENLKKVKEEIEKKTETEINE

SEQ ID NO: 2617632 - protein, 19 aa, Entamoeba histolytica
ENENPNEETITTQKDPGVI

SEQ ID NO: 2617633 - protein, 7 aa, Entamoeba histolytica
ENENSDV

SEQ ID NO: 2617634 - protein, 6 aa, Entamoeba histolytica
ENEPEN

SEQ ID NO: 2617635 - protein, 6 aa, Entamoeba histolytica
ENEPFN

SEQ ID NO: 2617636 - protein, 7 aa, Entamoeba histolytica
ENEPIEA

SEQ ID NO: 2617637 - protein, 5 aa, Entamoeba histolytica
ENEPP

SEQ ID NO: 2617638 - protein, 7 aa, Entamoeba histolytica
ENEQERP

SEQ ID NO: 2617639 - protein, 8 aa, Entamoeba histolytica
ENEQGNPL

SEQ ID NO: 2617640 - protein, 5 aa, Entamoeba histolytica
ENEQL

SEQ ID NO: 2617641 - protein, 8 aa, Entamoeba histolytica
ENEQNCGF

SEQ ID NO: 2617642 - protein, 13 aa, Entamoeba histolytica
ENEQNDKPTEIKE

SEQ ID NO: 2617643 - protein, 6 aa, Entamoeba histolytica
ENEQRK

SEQ ID NO: 2617644 - protein, 5 aa, Entamoeba histolytica
ENEQV

SEQ ID NO: 2617645 - protein, 52 aa, Entamoeba histolytica
ENERDIEEETKQKKKEEQTNELKCDDETKGITPKKEDVENNQNEVSLSDSSV

SEQ ID NO: 2617646 - protein, 19 aa, Entamoeba histolytica
ENERERKTNEERDKNEKEL

SEQ ID NO: 2617647 - protein, 5 aa, Entamoeba histolytica
ENERI

SEQ ID NO: 2617648 - protein, 6 aa, Entamoeba histolytica
ENERIS

SEQ ID NO: 2617649 - protein, 5 aa, Entamoeba histolytica
ENERL

SEQ ID NO: 2617650 - protein, 16 aa, Entamoeba histolytica
ENERSKKIKNSDEKDQ

SEQ ID NO: 2617651 - protein, 4 aa, Entamoeba histolytica
ENES

SEQ ID NO: 2617652 - protein, 11 aa, Entamoeba histolytica
ENESGKLKKRE

SEQ ID NO: 2617653 - protein, 5 aa, Entamoeba histolytica
ENESI

SEQ ID NO: 2617654 - protein, 6 aa, Entamoeba histolytica
ENESSI

SEQ ID NO: 2617655 - protein, 8 aa, Entamoeba histolytica
ENESSVND

SEQ ID NO: 2617656 - protein, 4 aa, Entamoeba histolytica
ENET

SEQ ID NO: 2617657 - protein, 6 aa, Entamoeba histolytica
ENETES

SEQ ID NO: 2617658 - protein, 5 aa, Entamoeba histolytica
ENETK

SEQ ID NO: 2617659 - protein, 10 aa, Entamoeba histolytica
ENETKEEREK

SEQ ID NO: 2617660 - protein, 15 aa, Entamoeba histolytica
ENETQPNQITHPNNS

SEQ ID NO: 2617661 - protein, 19 aa, Entamoeba histolytica
ENETVNDSIHQQKESTQQL

SEQ ID NO: 2617662 - protein, 18 aa, Entamoeba histolytica
ENEVQKAFGPGDVRRNSE

SEQ ID NO: 2617663 - protein, 5 aa, Entamoeba histolytica
ENEWE

SEQ ID NO: 2617664 - protein, 4 aa, Entamoeba histolytica
ENEY

SEQ ID NO: 2617665 - protein, 10 aa, Entamoeba histolytica
ENEYNKDELK

SEQ ID NO: 2617666 - protein, 12 aa, Entamoeba histolytica
ENFQNKTQNKTT

SEQ ID NO: 2617667 - protein, 5 aa, Entamoeba histolytica
ENGAK

SEQ ID NO: 2617668 - protein, 4 aa, Entamoeba histolytica
ENGC

SEQ ID NO: 2617669 - protein, 11 aa, Entamoeba histolytica
ENGDEQDSSIS

SEQ ID NO: 2617670 - protein, 7 aa, Entamoeba histolytica
ENGDGRI

SEQ ID NO: 2617671 - protein, 4 aa, Entamoeba histolytica
ENGE

SEQ ID NO: 2617672 - protein, 9 aa, Entamoeba histolytica
ENGEDNSLV

SEQ ID NO: 2617673 - protein, 5 aa, Entamoeba histolytica
ENGEF

SEQ ID NO: 2617674 - protein, 7 aa, Entamoeba histolytica
ENGEITT

SEQ ID NO: 2617675 - protein, 8 aa, Entamoeba histolytica
ENGENFSL

SEQ ID NO: 2617676 - protein, 6 aa, Entamoeba histolytica
ENGENL

SEQ ID NO: 2617677 - protein, 10 aa, Entamoeba histolytica
ENGEQQMPDC

SEQ ID NO: 2617678 - protein, 7 aa, Entamoeba histolytica
ENGESVS

SEQ ID NO: 2617679 - protein, 5 aa, Entamoeba histolytica
ENGEV

SEQ ID NO: 2617680 - protein, 7 aa, Entamoeba histolytica
ENGEYDE

SEQ ID NO: 2617681 - protein, 7 aa, Entamoeba histolytica
ENGGNRE

SEQ ID NO: 2617682 - protein, 11 aa, Entamoeba histolytica
ENGGSLDQETA

SEQ ID NO: 2617683 - protein, 9 aa, Entamoeba histolytica
ENGGTEGRA

SEQ ID NO: 2617684 - protein, 5 aa, Entamoeba histolytica
ENGGY

SEQ ID NO: 2617685 - protein, 16 aa, Entamoeba histolytica
ENGHPQKQFGRRQHEE

SEQ ID NO: 2617686 - protein, 9 aa, Entamoeba histolytica
ENGIEQKYG

SEQ ID NO: 2617687 - protein, 13 aa, Entamoeba histolytica
ENGIGKKVESTSK

SEQ ID NO: 2617688 - protein, 9 aa, Entamoeba histolytica
ENGKDSKWA

SEQ ID NO: 2617689 - protein, 9 aa, Entamoeba histolytica
ENGKENDLE

SEQ ID NO: 2617690 - protein, 11 aa, Entamoeba histolytica
ENGKEQINEEN

SEQ ID NO: 2617691 - protein, 7 aa, Entamoeba histolytica
ENGKNIY

SEQ ID NO: 2617692 - protein, 11 aa, Entamoeba histolytica
ENGLQDKPSTL

SEQ ID NO: 2617693 - protein, 4 aa, Entamoeba histolytica
ENGM

SEQ ID NO: 2617694 - protein, 6 aa, Entamoeba histolytica
ENGMEE

SEQ ID NO: 2617695 - protein, 9 aa, Entamoeba histolytica
ENGNDKIRA

SEQ ID NO: 2617696 - protein, 11 aa, Entamoeba histolytica
ENGNETDPRDL

SEQ ID NO: 2617697 - protein, 8 aa, Entamoeba histolytica
ENGPIREK

SEQ ID NO: 2617698 - protein, 10 aa, Entamoeba histolytica
ENGPKEGASK

SEQ ID NO: 2617699 - protein, 7 aa, Entamoeba histolytica
ENGPKVL

SEQ ID NO: 2617700 - protein, 7 aa, Entamoeba histolytica
ENGQEPV

SEQ ID NO: 2617701 - protein, 7 aa, Entamoeba histolytica
ENGQHGN

SEQ ID NO: 2617702 - protein, 7 aa, Entamoeba histolytica
ENGQIET

SEQ ID NO: 2617703 - protein, 24 aa, Entamoeba histolytica
ENGRKNPNVARRKIGKKNKRLQKD

SEQ ID NO: 2617704 - protein, 6 aa, Entamoeba histolytica
ENGSEL

SEQ ID NO: 2617705 - protein, 7 aa, Entamoeba histolytica
ENGSERR

SEQ ID NO: 2617706 - protein, 12 aa, Entamoeba histolytica
ENGSIEEGQATT

SEQ ID NO: 2617707 - protein, 6 aa, Entamoeba histolytica
ENGSIK

SEQ ID NO: 2617708 - protein, 6 aa, Entamoeba histolytica
ENGSKV

SEQ ID NO: 2617709 - protein, 9 aa, Entamoeba histolytica
ENGSNEIKH

SEQ ID NO: 2617710 - protein, 14 aa, Entamoeba histolytica
ENGSPLNGLNSPEQ

SEQ ID NO: 2617711 - protein, 8 aa, Entamoeba histolytica
ENGSTEVP

SEQ ID NO: 2617712 - protein, 7 aa, Entamoeba histolytica
ENGSTGA

SEQ ID NO: 2617713 - protein, 4 aa, Entamoeba histolytica
ENGT

SEQ ID NO: 2617714 - protein, 8 aa, Entamoeba histolytica
ENGTDGKQ

SEQ ID NO: 2617715 - protein, 8 aa, Entamoeba histolytica
ENGTGKPY

SEQ ID NO: 2617716 - protein, 5 aa, Entamoeba histolytica
ENGTK

SEQ ID NO: 2617717 - protein, 5 aa, Entamoeba histolytica
ENGTM

SEQ ID NO: 2617718 - protein, 7 aa, Entamoeba histolytica
ENGTRTK

SEQ ID NO: 2617719 - protein, 4 aa, Entamoeba histolytica
ENGY

SEQ ID NO: 2617720 - protein, 11 aa, Entamoeba histolytica
ENHCSVGSRKP

SEQ ID NO: 2617721 - protein, 6 aa, Entamoeba histolytica
ENHEIE

SEQ ID NO: 2617722 - protein, 6 aa, Entamoeba histolytica
ENHPTS

SEQ ID NO: 2617723 - protein, 6 aa, Entamoeba histolytica
ENIDRD

SEQ ID NO: 2617724 - protein, 6 aa, Entamoeba histolytica
ENIDST

SEQ ID NO: 2617725 - protein, 8 aa, Entamoeba histolytica
ENIEDNKR

SEQ ID NO: 2617726 - protein, 18 aa, Entamoeba histolytica
ENIEDNSVTMETHNKSGP

SEQ ID NO: 2617727 - protein, 9 aa, Entamoeba histolytica
ENIEKEGNE

SEQ ID NO: 2617728 - protein, 10 aa, Entamoeba histolytica
ENIEKKKELL

SEQ ID NO: 2617729 - protein, 14 aa, Entamoeba histolytica
ENIEKRGRPEEKDY

SEQ ID NO: 2617730 - protein, 7 aa, Entamoeba histolytica
ENIENET

SEQ ID NO: 2617731 - protein, 6 aa, Entamoeba histolytica
ENIHDE

SEQ ID NO: 2617732 - protein, 16 aa, Entamoeba histolytica
ENIPEGSSSNGGSTYL

SEQ ID NO: 2617733 - protein, 10 aa, Entamoeba histolytica
ENIPKTQATI

SEQ ID NO: 2617734 - protein, 7 aa, Entamoeba histolytica
ENIPQTA

SEQ ID NO: 2617735 - protein, 10 aa, Entamoeba histolytica
ENIPTPQEQE

SEQ ID NO: 2617736 - protein, 23 aa, Entamoeba histolytica
ENIQESGETFQKPDYIGQSSNKC

SEQ ID NO: 2617737 - protein, 10 aa, Entamoeba histolytica
ENIQKQINEN

SEQ ID NO: 2617738 - protein, 5 aa, Entamoeba histolytica
ENISE

SEQ ID NO: 2617739 - protein, 14 aa, Entamoeba histolytica
ENISEVEKREETKV

SEQ ID NO: 2617740 - protein, 10 aa, Entamoeba histolytica
ENISPSMKKS

SEQ ID NO: 2617741 - protein, 9 aa, Entamoeba histolytica
ENISSEAME

SEQ ID NO: 2617742 - protein, 8 aa, Entamoeba histolytica
ENISTTFN

SEQ ID NO: 2617743 - protein, 7 aa, Entamoeba histolytica
ENITPES

SEQ ID NO: 2617744 - protein, 5 aa, Entamoeba histolytica
ENITS

SEQ ID NO: 2617745 - protein, 6 aa, Entamoeba histolytica
ENITTV

SEQ ID NO: 2617746 - protein, 4 aa, Entamoeba histolytica
ENIV

SEQ ID NO: 2617747 - protein, 10 aa, Entamoeba histolytica
ENKAIRPEKQ

SEQ ID NO: 2617748 - protein, 5 aa, Entamoeba histolytica
ENKAL

SEQ ID NO: 2617749 - protein, 5 aa, Entamoeba histolytica
ENKAM

SEQ ID NO: 2617750 - protein, 12 aa, Entamoeba histolytica
ENKCSEENKRSI

SEQ ID NO: 2617751 - protein, 4 aa, Entamoeba histolytica
ENKD

SEQ ID NO: 2617752 - protein, 9 aa, Entamoeba histolytica
ENKDKEYET

SEQ ID NO: 2617753 - protein, 9 aa, Entamoeba histolytica
ENKDPIQSN

SEQ ID NO: 2617754 - protein, 23 aa, Entamoeba histolytica
ENKEIKQQLDDERNNNKKLLESQ

SEQ ID NO: 2617755 - protein, 11 aa, Entamoeba histolytica
ENKEINGTEYP

SEQ ID NO: 2617756 - protein, 14 aa, Entamoeba histolytica
ENKEINKEINQNHT

SEQ ID NO: 2617757 - protein, 9 aa, Entamoeba histolytica
ENKEKSKEA

SEQ ID NO: 2617758 - protein, 13 aa, Entamoeba histolytica
ENKELKAKLSREV

SEQ ID NO: 2617759 - protein, 35 aa, Entamoeba histolytica
ENKENEENEEEKKPKSNNDDKKLNNSKKLSKPSIG

SEQ ID NO: 2617760 - protein, 5 aa, Entamoeba histolytica
ENKEP

SEQ ID NO: 2617761 - protein, 6 aa, Entamoeba histolytica
ENKESI

SEQ ID NO: 2617762 - protein, 10 aa, Entamoeba histolytica
ENKESSQALS

SEQ ID NO: 2617763 - protein, 5 aa, Entamoeba histolytica
ENKEV

SEQ ID NO: 2617764 - protein, 15 aa, Entamoeba histolytica
ENKFDNIKTSAKMRN

SEQ ID NO: 2617765 - protein, 7 aa, Entamoeba histolytica
ENKFPTN

SEQ ID NO: 2617766 - protein, 8 aa, Entamoeba histolytica
ENKFTDKN

SEQ ID NO: 2617767 - protein, 8 aa, Entamoeba histolytica
ENKGGKLQ

SEQ ID NO: 2617768 - protein, 10 aa, Entamoeba histolytica
ENKGKDVTPL

SEQ ID NO: 2617769 - protein, 8 aa, Entamoeba histolytica
ENKGKYDR

SEQ ID NO: 2617770 - protein, 9 aa, Entamoeba histolytica
ENKGKYVPQ

SEQ ID NO: 2617771 - protein, 5 aa, Entamoeba histolytica
ENKGV

SEQ ID NO: 2617772 - protein, 6 aa, Entamoeba histolytica
ENKHER

SEQ ID NO: 2617773 - protein, 12 aa, Entamoeba histolytica
ENKIEENKRREV

SEQ ID NO: 2617774 - protein, 12 aa, Entamoeba histolytica
ENKIEKKTNASF

SEQ ID NO: 2617775 - protein, 5 aa, Entamoeba histolytica
ENKIK

SEQ ID NO: 2617776 - protein, 6 aa, Entamoeba histolytica
ENKIQG

SEQ ID NO: 2617777 - protein, 10 aa, Entamoeba histolytica
ENKISEEQEN

SEQ ID NO: 2617778 - protein, 8 aa, Entamoeba histolytica
ENKKEEAL

SEQ ID NO: 2617779 - protein, 7 aa, Entamoeba histolytica
ENKKEKK

SEQ ID NO: 2617780 - protein, 9 aa, Entamoeba histolytica
ENKKETGTL

SEQ ID NO: 2617781 - protein, 5 aa, Entamoeba histolytica
ENKKK

SEQ ID NO: 2617782 - protein, 9 aa, Entamoeba histolytica
ENKKKKTYT

SEQ ID NO: 2617783 - protein, 17 aa, Entamoeba histolytica
ENKKMTKEVEHKPQKKI

SEQ ID NO: 2617784 - protein, 6 aa, Entamoeba histolytica
ENKKTC

SEQ ID NO: 2617785 - protein, 27 aa, Entamoeba histolytica
ENKLAEAAINKEEKVRKTRKRRGQQEA

SEQ ID NO: 2617786 - protein, 9 aa, Entamoeba histolytica
ENKLRNNPS

SEQ ID NO: 2617787 - protein, 8 aa, Entamoeba histolytica
ENKMNSRD

SEQ ID NO: 2617788 - protein, 8 aa, Entamoeba histolytica
ENKMSTSN

SEQ ID NO: 2617789 - protein, 7 aa, Entamoeba histolytica
ENKNENG

SEQ ID NO: 2617790 - protein, 14 aa, Entamoeba histolytica
ENKNESNNKQIKDV

SEQ ID NO: 2617791 - protein, 5 aa, Entamoeba histolytica
ENKNI

SEQ ID NO: 2617792 - protein, 7 aa, Entamoeba histolytica
ENKNISS

SEQ ID NO: 2617793 - protein, 7 aa, Entamoeba histolytica
ENKNNQI

SEQ ID NO: 2617794 - protein, 9 aa, Entamoeba histolytica
ENKPDGIAK

SEQ ID NO: 2617795 - protein, 8 aa, Entamoeba histolytica
ENKPESSI

SEQ ID NO: 2617796 - protein, 10 aa, Entamoeba histolytica
ENKPKSSDTL

SEQ ID NO: 2617797 - protein, 20 aa, Entamoeba histolytica
ENKPLEKITPPKRMSEENNG

SEQ ID NO: 2617798 - protein, 8 aa, Entamoeba histolytica
ENKQMTGM

SEQ ID NO: 2617799 - protein, 8 aa, Entamoeba histolytica
ENKQNQFI

SEQ ID NO: 2617800 - protein, 7 aa, Entamoeba histolytica
ENKQPSQ

SEQ ID NO: 2617801 - protein, 9 aa, Entamoeba histolytica
ENKRAKKEW

SEQ ID NO: 2617802 - protein, 11 aa, Entamoeba histolytica
ENKRKKENQQI

SEQ ID NO: 2617803 - protein, 5 aa, Entamoeba histolytica
ENKRM

SEQ ID NO: 2617804 - protein, 8 aa, Entamoeba histolytica
ENKRNEKS

SEQ ID NO: 2617805 - protein, 7 aa, Entamoeba histolytica
ENKRQEL

SEQ ID NO: 2617806 - protein, 8 aa, Entamoeba histolytica
ENKRSELS

SEQ ID NO: 2617807 - protein, 7 aa, Entamoeba histolytica
ENKSKIG

SEQ ID NO: 2617808 - protein, 8 aa, Entamoeba histolytica
ENKSLDPN

SEQ ID NO: 2617809 - protein, 8 aa, Entamoeba histolytica
ENKSYGSQ

SEQ ID NO: 2617810 - protein, 6 aa, Entamoeba histolytica
ENKTNR

SEQ ID NO: 2617811 - protein, 10 aa, Entamoeba histolytica
ENKTQTEERE

SEQ ID NO: 2617812 - protein, 35 aa, Entamoeba histolytica
ENKTRHSTAQSEVINESTTPKDEYNKTSRSVGVTP

SEQ ID NO: 2617813 - protein, 7 aa, Entamoeba histolytica
ENKVSRK

SEQ ID NO: 2617814 - protein, 5 aa, Entamoeba histolytica
ENKYG

SEQ ID NO: 2617815 - protein, 5 aa, Entamoeba histolytica
ENKYI

SEQ ID NO: 2617816 - protein, 11 aa, Entamoeba histolytica
ENLEERKKGLT

SEQ ID NO: 2617817 - protein, 8 aa, Entamoeba histolytica
ENLGATTQ

SEQ ID NO: 2617818 - protein, 11 aa, Entamoeba histolytica
ENLKKKKKGVK

SEQ ID NO: 2617819 - protein, 5 aa, Entamoeba histolytica
ENLKQ

SEQ ID NO: 2617820 - protein, 5 aa, Entamoeba histolytica
ENLNE

SEQ ID NO: 2617821 - protein, 6 aa, Entamoeba histolytica
ENLNEQ

SEQ ID NO: 2617822 - protein, 8 aa, Entamoeba histolytica
ENLPGGHN

SEQ ID NO: 2617823 - protein, 7 aa, Entamoeba histolytica
ENLPTEH

SEQ ID NO: 2617824 - protein, 20 aa, Entamoeba histolytica
ENLQTTNVQESKKEEQKEMT

SEQ ID NO: 2617825 - protein, 5 aa, Entamoeba histolytica
ENLSD

SEQ ID NO: 2617826 - protein, 9 aa, Entamoeba histolytica
ENLSKVPSE

SEQ ID NO: 2617827 - protein, 14 aa, Entamoeba histolytica
ENLSNKEECKNNTY

SEQ ID NO: 2617828 - protein, 6 aa, Entamoeba histolytica
ENLSPT

SEQ ID NO: 2617829 - protein, 5 aa, Entamoeba histolytica
ENLSQ

SEQ ID NO: 2617830 - protein, 9 aa, Entamoeba histolytica
ENLTAPSNT

SEQ ID NO: 2617831 - protein, 9 aa, Entamoeba histolytica
ENLTREEGV

SEQ ID NO: 2617832 - protein, 4 aa, Entamoeba histolytica
ENMN

SEQ ID NO: 2617833 - protein, 12 aa, Entamoeba histolytica
ENMNSKLEAYMK

SEQ ID NO: 2617834 - protein, 5 aa, Entamoeba histolytica
ENMPS

SEQ ID NO: 2617835 - protein, 9 aa, Entamoeba histolytica
ENNASENAS

SEQ ID NO: 2617836 - protein, 4 aa, Entamoeba histolytica
ENNC

SEQ ID NO: 2617837 - protein, 5 aa, Entamoeba histolytica
ENNCR

SEQ ID NO: 2617838 - protein, 18 aa, Entamoeba histolytica
ENNDSLGKTLSSRKSNNE

SEQ ID NO: 2617839 - protein, 9 aa, Entamoeba histolytica
ENNEKQEGI

SEQ ID NO: 2617840 - protein, 13 aa, Entamoeba histolytica
ENNELDNNVPNYK

SEQ ID NO: 2617841 - protein, 12 aa, Entamoeba histolytica
ENNEMKKQINDL

SEQ ID NO: 2617842 - protein, 20 aa, Entamoeba histolytica
ENNENERKITRSSFNPRTAG

SEQ ID NO: 2617843 - protein, 22 aa, Entamoeba histolytica
ENNENKLSTEGERKEINKNEYV

SEQ ID NO: 2617844 - protein, 9 aa, Entamoeba histolytica
ENNERFKEE

SEQ ID NO: 2617845 - protein, 7 aa, Entamoeba histolytica
ENNESEW

SEQ ID NO: 2617846 - protein, 6 aa, Entamoeba histolytica
ENNETF

SEQ ID NO: 2617847 - protein, 6 aa, Entamoeba histolytica
ENNEVR

SEQ ID NO: 2617848 - protein, 5 aa, Entamoeba histolytica
ENNGE

SEQ ID NO: 2617849 - protein, 16 aa, Entamoeba histolytica
ENNGKRGYFPSNYVRI

SEQ ID NO: 2617850 - protein, 7 aa, Entamoeba histolytica
ENNHNLA

SEQ ID NO: 2617851 - protein, 12 aa, Entamoeba histolytica
ENNIKKPSMTKE

SEQ ID NO: 2617852 - protein, 13 aa, Entamoeba histolytica
ENNISYEDSTGRN

SEQ ID NO: 2617853 - protein, 7 aa, Entamoeba histolytica
ENNKEMH

SEQ ID NO: 2617854 - protein, 18 aa, Entamoeba histolytica
ENNKGDKIERLTGTTTRG

SEQ ID NO: 2617855 - protein, 7 aa, Entamoeba histolytica
ENNKGIP

SEQ ID NO: 2617856 - protein, 10 aa, Entamoeba histolytica
ENNKTIRSRK

SEQ ID NO: 2617857 - protein, 13 aa, Entamoeba histolytica
ENNKTNQNTMDYN

SEQ ID NO: 2617858 - protein, 7 aa, Entamoeba histolytica
ENNNDLL

SEQ ID NO: 2617859 - protein, 7 aa, Entamoeba histolytica
ENNNETH

SEQ ID NO: 2617860 - protein, 6 aa, Entamoeba histolytica
ENNNHE

SEQ ID NO: 2617861 - protein, 26 aa, Entamoeba histolytica
ENNNKSLLTPSDTNEDTLPSVPEKSS

SEQ ID NO: 2617862 - protein, 9 aa, Entamoeba histolytica
ENNNNNDDR

SEQ ID NO: 2617863 - protein, 12 aa, Entamoeba histolytica
ENNNQGKEDESI

SEQ ID NO: 2617864 - protein, 7 aa, Entamoeba histolytica
ENNNQSE

SEQ ID NO: 2617865 - protein, 5 aa, Entamoeba histolytica
ENNPC

SEQ ID NO: 2617866 - protein, 15 aa, Entamoeba histolytica
ENNPCPPSTEAGNAI

SEQ ID NO: 2617867 - protein, 8 aa, Entamoeba histolytica
ENNPEQQQ

SEQ ID NO: 2617868 - protein, 11 aa, Entamoeba histolytica
ENNPITDSKEN

SEQ ID NO: 2617869 - protein, 6 aa, Entamoeba histolytica
ENNPPK

SEQ ID NO: 2617870 - protein, 7 aa, Entamoeba histolytica
ENNPYDQ

SEQ ID NO: 2617871 - protein, 9 aa, Entamoeba histolytica
ENNQENGVD

SEQ ID NO: 2617872 - protein, 10 aa, Entamoeba histolytica
ENNQKQLGNE

SEQ ID NO: 2617873 - protein, 9 aa, Entamoeba histolytica
ENNQPPLRS

SEQ ID NO: 2617874 - protein, 8 aa, Entamoeba histolytica
ENNRKNID

SEQ ID NO: 2617875 - protein, 4 aa, Entamoeba histolytica
ENNS

SEQ ID NO: 2617876 - protein, 5 aa, Entamoeba histolytica
ENNSI

SEQ ID NO: 2617877 - protein, 15 aa, Entamoeba histolytica
ENNSKIKSEYQSGIN

SEQ ID NO: 2617878 - protein, 6 aa, Entamoeba histolytica
ENNSTT

SEQ ID NO: 2617879 - protein, 10 aa, Entamoeba histolytica
ENNTLKEDKQ

SEQ ID NO: 2617880 - protein, 6 aa, Entamoeba histolytica
ENNTPI

SEQ ID NO: 2617881 - protein, 17 aa, Entamoeba histolytica
ENNTSSKNCFGTEKKTL

SEQ ID NO: 2617882 - protein, 4 aa, Entamoeba histolytica
ENNV

SEQ ID NO: 2617883 - protein, 6 aa, Entamoeba histolytica
ENNYQE

SEQ ID NO: 2617884 - protein, 6 aa, Entamoeba histolytica
ENPAYK

SEQ ID NO: 2617885 - protein, 6 aa, Entamoeba histolytica
ENPECD

SEQ ID NO: 2617886 - protein, 6 aa, Entamoeba histolytica
ENPEEL

SEQ ID NO: 2617887 - protein, 5 aa, Entamoeba histolytica
ENPEK

SEQ ID NO: 2617888 - protein, 8 aa, Entamoeba histolytica
ENPELTQP

SEQ ID NO: 2617889 - protein, 6 aa, Entamoeba histolytica
ENPFGR

SEQ ID NO: 2617890 - protein, 7 aa, Entamoeba histolytica
ENPGESL

SEQ ID NO: 2617891 - protein, 5 aa, Entamoeba histolytica
ENPIM

SEQ ID NO: 2617892 - protein, 5 aa, Entamoeba histolytica
ENPIN

SEQ ID NO: 2617893 - protein, 7 aa, Entamoeba histolytica
ENPIPKK

SEQ ID NO: 2617894 - protein, 6 aa, Entamoeba histolytica
ENPISS

SEQ ID NO: 2617895 - protein, 13 aa, Entamoeba histolytica
ENPKLQSILFKEF

SEQ ID NO: 2617896 - protein, 9 aa, Entamoeba histolytica
ENPNERPTS

SEQ ID NO: 2617897 - protein, 14 aa, Entamoeba histolytica
ENPNHSTPKHNQEV

SEQ ID NO: 2617898 - protein, 9 aa, Entamoeba histolytica
ENPNKETVS

SEQ ID NO: 2617899 - protein, 17 aa, Entamoeba histolytica
ENPNNLKKLRKDPKYRQ

SEQ ID NO: 2617900 - protein, 8 aa, Entamoeba histolytica
ENPNNPRQ

SEQ ID NO: 2617901 - protein, 13 aa, Entamoeba histolytica
ENPPENPDRPTTC

SEQ ID NO: 2617902 - protein, 9 aa, Entamoeba histolytica
ENPPQNTPE

SEQ ID NO: 2617903 - protein, 4 aa, Entamoeba histolytica
ENPQ

SEQ ID NO: 2617904 - protein, 7 aa, Entamoeba histolytica
ENPQKQI

SEQ ID NO: 2617905 - protein, 5 aa, Entamoeba histolytica
ENPQT

SEQ ID NO: 2617906 - protein, 6 aa, Entamoeba histolytica
ENPRKR

SEQ ID NO: 2617907 - protein, 5 aa, Entamoeba histolytica
ENPSN

SEQ ID NO: 2617908 - protein, 5 aa, Entamoeba histolytica
ENPTP

SEQ ID NO: 2617909 - protein, 6 aa, Entamoeba histolytica
ENPTPI

SEQ ID NO: 2617910 - protein, 4 aa, Entamoeba histolytica
ENPV

SEQ ID NO: 2617911 - protein, 7 aa, Entamoeba histolytica
ENPVRGR

SEQ ID NO: 2617912 - protein, 5 aa, Entamoeba histolytica
ENPYK

SEQ ID NO: 2617913 - protein, 25 aa, Entamoeba histolytica
ENPYTTKYIPDDDFNDYSKIPSSNI

SEQ ID NO: 2617914 - protein, 4 aa, Entamoeba histolytica
ENQA

SEQ ID NO: 2617915 - protein, 13 aa, Entamoeba histolytica
ENQAKTSPSQMDG

SEQ ID NO: 2617916 - protein, 10 aa, Entamoeba histolytica
ENQDTSKLAS

SEQ ID NO: 2617917 - protein, 6 aa, Entamoeba histolytica
ENQEDF

SEQ ID NO: 2617918 - protein, 8 aa, Entamoeba histolytica
ENQELSTK

SEQ ID NO: 2617919 - protein, 5 aa, Entamoeba histolytica
ENQEN

SEQ ID NO: 2617920 - protein, 7 aa, Entamoeba histolytica
ENQESPL

SEQ ID NO: 2617921 - protein, 5 aa, Entamoeba histolytica
ENQET

SEQ ID NO: 2617922 - protein, 4 aa, Entamoeba histolytica
ENQF

SEQ ID NO: 2617923 - protein, 8 aa, Entamoeba histolytica
ENQGFENY

SEQ ID NO: 2617924 - protein, 10 aa, Entamoeba histolytica
ENQGTANFAK

SEQ ID NO: 2617925 - protein, 17 aa, Entamoeba histolytica
ENQISKSESFPPTQEEN

SEQ ID NO: 2617926 - protein, 6 aa, Entamoeba histolytica
ENQITS

SEQ ID NO: 2617927 - protein, 18 aa, Entamoeba histolytica
ENQKDRIKKQLEETRNTM

SEQ ID NO: 2617928 - protein, 6 aa, Entamoeba histolytica
ENQKDV

SEQ ID NO: 2617929 - protein, 9 aa, Entamoeba histolytica
ENQKEEDRR

SEQ ID NO: 2617930 - protein, 6 aa, Entamoeba histolytica
ENQKEF

SEQ ID NO: 2617931 - protein, 10 aa, Entamoeba histolytica
ENQKERAAQY

SEQ ID NO: 2617932 - protein, 7 aa, Entamoeba histolytica
ENQKGND

SEQ ID NO: 2617933 - protein, 17 aa, Entamoeba histolytica
ENQKIKEKLRSERTQNI

SEQ ID NO: 2617934 - protein, 20 aa, Entamoeba histolytica
ENQKKQFDKQNEKYQTECRD

SEQ ID NO: 2617935 - protein, 11 aa, Entamoeba histolytica
ENQKPTKTVKK

SEQ ID NO: 2617936 - protein, 31 aa, Entamoeba histolytica
ENQKQQTSTKSTERVNVTKPTTPSTQEQAGC

SEQ ID NO: 2617937 - protein, 5 aa, Entamoeba histolytica
ENQND

SEQ ID NO: 2617938 - protein, 17 aa, Entamoeba histolytica
ENQNESNDSQEEDDVND

SEQ ID NO: 2617939 - protein, 6 aa, Entamoeba histolytica
ENQNSL

SEQ ID NO: 2617940 - protein, 5 aa, Entamoeba histolytica
ENQNV

SEQ ID NO: 2617941 - protein, 4 aa, Entamoeba histolytica
ENQP

SEQ ID NO: 2617942 - protein, 13 aa, Entamoeba histolytica
ENQPLTQITQPKI

SEQ ID NO: 2617943 - protein, 11 aa, Entamoeba histolytica
ENQQQEQIERK

SEQ ID NO: 2617944 - protein, 7 aa, Entamoeba histolytica
ENQQSVL

SEQ ID NO: 2617945 - protein, 9 aa, Entamoeba histolytica
ENQQTEKDA

SEQ ID NO: 2617946 - protein, 5 aa, Entamoeba histolytica
ENQRR

SEQ ID NO: 2617947 - protein, 15 aa, Entamoeba histolytica
ENQRRRYMLKVGQFV

SEQ ID NO: 2617948 - protein, 5 aa, Entamoeba histolytica
ENQRY

SEQ ID NO: 2617949 - protein, 8 aa, Entamoeba histolytica
ENQTENEI

SEQ ID NO: 2617950 - protein, 6 aa, Entamoeba histolytica
ENQTNP

SEQ ID NO: 2617951 - protein, 5 aa, Entamoeba histolytica
ENQTS

SEQ ID NO: 2617952 - protein, 11 aa, Entamoeba histolytica
ENQTTNQMKRN

SEQ ID NO: 2617953 - protein, 7 aa, Entamoeba histolytica
ENQTVSE

SEQ ID NO: 2617954 - protein, 5 aa, Entamoeba histolytica
ENQYS

SEQ ID NO: 2617955 - protein, 10 aa, Entamoeba histolytica
ENRDYQSEQE

SEQ ID NO: 2617956 - protein, 4 aa, Entamoeba histolytica
ENRE

SEQ ID NO: 2617957 - protein, 6 aa, Entamoeba histolytica
ENREEA

SEQ ID NO: 2617958 - protein, 9 aa, Entamoeba histolytica
ENREEELQS

SEQ ID NO: 2617959 - protein, 6 aa, Entamoeba histolytica
ENRHNV

SEQ ID NO: 2617960 - protein, 8 aa, Entamoeba histolytica
ENRIRREN

SEQ ID NO: 2617961 - protein, 18 aa, Entamoeba histolytica
ENRKHDAIKEEIKDSKKH

SEQ ID NO: 2617962 - protein, 30 aa, Entamoeba histolytica
ENRKKRNEKQRERSKKRRPEHQTETYNGRQ

SEQ ID NO: 2617963 - protein, 8 aa, Entamoeba histolytica
ENRNKIEQ

SEQ ID NO: 2617964 - protein, 32 aa, Entamoeba histolytica
ENRQKRLSSQNNVIPSSQTTTLVEPQKDKNSV

SEQ ID NO: 2617965 - protein, 12 aa, Entamoeba histolytica
ENRRDNETIGCT

SEQ ID NO: 2617966 - protein, 16 aa, Entamoeba histolytica
ENRSMSPGNDFESSVR

SEQ ID NO: 2617967 - protein, 8 aa, Entamoeba histolytica
ENRTKATS

SEQ ID NO: 2617968 - protein, 4 aa, Entamoeba histolytica
ENRV

SEQ ID NO: 2617969 - protein, 4 aa, Entamoeba histolytica
ENRY

SEQ ID NO: 2617970 - protein, 6 aa, Entamoeba histolytica
ENSAPM

SEQ ID NO: 2617971 - protein, 6 aa, Entamoeba histolytica
ENSCDI

SEQ ID NO: 2617972 - protein, 14 aa, Entamoeba histolytica
ENSDRVRKNEDESQ

SEQ ID NO: 2617973 - protein, 4 aa, Entamoeba histolytica
ENSE

SEQ ID NO: 2617974 - protein, 6 aa, Entamoeba histolytica
ENSEDL

SEQ ID NO: 2617975 - protein, 9 aa, Entamoeba histolytica
ENSEGEYSN

SEQ ID NO: 2617976 - protein, 12 aa, Entamoeba histolytica
ENSEKTDKIQEA

SEQ ID NO: 2617977 - protein, 27 aa, Entamoeba histolytica
ENSELASVTGEETKPLDERETKSIGDR

SEQ ID NO: 2617978 - protein, 13 aa, Entamoeba histolytica
ENSFSSTSSVPLS

SEQ ID NO: 2617979 - protein, 7 aa, Entamoeba histolytica
ENSGTLI

SEQ ID NO: 2617980 - protein, 23 aa, Entamoeba histolytica
ENSISSNESEEHFNTSDSYGSIS

SEQ ID NO: 2617981 - protein, 7 aa, Entamoeba histolytica
ENSKDSL

SEQ ID NO: 2617982 - protein, 6 aa, Entamoeba histolytica
ENSKGS

SEQ ID NO: 2617983 - protein, 11 aa, Entamoeba histolytica
ENSKKENTELV

SEQ ID NO: 2617984 - protein, 10 aa, Entamoeba histolytica
ENSKKNVPAT

SEQ ID NO: 2617985 - protein, 4 aa, Entamoeba histolytica
ENSN

SEQ ID NO: 2617986 - protein, 8 aa, Entamoeba histolytica
ENSNAYGE

SEQ ID NO: 2617987 - protein, 5 aa, Entamoeba histolytica
ENSNC

SEQ ID NO: 2617988 - protein, 16 aa, Entamoeba histolytica
ENSNGEEKTKPVKELT

SEQ ID NO: 2617989 - protein, 24 aa, Entamoeba histolytica
ENSNIERDEESGSLLGRERNEEPM

SEQ ID NO: 2617990 - protein, 7 aa, Entamoeba histolytica
ENSNIKP

SEQ ID NO: 2617991 - protein, 7 aa, Entamoeba histolytica
ENSNVQD

SEQ ID NO: 2617992 - protein, 5 aa, Entamoeba histolytica
ENSPE

SEQ ID NO: 2617993 - protein, 15 aa, Entamoeba histolytica
ENSPIMSDKDNEMTP

SEQ ID NO: 2617994 - protein, 5 aa, Entamoeba histolytica
ENSPV

SEQ ID NO: 2617995 - protein, 5 aa, Entamoeba histolytica
ENSPY

SEQ ID NO: 2617996 - protein, 10 aa, Entamoeba histolytica
ENSQKRKKTY

SEQ ID NO: 2617997 - protein, 15 aa, Entamoeba histolytica
ENSQNEVSDQINERT

SEQ ID NO: 2617998 - protein, 6 aa, Entamoeba histolytica
ENSQNI

SEQ ID NO: 2617999 - protein, 13 aa, Entamoeba histolytica
ENSRELTTTCKEE

SEQ ID NO: 2618000 - protein, 4 aa, Entamoeba histolytica
ENSS

SEQ ID NO: 2618001 - protein, 27 aa, Entamoeba histolytica
ENSSDEEYQRSKREERARERKEKREKL

SEQ ID NO: 2618002 - protein, 10 aa, Entamoeba histolytica
ENSSDNGQSL

SEQ ID NO: 2618003 - protein, 17 aa, Entamoeba histolytica
ENSSGYAEITDKSALET

SEQ ID NO: 2618004 - protein, 9 aa, Entamoeba histolytica
ENSSPQQPQ

SEQ ID NO: 2618005 - protein, 10 aa, Entamoeba histolytica
ENSSVLNDSK

SEQ ID NO: 2618006 - protein, 5 aa, Entamoeba histolytica
ENSSW

SEQ ID NO: 2618007 - protein, 9 aa, Entamoeba histolytica
ENSTARHKK

SEQ ID NO: 2618008 - protein, 7 aa, Entamoeba histolytica
ENSTIPL

SEQ ID NO: 2618009 - protein, 6 aa, Entamoeba histolytica
ENSTLK

SEQ ID NO: 2618010 - protein, 12 aa, Entamoeba histolytica
ENSTNERNKYQD

SEQ ID NO: 2618011 - protein, 9 aa, Entamoeba histolytica
ENTAGPALD

SEQ ID NO: 2618012 - protein, 19 aa, Entamoeba histolytica
ENTDAAKNRSEHKYETTPS

SEQ ID NO: 2618013 - protein, 15 aa, Entamoeba histolytica
ENTDSFIQTNMQKIF

SEQ ID NO: 2618014 - protein, 4 aa, Entamoeba histolytica
ENTE

SEQ ID NO: 2618015 - protein, 8 aa, Entamoeba histolytica
ENTEEINQ

SEQ ID NO: 2618016 - protein, 8 aa, Entamoeba histolytica
ENTEEPYL

SEQ ID NO: 2618017 - protein, 10 aa, Entamoeba histolytica
ENTGVTNPDK

SEQ ID NO: 2618018 - protein, 7 aa, Entamoeba histolytica
ENTIGIP

SEQ ID NO: 2618019 - protein, 15 aa, Entamoeba histolytica
ENTIPNKKDSSHNLQ

SEQ ID NO: 2618020 - protein, 27 aa, Entamoeba histolytica
ENTITAKEETKESEDKNEIKSNETKKN

SEQ ID NO: 2618021 - protein, 10 aa, Entamoeba histolytica
ENTKETCKSV

SEQ ID NO: 2618022 - protein, 11 aa, Entamoeba histolytica
ENTKKKSKDEI

SEQ ID NO: 2618023 - protein, 9 aa, Entamoeba histolytica
ENTKQTQPV

SEQ ID NO: 2618024 - protein, 14 aa, Entamoeba histolytica
ENTKTESASSSKLN

SEQ ID NO: 2618025 - protein, 8 aa, Entamoeba histolytica
ENTLETHP

SEQ ID NO: 2618026 - protein, 5 aa, Entamoeba histolytica
ENTMK

SEQ ID NO: 2618027 - protein, 9 aa, Entamoeba histolytica
ENTMKNSHK

SEQ ID NO: 2618028 - protein, 6 aa, Entamoeba histolytica
ENTMPG

SEQ ID NO: 2618029 - protein, 7 aa, Entamoeba histolytica
ENTNDKE

SEQ ID NO: 2618030 - protein, 6 aa, Entamoeba histolytica
ENTNIE

SEQ ID NO: 2618031 - protein, 75 aa, Entamoeba histolytica
ENTNKKQEELKPKKIEYKESNDKQKIKEEIKEEEIKEEIKEEIESEDTEEALKKEYEEMEEEEEFSNSSDSQQYF

SEQ ID NO: 2618032 - protein, 17 aa, Entamoeba histolytica
ENTNTQPPKKPQKSRIF

SEQ ID NO: 2618033 - protein, 10 aa, Entamoeba histolytica
ENTPERKETF

SEQ ID NO: 2618034 - protein, 5 aa, Entamoeba histolytica
ENTPL

SEQ ID NO: 2618035 - protein, 9 aa, Entamoeba histolytica
ENTPNGHSG

SEQ ID NO: 2618036 - protein, 8 aa, Entamoeba histolytica
ENTPNYQK

SEQ ID NO: 2618037 - protein, 6 aa, Entamoeba histolytica
ENTPYC

SEQ ID NO: 2618038 - protein, 6 aa, Entamoeba histolytica
ENTPYM

SEQ ID NO: 2618039 - protein, 6 aa, Entamoeba histolytica
ENTQIP

SEQ ID NO: 2618040 - protein, 14 aa, Entamoeba histolytica
ENTQLPKKQTFCSL

SEQ ID NO: 2618041 - protein, 4 aa, Entamoeba histolytica
ENTR

SEQ ID NO: 2618042 - protein, 6 aa, Entamoeba histolytica
ENTRLE

SEQ ID NO: 2618043 - protein, 9 aa, Entamoeba histolytica
ENTRVKDDL

SEQ ID NO: 2618044 - protein, 6 aa, Entamoeba histolytica
ENTSAR

SEQ ID NO: 2618045 - protein, 9 aa, Entamoeba histolytica
ENTSATRVA

SEQ ID NO: 2618046 - protein, 8 aa, Entamoeba histolytica
ENTSEFEY

SEQ ID NO: 2618047 - protein, 10 aa, Entamoeba histolytica
ENTSENSLNI

SEQ ID NO: 2618048 - protein, 8 aa, Entamoeba histolytica
ENTSEYSS

SEQ ID NO: 2618049 - protein, 8 aa, Entamoeba histolytica
ENTSGEAT

SEQ ID NO: 2618050 - protein, 7 aa, Entamoeba histolytica
ENTSNSV

SEQ ID NO: 2618051 - protein, 9 aa, Entamoeba histolytica
ENTSSSVVE

SEQ ID NO: 2618052 - protein, 6 aa, Entamoeba histolytica
ENTSVE

SEQ ID NO: 2618053 - protein, 6 aa, Entamoeba histolytica
ENTTIK

SEQ ID NO: 2618054 - protein, 6 aa, Entamoeba histolytica
ENTTKK

SEQ ID NO: 2618055 - protein, 6 aa, Entamoeba histolytica
ENTTLS

SEQ ID NO: 2618056 - protein, 19 aa, Entamoeba histolytica
ENTTTETDTTEQTKQKKEI

SEQ ID NO: 2618057 - protein, 5 aa, Entamoeba histolytica
ENVAK

SEQ ID NO: 2618058 - protein, 19 aa, Entamoeba histolytica
ENVDSEKVKEANNKLTKDF

SEQ ID NO: 2618059 - protein, 4 aa, Entamoeba histolytica
ENVE

SEQ ID NO: 2618060 - protein, 8 aa, Entamoeba histolytica
ENVKGGDV

SEQ ID NO: 2618061 - protein, 5 aa, Entamoeba histolytica
ENVNN

SEQ ID NO: 2618062 - protein, 9 aa, Entamoeba histolytica
ENVNTHNTF

SEQ ID NO: 2618063 - protein, 5 aa, Entamoeba histolytica
ENVPL

SEQ ID NO: 2618064 - protein, 8 aa, Entamoeba histolytica
ENVPTSIS

SEQ ID NO: 2618065 - protein, 6 aa, Entamoeba histolytica
ENVQEE

SEQ ID NO: 2618066 - protein, 5 aa, Entamoeba histolytica
ENVSE

SEQ ID NO: 2618067 - protein, 13 aa, Entamoeba histolytica
ENVSQGNPTTSSD

SEQ ID NO: 2618068 - protein, 14 aa, Entamoeba histolytica
ENVSQGNPTTSSDT

SEQ ID NO: 2618069 - protein, 4 aa, Entamoeba histolytica
ENVY

SEQ ID NO: 2618070 - protein, 5 aa, Entamoeba histolytica
ENWDN

SEQ ID NO: 2618071 - protein, 6 aa, Entamoeba histolytica
ENWEEN

SEQ ID NO: 2618072 - protein, 14 aa, Entamoeba histolytica
ENWLSSKPRLKEDI

SEQ ID NO: 2618073 - protein, 6 aa, Entamoeba histolytica
ENWNRT

SEQ ID NO: 2618074 - protein, 8 aa, Entamoeba histolytica
ENWPESPL

SEQ ID NO: 2618075 - protein, 5 aa, Entamoeba histolytica
ENWPI

SEQ ID NO: 2618076 - protein, 11 aa, Entamoeba histolytica
ENWSPVEGETN

SEQ ID NO: 2618077 - protein, 4 aa, Entamoeba histolytica
ENYD

SEQ ID NO: 2618078 - protein, 6 aa, Entamoeba histolytica
ENYDEK

SEQ ID NO: 2618079 - protein, 13 aa, Entamoeba histolytica
ENYDVSPKEENEI

SEQ ID NO: 2618080 - protein, 5 aa, Entamoeba histolytica
ENYEC

SEQ ID NO: 2618081 - protein, 7 aa, Entamoeba histolytica
ENYEEEY

SEQ ID NO: 2618082 - protein, 14 aa, Entamoeba histolytica
ENYEVKKSYKATNY

SEQ ID NO: 2618083 - protein, 7 aa, Entamoeba histolytica
ENYNEET

SEQ ID NO: 2618084 - protein, 7 aa, Entamoeba histolytica
ENYPETP

SEQ ID NO: 2618085 - protein, 9 aa, Entamoeba histolytica
ENYPSTTNF

SEQ ID NO: 2618086 - protein, 7 aa, Entamoeba histolytica
ENYPWDS

SEQ ID NO: 2618087 - protein, 8 aa, Entamoeba histolytica
ENYRNDPE

SEQ ID NO: 2618088 - protein, 4 aa, Entamoeba histolytica
ENYS

SEQ ID NO: 2618089 - protein, 19 aa, Entamoeba histolytica
EPAESAVLSGKPKGPHGIQ

SEQ ID NO: 2618090 - protein, 7 aa, Entamoeba histolytica
EPAGSHG

SEQ ID NO: 2618091 - protein, 6 aa, Entamoeba histolytica
EPAGTG

SEQ ID NO: 2618092 - protein, 6 aa, Entamoeba histolytica
EPAKEI

SEQ ID NO: 2618093 - protein, 8 aa, Entamoeba histolytica
EPASSELT

SEQ ID NO: 2618094 - protein, 14 aa, Entamoeba histolytica
EPATTSSADMNPDY

SEQ ID NO: 2618095 - protein, 9 aa, Entamoeba histolytica
EPCGGCGKP

SEQ ID NO: 2618096 - protein, 15 aa, Entamoeba histolytica
EPDGTIKKEGKTLNS

SEQ ID NO: 2618097 - protein, 5 aa, Entamoeba histolytica
EPDKP

SEQ ID NO: 2618098 - protein, 14 aa, Entamoeba histolytica
EPDNGFKLKGDGEY

SEQ ID NO: 2618099 - protein, 5 aa, Entamoeba histolytica
EPDNN

SEQ ID NO: 2618100 - protein, 10 aa, Entamoeba histolytica
EPDPKDTITL

SEQ ID NO: 2618101 - protein, 5 aa, Entamoeba histolytica
EPDSE

SEQ ID NO: 2618102 - protein, 9 aa, Entamoeba histolytica
EPDSSSQSL

SEQ ID NO: 2618103 - protein, 20 aa, Entamoeba histolytica
EPDTGDIINSADEPDTSHDN

SEQ ID NO: 2618104 - protein, 5 aa, Entamoeba histolytica
EPDTT

SEQ ID NO: 2618105 - protein, 7 aa, Entamoeba histolytica
EPDVGKT

SEQ ID NO: 2618106 - protein, 9 aa, Entamoeba histolytica
EPDYESRGK

SEQ ID NO: 2618107 - protein, 7 aa, Entamoeba histolytica
EPEAGDP

SEQ ID NO: 2618108 - protein, 9 aa, Entamoeba histolytica
EPEAKTKYR

SEQ ID NO: 2618109 - protein, 4 aa, Entamoeba histolytica
EPEG

SEQ ID NO: 2618110 - protein, 14 aa, Entamoeba histolytica
EPEGFDKDDNEKVT

SEQ ID NO: 2618111 - protein, 8 aa, Entamoeba histolytica
EPEGSELG

SEQ ID NO: 2618112 - protein, 10 aa, Entamoeba histolytica
EPEQISNTYD

SEQ ID NO: 2618113 - protein, 10 aa, Entamoeba histolytica
EPEQKSYSID

SEQ ID NO: 2618114 - protein, 5 aa, Entamoeba histolytica
EPERT

SEQ ID NO: 2618115 - protein, 10 aa, Entamoeba histolytica
EPETRPTLNE

SEQ ID NO: 2618116 - protein, 12 aa, Entamoeba histolytica
EPETYGDLSPST

SEQ ID NO: 2618117 - protein, 7 aa, Entamoeba histolytica
EPEYEPE

SEQ ID NO: 2618118 - protein, 10 aa, Entamoeba histolytica
EPEYSDASNY

SEQ ID NO: 2618119 - protein, 7 aa, Entamoeba histolytica
EPFEQSQ

SEQ ID NO: 2618120 - protein, 11 aa, Entamoeba histolytica
EPFHSDESNVV

SEQ ID NO: 2618121 - protein, 28 aa, Entamoeba histolytica
EPFNESNDITNSPSSKSTRNEKSLSPPL

SEQ ID NO: 2618122 - protein, 11 aa, Entamoeba histolytica
EPFNHKDENDA

SEQ ID NO: 2618123 - protein, 16 aa, Entamoeba histolytica
EPFNPVASNTPYSPFP

SEQ ID NO: 2618124 - protein, 11 aa, Entamoeba histolytica
EPFNQKDESDA

SEQ ID NO: 2618125 - protein, 8 aa, Entamoeba histolytica
EPFNSGET

SEQ ID NO: 2618126 - protein, 7 aa, Entamoeba histolytica
EPFSTQN

SEQ ID NO: 2618127 - protein, 4 aa, Entamoeba histolytica
EPGE

SEQ ID NO: 2618128 - protein, 5 aa, Entamoeba histolytica
EPGGS

SEQ ID NO: 2618129 - protein, 4 aa, Entamoeba histolytica
EPGH

SEQ ID NO: 2618130 - protein, 6 aa, Entamoeba histolytica
EPGIAK

SEQ ID NO: 2618131 - protein, 4 aa, Entamoeba histolytica
EPGL

SEQ ID NO: 2618132 - protein, 6 aa, Entamoeba histolytica
EPGSCQ

SEQ ID NO: 2618133 - protein, 15 aa, Entamoeba histolytica
EPGSVETHIGNSKAL

SEQ ID NO: 2618134 - protein, 8 aa, Entamoeba histolytica
EPGTNGQH

SEQ ID NO: 2618135 - protein, 4 aa, Entamoeba histolytica
EPGY

SEQ ID NO: 2618136 - protein, 6 aa, Entamoeba histolytica
EPHHSR

SEQ ID NO: 2618137 - protein, 6 aa, Entamoeba histolytica
EPHQGI

SEQ ID NO: 2618138 - protein, 12 aa, Entamoeba histolytica
EPHSIKNENLPI

SEQ ID NO: 2618139 - protein, 62 aa, Entamoeba histolytica
EPIDDDYDGIEKNVKRKQLNPRKPLKGKKKLKKPKETHKISEEKVQDEVQKQEVKDSSQEVI

SEQ ID NO: 2618140 - protein, 9 aa, Entamoeba histolytica
EPIDGQHKL

SEQ ID NO: 2618141 - protein, 7 aa, Entamoeba histolytica
EPIDPTS

SEQ ID NO: 2618142 - protein, 8 aa, Entamoeba histolytica
EPIEEREE

SEQ ID NO: 2618143 - protein, 7 aa, Entamoeba histolytica
EPIEKDD

SEQ ID NO: 2618144 - protein, 11 aa, Entamoeba histolytica
EPIESKKNVVG

SEQ ID NO: 2618145 - protein, 12 aa, Entamoeba histolytica
EPIKEEETNNKE

SEQ ID NO: 2618146 - protein, 57 aa, Entamoeba histolytica
EPIKENDEQPITKKKSYEQGEGTESNDLNKKIEQADQSDYEKQELTRKKQEEEQKRI

SEQ ID NO: 2618147 - protein, 18 aa, Entamoeba histolytica
EPIKREDEERPDDLGYDD

SEQ ID NO: 2618148 - protein, 13 aa, Entamoeba histolytica
EPIKRKPDEDIPI

SEQ ID NO: 2618149 - protein, 5 aa, Entamoeba histolytica
EPILN

SEQ ID NO: 2618150 - protein, 21 aa, Entamoeba histolytica
EPILTTEESNLSNTLPEDEIQ

SEQ ID NO: 2618151 - protein, 33 aa, Entamoeba histolytica
EPINKKDINKRDEEVQEKVTNEDNQEMTEETSS

SEQ ID NO: 2618152 - protein, 6 aa, Entamoeba histolytica
EPIQPS

SEQ ID NO: 2618153 - protein, 9 aa, Entamoeba histolytica
EPIRDPQTL

SEQ ID NO: 2618154 - protein, 5 aa, Entamoeba histolytica
EPIRN

SEQ ID NO: 2618155 - protein, 11 aa, Entamoeba histolytica
EPKCADKNYAE

SEQ ID NO: 2618156 - protein, 8 aa, Entamoeba histolytica
EPKDDIKK

SEQ ID NO: 2618157 - protein, 5 aa, Entamoeba histolytica
EPKED

SEQ ID NO: 2618158 - protein, 7 aa, Entamoeba histolytica
EPKESRE

SEQ ID NO: 2618159 - protein, 6 aa, Entamoeba histolytica
EPKEVK

SEQ ID NO: 2618160 - protein, 4 aa, Entamoeba histolytica
EPKF

SEQ ID NO: 2618161 - protein, 8 aa, Entamoeba histolytica
EPKKKGEL

SEQ ID NO: 2618162 - protein, 10 aa, Entamoeba histolytica
EPKKWNEGKE

SEQ ID NO: 2618163 - protein, 5 aa, Entamoeba histolytica
EPKMG

SEQ ID NO: 2618164 - protein, 13 aa, Entamoeba histolytica
EPKNEEKKESQFK

SEQ ID NO: 2618165 - protein, 11 aa, Entamoeba histolytica
EPKNQTMSNEE

SEQ ID NO: 2618166 - protein, 19 aa, Entamoeba histolytica
EPKNYGFDSNPMYSPSGKK

SEQ ID NO: 2618167 - protein, 4 aa, Entamoeba histolytica
EPKQ

SEQ ID NO: 2618168 - protein, 111 aa, Entamoeba histolytica
EPKQQVDEEPKQQVDEEPKQQVDEEPKQQVDEEPKQQVDEEPKQQVDEEPKQQVDEEPKQQVDEEPKQQVDEEPKQQVDEEPKQQVDEEPKQQVDEEPKQQVDEEPNVRDI

SEQ ID NO: 2618169 - protein, 4 aa, Entamoeba histolytica
EPKR

SEQ ID NO: 2618170 - protein, 8 aa, Entamoeba histolytica
EPKRPRED

SEQ ID NO: 2618171 - protein, 14 aa, Entamoeba histolytica
EPKWEDAQNKNGGR

SEQ ID NO: 2618172 - protein, 6 aa, Entamoeba histolytica
EPKYDE

SEQ ID NO: 2618173 - protein, 4 aa, Entamoeba histolytica
EPLD

SEQ ID NO: 2618174 - protein, 5 aa, Entamoeba histolytica
EPLEE

SEQ ID NO: 2618175 - protein, 8 aa, Entamoeba histolytica
EPLHPTQN

SEQ ID NO: 2618176 - protein, 18 aa, Entamoeba histolytica
EPLIPSGVKKQTTQTTLN

SEQ ID NO: 2618177 - protein, 10 aa, Entamoeba histolytica
EPLKKGDNEA

SEQ ID NO: 2618178 - protein, 15 aa, Entamoeba histolytica
EPLKSLKGKPQGRNE

SEQ ID NO: 2618179 - protein, 9 aa, Entamoeba histolytica
EPLNKTPTT

SEQ ID NO: 2618180 - protein, 10 aa, Entamoeba histolytica
EPLNTQKPET

SEQ ID NO: 2618181 - protein, 8 aa, Entamoeba histolytica
EPLPDEHT

SEQ ID NO: 2618182 - protein, 7 aa, Entamoeba histolytica
EPLPEDV

SEQ ID NO: 2618183 - protein, 6 aa, Entamoeba histolytica
EPLPEN

SEQ ID NO: 2618184 - protein, 5 aa, Entamoeba histolytica
EPLPK

SEQ ID NO: 2618185 - protein, 34 aa, Entamoeba histolytica
EPLPSTNSPRSENEPPGLPVASQNDNIDQTPDIV

SEQ ID NO: 2618186 - protein, 9 aa, Entamoeba histolytica
EPLTEEYSS

SEQ ID NO: 2618187 - protein, 5 aa, Entamoeba histolytica
EPLTQ

SEQ ID NO: 2618188 - protein, 7 aa, Entamoeba histolytica
EPLTTEK

SEQ ID NO: 2618189 - protein, 15 aa, Entamoeba histolytica
EPMNTKNDTMNSSGK

SEQ ID NO: 2618190 - protein, 6 aa, Entamoeba histolytica
EPMQPQ

SEQ ID NO: 2618191 - protein, 4 aa, Entamoeba histolytica
EPMT

SEQ ID NO: 2618192 - protein, 6 aa, Entamoeba histolytica
EPNDQS

SEQ ID NO: 2618193 - protein, 10 aa, Entamoeba histolytica
EPNEESDRRI

SEQ ID NO: 2618194 - protein, 11 aa, Entamoeba histolytica
EPNEQFTDDSD

SEQ ID NO: 2618195 - protein, 8 aa, Entamoeba histolytica
EPNIPDTI

SEQ ID NO: 2618196 - protein, 5 aa, Entamoeba histolytica
EPNIT

SEQ ID NO: 2618197 - protein, 5 aa, Entamoeba histolytica
EPNKL

SEQ ID NO: 2618198 - protein, 8 aa, Entamoeba histolytica
EPNKRIKE

SEQ ID NO: 2618199 - protein, 7 aa, Entamoeba histolytica
EPNLSSA

SEQ ID NO: 2618200 - protein, 49 aa, Entamoeba histolytica
EPNMTSADTIRKEALQKEEEEKRIQEEKEKAEEIRRAEEEQKQYEEEQY

SEQ ID NO: 2618201 - protein, 4 aa, Entamoeba histolytica
EPNN

SEQ ID NO: 2618202 - protein, 9 aa, Entamoeba histolytica
EPNNEGPTI

SEQ ID NO: 2618203 - protein, 4 aa, Entamoeba histolytica
EPNP

SEQ ID NO: 2618204 - protein, 13 aa, Entamoeba histolytica
EPNPSSPANGEAA

SEQ ID NO: 2618205 - protein, 10 aa, Entamoeba histolytica
EPNQKNTEKL

SEQ ID NO: 2618206 - protein, 7 aa, Entamoeba histolytica
EPNSIEH

SEQ ID NO: 2618207 - protein, 7 aa, Entamoeba histolytica
EPNSQRQ

SEQ ID NO: 2618208 - protein, 5 aa, Entamoeba histolytica
EPNTI

SEQ ID NO: 2618209 - protein, 5 aa, Entamoeba histolytica
EPNVR

SEQ ID NO: 2618210 - protein, 7 aa, Entamoeba histolytica
EPNYQNS

SEQ ID NO: 2618211 - protein, 7 aa, Entamoeba histolytica
EPPEPND

SEQ ID NO: 2618212 - protein, 8 aa, Entamoeba histolytica
EPPGQGPL

SEQ ID NO: 2618213 - protein, 5 aa, Entamoeba histolytica
EPPHT

SEQ ID NO: 2618214 - protein, 5 aa, Entamoeba histolytica
EPPKL

SEQ ID NO: 2618215 - protein, 12 aa, Entamoeba histolytica
EPPKTKTTTNMN

SEQ ID NO: 2618216 - protein, 11 aa, Entamoeba histolytica
EPPLTGETPED

SEQ ID NO: 2618217 - protein, 9 aa, Entamoeba histolytica
EPPNEDDLI

SEQ ID NO: 2618218 - protein, 27 aa, Entamoeba histolytica
EPPNLKKSSGWTTRSGRMRKSEEIKEM

SEQ ID NO: 2618219 - protein, 9 aa, Entamoeba histolytica
EPPNNGPLS

SEQ ID NO: 2618220 - protein, 4 aa, Entamoeba histolytica
EPPP

SEQ ID NO: 2618221 - protein, 6 aa, Entamoeba histolytica
EPPPGY

SEQ ID NO: 2618222 - protein, 19 aa, Entamoeba histolytica
EPPPKAEAVQDKSKYDRLD

SEQ ID NO: 2618223 - protein, 8 aa, Entamoeba histolytica
EPPPQDLQ

SEQ ID NO: 2618224 - protein, 10 aa, Entamoeba histolytica
EPPSPKGQKF

SEQ ID NO: 2618225 - protein, 4 aa, Entamoeba histolytica
EPPY

SEQ ID NO: 2618226 - protein, 5 aa, Entamoeba histolytica
EPPYG

SEQ ID NO: 2618227 - protein, 6 aa, Entamoeba histolytica
EPQCGK

SEQ ID NO: 2618228 - protein, 11 aa, Entamoeba histolytica
EPQHKSKKYQY

SEQ ID NO: 2618229 - protein, 4 aa, Entamoeba histolytica
EPQL

SEQ ID NO: 2618230 - protein, 6 aa, Entamoeba histolytica
EPQSMN

SEQ ID NO: 2618231 - protein, 12 aa, Entamoeba histolytica
EPQSSARLRTST

SEQ ID NO: 2618232 - protein, 5 aa, Entamoeba histolytica
EPQTI

SEQ ID NO: 2618233 - protein, 7 aa, Entamoeba histolytica
EPQTTAR

SEQ ID NO: 2618234 - protein, 13 aa, Entamoeba histolytica
EPRNEYMDEKTKR

SEQ ID NO: 2618235 - protein, 25 aa, Entamoeba histolytica
EPRQVTSNQGHLTKPTSQAKVRGLG

SEQ ID NO: 2618236 - protein, 4 aa, Entamoeba histolytica
EPRS

SEQ ID NO: 2618237 - protein, 9 aa, Entamoeba histolytica
EPRSNTVQK

SEQ ID NO: 2618238 - protein, 5 aa, Entamoeba histolytica
EPRYN

SEQ ID NO: 2618239 - protein, 8 aa, Entamoeba histolytica
EPSAKQPH

SEQ ID NO: 2618240 - protein, 5 aa, Entamoeba histolytica
EPSEL

SEQ ID NO: 2618241 - protein, 9 aa, Entamoeba histolytica
EPSFDTKTL

SEQ ID NO: 2618242 - protein, 8 aa, Entamoeba histolytica
EPSKFPSN

SEQ ID NO: 2618243 - protein, 13 aa, Entamoeba histolytica
EPSKRLTDPDQIK

SEQ ID NO: 2618244 - protein, 6 aa, Entamoeba histolytica
EPSKSY

SEQ ID NO: 2618245 - protein, 4 aa, Entamoeba histolytica
EPSP

SEQ ID NO: 2618246 - protein, 6 aa, Entamoeba histolytica
EPSPNL

SEQ ID NO: 2618247 - protein, 13 aa, Entamoeba histolytica
EPSPRRKNLQKRL

SEQ ID NO: 2618248 - protein, 13 aa, Entamoeba histolytica
EPSQIQSLQTQNQ

SEQ ID NO: 2618249 - protein, 21 aa, Entamoeba histolytica
EPSQITKTEIPPTPTKEVTPE

SEQ ID NO: 2618250 - protein, 12 aa, Entamoeba histolytica
EPSQRISLLYLL

SEQ ID NO: 2618251 - protein, 8 aa, Entamoeba histolytica
EPSRQEIA

SEQ ID NO: 2618252 - protein, 8 aa, Entamoeba histolytica
EPSSARKA

SEQ ID NO: 2618253 - protein, 10 aa, Entamoeba histolytica
EPSSYQMSGM

SEQ ID NO: 2618254 - protein, 8 aa, Entamoeba histolytica
EPSTQTPA

SEQ ID NO: 2618255 - protein, 7 aa, Entamoeba histolytica
EPSVGKT

SEQ ID NO: 2618256 - protein, 10 aa, Entamoeba histolytica
EPSVGKTSTI

SEQ ID NO: 2618257 - protein, 5 aa, Entamoeba histolytica
EPSVH

SEQ ID NO: 2618258 - protein, 6 aa, Entamoeba histolytica
EPSYEE

SEQ ID NO: 2618259 - protein, 6 aa, Entamoeba histolytica
EPTAAA

SEQ ID NO: 2618260 - protein, 5 aa, Entamoeba histolytica
EPTDE

SEQ ID NO: 2618261 - protein, 5 aa, Entamoeba histolytica
EPTDF

SEQ ID NO: 2618262 - protein, 9 aa, Entamoeba histolytica
EPTDKISDL

SEQ ID NO: 2618263 - protein, 11 aa, Entamoeba histolytica
EPTDTSSSSNL

SEQ ID NO: 2618264 - protein, 5 aa, Entamoeba histolytica
EPTEL

SEQ ID NO: 2618265 - protein, 6 aa, Entamoeba histolytica
EPTENA

SEQ ID NO: 2618266 - protein, 8 aa, Entamoeba histolytica
EPTEQKNE

SEQ ID NO: 2618267 - protein, 7 aa, Entamoeba histolytica
EPTEQNT

SEQ ID NO: 2618268 - protein, 4 aa, Entamoeba histolytica
EPTG

SEQ ID NO: 2618269 - protein, 11 aa, Entamoeba histolytica
EPTGDLDSYNT

SEQ ID NO: 2618270 - protein, 6 aa, Entamoeba histolytica
EPTKIS

SEQ ID NO: 2618271 - protein, 8 aa, Entamoeba histolytica
EPTLPQVP

SEQ ID NO: 2618272 - protein, 7 aa, Entamoeba histolytica
EPTMPKD

SEQ ID NO: 2618273 - protein, 18 aa, Entamoeba histolytica
EPTNENIKRDSAIVTGAT

SEQ ID NO: 2618274 - protein, 6 aa, Entamoeba histolytica
EPTNTS

SEQ ID NO: 2618275 - protein, 4 aa, Entamoeba histolytica
EPTQ

SEQ ID NO: 2618276 - protein, 5 aa, Entamoeba histolytica
EPTQP

SEQ ID NO: 2618277 - protein, 11 aa, Entamoeba histolytica
EPTQTDCPEMP

SEQ ID NO: 2618278 - protein, 8 aa, Entamoeba histolytica
EPTRDSPL

SEQ ID NO: 2618279 - protein, 4 aa, Entamoeba histolytica
EPTT

SEQ ID NO: 2618280 - protein, 5 aa, Entamoeba histolytica
EPTTM

SEQ ID NO: 2618281 - protein, 5 aa, Entamoeba histolytica
EPTVR

SEQ ID NO: 2618282 - protein, 6 aa, Entamoeba histolytica
EPTYKT

SEQ ID NO: 2618283 - protein, 14 aa, Entamoeba histolytica
EPVKNYKEQGESYL

SEQ ID NO: 2618284 - protein, 4 aa, Entamoeba histolytica
EPYD

SEQ ID NO: 2618285 - protein, 9 aa, Entamoeba histolytica
EPYFEDENE

SEQ ID NO: 2618286 - protein, 9 aa, Entamoeba histolytica
EPYKDISSD

SEQ ID NO: 2618287 - protein, 5 aa, Entamoeba histolytica
EPYKE

SEQ ID NO: 2618288 - protein, 7 aa, Entamoeba histolytica
EPYKSRK

SEQ ID NO: 2618289 - protein, 4 aa, Entamoeba histolytica
EPYY

SEQ ID NO: 2618290 - protein, 5 aa, Entamoeba histolytica
EPYYG

SEQ ID NO: 2618291 - protein, 4 aa, Entamoeba histolytica
EQAE

SEQ ID NO: 2618292 - protein, 8 aa, Entamoeba histolytica
EQAETHEC

SEQ ID NO: 2618293 - protein, 12 aa, Entamoeba histolytica
EQAGSDKYGEES

SEQ ID NO: 2618294 - protein, 8 aa, Entamoeba histolytica
EQAINSPI

SEQ ID NO: 2618295 - protein, 13 aa, Entamoeba histolytica
EQAKERKKREKKD

SEQ ID NO: 2618296 - protein, 5 aa, Entamoeba histolytica
EQALS

SEQ ID NO: 2618297 - protein, 4 aa, Entamoeba histolytica
EQAN

SEQ ID NO: 2618298 - protein, 9 aa, Entamoeba histolytica
EQANTTKEF

SEQ ID NO: 2618299 - protein, 6 aa, Entamoeba histolytica
EQAQTL

SEQ ID NO: 2618300 - protein, 9 aa, Entamoeba histolytica
EQARGDGTS

SEQ ID NO: 2618301 - protein, 7 aa, Entamoeba histolytica
EQASKEM

SEQ ID NO: 2618302 - protein, 4 aa, Entamoeba histolytica
EQDE

SEQ ID NO: 2618303 - protein, 6 aa, Entamoeba histolytica
EQDEKN

SEQ ID NO: 2618304 - protein, 18 aa, Entamoeba histolytica
EQDEYTPEELEELKKKFA

SEQ ID NO: 2618305 - protein, 10 aa, Entamoeba histolytica
EQDGRPSSSD

SEQ ID NO: 2618306 - protein, 13 aa, Entamoeba histolytica
EQDGTYTVQRPND

SEQ ID NO: 2618307 - protein, 5 aa, Entamoeba histolytica
EQDIR

SEQ ID NO: 2618308 - protein, 6 aa, Entamoeba histolytica
EQDKKT

SEQ ID NO: 2618309 - protein, 7 aa, Entamoeba histolytica
EQDKKTL

SEQ ID NO: 2618310 - protein, 7 aa, Entamoeba histolytica
EQDKKTR

SEQ ID NO: 2618311 - protein, 5 aa, Entamoeba histolytica
EQDSE

SEQ ID NO: 2618312 - protein, 14 aa, Entamoeba histolytica
EQDSEEKEEMQESE

SEQ ID NO: 2618313 - protein, 6 aa, Entamoeba histolytica
EQDSEK

SEQ ID NO: 2618314 - protein, 7 aa, Entamoeba histolytica
EQDSLTI

SEQ ID NO: 2618315 - protein, 10 aa, Entamoeba histolytica
EQDTFTDPQK

SEQ ID NO: 2618316 - protein, 5 aa, Entamoeba histolytica
EQDTP

SEQ ID NO: 2618317 - protein, 7 aa, Entamoeba histolytica
EQDWRPS

SEQ ID NO: 2618318 - protein, 5 aa, Entamoeba histolytica
EQDYS

SEQ ID NO: 2618319 - protein, 6 aa, Entamoeba histolytica
EQEDMN

SEQ ID NO: 2618320 - protein, 6 aa, Entamoeba histolytica
EQEEEI

SEQ ID NO: 2618321 - protein, 7 aa, Entamoeba histolytica
EQEEEKL

SEQ ID NO: 2618322 - protein, 5 aa, Entamoeba histolytica
EQEEI

SEQ ID NO: 2618323 - protein, 12 aa, Entamoeba histolytica
EQEEKDKEKYSI

SEQ ID NO: 2618324 - protein, 27 aa, Entamoeba histolytica
EQEEYEKENVNERKNIEINEKEITQPI

SEQ ID NO: 2618325 - protein, 4 aa, Entamoeba histolytica
EQEG

SEQ ID NO: 2618326 - protein, 15 aa, Entamoeba histolytica
EQEGDKEQKKEKQEV

SEQ ID NO: 2618327 - protein, 6 aa, Entamoeba histolytica
EQEGKK

SEQ ID NO: 2618328 - protein, 5 aa, Entamoeba histolytica
EQEGL

SEQ ID NO: 2618329 - protein, 4 aa, Entamoeba histolytica
EQEK

SEQ ID NO: 2618330 - protein, 13 aa, Entamoeba histolytica
EQEMEKEKRDNEL

SEQ ID NO: 2618331 - protein, 5 aa, Entamoeba histolytica
EQEMT

SEQ ID NO: 2618332 - protein, 8 aa, Entamoeba histolytica
EQENDIDE

SEQ ID NO: 2618333 - protein, 5 aa, Entamoeba histolytica
EQENK

SEQ ID NO: 2618334 - protein, 9 aa, Entamoeba histolytica
EQENRPKSG

SEQ ID NO: 2618335 - protein, 7 aa, Entamoeba histolytica
EQENTNY

SEQ ID NO: 2618336 - protein, 13 aa, Entamoeba histolytica
EQEPIPSKYDLIE

SEQ ID NO: 2618337 - protein, 5 aa, Entamoeba histolytica
EQEPK

SEQ ID NO: 2618338 - protein, 5 aa, Entamoeba histolytica
EQEPM

SEQ ID NO: 2618339 - protein, 7 aa, Entamoeba histolytica
EQEQERK

SEQ ID NO: 2618340 - protein, 8 aa, Entamoeba histolytica
EQEQNDLD

SEQ ID NO: 2618341 - protein, 4 aa, Entamoeba histolytica
EQER

SEQ ID NO: 2618342 - protein, 10 aa, Entamoeba histolytica
EQERKTTHHR

SEQ ID NO: 2618343 - protein, 5 aa, Entamoeba histolytica
EQERQ

SEQ ID NO: 2618344 - protein, 7 aa, Entamoeba histolytica
EQERTKR

SEQ ID NO: 2618345 - protein, 4 aa, Entamoeba histolytica
EQES

SEQ ID NO: 2618346 - protein, 10 aa, Entamoeba histolytica
EQESDAKDWK

SEQ ID NO: 2618347 - protein, 8 aa, Entamoeba histolytica
EQESEKDI

SEQ ID NO: 2618348 - protein, 10 aa, Entamoeba histolytica
EQESEKKMTV

SEQ ID NO: 2618349 - protein, 22 aa, Entamoeba histolytica
EQESIEKSANQEGESTSDEDTF

SEQ ID NO: 2618350 - protein, 9 aa, Entamoeba histolytica
EQETEELTK

SEQ ID NO: 2618351 - protein, 9 aa, Entamoeba histolytica
EQETSGSDI

SEQ ID NO: 2618352 - protein, 6 aa, Entamoeba histolytica
EQEYDA

SEQ ID NO: 2618353 - protein, 5 aa, Entamoeba histolytica
EQFER

SEQ ID NO: 2618354 - protein, 6 aa, Entamoeba histolytica
EQFETG

SEQ ID NO: 2618355 - protein, 11 aa, Entamoeba histolytica
EQFGERKSHYD

SEQ ID NO: 2618356 - protein, 4 aa, Entamoeba histolytica
EQFN

SEQ ID NO: 2618357 - protein, 10 aa, Entamoeba histolytica
EQFQRKSAQL

SEQ ID NO: 2618358 - protein, 13 aa, Entamoeba histolytica
EQFRGHNQQDAQE

SEQ ID NO: 2618359 - protein, 4 aa, Entamoeba histolytica
EQGD

SEQ ID NO: 2618360 - protein, 9 aa, Entamoeba histolytica
EQGDDNGGL

SEQ ID NO: 2618361 - protein, 6 aa, Entamoeba histolytica
EQGEYV

SEQ ID NO: 2618362 - protein, 4 aa, Entamoeba histolytica
EQGF

SEQ ID NO: 2618363 - protein, 5 aa, Entamoeba histolytica
EQGID

SEQ ID NO: 2618364 - protein, 6 aa, Entamoeba histolytica
EQGKID

SEQ ID NO: 2618365 - protein, 8 aa, Entamoeba histolytica
EQGKPGLQ

SEQ ID NO: 2618366 - protein, 10 aa, Entamoeba histolytica
EQGKSRWSPV

SEQ ID NO: 2618367 - protein, 8 aa, Entamoeba histolytica
EQGKSVAR

SEQ ID NO: 2618368 - protein, 4 aa, Entamoeba histolytica
EQGM

SEQ ID NO: 2618369 - protein, 6 aa, Entamoeba histolytica
EQGNNI

SEQ ID NO: 2618370 - protein, 8 aa, Entamoeba histolytica
EQGNTNQF

SEQ ID NO: 2618371 - protein, 7 aa, Entamoeba histolytica
EQGVPLQ

SEQ ID NO: 2618372 - protein, 10 aa, Entamoeba histolytica
EQHNNNKSFP

SEQ ID NO: 2618373 - protein, 10 aa, Entamoeba histolytica
EQHQDDIKSI

SEQ ID NO: 2618374 - protein, 4 aa, Entamoeba histolytica
EQID

SEQ ID NO: 2618375 - protein, 35 aa, Entamoeba histolytica
EQIDTNTLNKSSSDEVQIEEHNKENNEINKSSLEQ

SEQ ID NO: 2618376 - protein, 5 aa, Entamoeba histolytica
EQIEE

SEQ ID NO: 2618377 - protein, 6 aa, Entamoeba histolytica
EQIEEI

SEQ ID NO: 2618378 - protein, 6 aa, Entamoeba histolytica
EQIEGL

SEQ ID NO: 2618379 - protein, 8 aa, Entamoeba histolytica
EQIGTPPK

SEQ ID NO: 2618380 - protein, 18 aa, Entamoeba histolytica
EQIKNAKETIGDKSQDEF

SEQ ID NO: 2618381 - protein, 21 aa, Entamoeba histolytica
EQIKQEKEIKENADKKEVKGL

SEQ ID NO: 2618382 - protein, 63 aa, Entamoeba histolytica
EQIKRKEEEIERINKEKKERSEEIKHKEDKYKDLEDKTKKEEKEQAIKEEERNKMKEKVDKEI

SEQ ID NO: 2618383 - protein, 16 aa, Entamoeba histolytica
EQINEKQDKDASLDTQ

SEQ ID NO: 2618384 - protein, 16 aa, Entamoeba histolytica
EQINETKNYRKGDKRA

SEQ ID NO: 2618385 - protein, 10 aa, Entamoeba histolytica
EQIPAKAGNL

SEQ ID NO: 2618386 - protein, 13 aa, Entamoeba histolytica
EQIPRTQNQRKKN

SEQ ID NO: 2618387 - protein, 5 aa, Entamoeba histolytica
EQISN

SEQ ID NO: 2618388 - protein, 10 aa, Entamoeba histolytica
EQISSSYRGK

SEQ ID NO: 2618389 - protein, 7 aa, Entamoeba histolytica
EQITPIS

SEQ ID NO: 2618390 - protein, 12 aa, Entamoeba histolytica
EQKAAAGGSGQG

SEQ ID NO: 2618391 - protein, 5 aa, Entamoeba histolytica
EQKDI

SEQ ID NO: 2618392 - protein, 10 aa, Entamoeba histolytica
EQKEKEITTF

SEQ ID NO: 2618393 - protein, 9 aa, Entamoeba histolytica
EQKEMEEEV

SEQ ID NO: 2618394 - protein, 11 aa, Entamoeba histolytica
EQKENDEKEYY

SEQ ID NO: 2618395 - protein, 8 aa, Entamoeba histolytica
EQKEPTLE

SEQ ID NO: 2618396 - protein, 12 aa, Entamoeba histolytica
EQKEQAKGNTQR

SEQ ID NO: 2618397 - protein, 43 aa, Entamoeba histolytica
EQKEQDIKNKQEQKKRIEEERAAEKKRKEEEEKLKKEQEEMEK

SEQ ID NO: 2618398 - protein, 17 aa, Entamoeba histolytica
EQKGIVDQEKEHNNKIK

SEQ ID NO: 2618399 - protein, 9 aa, Entamoeba histolytica
EQKGKMNEE

SEQ ID NO: 2618400 - protein, 5 aa, Entamoeba histolytica
EQKGV

SEQ ID NO: 2618401 - protein, 12 aa, Entamoeba histolytica
EQKHKRASQKKV

SEQ ID NO: 2618402 - protein, 10 aa, Entamoeba histolytica
EQKKDTTGIT

SEQ ID NO: 2618403 - protein, 28 aa, Entamoeba histolytica
EQKKIEEEQNKQQSHEQNESSKNENNYS

SEQ ID NO: 2618404 - protein, 6 aa, Entamoeba histolytica
EQKKNL

SEQ ID NO: 2618405 - protein, 17 aa, Entamoeba histolytica
EQKKNTQNKAKTRIDKD

SEQ ID NO: 2618406 - protein, 8 aa, Entamoeba histolytica
EQKKRWKD

SEQ ID NO: 2618407 - protein, 24 aa, Entamoeba histolytica
EQKNEDKKRKQQQDEQLKKQLESK

SEQ ID NO: 2618408 - protein, 10 aa, Entamoeba histolytica
EQKNTKLEEL

SEQ ID NO: 2618409 - protein, 5 aa, Entamoeba histolytica
EQKNV

SEQ ID NO: 2618410 - protein, 6 aa, Entamoeba histolytica
EQKPLK

SEQ ID NO: 2618411 - protein, 23 aa, Entamoeba histolytica
EQKPTEEEKTKKKQSKKEQKREM

SEQ ID NO: 2618412 - protein, 8 aa, Entamoeba histolytica
EQKQEHKL

SEQ ID NO: 2618413 - protein, 8 aa, Entamoeba histolytica
EQKQKEEI

SEQ ID NO: 2618414 - protein, 7 aa, Entamoeba histolytica
EQKQKEN

SEQ ID NO: 2618415 - protein, 8 aa, Entamoeba histolytica
EQKQLTPR

SEQ ID NO: 2618416 - protein, 6 aa, Entamoeba histolytica
EQKREF

SEQ ID NO: 2618417 - protein, 11 aa, Entamoeba histolytica
EQKRTAKKDDT

SEQ ID NO: 2618418 - protein, 5 aa, Entamoeba histolytica
EQKSV

SEQ ID NO: 2618419 - protein, 9 aa, Entamoeba histolytica
EQKTEETQF

SEQ ID NO: 2618420 - protein, 9 aa, Entamoeba histolytica
EQKTGNITV

SEQ ID NO: 2618421 - protein, 11 aa, Entamoeba histolytica
EQKTKKEQMND

SEQ ID NO: 2618422 - protein, 8 aa, Entamoeba histolytica
EQKVAEAE

SEQ ID NO: 2618423 - protein, 9 aa, Entamoeba histolytica
EQKVDENQE

SEQ ID NO: 2618424 - protein, 19 aa, Entamoeba histolytica
EQKYDREDVNYSHKEYQKI

SEQ ID NO: 2618425 - protein, 10 aa, Entamoeba histolytica
EQKYKSEGIK

SEQ ID NO: 2618426 - protein, 6 aa, Entamoeba histolytica
EQLAPV

SEQ ID NO: 2618427 - protein, 8 aa, Entamoeba histolytica
EQLDEEEK

SEQ ID NO: 2618428 - protein, 9 aa, Entamoeba histolytica
EQLDKETKG

SEQ ID NO: 2618429 - protein, 25 aa, Entamoeba histolytica
EQLDNQQQEQKPEEQKQEVKETPHL

SEQ ID NO: 2618430 - protein, 11 aa, Entamoeba histolytica
EQLEEENKKLK

SEQ ID NO: 2618431 - protein, 21 aa, Entamoeba histolytica
EQLEKTKAEKDENKNVADQEV

SEQ ID NO: 2618432 - protein, 24 aa, Entamoeba histolytica
EQLEQERTTAANAEAERKKIQAEL

SEQ ID NO: 2618433 - protein, 5 aa, Entamoeba histolytica
EQLES

SEQ ID NO: 2618434 - protein, 23 aa, Entamoeba histolytica
EQLKEENKEEEEDKVEETLKEQG

SEQ ID NO: 2618435 - protein, 6 aa, Entamoeba histolytica
EQLKES

SEQ ID NO: 2618436 - protein, 7 aa, Entamoeba histolytica
EQLKRGN

SEQ ID NO: 2618437 - protein, 9 aa, Entamoeba histolytica
EQLNQNSQQ

SEQ ID NO: 2618438 - protein, 7 aa, Entamoeba histolytica
EQLNSNC

SEQ ID NO: 2618439 - protein, 6 aa, Entamoeba histolytica
EQLPEN

SEQ ID NO: 2618440 - protein, 18 aa, Entamoeba histolytica
EQLQEEEDSEEEDNPDTF

SEQ ID NO: 2618441 - protein, 5 aa, Entamoeba histolytica
EQLSK

SEQ ID NO: 2618442 - protein, 19 aa, Entamoeba histolytica
EQLSKSNSSQKCFSSEKEK

SEQ ID NO: 2618443 - protein, 21 aa, Entamoeba histolytica
EQLTGSIRTSLNDVSDCGGRI

SEQ ID NO: 2618444 - protein, 20 aa, Entamoeba histolytica
EQLTPSPPCTKSPEQQQKAK

SEQ ID NO: 2618445 - protein, 7 aa, Entamoeba histolytica
EQMRTPA

SEQ ID NO: 2618446 - protein, 5 aa, Entamoeba histolytica
EQMSK

SEQ ID NO: 2618447 - protein, 4 aa, Entamoeba histolytica
EQMT

SEQ ID NO: 2618448 - protein, 19 aa, Entamoeba histolytica
EQNAEKSEEIANTQKTLNQ

SEQ ID NO: 2618449 - protein, 4 aa, Entamoeba histolytica
EQNC

SEQ ID NO: 2618450 - protein, 4 aa, Entamoeba histolytica
EQND

SEQ ID NO: 2618451 - protein, 5 aa, Entamoeba histolytica
EQNEH

SEQ ID NO: 2618452 - protein, 8 aa, Entamoeba histolytica
EQNEIPQI

SEQ ID NO: 2618453 - protein, 17 aa, Entamoeba histolytica
EQNEKESEKGESSGIRD

SEQ ID NO: 2618454 - protein, 15 aa, Entamoeba histolytica
EQNELEEREKEEKEL

SEQ ID NO: 2618455 - protein, 6 aa, Entamoeba histolytica
EQNENG

SEQ ID NO: 2618456 - protein, 4 aa, Entamoeba histolytica
EQNG

SEQ ID NO: 2618457 - protein, 11 aa, Entamoeba histolytica
EQNGKSANEYP

SEQ ID NO: 2618458 - protein, 6 aa, Entamoeba histolytica
EQNGYT

SEQ ID NO: 2618459 - protein, 8 aa, Entamoeba histolytica
EQNHSNEQ

SEQ ID NO: 2618460 - protein, 4 aa, Entamoeba histolytica
EQNI

SEQ ID NO: 2618461 - protein, 9 aa, Entamoeba histolytica
EQNKEAIER

SEQ ID NO: 2618462 - protein, 9 aa, Entamoeba histolytica
EQNKEHNQQ

SEQ ID NO: 2618463 - protein, 6 aa, Entamoeba histolytica
EQNKRV

SEQ ID NO: 2618464 - protein, 4 aa, Entamoeba histolytica
EQNL

SEQ ID NO: 2618465 - protein, 7 aa, Entamoeba histolytica
EQNLGKD

SEQ ID NO: 2618466 - protein, 10 aa, Entamoeba histolytica
EQNLSDSISE

SEQ ID NO: 2618467 - protein, 10 aa, Entamoeba histolytica
EQNNDWKSKL

SEQ ID NO: 2618468 - protein, 5 aa, Entamoeba histolytica
EQNNQ

SEQ ID NO: 2618469 - protein, 10 aa, Entamoeba histolytica
EQNQTPQKSL

SEQ ID NO: 2618470 - protein, 6 aa, Entamoeba histolytica
EQNRPG

SEQ ID NO: 2618471 - protein, 5 aa, Entamoeba histolytica
EQNSM

SEQ ID NO: 2618472 - protein, 8 aa, Entamoeba histolytica
EQNSTNEL

SEQ ID NO: 2618473 - protein, 5 aa, Entamoeba histolytica
EQNTQ

SEQ ID NO: 2618474 - protein, 7 aa, Entamoeba histolytica
EQPDLTT

SEQ ID NO: 2618475 - protein, 21 aa, Entamoeba histolytica
EQPINREGMSDKQYNRSKESW

SEQ ID NO: 2618476 - protein, 6 aa, Entamoeba histolytica
EQPISS

SEQ ID NO: 2618477 - protein, 5 aa, Entamoeba histolytica
EQPLL

SEQ ID NO: 2618478 - protein, 11 aa, Entamoeba histolytica
EQPLTGPKRER

SEQ ID NO: 2618479 - protein, 4 aa, Entamoeba histolytica
EQPP

SEQ ID NO: 2618480 - protein, 5 aa, Entamoeba histolytica
EQPPC

SEQ ID NO: 2618481 - protein, 7 aa, Entamoeba histolytica
EQPPTTV

SEQ ID NO: 2618482 - protein, 50 aa, Entamoeba histolytica
EQPQTARTAESKNGIEIEEKYKGKTLKQSTDILNSSSKLKPRRRSRSMAS

SEQ ID NO: 2618483 - protein, 5 aa, Entamoeba histolytica
EQPRE

SEQ ID NO: 2618484 - protein, 38 aa, Entamoeba histolytica
EQPRNGNTTIVPEKKSNTISQQTKTEPILTSQTNTNQN

SEQ ID NO: 2618485 - protein, 14 aa, Entamoeba histolytica
EQPSDTITTLSSST

SEQ ID NO: 2618486 - protein, 14 aa, Entamoeba histolytica
EQPSNTHVELKVCL

SEQ ID NO: 2618487 - protein, 6 aa, Entamoeba histolytica
EQPSPL

SEQ ID NO: 2618488 - protein, 19 aa, Entamoeba histolytica
EQPSQNAQSLTISGGSSSV

SEQ ID NO: 2618489 - protein, 7 aa, Entamoeba histolytica
EQPTNEP

SEQ ID NO: 2618490 - protein, 9 aa, Entamoeba histolytica
EQPTQENNV

SEQ ID NO: 2618491 - protein, 17 aa, Entamoeba histolytica
EQQASKIEGDGEMNSKE

SEQ ID NO: 2618492 - protein, 13 aa, Entamoeba histolytica
EQQDELHRSDLEK

SEQ ID NO: 2618493 - protein, 14 aa, Entamoeba histolytica
EQQDLEAQKTSVTR

SEQ ID NO: 2618494 - protein, 37 aa, Entamoeba histolytica
EQQEDEKKKYEDEIEEQKKNIKIQEENIKEKDDEIEN

SEQ ID NO: 2618495 - protein, 8 aa, Entamoeba histolytica
EQQEEESY

SEQ ID NO: 2618496 - protein, 7 aa, Entamoeba histolytica
EQQEFES

SEQ ID NO: 2618497 - protein, 19 aa, Entamoeba histolytica
EQQETKEEEIQDAATKELV

SEQ ID NO: 2618498 - protein, 6 aa, Entamoeba histolytica
EQQEYK

SEQ ID NO: 2618499 - protein, 8 aa, Entamoeba histolytica
EQQFKEEK

SEQ ID NO: 2618500 - protein, 4 aa, Entamoeba histolytica
EQQK

SEQ ID NO: 2618501 - protein, 38 aa, Entamoeba histolytica
EQQKDDKKENTNPPKTETSSKENKEIIQSSNTNKQINS

SEQ ID NO: 2618502 - protein, 24 aa, Entamoeba histolytica
EQQKEYERQKKDLEDRKKENEERL

SEQ ID NO: 2618503 - protein, 6 aa, Entamoeba histolytica
EQQKQD

SEQ ID NO: 2618504 - protein, 23 aa, Entamoeba histolytica
EQQKQEKKELKSFKRREKRHTIQ

SEQ ID NO: 2618505 - protein, 9 aa, Entamoeba histolytica
EQQKQIESL

SEQ ID NO: 2618506 - protein, 9 aa, Entamoeba histolytica
EQQKTTNEL

SEQ ID NO: 2618507 - protein, 4 aa, Entamoeba histolytica
EQQM

SEQ ID NO: 2618508 - protein, 5 aa, Entamoeba histolytica
EQQNE

SEQ ID NO: 2618509 - protein, 5 aa, Entamoeba histolytica
EQQNK

SEQ ID NO: 2618510 - protein, 4 aa, Entamoeba histolytica
EQQP

SEQ ID NO: 2618511 - protein, 5 aa, Entamoeba histolytica
EQQPE

SEQ ID NO: 2618512 - protein, 8 aa, Entamoeba histolytica
EQQPKENS

SEQ ID NO: 2618513 - protein, 4 aa, Entamoeba histolytica
EQQQ

SEQ ID NO: 2618514 - protein, 13 aa, Entamoeba histolytica
EQQQQQSSSITTN

SEQ ID NO: 2618515 - protein, 12 aa, Entamoeba histolytica
EQQQQSSSITTN

SEQ ID NO: 2618516 - protein, 19 aa, Entamoeba histolytica
EQQRIEKRNERLKEKNEEL

SEQ ID NO: 2618517 - protein, 11 aa, Entamoeba histolytica
EQQRKEKAAMR

SEQ ID NO: 2618518 - protein, 5 aa, Entamoeba histolytica
EQQSF

SEQ ID NO: 2618519 - protein, 6 aa, Entamoeba histolytica
EQQSYL

SEQ ID NO: 2618520 - protein, 10 aa, Entamoeba histolytica
EQQTHKPIKG

SEQ ID NO: 2618521 - protein, 10 aa, Entamoeba histolytica
EQRAQALKEN

SEQ ID NO: 2618522 - protein, 6 aa, Entamoeba histolytica
EQRCRQ

SEQ ID NO: 2618523 - protein, 4 aa, Entamoeba histolytica
EQRD

SEQ ID NO: 2618524 - protein, 6 aa, Entamoeba histolytica
EQRENS

SEQ ID NO: 2618525 - protein, 8 aa, Entamoeba histolytica
EQREVGAV

SEQ ID NO: 2618526 - protein, 17 aa, Entamoeba histolytica
EQRGNIKSQTMSSQEFK

SEQ ID NO: 2618527 - protein, 104 aa, Entamoeba histolytica
EQRGQLKKTGPQRQTPSVTKSSSSTQFAPKSQSYSNPKTTTKTYTSSSTVPKPVHSTNSIQPTTKPSSYKTTYGSVTNSSPRTKLNTNSPFSSQTNEQKKEELK

SEQ ID NO: 2618528 - protein, 5 aa, Entamoeba histolytica
EQRKC

SEQ ID NO: 2618529 - protein, 8 aa, Entamoeba histolytica
EQRKTKTI

SEQ ID NO: 2618530 - protein, 8 aa, Entamoeba histolytica
EQRKTKTV

SEQ ID NO: 2618531 - protein, 5 aa, Entamoeba histolytica
EQRLQ

SEQ ID NO: 2618532 - protein, 5 aa, Entamoeba histolytica
EQRMD

SEQ ID NO: 2618533 - protein, 23 aa, Entamoeba histolytica
EQRNDESSEEDTNDEGGAFFIGD

SEQ ID NO: 2618534 - protein, 5 aa, Entamoeba histolytica
EQRNK

SEQ ID NO: 2618535 - protein, 8 aa, Entamoeba histolytica
EQRREEAQ

SEQ ID NO: 2618536 - protein, 8 aa, Entamoeba histolytica
EQRRKEES

SEQ ID NO: 2618537 - protein, 16 aa, Entamoeba histolytica
EQRRLDDRRDRRDDYH

SEQ ID NO: 2618538 - protein, 6 aa, Entamoeba histolytica
EQRSVV

SEQ ID NO: 2618539 - protein, 6 aa, Entamoeba histolytica
EQRTEM

SEQ ID NO: 2618540 - protein, 11 aa, Entamoeba histolytica
EQRTNTGSMGL

SEQ ID NO: 2618541 - protein, 13 aa, Entamoeba histolytica
EQRVGTEKEGDDF

SEQ ID NO: 2618542 - protein, 4 aa, Entamoeba histolytica
EQRY

SEQ ID NO: 2618543 - protein, 10 aa, Entamoeba histolytica
EQSDEDENIK

SEQ ID NO: 2618544 - protein, 8 aa, Entamoeba histolytica
EQSEITDY

SEQ ID NO: 2618545 - protein, 4 aa, Entamoeba histolytica
EQSF

SEQ ID NO: 2618546 - protein, 5 aa, Entamoeba histolytica
EQSFE

SEQ ID NO: 2618547 - protein, 5 aa, Entamoeba histolytica
EQSFP

SEQ ID NO: 2618548 - protein, 7 aa, Entamoeba histolytica
EQSIAEK

SEQ ID NO: 2618549 - protein, 15 aa, Entamoeba histolytica
EQSIEKPTNDKQTNG

SEQ ID NO: 2618550 - protein, 8 aa, Entamoeba histolytica
EQSIPSPL

SEQ ID NO: 2618551 - protein, 7 aa, Entamoeba histolytica
EQSITKP

SEQ ID NO: 2618552 - protein, 10 aa, Entamoeba histolytica
EQSKPDTREI

SEQ ID NO: 2618553 - protein, 5 aa, Entamoeba histolytica
EQSLS

SEQ ID NO: 2618554 - protein, 8 aa, Entamoeba histolytica
EQSNDYQY

SEQ ID NO: 2618555 - protein, 5 aa, Entamoeba histolytica
EQSNQ

SEQ ID NO: 2618556 - protein, 4 aa, Entamoeba histolytica
EQSP

SEQ ID NO: 2618557 - protein, 4 aa, Entamoeba histolytica
EQSQ

SEQ ID NO: 2618558 - protein, 5 aa, Entamoeba histolytica
EQSRE

SEQ ID NO: 2618559 - protein, 9 aa, Entamoeba histolytica
EQSRRDDME

SEQ ID NO: 2618560 - protein, 8 aa, Entamoeba histolytica
EQSSEEVE

SEQ ID NO: 2618561 - protein, 10 aa, Entamoeba histolytica
EQSSPSDRFD

SEQ ID NO: 2618562 - protein, 12 aa, Entamoeba histolytica
EQSSTENEMPDE

SEQ ID NO: 2618563 - protein, 7 aa, Entamoeba histolytica
EQSSVTR

SEQ ID NO: 2618564 - protein, 8 aa, Entamoeba histolytica
EQSTPFSE

SEQ ID NO: 2618565 - protein, 34 aa, Entamoeba histolytica
EQSTTVKESNKKELDKQKAEEEEKKKKQEQLEAE

SEQ ID NO: 2618566 - protein, 24 aa, Entamoeba histolytica
EQSYDVERAEKKAERRWRKETADV

SEQ ID NO: 2618567 - protein, 10 aa, Entamoeba histolytica
EQTATKYPNK

SEQ ID NO: 2618568 - protein, 5 aa, Entamoeba histolytica
EQTEL

SEQ ID NO: 2618569 - protein, 7 aa, Entamoeba histolytica
EQTENGF

SEQ ID NO: 2618570 - protein, 16 aa, Entamoeba histolytica
EQTENLDEEVKASGFD

SEQ ID NO: 2618571 - protein, 7 aa, Entamoeba histolytica
EQTEQAV

SEQ ID NO: 2618572 - protein, 9 aa, Entamoeba histolytica
EQTESNKQE

SEQ ID NO: 2618573 - protein, 5 aa, Entamoeba histolytica
EQTET

SEQ ID NO: 2618574 - protein, 5 aa, Entamoeba histolytica
EQTGG

SEQ ID NO: 2618575 - protein, 4 aa, Entamoeba histolytica
EQTH

SEQ ID NO: 2618576 - protein, 5 aa, Entamoeba histolytica
EQTIN

SEQ ID NO: 2618577 - protein, 6 aa, Entamoeba histolytica
EQTIPI

SEQ ID NO: 2618578 - protein, 7 aa, Entamoeba histolytica
EQTKIDS

SEQ ID NO: 2618579 - protein, 8 aa, Entamoeba histolytica
EQTKPKRR

SEQ ID NO: 2618580 - protein, 12 aa, Entamoeba histolytica
EQTLEDAKNKWN

SEQ ID NO: 2618581 - protein, 5 aa, Entamoeba histolytica
EQTMK

SEQ ID NO: 2618582 - protein, 10 aa, Entamoeba histolytica
EQTMNEKRTK

SEQ ID NO: 2618583 - protein, 6 aa, Entamoeba histolytica
EQTNEI

SEQ ID NO: 2618584 - protein, 8 aa, Entamoeba histolytica
EQTPSSNC

SEQ ID NO: 2618585 - protein, 6 aa, Entamoeba histolytica
EQTQPE

SEQ ID NO: 2618586 - protein, 12 aa, Entamoeba histolytica
EQTQTVQSTEMG

SEQ ID NO: 2618587 - protein, 13 aa, Entamoeba histolytica
EQTRLRASETKPV

SEQ ID NO: 2618588 - protein, 5 aa, Entamoeba histolytica
EQTTL

SEQ ID NO: 2618589 - protein, 13 aa, Entamoeba histolytica
EQTVDDIENDVSK

SEQ ID NO: 2618590 - protein, 8 aa, Entamoeba histolytica
EQTYDEEI

SEQ ID NO: 2618591 - protein, 7 aa, Entamoeba histolytica
EQVAVSS

SEQ ID NO: 2618592 - protein, 4 aa, Entamoeba histolytica
EQVE

SEQ ID NO: 2618593 - protein, 45 aa, Entamoeba histolytica
EQVEEDFGEQNEDKPKRKKLNERKALKSTKSKKVKKEKTKTTNEV

SEQ ID NO: 2618594 - protein, 9 aa, Entamoeba histolytica
EQVEKDSGL

SEQ ID NO: 2618595 - protein, 6 aa, Entamoeba histolytica
EQVEPN

SEQ ID NO: 2618596 - protein, 9 aa, Entamoeba histolytica
EQVESNEKM

SEQ ID NO: 2618597 - protein, 21 aa, Entamoeba histolytica
EQVKNKKEKPKKPKKKKSREL

SEQ ID NO: 2618598 - protein, 10 aa, Entamoeba histolytica
EQVKPEETTP

SEQ ID NO: 2618599 - protein, 13 aa, Entamoeba histolytica
EQVQKSKEAANRW

SEQ ID NO: 2618600 - protein, 17 aa, Entamoeba histolytica
EQVSSGVRSYEKYSKNK

SEQ ID NO: 2618601 - protein, 10 aa, Entamoeba histolytica
EQWKNAQKTE

SEQ ID NO: 2618602 - protein, 10 aa, Entamoeba histolytica
EQWKRNKPQL

SEQ ID NO: 2618603 - protein, 6 aa, Entamoeba histolytica
EQWKSD

SEQ ID NO: 2618604 - protein, 4 aa, Entamoeba histolytica
EQWT

SEQ ID NO: 2618605 - protein, 9 aa, Entamoeba histolytica
EQWTKASDV

SEQ ID NO: 2618606 - protein, 5 aa, Entamoeba histolytica
EQYDE

SEQ ID NO: 2618607 - protein, 13 aa, Entamoeba histolytica
EQYDEIAKKQAEL

SEQ ID NO: 2618608 - protein, 10 aa, Entamoeba histolytica
EQYDYDTSVR

SEQ ID NO: 2618609 - protein, 10 aa, Entamoeba histolytica
EQYEKEKEEI

SEQ ID NO: 2618610 - protein, 12 aa, Entamoeba histolytica
EQYGDQSISQTS

SEQ ID NO: 2618611 - protein, 14 aa, Entamoeba histolytica
EQYGEKSVSQTSEV

SEQ ID NO: 2618612 - protein, 7 aa, Entamoeba histolytica
EQYLPSK

SEQ ID NO: 2618613 - protein, 8 aa, Entamoeba histolytica
EQYPAEVP

SEQ ID NO: 2618614 - protein, 8 aa, Entamoeba histolytica
EQYPGSEV

SEQ ID NO: 2618615 - protein, 8 aa, Entamoeba histolytica
EQYPPEVT

SEQ ID NO: 2618616 - protein, 5 aa, Entamoeba histolytica
EQYSE

SEQ ID NO: 2618617 - protein, 11 aa, Entamoeba histolytica
ERAAERERKEQ

SEQ ID NO: 2618618 - protein, 8 aa, Entamoeba histolytica
ERADRKEY

SEQ ID NO: 2618619 - protein, 7 aa, Entamoeba histolytica
ERADTAA

SEQ ID NO: 2618620 - protein, 5 aa, Entamoeba histolytica
ERADY

SEQ ID NO: 2618621 - protein, 8 aa, Entamoeba histolytica
ERADYDKD

SEQ ID NO: 2618622 - protein, 18 aa, Entamoeba histolytica
ERAFDQQRRIRNERRFRE

SEQ ID NO: 2618623 - protein, 6 aa, Entamoeba histolytica
ERAGTS

SEQ ID NO: 2618624 - protein, 7 aa, Entamoeba histolytica
ERAHTPA

SEQ ID NO: 2618625 - protein, 6 aa, Entamoeba histolytica
ERAKET

SEQ ID NO: 2618626 - protein, 5 aa, Entamoeba histolytica
ERAKL

SEQ ID NO: 2618627 - protein, 15 aa, Entamoeba histolytica
ERAKRTLSSAATANI

SEQ ID NO: 2618628 - protein, 8 aa, Entamoeba histolytica
ERAQESKV

SEQ ID NO: 2618629 - protein, 48 aa, Entamoeba histolytica
ERAQQRYDEMKRNQEIENKIKEEQRRKKSLEDTKRKRSHSRHSTETQL

SEQ ID NO: 2618630 - protein, 8 aa, Entamoeba histolytica
ERASSDFD

SEQ ID NO: 2618631 - protein, 10 aa, Entamoeba histolytica
ERCKEENRDS

SEQ ID NO: 2618632 - protein, 8 aa, Entamoeba histolytica
ERCPEEDR

SEQ ID NO: 2618633 - protein, 12 aa, Entamoeba histolytica
ERCRTDTPQKDV

SEQ ID NO: 2618634 - protein, 4 aa, Entamoeba histolytica
ERCS

SEQ ID NO: 2618635 - protein, 8 aa, Entamoeba histolytica
ERDDPTYT

SEQ ID NO: 2618636 - protein, 12 aa, Entamoeba histolytica
ERDKIKGVLNYL

SEQ ID NO: 2618637 - protein, 15 aa, Entamoeba histolytica
ERDKQAEAEEKKPIL

SEQ ID NO: 2618638 - protein, 86 aa, Entamoeba histolytica
ERDKVANVEEESEEDKKKPIKKQSTKEKKEKKVAKKDDKKSLKKEVAQKETQKSSSKTEKEVKKPKLTKIEKKKATPKKEAKTKGK

SEQ ID NO: 2618639 - protein, 8 aa, Entamoeba histolytica
ERDLTKRQ

SEQ ID NO: 2618640 - protein, 7 aa, Entamoeba histolytica
ERDNPKF

SEQ ID NO: 2618641 - protein, 13 aa, Entamoeba histolytica
ERDPETYGPSGKE

SEQ ID NO: 2618642 - protein, 7 aa, Entamoeba histolytica
ERDQKGF

SEQ ID NO: 2618643 - protein, 44 aa, Entamoeba histolytica
ERDQTKTRVPVEADDGNMSEEYVEEKQDSESEELEKEESEKEEE

SEQ ID NO: 2618644 - protein, 9 aa, Entamoeba histolytica
ERDRDSKMN

SEQ ID NO: 2618645 - protein, 8 aa, Entamoeba histolytica
ERDRRDRE

SEQ ID NO: 2618646 - protein, 7 aa, Entamoeba histolytica
ERDTSNY

SEQ ID NO: 2618647 - protein, 5 aa, Entamoeba histolytica
EREAI

SEQ ID NO: 2618648 - protein, 10 aa, Entamoeba histolytica
EREANKTGRI

SEQ ID NO: 2618649 - protein, 5 aa, Entamoeba histolytica
EREDD

SEQ ID NO: 2618650 - protein, 14 aa, Entamoeba histolytica
EREDKPKDTNKTVE

SEQ ID NO: 2618651 - protein, 5 aa, Entamoeba histolytica
EREDM

SEQ ID NO: 2618652 - protein, 14 aa, Entamoeba histolytica
EREEIEINQPKRRL

SEQ ID NO: 2618653 - protein, 9 aa, Entamoeba histolytica
EREGNTTGV

SEQ ID NO: 2618654 - protein, 10 aa, Entamoeba histolytica
EREGSIPSGI

SEQ ID NO: 2618655 - protein, 22 aa, Entamoeba histolytica
EREHNEKQLDTKLDKIDDANYE

SEQ ID NO: 2618656 - protein, 5 aa, Entamoeba histolytica
EREIM

SEQ ID NO: 2618657 - protein, 8 aa, Entamoeba histolytica
EREIPSEK

SEQ ID NO: 2618658 - protein, 25 aa, Entamoeba histolytica
EREKGYNKHRQNLKKKYEKKPRRPG

SEQ ID NO: 2618659 - protein, 10 aa, Entamoeba histolytica
EREKIEEDLN

SEQ ID NO: 2618660 - protein, 13 aa, Entamoeba histolytica
EREKIGDAPVYQD

SEQ ID NO: 2618661 - protein, 11 aa, Entamoeba histolytica
EREKKETNECK

SEQ ID NO: 2618662 - protein, 9 aa, Entamoeba histolytica
ERELKKTAM

SEQ ID NO: 2618663 - protein, 9 aa, Entamoeba histolytica
EREMTPEDE

SEQ ID NO: 2618664 - protein, 4 aa, Entamoeba histolytica
EREN

SEQ ID NO: 2618665 - protein, 6 aa, Entamoeba histolytica
ERENEI

SEQ ID NO: 2618666 - protein, 9 aa, Entamoeba histolytica
ERENERDIN

SEQ ID NO: 2618667 - protein, 44 aa, Entamoeba histolytica
ERENGTKLEEETNKQKLESCSRKVDDLQKKEKDCDNKLKTIPDQ

SEQ ID NO: 2618668 - protein, 9 aa, Entamoeba histolytica
ERENNSVLT

SEQ ID NO: 2618669 - protein, 7 aa, Entamoeba histolytica
EREPKVN

SEQ ID NO: 2618670 - protein, 4 aa, Entamoeba histolytica
ERER

SEQ ID NO: 2618671 - protein, 5 aa, Entamoeba histolytica
ERERG

SEQ ID NO: 2618672 - protein, 7 aa, Entamoeba histolytica
ERERKER

SEQ ID NO: 2618673 - protein, 26 aa, Entamoeba histolytica
ERERSNYFNKKTSEEDGYTDDEDFTV

SEQ ID NO: 2618674 - protein, 8 aa, Entamoeba histolytica
ERESIEKK

SEQ ID NO: 2618675 - protein, 7 aa, Entamoeba histolytica
ERESNGL

SEQ ID NO: 2618676 - protein, 5 aa, Entamoeba histolytica
EREYD

SEQ ID NO: 2618677 - protein, 12 aa, Entamoeba histolytica
EREYDRRPHTGQ

SEQ ID NO: 2618678 - protein, 24 aa, Entamoeba histolytica
ERFEEKKMKEEIKESNIPKEKQEM

SEQ ID NO: 2618679 - protein, 8 aa, Entamoeba histolytica
ERFGSENT

SEQ ID NO: 2618680 - protein, 21 aa, Entamoeba histolytica
ERFKEEKEEKMGIATLQYLVN

SEQ ID NO: 2618681 - protein, 9 aa, Entamoeba histolytica
ERFNSQKGE

SEQ ID NO: 2618682 - protein, 10 aa, Entamoeba histolytica
ERGDNNGTTK

SEQ ID NO: 2618683 - protein, 4 aa, Entamoeba histolytica
ERGE

SEQ ID NO: 2618684 - protein, 7 aa, Entamoeba histolytica
ERGELKV

SEQ ID NO: 2618685 - protein, 9 aa, Entamoeba histolytica
ERGENSINE

SEQ ID NO: 2618686 - protein, 5 aa, Entamoeba histolytica
ERGGK

SEQ ID NO: 2618687 - protein, 6 aa, Entamoeba histolytica
ERGGMD

SEQ ID NO: 2618688 - protein, 12 aa, Entamoeba histolytica
ERGISEEQKKLE

SEQ ID NO: 2618689 - protein, 10 aa, Entamoeba histolytica
ERGKAMEKAE

SEQ ID NO: 2618690 - protein, 6 aa, Entamoeba histolytica
ERGNEK

SEQ ID NO: 2618691 - protein, 4 aa, Entamoeba histolytica
ERGR

SEQ ID NO: 2618692 - protein, 7 aa, Entamoeba histolytica
ERGTERY

SEQ ID NO: 2618693 - protein, 9 aa, Entamoeba histolytica
ERGVDSDDE

SEQ ID NO: 2618694 - protein, 9 aa, Entamoeba histolytica
ERHEDPNET

SEQ ID NO: 2618695 - protein, 12 aa, Entamoeba histolytica
ERHTGSGIDPTQ

SEQ ID NO: 2618696 - protein, 10 aa, Entamoeba histolytica
ERIANEYKGG

SEQ ID NO: 2618697 - protein, 13 aa, Entamoeba histolytica
ERIDEDNEENKKY

SEQ ID NO: 2618698 - protein, 6 aa, Entamoeba histolytica
ERIEAK

SEQ ID NO: 2618699 - protein, 18 aa, Entamoeba histolytica
ERIEARSASFGKGGERTA

SEQ ID NO: 2618700 - protein, 6 aa, Entamoeba histolytica
ERIEND

SEQ ID NO: 2618701 - protein, 7 aa, Entamoeba histolytica
ERIEQSN

SEQ ID NO: 2618702 - protein, 10 aa, Entamoeba histolytica
ERIITSKDGR

SEQ ID NO: 2618703 - protein, 7 aa, Entamoeba histolytica
ERINDVK

SEQ ID NO: 2618704 - protein, 7 aa, Entamoeba histolytica
ERINNNK

SEQ ID NO: 2618705 - protein, 5 aa, Entamoeba histolytica
ERIQY

SEQ ID NO: 2618706 - protein, 6 aa, Entamoeba histolytica
ERIRTE

SEQ ID NO: 2618707 - protein, 7 aa, Entamoeba histolytica
ERITNDG

SEQ ID NO: 2618708 - protein, 10 aa, Entamoeba histolytica
ERKDEKGIGE

SEQ ID NO: 2618709 - protein, 7 aa, Entamoeba histolytica
ERKEELE

SEQ ID NO: 2618710 - protein, 10 aa, Entamoeba histolytica
ERKEEQSDDI

SEQ ID NO: 2618711 - protein, 13 aa, Entamoeba histolytica
ERKERQKGSREII

SEQ ID NO: 2618712 - protein, 4 aa, Entamoeba histolytica
ERKF

SEQ ID NO: 2618713 - protein, 8 aa, Entamoeba histolytica
ERKITQPG

SEQ ID NO: 2618714 - protein, 10 aa, Entamoeba histolytica
ERKKEGEWRK

SEQ ID NO: 2618715 - protein, 11 aa, Entamoeba histolytica
ERKKEKLSLEG

SEQ ID NO: 2618716 - protein, 36 aa, Entamoeba histolytica
ERKKKEEEERLRREEEEKRNNESMTANARKEAMGEC

SEQ ID NO: 2618717 - protein, 5 aa, Entamoeba histolytica
ERKKM

SEQ ID NO: 2618718 - protein, 11 aa, Entamoeba histolytica
ERKKRKQMKDQ

SEQ ID NO: 2618719 - protein, 8 aa, Entamoeba histolytica
ERKKSGGL

SEQ ID NO: 2618720 - protein, 8 aa, Entamoeba histolytica
ERKLETQK

SEQ ID NO: 2618721 - protein, 9 aa, Entamoeba histolytica
ERKNNVSPI

SEQ ID NO: 2618722 - protein, 6 aa, Entamoeba histolytica
ERKPPE

SEQ ID NO: 2618723 - protein, 9 aa, Entamoeba histolytica
ERKPPYEDL

SEQ ID NO: 2618724 - protein, 5 aa, Entamoeba histolytica
ERKQE

SEQ ID NO: 2618725 - protein, 8 aa, Entamoeba histolytica
ERKQQDPE

SEQ ID NO: 2618726 - protein, 12 aa, Entamoeba histolytica
ERKRGKLSSQRE

SEQ ID NO: 2618727 - protein, 26 aa, Entamoeba histolytica
ERKRQNDKLKQMEKEKIKDESENYKL

SEQ ID NO: 2618728 - protein, 13 aa, Entamoeba histolytica
ERKRSCEKYQSEW

SEQ ID NO: 2618729 - protein, 41 aa, Entamoeba histolytica
ERKSEEKKDKTEETESTTTSPQKGSIVQTPRGKFSNGKKLE

SEQ ID NO: 2618730 - protein, 7 aa, Entamoeba histolytica
ERKSNKT

SEQ ID NO: 2618731 - protein, 19 aa, Entamoeba histolytica
ERKTEGKEAQLLIEKWKTY

SEQ ID NO: 2618732 - protein, 7 aa, Entamoeba histolytica
ERKTGSI

SEQ ID NO: 2618733 - protein, 17 aa, Entamoeba histolytica
ERKTKKYWSTEQKKLAV

SEQ ID NO: 2618734 - protein, 41 aa, Entamoeba histolytica
ERKTNTTSSSTTTESKEDKKKDESKEKDTKPPRSPRGSLLP

SEQ ID NO: 2618735 - protein, 10 aa, Entamoeba histolytica
ERKTQEKKSV

SEQ ID NO: 2618736 - protein, 12 aa, Entamoeba histolytica
ERKTRKVIKPNS

SEQ ID NO: 2618737 - protein, 13 aa, Entamoeba histolytica
ERKTRNVDRDNKT

SEQ ID NO: 2618738 - protein, 28 aa, Entamoeba histolytica
ERKVPNEISTQIPTENLANGTESESQTE

SEQ ID NO: 2618739 - protein, 7 aa, Entamoeba histolytica
ERKYEKQ

SEQ ID NO: 2618740 - protein, 12 aa, Entamoeba histolytica
ERKYKRNLQRNK

SEQ ID NO: 2618741 - protein, 4 aa, Entamoeba histolytica
ERLD

SEQ ID NO: 2618742 - protein, 5 aa, Entamoeba histolytica
ERLDQ

SEQ ID NO: 2618743 - protein, 8 aa, Entamoeba histolytica
ERLDSQQQ

SEQ ID NO: 2618744 - protein, 7 aa, Entamoeba histolytica
ERLEREK

SEQ ID NO: 2618745 - protein, 12 aa, Entamoeba histolytica
ERLKEYSKQKNV

SEQ ID NO: 2618746 - protein, 9 aa, Entamoeba histolytica
ERLNEPGEI

SEQ ID NO: 2618747 - protein, 10 aa, Entamoeba histolytica
ERLNKSNGII

SEQ ID NO: 2618748 - protein, 11 aa, Entamoeba histolytica
ERLPGNEQYQE

SEQ ID NO: 2618749 - protein, 6 aa, Entamoeba histolytica
ERLPNI

SEQ ID NO: 2618750 - protein, 21 aa, Entamoeba histolytica
ERLQRDTSNNSKTNINSEETL

SEQ ID NO: 2618751 - protein, 18 aa, Entamoeba histolytica
ERLSAKEAMNHPLFQCLS

SEQ ID NO: 2618752 - protein, 18 aa, Entamoeba histolytica
ERLSQTKTLGRRKTTRKS

SEQ ID NO: 2618753 - protein, 9 aa, Entamoeba histolytica
ERLTTSLDT

SEQ ID NO: 2618754 - protein, 4 aa, Entamoeba histolytica
ERMK

SEQ ID NO: 2618755 - protein, 49 aa, Entamoeba histolytica
  misc_feature (15)..(48): Xaa can be any naturally occurring amino acid
ERMKDRKETVRAIAXXXXXXXXXXXXXXXXXXXXXXXXXXXXXXXXXXG

SEQ ID NO: 2618756 - protein, 5 aa, Entamoeba histolytica
ERMME

SEQ ID NO: 2618757 - protein, 4 aa, Entamoeba histolytica
ERMN

SEQ ID NO: 2618758 - protein, 8 aa, Entamoeba histolytica
ERMSQSSY

SEQ ID NO: 2618759 - protein, 4 aa, Entamoeba histolytica
ERNA

SEQ ID NO: 2618760 - protein, 4 aa, Entamoeba histolytica
ERNE

SEQ ID NO: 2618761 - protein, 10 aa, Entamoeba histolytica
ERNEEEEKEY

SEQ ID NO: 2618762 - protein, 4 aa, Entamoeba histolytica
ERNG

SEQ ID NO: 2618763 - protein, 6 aa, Entamoeba histolytica
ERNGEV

SEQ ID NO: 2618764 - protein, 5 aa, Entamoeba histolytica
ERNHP

SEQ ID NO: 2618765 - protein, 14 aa, Entamoeba histolytica
ERNKCSPKKSSRYY

SEQ ID NO: 2618766 - protein, 6 aa, Entamoeba histolytica
ERNKIN

SEQ ID NO: 2618767 - protein, 7 aa, Entamoeba histolytica
ERNNEII

SEQ ID NO: 2618768 - protein, 7 aa, Entamoeba histolytica
ERNNGEK

SEQ ID NO: 2618769 - protein, 8 aa, Entamoeba histolytica
ERNNPNLF

SEQ ID NO: 2618770 - protein, 6 aa, Entamoeba histolytica
ERNNTN

SEQ ID NO: 2618771 - protein, 9 aa, Entamoeba histolytica
ERNPKRSYE

SEQ ID NO: 2618772 - protein, 4 aa, Entamoeba histolytica
ERNR

SEQ ID NO: 2618773 - protein, 6 aa, Entamoeba histolytica
ERNRAE

SEQ ID NO: 2618774 - protein, 11 aa, Entamoeba histolytica
ERNTTSMSDKE

SEQ ID NO: 2618775 - protein, 6 aa, Entamoeba histolytica
ERNYEE

SEQ ID NO: 2618776 - protein, 6 aa, Entamoeba histolytica
ERPAKL

SEQ ID NO: 2618777 - protein, 22 aa, Entamoeba histolytica
ERPEDEKKEEENPEDEKKEEKL

SEQ ID NO: 2618778 - protein, 6 aa, Entamoeba histolytica
ERPKDL

SEQ ID NO: 2618779 - protein, 7 aa, Entamoeba histolytica
ERPKETK

SEQ ID NO: 2618780 - protein, 11 aa, Entamoeba histolytica
ERPKKYGSKSI

SEQ ID NO: 2618781 - protein, 7 aa, Entamoeba histolytica
ERPKYQI

SEQ ID NO: 2618782 - protein, 5 aa, Entamoeba histolytica
ERPLN

SEQ ID NO: 2618783 - protein, 7 aa, Entamoeba histolytica
ERPNSVP

SEQ ID NO: 2618784 - protein, 6 aa, Entamoeba histolytica
ERPQSK

SEQ ID NO: 2618785 - protein, 19 aa, Entamoeba histolytica
ERPTAGARKGKLTIKTTDM

SEQ ID NO: 2618786 - protein, 9 aa, Entamoeba histolytica
ERPTKTRVK

SEQ ID NO: 2618787 - protein, 6 aa, Entamoeba histolytica
ERPTTQ

SEQ ID NO: 2618788 - protein, 5 aa, Entamoeba histolytica
ERPYR

SEQ ID NO: 2618789 - protein, 30 aa, Entamoeba histolytica
ERQDTPNLNETSLQPSLPSKLYTTQRTSIS

SEQ ID NO: 2618790 - protein, 35 aa, Entamoeba histolytica
ERQEEIKKERAEREEAKKKEKREKQEKKEQEERLE

SEQ ID NO: 2618791 - protein, 8 aa, Entamoeba histolytica
ERQETADK

SEQ ID NO: 2618792 - protein, 8 aa, Entamoeba histolytica
ERQGTPDT

SEQ ID NO: 2618793 - protein, 29 aa, Entamoeba histolytica
ERQKEIDRLEEEETKAKIEREKKRAEIER

SEQ ID NO: 2618794 - protein, 5 aa, Entamoeba histolytica
ERQKG

SEQ ID NO: 2618795 - protein, 7 aa, Entamoeba histolytica
ERQKPEV

SEQ ID NO: 2618796 - protein, 10 aa, Entamoeba histolytica
ERQQPKSMRG

SEQ ID NO: 2618797 - protein, 9 aa, Entamoeba histolytica
ERQQSEVNM

SEQ ID NO: 2618798 - protein, 5 aa, Entamoeba histolytica
ERQQV

SEQ ID NO: 2618799 - protein, 4 aa, Entamoeba histolytica
ERQR

SEQ ID NO: 2618800 - protein, 7 aa, Entamoeba histolytica
ERQRPKR

SEQ ID NO: 2618801 - protein, 5 aa, Entamoeba histolytica
ERQTA

SEQ ID NO: 2618802 - protein, 22 aa, Entamoeba histolytica
ERQTTTTKDIKDFKERNAANRA

SEQ ID NO: 2618803 - protein, 7 aa, Entamoeba histolytica
ERQVPPT

SEQ ID NO: 2618804 - protein, 56 aa, Entamoeba histolytica
ERRERYNDRFERRERSYDDYNSHERRREERYEYRNRHEKREEKKGRKEEEVNDKES

SEQ ID NO: 2618805 - protein, 4 aa, Entamoeba histolytica
ERRK

SEQ ID NO: 2618806 - protein, 7 aa, Entamoeba histolytica
ERRKEEI

SEQ ID NO: 2618807 - protein, 9 aa, Entamoeba histolytica
ERRKHSELP

SEQ ID NO: 2618808 - protein, 6 aa, Entamoeba histolytica
ERRKNK

SEQ ID NO: 2618809 - protein, 8 aa, Entamoeba histolytica
ERRNEDFC

SEQ ID NO: 2618810 - protein, 13 aa, Entamoeba histolytica
ERRPSGPRKGQSI

SEQ ID NO: 2618811 - protein, 14 aa, Entamoeba histolytica
ERRPTKSAKKTLQM

SEQ ID NO: 2618812 - protein, 7 aa, Entamoeba histolytica
ERRQREL

SEQ ID NO: 2618813 - protein, 26 aa, Entamoeba histolytica
ERRREEFNKRENLPMANREEKEVEQT

SEQ ID NO: 2618814 - protein, 9 aa, Entamoeba histolytica
ERRRESENK

SEQ ID NO: 2618815 - protein, 35 aa, Entamoeba histolytica
ERRYDRDSRSVSRRRRSDYRSSDYSRERDDRRRYY

SEQ ID NO: 2618816 - protein, 7 aa, Entamoeba histolytica
ERSATKL

SEQ ID NO: 2618817 - protein, 4 aa, Entamoeba histolytica
ERSE

SEQ ID NO: 2618818 - protein, 19 aa, Entamoeba histolytica
ERSEKRMKEIEEEREKSQQ

SEQ ID NO: 2618819 - protein, 10 aa, Entamoeba histolytica
ERSESKEKDL

SEQ ID NO: 2618820 - protein, 10 aa, Entamoeba histolytica
ERSETENLAG

SEQ ID NO: 2618821 - protein, 13 aa, Entamoeba histolytica
ERSGTRISAVNRP

SEQ ID NO: 2618822 - protein, 8 aa, Entamoeba histolytica
ERSHKGDT

SEQ ID NO: 2618823 - protein, 15 aa, Entamoeba histolytica
ERSHSTVSRLPSPKS

SEQ ID NO: 2618824 - protein, 5 aa, Entamoeba histolytica
ERSIP

SEQ ID NO: 2618825 - protein, 7 aa, Entamoeba histolytica
ERSKMRD

SEQ ID NO: 2618826 - protein, 5 aa, Entamoeba histolytica
ERSNI

SEQ ID NO: 2618827 - protein, 29 aa, Entamoeba histolytica
ERSQDNDPISEHVNQSKVENNTDKINQEQ

SEQ ID NO: 2618828 - protein, 7 aa, Entamoeba histolytica
ERSQTVS

SEQ ID NO: 2618829 - protein, 4 aa, Entamoeba histolytica
ERSR

SEQ ID NO: 2618830 - protein, 11 aa, Entamoeba histolytica
ERSSADEPIPI

SEQ ID NO: 2618831 - protein, 4 aa, Entamoeba histolytica
ERST

SEQ ID NO: 2618832 - protein, 14 aa, Entamoeba histolytica
ERSTTFSTRSNDSL

SEQ ID NO: 2618833 - protein, 5 aa, Entamoeba histolytica
ERSYK

SEQ ID NO: 2618834 - protein, 12 aa, Entamoeba histolytica
ERTDTSKDIQAS

SEQ ID NO: 2618835 - protein, 28 aa, Entamoeba histolytica
ERTEGLSDDEKNEMKEQKKNKQEESEDS

SEQ ID NO: 2618836 - protein, 10 aa, Entamoeba histolytica
ERTEKMGTSI

SEQ ID NO: 2618837 - protein, 10 aa, Entamoeba histolytica
ERTETFNGKA

SEQ ID NO: 2618838 - protein, 5 aa, Entamoeba histolytica
ERTIN

SEQ ID NO: 2618839 - protein, 16 aa, Entamoeba histolytica
ERTIPSLRKSSDSLPK

SEQ ID NO: 2618840 - protein, 7 aa, Entamoeba histolytica
ERTKDQF

SEQ ID NO: 2618841 - protein, 9 aa, Entamoeba histolytica
ERTKEEIEN

SEQ ID NO: 2618842 - protein, 23 aa, Entamoeba histolytica
ERTKEMSDTQREKTKAKTAPRRG

SEQ ID NO: 2618843 - protein, 6 aa, Entamoeba histolytica
ERTKGC

SEQ ID NO: 2618844 - protein, 8 aa, Entamoeba histolytica
ERTKMRDD

SEQ ID NO: 2618845 - protein, 7 aa, Entamoeba histolytica
ERTKNAQ

SEQ ID NO: 2618846 - protein, 17 aa, Entamoeba histolytica
ERTNEQNDDLGLNDMVV

SEQ ID NO: 2618847 - protein, 24 aa, Entamoeba histolytica
ERTRNKRNERILNEEEKKGIYSGK

SEQ ID NO: 2618848 - protein, 9 aa, Entamoeba histolytica
ERTSDKLMN

SEQ ID NO: 2618849 - protein, 5 aa, Entamoeba histolytica
ERTSL

SEQ ID NO: 2618850 - protein, 6 aa, Entamoeba histolytica
ERTTKE

SEQ ID NO: 2618851 - protein, 4 aa, Entamoeba histolytica
ERTY

SEQ ID NO: 2618852 - protein, 9 aa, Entamoeba histolytica
ERTYPEDRQ

SEQ ID NO: 2618853 - protein, 7 aa, Entamoeba histolytica
ERVEKSV

SEQ ID NO: 2618854 - protein, 7 aa, Entamoeba histolytica
ERVGEAQ

SEQ ID NO: 2618855 - protein, 14 aa, Entamoeba histolytica
ERVKNIKSTGEERL

SEQ ID NO: 2618856 - protein, 9 aa, Entamoeba histolytica
ERVSPSKDK

SEQ ID NO: 2618857 - protein, 6 aa, Entamoeba histolytica
ERWEEQ

SEQ ID NO: 2618858 - protein, 9 aa, Entamoeba histolytica
ERWEGSPTL

SEQ ID NO: 2618859 - protein, 7 aa, Entamoeba histolytica
ERYDDKK

SEQ ID NO: 2618860 - protein, 8 aa, Entamoeba histolytica
ERYGDEES

SEQ ID NO: 2618861 - protein, 7 aa, Entamoeba histolytica
ERYKNDK

SEQ ID NO: 2618862 - protein, 25 aa, Entamoeba histolytica
ERYKQNKTSDEKLEYPQIKKGPKVN

SEQ ID NO: 2618863 - protein, 5 aa, Entamoeba histolytica
ERYKT

SEQ ID NO: 2618864 - protein, 9 aa, Entamoeba histolytica
ERYLGSSNE

SEQ ID NO: 2618865 - protein, 8 aa, Entamoeba histolytica
ERYNNNGY

SEQ ID NO: 2618866 - protein, 15 aa, Entamoeba histolytica
ERYNQANKNSQQNIE

SEQ ID NO: 2618867 - protein, 8 aa, Entamoeba histolytica
ESAATLQP

SEQ ID NO: 2618868 - protein, 4 aa, Entamoeba histolytica
ESAK

SEQ ID NO: 2618869 - protein, 7 aa, Entamoeba histolytica
ESAKTNV

SEQ ID NO: 2618870 - protein, 15 aa, Entamoeba histolytica
ESAMKGLKEGDKIQI

SEQ ID NO: 2618871 - protein, 8 aa, Entamoeba histolytica
ESAQEQKQ

SEQ ID NO: 2618872 - protein, 5 aa, Entamoeba histolytica
ESCNG

SEQ ID NO: 2618873 - protein, 6 aa, Entamoeba histolytica
ESCNNE

SEQ ID NO: 2618874 - protein, 5 aa, Entamoeba histolytica
ESCRK

SEQ ID NO: 2618875 - protein, 6 aa, Entamoeba histolytica
ESCVSD

SEQ ID NO: 2618876 - protein, 32 aa, Entamoeba histolytica
ESDDAEIDRDNWGKNTDVYYQKKRDKELKNDE

SEQ ID NO: 2618877 - protein, 7 aa, Entamoeba histolytica
ESDDDNE

SEQ ID NO: 2618878 - protein, 18 aa, Entamoeba histolytica
ESDDFEDSEDDKDNEEYD

SEQ ID NO: 2618879 - protein, 10 aa, Entamoeba histolytica
ESDDSSSLTT

SEQ ID NO: 2618880 - protein, 7 aa, Entamoeba histolytica
ESDEEEL

SEQ ID NO: 2618881 - protein, 59 aa, Entamoeba histolytica
ESDEIVSGSEKKEEMSESEIEENIKEEKMSEGESQEDSLQENKSNDKSHMSSNDMSEEN

SEQ ID NO: 2618882 - protein, 8 aa, Entamoeba histolytica
ESDEKPPH

SEQ ID NO: 2618883 - protein, 10 aa, Entamoeba histolytica
ESDETKMSKQ

SEQ ID NO: 2618884 - protein, 12 aa, Entamoeba histolytica
ESDGIQKIQTSN

SEQ ID NO: 2618885 - protein, 46 aa, Entamoeba histolytica
ESDHPTEEQENVGGSDNPTEEQVNSQPNEVPKQESDEDKLPSFGDD

SEQ ID NO: 2618886 - protein, 11 aa, Entamoeba histolytica
ESDHRSSVSSR

SEQ ID NO: 2618887 - protein, 42 aa, Entamoeba histolytica
ESDKCKVETLPRRPTQSIPNKKKMSKEGFEKKKKMTCETKEK

SEQ ID NO: 2618888 - protein, 5 aa, Entamoeba histolytica
ESDKY

SEQ ID NO: 2618889 - protein, 14 aa, Entamoeba histolytica
ESDNGIENENERIS

SEQ ID NO: 2618890 - protein, 7 aa, Entamoeba histolytica
ESDNMSL

SEQ ID NO: 2618891 - protein, 8 aa, Entamoeba histolytica
ESDNNTIK

SEQ ID NO: 2618892 - protein, 10 aa, Entamoeba histolytica
ESDNSSESKR

SEQ ID NO: 2618893 - protein, 5 aa, Entamoeba histolytica
ESDNY

SEQ ID NO: 2618894 - protein, 6 aa, Entamoeba histolytica
ESDPGV

SEQ ID NO: 2618895 - protein, 5 aa, Entamoeba histolytica
ESDPM

SEQ ID NO: 2618896 - protein, 6 aa, Entamoeba histolytica
ESDREM

SEQ ID NO: 2618897 - protein, 6 aa, Entamoeba histolytica
ESDRLK

SEQ ID NO: 2618898 - protein, 8 aa, Entamoeba histolytica
ESDSAGKL

SEQ ID NO: 2618899 - protein, 5 aa, Entamoeba histolytica
ESDTC

SEQ ID NO: 2618900 - protein, 10 aa, Entamoeba histolytica
ESDTTSQPID

SEQ ID NO: 2618901 - protein, 11 aa, Entamoeba histolytica
ESDTVKTRKSQ

SEQ ID NO: 2618902 - protein, 6 aa, Entamoeba histolytica
ESDVSR

SEQ ID NO: 2618903 - protein, 6 aa, Entamoeba histolytica
ESDYVS

SEQ ID NO: 2618904 - protein, 14 aa, Entamoeba histolytica
ESEAGASGAVHGGC

SEQ ID NO: 2618905 - protein, 5 aa, Entamoeba histolytica
ESEAI

SEQ ID NO: 2618906 - protein, 8 aa, Entamoeba histolytica
ESEAVDAS

SEQ ID NO: 2618907 - protein, 4 aa, Entamoeba histolytica
ESEC

SEQ ID NO: 2618908 - protein, 6 aa, Entamoeba histolytica
ESEDEE

SEQ ID NO: 2618909 - protein, 19 aa, Entamoeba histolytica
ESEDENENKQSSSKITQND

SEQ ID NO: 2618910 - protein, 6 aa, Entamoeba histolytica
ESEDYT

SEQ ID NO: 2618911 - protein, 6 aa, Entamoeba histolytica
ESEEDK

SEQ ID NO: 2618912 - protein, 61 aa, Entamoeba histolytica
ESEEEKRQPPTIKEKKYNRQKSIKTPKPIKIPKTKRNKTTDTPKKRQTKTQTEKRNSLTRK

SEQ ID NO: 2618913 - protein, 19 aa, Entamoeba histolytica
ESEENKEIFNSGKSFADEN

SEQ ID NO: 2618914 - protein, 36 aa, Entamoeba histolytica
ESEENSPTNHKTKDNESIESSQSASNGVSNINEKDK

SEQ ID NO: 2618915 - protein, 5 aa, Entamoeba histolytica
ESEEV

SEQ ID NO: 2618916 - protein, 14 aa, Entamoeba histolytica
ESEIPTIAENEEKN

SEQ ID NO: 2618917 - protein, 4 aa, Entamoeba histolytica
ESEK

SEQ ID NO: 2618918 - protein, 10 aa, Entamoeba histolytica
ESEKESLSDD

SEQ ID NO: 2618919 - protein, 8 aa, Entamoeba histolytica
ESEKKDCT

SEQ ID NO: 2618920 - protein, 6 aa, Entamoeba histolytica
ESENAV

SEQ ID NO: 2618921 - protein, 9 aa, Entamoeba histolytica
ESENPSAAQ

SEQ ID NO: 2618922 - protein, 8 aa, Entamoeba histolytica
ESENRQLK

SEQ ID NO: 2618923 - protein, 6 aa, Entamoeba histolytica
ESENYN

SEQ ID NO: 2618924 - protein, 10 aa, Entamoeba histolytica
ESEPYKGNER

SEQ ID NO: 2618925 - protein, 6 aa, Entamoeba histolytica
ESEQVK

SEQ ID NO: 2618926 - protein, 12 aa, Entamoeba histolytica
ESERGQLSTTET

SEQ ID NO: 2618927 - protein, 6 aa, Entamoeba histolytica
ESERPA

SEQ ID NO: 2618928 - protein, 19 aa, Entamoeba histolytica
ESESGVEPSSYEEKASLDN

SEQ ID NO: 2618929 - protein, 16 aa, Entamoeba histolytica
ESESINNNWKNEKESL

SEQ ID NO: 2618930 - protein, 10 aa, Entamoeba histolytica
ESESSQTPHL

SEQ ID NO: 2618931 - protein, 5 aa, Entamoeba histolytica
ESETE

SEQ ID NO: 2618932 - protein, 6 aa, Entamoeba histolytica
ESETEN

SEQ ID NO: 2618933 - protein, 30 aa, Entamoeba histolytica
ESETIENKEENKEEENKEEENEENKEEENV

SEQ ID NO: 2618934 - protein, 29 aa, Entamoeba histolytica
ESETIRKEIQENDVQKNTEVMNKEIKQLI

SEQ ID NO: 2618935 - protein, 7 aa, Entamoeba histolytica
ESETLKN

SEQ ID NO: 2618936 - protein, 5 aa, Entamoeba histolytica
ESETV

SEQ ID NO: 2618937 - protein, 4 aa, Entamoeba histolytica
ESEV

SEQ ID NO: 2618938 - protein, 5 aa, Entamoeba histolytica
ESEYS

SEQ ID NO: 2618939 - protein, 8 aa, Entamoeba histolytica
ESFGPQNT

SEQ ID NO: 2618940 - protein, 4 aa, Entamoeba histolytica
ESFN

SEQ ID NO: 2618941 - protein, 5 aa, Entamoeba histolytica
ESFNE

SEQ ID NO: 2618942 - protein, 4 aa, Entamoeba histolytica
ESFS

SEQ ID NO: 2618943 - protein, 9 aa, Entamoeba histolytica
ESFSSGRLT

SEQ ID NO: 2618944 - protein, 7 aa, Entamoeba histolytica
ESFSSPM

SEQ ID NO: 2618945 - protein, 14 aa, Entamoeba histolytica
ESGDGDYSFEGDKE

SEQ ID NO: 2618946 - protein, 10 aa, Entamoeba histolytica
ESGEDLEKEE

SEQ ID NO: 2618947 - protein, 5 aa, Entamoeba histolytica
ESGEF

SEQ ID NO: 2618948 - protein, 11 aa, Entamoeba histolytica
ESGEIKFTENG

SEQ ID NO: 2618949 - protein, 7 aa, Entamoeba histolytica
ESGEIND

SEQ ID NO: 2618950 - protein, 7 aa, Entamoeba histolytica
ESGFTPE

SEQ ID NO: 2618951 - protein, 12 aa, Entamoeba histolytica
ESGGREQNSNQQ

SEQ ID NO: 2618952 - protein, 5 aa, Entamoeba histolytica
ESGHI

SEQ ID NO: 2618953 - protein, 4 aa, Entamoeba histolytica
ESGI

SEQ ID NO: 2618954 - protein, 7 aa, Entamoeba histolytica
ESGISNV

SEQ ID NO: 2618955 - protein, 6 aa, Entamoeba histolytica
ESGKFN

SEQ ID NO: 2618956 - protein, 7 aa, Entamoeba histolytica
ESGKGLS

SEQ ID NO: 2618957 - protein, 10 aa, Entamoeba histolytica
ESGKIKPING

SEQ ID NO: 2618958 - protein, 18 aa, Entamoeba histolytica
ESGKNIEIDKSKVKSKGK

SEQ ID NO: 2618959 - protein, 6 aa, Entamoeba histolytica
ESGLNT

SEQ ID NO: 2618960 - protein, 11 aa, Entamoeba histolytica
ESGMKGGTTKV

SEQ ID NO: 2618961 - protein, 6 aa, Entamoeba histolytica
ESGNAY

SEQ ID NO: 2618962 - protein, 10 aa, Entamoeba histolytica
ESGNGKSSLG

SEQ ID NO: 2618963 - protein, 7 aa, Entamoeba histolytica
ESGNIRE

SEQ ID NO: 2618964 - protein, 13 aa, Entamoeba histolytica
ESGQLPTSFFSQP

SEQ ID NO: 2618965 - protein, 12 aa, Entamoeba histolytica
ESGRAKSRAAQL

SEQ ID NO: 2618966 - protein, 6 aa, Entamoeba histolytica
ESGREV

SEQ ID NO: 2618967 - protein, 10 aa, Entamoeba histolytica
ESGRHDPLGT

SEQ ID NO: 2618968 - protein, 10 aa, Entamoeba histolytica
ESGSSEYRID

SEQ ID NO: 2618969 - protein, 8 aa, Entamoeba histolytica
ESGTGSGC

SEQ ID NO: 2618970 - protein, 5 aa, Entamoeba histolytica
ESGTS

SEQ ID NO: 2618971 - protein, 4 aa, Entamoeba histolytica
ESHI

SEQ ID NO: 2618972 - protein, 9 aa, Entamoeba histolytica
ESHKTNQTY

SEQ ID NO: 2618973 - protein, 14 aa, Entamoeba histolytica
ESHNPSAKTKAMDT

SEQ ID NO: 2618974 - protein, 7 aa, Entamoeba histolytica
ESHNSNV

SEQ ID NO: 2618975 - protein, 10 aa, Entamoeba histolytica
ESHNTTSINT

SEQ ID NO: 2618976 - protein, 19 aa, Entamoeba histolytica
ESHPGEKLPPDPHKFPGKL

SEQ ID NO: 2618977 - protein, 7 aa, Entamoeba histolytica
ESHPTNI

SEQ ID NO: 2618978 - protein, 4 aa, Entamoeba histolytica
ESHR

SEQ ID NO: 2618979 - protein, 8 aa, Entamoeba histolytica
ESHYGNEQ

SEQ ID NO: 2618980 - protein, 13 aa, Entamoeba histolytica
ESIAKKGEKCEKD

SEQ ID NO: 2618981 - protein, 13 aa, Entamoeba histolytica
ESIDEKEDEITKL

SEQ ID NO: 2618982 - protein, 13 aa, Entamoeba histolytica
ESIDNSNLSQPRL

SEQ ID NO: 2618983 - protein, 9 aa, Entamoeba histolytica
ESIDSSKAI

SEQ ID NO: 2618984 - protein, 17 aa, Entamoeba histolytica
ESIDSSYNNKVNTTTRA

SEQ ID NO: 2618985 - protein, 10 aa, Entamoeba histolytica
ESIEKNNELE

SEQ ID NO: 2618986 - protein, 11 aa, Entamoeba histolytica
ESIEKTEREQL

SEQ ID NO: 2618987 - protein, 8 aa, Entamoeba histolytica
ESIENNEI

SEQ ID NO: 2618988 - protein, 7 aa, Entamoeba histolytica
ESIEQKG

SEQ ID NO: 2618989 - protein, 11 aa, Entamoeba histolytica
ESIESNEEDFE

SEQ ID NO: 2618990 - protein, 6 aa, Entamoeba histolytica
ESIEYD

SEQ ID NO: 2618991 - protein, 16 aa, Entamoeba histolytica
ESIGEDETMQMEEEPI

SEQ ID NO: 2618992 - protein, 30 aa, Entamoeba histolytica
ESIINSKDEELKLKASTNTSNFSGSKEPMI

SEQ ID NO: 2618993 - protein, 9 aa, Entamoeba histolytica
ESIKATTSL

SEQ ID NO: 2618994 - protein, 31 aa, Entamoeba histolytica
ESIKTDKKVEEEKDINLTKQNEKKEEDCSQK

SEQ ID NO: 2618995 - protein, 46 aa, Entamoeba histolytica
ESINENKESFDTFNKEENTIDKPEIQSENKQQIEEGSQTINPKQEI

SEQ ID NO: 2618996 - protein, 7 aa, Entamoeba histolytica
ESINNES

SEQ ID NO: 2618997 - protein, 10 aa, Entamoeba histolytica
ESINNNNTNI

SEQ ID NO: 2618998 - protein, 5 aa, Entamoeba histolytica
ESINT

SEQ ID NO: 2618999 - protein, 7 aa, Entamoeba histolytica
ESIQDTN

SEQ ID NO: 2619000 - protein, 33 aa, Entamoeba histolytica
ESIRRENREKRIDEAEKKKKEEETKPERRKTRP

SEQ ID NO: 2619001 - protein, 25 aa, Entamoeba histolytica
ESISDDDSSFDDVNDTIADDNEEET

SEQ ID NO: 2619002 - protein, 30 aa, Entamoeba histolytica
ESISDDVSEEEICSSDNTSNEDSESSDGEE

SEQ ID NO: 2619003 - protein, 8 aa, Entamoeba histolytica
ESISPQSL

SEQ ID NO: 2619004 - protein, 8 aa, Entamoeba histolytica
ESISQQEY

SEQ ID NO: 2619005 - protein, 6 aa, Entamoeba histolytica
ESISSP

SEQ ID NO: 2619006 - protein, 5 aa, Entamoeba histolytica
ESISV

SEQ ID NO: 2619007 - protein, 7 aa, Entamoeba histolytica
ESITDKD

SEQ ID NO: 2619008 - protein, 5 aa, Entamoeba histolytica
ESIVT

SEQ ID NO: 2619009 - protein, 8 aa, Entamoeba histolytica
ESKAERDS

SEQ ID NO: 2619010 - protein, 11 aa, Entamoeba histolytica
ESKANGGVRRE

SEQ ID NO: 2619011 - protein, 9 aa, Entamoeba histolytica
ESKDEESKQ

SEQ ID NO: 2619012 - protein, 6 aa, Entamoeba histolytica
ESKDKK

SEQ ID NO: 2619013 - protein, 4 aa, Entamoeba histolytica
ESKE

SEQ ID NO: 2619014 - protein, 7 aa, Entamoeba histolytica
ESKEDDM

SEQ ID NO: 2619015 - protein, 15 aa, Entamoeba histolytica
ESKEEDKKNEEDIIK

SEQ ID NO: 2619016 - protein, 17 aa, Entamoeba histolytica
ESKEEIKTEEINKEEIT

SEQ ID NO: 2619017 - protein, 6 aa, Entamoeba histolytica
ESKEEM

SEQ ID NO: 2619018 - protein, 14 aa, Entamoeba histolytica
ESKEGNIPENESNA

SEQ ID NO: 2619019 - protein, 12 aa, Entamoeba histolytica
ESKEHEERKNEE

SEQ ID NO: 2619020 - protein, 7 aa, Entamoeba histolytica
ESKEIRD

SEQ ID NO: 2619021 - protein, 8 aa, Entamoeba histolytica
ESKEKQLE

SEQ ID NO: 2619022 - protein, 5 aa, Entamoeba histolytica
ESKEN

SEQ ID NO: 2619023 - protein, 10 aa, Entamoeba histolytica
ESKESNEKTI

SEQ ID NO: 2619024 - protein, 8 aa, Entamoeba histolytica
ESKETISI

SEQ ID NO: 2619025 - protein, 4 aa, Entamoeba histolytica
ESKF

SEQ ID NO: 2619026 - protein, 5 aa, Entamoeba histolytica
ESKFE

SEQ ID NO: 2619027 - protein, 4 aa, Entamoeba histolytica
ESKG

SEQ ID NO: 2619028 - protein, 9 aa, Entamoeba histolytica
ESKGDEVKK

SEQ ID NO: 2619029 - protein, 10 aa, Entamoeba histolytica
ESKGNKEYSS

SEQ ID NO: 2619030 - protein, 8 aa, Entamoeba histolytica
ESKHSHQN

SEQ ID NO: 2619031 - protein, 4 aa, Entamoeba histolytica
ESKI

SEQ ID NO: 2619032 - protein, 8 aa, Entamoeba histolytica
ESKIGEDY

SEQ ID NO: 2619033 - protein, 12 aa, Entamoeba histolytica
ESKISKEQNQFN

SEQ ID NO: 2619034 - protein, 7 aa, Entamoeba histolytica
ESKISKG

SEQ ID NO: 2619035 - protein, 4 aa, Entamoeba histolytica
ESKK

SEQ ID NO: 2619036 - protein, 9 aa, Entamoeba histolytica
ESKKEINKM

SEQ ID NO: 2619037 - protein, 9 aa, Entamoeba histolytica
ESKKGTQMT

SEQ ID NO: 2619038 - protein, 9 aa, Entamoeba histolytica
ESKKIKNEK

SEQ ID NO: 2619039 - protein, 36 aa, Entamoeba histolytica
ESKKINEMKQKEKDIENTLQPSDNTNLISSQQEIEN

SEQ ID NO: 2619040 - protein, 10 aa, Entamoeba histolytica
ESKKPSSLNC

SEQ ID NO: 2619041 - protein, 6 aa, Entamoeba histolytica
ESKKQM

SEQ ID NO: 2619042 - protein, 8 aa, Entamoeba histolytica
ESKKRINE

SEQ ID NO: 2619043 - protein, 19 aa, Entamoeba histolytica
ESKKTTGNKGNQKETARKI

SEQ ID NO: 2619044 - protein, 4 aa, Entamoeba histolytica
ESKL

SEQ ID NO: 2619045 - protein, 6 aa, Entamoeba histolytica
ESKLGR

SEQ ID NO: 2619046 - protein, 9 aa, Entamoeba histolytica
ESKLKTKIR

SEQ ID NO: 2619047 - protein, 4 aa, Entamoeba histolytica
ESKM

SEQ ID NO: 2619048 - protein, 19 aa, Entamoeba histolytica
ESKMKEKIKDIEKEETEEF

SEQ ID NO: 2619049 - protein, 8 aa, Entamoeba histolytica
ESKNDANE

SEQ ID NO: 2619050 - protein, 15 aa, Entamoeba histolytica
ESKNEKKSIKSKTCY

SEQ ID NO: 2619051 - protein, 10 aa, Entamoeba histolytica
ESKNEPVKTI

SEQ ID NO: 2619052 - protein, 12 aa, Entamoeba histolytica
ESKNGKGVSTNE

SEQ ID NO: 2619053 - protein, 6 aa, Entamoeba histolytica
ESKNRE

SEQ ID NO: 2619054 - protein, 20 aa, Entamoeba histolytica
ESKPIEKKPVESKPIEKKPV

SEQ ID NO: 2619055 - protein, 10 aa, Entamoeba histolytica
ESKPLPTSQV

SEQ ID NO: 2619056 - protein, 7 aa, Entamoeba histolytica
ESKQNDV

SEQ ID NO: 2619057 - protein, 9 aa, Entamoeba histolytica
ESKQQQQEL

SEQ ID NO: 2619058 - protein, 6 aa, Entamoeba histolytica
ESKQVS

SEQ ID NO: 2619059 - protein, 11 aa, Entamoeba histolytica
ESKREEDSIEE

SEQ ID NO: 2619060 - protein, 5 aa, Entamoeba histolytica
ESKRM

SEQ ID NO: 2619061 - protein, 10 aa, Entamoeba histolytica
ESKSGDVKRM

SEQ ID NO: 2619062 - protein, 11 aa, Entamoeba histolytica
ESKSPHRPDGN

SEQ ID NO: 2619063 - protein, 10 aa, Entamoeba histolytica
ESKSQSSKLG

SEQ ID NO: 2619064 - protein, 5 aa, Entamoeba histolytica
ESKTD

SEQ ID NO: 2619065 - protein, 8 aa, Entamoeba histolytica
ESKTGKKC

SEQ ID NO: 2619066 - protein, 6 aa, Entamoeba histolytica
ESKTKM

SEQ ID NO: 2619067 - protein, 9 aa, Entamoeba histolytica
ESKTNQSAM

SEQ ID NO: 2619068 - protein, 9 aa, Entamoeba histolytica
ESKTPNRHS

SEQ ID NO: 2619069 - protein, 6 aa, Entamoeba histolytica
ESLADD

SEQ ID NO: 2619070 - protein, 9 aa, Entamoeba histolytica
ESLDEYTKD

SEQ ID NO: 2619071 - protein, 4 aa, Entamoeba histolytica
ESLE

SEQ ID NO: 2619072 - protein, 5 aa, Entamoeba histolytica
ESLEE

SEQ ID NO: 2619073 - protein, 13 aa, Entamoeba histolytica
ESLENIGYSKITF

SEQ ID NO: 2619074 - protein, 8 aa, Entamoeba histolytica
ESLENPTL

SEQ ID NO: 2619075 - protein, 4 aa, Entamoeba histolytica
ESLH

SEQ ID NO: 2619076 - protein, 48 aa, Entamoeba histolytica
ESLHSSITKSESENKESQGSEVERQKNELENIQEGTTEKLKESVEQEE

SEQ ID NO: 2619077 - protein, 14 aa, Entamoeba histolytica
ESLHYSKEQTTTVI

SEQ ID NO: 2619078 - protein, 30 aa, Entamoeba histolytica
ESLKEENNKIQDELEQKNQELSKVKEEKEK

SEQ ID NO: 2619079 - protein, 6 aa, Entamoeba histolytica
ESLKNK

SEQ ID NO: 2619080 - protein, 16 aa, Entamoeba histolytica
ESLKREKEKISNQKRS

SEQ ID NO: 2619081 - protein, 10 aa, Entamoeba histolytica
ESLKSTNNVL

SEQ ID NO: 2619082 - protein, 4 aa, Entamoeba histolytica
ESLN

SEQ ID NO: 2619083 - protein, 9 aa, Entamoeba histolytica
ESLNDRKKR

SEQ ID NO: 2619084 - protein, 12 aa, Entamoeba histolytica
ESLNEKKSWKTG

SEQ ID NO: 2619085 - protein, 8 aa, Entamoeba histolytica
ESLNEKSR

SEQ ID NO: 2619086 - protein, 10 aa, Entamoeba histolytica
ESLNPSKSTN

SEQ ID NO: 2619087 - protein, 5 aa, Entamoeba histolytica
ESLNS

SEQ ID NO: 2619088 - protein, 7 aa, Entamoeba histolytica
ESLPGDI

SEQ ID NO: 2619089 - protein, 5 aa, Entamoeba histolytica
ESLPR

SEQ ID NO: 2619090 - protein, 9 aa, Entamoeba histolytica
ESLQEKQID

SEQ ID NO: 2619091 - protein, 12 aa, Entamoeba histolytica
ESLQQRTTKIQN

SEQ ID NO: 2619092 - protein, 11 aa, Entamoeba histolytica
ESLQSESITSG

SEQ ID NO: 2619093 - protein, 19 aa, Entamoeba histolytica
ESLSYSPSDFQQEVEDSRI

SEQ ID NO: 2619094 - protein, 4 aa, Entamoeba histolytica
ESLT

SEQ ID NO: 2619095 - protein, 47 aa, Entamoeba histolytica
ESLTEAKENEVTTKDDTEIKDDTEIKDDTEIKDDTEIKDDKKITSQD

SEQ ID NO: 2619096 - protein, 12 aa, Entamoeba histolytica
ESLTTKEKKRCN

SEQ ID NO: 2619097 - protein, 15 aa, Entamoeba histolytica
ESMQIGGESTPEESA

SEQ ID NO: 2619098 - protein, 4 aa, Entamoeba histolytica
ESMY

SEQ ID NO: 2619099 - protein, 5 aa, Entamoeba histolytica
ESNAA

SEQ ID NO: 2619100 - protein, 12 aa, Entamoeba histolytica
ESNAQQNRNTIT

SEQ ID NO: 2619101 - protein, 18 aa, Entamoeba histolytica
ESNDESTWPKPPACLGDD

SEQ ID NO: 2619102 - protein, 37 aa, Entamoeba histolytica
ESNDKEKHTPIQQQNEPKQEEITNETNENTPEEAKEL

SEQ ID NO: 2619103 - protein, 6 aa, Entamoeba histolytica
ESNDSK

SEQ ID NO: 2619104 - protein, 7 aa, Entamoeba histolytica
ESNDYKN

SEQ ID NO: 2619105 - protein, 5 aa, Entamoeba histolytica
ESNEA

SEQ ID NO: 2619106 - protein, 6 aa, Entamoeba histolytica
ESNEAT

SEQ ID NO: 2619107 - protein, 10 aa, Entamoeba histolytica
ESNEGGEETN

SEQ ID NO: 2619108 - protein, 9 aa, Entamoeba histolytica
ESNEKENII

SEQ ID NO: 2619109 - protein, 8 aa, Entamoeba histolytica
ESNENSGQ

SEQ ID NO: 2619110 - protein, 7 aa, Entamoeba histolytica
ESNEPFD

SEQ ID NO: 2619111 - protein, 11 aa, Entamoeba histolytica
ESNGDNDKIES

SEQ ID NO: 2619112 - protein, 13 aa, Entamoeba histolytica
ESNGINSSTLQRE

SEQ ID NO: 2619113 - protein, 10 aa, Entamoeba histolytica
ESNGSNKRQM

SEQ ID NO: 2619114 - protein, 8 aa, Entamoeba histolytica
ESNHGNYN

SEQ ID NO: 2619115 - protein, 5 aa, Entamoeba histolytica
ESNHT

SEQ ID NO: 2619116 - protein, 4 aa, Entamoeba histolytica
ESNI

SEQ ID NO: 2619117 - protein, 8 aa, Entamoeba histolytica
ESNIKQRA

SEQ ID NO: 2619118 - protein, 9 aa, Entamoeba histolytica
ESNKINQIK

SEQ ID NO: 2619119 - protein, 7 aa, Entamoeba histolytica
ESNKISL

SEQ ID NO: 2619120 - protein, 9 aa, Entamoeba histolytica
ESNKKKGLK

SEQ ID NO: 2619121 - protein, 10 aa, Entamoeba histolytica
ESNKKKQEEV

SEQ ID NO: 2619122 - protein, 25 aa, Entamoeba histolytica
ESNKKNGHQIETNTSKFKEITNKDK

SEQ ID NO: 2619123 - protein, 8 aa, Entamoeba histolytica
ESNKPARH

SEQ ID NO: 2619124 - protein, 13 aa, Entamoeba histolytica
ESNKQKENLHNKR

SEQ ID NO: 2619125 - protein, 11 aa, Entamoeba histolytica
ESNMEKENHEY

SEQ ID NO: 2619126 - protein, 9 aa, Entamoeba histolytica
ESNNENVKN

SEQ ID NO: 2619127 - protein, 7 aa, Entamoeba histolytica
ESNNEQN

SEQ ID NO: 2619128 - protein, 8 aa, Entamoeba histolytica
ESNNEQNI

SEQ ID NO: 2619129 - protein, 6 aa, Entamoeba histolytica
ESNNKM

SEQ ID NO: 2619130 - protein, 7 aa, Entamoeba histolytica
ESNNSKF

SEQ ID NO: 2619131 - protein, 4 aa, Entamoeba histolytica
ESNP

SEQ ID NO: 2619132 - protein, 11 aa, Entamoeba histolytica
ESNPLQKLTED

SEQ ID NO: 2619133 - protein, 6 aa, Entamoeba histolytica
ESNPPM

SEQ ID NO: 2619134 - protein, 8 aa, Entamoeba histolytica
ESNPSTVK

SEQ ID NO: 2619135 - protein, 50 aa, Entamoeba histolytica
ESNPTTTQKKEESKQEEQKKEEKKKPKENIKKEESKENIKKEEPKEEHSC

SEQ ID NO: 2619136 - protein, 13 aa, Entamoeba histolytica
ESNQKDETISSNE

SEQ ID NO: 2619137 - protein, 9 aa, Entamoeba histolytica
ESNQQQADK

SEQ ID NO: 2619138 - protein, 7 aa, Entamoeba histolytica
ESNQSDC

SEQ ID NO: 2619139 - protein, 5 aa, Entamoeba histolytica
ESNRS

SEQ ID NO: 2619140 - protein, 5 aa, Entamoeba histolytica
ESNSD

SEQ ID NO: 2619141 - protein, 7 aa, Entamoeba histolytica
ESNSEYK

SEQ ID NO: 2619142 - protein, 9 aa, Entamoeba histolytica
ESNSHSVKK

SEQ ID NO: 2619143 - protein, 16 aa, Entamoeba histolytica
ESNSISMGRNANPEFN

SEQ ID NO: 2619144 - protein, 50 aa, Entamoeba histolytica
ESNSISNEQPQQHQENQEKQISQLQPTKETDQSKEKIEEIKDQSLQTDYK

SEQ ID NO: 2619145 - protein, 6 aa, Entamoeba histolytica
ESNSNI

SEQ ID NO: 2619146 - protein, 5 aa, Entamoeba histolytica
ESNSS

SEQ ID NO: 2619147 - protein, 43 aa, Entamoeba histolytica
ESNSTSPLEELESPSLTPKCKRSYSVSSNGGRTPRSSKKSFCS

SEQ ID NO: 2619148 - protein, 29 aa, Entamoeba histolytica
ESNTIHRKPARPIRPSQSMVSDTDSSESI

SEQ ID NO: 2619149 - protein, 29 aa, Entamoeba histolytica
ESNTIRRKPTRSIRSSQSMVSDTDSSESI

SEQ ID NO: 2619150 - protein, 31 aa, Entamoeba histolytica
ESNTIRRKPTRSIRSSQSMVSDTDSSESIAM

SEQ ID NO: 2619151 - protein, 15 aa, Entamoeba histolytica
ESNTLIPEDSKNFVK

SEQ ID NO: 2619152 - protein, 15 aa, Entamoeba histolytica
ESNVFEQKKEKDAIL

SEQ ID NO: 2619153 - protein, 4 aa, Entamoeba histolytica
ESPC

SEQ ID NO: 2619154 - protein, 7 aa, Entamoeba histolytica
ESPCGSC

SEQ ID NO: 2619155 - protein, 5 aa, Entamoeba histolytica
ESPDF

SEQ ID NO: 2619156 - protein, 14 aa, Entamoeba histolytica
ESPEAIPAGETPQT

SEQ ID NO: 2619157 - protein, 18 aa, Entamoeba histolytica
ESPENSQSETTPKKETLN

SEQ ID NO: 2619158 - protein, 10 aa, Entamoeba histolytica
ESPERPLSTE

SEQ ID NO: 2619159 - protein, 8 aa, Entamoeba histolytica
ESPESSNK

SEQ ID NO: 2619160 - protein, 5 aa, Entamoeba histolytica
ESPFR

SEQ ID NO: 2619161 - protein, 5 aa, Entamoeba histolytica
ESPID

SEQ ID NO: 2619162 - protein, 29 aa, Entamoeba histolytica
ESPISDGTTPKIKKEKKEKKGRKGSIEGN

SEQ ID NO: 2619163 - protein, 7 aa, Entamoeba histolytica
ESPISNS

SEQ ID NO: 2619164 - protein, 8 aa, Entamoeba histolytica
ESPITGKP

SEQ ID NO: 2619165 - protein, 5 aa, Entamoeba histolytica
ESPMK

SEQ ID NO: 2619166 - protein, 8 aa, Entamoeba histolytica
ESPNKERL

SEQ ID NO: 2619167 - protein, 7 aa, Entamoeba histolytica
ESPPIPQ

SEQ ID NO: 2619168 - protein, 5 aa, Entamoeba histolytica
ESPRN

SEQ ID NO: 2619169 - protein, 7 aa, Entamoeba histolytica
ESPSFTE

SEQ ID NO: 2619170 - protein, 13 aa, Entamoeba histolytica
ESPSKEDSSDNEW

SEQ ID NO: 2619171 - protein, 6 aa, Entamoeba histolytica
ESPSQS

SEQ ID NO: 2619172 - protein, 5 aa, Entamoeba histolytica
ESPSV

SEQ ID NO: 2619173 - protein, 7 aa, Entamoeba histolytica
ESPTFEA

SEQ ID NO: 2619174 - protein, 18 aa, Entamoeba histolytica
ESPTISSVTRSEPSTPIS

SEQ ID NO: 2619175 - protein, 8 aa, Entamoeba histolytica
ESPVEITS

SEQ ID NO: 2619176 - protein, 5 aa, Entamoeba histolytica
ESPYK

SEQ ID NO: 2619177 - protein, 11 aa, Entamoeba histolytica
ESPYVGSITPE

SEQ ID NO: 2619178 - protein, 6 aa, Entamoeba histolytica
ESQAQE

SEQ ID NO: 2619179 - protein, 4 aa, Entamoeba histolytica
ESQC

SEQ ID NO: 2619180 - protein, 16 aa, Entamoeba histolytica
ESQEKEFNNETEQKEI

SEQ ID NO: 2619181 - protein, 7 aa, Entamoeba histolytica
ESQEKLD

SEQ ID NO: 2619182 - protein, 7 aa, Entamoeba histolytica
ESQHKRD

SEQ ID NO: 2619183 - protein, 8 aa, Entamoeba histolytica
ESQIEPGV

SEQ ID NO: 2619184 - protein, 7 aa, Entamoeba histolytica
ESQIKNG

SEQ ID NO: 2619185 - protein, 9 aa, Entamoeba histolytica
ESQKEVIEG

SEQ ID NO: 2619186 - protein, 5 aa, Entamoeba histolytica
ESQKI

SEQ ID NO: 2619187 - protein, 5 aa, Entamoeba histolytica
ESQKL

SEQ ID NO: 2619188 - protein, 7 aa, Entamoeba histolytica
ESQLKAA

SEQ ID NO: 2619189 - protein, 5 aa, Entamoeba histolytica
ESQLP

SEQ ID NO: 2619190 - protein, 8 aa, Entamoeba histolytica
ESQNASIR

SEQ ID NO: 2619191 - protein, 7 aa, Entamoeba histolytica
ESQNKQN

SEQ ID NO: 2619192 - protein, 9 aa, Entamoeba histolytica
ESQNKQQKI

SEQ ID NO: 2619193 - protein, 10 aa, Entamoeba histolytica
ESQNKVEDLN

SEQ ID NO: 2619194 - protein, 7 aa, Entamoeba histolytica
ESQPHNT

SEQ ID NO: 2619195 - protein, 5 aa, Entamoeba histolytica
ESQPK

SEQ ID NO: 2619196 - protein, 9 aa, Entamoeba histolytica
ESQPPYKEH

SEQ ID NO: 2619197 - protein, 5 aa, Entamoeba histolytica
ESQPY

SEQ ID NO: 2619198 - protein, 26 aa, Entamoeba histolytica
ESQQKQIETTPNSTIEKSYEKVEDVN

SEQ ID NO: 2619199 - protein, 6 aa, Entamoeba histolytica
ESQRKE

SEQ ID NO: 2619200 - protein, 12 aa, Entamoeba histolytica
ESQRKEWKTSLT

SEQ ID NO: 2619201 - protein, 11 aa, Entamoeba histolytica
ESQSRQKLPSF

SEQ ID NO: 2619202 - protein, 46 aa, Entamoeba histolytica
ESQTQKSLELNTKTNNNSVESIQEPNPSHCEVTSTSSDNLDNQIPP

SEQ ID NO: 2619203 - protein, 4 aa, Entamoeba histolytica
ESQV

SEQ ID NO: 2619204 - protein, 5 aa, Entamoeba histolytica
ESQYE

SEQ ID NO: 2619205 - protein, 9 aa, Entamoeba histolytica
ESRADPNVN

SEQ ID NO: 2619206 - protein, 20 aa, Entamoeba histolytica
ESRAENEKFHRNRTGRTSKV

SEQ ID NO: 2619207 - protein, 12 aa, Entamoeba histolytica
ESRGFDTKEVQS

SEQ ID NO: 2619208 - protein, 4 aa, Entamoeba histolytica
ESRI

SEQ ID NO: 2619209 - protein, 7 aa, Entamoeba histolytica
ESRIDRE

SEQ ID NO: 2619210 - protein, 4 aa, Entamoeba histolytica
ESRK

SEQ ID NO: 2619211 - protein, 10 aa, Entamoeba histolytica
ESRKKQEEAL

SEQ ID NO: 2619212 - protein, 11 aa, Entamoeba histolytica
ESRKKYEESHQ

SEQ ID NO: 2619213 - protein, 7 aa, Entamoeba histolytica
ESRNLTT

SEQ ID NO: 2619214 - protein, 9 aa, Entamoeba histolytica
ESRNRRPAY

SEQ ID NO: 2619215 - protein, 12 aa, Entamoeba histolytica
ESRPKKVSKCNI

SEQ ID NO: 2619216 - protein, 17 aa, Entamoeba histolytica
ESRPNGSFYINTRDPLL

SEQ ID NO: 2619217 - protein, 11 aa, Entamoeba histolytica
ESRQLVGKPTV

SEQ ID NO: 2619218 - protein, 7 aa, Entamoeba histolytica
ESRRERL

SEQ ID NO: 2619219 - protein, 7 aa, Entamoeba histolytica
ESRRSNI

SEQ ID NO: 2619220 - protein, 20 aa, Entamoeba histolytica
ESRSTSAPPQMDRIGSSGEV

SEQ ID NO: 2619221 - protein, 5 aa, Entamoeba histolytica
ESSDE

SEQ ID NO: 2619222 - protein, 9 aa, Entamoeba histolytica
ESSDGDGRM

SEQ ID NO: 2619223 - protein, 8 aa, Entamoeba histolytica
ESSDSGKK

SEQ ID NO: 2619224 - protein, 7 aa, Entamoeba histolytica
ESSDSPC

SEQ ID NO: 2619225 - protein, 10 aa, Entamoeba histolytica
ESSEQPYVAS

SEQ ID NO: 2619226 - protein, 7 aa, Entamoeba histolytica
ESSFEGC

SEQ ID NO: 2619227 - protein, 6 aa, Entamoeba histolytica
ESSFET

SEQ ID NO: 2619228 - protein, 9 aa, Entamoeba histolytica
ESSFGENEK

SEQ ID NO: 2619229 - protein, 7 aa, Entamoeba histolytica
ESSFPKE

SEQ ID NO: 2619230 - protein, 5 aa, Entamoeba histolytica
ESSGA

SEQ ID NO: 2619231 - protein, 5 aa, Entamoeba histolytica
ESSGM

SEQ ID NO: 2619232 - protein, 8 aa, Entamoeba histolytica
ESSGSKEV

SEQ ID NO: 2619233 - protein, 17 aa, Entamoeba histolytica
ESSHVPTLPVTDGLIVS

SEQ ID NO: 2619234 - protein, 5 aa, Entamoeba histolytica
ESSID

SEQ ID NO: 2619235 - protein, 9 aa, Entamoeba histolytica
ESSIEQKTA

SEQ ID NO: 2619236 - protein, 10 aa, Entamoeba histolytica
ESSKGKDDKI

SEQ ID NO: 2619237 - protein, 21 aa, Entamoeba histolytica
ESSKLTPKNFKEDEKDEGCNI

SEQ ID NO: 2619238 - protein, 6 aa, Entamoeba histolytica
ESSKRV

SEQ ID NO: 2619239 - protein, 14 aa, Entamoeba histolytica
ESSKTEEEKSNLQI

SEQ ID NO: 2619240 - protein, 21 aa, Entamoeba histolytica
ESSKTKLSNDLEEKNKTLNGL

SEQ ID NO: 2619241 - protein, 10 aa, Entamoeba histolytica
ESSLEIKKGE

SEQ ID NO: 2619242 - protein, 8 aa, Entamoeba histolytica
ESSNASIR

SEQ ID NO: 2619243 - protein, 8 aa, Entamoeba histolytica
ESSNKKNR

SEQ ID NO: 2619244 - protein, 7 aa, Entamoeba histolytica
ESSNNYE

SEQ ID NO: 2619245 - protein, 10 aa, Entamoeba histolytica
ESSNSVVQGK

SEQ ID NO: 2619246 - protein, 5 aa, Entamoeba histolytica
ESSPI

SEQ ID NO: 2619247 - protein, 12 aa, Entamoeba histolytica
ESSPIISPSNSI

SEQ ID NO: 2619248 - protein, 14 aa, Entamoeba histolytica
ESSPIPLNEEGEEG

SEQ ID NO: 2619249 - protein, 4 aa, Entamoeba histolytica
ESSQ

SEQ ID NO: 2619250 - protein, 21 aa, Entamoeba histolytica
ESSQAEEKEKKPTKRGQRQSI

SEQ ID NO: 2619251 - protein, 18 aa, Entamoeba histolytica
ESSQSNPNNNLKKDNALN

SEQ ID NO: 2619252 - protein, 7 aa, Entamoeba histolytica
ESSQYSQ

SEQ ID NO: 2619253 - protein, 16 aa, Entamoeba histolytica
ESSSCSGNKKSETFNL

SEQ ID NO: 2619254 - protein, 14 aa, Entamoeba histolytica
ESSSEREDKHTPRI

SEQ ID NO: 2619255 - protein, 22 aa, Entamoeba histolytica
ESSSESSETSSGSVNSINDNCD

SEQ ID NO: 2619256 - protein, 9 aa, Entamoeba histolytica
ESSSFDNSV

SEQ ID NO: 2619257 - protein, 5 aa, Entamoeba histolytica
ESSSI

SEQ ID NO: 2619258 - protein, 10 aa, Entamoeba histolytica
ESSTKNVQNF

SEQ ID NO: 2619259 - protein, 10 aa, Entamoeba histolytica
ESSTKRYVPR

SEQ ID NO: 2619260 - protein, 7 aa, Entamoeba histolytica
ESSVGKT

SEQ ID NO: 2619261 - protein, 7 aa, Entamoeba histolytica
ESSVGSI

SEQ ID NO: 2619262 - protein, 13 aa, Entamoeba histolytica
ESSYCPAETDIDQ

SEQ ID NO: 2619263 - protein, 7 aa, Entamoeba histolytica
ESSYKDV

SEQ ID NO: 2619264 - protein, 4 aa, Entamoeba histolytica
ESTA

SEQ ID NO: 2619265 - protein, 5 aa, Entamoeba histolytica
ESTAA

SEQ ID NO: 2619266 - protein, 11 aa, Entamoeba histolytica
ESTASVEVDDA

SEQ ID NO: 2619267 - protein, 5 aa, Entamoeba histolytica
ESTCY

SEQ ID NO: 2619268 - protein, 11 aa, Entamoeba histolytica
ESTDSNSNAPT

SEQ ID NO: 2619269 - protein, 10 aa, Entamoeba histolytica
ESTEANEAPV

SEQ ID NO: 2619270 - protein, 5 aa, Entamoeba histolytica
ESTEE

SEQ ID NO: 2619271 - protein, 6 aa, Entamoeba histolytica
ESTEEQ

SEQ ID NO: 2619272 - protein, 9 aa, Entamoeba histolytica
ESTENREEQ

SEQ ID NO: 2619273 - protein, 4 aa, Entamoeba histolytica
ESTG

SEQ ID NO: 2619274 - protein, 7 aa, Entamoeba histolytica
ESTGECI

SEQ ID NO: 2619275 - protein, 14 aa, Entamoeba histolytica
ESTGKYQNSKHDSV

SEQ ID NO: 2619276 - protein, 4 aa, Entamoeba histolytica
ESTH

SEQ ID NO: 2619277 - protein, 4 aa, Entamoeba histolytica
ESTI

SEQ ID NO: 2619278 - protein, 12 aa, Entamoeba histolytica
ESTIEGEQQSQI

SEQ ID NO: 2619279 - protein, 9 aa, Entamoeba histolytica
ESTKSLNNY

SEQ ID NO: 2619280 - protein, 9 aa, Entamoeba histolytica
ESTKSPAEY

SEQ ID NO: 2619281 - protein, 5 aa, Entamoeba histolytica
ESTKY

SEQ ID NO: 2619282 - protein, 4 aa, Entamoeba histolytica
ESTL

SEQ ID NO: 2619283 - protein, 10 aa, Entamoeba histolytica
ESTLPTDESY

SEQ ID NO: 2619284 - protein, 21 aa, Entamoeba histolytica
ESTMGEFQSTPTTEQHSGIKK

SEQ ID NO: 2619285 - protein, 9 aa, Entamoeba histolytica
ESTNYREET

SEQ ID NO: 2619286 - protein, 4 aa, Entamoeba histolytica
ESTP

SEQ ID NO: 2619287 - protein, 5 aa, Entamoeba histolytica
ESTPE

SEQ ID NO: 2619288 - protein, 8 aa, Entamoeba histolytica
ESTPFEDV

SEQ ID NO: 2619289 - protein, 6 aa, Entamoeba histolytica
ESTPPA

SEQ ID NO: 2619290 - protein, 15 aa, Entamoeba histolytica
ESTPTLYPTQQFNPN

SEQ ID NO: 2619291 - protein, 8 aa, Entamoeba histolytica
ESTQADEP

SEQ ID NO: 2619292 - protein, 5 aa, Entamoeba histolytica
ESTQF

SEQ ID NO: 2619293 - protein, 5 aa, Entamoeba histolytica
ESTQH

SEQ ID NO: 2619294 - protein, 7 aa, Entamoeba histolytica
ESTQPKC

SEQ ID NO: 2619295 - protein, 9 aa, Entamoeba histolytica
ESTQSSNKR

SEQ ID NO: 2619296 - protein, 6 aa, Entamoeba histolytica
ESTRTM

SEQ ID NO: 2619297 - protein, 9 aa, Entamoeba histolytica
ESTRTTGLY

SEQ ID NO: 2619298 - protein, 7 aa, Entamoeba histolytica
ESTSAYD

SEQ ID NO: 2619299 - protein, 14 aa, Entamoeba histolytica
ESTSMTESSSHDRV

SEQ ID NO: 2619300 - protein, 7 aa, Entamoeba histolytica
ESTSNDI

SEQ ID NO: 2619301 - protein, 7 aa, Entamoeba histolytica
ESTTEDG

SEQ ID NO: 2619302 - protein, 12 aa, Entamoeba histolytica
ESTTEPSTQKTH

SEQ ID NO: 2619303 - protein, 7 aa, Entamoeba histolytica
ESTTGIC

SEQ ID NO: 2619304 - protein, 21 aa, Entamoeba histolytica
ESTTSWDGTSLPSYPDGQPKI

SEQ ID NO: 2619305 - protein, 7 aa, Entamoeba histolytica
ESTVESG

SEQ ID NO: 2619306 - protein, 13 aa, Entamoeba histolytica
ESTVSSSNETKVD

SEQ ID NO: 2619307 - protein, 7 aa, Entamoeba histolytica
ESVDKRK

SEQ ID NO: 2619308 - protein, 9 aa, Entamoeba histolytica
ESVDQKTDL

SEQ ID NO: 2619309 - protein, 13 aa, Entamoeba histolytica
ESVDSKSKTSEKP

SEQ ID NO: 2619310 - protein, 7 aa, Entamoeba histolytica
ESVETIK

SEQ ID NO: 2619311 - protein, 9 aa, Entamoeba histolytica
ESVGKDKGI

SEQ ID NO: 2619312 - protein, 9 aa, Entamoeba histolytica
ESVGSTKKV

SEQ ID NO: 2619313 - protein, 21 aa, Entamoeba histolytica
ESVKNAREEAAKAQPAKKVGK

SEQ ID NO: 2619314 - protein, 23 aa, Entamoeba histolytica
ESVKNKYNKLNEEEDNKEERGIV

SEQ ID NO: 2619315 - protein, 10 aa, Entamoeba histolytica
ESVNKKNKEI

SEQ ID NO: 2619316 - protein, 13 aa, Entamoeba histolytica
ESVNNSPSGYEKN

SEQ ID NO: 2619317 - protein, 9 aa, Entamoeba histolytica
ESVQNKTET

SEQ ID NO: 2619318 - protein, 8 aa, Entamoeba histolytica
ESVQREIE

SEQ ID NO: 2619319 - protein, 5 aa, Entamoeba histolytica
ESVRG

SEQ ID NO: 2619320 - protein, 6 aa, Entamoeba histolytica
ESVSKG

SEQ ID NO: 2619321 - protein, 5 aa, Entamoeba histolytica
ESVTK

SEQ ID NO: 2619322 - protein, 15 aa, Entamoeba histolytica
ESVTQTTFKSATENI

SEQ ID NO: 2619323 - protein, 27 aa, Entamoeba histolytica
ESVVEEKNKDKAPKGSVSEKKRKSRNG

SEQ ID NO: 2619324 - protein, 5 aa, Entamoeba histolytica
ESWEK

SEQ ID NO: 2619325 - protein, 5 aa, Entamoeba histolytica
ESYAK

SEQ ID NO: 2619326 - protein, 12 aa, Entamoeba histolytica
ESYARQKYESYI

SEQ ID NO: 2619327 - protein, 7 aa, Entamoeba histolytica
ESYATQY

SEQ ID NO: 2619328 - protein, 4 aa, Entamoeba histolytica
ESYE

SEQ ID NO: 2619329 - protein, 51 aa, Entamoeba histolytica
ESYEKAEQMYQDDKAKAEKEAKKEAEKKRKMEEQERKAKEREAKKKQQEAM

SEQ ID NO: 2619330 - protein, 4 aa, Entamoeba histolytica
ESYL

SEQ ID NO: 2619331 - protein, 9 aa, Entamoeba histolytica
ESYNKSENV

SEQ ID NO: 2619332 - protein, 4 aa, Entamoeba histolytica
ESYP

SEQ ID NO: 2619333 - protein, 11 aa, Entamoeba histolytica
ESYRNNKTLEN

SEQ ID NO: 2619334 - protein, 8 aa, Entamoeba histolytica
ESYSKGSV

SEQ ID NO: 2619335 - protein, 11 aa, Entamoeba histolytica
ESYSQKEEELK

SEQ ID NO: 2619336 - protein, 12 aa, Entamoeba histolytica
ESYTEYNGSHPK

SEQ ID NO: 2619337 - protein, 14 aa, Entamoeba histolytica
ESYTSDSTEETNPK

SEQ ID NO: 2619338 - protein, 7 aa, Entamoeba histolytica
ESYVDSD

SEQ ID NO: 2619339 - protein, 10 aa, Entamoeba histolytica
ETAAQGPLPT

SEQ ID NO: 2619340 - protein, 5 aa, Entamoeba histolytica
ETACS

SEQ ID NO: 2619341 - protein, 4 aa, Entamoeba histolytica
ETAK

SEQ ID NO: 2619342 - protein, 6 aa, Entamoeba histolytica
ETAKID

SEQ ID NO: 2619343 - protein, 23 aa, Entamoeba histolytica
ETAKRIKETIENESQKKKRITPQ

SEQ ID NO: 2619344 - protein, 5 aa, Entamoeba histolytica
ETANE

SEQ ID NO: 2619345 - protein, 9 aa, Entamoeba histolytica
ETANQEGTH

SEQ ID NO: 2619346 - protein, 9 aa, Entamoeba histolytica
ETAQKSGYY

SEQ ID NO: 2619347 - protein, 10 aa, Entamoeba histolytica
ETAQNEITTQ

SEQ ID NO: 2619348 - protein, 15 aa, Entamoeba histolytica
ETAQQQTIAPAKEEM

SEQ ID NO: 2619349 - protein, 30 aa, Entamoeba histolytica; identical to SEQ ID NO: 2557571

SEQ ID NO: 2619350 - protein, 8 aa, Entamoeba histolytica
ETAYNSGE

SEQ ID NO: 2619351 - protein, 11 aa, Entamoeba histolytica
ETCDGKKIYKQ

SEQ ID NO: 2619352 - protein, 15 aa, Entamoeba histolytica
ETCESRENEINPKTL

SEQ ID NO: 2619353 - protein, 7 aa, Entamoeba histolytica
ETCEYTG

SEQ ID NO: 2619354 - protein, 9 aa, Entamoeba histolytica
ETCQSSKDI

SEQ ID NO: 2619355 - protein, 9 aa, Entamoeba histolytica
ETCRGNSLP

SEQ ID NO: 2619356 - protein, 4 aa, Entamoeba histolytica
ETCV

SEQ ID NO: 2619357 - protein, 10 aa, Entamoeba histolytica
ETDEGDDAME

SEQ ID NO: 2619358 - protein, 9 aa, Entamoeba histolytica
ETDEIEPEM

SEQ ID NO: 2619359 - protein, 5 aa, Entamoeba histolytica
ETDEK

SEQ ID NO: 2619360 - protein, 6 aa, Entamoeba histolytica
ETDEVE

SEQ ID NO: 2619361 - protein, 5 aa, Entamoeba histolytica
ETDKD

SEQ ID NO: 2619362 - protein, 17 aa, Entamoeba histolytica
ETDKENEEDKGYNDYND

SEQ ID NO: 2619363 - protein, 7 aa, Entamoeba histolytica
ETDKGVE

SEQ ID NO: 2619364 - protein, 4 aa, Entamoeba histolytica
ETDL

SEQ ID NO: 2619365 - protein, 5 aa, Entamoeba histolytica
ETDLP

SEQ ID NO: 2619366 - protein, 7 aa, Entamoeba histolytica
ETDMDER

SEQ ID NO: 2619367 - protein, 7 aa, Entamoeba histolytica
ETDMEEK

SEQ ID NO: 2619368 - protein, 4 aa, Entamoeba histolytica
ETDN

SEQ ID NO: 2619369 - protein, 7 aa, Entamoeba histolytica
ETDNEFE

SEQ ID NO: 2619370 - protein, 6 aa, Entamoeba histolytica
ETDPQT

SEQ ID NO: 2619371 - protein, 15 aa, Entamoeba histolytica
ETDPWDEEEKPNNGT

SEQ ID NO: 2619372 - protein, 24 aa, Entamoeba histolytica
ETDQFQSNPPSSDSSKSKESTKPF

SEQ ID NO: 2619373 - protein, 7 aa, Entamoeba histolytica
ETDQPFK

SEQ ID NO: 2619374 - protein, 6 aa, Entamoeba histolytica
ETDREI

SEQ ID NO: 2619375 - protein, 4 aa, Entamoeba histolytica
ETDS

SEQ ID NO: 2619376 - protein, 10 aa, Entamoeba histolytica
ETDSDDENDI

SEQ ID NO: 2619377 - protein, 10 aa, Entamoeba histolytica
ETDTKKKQQL

SEQ ID NO: 2619378 - protein, 4 aa, Entamoeba histolytica
ETDV

SEQ ID NO: 2619379 - protein, 4 aa, Entamoeba histolytica
ETDY

SEQ ID NO: 2619380 - protein, 11 aa, Entamoeba histolytica
ETEAKNYSNQF

SEQ ID NO: 2619381 - protein, 6 aa, Entamoeba histolytica
ETEAPL

SEQ ID NO: 2619382 - protein, 14 aa, Entamoeba histolytica
ETEAQRIANQTEEV

SEQ ID NO: 2619383 - protein, 26 aa, Entamoeba histolytica
ETEDAREFHSQNQNRIRKQGLKGKLD

SEQ ID NO: 2619384 - protein, 10 aa, Entamoeba histolytica
ETEDDKEKNK

SEQ ID NO: 2619385 - protein, 5 aa, Entamoeba histolytica
ETEDN

SEQ ID NO: 2619386 - protein, 8 aa, Entamoeba histolytica
ETEDQVSH

SEQ ID NO: 2619387 - protein, 36 aa, Entamoeba histolytica
ETEEAQNNEIMNDTLPIKKKRKEKNIKRKKKNKLKN

SEQ ID NO: 2619388 - protein, 19 aa, Entamoeba histolytica
ETEEDAKKAVAANGVEFEG

SEQ ID NO: 2619389 - protein, 7 aa, Entamoeba histolytica
ETEEEKK

SEQ ID NO: 2619390 - protein, 12 aa, Entamoeba histolytica
ETEEETNKALAA

SEQ ID NO: 2619391 - protein, 7 aa, Entamoeba histolytica
ETEEKSL

SEQ ID NO: 2619392 - protein, 28 aa, Entamoeba histolytica
ETEENKPNQKEETTEEQQPQQITEEQNQ

SEQ ID NO: 2619393 - protein, 44 aa, Entamoeba histolytica
ETEETETSDELSKSVKKEEGIVGEPPTQIESEGTKESEKDNKVI

SEQ ID NO: 2619394 - protein, 5 aa, Entamoeba histolytica
ETEEV

SEQ ID NO: 2619395 - protein, 5 aa, Entamoeba histolytica
ETEGK

SEQ ID NO: 2619396 - protein, 4 aa, Entamoeba histolytica
ETEI

SEQ ID NO: 2619397 - protein, 7 aa, Entamoeba histolytica
ETEIGNE

SEQ ID NO: 2619398 - protein, 14 aa, Entamoeba histolytica
ETEIQSTYGDEERA

SEQ ID NO: 2619399 - protein, 4 aa, Entamoeba histolytica
ETEK

SEQ ID NO: 2619400 - protein, 13 aa, Entamoeba histolytica
ETEKAGQSQKSIE

SEQ ID NO: 2619401 - protein, 16 aa, Entamoeba histolytica
ETEKATGTSDLEEKHD

SEQ ID NO: 2619402 - protein, 9 aa, Entamoeba histolytica
ETEKDSIQN

SEQ ID NO: 2619403 - protein, 10 aa, Entamoeba histolytica
ETEKNLPQIS

SEQ ID NO: 2619404 - protein, 20 aa, Entamoeba histolytica
ETEKTVKQNNDENIEETDTI

SEQ ID NO: 2619405 - protein, 11 aa, Entamoeba histolytica
ETELENKQEKY

SEQ ID NO: 2619406 - protein, 6 aa, Entamoeba histolytica
ETELPA

SEQ ID NO: 2619407 - protein, 4 aa, Entamoeba histolytica
ETEM

SEQ ID NO: 2619408 - protein, 9 aa, Entamoeba histolytica
ETENGEQER

SEQ ID NO: 2619409 - protein, 8 aa, Entamoeba histolytica
ETENLKAD

SEQ ID NO: 2619410 - protein, 7 aa, Entamoeba histolytica
ETENSES

SEQ ID NO: 2619411 - protein, 8 aa, Entamoeba histolytica
ETENSLKD

SEQ ID NO: 2619412 - protein, 20 aa, Entamoeba histolytica
ETEPKPKDSTKKTQEPKQYQ

SEQ ID NO: 2619413 - protein, 14 aa, Entamoeba histolytica
ETEQATGVKSNLRN

SEQ ID NO: 2619414 - protein, 10 aa, Entamoeba histolytica
ETESKIKEEE

SEQ ID NO: 2619415 - protein, 6 aa, Entamoeba histolytica
ETESKT

SEQ ID NO: 2619416 - protein, 6 aa, Entamoeba histolytica
ETETAL

SEQ ID NO: 2619417 - protein, 6 aa, Entamoeba histolytica
ETETDP

SEQ ID NO: 2619418 - protein, 7 aa, Entamoeba histolytica
ETETITT

SEQ ID NO: 2619419 - protein, 5 aa, Entamoeba histolytica
ETETM

SEQ ID NO: 2619420 - protein, 7 aa, Entamoeba histolytica
ETETSKN

SEQ ID NO: 2619421 - protein, 7 aa, Entamoeba histolytica
ETETTAV

SEQ ID NO: 2619422 - protein, 18 aa, Entamoeba histolytica
ETETTKDKEEEQKNPEIG

SEQ ID NO: 2619423 - protein, 8 aa, Entamoeba histolytica
ETETTQRA

SEQ ID NO: 2619424 - protein, 7 aa, Entamoeba histolytica
ETEWNGE

SEQ ID NO: 2619425 - protein, 14 aa, Entamoeba histolytica
ETEWRNGDDIKTYE

SEQ ID NO: 2619426 - protein, 27 aa, Entamoeba histolytica
ETEYSKKKKMSPKEYSEVEKPKGRKTS

SEQ ID NO: 2619427 - protein, 10 aa, Entamoeba histolytica
ETFDYAPKSK

SEQ ID NO: 2619428 - protein, 13 aa, Entamoeba histolytica
ETFESNPSEIEKV

SEQ ID NO: 2619429 - protein, 5 aa, Entamoeba histolytica
ETFNT

SEQ ID NO: 2619430 - protein, 4 aa, Entamoeba histolytica
ETFP

SEQ ID NO: 2619431 - protein, 5 aa, Entamoeba histolytica
ETFSS

SEQ ID NO: 2619432 - protein, 10 aa, Entamoeba histolytica
ETGAGTGQLS

SEQ ID NO: 2619433 - protein, 8 aa, Entamoeba histolytica
ETGAPTEG

SEQ ID NO: 2619434 - protein, 7 aa, Entamoeba histolytica
ETGEKWN

SEQ ID NO: 2619435 - protein, 5 aa, Entamoeba histolytica
ETGIN

SEQ ID NO: 2619436 - protein, 10 aa, Entamoeba histolytica
ETGKGEIDKN

SEQ ID NO: 2619437 - protein, 10 aa, Entamoeba histolytica
ETGKKAVDSK

SEQ ID NO: 2619438 - protein, 14 aa, Entamoeba histolytica
ETGKKWGSLHPYNL

SEQ ID NO: 2619439 - protein, 10 aa, Entamoeba histolytica
ETGKPSMLTD

SEQ ID NO: 2619440 - protein, 18 aa, Entamoeba histolytica
ETGLNPFADEPSANALKP

SEQ ID NO: 2619441 - protein, 8 aa, Entamoeba histolytica
ETGNGKSS

SEQ ID NO: 2619442 - protein, 10 aa, Entamoeba histolytica
ETGPIDPNQK

SEQ ID NO: 2619443 - protein, 5 aa, Entamoeba histolytica
ETGRT

SEQ ID NO: 2619444 - protein, 4 aa, Entamoeba histolytica
ETGS

SEQ ID NO: 2619445 - protein, 10 aa, Entamoeba histolytica
ETGSGKSSLG

SEQ ID NO: 2619446 - protein, 6 aa, Entamoeba histolytica
ETGSYN

SEQ ID NO: 2619447 - protein, 8 aa, Entamoeba histolytica
ETGTGKSL

SEQ ID NO: 2619448 - protein, 7 aa, Entamoeba histolytica
ETGTGKT

SEQ ID NO: 2619449 - protein, 9 aa, Entamoeba histolytica
ETGTGKTTM

SEQ ID NO: 2619450 - protein, 15 aa, Entamoeba histolytica
ETHEGDANACSFDPN

SEQ ID NO: 2619451 - protein, 4 aa, Entamoeba histolytica
ETHG

SEQ ID NO: 2619452 - protein, 7 aa, Entamoeba histolytica
ETHGLEQ

SEQ ID NO: 2619453 - protein, 6 aa, Entamoeba histolytica
ETHGYV

SEQ ID NO: 2619454 - protein, 7 aa, Entamoeba histolytica
ETHLPDS

SEQ ID NO: 2619455 - protein, 14 aa, Entamoeba histolytica
ETHNANVKTRTMDT

SEQ ID NO: 2619456 - protein, 7 aa, Entamoeba histolytica
ETHNKEI

SEQ ID NO: 2619457 - protein, 8 aa, Entamoeba histolytica
ETHNPSAK

SEQ ID NO: 2619458 - protein, 5 aa, Entamoeba histolytica
ETHNY

SEQ ID NO: 2619459 - protein, 15 aa, Entamoeba histolytica
ETHPQYEGKDQNDAH

SEQ ID NO: 2619460 - protein, 9 aa, Entamoeba histolytica
ETIADDAEY

SEQ ID NO: 2619461 - protein, 5 aa, Entamoeba histolytica
ETIDK

SEQ ID NO: 2619462 - protein, 10 aa, Entamoeba histolytica
ETIDYGDTKS

SEQ ID NO: 2619463 - protein, 4 aa, Entamoeba histolytica
ETIE

SEQ ID NO: 2619464 - protein, 10 aa, Entamoeba histolytica
ETIEEESGKL

SEQ ID NO: 2619465 - protein, 8 aa, Entamoeba histolytica
ETIEGGSK

SEQ ID NO: 2619466 - protein, 5 aa, Entamoeba histolytica
ETIEN

SEQ ID NO: 2619467 - protein, 28 aa, Entamoeba histolytica
ETIESPSESPIDNSSIKTQSPTIPEKKS

SEQ ID NO: 2619468 - protein, 8 aa, Entamoeba histolytica
ETIETKVS

SEQ ID NO: 2619469 - protein, 5 aa, Entamoeba histolytica
ETIEY

SEQ ID NO: 2619470 - protein, 5 aa, Entamoeba histolytica
ETIGG

SEQ ID NO: 2619471 - protein, 9 aa, Entamoeba histolytica
ETIHPETRR

SEQ ID NO: 2619472 - protein, 10 aa, Entamoeba histolytica
ETIKEGSNYK

SEQ ID NO: 2619473 - protein, 8 aa, Entamoeba histolytica
ETINEQED

SEQ ID NO: 2619474 - protein, 14 aa, Entamoeba histolytica
ETINGQKLDKNSVR

SEQ ID NO: 2619475 - protein, 14 aa, Entamoeba histolytica
ETINPTAKKTISID

SEQ ID NO: 2619476 - protein, 14 aa, Entamoeba histolytica
ETIPEPKKKGKGKI

SEQ ID NO: 2619477 - protein, 5 aa, Entamoeba histolytica
ETIQS

SEQ ID NO: 2619478 - protein, 14 aa, Entamoeba histolytica
ETISKSTELKSKTH

SEQ ID NO: 2619479 - protein, 4 aa, Entamoeba histolytica
ETIT

SEQ ID NO: 2619480 - protein, 6 aa, Entamoeba histolytica
ETITTE

SEQ ID NO: 2619481 - protein, 5 aa, Entamoeba histolytica
ETIYS

SEQ ID NO: 2619482 - protein, 11 aa, Entamoeba histolytica
ETKAGGDESGV

SEQ ID NO: 2619483 - protein, 24 aa, Entamoeba histolytica
ETKDDEIKNKAQELSDKTKEFEEQ

SEQ ID NO: 2619484 - protein, 6 aa, Entamoeba histolytica
ETKDEE

SEQ ID NO: 2619485 - protein, 7 aa, Entamoeba histolytica
ETKEECE

SEQ ID NO: 2619486 - protein, 30 aa, Entamoeba histolytica
ETKEEETNNDSKEEIKEEETNNDSKEETKL

SEQ ID NO: 2619487 - protein, 45 aa, Entamoeba histolytica
ETKEEKKEEPKEQNHKEEKKKKGKPIPRDPNKPVRAKPNTKADKK

SEQ ID NO: 2619488 - protein, 6 aa, Entamoeba histolytica
ETKEEM

SEQ ID NO: 2619489 - protein, 8 aa, Entamoeba histolytica
ETKEENHV

SEQ ID NO: 2619490 - protein, 8 aa, Entamoeba histolytica
ETKEETGI

SEQ ID NO: 2619491 - protein, 13 aa, Entamoeba histolytica
ETKEGKKGYGGNG

SEQ ID NO: 2619492 - protein, 5 aa, Entamoeba histolytica
ETKEI

SEQ ID NO: 2619493 - protein, 6 aa, Entamoeba histolytica
ETKEQK

SEQ ID NO: 2619494 - protein, 4 aa, Entamoeba histolytica
ETKF

SEQ ID NO: 2619495 - protein, 11 aa, Entamoeba histolytica
ETKFQNNKDEM

SEQ ID NO: 2619496 - protein, 5 aa, Entamoeba histolytica
ETKKI

SEQ ID NO: 2619497 - protein, 8 aa, Entamoeba histolytica
ETKKKYCD

SEQ ID NO: 2619498 - protein, 6 aa, Entamoeba histolytica
ETKKMD

SEQ ID NO: 2619499 - protein, 6 aa, Entamoeba histolytica
ETKKQL

SEQ ID NO: 2619500 - protein, 20 aa, Entamoeba histolytica
ETKKRKSTSSISSKSPRPKA

SEQ ID NO: 2619501 - protein, 11 aa, Entamoeba histolytica
ETKKSKIKNYA

SEQ ID NO: 2619502 - protein, 6 aa, Entamoeba histolytica
ETKLGQ

SEQ ID NO: 2619503 - protein, 4 aa, Entamoeba histolytica
ETKM

SEQ ID NO: 2619504 - protein, 7 aa, Entamoeba histolytica
ETKMPEL

SEQ ID NO: 2619505 - protein, 13 aa, Entamoeba histolytica
ETKNFKENKPIHF

SEQ ID NO: 2619506 - protein, 6 aa, Entamoeba histolytica
ETKNNE

SEQ ID NO: 2619507 - protein, 7 aa, Entamoeba histolytica
ETKPEDI

SEQ ID NO: 2619508 - protein, 13 aa, Entamoeba histolytica
ETKPEESNQCKEV

SEQ ID NO: 2619509 - protein, 5 aa, Entamoeba histolytica
ETKPK

SEQ ID NO: 2619510 - protein, 6 aa, Entamoeba histolytica
ETKPTE

SEQ ID NO: 2619511 - protein, 4 aa, Entamoeba histolytica
ETKQ

SEQ ID NO: 2619512 - protein, 8 aa, Entamoeba histolytica
ETKQETKV

SEQ ID NO: 2619513 - protein, 7 aa, Entamoeba histolytica
ETKQGTI

SEQ ID NO: 2619514 - protein, 15 aa, Entamoeba histolytica
ETKQNEVNKENETSL

SEQ ID NO: 2619515 - protein, 15 aa, Entamoeba histolytica
ETKQNNQIKRQSSEL

SEQ ID NO: 2619516 - protein, 12 aa, Entamoeba histolytica
ETKQSNIQSTRV

SEQ ID NO: 2619517 - protein, 5 aa, Entamoeba histolytica
ETKRA

SEQ ID NO: 2619518 - protein, 11 aa, Entamoeba histolytica
ETKRGEINNEL

SEQ ID NO: 2619519 - protein, 6 aa, Entamoeba histolytica
ETKRLN

SEQ ID NO: 2619520 - protein, 8 aa, Entamoeba histolytica
ETKSAQQI

SEQ ID NO: 2619521 - protein, 8 aa, Entamoeba histolytica
ETKSESSH

SEQ ID NO: 2619522 - protein, 14 aa, Entamoeba histolytica
ETKSINTQSDSLKT

SEQ ID NO: 2619523 - protein, 8 aa, Entamoeba histolytica
ETKSSGEI

SEQ ID NO: 2619524 - protein, 8 aa, Entamoeba histolytica
ETKTFKGN

SEQ ID NO: 2619525 - protein, 9 aa, Entamoeba histolytica
ETKTGYRGT

SEQ ID NO: 2619526 - protein, 8 aa, Entamoeba histolytica
ETKTIHNN

SEQ ID NO: 2619527 - protein, 12 aa, Entamoeba histolytica
ETKTTQITPEKE

SEQ ID NO: 2619528 - protein, 10 aa, Entamoeba histolytica
ETKTTQQKKL

SEQ ID NO: 2619529 - protein, 7 aa, Entamoeba histolytica
ETLDEDI

SEQ ID NO: 2619530 - protein, 4 aa, Entamoeba histolytica
ETLE

SEQ ID NO: 2619531 - protein, 13 aa, Entamoeba histolytica
ETLEEEQNNDDFT

SEQ ID NO: 2619532 - protein, 11 aa, Entamoeba histolytica
ETLESKKSRRL

SEQ ID NO: 2619533 - protein, 7 aa, Entamoeba histolytica
ETLESTS

SEQ ID NO: 2619534 - protein, 5 aa, Entamoeba histolytica
ETLGG

SEQ ID NO: 2619535 - protein, 4 aa, Entamoeba histolytica
ETLI

SEQ ID NO: 2619536 - protein, 4 aa, Entamoeba histolytica
ETLK

SEQ ID NO: 2619537 - protein, 10 aa, Entamoeba histolytica
ETLKEHPEDV

SEQ ID NO: 2619538 - protein, 10 aa, Entamoeba histolytica
ETLKKNQEIT

SEQ ID NO: 2619539 - protein, 17 aa, Entamoeba histolytica
ETLKSYSSKFEKSDISN

SEQ ID NO: 2619540 - protein, 9 aa, Entamoeba histolytica
ETLKTKPDE

SEQ ID NO: 2619541 - protein, 4 aa, Entamoeba histolytica
ETLN

SEQ ID NO: 2619542 - protein, 11 aa, Entamoeba histolytica
ETLNEKQKDYA

SEQ ID NO: 2619543 - protein, 46 aa, Entamoeba histolytica
ETLQNTERRMEEDDDSGDNDEEYHAEEEESGDDDIMSESEEEEEEQ

SEQ ID NO: 2619544 - protein, 8 aa, Entamoeba histolytica
ETLQTKPG

SEQ ID NO: 2619545 - protein, 8 aa, Entamoeba histolytica
ETLRGSDG

SEQ ID NO: 2619546 - protein, 6 aa, Entamoeba histolytica
ETLRQE

SEQ ID NO: 2619547 - protein, 27 aa, Entamoeba histolytica
ETLTADSDNSLIESDEEKNKQQGKPIF

SEQ ID NO: 2619548 - protein, 11 aa, Entamoeba histolytica
ETLTKQNVHKK

SEQ ID NO: 2619549 - protein, 6 aa, Entamoeba histolytica
ETLTSN

SEQ ID NO: 2619550 - protein, 6 aa, Entamoeba histolytica
ETMGSN

SEQ ID NO: 2619551 - protein, 15 aa, Entamoeba histolytica
ETMKTSPKYSYKSDA

SEQ ID NO: 2619552 - protein, 10 aa, Entamoeba histolytica
ETMQTPQESI

SEQ ID NO: 2619553 - protein, 4 aa, Entamoeba histolytica
ETMR

SEQ ID NO: 2619554 - protein, 11 aa, Entamoeba histolytica
ETMVDPQQESQ

SEQ ID NO: 2619555 - protein, 8 aa, Entamoeba histolytica
ETNDCPNE

SEQ ID NO: 2619556 - protein, 17 aa, Entamoeba histolytica
ETNDSFNTKKLSSRPFT

SEQ ID NO: 2619557 - protein, 5 aa, Entamoeba histolytica
ETNEF

SEQ ID NO: 2619558 - protein, 12 aa, Entamoeba histolytica
ETNEGNFQPRSS

SEQ ID NO: 2619559 - protein, 15 aa, Entamoeba histolytica
ETNEIEQTKKPKLPL

SEQ ID NO: 2619560 - protein, 10 aa, Entamoeba histolytica
ETNEKKNEEI

SEQ ID NO: 2619561 - protein, 10 aa, Entamoeba histolytica
ETNENTNNVI

SEQ ID NO: 2619562 - protein, 5 aa, Entamoeba histolytica
ETNGK

SEQ ID NO: 2619563 - protein, 13 aa, Entamoeba histolytica
ETNIKNEEQEYKG

SEQ ID NO: 2619564 - protein, 5 aa, Entamoeba histolytica
ETNIN

SEQ ID NO: 2619565 - protein, 8 aa, Entamoeba histolytica
ETNINDGF

SEQ ID NO: 2619566 - protein, 4 aa, Entamoeba histolytica
ETNK

SEQ ID NO: 2619567 - protein, 7 aa, Entamoeba histolytica
ETNKEEI

SEQ ID NO: 2619568 - protein, 9 aa, Entamoeba histolytica
ETNKGLEEL

SEQ ID NO: 2619569 - protein, 5 aa, Entamoeba histolytica
ETNKL

SEQ ID NO: 2619570 - protein, 6 aa, Entamoeba histolytica
ETNKYR

SEQ ID NO: 2619571 - protein, 7 aa, Entamoeba histolytica
ETNLKAS

SEQ ID NO: 2619572 - protein, 5 aa, Entamoeba histolytica
ETNND

SEQ ID NO: 2619573 - protein, 11 aa, Entamoeba histolytica
ETNNKKNTTPL

SEQ ID NO: 2619574 - protein, 5 aa, Entamoeba histolytica
ETNPQ

SEQ ID NO: 2619575 - protein, 14 aa, Entamoeba histolytica
ETNPQPCKRTAGGG

SEQ ID NO: 2619576 - protein, 6 aa, Entamoeba histolytica
ETNPVN

SEQ ID NO: 2619577 - protein, 7 aa, Entamoeba histolytica
ETNQPLS

SEQ ID NO: 2619578 - protein, 5 aa, Entamoeba histolytica
ETNRM

SEQ ID NO: 2619579 - protein, 5 aa, Entamoeba histolytica
ETNSL

SEQ ID NO: 2619580 - protein, 25 aa, Entamoeba histolytica
ETNSNPPKFLSSEGKIKKSLLSENQ

SEQ ID NO: 2619581 - protein, 9 aa, Entamoeba histolytica
ETNTEEEIK

SEQ ID NO: 2619582 - protein, 7 aa, Entamoeba histolytica
ETNTINE

SEQ ID NO: 2619583 - protein, 29 aa, Entamoeba histolytica
ETNTIRRKPTRSIRPSQSMVSDTDSSESI

SEQ ID NO: 2619584 - protein, 31 aa, Entamoeba histolytica
ETNTIRRKPTRSIRPSQSMVSDTDSSESIAM

SEQ ID NO: 2619585 - protein, 9 aa, Entamoeba histolytica
ETNTNSNQL

SEQ ID NO: 2619586 - protein, 8 aa, Entamoeba histolytica
ETNTQALR

SEQ ID NO: 2619587 - protein, 5 aa, Entamoeba histolytica
ETNTR

SEQ ID NO: 2619588 - protein, 5 aa, Entamoeba histolytica
ETNTT

SEQ ID NO: 2619589 - protein, 5 aa, Entamoeba histolytica
ETNYP

SEQ ID NO: 2619590 - protein, 7 aa, Entamoeba histolytica
ETPEHND

SEQ ID NO: 2619591 - protein, 13 aa, Entamoeba histolytica
ETPENVAPGEVPR

SEQ ID NO: 2619592 - protein, 7 aa, Entamoeba histolytica
ETPETPI

SEQ ID NO: 2619593 - protein, 12 aa, Entamoeba histolytica
ETPFPKKSGGAV

SEQ ID NO: 2619594 - protein, 7 aa, Entamoeba histolytica
ETPGSHT

SEQ ID NO: 2619595 - protein, 4 aa, Entamoeba histolytica
ETPH

SEQ ID NO: 2619596 - protein, 5 aa, Entamoeba histolytica
ETPHR

SEQ ID NO: 2619597 - protein, 6 aa, Entamoeba histolytica
ETPIEN

SEQ ID NO: 2619598 - protein, 13 aa, Entamoeba histolytica
ETPITSMTSRPKV

SEQ ID NO: 2619599 - protein, 4 aa, Entamoeba histolytica
ETPK

SEQ ID NO: 2619600 - protein, 6 aa, Entamoeba histolytica
ETPKAT

SEQ ID NO: 2619601 - protein, 5 aa, Entamoeba histolytica
ETPKF

SEQ ID NO: 2619602 - protein, 7 aa, Entamoeba histolytica
ETPKKND

SEQ ID NO: 2619603 - protein, 5 aa, Entamoeba histolytica
ETPKR

SEQ ID NO: 2619604 - protein, 9 aa, Entamoeba histolytica
ETPKSKYQL

SEQ ID NO: 2619605 - protein, 21 aa, Entamoeba histolytica
ETPKTKTKTEKKKKEIDEDDL

SEQ ID NO: 2619606 - protein, 10 aa, Entamoeba histolytica
ETPKVNSDSK

SEQ ID NO: 2619607 - protein, 13 aa, Entamoeba histolytica
ETPMPKDGILPGD

SEQ ID NO: 2619608 - protein, 7 aa, Entamoeba histolytica
ETPNDQL

SEQ ID NO: 2619609 - protein, 11 aa, Entamoeba histolytica
ETPNSNDNKSI

SEQ ID NO: 2619610 - protein, 26 aa, Entamoeba histolytica
ETPPQEHKGAAKISLGGPEEGNELPK

SEQ ID NO: 2619611 - protein, 4 aa, Entamoeba histolytica
ETPR

SEQ ID NO: 2619612 - protein, 23 aa, Entamoeba histolytica
ETPRNKQRRQTEGDTIKTPRGME

SEQ ID NO: 2619613 - protein, 9 aa, Entamoeba histolytica
ETPSEEQRT

SEQ ID NO: 2619614 - protein, 7 aa, Entamoeba histolytica
ETPSKKV

SEQ ID NO: 2619615 - protein, 10 aa, Entamoeba histolytica
ETPSPTSSND

SEQ ID NO: 2619616 - protein, 4 aa, Entamoeba histolytica
ETPT

SEQ ID NO: 2619617 - protein, 6 aa, Entamoeba histolytica
ETPTIN

SEQ ID NO: 2619618 - protein, 13 aa, Entamoeba histolytica
ETPTKPSNNETVT

SEQ ID NO: 2619619 - protein, 11 aa, Entamoeba histolytica
ETPTQKLTEEM

SEQ ID NO: 2619620 - protein, 6 aa, Entamoeba histolytica
ETQDFK

SEQ ID NO: 2619621 - protein, 28 aa, Entamoeba histolytica
ETQEAIDEEKQYVPRNGGVDFSGFTYVG

SEQ ID NO: 2619622 - protein, 12 aa, Entamoeba histolytica
ETQEAMRKSPEH

SEQ ID NO: 2619623 - protein, 14 aa, Entamoeba histolytica
ETQEMEEDDDETIE

SEQ ID NO: 2619624 - protein, 6 aa, Entamoeba histolytica
ETQETV

SEQ ID NO: 2619625 - protein, 7 aa, Entamoeba histolytica
ETQHQKE

SEQ ID NO: 2619626 - protein, 4 aa, Entamoeba histolytica
ETQI

SEQ ID NO: 2619627 - protein, 7 aa, Entamoeba histolytica
ETQKIDP

SEQ ID NO: 2619628 - protein, 6 aa, Entamoeba histolytica
ETQKMN

SEQ ID NO: 2619629 - protein, 9 aa, Entamoeba histolytica
ETQKSISTN

SEQ ID NO: 2619630 - protein, 10 aa, Entamoeba histolytica
ETQKTRNETI

SEQ ID NO: 2619631 - protein, 15 aa, Entamoeba histolytica
ETQKVRDDDKNGMGP

SEQ ID NO: 2619632 - protein, 7 aa, Entamoeba histolytica
ETQLEKS

SEQ ID NO: 2619633 - protein, 10 aa, Entamoeba histolytica
ETQLNSLKGS

SEQ ID NO: 2619634 - protein, 10 aa, Entamoeba histolytica
ETQNNDPYTN

SEQ ID NO: 2619635 - protein, 22 aa, Entamoeba histolytica
ETQPLTSKTNKIDKERVKSSNE

SEQ ID NO: 2619636 - protein, 6 aa, Entamoeba histolytica
ETQPSY

SEQ ID NO: 2619637 - protein, 17 aa, Entamoeba histolytica
ETQQKLSQMKKKNEQFN

SEQ ID NO: 2619638 - protein, 7 aa, Entamoeba histolytica
ETQREGM

SEQ ID NO: 2619639 - protein, 13 aa, Entamoeba histolytica
ETQRGQSKDDPID

SEQ ID NO: 2619640 - protein, 7 aa, Entamoeba histolytica
ETQRKTR

SEQ ID NO: 2619641 - protein, 8 aa, Entamoeba histolytica
ETQSEREV

SEQ ID NO: 2619642 - protein, 9 aa, Entamoeba histolytica
ETQSRTQDR

SEQ ID NO: 2619643 - protein, 13 aa, Entamoeba histolytica
ETQTKDEEKQEIE

SEQ ID NO: 2619644 - protein, 16 aa, Entamoeba histolytica
ETQTPNHNKNEEISGI

SEQ ID NO: 2619645 - protein, 8 aa, Entamoeba histolytica
ETRDDITN

SEQ ID NO: 2619646 - protein, 7 aa, Entamoeba histolytica
ETRDGRI

SEQ ID NO: 2619647 - protein, 5 aa, Entamoeba histolytica
ETRES

SEQ ID NO: 2619648 - protein, 10 aa, Entamoeba histolytica
ETRGPKAKTC

SEQ ID NO: 2619649 - protein, 5 aa, Entamoeba histolytica
ETRKG

SEQ ID NO: 2619650 - protein, 7 aa, Entamoeba histolytica
ETRMDGI

SEQ ID NO: 2619651 - protein, 9 aa, Entamoeba histolytica
ETRNEEEKG

SEQ ID NO: 2619652 - protein, 9 aa, Entamoeba histolytica
ETRPALKDR

SEQ ID NO: 2619653 - protein, 18 aa, Entamoeba histolytica
ETRSTKQLKTKIAASTVN

SEQ ID NO: 2619654 - protein, 14 aa, Entamoeba histolytica
ETRTEEEPINQEPI

SEQ ID NO: 2619655 - protein, 10 aa, Entamoeba histolytica
ETSAATAQGV

SEQ ID NO: 2619656 - protein, 10 aa, Entamoeba histolytica
ETSAKNKLNI

SEQ ID NO: 2619657 - protein, 10 aa, Entamoeba histolytica
ETSAKTFEGV

SEQ ID NO: 2619658 - protein, 11 aa, Entamoeba histolytica
ETSAKTGAQVD

SEQ ID NO: 2619659 - protein, 9 aa, Entamoeba histolytica
ETSAKTKEG

SEQ ID NO: 2619660 - protein, 8 aa, Entamoeba histolytica
ETSASENI

SEQ ID NO: 2619661 - protein, 9 aa, Entamoeba histolytica
ETSEEAIRN

SEQ ID NO: 2619662 - protein, 16 aa, Entamoeba histolytica
ETSEEELKEKMGEYGE

SEQ ID NO: 2619663 - protein, 7 aa, Entamoeba histolytica
ETSEKIE

SEQ ID NO: 2619664 - protein, 5 aa, Entamoeba histolytica
ETSGR

SEQ ID NO: 2619665 - protein, 9 aa, Entamoeba histolytica
ETSGTVETS

SEQ ID NO: 2619666 - protein, 4 aa, Entamoeba histolytica
ETSH

SEQ ID NO: 2619667 - protein, 4 aa, Entamoeba histolytica
ETSI

SEQ ID NO: 2619668 - protein, 5 aa, Entamoeba histolytica
ETSIP

SEQ ID NO: 2619669 - protein, 5 aa, Entamoeba histolytica
ETSIS

SEQ ID NO: 2619670 - protein, 22 aa, Entamoeba histolytica
ETSKAKKLDEATEQTKEESERY

SEQ ID NO: 2619671 - protein, 5 aa, Entamoeba histolytica
ETSKE

SEQ ID NO: 2619672 - protein, 10 aa, Entamoeba histolytica
ETSKELNPKD

SEQ ID NO: 2619673 - protein, 9 aa, Entamoeba histolytica
ETSKSVEKD

SEQ ID NO: 2619674 - protein, 4 aa, Entamoeba histolytica
ETSN

SEQ ID NO: 2619675 - protein, 8 aa, Entamoeba histolytica
ETSNNSRM

SEQ ID NO: 2619676 - protein, 7 aa, Entamoeba histolytica
ETSNSNI

SEQ ID NO: 2619677 - protein, 4 aa, Entamoeba histolytica
ETSP

SEQ ID NO: 2619678 - protein, 9 aa, Entamoeba histolytica
ETSPDVEKP

SEQ ID NO: 2619679 - protein, 7 aa, Entamoeba histolytica
ETSPELF

SEQ ID NO: 2619680 - protein, 9 aa, Entamoeba histolytica
ETSPFREED

SEQ ID NO: 2619681 - protein, 8 aa, Entamoeba histolytica
ETSPTERT

SEQ ID NO: 2619682 - protein, 6 aa, Entamoeba histolytica
ETSPTF

SEQ ID NO: 2619683 - protein, 8 aa, Entamoeba histolytica
ETSPTIDD

SEQ ID NO: 2619684 - protein, 10 aa, Entamoeba histolytica
ETSPTKEDKK

SEQ ID NO: 2619685 - protein, 6 aa, Entamoeba histolytica
ETSQSI

SEQ ID NO: 2619686 - protein, 5 aa, Entamoeba histolytica
ETSRE

SEQ ID NO: 2619687 - protein, 13 aa, Entamoeba histolytica
ETSSFDSDSSEEE

SEQ ID NO: 2619688 - protein, 7 aa, Entamoeba histolytica
ETSSFHS

SEQ ID NO: 2619689 - protein, 4 aa, Entamoeba histolytica
ETST

SEQ ID NO: 2619690 - protein, 5 aa, Entamoeba histolytica
ETSTC

SEQ ID NO: 2619691 - protein, 8 aa, Entamoeba histolytica
ETSTRATP

SEQ ID NO: 2619692 - protein, 9 aa, Entamoeba histolytica
ETSTSQSEF

SEQ ID NO: 2619693 - protein, 9 aa, Entamoeba histolytica
ETSTTTTEL

SEQ ID NO: 2619694 - protein, 4 aa, Entamoeba histolytica
ETSV

SEQ ID NO: 2619695 - protein, 7 aa, Entamoeba histolytica
ETSVEPV

SEQ ID NO: 2619696 - protein, 4 aa, Entamoeba histolytica
ETSY

SEQ ID NO: 2619697 - protein, 13 aa, Entamoeba histolytica
ETTANKKKTLSRS

SEQ ID NO: 2619698 - protein, 4 aa, Entamoeba histolytica
ETTD

SEQ ID NO: 2619699 - protein, 6 aa, Entamoeba histolytica
ETTDCA

SEQ ID NO: 2619700 - protein, 7 aa, Entamoeba histolytica
ETTDDGK

SEQ ID NO: 2619701 - protein, 5 aa, Entamoeba histolytica
ETTDE

SEQ ID NO: 2619702 - protein, 7 aa, Entamoeba histolytica
ETTDGKR

SEQ ID NO: 2619703 - protein, 13 aa, Entamoeba histolytica
ETTDSNSNSIRES

SEQ ID NO: 2619704 - protein, 9 aa, Entamoeba histolytica
ETTEDTIDQ

SEQ ID NO: 2619705 - protein, 11 aa, Entamoeba histolytica
ETTEEDEISLK

SEQ ID NO: 2619706 - protein, 6 aa, Entamoeba histolytica
ETTEKY

SEQ ID NO: 2619707 - protein, 6 aa, Entamoeba histolytica
ETTENK

SEQ ID NO: 2619708 - protein, 4 aa, Entamoeba histolytica
ETTF

SEQ ID NO: 2619709 - protein, 4 aa, Entamoeba histolytica
ETTG

SEQ ID NO: 2619710 - protein, 7 aa, Entamoeba histolytica
ETTGKRG

SEQ ID NO: 2619711 - protein, 7 aa, Entamoeba histolytica
ETTGQVK

SEQ ID NO: 2619712 - protein, 11 aa, Entamoeba histolytica
ETTGQVKEEVK

SEQ ID NO: 2619713 - protein, 8 aa, Entamoeba histolytica
ETTHSRKK

SEQ ID NO: 2619714 - protein, 5 aa, Entamoeba histolytica
ETTIS

SEQ ID NO: 2619715 - protein, 9 aa, Entamoeba histolytica
ETTKEDTLL

SEQ ID NO: 2619716 - protein, 11 aa, Entamoeba histolytica
ETTKERETENK

SEQ ID NO: 2619717 - protein, 10 aa, Entamoeba histolytica
ETTKKGLTQA

SEQ ID NO: 2619718 - protein, 5 aa, Entamoeba histolytica
ETTLK

SEQ ID NO: 2619719 - protein, 4 aa, Entamoeba histolytica
ETTN

SEQ ID NO: 2619720 - protein, 9 aa, Entamoeba histolytica
ETTNASIRD

SEQ ID NO: 2619721 - protein, 11 aa, Entamoeba histolytica
ETTNASTKDVE

SEQ ID NO: 2619722 - protein, 10 aa, Entamoeba histolytica
ETTNKEQPNE

SEQ ID NO: 2619723 - protein, 28 aa, Entamoeba histolytica
ETTNPEETTPTEKKPRQSKKTKEEKPKK

SEQ ID NO: 2619724 - protein, 6 aa, Entamoeba histolytica
ETTNQP

SEQ ID NO: 2619725 - protein, 6 aa, Entamoeba histolytica
ETTNYS

SEQ ID NO: 2619726 - protein, 18 aa, Entamoeba histolytica
ETTPLQKPSNPYGQTKAM

SEQ ID NO: 2619727 - protein, 7 aa, Entamoeba histolytica
ETTQQYY

SEQ ID NO: 2619728 - protein, 10 aa, Entamoeba histolytica
ETTQSEGTSI

SEQ ID NO: 2619729 - protein, 8 aa, Entamoeba histolytica
ETTQSQME

SEQ ID NO: 2619730 - protein, 6 aa, Entamoeba histolytica
ETTRGA

SEQ ID NO: 2619731 - protein, 11 aa, Entamoeba histolytica
ETTRQVDEQVK

SEQ ID NO: 2619732 - protein, 19 aa, Entamoeba histolytica
ETTRTSQSKHGSHSPNIHQ

SEQ ID NO: 2619733 - protein, 4 aa, Entamoeba histolytica
ETTS

SEQ ID NO: 2619734 - protein, 9 aa, Entamoeba histolytica
ETTTEGKKF

SEQ ID NO: 2619735 - protein, 7 aa, Entamoeba histolytica
ETTTKKE

SEQ ID NO: 2619736 - protein, 16 aa, Entamoeba histolytica
ETTTPTKLSKKKKSIF

SEQ ID NO: 2619737 - protein, 8 aa, Entamoeba histolytica
ETTTQAEL

SEQ ID NO: 2619738 - protein, 279 aa, Entamoeba histolytica
ETTTTEQALKEGAETVSQGSTTTVQQEQGSRVTTHGDATETLSQPGSASAGVSSTSQPQVPSGQGDGVSSQSGGSTQAEQTTHSIETSSQTKPSGASTTSSEGGATKGGAEAITTVPADTAQQSTPTTSTTGSTSSTTQSKPSTPITPPQSSSAVGITETTTHLGDTPSPVTTQPGAQTKQPSESGSQTSSPTTSTSTTTPATSTQTSPSVPQTSSHPTTDNPQTSQPQSNTNPSTITPSKDKEGTSQKDDSQKEHPQLNQPQQNEKQDNKNTTTTVNS

SEQ ID NO: 2619739 - protein, 13 aa, Entamoeba histolytica
ETTVSGDKERFNE

SEQ ID NO: 2619740 - protein, 11 aa, Entamoeba histolytica
ETTVTGAGAAQ

SEQ ID NO: 2619741 - protein, 9 aa, Entamoeba histolytica
ETTYNDELS

SEQ ID NO: 2619742 - protein, 4 aa, Entamoeba histolytica
ETVD

SEQ ID NO: 2619743 - protein, 6 aa, Entamoeba histolytica
ETVDQT

SEQ ID NO: 2619744 - protein, 5 aa, Entamoeba histolytica
ETVES

SEQ ID NO: 2619745 - protein, 4 aa, Entamoeba histolytica
ETVK

SEQ ID NO: 2619746 - protein, 25 aa, Entamoeba histolytica
ETVKETARRIEEPTRREEVEEREEA

SEQ ID NO: 2619747 - protein, 6 aa, Entamoeba histolytica
ETVLEN

SEQ ID NO: 2619748 - protein, 12 aa, Entamoeba histolytica
ETVNEEEKQIKE

SEQ ID NO: 2619749 - protein, 4 aa, Entamoeba histolytica
ETVR

SEQ ID NO: 2619750 - protein, 6 aa, Entamoeba histolytica
ETVRSA

SEQ ID NO: 2619751 - protein, 6 aa, Entamoeba histolytica
ETVSKD

SEQ ID NO: 2619752 - protein, 11 aa, Entamoeba histolytica
ETVSPPSSVNI

SEQ ID NO: 2619753 - protein, 6 aa, Entamoeba histolytica
ETYDKD

SEQ ID NO: 2619754 - protein, 7 aa, Entamoeba histolytica
ETYEETY

SEQ ID NO: 2619755 - protein, 7 aa, Entamoeba histolytica
ETYNPEL

SEQ ID NO: 2619756 - protein, 12 aa, Entamoeba histolytica
ETYPSSFLLLKI

SEQ ID NO: 2619757 - protein, 4 aa, Entamoeba histolytica
ETYQ

SEQ ID NO: 2619758 - protein, 11 aa, Entamoeba histolytica
ETYRNMKNEKC

SEQ ID NO: 2619759 - protein, 14 aa, Entamoeba histolytica
ETYTQTEEVPDPNV

SEQ ID NO: 2619760 - protein, 5 aa, Entamoeba histolytica
EVAEA

SEQ ID NO: 2619761 - protein, 8 aa, Entamoeba histolytica
EVAGPSDV

SEQ ID NO: 2619762 - protein, 11 aa, Entamoeba histolytica
EVANGSSLKTA

SEQ ID NO: 2619763 - protein, 16 aa, Entamoeba histolytica
EVANIKDKPQASTDEN

SEQ ID NO: 2619764 - protein, 6 aa, Entamoeba histolytica
EVAQKQ

SEQ ID NO: 2619765 - protein, 11 aa, Entamoeba histolytica
EVASRESSQFR

SEQ ID NO: 2619766 - protein, 18 aa, Entamoeba histolytica
EVCSDQPNIPEVEFPLKM

SEQ ID NO: 2619767 - protein, 4 aa, Entamoeba histolytica
EVDE

SEQ ID NO: 2619768 - protein, 9 aa, Entamoeba histolytica
EVDEEGNTA

SEQ ID NO: 2619769 - protein, 12 aa, Entamoeba histolytica
EVDEEGYPNPDS

SEQ ID NO: 2619770 - protein, 5 aa, Entamoeba histolytica
EVDEN

SEQ ID NO: 2619771 - protein, 4 aa, Entamoeba histolytica
EVDG

SEQ ID NO: 2619772 - protein, 9 aa, Entamoeba histolytica
EVDGDDRSV

SEQ ID NO: 2619773 - protein, 6 aa, Entamoeba histolytica
EVDGTT

SEQ ID NO: 2619774 - protein, 5 aa, Entamoeba histolytica
EVDIS

SEQ ID NO: 2619775 - protein, 8 aa, Entamoeba histolytica
EVDMTEDE

SEQ ID NO: 2619776 - protein, 24 aa, Entamoeba histolytica
EVDNIQENKVEQQQNEKKENEEKV

SEQ ID NO: 2619777 - protein, 13 aa, Entamoeba histolytica
EVDPATLSDNENI

SEQ ID NO: 2619778 - protein, 10 aa, Entamoeba histolytica
EVDPDGDRTI

SEQ ID NO: 2619779 - protein, 6 aa, Entamoeba histolytica
EVDSNS

SEQ ID NO: 2619780 - protein, 8 aa, Entamoeba histolytica
EVDSNTID

SEQ ID NO: 2619781 - protein, 54 aa, Entamoeba histolytica
EVEAQRKKIEENAQKIKENTIKQEQLNDLKKKNKELKKRIEKGSLDVEAREREV

SEQ ID NO: 2619782 - protein, 4 aa, Entamoeba histolytica
EVED

SEQ ID NO: 2619783 - protein, 38 aa, Entamoeba histolytica
EVEDAERREFERSQQTPQREFNENPRFTDGYSEEINRR

SEQ ID NO: 2619784 - protein, 13 aa, Entamoeba histolytica
EVEEELDENDKTL

SEQ ID NO: 2619785 - protein, 8 aa, Entamoeba histolytica
EVEEKEKK

SEQ ID NO: 2619786 - protein, 6 aa, Entamoeba histolytica
EVEENK

SEQ ID NO: 2619787 - protein, 7 aa, Entamoeba histolytica
EVEEVKE

SEQ ID NO: 2619788 - protein, 8 aa, Entamoeba histolytica
EVEGERRE

SEQ ID NO: 2619789 - protein, 14 aa, Entamoeba histolytica
EVEKDEEAKNTMKN

SEQ ID NO: 2619790 - protein, 18 aa, Entamoeba histolytica
EVEKKATISHGSAGFETI

SEQ ID NO: 2619791 - protein, 42 aa, Entamoeba histolytica
EVEKKENEITEQKKKDEQEKEELKKRIEETEKNAAAGSEQIL

SEQ ID NO: 2619792 - protein, 9 aa, Entamoeba histolytica
EVEKRGTIE

SEQ ID NO: 2619793 - protein, 12 aa, Entamoeba histolytica
EVEKSIPPKEET

SEQ ID NO: 2619794 - protein, 21 aa, Entamoeba histolytica
EVENPDNSYNEDKEWKNEGTS

SEQ ID NO: 2619795 - protein, 5 aa, Entamoeba histolytica
EVEPF

SEQ ID NO: 2619796 - protein, 13 aa, Entamoeba histolytica
EVEQQERNQVKNT

SEQ ID NO: 2619797 - protein, 153 aa, Entamoeba histolytica
EVEQSKQEEQPQQEEVQESKQEEQPQQEEQPQQEEQPQQEEQPQQEEQPQQEEQPQQEEQPQQEEQPQQEEQPQQEEQPQQEEQPQQEEQPQQEEQPQQEEQPQQEEQPQQEEQPQQEEQPQQEEQPKQEEQPQQEEQPQQEEQPKQEEETPL

SEQ ID NO: 2619798 - protein, 5 aa, Entamoeba histolytica
EVERD

SEQ ID NO: 2619799 - protein, 18 aa, Entamoeba histolytica
EVERETRMAQSKKRDAEN

SEQ ID NO: 2619800 - protein, 6 aa, Entamoeba histolytica
EVERRL

SEQ ID NO: 2619801 - protein, 13 aa, Entamoeba histolytica
EVESGGDESDIEK

SEQ ID NO: 2619802 - protein, 8 aa, Entamoeba histolytica
EVESGREV

SEQ ID NO: 2619803 - protein, 5 aa, Entamoeba histolytica
EVEST

SEQ ID NO: 2619804 - protein, 6 aa, Entamoeba histolytica
EVESTF

SEQ ID NO: 2619805 - protein, 5 aa, Entamoeba histolytica
EVETD

SEQ ID NO: 2619806 - protein, 6 aa, Entamoeba histolytica
EVETIK

SEQ ID NO: 2619807 - protein, 26 aa, Entamoeba histolytica
EVEVKKDEEEAINKSTRKEKKTQIEE

SEQ ID NO: 2619808 - protein, 7 aa, Entamoeba histolytica
EVGDDKI

SEQ ID NO: 2619809 - protein, 5 aa, Entamoeba histolytica
EVGEL

SEQ ID NO: 2619810 - protein, 7 aa, Entamoeba histolytica
EVGELTK

SEQ ID NO: 2619811 - protein, 7 aa, Entamoeba histolytica
EVGESRI

SEQ ID NO: 2619812 - protein, 5 aa, Entamoeba histolytica
EVGGL

SEQ ID NO: 2619813 - protein, 17 aa, Entamoeba histolytica
EVGGSRHVEREHIVTCL

SEQ ID NO: 2619814 - protein, 8 aa, Entamoeba histolytica
EVGNETQF

SEQ ID NO: 2619815 - protein, 5 aa, Entamoeba histolytica
EVGPN

SEQ ID NO: 2619816 - protein, 4 aa, Entamoeba histolytica
EVGQ

SEQ ID NO: 2619817 - protein, 12 aa, Entamoeba histolytica
EVGSSISISGDT

SEQ ID NO: 2619818 - protein, 6 aa, Entamoeba histolytica
EVGYST

SEQ ID NO: 2619819 - protein, 16 aa, Entamoeba histolytica
EVHEDSTESKKPRKDN

SEQ ID NO: 2619820 - protein, 22 aa, Entamoeba histolytica
EVHTDGTNDETDDYTENNEEEL

SEQ ID NO: 2619821 - protein, 10 aa, Entamoeba histolytica
EVIQEKTKRI

SEQ ID NO: 2619822 - protein, 24 aa, Entamoeba histolytica
EVKAQEQAKEDKRKALQKKIETAG

SEQ ID NO: 2619823 - protein, 8 aa, Entamoeba histolytica
EVKATGDF

SEQ ID NO: 2619824 - protein, 8 aa, Entamoeba histolytica
EVKEDEDR

SEQ ID NO: 2619825 - protein, 5 aa, Entamoeba histolytica
EVKEG

SEQ ID NO: 2619826 - protein, 9 aa, Entamoeba histolytica
EVKEGENKE

SEQ ID NO: 2619827 - protein, 11 aa, Entamoeba histolytica
EVKEKDEGKVT

SEQ ID NO: 2619828 - protein, 8 aa, Entamoeba histolytica
EVKERNEY

SEQ ID NO: 2619829 - protein, 13 aa, Entamoeba histolytica
EVKESRNKRDMPR

SEQ ID NO: 2619830 - protein, 10 aa, Entamoeba histolytica
EVKEYEKRSD

SEQ ID NO: 2619831 - protein, 5 aa, Entamoeba histolytica
EVKGD

SEQ ID NO: 2619832 - protein, 10 aa, Entamoeba histolytica
EVKGQKKEMN

SEQ ID NO: 2619833 - protein, 17 aa, Entamoeba histolytica
EVKKEEGKRKKKTKEII

SEQ ID NO: 2619834 - protein, 26 aa, Entamoeba histolytica
EVKKEEKISQRNCESEVMSPRKNSVD

SEQ ID NO: 2619835 - protein, 8 aa, Entamoeba histolytica
EVKNGKKV

SEQ ID NO: 2619836 - protein, 5 aa, Entamoeba histolytica
EVKPV

SEQ ID NO: 2619837 - protein, 7 aa, Entamoeba histolytica
EVKQTRS

SEQ ID NO: 2619838 - protein, 12 aa, Entamoeba histolytica
EVKREKKGKKIN

SEQ ID NO: 2619839 - protein, 13 aa, Entamoeba histolytica
EVKRESKSFEGVQ

SEQ ID NO: 2619840 - protein, 7 aa, Entamoeba histolytica
EVKSTEL

SEQ ID NO: 2619841 - protein, 5 aa, Entamoeba histolytica
EVKTE

SEQ ID NO: 2619842 - protein, 5 aa, Entamoeba histolytica
EVLER

SEQ ID NO: 2619843 - protein, 5 aa, Entamoeba histolytica
EVLNE

SEQ ID NO: 2619844 - protein, 7 aa, Entamoeba histolytica
EVLNRNT

SEQ ID NO: 2619845 - protein, 8 aa, Entamoeba histolytica
EVLSKEPN

SEQ ID NO: 2619846 - protein, 6 aa, Entamoeba histolytica
EVMEES

SEQ ID NO: 2619847 - protein, 6 aa, Entamoeba histolytica
EVNDEE

SEQ ID NO: 2619848 - protein, 8 aa, Entamoeba histolytica
EVNEGEKL

SEQ ID NO: 2619849 - protein, 6 aa, Entamoeba histolytica
EVNEGV

SEQ ID NO: 2619850 - protein, 5 aa, Entamoeba histolytica
EVNEK

SEQ ID NO: 2619851 - protein, 11 aa, Entamoeba histolytica
EVNEKSQEKEI

SEQ ID NO: 2619852 - protein, 8 aa, Entamoeba histolytica
EVNEKYNT

SEQ ID NO: 2619853 - protein, 7 aa, Entamoeba histolytica
EVNENLE

SEQ ID NO: 2619854 - protein, 4 aa, Entamoeba histolytica
EVNG

SEQ ID NO: 2619855 - protein, 21 aa, Entamoeba histolytica
EVNGHNNEANIEDKLTSQDLA

SEQ ID NO: 2619856 - protein, 7 aa, Entamoeba histolytica
EVNGNDT

SEQ ID NO: 2619857 - protein, 10 aa, Entamoeba histolytica
EVNKEEYTSK

SEQ ID NO: 2619858 - protein, 16 aa, Entamoeba histolytica
EVNKEKKQPPKETILS

SEQ ID NO: 2619859 - protein, 5 aa, Entamoeba histolytica
EVNKP

SEQ ID NO: 2619860 - protein, 8 aa, Entamoeba histolytica
EVNKTKEI

SEQ ID NO: 2619861 - protein, 9 aa, Entamoeba histolytica
EVNKTSPSL

SEQ ID NO: 2619862 - protein, 9 aa, Entamoeba histolytica
EVNNDNEKL

SEQ ID NO: 2619863 - protein, 20 aa, Entamoeba histolytica
EVNNEPIKTGPKEEQQTKQV

SEQ ID NO: 2619864 - protein, 24 aa, Entamoeba histolytica
EVNNTPSGSINIETTSPEKKEGGC

SEQ ID NO: 2619865 - protein, 4 aa, Entamoeba histolytica
EVNP

SEQ ID NO: 2619866 - protein, 5 aa, Entamoeba histolytica
EVNQI

SEQ ID NO: 2619867 - protein, 7 aa, Entamoeba histolytica
EVNQRGI

SEQ ID NO: 2619868 - protein, 9 aa, Entamoeba histolytica
EVNSQDVDE

SEQ ID NO: 2619869 - protein, 7 aa, Entamoeba histolytica
EVNSQTN

SEQ ID NO: 2619870 - protein, 6 aa, Entamoeba histolytica
EVNTQE

SEQ ID NO: 2619871 - protein, 8 aa, Entamoeba histolytica
EVNTRDSL

SEQ ID NO: 2619872 - protein, 17 aa, Entamoeba histolytica
EVNVDEKLASEKEEISN

SEQ ID NO: 2619873 - protein, 5 aa, Entamoeba histolytica
EVPEE

SEQ ID NO: 2619874 - protein, 5 aa, Entamoeba histolytica
EVPEK

SEQ ID NO: 2619875 - protein, 8 aa, Entamoeba histolytica
EVPENGNE

SEQ ID NO: 2619876 - protein, 11 aa, Entamoeba histolytica
EVPESKKDSLL

SEQ ID NO: 2619877 - protein, 9 aa, Entamoeba histolytica
EVPGNELTP

SEQ ID NO: 2619878 - protein, 9 aa, Entamoeba histolytica
EVPNAEQSI

SEQ ID NO: 2619879 - protein, 6 aa, Entamoeba histolytica
EVPQLS

SEQ ID NO: 2619880 - protein, 7 aa, Entamoeba histolytica
EVPSDSE

SEQ ID NO: 2619881 - protein, 5 aa, Entamoeba histolytica
EVPSR

SEQ ID NO: 2619882 - protein, 5 aa, Entamoeba histolytica
EVPSS

SEQ ID NO: 2619883 - protein, 4 aa, Entamoeba histolytica
EVPT

SEQ ID NO: 2619884 - protein, 8 aa, Entamoeba histolytica
EVPTTDIE

SEQ ID NO: 2619885 - protein, 11 aa, Entamoeba histolytica
EVQDNHEKAVA

SEQ ID NO: 2619886 - protein, 4 aa, Entamoeba histolytica
EVQE

SEQ ID NO: 2619887 - protein, 10 aa, Entamoeba histolytica
EVQGLSEEKA

SEQ ID NO: 2619888 - protein, 12 aa, Entamoeba histolytica
EVQGSSQLSNDS

SEQ ID NO: 2619889 - protein, 5 aa, Entamoeba histolytica
EVQPM

SEQ ID NO: 2619890 - protein, 21 aa, Entamoeba histolytica
EVQPTTSKEESSWQQNSWDFS

SEQ ID NO: 2619891 - protein, 4 aa, Entamoeba histolytica
EVQV

SEQ ID NO: 2619892 - protein, 8 aa, Entamoeba histolytica
EVREKGHQ

SEQ ID NO: 2619893 - protein, 9 aa, Entamoeba histolytica
EVREQEHRE

SEQ ID NO: 2619894 - protein, 12 aa, Entamoeba histolytica
EVRKDDEDDETR

SEQ ID NO: 2619895 - protein, 18 aa, Entamoeba histolytica
EVRKTKDENMTKKQKRLS

SEQ ID NO: 2619896 - protein, 15 aa, Entamoeba histolytica
EVRKTPEKINSLAEQ

SEQ ID NO: 2619897 - protein, 10 aa, Entamoeba histolytica
EVRNKEIKTK

SEQ ID NO: 2619898 - protein, 23 aa, Entamoeba histolytica
EVRQPEETGTGNDKKKKKKEKVL

SEQ ID NO: 2619899 - protein, 17 aa, Entamoeba histolytica
EVSAAREEVPGRRGYPG

SEQ ID NO: 2619900 - protein, 11 aa, Entamoeba histolytica
EVSEADKTEIF

SEQ ID NO: 2619901 - protein, 5 aa, Entamoeba histolytica
EVSGG

SEQ ID NO: 2619902 - protein, 4 aa, Entamoeba histolytica
EVSH

SEQ ID NO: 2619903 - protein, 7 aa, Entamoeba histolytica
EVSKDET

SEQ ID NO: 2619904 - protein, 5 aa, Entamoeba histolytica
EVSKK

SEQ ID NO: 2619905 - protein, 10 aa, Entamoeba histolytica
EVSPSGVKKD

SEQ ID NO: 2619906 - protein, 7 aa, Entamoeba histolytica
EVSSGSL

SEQ ID NO: 2619907 - protein, 20 aa, Entamoeba histolytica
EVSSKQQQTIEILKKQLSLS

SEQ ID NO: 2619908 - protein, 11 aa, Entamoeba histolytica
EVSTAQRRQTE

SEQ ID NO: 2619909 - protein, 8 aa, Entamoeba histolytica
EVSTKTDI

SEQ ID NO: 2619910 - protein, 13 aa, Entamoeba histolytica
EVSTTPKYYESKL

SEQ ID NO: 2619911 - protein, 16 aa, Entamoeba histolytica
EVTDENGHILQEFKKW

SEQ ID NO: 2619912 - protein, 6 aa, Entamoeba histolytica
EVTDSI

SEQ ID NO: 2619913 - protein, 6 aa, Entamoeba histolytica
EVTESN

SEQ ID NO: 2619914 - protein, 9 aa, Entamoeba histolytica
EVTGDTNIP

SEQ ID NO: 2619915 - protein, 9 aa, Entamoeba histolytica
EVTGTHDIE

SEQ ID NO: 2619916 - protein, 4 aa, Entamoeba histolytica
EVTI

SEQ ID NO: 2619917 - protein, 7 aa, Entamoeba histolytica
EVTKDKE

SEQ ID NO: 2619918 - protein, 13 aa, Entamoeba histolytica
EVTKDSEETRFDQ

SEQ ID NO: 2619919 - protein, 8 aa, Entamoeba histolytica
EVTKEQEK

SEQ ID NO: 2619920 - protein, 21 aa, Entamoeba histolytica
EVTKKSTNEVIEKQTGEKEST

SEQ ID NO: 2619921 - protein, 7 aa, Entamoeba histolytica
EVTLTTK

SEQ ID NO: 2619922 - protein, 11 aa, Entamoeba histolytica
EVTLTTTGSEY

SEQ ID NO: 2619923 - protein, 10 aa, Entamoeba histolytica
EVTPTNAAGK

SEQ ID NO: 2619924 - protein, 7 aa, Entamoeba histolytica
EVTREDM

SEQ ID NO: 2619925 - protein, 12 aa, Entamoeba histolytica
EVTRQPNKFDNG

SEQ ID NO: 2619926 - protein, 17 aa, Entamoeba histolytica
EVTSGAQIDIGKDGTSI

SEQ ID NO: 2619927 - protein, 10 aa, Entamoeba histolytica
EVTSPKNADL

SEQ ID NO: 2619928 - protein, 5 aa, Entamoeba histolytica
EVVHP

SEQ ID NO: 2619929 - protein, 5 aa, Entamoeba histolytica
EVWTD

SEQ ID NO: 2619930 - protein, 5 aa, Entamoeba histolytica
EVYGN

SEQ ID NO: 2619931 - protein, 46 aa, Entamoeba histolytica
EWDDPTKEEEKHENTTMEEEEEGSMEEDKDNNKEEGSMEEEEESEE

SEQ ID NO: 2619932 - protein, 51 aa, Entamoeba histolytica
EWDDPTKEEEKHENTTMEEEEEIEEEDKEEENMEEEDKEEGSMEEEEESEE

SEQ ID NO: 2619933 - protein, 57 aa, Entamoeba histolytica
EWDDPTKEEEKHENTTMEEEEEIEEGKDNNKEEGSMEEDKEEEDKEEENMEEEESEE

SEQ ID NO: 2619934 - protein, 57 aa, Entamoeba histolytica
EWDDPTKEEEKHENTTMEEEEEIEEGKDNNKEEGSMEEDKEEENMEEEDKEEGESEE

SEQ ID NO: 2619935 - protein, 7 aa, Entamoeba histolytica
EWDGSMK

SEQ ID NO: 2619936 - protein, 11 aa, Entamoeba histolytica
EWEEKKRCTPL

SEQ ID NO: 2619937 - protein, 5 aa, Entamoeba histolytica
EWEGK

SEQ ID NO: 2619938 - protein, 6 aa, Entamoeba histolytica
EWKEAK

SEQ ID NO: 2619939 - protein, 13 aa, Entamoeba histolytica
EWKNENEELKQKE

SEQ ID NO: 2619940 - protein, 6 aa, Entamoeba histolytica
EWKNPR

SEQ ID NO: 2619941 - protein, 18 aa, Entamoeba histolytica
EWNKKENNLNKSNQELTE

SEQ ID NO: 2619942 - protein, 9 aa, Entamoeba histolytica
EWNKSLKQY

SEQ ID NO: 2619943 - protein, 14 aa, Entamoeba histolytica
EWNNKNNGGRIKRN

SEQ ID NO: 2619944 - protein, 22 aa, Entamoeba histolytica
EWNSQEKYNSNVRGKKGFNSTT

SEQ ID NO: 2619945 - protein, 28 aa, Entamoeba histolytica
EWSKTKEKKENKEKGAKMNTSVKTKEQV

SEQ ID NO: 2619946 - protein, 6 aa, Entamoeba histolytica
EWSNKN

SEQ ID NO: 2619947 - protein, 6 aa, Entamoeba histolytica
EWSQPQ

SEQ ID NO: 2619948 - protein, 19 aa, Entamoeba histolytica
EWTKSNEHFDTERVIVVEM

SEQ ID NO: 2619949 - protein, 6 aa, Entamoeba histolytica
EWTNKT

SEQ ID NO: 2619950 - protein, 8 aa, Entamoeba histolytica
EYAKQKGA

SEQ ID NO: 2619951 - protein, 8 aa, Entamoeba histolytica
EYANGAKF

SEQ ID NO: 2619952 - protein, 54 aa, Entamoeba histolytica
EYCSKNKSKNTNNTETKIEKSNESIEDNGVDTKNENPKVERSYSEGVVDSDEEL

SEQ ID NO: 2619953 - protein, 7 aa, Entamoeba histolytica
EYDAKTT

SEQ ID NO: 2619954 - protein, 5 aa, Entamoeba histolytica
EYDDI

SEQ ID NO: 2619955 - protein, 7 aa, Entamoeba histolytica
EYDDIDD

SEQ ID NO: 2619956 - protein, 22 aa, Entamoeba histolytica
EYDDKKEQQTDIDYSKDNDTSL

SEQ ID NO: 2619957 - protein, 22 aa, Entamoeba histolytica
EYDERDNEEFYDSSETKYGMEE

SEQ ID NO: 2619958 - protein, 9 aa, Entamoeba histolytica
EYDESENGF

SEQ ID NO: 2619959 - protein, 6 aa, Entamoeba histolytica
EYDETE

SEQ ID NO: 2619960 - protein, 47 aa, Entamoeba histolytica
EYDETLSKEQAESKTKLQESTSVDTSKQSNDLKTTEEKQISSNNNNN

SEQ ID NO: 2619961 - protein, 4 aa, Entamoeba histolytica
EYDF

SEQ ID NO: 2619962 - protein, 12 aa, Entamoeba histolytica
EYDGEEKVEELE

SEQ ID NO: 2619963 - protein, 16 aa, Entamoeba histolytica
EYDKSAKEAEDAYTSK

SEQ ID NO: 2619964 - protein, 4 aa, Entamoeba histolytica
EYDN

SEQ ID NO: 2619965 - protein, 12 aa, Entamoeba histolytica
EYDNKSNKGSVE

SEQ ID NO: 2619966 - protein, 9 aa, Entamoeba histolytica
EYDPDEYEV

SEQ ID NO: 2619967 - protein, 8 aa, Entamoeba histolytica
EYDPGIKQ

SEQ ID NO: 2619968 - protein, 22 aa, Entamoeba histolytica
EYDTPQPHNNTEQKTTETPETY

SEQ ID NO: 2619969 - protein, 9 aa, Entamoeba histolytica
EYEDGKADV

SEQ ID NO: 2619970 - protein, 9 aa, Entamoeba histolytica
EYEDSNNSC

SEQ ID NO: 2619971 - protein, 8 aa, Entamoeba histolytica
EYEEAQKD

SEQ ID NO: 2619972 - protein, 6 aa, Entamoeba histolytica
EYEEKK

SEQ ID NO: 2619973 - protein, 6 aa, Entamoeba histolytica
EYEEKS

SEQ ID NO: 2619974 - protein, 4 aa, Entamoeba histolytica
EYEG

SEQ ID NO: 2619975 - protein, 7 aa, Entamoeba histolytica
EYEGHST

SEQ ID NO: 2619976 - protein, 5 aa, Entamoeba histolytica
EYEGI

SEQ ID NO: 2619977 - protein, 6 aa, Entamoeba histolytica
EYEGKT

SEQ ID NO: 2619978 - protein, 4 aa, Entamoeba histolytica
EYEH

SEQ ID NO: 2619979 - protein, 8 aa, Entamoeba histolytica
EYEKEAKS

SEQ ID NO: 2619980 - protein, 19 aa, Entamoeba histolytica
EYEKERTYKDMDKFLSDYL

SEQ ID NO: 2619981 - protein, 5 aa, Entamoeba histolytica
EYEKK

SEQ ID NO: 2619982 - protein, 10 aa, Entamoeba histolytica
EYEKKQKKDI

SEQ ID NO: 2619983 - protein, 11 aa, Entamoeba histolytica
EYEKSNSSQIG

SEQ ID NO: 2619984 - protein, 9 aa, Entamoeba histolytica
EYEKSTGKE

SEQ ID NO: 2619985 - protein, 6 aa, Entamoeba histolytica
EYENGQ

SEQ ID NO: 2619986 - protein, 4 aa, Entamoeba histolytica
EYEP

SEQ ID NO: 2619987 - protein, 5 aa, Entamoeba histolytica
EYEQQ

SEQ ID NO: 2619988 - protein, 14 aa, Entamoeba histolytica
EYESKGKISPDRDG

SEQ ID NO: 2619989 - protein, 6 aa, Entamoeba histolytica
EYESKY

SEQ ID NO: 2619990 - protein, 5 aa, Entamoeba histolytica
EYFDG

SEQ ID NO: 2619991 - protein, 4 aa, Entamoeba histolytica
EYGA

SEQ ID NO: 2619992 - protein, 8 aa, Entamoeba histolytica
EYGDSEND

SEQ ID NO: 2619993 - protein, 9 aa, Entamoeba histolytica
EYGDTKSKL

SEQ ID NO: 2619994 - protein, 5 aa, Entamoeba histolytica
EYGED

SEQ ID NO: 2619995 - protein, 10 aa, Entamoeba histolytica
EYGEYYQGRG

SEQ ID NO: 2619996 - protein, 16 aa, Entamoeba histolytica
EYGNNNKLPQINPRTQ

SEQ ID NO: 2619997 - protein, 12 aa, Entamoeba histolytica
EYGNSKGLIGQS

SEQ ID NO: 2619998 - protein, 15 aa, Entamoeba histolytica
EYGTATNIKSRVNRQ

SEQ ID NO: 2619999 - protein, 4 aa, Entamoeba histolytica
EYGV

SEQ ID NO: 2620000 - protein, 5 aa, Entamoeba histolytica
EYHEG

SEQ ID NO: 2620001 - protein, 5 aa, Entamoeba histolytica
EYHPP

SEQ ID NO: 2620002 - protein, 4 aa, Entamoeba histolytica
EYIE

SEQ ID NO: 2620003 - protein, 6 aa, Entamoeba histolytica
EYIGDK

SEQ ID NO: 2620004 - protein, 8 aa, Entamoeba histolytica
EYISNGAS

SEQ ID NO: 2620005 - protein, 5 aa, Entamoeba histolytica
EYISP

SEQ ID NO: 2620006 - protein, 11 aa, Entamoeba histolytica
EYKDNKHNPQC

SEQ ID NO: 2620007 - protein, 10 aa, Entamoeba histolytica
EYKEKSTVAI

SEQ ID NO: 2620008 - protein, 11 aa, Entamoeba histolytica
EYKKYGSGKDI

SEQ ID NO: 2620009 - protein, 4 aa, Entamoeba histolytica
EYKN

SEQ ID NO: 2620010 - protein, 9 aa, Entamoeba histolytica
EYKNSTGFK

SEQ ID NO: 2620011 - protein, 17 aa, Entamoeba histolytica
EYKPKRSISSEPFTRQR

SEQ ID NO: 2620012 - protein, 4 aa, Entamoeba histolytica
EYKV

SEQ ID NO: 2620013 - protein, 20 aa, Entamoeba histolytica
EYKVNEKEAIAYSQKANEAM

SEQ ID NO: 2620014 - protein, 4 aa, Entamoeba histolytica
EYLG

SEQ ID NO: 2620015 - protein, 8 aa, Entamoeba histolytica
EYLNDSEK

SEQ ID NO: 2620016 - protein, 13 aa, Entamoeba histolytica
EYLSNKTVQRRFS

SEQ ID NO: 2620017 - protein, 5 aa, Entamoeba histolytica
EYNEN

SEQ ID NO: 2620018 - protein, 4 aa, Entamoeba histolytica
EYNK

SEQ ID NO: 2620019 - protein, 11 aa, Entamoeba histolytica
EYNKETKNFEQ

SEQ ID NO: 2620020 - protein, 20 aa, Entamoeba histolytica
EYNKTKVTKATNLIVPLDNL

SEQ ID NO: 2620021 - protein, 9 aa, Entamoeba histolytica
EYNLESENE

SEQ ID NO: 2620022 - protein, 6 aa, Entamoeba histolytica
EYNLPP

SEQ ID NO: 2620023 - protein, 8 aa, Entamoeba histolytica
EYNQSGDI

SEQ ID NO: 2620024 - protein, 13 aa, Entamoeba histolytica
EYNSKKTKARQIT

SEQ ID NO: 2620025 - protein, 9 aa, Entamoeba histolytica
EYNSRTGME

SEQ ID NO: 2620026 - protein, 7 aa, Entamoeba histolytica
EYNSSDN

SEQ ID NO: 2620027 - protein, 7 aa, Entamoeba histolytica
EYNSSED

SEQ ID NO: 2620028 - protein, 5 aa, Entamoeba histolytica
EYNTR

SEQ ID NO: 2620029 - protein, 4 aa, Entamoeba histolytica
EYNY

SEQ ID NO: 2620030 - protein, 10 aa, Entamoeba histolytica
EYPFSTNKAT

SEQ ID NO: 2620031 - protein, 7 aa, Entamoeba histolytica
EYPGGEE

SEQ ID NO: 2620032 - protein, 8 aa, Entamoeba histolytica
EYPIEKGN

SEQ ID NO: 2620033 - protein, 6 aa, Entamoeba histolytica
EYPIPD

SEQ ID NO: 2620034 - protein, 9 aa, Entamoeba histolytica
EYPKPENGI

SEQ ID NO: 2620035 - protein, 9 aa, Entamoeba histolytica
EYPKSSKGI

SEQ ID NO: 2620036 - protein, 4 aa, Entamoeba histolytica
EYPN

SEQ ID NO: 2620037 - protein, 5 aa, Entamoeba histolytica
EYPNH

SEQ ID NO: 2620038 - protein, 5 aa, Entamoeba histolytica
EYPPN

SEQ ID NO: 2620039 - protein, 5 aa, Entamoeba histolytica
EYPPS

SEQ ID NO: 2620040 - protein, 9 aa, Entamoeba histolytica
EYPQGKEGI

SEQ ID NO: 2620041 - protein, 6 aa, Entamoeba histolytica
EYPSKK

SEQ ID NO: 2620042 - protein, 5 aa, Entamoeba histolytica
EYPST

SEQ ID NO: 2620043 - protein, 7 aa, Entamoeba histolytica
EYPTGAN

SEQ ID NO: 2620044 - protein, 9 aa, Entamoeba histolytica
EYPTRPPKC

SEQ ID NO: 2620045 - protein, 6 aa, Entamoeba histolytica
EYPTTS

SEQ ID NO: 2620046 - protein, 5 aa, Entamoeba histolytica
EYQEE

SEQ ID NO: 2620047 - protein, 5 aa, Entamoeba histolytica
EYQEG

SEQ ID NO: 2620048 - protein, 9 aa, Entamoeba histolytica
EYQEKRDFE

SEQ ID NO: 2620049 - protein, 11 aa, Entamoeba histolytica
EYQGNSDEELK

SEQ ID NO: 2620050 - protein, 5 aa, Entamoeba histolytica
EYQKN

SEQ ID NO: 2620051 - protein, 11 aa, Entamoeba histolytica
EYQNDSDEEKM

SEQ ID NO: 2620052 - protein, 8 aa, Entamoeba histolytica
EYQPSKRY

SEQ ID NO: 2620053 - protein, 9 aa, Entamoeba histolytica
EYQPTEGEE

SEQ ID NO: 2620054 - protein, 26 aa, Entamoeba histolytica
EYQQMQQKKRPVQKTKEVDYQKEREY

SEQ ID NO: 2620055 - protein, 6 aa, Entamoeba histolytica
EYQTPS

SEQ ID NO: 2620056 - protein, 12 aa, Entamoeba histolytica
EYRDSEEDSSEF

SEQ ID NO: 2620057 - protein, 7 aa, Entamoeba histolytica
EYRGGAA

SEQ ID NO: 2620058 - protein, 10 aa, Entamoeba histolytica
EYRKDIDEEL

SEQ ID NO: 2620059 - protein, 8 aa, Entamoeba histolytica
EYRRQGIG

SEQ ID NO: 2620060 - protein, 6 aa, Entamoeba histolytica
EYRSTQ

SEQ ID NO: 2620061 - protein, 13 aa, Entamoeba histolytica
EYSDKKEIGNTKG

SEQ ID NO: 2620062 - protein, 9 aa, Entamoeba histolytica
EYSEADKNA

SEQ ID NO: 2620063 - protein, 13 aa, Entamoeba histolytica
EYSESGSPFYGEA

SEQ ID NO: 2620064 - protein, 11 aa, Entamoeba histolytica
EYSFSNSKNVD

SEQ ID NO: 2620065 - protein, 4 aa, Entamoeba histolytica
EYSI

SEQ ID NO: 2620066 - protein, 4 aa, Entamoeba histolytica
EYSN

SEQ ID NO: 2620067 - protein, 8 aa, Entamoeba histolytica
EYSPSPNV

SEQ ID NO: 2620068 - protein, 8 aa, Entamoeba histolytica
EYSQATEY

SEQ ID NO: 2620069 - protein, 18 aa, Entamoeba histolytica
EYSQGRDGAELANPETFA

SEQ ID NO: 2620070 - protein, 8 aa, Entamoeba histolytica
EYSSDEHT

SEQ ID NO: 2620071 - protein, 7 aa, Entamoeba histolytica
EYSSHGR

SEQ ID NO: 2620072 - protein, 8 aa, Entamoeba histolytica
EYSSNNQD

SEQ ID NO: 2620073 - protein, 16 aa, Entamoeba histolytica
EYSTDYKSTIGSDISQ

SEQ ID NO: 2620074 - protein, 15 aa, Entamoeba histolytica
EYSTECSKEYSKAEG

SEQ ID NO: 2620075 - protein, 9 aa, Entamoeba histolytica
EYSTPPPHS

SEQ ID NO: 2620076 - protein, 5 aa, Entamoeba histolytica
EYTAE

SEQ ID NO: 2620077 - protein, 9 aa, Entamoeba histolytica
EYTDDSPEF

SEQ ID NO: 2620078 - protein, 6 aa, Entamoeba histolytica
EYTDSI

SEQ ID NO: 2620079 - protein, 4 aa, Entamoeba histolytica
EYTE

SEQ ID NO: 2620080 - protein, 13 aa, Entamoeba histolytica
EYTEEDREEYGNT

SEQ ID NO: 2620081 - protein, 14 aa, Entamoeba histolytica
EYTEEDRKKYGNTI

SEQ ID NO: 2620082 - protein, 14 aa, Entamoeba histolytica
EYTEEDRNKYGNTI

SEQ ID NO: 2620083 - protein, 13 aa, Entamoeba histolytica
EYTEEDRNTYGNT

SEQ ID NO: 2620084 - protein, 15 aa, Entamoeba histolytica
EYTEEESNEEEDEEP

SEQ ID NO: 2620085 - protein, 20 aa, Entamoeba histolytica
EYTEYDREEFGDEIPPEVNS

SEQ ID NO: 2620086 - protein, 4 aa, Entamoeba histolytica
EYTG

SEQ ID NO: 2620087 - protein, 9 aa, Entamoeba histolytica
EYTGGDNAV

SEQ ID NO: 2620088 - protein, 10 aa, Entamoeba histolytica
EYTGKREFDT

SEQ ID NO: 2620089 - protein, 12 aa, Entamoeba histolytica
EYTISKEKSSNV

SEQ ID NO: 2620090 - protein, 13 aa, Entamoeba histolytica
EYTKEDGEEYGNT

SEQ ID NO: 2620091 - protein, 13 aa, Entamoeba histolytica
EYTKEDREEYGNT

SEQ ID NO: 2620092 - protein, 14 aa, Entamoeba histolytica
EYTKEDRKKYGNTI

SEQ ID NO: 2620093 - protein, 10 aa, Entamoeba histolytica
EYTKEKKSEM

SEQ ID NO: 2620094 - protein, 31 aa, Entamoeba histolytica
EYTLNNGTCESKENKNGKNEEIYCENGKYIK

SEQ ID NO: 2620095 - protein, 12 aa, Entamoeba histolytica
EYTNTVDSNKQR

SEQ ID NO: 2620096 - protein, 7 aa, Entamoeba histolytica
EYTQEDR

SEQ ID NO: 2620097 - protein, 24 aa, Entamoeba histolytica
EYTQEDREEYGNTIPNEVTSLGNK

SEQ ID NO: 2620098 - protein, 18 aa, Entamoeba histolytica
EYTQEDRKKYGNTIPNEV

SEQ ID NO: 2620099 - protein, 5 aa, Entamoeba histolytica
EYTQN

SEQ ID NO: 2620100 - protein, 15 aa, Entamoeba histolytica
EYTSESDEDDDDEEE

SEQ ID NO: 2620101 - protein, 6 aa, Entamoeba histolytica
EYTSHE

SEQ ID NO: 2620102 - protein, 6 aa, Entamoeba histolytica
EYTSNP

SEQ ID NO: 2620103 - protein, 4 aa, Entamoeba histolytica
EYTT

SEQ ID NO: 2620104 - protein, 8 aa, Entamoeba histolytica
EYTTPEER

SEQ ID NO: 2620105 - protein, 8 aa, Entamoeba histolytica
EYTTSASV

SEQ ID NO: 2620106 - protein, 9 aa, Entamoeba histolytica
EYTTTKEEL

SEQ ID NO: 2620107 - protein, 14 aa, Entamoeba histolytica
EYVDPTEGMTEEEK

SEQ ID NO: 2620108 - protein, 5 aa, Entamoeba histolytica
EYYGD

SEQ ID NO: 2620109 - protein, 15 aa, Entamoeba histolytica
FAAAGGYIASDKSTI

SEQ ID NO: 2620110 - protein, 9 aa, Entamoeba histolytica
FAASNPTNV

SEQ ID NO: 2620111 - protein, 64 aa, Entamoeba histolytica
FADDDNATSDNNLEMTNPTIPSKKSIKKSSKKSIKKSIKKSIKKSIKKASKKSTNSSSNGIQPM

SEQ ID NO: 2620112 - protein, 9 aa, Entamoeba histolytica
FADDEDPIE

SEQ ID NO: 2620113 - protein, 14 aa, Entamoeba histolytica
FADPANATDAKINE

SEQ ID NO: 2620114 - protein, 6 aa, Entamoeba histolytica
FAEKTK

SEQ ID NO: 2620115 - protein, 8 aa, Entamoeba histolytica
FAENSNNI

SEQ ID NO: 2620116 - protein, 11 aa, Entamoeba histolytica
FAEQTKSTVGA

SEQ ID NO: 2620117 - protein, 6 aa, Entamoeba histolytica
FAGGLD

SEQ ID NO: 2620118 - protein, 7 aa, Entamoeba histolytica
FAGKGQK

SEQ ID NO: 2620119 - protein, 11 aa, Entamoeba histolytica
FAKEKNGMALE

SEQ ID NO: 2620120 - protein, 7 aa, Entamoeba histolytica
FAKGGER

SEQ ID NO: 2620121 - protein, 13 aa, Entamoeba histolytica
FAKPEKSSIEPTM

SEQ ID NO: 2620122 - protein, 12 aa, Entamoeba histolytica
FALQSNNAIIHL

SEQ ID NO: 2620123 - protein, 11 aa, Entamoeba histolytica
FANDPNVTDGA

SEQ ID NO: 2620124 - protein, 16 aa, Entamoeba histolytica
FANPVTQQKPVSPLKQ

SEQ ID NO: 2620125 - protein, 15 aa, Entamoeba histolytica
FANSSNTNDSIPPPV

SEQ ID NO: 2620126 - protein, 7 aa, Entamoeba histolytica
FAPKGRK

SEQ ID NO: 2620127 - protein, 26 aa, Entamoeba histolytica
FAPKKTNHSYGRRFTASDKIKKEKEI

SEQ ID NO: 2620128 - protein, 7 aa, Entamoeba histolytica
FAPKNEE

SEQ ID NO: 2620129 - protein, 5 aa, Entamoeba histolytica
FAPNT

SEQ ID NO: 2620130 - protein, 7 aa, Entamoeba histolytica
FAPQKTF

SEQ ID NO: 2620131 - protein, 6 aa, Entamoeba histolytica
FAPQPP

SEQ ID NO: 2620132 - protein, 15 aa, Entamoeba histolytica
FAPTTLKEAAKEAKE

SEQ ID NO: 2620133 - protein, 6 aa, Entamoeba histolytica
FAQETP

SEQ ID NO: 2620134 - protein, 8 aa, Entamoeba histolytica
FAQNSKNE

SEQ ID NO: 2620135 - protein, 7 aa, Entamoeba histolytica
FARRTGG

SEQ ID NO: 2620136 - protein, 7 aa, Entamoeba histolytica
FARSGSI

SEQ ID NO: 2620137 - protein, 7 aa, Entamoeba histolytica
FARSGSV

SEQ ID NO: 2620138 - protein, 7 aa, Entamoeba histolytica
FASGGND

SEQ ID NO: 2620139 - protein, 6 aa, Entamoeba histolytica
FASTRT

SEQ ID NO: 2620140 - protein, 6 aa, Entamoeba histolytica
FATGGE

SEQ ID NO: 2620141 - protein, 9 aa, Entamoeba histolytica
FATNSADVK

SEQ ID NO: 2620142 - protein, 16 aa, Entamoeba histolytica
FATPRSARRHNEIREE

SEQ ID NO: 2620143 - protein, 11 aa, Entamoeba histolytica
FATQAEAEKEC

SEQ ID NO: 2620144 - protein, 7 aa, Entamoeba histolytica
FATRAKY

SEQ ID NO: 2620145 - protein, 17 aa, Entamoeba histolytica
FCDSDEQKQEEKEDEIQ

SEQ ID NO: 2620146 - protein, 9 aa, Entamoeba histolytica
FCESEGQNV

SEQ ID NO: 2620147 - protein, 30 aa, Entamoeba histolytica
FCKSKQKQKKAQQVEEFDEEPQPISPKQEV

SEQ ID NO: 2620148 - protein, 17 aa, Entamoeba histolytica
FCSDKGSQYNCDNEKKD

SEQ ID NO: 2620149 - protein, 9 aa, Entamoeba histolytica
FCSQESKLE

SEQ ID NO: 2620150 - protein, 10 aa, Entamoeba histolytica
FDASDKAIAN

SEQ ID NO: 2620151 - protein, 10 aa, Entamoeba histolytica
FDDDGNNGSD

SEQ ID NO: 2620152 - protein, 10 aa, Entamoeba histolytica
FDDEDDVNEI

SEQ ID NO: 2620153 - protein, 29 aa, Entamoeba histolytica
FDDEDETSHTNNKISETTQPHNEGEIEID

SEQ ID NO: 2620154 - protein, 9 aa, Entamoeba histolytica
FDDEPNPVI

SEQ ID NO: 2620155 - protein, 7 aa, Entamoeba histolytica
FDDKKAD

SEQ ID NO: 2620156 - protein, 5 aa, Entamoeba histolytica
FDDPE

SEQ ID NO: 2620157 - protein, 20 aa, Entamoeba histolytica
FDDPKTAGFRKTRNYQTEQQ

SEQ ID NO: 2620158 - protein, 7 aa, Entamoeba histolytica
FDDPQRW

SEQ ID NO: 2620159 - protein, 9 aa, Entamoeba histolytica
FDDQTGAEE

SEQ ID NO: 2620160 - protein, 4 aa, Entamoeba histolytica
FDDY

SEQ ID NO: 2620161 - protein, 15 aa, Entamoeba histolytica
FDDYDDSTDSSEEEF

SEQ ID NO: 2620162 - protein, 12 aa, Entamoeba histolytica
FDEDSYVDDSDT

SEQ ID NO: 2620163 - protein, 10 aa, Entamoeba histolytica
FDEDVSGALQ

SEQ ID NO: 2620164 - protein, 23 aa, Entamoeba histolytica
FDEEDGEAMEEEEEEEEEEEDIF

SEQ ID NO: 2620165 - protein, 8 aa, Entamoeba histolytica
FDEENSAV

SEQ ID NO: 2620166 - protein, 6 aa, Entamoeba histolytica
FDEEPK

SEQ ID NO: 2620167 - protein, 18 aa, Entamoeba histolytica
FDEESSRKALEKTKGDIE

SEQ ID NO: 2620168 - protein, 9 aa, Entamoeba histolytica
FDEGENNAN

SEQ ID NO: 2620169 - protein, 4 aa, Entamoeba histolytica
FDEK

SEQ ID NO: 2620170 - protein, 15 aa, Entamoeba histolytica
FDEKKPYTYPPSPND

SEQ ID NO: 2620171 - protein, 5 aa, Entamoeba histolytica
FDEND

SEQ ID NO: 2620172 - protein, 23 aa, Entamoeba histolytica
FDENEQEEEEMDKEDLQQITSPI

SEQ ID NO: 2620173 - protein, 5 aa, Entamoeba histolytica
FDERY

SEQ ID NO: 2620174 - protein, 30 aa, Entamoeba histolytica
FDESGENEDLSNSDNSEDSDNDADINFDEI

SEQ ID NO: 2620175 - protein, 9 aa, Entamoeba histolytica
FDESGGKKI

SEQ ID NO: 2620176 - protein, 8 aa, Entamoeba histolytica
FDESKYDE

SEQ ID NO: 2620177 - protein, 5 aa, Entamoeba histolytica
FDEST

SEQ ID NO: 2620178 - protein, 8 aa, Entamoeba histolytica
FDETTYDN

SEQ ID NO: 2620179 - protein, 5 aa, Entamoeba histolytica
FDEYS

SEQ ID NO: 2620180 - protein, 14 aa, Entamoeba histolytica
FDEYSKSQIQANMD

SEQ ID NO: 2620181 - protein, 6 aa, Entamoeba histolytica
FDGCSS

SEQ ID NO: 2620182 - protein, 4 aa, Entamoeba histolytica
FDGD

SEQ ID NO: 2620183 - protein, 11 aa, Entamoeba histolytica
FDGDGKIGMDD

SEQ ID NO: 2620184 - protein, 5 aa, Entamoeba histolytica
FDGKE

SEQ ID NO: 2620185 - protein, 5 aa, Entamoeba histolytica
FDGKK

SEQ ID NO: 2620186 - protein, 7 aa, Entamoeba histolytica
FDGKNVE

SEQ ID NO: 2620187 - protein, 12 aa, Entamoeba histolytica
FDGPKPDKNGEM

SEQ ID NO: 2620188 - protein, 5 aa, Entamoeba histolytica
FDGSH

SEQ ID NO: 2620189 - protein, 10 aa, Entamoeba histolytica
FDGSTRPGLA

SEQ ID NO: 2620190 - protein, 6 aa, Entamoeba histolytica
FDIEDD

SEQ ID NO: 2620191 - protein, 22 aa, Entamoeba histolytica
FDIKKDNVKKSIKELDSNGDGV

SEQ ID NO: 2620192 - protein, 8 aa, Entamoeba histolytica
FDKDSKCS

SEQ ID NO: 2620193 - protein, 20 aa, Entamoeba histolytica
FDKEEKSKEKEPKCNKSERM

SEQ ID NO: 2620194 - protein, 6 aa, Entamoeba histolytica
FDKEPQ

SEQ ID NO: 2620195 - protein, 6 aa, Entamoeba histolytica
FDKGEY

SEQ ID NO: 2620196 - protein, 6 aa, Entamoeba histolytica
FDKGSL

SEQ ID NO: 2620197 - protein, 4 aa, Entamoeba histolytica
FDKN

SEQ ID NO: 2620198 - protein, 10 aa, Entamoeba histolytica
FDKNEEDSAY

SEQ ID NO: 2620199 - protein, 8 aa, Entamoeba histolytica
FDKNEINE

SEQ ID NO: 2620200 - protein, 4 aa, Entamoeba histolytica
FDKP

SEQ ID NO: 2620201 - protein, 9 aa, Entamoeba histolytica
FDKPTSSTL

SEQ ID NO: 2620202 - protein, 10 aa, Entamoeba histolytica
FDKSNSEGTL

SEQ ID NO: 2620203 - protein, 9 aa, Entamoeba histolytica
FDKTSPEIF

SEQ ID NO: 2620204 - protein, 17 aa, Entamoeba histolytica
FDNDDYEEYQLGDNEED

SEQ ID NO: 2620205 - protein, 10 aa, Entamoeba histolytica
FDNDNKKQSF

SEQ ID NO: 2620206 - protein, 28 aa, Entamoeba histolytica
FDNEQKRKKEKSMKDEEKVINEDNELSD

SEQ ID NO: 2620207 - protein, 4 aa, Entamoeba histolytica
FDNG

SEQ ID NO: 2620208 - protein, 5 aa, Entamoeba histolytica
FDNKA

SEQ ID NO: 2620209 - protein, 9 aa, Entamoeba histolytica
FDNKRTEML

SEQ ID NO: 2620210 - protein, 6 aa, Entamoeba histolytica
FDNNGK

SEQ ID NO: 2620211 - protein, 11 aa, Entamoeba histolytica
FDNQPIDEVSK

SEQ ID NO: 2620212 - protein, 12 aa, Entamoeba histolytica
FDNSTETPLEIN

SEQ ID NO: 2620213 - protein, 8 aa, Entamoeba histolytica
FDNTKAKE

SEQ ID NO: 2620214 - protein, 7 aa, Entamoeba histolytica
FDNTSSP

SEQ ID NO: 2620215 - protein, 4 aa, Entamoeba histolytica
FDPE

SEQ ID NO: 2620216 - protein, 10 aa, Entamoeba histolytica
FDPKDTHPLQ

SEQ ID NO: 2620217 - protein, 7 aa, Entamoeba histolytica
FDPKTKQ

SEQ ID NO: 2620218 - protein, 9 aa, Entamoeba histolytica
FDPQSGKYF

SEQ ID NO: 2620219 - protein, 7 aa, Entamoeba histolytica
FDPSTGM

SEQ ID NO: 2620220 - protein, 9 aa, Entamoeba histolytica
FDPTKITGI

SEQ ID NO: 2620221 - protein, 5 aa, Entamoeba histolytica
FDPTN

SEQ ID NO: 2620222 - protein, 16 aa, Entamoeba histolytica
FDQNKTTLKQLTSEEL

SEQ ID NO: 2620223 - protein, 9 aa, Entamoeba histolytica
FDQNTPCKP

SEQ ID NO: 2620224 - protein, 7 aa, Entamoeba histolytica
FDQSSSI

SEQ ID NO: 2620225 - protein, 6 aa, Entamoeba histolytica
FDQTPD

SEQ ID NO: 2620226 - protein, 5 aa, Entamoeba histolytica
FDQTT

SEQ ID NO: 2620227 - protein, 12 aa, Entamoeba histolytica
FDQVEEQPNQKT

SEQ ID NO: 2620228 - protein, 9 aa, Entamoeba histolytica
FDRTTKYPE

SEQ ID NO: 2620229 - protein, 4 aa, Entamoeba histolytica
FDSA

SEQ ID NO: 2620230 - protein, 7 aa, Entamoeba histolytica
FDSDNER

SEQ ID NO: 2620231 - protein, 10 aa, Entamoeba histolytica
FDSDSTQQDV

SEQ ID NO: 2620232 - protein, 8 aa, Entamoeba histolytica
FDSEETEQ

SEQ ID NO: 2620233 - protein, 15 aa, Entamoeba histolytica
FDSKDKLYSKISRES

SEQ ID NO: 2620234 - protein, 16 aa, Entamoeba histolytica
FDSKSKDIGSKYNTTQ

SEQ ID NO: 2620235 - protein, 21 aa, Entamoeba histolytica
FDSNGKLKEITQQPGESKESF

SEQ ID NO: 2620236 - protein, 7 aa, Entamoeba histolytica
FDSNTLS

SEQ ID NO: 2620237 - protein, 12 aa, Entamoeba histolytica
FDSPKIKVTPKI

SEQ ID NO: 2620238 - protein, 11 aa, Entamoeba histolytica
FDSQEEKKEEM

SEQ ID NO: 2620239 - protein, 8 aa, Entamoeba histolytica
FDSSNENK

SEQ ID NO: 2620240 - protein, 7 aa, Entamoeba histolytica
FDSSSDN

SEQ ID NO: 2620241 - protein, 17 aa, Entamoeba histolytica
FDSSTIKEIKKRKSEQT

SEQ ID NO: 2620242 - protein, 11 aa, Entamoeba histolytica
FDSTKPQREKY

SEQ ID NO: 2620243 - protein, 12 aa, Entamoeba histolytica
FDSTKSNFEEGI

SEQ ID NO: 2620244 - protein, 21 aa, Entamoeba histolytica
FDSTTDDESMVNNKPIEDTNS

SEQ ID NO: 2620245 - protein, 30 aa, Entamoeba histolytica
FDSVDDESALEQTVGNLPSANEWKSKENPP

SEQ ID NO: 2620246 - protein, 11 aa, Entamoeba histolytica
FDSYRGTNYPG

SEQ ID NO: 2620247 - protein, 11 aa, Entamoeba histolytica
FDTIKNEKEIK

SEQ ID NO: 2620248 - protein, 7 aa, Entamoeba histolytica
FDTKEDA

SEQ ID NO: 2620249 - protein, 14 aa, Entamoeba histolytica
FDTPKTSVSLTPNV

SEQ ID NO: 2620250 - protein, 13 aa, Entamoeba histolytica
FDTRPKDVEAPFR

SEQ ID NO: 2620251 - protein, 6 aa, Entamoeba histolytica
FDTTNP

SEQ ID NO: 2620252 - protein, 14 aa, Entamoeba histolytica
FDTTSVKAAADSYK

SEQ ID NO: 2620253 - protein, 15 aa, Entamoeba histolytica
FDVEPKAKCKKTERV

SEQ ID NO: 2620254 - protein, 12 aa, Entamoeba histolytica
FDVNDNPNPVVK

SEQ ID NO: 2620255 - protein, 24 aa, Entamoeba histolytica
FDVTDDVNSKTQKTSGFYGEGNRS

SEQ ID NO: 2620256 - protein, 10 aa, Entamoeba histolytica
FDYSTNTGYP

SEQ ID NO: 2620257 - protein, 5 aa, Entamoeba histolytica
FEAPP

SEQ ID NO: 2620258 - protein, 6 aa, Entamoeba histolytica
FEAPPG

SEQ ID NO: 2620259 - protein, 14 aa, Entamoeba histolytica
FEAQTAISSNIQNV

SEQ ID NO: 2620260 - protein, 4 aa, Entamoeba histolytica
FEDE

SEQ ID NO: 2620261 - protein, 8 aa, Entamoeba histolytica
FEDEQKEH

SEQ ID NO: 2620262 - protein, 11 aa, Entamoeba histolytica
FEDIESNSEQM

SEQ ID NO: 2620263 - protein, 14 aa, Entamoeba histolytica
FEDKTGLEESMTDN

SEQ ID NO: 2620264 - protein, 16 aa, Entamoeba histolytica
FEDNNISSLSGSKQIQ

SEQ ID NO: 2620265 - protein, 6 aa, Entamoeba histolytica
FEDQDG

SEQ ID NO: 2620266 - protein, 19 aa, Entamoeba histolytica
FEDQDGFKISSDDEQSSKL

SEQ ID NO: 2620267 - protein, 11 aa, Entamoeba histolytica
FEDREVEREKV

SEQ ID NO: 2620268 - protein, 10 aa, Entamoeba histolytica
FEDSSKVIED

SEQ ID NO: 2620269 - protein, 5 aa, Entamoeba histolytica
FEDTD

SEQ ID NO: 2620270 - protein, 6 aa, Entamoeba histolytica
FEDTDD

SEQ ID NO: 2620271 - protein, 12 aa, Entamoeba histolytica
FEEAKRAKNQLN

SEQ ID NO: 2620272 - protein, 8 aa, Entamoeba histolytica
FEEARERL

SEQ ID NO: 2620273 - protein, 32 aa, Entamoeba histolytica
FEEEDDDDVVEEAATKAEGDDDDLLEKADEQI

SEQ ID NO: 2620274 - protein, 28 aa, Entamoeba histolytica
FEEEEDDDDYDENDDGYDEEGDDYDEDN

SEQ ID NO: 2620275 - protein, 20 aa, Entamoeba histolytica
FEEEGLKEFKGKTIQLPFIL

SEQ ID NO: 2620276 - protein, 15 aa, Entamoeba histolytica
FEEELSDNEAAPTWI

SEQ ID NO: 2620277 - protein, 6 aa, Entamoeba histolytica
FEEEPD

SEQ ID NO: 2620278 - protein, 6 aa, Entamoeba histolytica
FEEEPK

SEQ ID NO: 2620279 - protein, 9 aa, Entamoeba histolytica
FEEESDDPE

SEQ ID NO: 2620280 - protein, 16 aa, Entamoeba histolytica
FEEGEDELKELNKTKE

SEQ ID NO: 2620281 - protein, 8 aa, Entamoeba histolytica
FEEGKEIG

SEQ ID NO: 2620282 - protein, 25 aa, Entamoeba histolytica
FEEGNERKRIKQENDEYKPNCSEYN

SEQ ID NO: 2620283 - protein, 25 aa, Entamoeba histolytica
FEEGNERKRIKQENDEYKPNRSEYK

SEQ ID NO: 2620284 - protein, 9 aa, Entamoeba histolytica
FEEKDGKEI

SEQ ID NO: 2620285 - protein, 9 aa, Entamoeba histolytica
FEEKQHGLE

SEQ ID NO: 2620286 - protein, 12 aa, Entamoeba histolytica
FEELPDRDDIQK

SEQ ID NO: 2620287 - protein, 27 aa, Entamoeba histolytica
FEENRKHEAQKKTEELMKEQKEADEIK

SEQ ID NO: 2620288 - protein, 14 aa, Entamoeba histolytica
FEENYNERSVGISR

SEQ ID NO: 2620289 - protein, 10 aa, Entamoeba histolytica
FEEPKTTEIS

SEQ ID NO: 2620290 - protein, 7 aa, Entamoeba histolytica
FEEQRAN

SEQ ID NO: 2620291 - protein, 4 aa, Entamoeba histolytica
FEER

SEQ ID NO: 2620292 - protein, 4 aa, Entamoeba histolytica
FEES

SEQ ID NO: 2620293 - protein, 7 aa, Entamoeba histolytica
FEESEYN

SEQ ID NO: 2620294 - protein, 5 aa, Entamoeba histolytica
FEESK

SEQ ID NO: 2620295 - protein, 9 aa, Entamoeba histolytica
FEESRSREE

SEQ ID NO: 2620296 - protein, 5 aa, Entamoeba histolytica
FEESS

SEQ ID NO: 2620297 - protein, 12 aa, Entamoeba histolytica
FEETEKGAEKAM

SEQ ID NO: 2620298 - protein, 7 aa, Entamoeba histolytica
FEETESK

SEQ ID NO: 2620299 - protein, 11 aa, Entamoeba histolytica
FEETKNQSDGF

SEQ ID NO: 2620300 - protein, 4 aa, Entamoeba histolytica
FEEV

SEQ ID NO: 2620301 - protein, 16 aa, Entamoeba histolytica
FEGESVKEKVNEYYKE

SEQ ID NO: 2620302 - protein, 4 aa, Entamoeba histolytica
FEGI

SEQ ID NO: 2620303 - protein, 12 aa, Entamoeba histolytica
FEGNPAGAHKDI

SEQ ID NO: 2620304 - protein, 9 aa, Entamoeba histolytica
FEGRDKDVD

SEQ ID NO: 2620305 - protein, 21 aa, Entamoeba histolytica
FEGRKAKAIAKTITKQRVESG

SEQ ID NO: 2620306 - protein, 4 aa, Entamoeba histolytica
FEGS

SEQ ID NO: 2620307 - protein, 9 aa, Entamoeba histolytica
FEGSKKPIL

SEQ ID NO: 2620308 - protein, 5 aa, Entamoeba histolytica
FEGSN

SEQ ID NO: 2620309 - protein, 8 aa, Entamoeba histolytica
FEGSSTQG

SEQ ID NO: 2620310 - protein, 4 aa, Entamoeba histolytica
FEGY

SEQ ID NO: 2620311 - protein, 4 aa, Entamoeba histolytica
FEHD

SEQ ID NO: 2620312 - protein, 8 aa, Entamoeba histolytica
FEHEDGSP

SEQ ID NO: 2620313 - protein, 11 aa, Entamoeba histolytica
FEHSEDGESYP

SEQ ID NO: 2620314 - protein, 19 aa, Entamoeba histolytica
FEINNQRNKTKAGDENEKL

SEQ ID NO: 2620315 - protein, 8 aa, Entamoeba histolytica
FEKEEETV

SEQ ID NO: 2620316 - protein, 13 aa, Entamoeba histolytica
FEKEGDPSFNDDG

SEQ ID NO: 2620317 - protein, 20 aa, Entamoeba histolytica
FEKEGEKNEMFSGTTSSGEV

SEQ ID NO: 2620318 - protein, 13 aa, Entamoeba histolytica
FEKEGLKQVNEEV

SEQ ID NO: 2620319 - protein, 19 aa, Entamoeba histolytica
FEKEKKEWAEKEKKYTEQI

SEQ ID NO: 2620320 - protein, 23 aa, Entamoeba histolytica
FEKENKEIERREKEKKINKKREQ

SEQ ID NO: 2620321 - protein, 9 aa, Entamoeba histolytica
FEKERRKQQ

SEQ ID NO: 2620322 - protein, 8 aa, Entamoeba histolytica
FEKETIPR

SEQ ID NO: 2620323 - protein, 4 aa, Entamoeba histolytica
FEKG

SEQ ID NO: 2620324 - protein, 5 aa, Entamoeba histolytica
FEKGE

SEQ ID NO: 2620325 - protein, 13 aa, Entamoeba histolytica
FEKGKPEKANDEI

SEQ ID NO: 2620326 - protein, 26 aa, Entamoeba histolytica
FEKKGNEKVRPNYKKFEPQEKEQTEV

SEQ ID NO: 2620327 - protein, 9 aa, Entamoeba histolytica
FEKKSRGYM

SEQ ID NO: 2620328 - protein, 13 aa, Entamoeba histolytica
FEKNQKKPKKIGV

SEQ ID NO: 2620329 - protein, 7 aa, Entamoeba histolytica
FEKQDTL

SEQ ID NO: 2620330 - protein, 11 aa, Entamoeba histolytica
FEKQKEESYEE

SEQ ID NO: 2620331 - protein, 14 aa, Entamoeba histolytica
FEKQTKSKQPQIAY

SEQ ID NO: 2620332 - protein, 16 aa, Entamoeba histolytica
FEKSIHESNVEKNDIE

SEQ ID NO: 2620333 - protein, 10 aa, Entamoeba histolytica
FEKSKEGGVL

SEQ ID NO: 2620334 - protein, 6 aa, Entamoeba histolytica
FEKSTK

SEQ ID NO: 2620335 - protein, 7 aa, Entamoeba histolytica
FEKTGDV

SEQ ID NO: 2620336 - protein, 16 aa, Entamoeba histolytica
FEKTRKVSGPRSLQGS

SEQ ID NO: 2620337 - protein, 12 aa, Entamoeba histolytica
FELEKEKSKTFE

SEQ ID NO: 2620338 - protein, 5 aa, Entamoeba histolytica
FELSG

SEQ ID NO: 2620339 - protein, 8 aa, Entamoeba histolytica
FENEKNAA

SEQ ID NO: 2620340 - protein, 8 aa, Entamoeba histolytica
FENGKAKK

SEQ ID NO: 2620341 - protein, 5 aa, Entamoeba histolytica
FENKT

SEQ ID NO: 2620342 - protein, 6 aa, Entamoeba histolytica
FENKVS

SEQ ID NO: 2620343 - protein, 5 aa, Entamoeba histolytica
FENNQ

SEQ ID NO: 2620344 - protein, 10 aa, Entamoeba histolytica
FENNTNDIEQ

SEQ ID NO: 2620345 - protein, 6 aa, Entamoeba histolytica
FENPSV

SEQ ID NO: 2620346 - protein, 15 aa, Entamoeba histolytica
FENRTEALPQRKTEI

SEQ ID NO: 2620347 - protein, 4 aa, Entamoeba histolytica
FENS

SEQ ID NO: 2620348 - protein, 73 aa, Entamoeba histolytica
FENSKDSTLGKEEKVVEEEKEETTSNSSSSSSESSSSEESSSSKSSESSSSESESEEEKKRVKKGKEGGEKKK

SEQ ID NO: 2620349 - protein, 5 aa, Entamoeba histolytica
FENTI

SEQ ID NO: 2620350 - protein, 10 aa, Entamoeba histolytica
FEPDTENTSL

SEQ ID NO: 2620351 - protein, 7 aa, Entamoeba histolytica
FEPENQP

SEQ ID NO: 2620352 - protein, 6 aa, Entamoeba histolytica
FEPEVS

SEQ ID NO: 2620353 - protein, 11 aa, Entamoeba histolytica
FEPKAEAKPDM

SEQ ID NO: 2620354 - protein, 4 aa, Entamoeba histolytica
FEPN

SEQ ID NO: 2620355 - protein, 10 aa, Entamoeba histolytica
FEPNPADFER

SEQ ID NO: 2620356 - protein, 9 aa, Entamoeba histolytica
FEPNQTQRC

SEQ ID NO: 2620357 - protein, 14 aa, Entamoeba histolytica
FEPPPSTTKRGCAD

SEQ ID NO: 2620358 - protein, 7 aa, Entamoeba histolytica
FEPPTQS

SEQ ID NO: 2620359 - protein, 5 aa, Entamoeba histolytica
FEPSG

SEQ ID NO: 2620360 - protein, 33 aa, Entamoeba histolytica
FEPSTNTSLLGSSNNSTIPGNSLTNSITSDISL

SEQ ID NO: 2620361 - protein, 5 aa, Entamoeba histolytica
FEPSY

SEQ ID NO: 2620362 - protein, 5 aa, Entamoeba histolytica
FEPTR

SEQ ID NO: 2620363 - protein, 6 aa, Entamoeba histolytica
FEPVSP

SEQ ID NO: 2620364 - protein, 5 aa, Entamoeba histolytica
FEQDS

SEQ ID NO: 2620365 - protein, 6 aa, Entamoeba histolytica
FEQEAN

SEQ ID NO: 2620366 - protein, 8 aa, Entamoeba histolytica
FEQEEGDV

SEQ ID NO: 2620367 - protein, 12 aa, Entamoeba histolytica
FEQEQEPNGKDT

SEQ ID NO: 2620368 - protein, 36 aa, Entamoeba histolytica
FEQPLDNESSSRKTEVKIQNSKKSSFISTPKPLTSF

SEQ ID NO: 2620369 - protein, 13 aa, Entamoeba histolytica
FEQPNQPSRQRKS

SEQ ID NO: 2620370 - protein, 5 aa, Entamoeba histolytica
FEQQP

SEQ ID NO: 2620371 - protein, 5 aa, Entamoeba histolytica
FEQTK

SEQ ID NO: 2620372 - protein, 6 aa, Entamoeba histolytica
FERDEN

SEQ ID NO: 2620373 - protein, 5 aa, Entamoeba histolytica
FERDS

SEQ ID NO: 2620374 - protein, 4 aa, Entamoeba histolytica
FERN

SEQ ID NO: 2620375 - protein, 5 aa, Entamoeba histolytica
FERPG

SEQ ID NO: 2620376 - protein, 6 aa, Entamoeba histolytica
FERPKE

SEQ ID NO: 2620377 - protein, 7 aa, Entamoeba histolytica
FERQESC

SEQ ID NO: 2620378 - protein, 4 aa, Entamoeba histolytica
FESC

SEQ ID NO: 2620379 - protein, 6 aa, Entamoeba histolytica
FESEKK

SEQ ID NO: 2620380 - protein, 5 aa, Entamoeba histolytica
FESIQ

SEQ ID NO: 2620381 - protein, 6 aa, Entamoeba histolytica
FESSEG

SEQ ID NO: 2620382 - protein, 7 aa, Entamoeba histolytica
FETEEGK

SEQ ID NO: 2620383 - protein, 7 aa, Entamoeba histolytica
FETHTDS

SEQ ID NO: 2620384 - protein, 19 aa, Entamoeba histolytica
FETKPKKISKIKKDSKKLT

SEQ ID NO: 2620385 - protein, 11 aa, Entamoeba histolytica
FETPQNNEPID

SEQ ID NO: 2620386 - protein, 4 aa, Entamoeba histolytica
FETR

SEQ ID NO: 2620387 - protein, 5 aa, Entamoeba histolytica
FETTL

SEQ ID NO: 2620388 - protein, 5 aa, Entamoeba histolytica
FETVG

SEQ ID NO: 2620389 - protein, 4 aa, Entamoeba histolytica
FEVP

SEQ ID NO: 2620390 - protein, 8 aa, Entamoeba histolytica
FEVTSSAQ

SEQ ID NO: 2620391 - protein, 6 aa, Entamoeba histolytica
FEYGDS

SEQ ID NO: 2620392 - protein, 7 aa, Entamoeba histolytica
FEYTQGT

SEQ ID NO: 2620393 - protein, 7 aa, Entamoeba histolytica
FGATEND

SEQ ID NO: 2620394 - protein, 7 aa, Entamoeba histolytica
FGATNRN

SEQ ID NO: 2620395 - protein, 12 aa, Entamoeba histolytica
FGDAKTADGVKA

SEQ ID NO: 2620396 - protein, 5 aa, Entamoeba histolytica
FGDDH

SEQ ID NO: 2620397 - protein, 12 aa, Entamoeba histolytica
FGDEERKATEQA

SEQ ID NO: 2620398 - protein, 10 aa, Entamoeba histolytica
FGDESEQCNR

SEQ ID NO: 2620399 - protein, 6 aa, Entamoeba histolytica
FGDETQ

SEQ ID NO: 2620400 - protein, 8 aa, Entamoeba histolytica
FGDNELSP

SEQ ID NO: 2620401 - protein, 8 aa, Entamoeba histolytica
FGEDANTQ

SEQ ID NO: 2620402 - protein, 12 aa, Entamoeba histolytica
FGEDDTGSFSDD

SEQ ID NO: 2620403 - protein, 8 aa, Entamoeba histolytica
FGEDGRAV

SEQ ID NO: 2620404 - protein, 10 aa, Entamoeba histolytica
FGEERNVEQI

SEQ ID NO: 2620405 - protein, 7 aa, Entamoeba histolytica
FGEGERS

SEQ ID NO: 2620406 - protein, 22 aa, Entamoeba histolytica
FGENEEEDDESNEDDDSNGDAL

SEQ ID NO: 2620407 - protein, 8 aa, Entamoeba histolytica
FGENQGPQ

SEQ ID NO: 2620408 - protein, 6 aa, Entamoeba histolytica
FGETTS

SEQ ID NO: 2620409 - protein, 4 aa, Entamoeba histolytica
FGEV

SEQ ID NO: 2620410 - protein, 5 aa, Entamoeba histolytica
FGFAT

SEQ ID NO: 2620411 - protein, 6 aa, Entamoeba histolytica
FGGDDK

SEQ ID NO: 2620412 - protein, 9 aa, Entamoeba histolytica
FGGEENTLN

SEQ ID NO: 2620413 - protein, 10 aa, Entamoeba histolytica
FGGEQGAAPQ

SEQ ID NO: 2620414 - protein, 10 aa, Entamoeba histolytica
FGGETNYEID

SEQ ID NO: 2620415 - protein, 9 aa, Entamoeba histolytica
FGGGQYSKH

SEQ ID NO: 2620416 - protein, 14 aa, Entamoeba histolytica
FGGIGKNQEALPDP

SEQ ID NO: 2620417 - protein, 4 aa, Entamoeba histolytica
FGGN

SEQ ID NO: 2620418 - protein, 48 aa, Entamoeba histolytica
FGGQQGGMLGGQQNGFGQQQGGFGTNGFGQQTQGGFGTTGFGQTTGFG

SEQ ID NO: 2620419 - protein, 12 aa, Entamoeba histolytica
FGGRKDFDGKVF

SEQ ID NO: 2620420 - protein, 10 aa, Entamoeba histolytica
FGGSAEDIFK

SEQ ID NO: 2620421 - protein, 18 aa, Entamoeba histolytica
FGGSQGSKTTTIFFKKMI

SEQ ID NO: 2620422 - protein, 6 aa, Entamoeba histolytica
FGGTQG

SEQ ID NO: 2620423 - protein, 4 aa, Entamoeba histolytica
FGGY

SEQ ID NO: 2620424 - protein, 11 aa, Entamoeba histolytica
FGHDSSNTSIT

SEQ ID NO: 2620425 - protein, 19 aa, Entamoeba histolytica
FGKDDSLGSNISYPSTSPK

SEQ ID NO: 2620426 - protein, 20 aa, Entamoeba histolytica
FGKESSKTKRLEEFNEEEKS

SEQ ID NO: 2620427 - protein, 10 aa, Entamoeba histolytica
FGKKDKNEYI

SEQ ID NO: 2620428 - protein, 5 aa, Entamoeba histolytica
FGKKN

SEQ ID NO: 2620429 - protein, 10 aa, Entamoeba histolytica
FGKKNEGDSA

SEQ ID NO: 2620430 - protein, 10 aa, Entamoeba histolytica
FGKKTKESDE

SEQ ID NO: 2620431 - protein, 13 aa, Entamoeba histolytica
FGKNNSKYGEYEE

SEQ ID NO: 2620432 - protein, 18 aa, Entamoeba histolytica
FGKNPSFSFTRKDGSSVS

SEQ ID NO: 2620433 - protein, 5 aa, Entamoeba histolytica
FGKPI

SEQ ID NO: 2620434 - protein, 6 aa, Entamoeba histolytica
FGKPVN

SEQ ID NO: 2620435 - protein, 5 aa, Entamoeba histolytica
FGKRT

SEQ ID NO: 2620436 - protein, 6 aa, Entamoeba histolytica
FGKSDN

SEQ ID NO: 2620437 - protein, 13 aa, Entamoeba histolytica
FGKSNSQNPFPTA

SEQ ID NO: 2620438 - protein, 9 aa, Entamoeba histolytica
FGLENTAQA

SEQ ID NO: 2620439 - protein, 9 aa, Entamoeba histolytica
FGNEQGKGH

SEQ ID NO: 2620440 - protein, 5 aa, Entamoeba histolytica
FGNGT

SEQ ID NO: 2620441 - protein, 6 aa, Entamoeba histolytica
FGNKQR

SEQ ID NO: 2620442 - protein, 10 aa, Entamoeba histolytica
FGNKSTAVTG

SEQ ID NO: 2620443 - protein, 10 aa, Entamoeba histolytica
FGNKTKENEM

SEQ ID NO: 2620444 - protein, 28 aa, Entamoeba histolytica
FGNNEKPKEETQNTIGGSFNNGLSTNNA

SEQ ID NO: 2620445 - protein, 12 aa, Entamoeba histolytica
FGNNNTQNTTFG

SEQ ID NO: 2620446 - protein, 37 aa, Entamoeba histolytica
FGNNSNLGNPFNQSQNNNTTEKDDDKLEEEENKTEFK

SEQ ID NO: 2620447 - protein, 5 aa, Entamoeba histolytica
FGNSI

SEQ ID NO: 2620448 - protein, 9 aa, Entamoeba histolytica
FGNSPTELI

SEQ ID NO: 2620449 - protein, 17 aa, Entamoeba histolytica
FGNSTLQNYKDNGVNTS

SEQ ID NO: 2620450 - protein, 12 aa, Entamoeba histolytica
FGNTVGVSNRST

SEQ ID NO: 2620451 - protein, 4 aa, Entamoeba histolytica
FGPD

SEQ ID NO: 2620452 - protein, 11 aa, Entamoeba histolytica
FGPGVEGGVTI

SEQ ID NO: 2620453 - protein, 4 aa, Entamoeba histolytica
FGPR

SEQ ID NO: 2620454 - protein, 10 aa, Entamoeba histolytica
FGPSGEEPRT

SEQ ID NO: 2620455 - protein, 8 aa, Entamoeba histolytica
FGPSNKQQ

SEQ ID NO: 2620456 - protein, 11 aa, Entamoeba histolytica
FGQPTQATHQN

SEQ ID NO: 2620457 - protein, 11 aa, Entamoeba histolytica
FGQQNKTNDGY

SEQ ID NO: 2620458 - protein, 22 aa, Entamoeba histolytica
FGQSQNNGMGGFGQQPNNGMGG

SEQ ID NO: 2620459 - protein, 4 aa, Entamoeba histolytica
FGQT

SEQ ID NO: 2620460 - protein, 80 aa, Entamoeba histolytica
FGQTNQQSNGFGGFGNTTGFGQTGNTQTSGFGGFGSTTGFGQTNNQQGGFGSFGQTSNTQTSGFGSFGQTNQQSNGFGGF

SEQ ID NO: 2620461 - protein, 30 aa, Entamoeba histolytica
FGQTNQQSNGFGGFGNTTGFGQTNSLTGLG

SEQ ID NO: 2620462 - protein, 26 aa, Entamoeba histolytica
FGQYPTQRTFRSTSGYTQNKPLDVST

SEQ ID NO: 2620463 - protein, 4 aa, Entamoeba histolytica
FGRN

SEQ ID NO: 2620464 - protein, 8 aa, Entamoeba histolytica
FGRNNPSM

SEQ ID NO: 2620465 - protein, 4 aa, Entamoeba histolytica
FGRS

SEQ ID NO: 2620466 - protein, 6 aa, Entamoeba histolytica
FGSAAK

SEQ ID NO: 2620467 - protein, 5 aa, Entamoeba histolytica
FGSAR

SEQ ID NO: 2620468 - protein, 26 aa, Entamoeba histolytica
FGSDEPTAYEKQKLTQYSNASAIGSE

SEQ ID NO: 2620469 - protein, 9 aa, Entamoeba histolytica
FGSDNSKYL

SEQ ID NO: 2620470 - protein, 14 aa, Entamoeba histolytica
FGSESAEKKEKLLE

SEQ ID NO: 2620471 - protein, 11 aa, Entamoeba histolytica
FGSKPNDDKWM

SEQ ID NO: 2620472 - protein, 5 aa, Entamoeba histolytica
FGSKS

SEQ ID NO: 2620473 - protein, 9 aa, Entamoeba histolytica
FGSKSPNKG

SEQ ID NO: 2620474 - protein, 22 aa, Entamoeba histolytica
FGSKTTFGFRESDDTETTPKFT

SEQ ID NO: 2620475 - protein, 9 aa, Entamoeba histolytica
FGSKTYSAK

SEQ ID NO: 2620476 - protein, 5 aa, Entamoeba histolytica
FGSNQ

SEQ ID NO: 2620477 - protein, 4 aa, Entamoeba histolytica
FGSS

SEQ ID NO: 2620478 - protein, 8 aa, Entamoeba histolytica
FGSSSEIK

SEQ ID NO: 2620479 - protein, 4 aa, Entamoeba histolytica
FGSY

SEQ ID NO: 2620480 - protein, 6 aa, Entamoeba histolytica
FGSYTR

SEQ ID NO: 2620481 - protein, 12 aa, Entamoeba histolytica
FGTAQKHKVENP

SEQ ID NO: 2620482 - protein, 4 aa, Entamoeba histolytica
FGTD

SEQ ID NO: 2620483 - protein, 9 aa, Entamoeba histolytica
FGTEDSTET

SEQ ID NO: 2620484 - protein, 6 aa, Entamoeba histolytica
FGTGMS

SEQ ID NO: 2620485 - protein, 7 aa, Entamoeba histolytica
FGTPYAQ

SEQ ID NO: 2620486 - protein, 10 aa, Entamoeba histolytica
FGTSKSTIQE

SEQ ID NO: 2620487 - protein, 28 aa, Entamoeba histolytica
FGTSNEKSTTNLSTQPTTTNTDKLTNNT

SEQ ID NO: 2620488 - protein, 93 aa, Entamoeba histolytica
FGTSTDKQKDTLISNPSLTDQSKTITSTTPGSSSDKPINTSNDQSKPTTVNSDNNKTDNFTTAPTPTLEQSKTNTLTTKPSSEQSKTNSFANT

SEQ ID NO: 2620489 - protein, 13 aa, Entamoeba histolytica
FGVDKDDQIPTLP

SEQ ID NO: 2620490 - protein, 16 aa, Entamoeba histolytica
FGVPGNKFKTSTVDPH

SEQ ID NO: 2620491 - protein, 4 aa, Entamoeba histolytica
FHDP

SEQ ID NO: 2620492 - protein, 7 aa, Entamoeba histolytica
FHGEADS

SEQ ID NO: 2620493 - protein, 32 aa, Entamoeba histolytica
FHKSPNKKLPIPPQKCADTQSVEYSELPPPPC

SEQ ID NO: 2620494 - protein, 22 aa, Entamoeba histolytica
FHQETSSLNQSTSLINNSESNE

SEQ ID NO: 2620495 - protein, 18 aa, Entamoeba histolytica
FHSEENEINNSSNQVQRS

SEQ ID NO: 2620496 - protein, 5 aa, Entamoeba histolytica
FHTTG

SEQ ID NO: 2620497 - protein, 15 aa, Entamoeba histolytica
FIDEQSESSERDQAF

SEQ ID NO: 2620498 - protein, 5 aa, Entamoeba histolytica
FIEKD

SEQ ID NO: 2620499 - protein, 6 aa, Entamoeba histolytica
FIESSQ

SEQ ID NO: 2620500 - protein, 8 aa, Entamoeba histolytica
FIGNEASS

SEQ ID NO: 2620501 - protein, 6 aa, Entamoeba histolytica
FIGTKN

SEQ ID NO: 2620502 - protein, 5 aa, Entamoeba histolytica
FIPEN

SEQ ID NO: 2620503 - protein, 7 aa, Entamoeba histolytica
FIPEPEK

SEQ ID NO: 2620504 - protein, 15 aa, Entamoeba histolytica
FIPEPEKKTQSAINR

SEQ ID NO: 2620505 - protein, 5 aa, Entamoeba histolytica
FIPET

SEQ ID NO: 2620506 - protein, 5 aa, Entamoeba histolytica
FIPPK

SEQ ID NO: 2620507 - protein, 31 aa, Entamoeba histolytica
FIPSNKETKEEKTKEEITSHNQTETEEIKNT

SEQ ID NO: 2620508 - protein, 7 aa, Entamoeba histolytica
FITGSDD

SEQ ID NO: 2620509 - protein, 10 aa, Entamoeba histolytica
FITPNEELKK

SEQ ID NO: 2620510 - protein, 12 aa, Entamoeba histolytica
FITSSNDNETAE

SEQ ID NO: 2620511 - protein, 5 aa, Entamoeba histolytica
FKADI

SEQ ID NO: 2620512 - protein, 8 aa, Entamoeba histolytica
FKAEKEVR

SEQ ID NO: 2620513 - protein, 7 aa, Entamoeba histolytica
FKAGNYQ

SEQ ID NO: 2620514 - protein, 7 aa, Entamoeba histolytica
FKAGRVR

SEQ ID NO: 2620515 - protein, 11 aa, Entamoeba histolytica
FKAKGGNNYSE

SEQ ID NO: 2620516 - protein, 5 aa, Entamoeba histolytica
FKANS

SEQ ID NO: 2620517 - protein, 5 aa, Entamoeba histolytica
FKAPS

SEQ ID NO: 2620518 - protein, 19 aa, Entamoeba histolytica
FKASHPSFEISPSEQQPVG

SEQ ID NO: 2620519 - protein, 12 aa, Entamoeba histolytica
FKASRINESDLI

SEQ ID NO: 2620520 - protein, 11 aa, Entamoeba histolytica
FKDDKKKKQNV

SEQ ID NO: 2620521 - protein, 7 aa, Entamoeba histolytica
FKDDQNE

SEQ ID NO: 2620522 - protein, 8 aa, Entamoeba histolytica
FKDEKDET

SEQ ID NO: 2620523 - protein, 29 aa, Entamoeba histolytica
FKDGSMASQIKKKEERKPKKRDDSNDNEH

SEQ ID NO: 2620524 - protein, 26 aa, Entamoeba histolytica
FKDGSMSSQIKEEERKPKKRDDNNEY

SEQ ID NO: 2620525 - protein, 5 aa, Entamoeba histolytica
FKDLN

SEQ ID NO: 2620526 - protein, 8 aa, Entamoeba histolytica
FKDQKKSI

SEQ ID NO: 2620527 - protein, 4 aa, Entamoeba histolytica
FKDS

SEQ ID NO: 2620528 - protein, 11 aa, Entamoeba histolytica
FKEDDENKTKE

SEQ ID NO: 2620529 - protein, 12 aa, Entamoeba histolytica
FKEDTTNGPLKS

SEQ ID NO: 2620530 - protein, 7 aa, Entamoeba histolytica
FKEEEIE

SEQ ID NO: 2620531 - protein, 10 aa, Entamoeba histolytica
FKEENDEVDV

SEQ ID NO: 2620532 - protein, 10 aa, Entamoeba histolytica
FKEEQNQEAI

SEQ ID NO: 2620533 - protein, 6 aa, Entamoeba histolytica
FKEERE

SEQ ID NO: 2620534 - protein, 5 aa, Entamoeba histolytica
FKEEV

SEQ ID NO: 2620535 - protein, 19 aa, Entamoeba histolytica
FKEGEKSEEHLPGKKGSTF

SEQ ID NO: 2620536 - protein, 7 aa, Entamoeba histolytica
FKEGERI

SEQ ID NO: 2620537 - protein, 9 aa, Entamoeba histolytica
FKEKPIDSN

SEQ ID NO: 2620538 - protein, 7 aa, Entamoeba histolytica
FKEKQDK

SEQ ID NO: 2620539 - protein, 9 aa, Entamoeba histolytica
FKEKSAKLS

SEQ ID NO: 2620540 - protein, 7 aa, Entamoeba histolytica
FKEKTTN

SEQ ID NO: 2620541 - protein, 9 aa, Entamoeba histolytica
FKEKYGRDL

SEQ ID NO: 2620542 - protein, 10 aa, Entamoeba histolytica
FKELRNSKTI

SEQ ID NO: 2620543 - protein, 7 aa, Entamoeba histolytica
FKEPESR

SEQ ID NO: 2620544 - protein, 19 aa, Entamoeba histolytica
FKEQKKQKSKQKKKPIHDD

SEQ ID NO: 2620545 - protein, 11 aa, Entamoeba histolytica
FKERERKEIEK

SEQ ID NO: 2620546 - protein, 6 aa, Entamoeba histolytica
FKESEE

SEQ ID NO: 2620547 - protein, 17 aa, Entamoeba histolytica
FKESETTRALKRVKRAM

SEQ ID NO: 2620548 - protein, 6 aa, Entamoeba histolytica
FKESIN

SEQ ID NO: 2620549 - protein, 10 aa, Entamoeba histolytica
FKESLDEAER

SEQ ID NO: 2620550 - protein, 8 aa, Entamoeba histolytica
FKESSDKI

SEQ ID NO: 2620551 - protein, 4 aa, Entamoeba histolytica
FKET

SEQ ID NO: 2620552 - protein, 19 aa, Entamoeba histolytica
FKETNEQKKISQKSTDINP

SEQ ID NO: 2620553 - protein, 8 aa, Entamoeba histolytica
FKETPEDN

SEQ ID NO: 2620554 - protein, 5 aa, Entamoeba histolytica
FKEVN

SEQ ID NO: 2620555 - protein, 15 aa, Entamoeba histolytica
FKGASKKTYEERGCA

SEQ ID NO: 2620556 - protein, 6 aa, Entamoeba histolytica
FKGDKS

SEQ ID NO: 2620557 - protein, 10 aa, Entamoeba histolytica
FKGEDVPVGG

SEQ ID NO: 2620558 - protein, 16 aa, Entamoeba histolytica
FKGEGDDDDNCSHRDD

SEQ ID NO: 2620559 - protein, 10 aa, Entamoeba histolytica
FKGENKENDC

SEQ ID NO: 2620560 - protein, 8 aa, Entamoeba histolytica
FKGGNNFN

SEQ ID NO: 2620561 - protein, 4 aa, Entamoeba histolytica
FKGI

SEQ ID NO: 2620562 - protein, 5 aa, Entamoeba histolytica
FKGKY

SEQ ID NO: 2620563 - protein, 6 aa, Entamoeba histolytica
FKGQKK

SEQ ID NO: 2620564 - protein, 7 aa, Entamoeba histolytica
FKGQTPQ

SEQ ID NO: 2620565 - protein, 6 aa, Entamoeba histolytica
FKGRTI

SEQ ID NO: 2620566 - protein, 9 aa, Entamoeba histolytica
FKGSNNKDQ

SEQ ID NO: 2620567 - protein, 7 aa, Entamoeba histolytica
FKGSSTS

SEQ ID NO: 2620568 - protein, 4 aa, Entamoeba histolytica
FKIN

SEQ ID NO: 2620569 - protein, 10 aa, Entamoeba histolytica
FKISSGDEQT

SEQ ID NO: 2620570 - protein, 14 aa, Entamoeba histolytica
FKKDNKDKLKEVAR

SEQ ID NO: 2620571 - protein, 15 aa, Entamoeba histolytica
FKKEEVKESPKGYKK

SEQ ID NO: 2620572 - protein, 7 aa, Entamoeba histolytica
FKKEQQP

SEQ ID NO: 2620573 - protein, 8 aa, Entamoeba histolytica
FKKGPYKT

SEQ ID NO: 2620574 - protein, 11 aa, Entamoeba histolytica
FKKKEEENEDY

SEQ ID NO: 2620575 - protein, 13 aa, Entamoeba histolytica
FKKKTTKVLKTMD

SEQ ID NO: 2620576 - protein, 28 aa, Entamoeba histolytica
FKKNKKQKMLKQSKSEIITKKSEEIDSQ

SEQ ID NO: 2620577 - protein, 36 aa, Entamoeba histolytica
FKKNSKHHKEKNNDEKKPKKNKQIKSPKITDISREE

SEQ ID NO: 2620578 - protein, 11 aa, Entamoeba histolytica
FKKQAQELAEK

SEQ ID NO: 2620579 - protein, 17 aa, Entamoeba histolytica
FKKQSLDNITAIVVKIP

SEQ ID NO: 2620580 - protein, 13 aa, Entamoeba histolytica
FKKRGTLYTNTGG

SEQ ID NO: 2620581 - protein, 18 aa, Entamoeba histolytica
FKKTMRKEQNIPEKETVQ

SEQ ID NO: 2620582 - protein, 9 aa, Entamoeba histolytica
FKMGSKKGD

SEQ ID NO: 2620583 - protein, 12 aa, Entamoeba histolytica
FKNDDEVEQAPC

SEQ ID NO: 2620584 - protein, 27 aa, Entamoeba histolytica
FKNDNPETPTQQQPKIPIKNERSVGTI

SEQ ID NO: 2620585 - protein, 48 aa, Entamoeba histolytica
FKNDSPERRTSNSRRRSFSPRQSRSYNNRSNSRSRNYRLDHSNPNHSP

SEQ ID NO: 2620586 - protein, 7 aa, Entamoeba histolytica
FKNEKNQ

SEQ ID NO: 2620587 - protein, 6 aa, Entamoeba histolytica
FKNEQV

SEQ ID NO: 2620588 - protein, 16 aa, Entamoeba histolytica
FKPAKDSKNKMKEEDA

SEQ ID NO: 2620589 - protein, 12 aa, Entamoeba histolytica
FKPEDNPNGLLE

SEQ ID NO: 2620590 - protein, 14 aa, Entamoeba histolytica
FKPEEGDKSEIKIQ

SEQ ID NO: 2620591 - protein, 6 aa, Entamoeba histolytica
FKPETM

SEQ ID NO: 2620592 - protein, 13 aa, Entamoeba histolytica
FKPGNSNPNPIPK

SEQ ID NO: 2620593 - protein, 5 aa, Entamoeba histolytica
FKPKD

SEQ ID NO: 2620594 - protein, 12 aa, Entamoeba histolytica
FKPKENSRDGLK

SEQ ID NO: 2620595 - protein, 9 aa, Entamoeba histolytica
FKPKQQYYY

SEQ ID NO: 2620596 - protein, 6 aa, Entamoeba histolytica
FKPLGG

SEQ ID NO: 2620597 - protein, 13 aa, Entamoeba histolytica
FKPNAPPPKETYY

SEQ ID NO: 2620598 - protein, 67 aa, Entamoeba histolytica
FKPQEQEHTNTPMEEEKPKDTPKTEEKKMEEETPKKEETQPMEEVSPEDIKKKEAQQQKEKGNELYK

SEQ ID NO: 2620599 - protein, 8 aa, Entamoeba histolytica
FKPTADSE

SEQ ID NO: 2620600 - protein, 7 aa, Entamoeba histolytica
FKPTKEQ

SEQ ID NO: 2620601 - protein, 5 aa, Entamoeba histolytica
FKQEC

SEQ ID NO: 2620602 - protein, 7 aa, Entamoeba histolytica
FKQEDIE

SEQ ID NO: 2620603 - protein, 11 aa, Entamoeba histolytica
FKQEMGSGEES

SEQ ID NO: 2620604 - protein, 8 aa, Entamoeba histolytica
FKQENEVS

SEQ ID NO: 2620605 - protein, 5 aa, Entamoeba histolytica
FKQEP

SEQ ID NO: 2620606 - protein, 11 aa, Entamoeba histolytica
FKQQNRSRRGL

SEQ ID NO: 2620607 - protein, 12 aa, Entamoeba histolytica
FKQTENGVSELS

SEQ ID NO: 2620608 - protein, 22 aa, Entamoeba histolytica
FKREPSFDTKNKDSLMTGMNPW

SEQ ID NO: 2620609 - protein, 5 aa, Entamoeba histolytica
FKRNA

SEQ ID NO: 2620610 - protein, 14 aa, Entamoeba histolytica
FKRSDSDREVLEYL

SEQ ID NO: 2620611 - protein, 12 aa, Entamoeba histolytica
FKRTRDGKEKIV

SEQ ID NO: 2620612 - protein, 9 aa, Entamoeba histolytica
FKSDDETGK

SEQ ID NO: 2620613 - protein, 6 aa, Entamoeba histolytica
FKSEDS

SEQ ID NO: 2620614 - protein, 6 aa, Entamoeba histolytica
FKSEEI

SEQ ID NO: 2620615 - protein, 17 aa, Entamoeba histolytica
FKSENQLKSHENSKKHK

SEQ ID NO: 2620616 - protein, 10 aa, Entamoeba histolytica
FKSESNESSV

SEQ ID NO: 2620617 - protein, 10 aa, Entamoeba histolytica
FKSKESHLKT

SEQ ID NO: 2620618 - protein, 11 aa, Entamoeba histolytica
FKSKPSGKSIK

SEQ ID NO: 2620619 - protein, 4 aa, Entamoeba histolytica
FKSN

SEQ ID NO: 2620620 - protein, 27 aa, Entamoeba histolytica
FKSPETSEIPGKGSVETPRSSPQMEKR

SEQ ID NO: 2620621 - protein, 10 aa, Entamoeba histolytica
FKSQDNKDEI

SEQ ID NO: 2620622 - protein, 7 aa, Entamoeba histolytica
FKSRSES

SEQ ID NO: 2620623 - protein, 8 aa, Entamoeba histolytica
FKSSHDPF

SEQ ID NO: 2620624 - protein, 11 aa, Entamoeba histolytica
FKSSPTSQGAN

SEQ ID NO: 2620625 - protein, 9 aa, Entamoeba histolytica
FKSTPLSTM

SEQ ID NO: 2620626 - protein, 4 aa, Entamoeba histolytica
FKTE

SEQ ID NO: 2620627 - protein, 8 aa, Entamoeba histolytica
FKTEPEFD

SEQ ID NO: 2620628 - protein, 8 aa, Entamoeba histolytica
FKTNPNRW

SEQ ID NO: 2620629 - protein, 6 aa, Entamoeba histolytica
FKTPNW

SEQ ID NO: 2620630 - protein, 18 aa, Entamoeba histolytica
FKTPSHVSDKDTNISGTV

SEQ ID NO: 2620631 - protein, 7 aa, Entamoeba histolytica
FKTPSQK

SEQ ID NO: 2620632 - protein, 10 aa, Entamoeba histolytica
FKTSNGYSTT

SEQ ID NO: 2620633 - protein, 8 aa, Entamoeba histolytica
FKTSPNRW

SEQ ID NO: 2620634 - protein, 21 aa, Entamoeba histolytica
FKVEGKENQEHQTTSSQGICE

SEQ ID NO: 2620635 - protein, 24 aa, Entamoeba histolytica
FKVGGGSASVTQETSGVYGEGDRK

SEQ ID NO: 2620636 - protein, 5 aa, Entamoeba histolytica
FKVNE

SEQ ID NO: 2620637 - protein, 27 aa, Entamoeba histolytica
FKYHGKKDFKSYKKHQQEAKPRPYQNK

SEQ ID NO: 2620638 - protein, 9 aa, Entamoeba histolytica
FKYNPAKAK

SEQ ID NO: 2620639 - protein, 9 aa, Entamoeba histolytica
FKYQKAKAQ

SEQ ID NO: 2620640 - protein, 10 aa, Entamoeba histolytica
FLEGKKPNTV

SEQ ID NO: 2620641 - protein, 8 aa, Entamoeba histolytica
FLPPHASE

SEQ ID NO: 2620642 - protein, 11 aa, Entamoeba histolytica
FLQPNSDGTNI

SEQ ID NO: 2620643 - protein, 6 aa, Entamoeba histolytica
FMGNPD

SEQ ID NO: 2620644 - protein, 11 aa, Entamoeba histolytica
FMQKSGKTEAY

SEQ ID NO: 2620645 - protein, 11 aa, Entamoeba histolytica
FMSTPAESATI

SEQ ID NO: 2620646 - protein, 19 aa, Entamoeba histolytica
FNAGSMKTRRWKDRGASVA

SEQ ID NO: 2620647 - protein, 7 aa, Entamoeba histolytica
FNARGTK

SEQ ID NO: 2620648 - protein, 4 aa, Entamoeba histolytica
FNDE

SEQ ID NO: 2620649 - protein, 7 aa, Entamoeba histolytica
FNDEKKW

SEQ ID NO: 2620650 - protein, 14 aa, Entamoeba histolytica
FNDENKLSEHSNSG

SEQ ID NO: 2620651 - protein, 16 aa, Entamoeba histolytica
FNDEQRNQTKKAALSA

SEQ ID NO: 2620652 - protein, 9 aa, Entamoeba histolytica
FNDGNDSLK

SEQ ID NO: 2620653 - protein, 9 aa, Entamoeba histolytica
FNDGRSNLD

SEQ ID NO: 2620654 - protein, 5 aa, Entamoeba histolytica
FNDGS

SEQ ID NO: 2620655 - protein, 7 aa, Entamoeba histolytica
FNDGTAA

SEQ ID NO: 2620656 - protein, 7 aa, Entamoeba histolytica
FNDKGPR

SEQ ID NO: 2620657 - protein, 6 aa, Entamoeba histolytica
FNDNGE

SEQ ID NO: 2620658 - protein, 8 aa, Entamoeba histolytica
FNDPIPKK

SEQ ID NO: 2620659 - protein, 7 aa, Entamoeba histolytica
FNDPNGK

SEQ ID NO: 2620660 - protein, 8 aa, Entamoeba histolytica
FNDQDPSV

SEQ ID NO: 2620661 - protein, 9 aa, Entamoeba histolytica
FNDSDDPKI

SEQ ID NO: 2620662 - protein, 14 aa, Entamoeba histolytica
FNDSGDNISCIVVR

SEQ ID NO: 2620663 - protein, 11 aa, Entamoeba histolytica
FNDSSSSSQQK

SEQ ID NO: 2620664 - protein, 7 aa, Entamoeba histolytica
FNDTEAE

SEQ ID NO: 2620665 - protein, 8 aa, Entamoeba histolytica
FNEEASKI

SEQ ID NO: 2620666 - protein, 5 aa, Entamoeba histolytica
FNEED

SEQ ID NO: 2620667 - protein, 6 aa, Entamoeba histolytica
FNEEEE

SEQ ID NO: 2620668 - protein, 6 aa, Entamoeba histolytica
FNEELT

SEQ ID NO: 2620669 - protein, 7 aa, Entamoeba histolytica
FNEGGKV

SEQ ID NO: 2620670 - protein, 6 aa, Entamoeba histolytica
FNEHER

SEQ ID NO: 2620671 - protein, 7 aa, Entamoeba histolytica
FNEKNNI

SEQ ID NO: 2620672 - protein, 9 aa, Entamoeba histolytica
FNEKPDYTA

SEQ ID NO: 2620673 - protein, 11 aa, Entamoeba histolytica
FNENGDDSEIS

SEQ ID NO: 2620674 - protein, 5 aa, Entamoeba histolytica
FNENT

SEQ ID NO: 2620675 - protein, 10 aa, Entamoeba histolytica
FNEPGSPITS

SEQ ID NO: 2620676 - protein, 10 aa, Entamoeba histolytica
FNEPKELSKE

SEQ ID NO: 2620677 - protein, 4 aa, Entamoeba histolytica
FNEQ

SEQ ID NO: 2620678 - protein, 5 aa, Entamoeba histolytica
FNEQS

SEQ ID NO: 2620679 - protein, 9 aa, Entamoeba histolytica
FNEQSNHYD

SEQ ID NO: 2620680 - protein, 33 aa, Entamoeba histolytica
FNETTTLTRSGSTEMGTYSPKSLPRKSVRKTLT

SEQ ID NO: 2620681 - protein, 4 aa, Entamoeba histolytica
FNEY

SEQ ID NO: 2620682 - protein, 6 aa, Entamoeba histolytica
FNGAEP

SEQ ID NO: 2620683 - protein, 8 aa, Entamoeba histolytica
FNGDENSQ

SEQ ID NO: 2620684 - protein, 10 aa, Entamoeba histolytica
FNGKGASKRT

SEQ ID NO: 2620685 - protein, 7 aa, Entamoeba histolytica
FNGKSEC

SEQ ID NO: 2620686 - protein, 9 aa, Entamoeba histolytica
FNGKSEYIT

SEQ ID NO: 2620687 - protein, 10 aa, Entamoeba histolytica
FNGKSEYITS

SEQ ID NO: 2620688 - protein, 11 aa, Entamoeba histolytica
FNGKSEYITSC

SEQ ID NO: 2620689 - protein, 6 aa, Entamoeba histolytica
FNGKSN

SEQ ID NO: 2620690 - protein, 16 aa, Entamoeba histolytica
FNGKTNVDRELDGLEE

SEQ ID NO: 2620691 - protein, 15 aa, Entamoeba histolytica
FNGNNDTSFYPDTSN

SEQ ID NO: 2620692 - protein, 8 aa, Entamoeba histolytica
FNGNSASV

SEQ ID NO: 2620693 - protein, 5 aa, Entamoeba histolytica
FNGPK

SEQ ID NO: 2620694 - protein, 7 aa, Entamoeba histolytica
FNGQNTA

SEQ ID NO: 2620695 - protein, 9 aa, Entamoeba histolytica
FNGRKGDRI

SEQ ID NO: 2620696 - protein, 6 aa, Entamoeba histolytica
FNGSEI

SEQ ID NO: 2620697 - protein, 5 aa, Entamoeba histolytica
FNGSN

SEQ ID NO: 2620698 - protein, 6 aa, Entamoeba histolytica
FNKDDK

SEQ ID NO: 2620699 - protein, 11 aa, Entamoeba histolytica
FNKDQTDKEKA

SEQ ID NO: 2620700 - protein, 4 aa, Entamoeba histolytica
FNKE

SEQ ID NO: 2620701 - protein, 8 aa, Entamoeba histolytica
FNKGFDEK

SEQ ID NO: 2620702 - protein, 6 aa, Entamoeba histolytica
FNKKDI

SEQ ID NO: 2620703 - protein, 6 aa, Entamoeba histolytica
FNKNST

SEQ ID NO: 2620704 - protein, 5 aa, Entamoeba histolytica
FNKNT

SEQ ID NO: 2620705 - protein, 8 aa, Entamoeba histolytica
FNKQGTIK

SEQ ID NO: 2620706 - protein, 13 aa, Entamoeba histolytica
FNKRSSSPSEDKV

SEQ ID NO: 2620707 - protein, 4 aa, Entamoeba histolytica
FNKS

SEQ ID NO: 2620708 - protein, 18 aa, Entamoeba histolytica
FNKTEDSAFDDPDYEEYT

SEQ ID NO: 2620709 - protein, 19 aa, Entamoeba histolytica
FNKTNTDIPPQLPPKPERL

SEQ ID NO: 2620710 - protein, 10 aa, Entamoeba histolytica
FNNEKNASVI

SEQ ID NO: 2620711 - protein, 22 aa, Entamoeba histolytica
FNNGMNNKYDPDDGEDEYYDED

SEQ ID NO: 2620712 - protein, 20 aa, Entamoeba histolytica
FNNGMNNNYDPDNGEDEYFE

SEQ ID NO: 2620713 - protein, 11 aa, Entamoeba histolytica
FNNPNRQKKTF

SEQ ID NO: 2620714 - protein, 4 aa, Entamoeba histolytica
FNNS

SEQ ID NO: 2620715 - protein, 8 aa, Entamoeba histolytica
FNNSEDGV

SEQ ID NO: 2620716 - protein, 12 aa, Entamoeba histolytica
FNNSEKSTIGSN

SEQ ID NO: 2620717 - protein, 7 aa, Entamoeba histolytica
FNNSLNK

SEQ ID NO: 2620718 - protein, 7 aa, Entamoeba histolytica
FNPEGMG

SEQ ID NO: 2620719 - protein, 10 aa, Entamoeba histolytica
FNPEGNCTQA

SEQ ID NO: 2620720 - protein, 9 aa, Entamoeba histolytica
FNPEGTPQI

SEQ ID NO: 2620721 - protein, 9 aa, Entamoeba histolytica
FNPEVSNDQ

SEQ ID NO: 2620722 - protein, 8 aa, Entamoeba histolytica
FNPKRKYL

SEQ ID NO: 2620723 - protein, 4 aa, Entamoeba histolytica
FNPL

SEQ ID NO: 2620724 - protein, 6 aa, Entamoeba histolytica
FNPNGK

SEQ ID NO: 2620725 - protein, 6 aa, Entamoeba histolytica
FNPPGN

SEQ ID NO: 2620726 - protein, 6 aa, Entamoeba histolytica
FNPPIP

SEQ ID NO: 2620727 - protein, 7 aa, Entamoeba histolytica
FNPQPDI

SEQ ID NO: 2620728 - protein, 6 aa, Entamoeba histolytica
FNPQPG

SEQ ID NO: 2620729 - protein, 14 aa, Entamoeba histolytica
FNPSLQPSSNYNYP

SEQ ID NO: 2620730 - protein, 15 aa, Entamoeba histolytica
FNPSPEKSKSGCCTV

SEQ ID NO: 2620731 - protein, 5 aa, Entamoeba histolytica
FNPSQ

SEQ ID NO: 2620732 - protein, 27 aa, Entamoeba histolytica
FNPSQSTQQQNPIISTSNTSLINSREK

SEQ ID NO: 2620733 - protein, 4 aa, Entamoeba histolytica
FNPT

SEQ ID NO: 2620734 - protein, 5 aa, Entamoeba histolytica
FNPTQ

SEQ ID NO: 2620735 - protein, 20 aa, Entamoeba histolytica
FNQEQTNAKTSTESIIFTSQ

SEQ ID NO: 2620736 - protein, 9 aa, Entamoeba histolytica
FNQESNDAK

SEQ ID NO: 2620737 - protein, 7 aa, Entamoeba histolytica
FNQIDEN

SEQ ID NO: 2620738 - protein, 14 aa, Entamoeba histolytica
FNQNIDNDDSDLPD

SEQ ID NO: 2620739 - protein, 12 aa, Entamoeba histolytica
FNQPEKQENKIE

SEQ ID NO: 2620740 - protein, 8 aa, Entamoeba histolytica
FNQSPQEV

SEQ ID NO: 2620741 - protein, 6 aa, Entamoeba histolytica
FNQTNN

SEQ ID NO: 2620742 - protein, 4 aa, Entamoeba histolytica
FNRF

SEQ ID NO: 2620743 - protein, 13 aa, Entamoeba histolytica
FNRKGNDSGGSWE

SEQ ID NO: 2620744 - protein, 13 aa, Entamoeba histolytica
FNRPEENKEAFTE

SEQ ID NO: 2620745 - protein, 11 aa, Entamoeba histolytica
FNRSERNWDSK

SEQ ID NO: 2620746 - protein, 4 aa, Entamoeba histolytica
FNSA

SEQ ID NO: 2620747 - protein, 31 aa, Entamoeba histolytica
FNSAQEKATAAKKAADEAKVKATAAKKVADE

SEQ ID NO: 2620748 - protein, 8 aa, Entamoeba histolytica
FNSGGIPT

SEQ ID NO: 2620749 - protein, 10 aa, Entamoeba histolytica
FNSKEEEEMI

SEQ ID NO: 2620750 - protein, 4 aa, Entamoeba histolytica
FNSL

SEQ ID NO: 2620751 - protein, 5 aa, Entamoeba histolytica
FNSNE

SEQ ID NO: 2620752 - protein, 10 aa, Entamoeba histolytica
FNSNKEEKLK

SEQ ID NO: 2620753 - protein, 8 aa, Entamoeba histolytica
FNSPYRRN

SEQ ID NO: 2620754 - protein, 8 aa, Entamoeba histolytica
FNSRGKRL

SEQ ID NO: 2620755 - protein, 5 aa, Entamoeba histolytica
FNSSN

SEQ ID NO: 2620756 - protein, 4 aa, Entamoeba histolytica
FNST

SEQ ID NO: 2620757 - protein, 4 aa, Entamoeba histolytica
FNTD

SEQ ID NO: 2620758 - protein, 11 aa, Entamoeba histolytica
FNTDNLSSSKR

SEQ ID NO: 2620759 - protein, 5 aa, Entamoeba histolytica
FNTNS

SEQ ID NO: 2620760 - protein, 11 aa, Entamoeba histolytica
FNTPQEFKTTP

SEQ ID NO: 2620761 - protein, 14 aa, Entamoeba histolytica
FNTPQYSVIWQNYS

SEQ ID NO: 2620762 - protein, 7 aa, Entamoeba histolytica
FNTSEMK

SEQ ID NO: 2620763 - protein, 12 aa, Entamoeba histolytica
FNTSNDKTSVDP

SEQ ID NO: 2620764 - protein, 6 aa, Entamoeba histolytica
FNTSNI

SEQ ID NO: 2620765 - protein, 10 aa, Entamoeba histolytica
FNTSNTLDTD

SEQ ID NO: 2620766 - protein, 9 aa, Entamoeba histolytica
FNTSQTNKR

SEQ ID NO: 2620767 - protein, 11 aa, Entamoeba histolytica
FNTSTPTPVIE

SEQ ID NO: 2620768 - protein, 24 aa, Entamoeba histolytica
FNTTSPKDIITTRSSQYDSLNSNK

SEQ ID NO: 2620769 - protein, 12 aa, Entamoeba histolytica
FNVEPKKSPRIA

SEQ ID NO: 2620770 - protein, 5 aa, Entamoeba histolytica
FNVPT

SEQ ID NO: 2620771 - protein, 14 aa, Entamoeba histolytica
FNVSNAKKISTPDY

SEQ ID NO: 2620772 - protein, 15 aa, Entamoeba histolytica
FNYASPSVAQSQKPF

SEQ ID NO: 2620773 - protein, 4 aa, Entamoeba histolytica
FNYP

SEQ ID NO: 2620774 - protein, 7 aa, Entamoeba histolytica
FPDEQKE

SEQ ID NO: 2620775 - protein, 6 aa, Entamoeba histolytica
FPDGSF

SEQ ID NO: 2620776 - protein, 6 aa, Entamoeba histolytica
FPDSAT

SEQ ID NO: 2620777 - protein, 11 aa, Entamoeba histolytica
FPDSPHHPEFP

SEQ ID NO: 2620778 - protein, 7 aa, Entamoeba histolytica
FPDTESN

SEQ ID NO: 2620779 - protein, 11 aa, Entamoeba histolytica
FPEDDDEENEF

SEQ ID NO: 2620780 - protein, 12 aa, Entamoeba histolytica
FPEDSSNSYDQK

SEQ ID NO: 2620781 - protein, 11 aa, Entamoeba histolytica
FPEEQKKETTL

SEQ ID NO: 2620782 - protein, 12 aa, Entamoeba histolytica
FPEEYNKYSKGI

SEQ ID NO: 2620783 - protein, 9 aa, Entamoeba histolytica
FPEKKQLNS

SEQ ID NO: 2620784 - protein, 4 aa, Entamoeba histolytica
FPEN

SEQ ID NO: 2620785 - protein, 7 aa, Entamoeba histolytica
FPENSQN

SEQ ID NO: 2620786 - protein, 13 aa, Entamoeba histolytica
FPEQERATHKSSI

SEQ ID NO: 2620787 - protein, 29 aa, Entamoeba histolytica
FPESLSDPHSTRSSPDIVNKRERDSKSVD

SEQ ID NO: 2620788 - protein, 6 aa, Entamoeba histolytica
FPESPV

SEQ ID NO: 2620789 - protein, 4 aa, Entamoeba histolytica
FPET

SEQ ID NO: 2620790 - protein, 12 aa, Entamoeba histolytica
FPFDEKRYKSQT

SEQ ID NO: 2620791 - protein, 5 aa, Entamoeba histolytica
FPFSD

SEQ ID NO: 2620792 - protein, 54 aa, Entamoeba histolytica
FPGEEKRGGRRGRGVYRGRGGFSSRGRGGSHASSRGGSSSRGRGGNTRGRGGRG

SEQ ID NO: 2620793 - protein, 5 aa, Entamoeba histolytica
FPGEK

SEQ ID NO: 2620794 - protein, 7 aa, Entamoeba histolytica
FPGETTN

SEQ ID NO: 2620795 - protein, 21 aa, Entamoeba histolytica
FPGFSSRTSCNMQDSAEPEEH

SEQ ID NO: 2620796 - protein, 21 aa, Entamoeba histolytica
FPGFSSRTSCNMQDSVDPDEH

SEQ ID NO: 2620797 - protein, 48 aa, Entamoeba histolytica
FPGRKNSGGLSDDDYDESDSDCHNETDEEHPDLSSDDERTTEDNDETE

SEQ ID NO: 2620798 - protein, 8 aa, Entamoeba histolytica
FPGSGKSQ

SEQ ID NO: 2620799 - protein, 10 aa, Entamoeba histolytica
FPGSSTSDQV

SEQ ID NO: 2620800 - protein, 4 aa, Entamoeba histolytica
FPIS

SEQ ID NO: 2620801 - protein, 5 aa, Entamoeba histolytica
FPISS

SEQ ID NO: 2620802 - protein, 4 aa, Entamoeba histolytica
FPKE

SEQ ID NO: 2620803 - protein, 7 aa, Entamoeba histolytica
FPKEIQP

SEQ ID NO: 2620804 - protein, 9 aa, Entamoeba histolytica
FPKNTPPAI

SEQ ID NO: 2620805 - protein, 25 aa, Entamoeba histolytica
FPKPESQENKREEEKEEKETDEGLE

SEQ ID NO: 2620806 - protein, 15 aa, Entamoeba histolytica
FPKQTKPNSTSSSST

SEQ ID NO: 2620807 - protein, 9 aa, Entamoeba histolytica
FPKTGTNTL

SEQ ID NO: 2620808 - protein, 8 aa, Entamoeba histolytica
FPKTSTEE

SEQ ID NO: 2620809 - protein, 5 aa, Entamoeba histolytica
FPLPS

SEQ ID NO: 2620810 - protein, 22 aa, Entamoeba histolytica
FPLQEKKKRSKPKTFDKKNIPK

SEQ ID NO: 2620811 - protein, 7 aa, Entamoeba histolytica
FPNAASD

SEQ ID NO: 2620812 - protein, 5 aa, Entamoeba histolytica
FPNED

SEQ ID NO: 2620813 - protein, 8 aa, Entamoeba histolytica
FPNGIDGN

SEQ ID NO: 2620814 - protein, 4 aa, Entamoeba histolytica
FPNK

SEQ ID NO: 2620815 - protein, 24 aa, Entamoeba histolytica
FPNKSNDSETSTSNTDVSEPNVPI

SEQ ID NO: 2620816 - protein, 9 aa, Entamoeba histolytica
FPNKSSQQI

SEQ ID NO: 2620817 - protein, 11 aa, Entamoeba histolytica
FPNPEEGKGAL

SEQ ID NO: 2620818 - protein, 7 aa, Entamoeba histolytica
FPNQRTP

SEQ ID NO: 2620819 - protein, 4 aa, Entamoeba histolytica
FPNR

SEQ ID NO: 2620820 - protein, 22 aa, Entamoeba histolytica
FPNSYKGSNNDTAIKKQPETLQ

SEQ ID NO: 2620821 - protein, 4 aa, Entamoeba histolytica
FPNT

SEQ ID NO: 2620822 - protein, 11 aa, Entamoeba histolytica
FPNTSNPGNLE

SEQ ID NO: 2620823 - protein, 14 aa, Entamoeba histolytica
FPNTTTSTNPITTY

SEQ ID NO: 2620824 - protein, 7 aa, Entamoeba histolytica
FPPEPNG

SEQ ID NO: 2620825 - protein, 7 aa, Entamoeba histolytica
FPPEPSG

SEQ ID NO: 2620826 - protein, 9 aa, Entamoeba histolytica
FPPKPEEAA

SEQ ID NO: 2620827 - protein, 20 aa, Entamoeba histolytica
FPPKPTTNTFDSDEFNPVEI

SEQ ID NO: 2620828 - protein, 4 aa, Entamoeba histolytica
FPPN

SEQ ID NO: 2620829 - protein, 17 aa, Entamoeba histolytica
FPPNEYPENGEVPCNDE

SEQ ID NO: 2620830 - protein, 4 aa, Entamoeba histolytica
FPPQ

SEQ ID NO: 2620831 - protein, 6 aa, Entamoeba histolytica
FPPQRK

SEQ ID NO: 2620832 - protein, 4 aa, Entamoeba histolytica
FPPR

SEQ ID NO: 2620833 - protein, 5 aa, Entamoeba histolytica
FPPSI

SEQ ID NO: 2620834 - protein, 5 aa, Entamoeba histolytica
FPPSR

SEQ ID NO: 2620835 - protein, 10 aa, Entamoeba histolytica
FPPTEEEAKR

SEQ ID NO: 2620836 - protein, 7 aa, Entamoeba histolytica
FPPTGGW

SEQ ID NO: 2620837 - protein, 10 aa, Entamoeba histolytica
FPPTHGGAKQ

SEQ ID NO: 2620838 - protein, 8 aa, Entamoeba histolytica
FPPTPKSK

SEQ ID NO: 2620839 - protein, 4 aa, Entamoeba histolytica
FPPV

SEQ ID NO: 2620840 - protein, 11 aa, Entamoeba histolytica
FPPVKGKPSWS

SEQ ID NO: 2620841 - protein, 5 aa, Entamoeba histolytica
FPPYQ

SEQ ID NO: 2620842 - protein, 11 aa, Entamoeba histolytica
FPQNDAPASFS

SEQ ID NO: 2620843 - protein, 17 aa, Entamoeba histolytica
FPQQEQSRKFSINSPKY

SEQ ID NO: 2620844 - protein, 8 aa, Entamoeba histolytica
FPQQNPKY

SEQ ID NO: 2620845 - protein, 40 aa, Entamoeba histolytica
FPQQPPMQGFPQQPPMQGFPQENQYPPIHENPPQAPIGQG

SEQ ID NO: 2620846 - protein, 51 aa, Entamoeba histolytica
FPQQQPPMQGFPQQQPPMQGFPQQPPMQGFPQKNQYPPIHENPPQAPIGQG

SEQ ID NO: 2620847 - protein, 23 aa, Entamoeba histolytica
FPQQQPPPQFPTTQYPDQTYTPL

SEQ ID NO: 2620848 - protein, 7 aa, Entamoeba histolytica
FPQSGDS

SEQ ID NO: 2620849 - protein, 5 aa, Entamoeba histolytica
FPQSI

SEQ ID NO: 2620850 - protein, 8 aa, Entamoeba histolytica
FPQTKKQY

SEQ ID NO: 2620851 - protein, 4 aa, Entamoeba histolytica
FPRD

SEQ ID NO: 2620852 - protein, 5 aa, Entamoeba histolytica
FPSAQ

SEQ ID NO: 2620853 - protein, 11 aa, Entamoeba histolytica
FPSASYPSADC

SEQ ID NO: 2620854 - protein, 4 aa, Entamoeba histolytica
FPSE

SEQ ID NO: 2620855 - protein, 20 aa, Entamoeba histolytica
FPSFRGNGSPINEDKNEDIP

SEQ ID NO: 2620856 - protein, 9 aa, Entamoeba histolytica
FPSKNYSPF

SEQ ID NO: 2620857 - protein, 4 aa, Entamoeba histolytica
FPSL

SEQ ID NO: 2620858 - protein, 14 aa, Entamoeba histolytica
FPSLNQTFKYFLYI

SEQ ID NO: 2620859 - protein, 4 aa, Entamoeba histolytica
FPSN

SEQ ID NO: 2620860 - protein, 7 aa, Entamoeba histolytica
FPSNPPK

SEQ ID NO: 2620861 - protein, 8 aa, Entamoeba histolytica
FPSSGNDV

SEQ ID NO: 2620862 - protein, 12 aa, Entamoeba histolytica
FPSSKSKIPSPI

SEQ ID NO: 2620863 - protein, 6 aa, Entamoeba histolytica
FPSSSS

SEQ ID NO: 2620864 - protein, 5 aa, Entamoeba histolytica
FPSTA

SEQ ID NO: 2620865 - protein, 7 aa, Entamoeba histolytica
FPSTNDE

SEQ ID NO: 2620866 - protein, 5 aa, Entamoeba histolytica
FPSTP

SEQ ID NO: 2620867 - protein, 11 aa, Entamoeba histolytica
FPSVNGKESWS

SEQ ID NO: 2620868 - protein, 7 aa, Entamoeba histolytica
FPTDPNL

SEQ ID NO: 2620869 - protein, 6 aa, Entamoeba histolytica
FPTEDK

SEQ ID NO: 2620870 - protein, 30 aa, Entamoeba histolytica
FPTEPKTNKFTQSSSEKANNSKDISGDDWG

SEQ ID NO: 2620871 - protein, 9 aa, Entamoeba histolytica
FPTEQGKTI

SEQ ID NO: 2620872 - protein, 4 aa, Entamoeba histolytica
FPTK

SEQ ID NO: 2620873 - protein, 5 aa, Entamoeba histolytica
FPTNN

SEQ ID NO: 2620874 - protein, 7 aa, Entamoeba histolytica
FPTNSNG

SEQ ID NO: 2620875 - protein, 4 aa, Entamoeba histolytica
FPTP

SEQ ID NO: 2620876 - protein, 8 aa, Entamoeba histolytica
FPTPNEEA

SEQ ID NO: 2620877 - protein, 9 aa, Entamoeba histolytica
FPTPNGIGD

SEQ ID NO: 2620878 - protein, 5 aa, Entamoeba histolytica
FPTSE

SEQ ID NO: 2620879 - protein, 5 aa, Entamoeba histolytica
FPVNS

SEQ ID NO: 2620880 - protein, 4 aa, Entamoeba histolytica
FPVP

SEQ ID NO: 2620881 - protein, 6 aa, Entamoeba histolytica
FPYQNK

SEQ ID NO: 2620882 - protein, 6 aa, Entamoeba histolytica
FQAGGH

SEQ ID NO: 2620883 - protein, 14 aa, Entamoeba histolytica
FQAPNKSSITSSQF

SEQ ID NO: 2620884 - protein, 18 aa, Entamoeba histolytica
FQDPKTSAQYLHAALELL

SEQ ID NO: 2620885 - protein, 9 aa, Entamoeba histolytica
FQEPPTSGA

SEQ ID NO: 2620886 - protein, 16 aa, Entamoeba histolytica
FQERRDARCRDRNRNY

SEQ ID NO: 2620887 - protein, 5 aa, Entamoeba histolytica
FQGAE

SEQ ID NO: 2620888 - protein, 4 aa, Entamoeba histolytica
FQGK

SEQ ID NO: 2620889 - protein, 18 aa, Entamoeba histolytica
FQGKERPRWNAPKSDELK

SEQ ID NO: 2620890 - protein, 10 aa, Entamoeba histolytica
FQGNTSKDAW

SEQ ID NO: 2620891 - protein, 4 aa, Entamoeba histolytica
FQGR

SEQ ID NO: 2620892 - protein, 14 aa, Entamoeba histolytica
FQGTALDPQQQQIY

SEQ ID NO: 2620893 - protein, 7 aa, Entamoeba histolytica
FQKDDKT

SEQ ID NO: 2620894 - protein, 6 aa, Entamoeba histolytica
FQKEED

SEQ ID NO: 2620895 - protein, 12 aa, Entamoeba histolytica
FQKIKGKTQHLS

SEQ ID NO: 2620896 - protein, 20 aa, Entamoeba histolytica
FQKRSDGPYQETESETMEKR

SEQ ID NO: 2620897 - protein, 7 aa, Entamoeba histolytica
FQKSSPV

SEQ ID NO: 2620898 - protein, 7 aa, Entamoeba histolytica
FQNDESE

SEQ ID NO: 2620899 - protein, 6 aa, Entamoeba histolytica
FQNEKK

SEQ ID NO: 2620900 - protein, 10 aa, Entamoeba histolytica
FQNEPSPITV

SEQ ID NO: 2620901 - protein, 15 aa, Entamoeba histolytica
FQNGSPHHPSTSSLL

SEQ ID NO: 2620902 - protein, 13 aa, Entamoeba histolytica
FQNSSYPQQIPPN

SEQ ID NO: 2620903 - protein, 7 aa, Entamoeba histolytica
FQNTPEV

SEQ ID NO: 2620904 - protein, 12 aa, Entamoeba histolytica
FQPLTNEQKNEI

SEQ ID NO: 2620905 - protein, 12 aa, Entamoeba histolytica
FQQPKKKGDARI

SEQ ID NO: 2620906 - protein, 5 aa, Entamoeba histolytica
FQRDS

SEQ ID NO: 2620907 - protein, 17 aa, Entamoeba histolytica
FQRGRTIGYPTANINPT

SEQ ID NO: 2620908 - protein, 9 aa, Entamoeba histolytica
FQRGSNPAE

SEQ ID NO: 2620909 - protein, 7 aa, Entamoeba histolytica
FQRNEQQ

SEQ ID NO: 2620910 - protein, 7 aa, Entamoeba histolytica
FQRTGTP

SEQ ID NO: 2620911 - protein, 8 aa, Entamoeba histolytica
FQSDTPSS

SEQ ID NO: 2620912 - protein, 11 aa, Entamoeba histolytica
FQSKQQGNENL

SEQ ID NO: 2620913 - protein, 6 aa, Entamoeba histolytica
FQSNTL

SEQ ID NO: 2620914 - protein, 9 aa, Entamoeba histolytica
FQSTPSPIK

SEQ ID NO: 2620915 - protein, 25 aa, Entamoeba histolytica
FQSTSYESRMDEQIQNNERSSKKFK

SEQ ID NO: 2620916 - protein, 5 aa, Entamoeba histolytica
FQTCE

SEQ ID NO: 2620917 - protein, 5 aa, Entamoeba histolytica
FQTDN

SEQ ID NO: 2620918 - protein, 6 aa, Entamoeba histolytica
FQTENK

SEQ ID NO: 2620919 - protein, 17 aa, Entamoeba histolytica
FQTKESKEEKEKVDEKI

SEQ ID NO: 2620920 - protein, 9 aa, Entamoeba histolytica
FQTLKEEGK

SEQ ID NO: 2620921 - protein, 19 aa, Entamoeba histolytica
FQTNNSMSMEEETKNNQFD

SEQ ID NO: 2620922 - protein, 9 aa, Entamoeba histolytica
FQTSQKSPK

SEQ ID NO: 2620923 - protein, 12 aa, Entamoeba histolytica
FQYDKSGEDHYN

SEQ ID NO: 2620924 - protein, 8 aa, Entamoeba histolytica
FRASKTMQ

SEQ ID NO: 2620925 - protein, 32 aa, Entamoeba histolytica
FRDANEKIQQAIQSESVKKKKYENDIKKEDEL

SEQ ID NO: 2620926 - protein, 11 aa, Entamoeba histolytica
FRDKGNSGSSL

SEQ ID NO: 2620927 - protein, 8 aa, Entamoeba histolytica
FRDNPEEA

SEQ ID NO: 2620928 - protein, 31 aa, Entamoeba histolytica
FRDRKKSAKIVEEEQLDEYESDSEKKKSTTI

SEQ ID NO: 2620929 - protein, 8 aa, Entamoeba histolytica
FREDNREN

SEQ ID NO: 2620930 - protein, 5 aa, Entamoeba histolytica
FREEG

SEQ ID NO: 2620931 - protein, 4 aa, Entamoeba histolytica
FREK

SEQ ID NO: 2620932 - protein, 7 aa, Entamoeba histolytica
FREPPGA

SEQ ID NO: 2620933 - protein, 15 aa, Entamoeba histolytica
FRETLDSYTSNPIPL

SEQ ID NO: 2620934 - protein, 9 aa, Entamoeba histolytica
FRGKSDKLT

SEQ ID NO: 2620935 - protein, 5 aa, Entamoeba histolytica
FRGND

SEQ ID NO: 2620936 - protein, 5 aa, Entamoeba histolytica
FRGSN

SEQ ID NO: 2620937 - protein, 7 aa, Entamoeba histolytica
FRGSTTA

SEQ ID NO: 2620938 - protein, 9 aa, Entamoeba histolytica
FRGYQQGSY

SEQ ID NO: 2620939 - protein, 8 aa, Entamoeba histolytica
FRKDTGSL

SEQ ID NO: 2620940 - protein, 23 aa, Entamoeba histolytica
FRNENQIRNESGLKEKRASDRKI

SEQ ID NO: 2620941 - protein, 8 aa, Entamoeba histolytica
FRNHADTV

SEQ ID NO: 2620942 - protein, 4 aa, Entamoeba histolytica
FRNT

SEQ ID NO: 2620943 - protein, 9 aa, Entamoeba histolytica
FRPGNTNPK

SEQ ID NO: 2620944 - protein, 35 aa, Entamoeba histolytica
FRPKTKQDKQEKINKHKEAKVEIKEDPSKKNRFDN

SEQ ID NO: 2620945 - protein, 10 aa, Entamoeba histolytica
FRPPGAPALK

SEQ ID NO: 2620946 - protein, 7 aa, Entamoeba histolytica
FRQQQEE

SEQ ID NO: 2620947 - protein, 87 aa, Entamoeba histolytica
FRRRRERAIREEKEQSPELINNTDDHRRCRERYSRSRSRSDSKERHYRRDSYNRYYSSRSRSASRDRHYRRHPTSHEHSSSRRRYYD

SEQ ID NO: 2620948 - protein, 9 aa, Entamoeba histolytica
FRRTPAQDE

SEQ ID NO: 2620949 - protein, 5 aa, Entamoeba histolytica
FRTPV

SEQ ID NO: 2620950 - protein, 6 aa, Entamoeba histolytica
FSAGTK

SEQ ID NO: 2620951 - protein, 9 aa, Entamoeba histolytica
FSATTPYGE

SEQ ID NO: 2620952 - protein, 14 aa, Entamoeba histolytica
FSDDSSEDLDNPFD

SEQ ID NO: 2620953 - protein, 4 aa, Entamoeba histolytica
FSDE

SEQ ID NO: 2620954 - protein, 44 aa, Entamoeba histolytica
FSDEEDDKDQNTESLSSSESKSTTGEYSESSYESEEDSEGDDID

SEQ ID NO: 2620955 - protein, 6 aa, Entamoeba histolytica
FSDEEK

SEQ ID NO: 2620956 - protein, 6 aa, Entamoeba histolytica
FSDEER

SEQ ID NO: 2620957 - protein, 4 aa, Entamoeba histolytica
FSDG

SEQ ID NO: 2620958 - protein, 5 aa, Entamoeba histolytica
FSDGD

SEQ ID NO: 2620959 - protein, 11 aa, Entamoeba histolytica
FSDGEEKLEKE

SEQ ID NO: 2620960 - protein, 12 aa, Entamoeba histolytica
FSDGKTQAFGRS

SEQ ID NO: 2620961 - protein, 12 aa, Entamoeba histolytica
FSDGLPKVPKEL

SEQ ID NO: 2620962 - protein, 5 aa, Entamoeba histolytica
FSDGS

SEQ ID NO: 2620963 - protein, 9 aa, Entamoeba histolytica
FSDGSEVYP

SEQ ID NO: 2620964 - protein, 10 aa, Entamoeba histolytica
FSDKKQKDAA

SEQ ID NO: 2620965 - protein, 13 aa, Entamoeba histolytica
FSDPDDSTNRERD

SEQ ID NO: 2620966 - protein, 6 aa, Entamoeba histolytica
FSDSKV

SEQ ID NO: 2620967 - protein, 4 aa, Entamoeba histolytica
FSEA

SEQ ID NO: 2620968 - protein, 12 aa, Entamoeba histolytica
FSEDAKKSETTE

SEQ ID NO: 2620969 - protein, 8 aa, Entamoeba histolytica
FSEDNPTV

SEQ ID NO: 2620970 - protein, 24 aa, Entamoeba histolytica
FSEDTKQNCLTTEEGENSSVPQTR

SEQ ID NO: 2620971 - protein, 6 aa, Entamoeba histolytica
FSEEEI

SEQ ID NO: 2620972 - protein, 6 aa, Entamoeba histolytica
FSEEEK

SEQ ID NO: 2620973 - protein, 7 aa, Entamoeba histolytica
FSEGDHS

SEQ ID NO: 2620974 - protein, 19 aa, Entamoeba histolytica
FSEGGEKDLGHPPMDESDQ

SEQ ID NO: 2620975 - protein, 11 aa, Entamoeba histolytica
FSEGSKRISPE

SEQ ID NO: 2620976 - protein, 9 aa, Entamoeba histolytica
FSEHDSKQI

SEQ ID NO: 2620977 - protein, 4 aa, Entamoeba histolytica
FSEK

SEQ ID NO: 2620978 - protein, 6 aa, Entamoeba histolytica
FSEKDI

SEQ ID NO: 2620979 - protein, 11 aa, Entamoeba histolytica
FSEKNSNKTRL

SEQ ID NO: 2620980 - protein, 5 aa, Entamoeba histolytica
FSENK

SEQ ID NO: 2620981 - protein, 11 aa, Entamoeba histolytica
FSENNSPKMSL

SEQ ID NO: 2620982 - protein, 8 aa, Entamoeba histolytica
FSENTDSI

SEQ ID NO: 2620983 - protein, 11 aa, Entamoeba histolytica
FSEQQSLGEQL

SEQ ID NO: 2620984 - protein, 5 aa, Entamoeba histolytica
FSESE

SEQ ID NO: 2620985 - protein, 18 aa, Entamoeba histolytica
FSESESASSSRQSIDGGN

SEQ ID NO: 2620986 - protein, 14 aa, Entamoeba histolytica
FSESPTDDCQKYSV

SEQ ID NO: 2620987 - protein, 10 aa, Entamoeba histolytica
FSEVTKSTVG

SEQ ID NO: 2620988 - protein, 10 aa, Entamoeba histolytica
FSGFSTKTES

SEQ ID NO: 2620989 - protein, 9 aa, Entamoeba histolytica
FSGGQQNQI

SEQ ID NO: 2620990 - protein, 18 aa, Entamoeba histolytica
FSGGRNTTEEHKKLGGQC

SEQ ID NO: 2620991 - protein, 8 aa, Entamoeba histolytica
FSGKKEKI

SEQ ID NO: 2620992 - protein, 6 aa, Entamoeba histolytica
FSGNGA

SEQ ID NO: 2620993 - protein, 11 aa, Entamoeba histolytica
FSGNKEEYDIE

SEQ ID NO: 2620994 - protein, 6 aa, Entamoeba histolytica
FSGNTK

SEQ ID NO: 2620995 - protein, 9 aa, Entamoeba histolytica
FSGPEVGEK

SEQ ID NO: 2620996 - protein, 5 aa, Entamoeba histolytica
FSGPV

SEQ ID NO: 2620997 - protein, 28 aa, Entamoeba histolytica
FSGQEQSSGLNVPNSPGLESQKQTTTSG

SEQ ID NO: 2620998 - protein, 5 aa, Entamoeba histolytica
FSGQP

SEQ ID NO: 2620999 - protein, 7 aa, Entamoeba histolytica
FSGSRGL

SEQ ID NO: 2621000 - protein, 5 aa, Entamoeba histolytica
FSGST

SEQ ID NO: 2621001 - protein, 6 aa, Entamoeba histolytica
FSGTKG

SEQ ID NO: 2621002 - protein, 5 aa, Entamoeba histolytica
FSGTN

SEQ ID NO: 2621003 - protein, 4 aa, Entamoeba histolytica
FSHD

SEQ ID NO: 2621004 - protein, 19 aa, Entamoeba histolytica
FSIQRKDKEEFSEETGTSI

SEQ ID NO: 2621005 - protein, 7 aa, Entamoeba histolytica
FSKDGKK

SEQ ID NO: 2621006 - protein, 7 aa, Entamoeba histolytica
FSKENRT

SEQ ID NO: 2621007 - protein, 5 aa, Entamoeba histolytica
FSKET

SEQ ID NO: 2621008 - protein, 10 aa, Entamoeba histolytica
FSKGVKKEMK

SEQ ID NO: 2621009 - protein, 7 aa, Entamoeba histolytica
FSKKQKA

SEQ ID NO: 2621010 - protein, 8 aa, Entamoeba histolytica
FSKNSGLT

SEQ ID NO: 2621011 - protein, 6 aa, Entamoeba histolytica
FSKPIP

SEQ ID NO: 2621012 - protein, 12 aa, Entamoeba histolytica
FSKPLTESKNSC

SEQ ID NO: 2621013 - protein, 5 aa, Entamoeba histolytica
FSKPQ

SEQ ID NO: 2621014 - protein, 16 aa, Entamoeba histolytica
FSKPSKKATNKHKCSL

SEQ ID NO: 2621015 - protein, 9 aa, Entamoeba histolytica
FSKPSTVNE

SEQ ID NO: 2621016 - protein, 4 aa, Entamoeba histolytica
FSKS

SEQ ID NO: 2621017 - protein, 19 aa, Entamoeba histolytica
FSKTEESIFDDPDYEEYNK

SEQ ID NO: 2621018 - protein, 19 aa, Entamoeba histolytica
FSKTEESIFDDPDYEEYTK

SEQ ID NO: 2621019 - protein, 18 aa, Entamoeba histolytica
FSLKKKRSVEDILKIFEN

SEQ ID NO: 2621020 - protein, 4 aa, Entamoeba histolytica
FSLT

SEQ ID NO: 2621021 - protein, 10 aa, Entamoeba histolytica
FSMGPDDYGV

SEQ ID NO: 2621022 - protein, 4 aa, Entamoeba histolytica
FSMP

SEQ ID NO: 2621023 - protein, 9 aa, Entamoeba histolytica
FSNAQSEGE

SEQ ID NO: 2621024 - protein, 4 aa, Entamoeba histolytica
FSND

SEQ ID NO: 2621025 - protein, 4 aa, Entamoeba histolytica
FSNE

SEQ ID NO: 2621026 - protein, 13 aa, Entamoeba histolytica
FSNGAEGLTAEEE

SEQ ID NO: 2621027 - protein, 18 aa, Entamoeba histolytica
FSNKTPSDIEQPLSKRKF

SEQ ID NO: 2621028 - protein, 14 aa, Entamoeba histolytica
FSNNEEIKKIQDDK

SEQ ID NO: 2621029 - protein, 5 aa, Entamoeba histolytica
FSNPN

SEQ ID NO: 2621030 - protein, 17 aa, Entamoeba histolytica
FSNPQNSLRPPKTAQAM

SEQ ID NO: 2621031 - protein, 6 aa, Entamoeba histolytica
FSNPRK

SEQ ID NO: 2621032 - protein, 9 aa, Entamoeba histolytica
FSNPTHEDF

SEQ ID NO: 2621033 - protein, 5 aa, Entamoeba histolytica
FSNQF

SEQ ID NO: 2621034 - protein, 5 aa, Entamoeba histolytica
FSNQT

SEQ ID NO: 2621035 - protein, 13 aa, Entamoeba histolytica
FSNRYSTSAEGFY

SEQ ID NO: 2621036 - protein, 8 aa, Entamoeba histolytica
FSNSIDEK

SEQ ID NO: 2621037 - protein, 10 aa, Entamoeba histolytica
FSNSLGETST

SEQ ID NO: 2621038 - protein, 13 aa, Entamoeba histolytica
FSNSNNKNTDSCR

SEQ ID NO: 2621039 - protein, 21 aa, Entamoeba histolytica
FSNSPDDTQFNDKKKYSSRHT

SEQ ID NO: 2621040 - protein, 21 aa, Entamoeba histolytica
FSNTPPQEINPPIPTIPTNTT

SEQ ID NO: 2621041 - protein, 21 aa, Entamoeba histolytica
FSPAPSQDEFPNTKHVPSFLF

SEQ ID NO: 2621042 - protein, 7 aa, Entamoeba histolytica
FSPDGSY

SEQ ID NO: 2621043 - protein, 16 aa, Entamoeba histolytica
FSPDSRSLVTASAQGT

SEQ ID NO: 2621044 - protein, 5 aa, Entamoeba histolytica
FSPED

SEQ ID NO: 2621045 - protein, 10 aa, Entamoeba histolytica
FSPENSNEIC

SEQ ID NO: 2621046 - protein, 6 aa, Entamoeba histolytica
FSPEVN

SEQ ID NO: 2621047 - protein, 4 aa, Entamoeba histolytica
FSPF

SEQ ID NO: 2621048 - protein, 6 aa, Entamoeba histolytica
FSPKDP

SEQ ID NO: 2621049 - protein, 7 aa, Entamoeba histolytica
FSPKELN

SEQ ID NO: 2621050 - protein, 9 aa, Entamoeba histolytica
FSPKPISNN

SEQ ID NO: 2621051 - protein, 5 aa, Entamoeba histolytica
FSPND

SEQ ID NO: 2621052 - protein, 7 aa, Entamoeba histolytica
FSPNGDY

SEQ ID NO: 2621053 - protein, 20 aa, Entamoeba histolytica
FSPNQSQTQLGSSLKKSNPY

SEQ ID NO: 2621054 - protein, 8 aa, Entamoeba histolytica
FSPPRTAL

SEQ ID NO: 2621055 - protein, 18 aa, Entamoeba histolytica
FSPRTPKSLRSSGTNSPV

SEQ ID NO: 2621056 - protein, 6 aa, Entamoeba histolytica
FSPSDS

SEQ ID NO: 2621057 - protein, 7 aa, Entamoeba histolytica
FSPSTSF

SEQ ID NO: 2621058 - protein, 5 aa, Entamoeba histolytica
FSPVR

SEQ ID NO: 2621059 - protein, 8 aa, Entamoeba histolytica
FSQDSYNN

SEQ ID NO: 2621060 - protein, 4 aa, Entamoeba histolytica
FSQE

SEQ ID NO: 2621061 - protein, 5 aa, Entamoeba histolytica
FSQEH

SEQ ID NO: 2621062 - protein, 6 aa, Entamoeba histolytica
FSQENK

SEQ ID NO: 2621063 - protein, 5 aa, Entamoeba histolytica
FSQET

SEQ ID NO: 2621064 - protein, 7 aa, Entamoeba histolytica
FSQKQFD

SEQ ID NO: 2621065 - protein, 20 aa, Entamoeba histolytica
FSQRQNEHSRRVPNEQIGSE

SEQ ID NO: 2621066 - protein, 8 aa, Entamoeba histolytica
FSQSVDTA

SEQ ID NO: 2621067 - protein, 11 aa, Entamoeba histolytica
FSRPGGRETGF

SEQ ID NO: 2621068 - protein, 7 aa, Entamoeba histolytica
FSRSAER

SEQ ID NO: 2621069 - protein, 6 aa, Entamoeba histolytica
FSSDNY

SEQ ID NO: 2621070 - protein, 14 aa, Entamoeba histolytica
FSSEQRDATAAAAE

SEQ ID NO: 2621071 - protein, 6 aa, Entamoeba histolytica
FSSEQT

SEQ ID NO: 2621072 - protein, 6 aa, Entamoeba histolytica
FSSGIT

SEQ ID NO: 2621073 - protein, 20 aa, Entamoeba histolytica
FSSGPSPYNPATGALSKPAF

SEQ ID NO: 2621074 - protein, 9 aa, Entamoeba histolytica
FSSHPPNLE

SEQ ID NO: 2621075 - protein, 4 aa, Entamoeba histolytica
FSSK

SEQ ID NO: 2621076 - protein, 53 aa, Entamoeba histolytica
FSSKKEEEEARLQQKIEKKKRTEKRKEIEDKKKKDEEEKKKNKPVRGKAGKMK

SEQ ID NO: 2621077 - protein, 8 aa, Entamoeba histolytica
FSSKSDKF

SEQ ID NO: 2621078 - protein, 4 aa, Entamoeba histolytica
FSSN

SEQ ID NO: 2621079 - protein, 18 aa, Entamoeba histolytica
FSSNGDPVYRSDGSIIEA

SEQ ID NO: 2621080 - protein, 10 aa, Entamoeba histolytica
FSSNKKTTSY

SEQ ID NO: 2621081 - protein, 9 aa, Entamoeba histolytica
FSSNRSENG

SEQ ID NO: 2621082 - protein, 5 aa, Entamoeba histolytica
FSSPD

SEQ ID NO: 2621083 - protein, 14 aa, Entamoeba histolytica
FSSPMKKKSTNFIG

SEQ ID NO: 2621084 - protein, 17 aa, Entamoeba histolytica
FSSPTGIRGDYWVHIKL

SEQ ID NO: 2621085 - protein, 9 aa, Entamoeba histolytica
FSSQQTARK

SEQ ID NO: 2621086 - protein, 4 aa, Entamoeba histolytica
FSSR

SEQ ID NO: 2621087 - protein, 11 aa, Entamoeba histolytica
FSSRHGQKGTL

SEQ ID NO: 2621088 - protein, 13 aa, Entamoeba histolytica
FSSRHGQKGTVGM

SEQ ID NO: 2621089 - protein, 4 aa, Entamoeba histolytica
FSSS

SEQ ID NO: 2621090 - protein, 9 aa, Entamoeba histolytica
FSSSEYLQQ

SEQ ID NO: 2621091 - protein, 9 aa, Entamoeba histolytica
FSSSPNTSI

SEQ ID NO: 2621092 - protein, 33 aa, Entamoeba histolytica
FSSSPSYSPNLSPKHTEESKQVTTSSNSPTEPY

SEQ ID NO: 2621093 - protein, 14 aa, Entamoeba histolytica
FSSSSAKPNQSSDD

SEQ ID NO: 2621094 - protein, 21 aa, Entamoeba histolytica
FSSSYNSRRFKNERRRGYDDY

SEQ ID NO: 2621095 - protein, 8 aa, Entamoeba histolytica
FSSTEKEL

SEQ ID NO: 2621096 - protein, 13 aa, Entamoeba histolytica
FSSTKEYNKLLCC

SEQ ID NO: 2621097 - protein, 7 aa, Entamoeba histolytica
FSTEKVK

SEQ ID NO: 2621098 - protein, 5 aa, Entamoeba histolytica
FSTEN

SEQ ID NO: 2621099 - protein, 12 aa, Entamoeba histolytica
FSTGSKRCSVKE

SEQ ID NO: 2621100 - protein, 4 aa, Entamoeba histolytica
FSTI

SEQ ID NO: 2621101 - protein, 11 aa, Entamoeba histolytica
FSTKTSKSEKF

SEQ ID NO: 2621102 - protein, 8 aa, Entamoeba histolytica
FSTNDSTV

SEQ ID NO: 2621103 - protein, 11 aa, Entamoeba histolytica
FSTNSSQTTRL

SEQ ID NO: 2621104 - protein, 5 aa, Entamoeba histolytica
FSTSG

SEQ ID NO: 2621105 - protein, 5 aa, Entamoeba histolytica
FSTSQ

SEQ ID NO: 2621106 - protein, 9 aa, Entamoeba histolytica
FSTSSDTLL

SEQ ID NO: 2621107 - protein, 9 aa, Entamoeba histolytica
FSTTTNEPY

SEQ ID NO: 2621108 - protein, 5 aa, Entamoeba histolytica
FSVTN

SEQ ID NO: 2621109 - protein, 4 aa, Entamoeba histolytica
FSWP

SEQ ID NO: 2621110 - protein, 7 aa, Entamoeba histolytica
FTASGLT

SEQ ID NO: 2621111 - protein, 4 aa, Entamoeba histolytica
FTDE

SEQ ID NO: 2621112 - protein, 6 aa, Entamoeba histolytica
FTDEQL

SEQ ID NO: 2621113 - protein, 5 aa, Entamoeba histolytica
FTDKN

SEQ ID NO: 2621114 - protein, 10 aa, Entamoeba histolytica
FTDSAKPDDI

SEQ ID NO: 2621115 - protein, 10 aa, Entamoeba histolytica
FTDSDREAKI

SEQ ID NO: 2621116 - protein, 5 aa, Entamoeba histolytica
FTEEE

SEQ ID NO: 2621117 - protein, 6 aa, Entamoeba histolytica
FTEGED

SEQ ID NO: 2621118 - protein, 6 aa, Entamoeba histolytica
FTEGHA

SEQ ID NO: 2621119 - protein, 16 aa, Entamoeba histolytica
FTEITGEGKNEEEKME

SEQ ID NO: 2621120 - protein, 8 aa, Entamoeba histolytica
FTEKKGFN

SEQ ID NO: 2621121 - protein, 4 aa, Entamoeba histolytica
FTEN

SEQ ID NO: 2621122 - protein, 5 aa, Entamoeba histolytica
FTENT

SEQ ID NO: 2621123 - protein, 9 aa, Entamoeba histolytica
FTEPPSEGS

SEQ ID NO: 2621124 - protein, 6 aa, Entamoeba histolytica
FTEQKR

SEQ ID NO: 2621125 - protein, 4 aa, Entamoeba histolytica
FTER

SEQ ID NO: 2621126 - protein, 51 aa, Entamoeba histolytica
FTESSLPSEKPLEQPVNQPKDVQKETTDVFSPKPSQSESIPPKINQTSTSP

SEQ ID NO: 2621127 - protein, 21 aa, Entamoeba histolytica
FTETGEMVTENEESSVSETFE

SEQ ID NO: 2621128 - protein, 12 aa, Entamoeba histolytica
FTGAEEDVDDDL

SEQ ID NO: 2621129 - protein, 15 aa, Entamoeba histolytica
FTGANPSHLKYEFSH

SEQ ID NO: 2621130 - protein, 10 aa, Entamoeba histolytica
FTGKKGTLRI

SEQ ID NO: 2621131 - protein, 10 aa, Entamoeba histolytica
FTGKRPIDDF

SEQ ID NO: 2621132 - protein, 10 aa, Entamoeba histolytica
FTGKYSEDVK

SEQ ID NO: 2621133 - protein, 5 aa, Entamoeba histolytica
FTGQD

SEQ ID NO: 2621134 - protein, 6 aa, Entamoeba histolytica
FTGSSK

SEQ ID NO: 2621135 - protein, 7 aa, Entamoeba histolytica
FTGSSNL

SEQ ID NO: 2621136 - protein, 17 aa, Entamoeba histolytica
FTGTGNSIGKSNATNFK

SEQ ID NO: 2621137 - protein, 5 aa, Entamoeba histolytica
FTGVG

SEQ ID NO: 2621138 - protein, 4 aa, Entamoeba histolytica
FTHK

SEQ ID NO: 2621139 - protein, 5 aa, Entamoeba histolytica
FTHPG

SEQ ID NO: 2621140 - protein, 10 aa, Entamoeba histolytica
FTKDKREEDI

SEQ ID NO: 2621141 - protein, 13 aa, Entamoeba histolytica
FTKELPESTPPEI

SEQ ID NO: 2621142 - protein, 11 aa, Entamoeba histolytica
FTKEQKESMFE

SEQ ID NO: 2621143 - protein, 4 aa, Entamoeba histolytica
FTKK

SEQ ID NO: 2621144 - protein, 6 aa, Entamoeba histolytica
FTKNNQ

SEQ ID NO: 2621145 - protein, 9 aa, Entamoeba histolytica
FTKPTQRGN

SEQ ID NO: 2621146 - protein, 45 aa, Entamoeba histolytica
FTKQNDSTDKITTNPETKDSDVLSNQINNKNNQILTSSKVENASL

SEQ ID NO: 2621147 - protein, 12 aa, Entamoeba histolytica
FTKTQKKKLSFN

SEQ ID NO: 2621148 - protein, 13 aa, Entamoeba histolytica
FTLDQTRKELGKI

SEQ ID NO: 2621149 - protein, 12 aa, Entamoeba histolytica
FTNEVTKDKTDV

SEQ ID NO: 2621150 - protein, 14 aa, Entamoeba histolytica
FTNKTNDTNNIQPK

SEQ ID NO: 2621151 - protein, 12 aa, Entamoeba histolytica
FTNNGDEKSVRN

SEQ ID NO: 2621152 - protein, 7 aa, Entamoeba histolytica
FTNQTAT

SEQ ID NO: 2621153 - protein, 9 aa, Entamoeba histolytica
FTNSYKATI

SEQ ID NO: 2621154 - protein, 12 aa, Entamoeba histolytica
FTNVNRSKFKNG

SEQ ID NO: 2621155 - protein, 4 aa, Entamoeba histolytica
FTPD

SEQ ID NO: 2621156 - protein, 19 aa, Entamoeba histolytica
FTPEEEEQIRKENLWCEEL

SEQ ID NO: 2621157 - protein, 18 aa, Entamoeba histolytica
FTPEKGSLASKSKKKIKA

SEQ ID NO: 2621158 - protein, 7 aa, Entamoeba histolytica
FTPEPND

SEQ ID NO: 2621159 - protein, 22 aa, Entamoeba histolytica
FTPHDKHKRPAIPDKKLTKSRS

SEQ ID NO: 2621160 - protein, 4 aa, Entamoeba histolytica
FTPI

SEQ ID NO: 2621161 - protein, 11 aa, Entamoeba histolytica
FTPKQKKETIQ

SEQ ID NO: 2621162 - protein, 9 aa, Entamoeba histolytica
FTPKTTEFQ

SEQ ID NO: 2621163 - protein, 9 aa, Entamoeba histolytica
FTPNPNDPL

SEQ ID NO: 2621164 - protein, 13 aa, Entamoeba histolytica
FTPPNLSKAVGER

SEQ ID NO: 2621165 - protein, 4 aa, Entamoeba histolytica
FTPQ

SEQ ID NO: 2621166 - protein, 37 aa, Entamoeba histolytica
FTPQVSPEGTIKSELTQQSLTRSKSGINVPRTKQSLP

SEQ ID NO: 2621167 - protein, 4 aa, Entamoeba histolytica
FTQD

SEQ ID NO: 2621168 - protein, 6 aa, Entamoeba histolytica
FTQKAN

SEQ ID NO: 2621169 - protein, 6 aa, Entamoeba histolytica
FTQNPQ

SEQ ID NO: 2621170 - protein, 6 aa, Entamoeba histolytica
FTQNPT

SEQ ID NO: 2621171 - protein, 24 aa, Entamoeba histolytica
FTQPDTNYQKKIGKEIGKATNIKS

SEQ ID NO: 2621172 - protein, 11 aa, Entamoeba histolytica
FTQPEQKTQAD

SEQ ID NO: 2621173 - protein, 31 aa, Entamoeba histolytica
FTQSQYEDEESNKNMEEEPSVIDKEKDQSLT

SEQ ID NO: 2621174 - protein, 13 aa, Entamoeba histolytica
FTQTKDDNKGKIV

SEQ ID NO: 2621175 - protein, 8 aa, Entamoeba histolytica
FTQTNNRN

SEQ ID NO: 2621176 - protein, 7 aa, Entamoeba histolytica
FTRARND

SEQ ID NO: 2621177 - protein, 13 aa, Entamoeba histolytica
FTRDSKVRNDRSM

SEQ ID NO: 2621178 - protein, 4 aa, Entamoeba histolytica
FTRE

SEQ ID NO: 2621179 - protein, 14 aa, Entamoeba histolytica
FTRKPKKKATKEQK

SEQ ID NO: 2621180 - protein, 16 aa, Entamoeba histolytica
FTRQQRPKVDSPQDEK

SEQ ID NO: 2621181 - protein, 19 aa, Entamoeba histolytica
FTSEDQKEFETSIPSECTS

SEQ ID NO: 2621182 - protein, 6 aa, Entamoeba histolytica
FTSEEE

SEQ ID NO: 2621183 - protein, 5 aa, Entamoeba histolytica
FTSPL

SEQ ID NO: 2621184 - protein, 6 aa, Entamoeba histolytica
FTSSEE

SEQ ID NO: 2621185 - protein, 6 aa, Entamoeba histolytica
FTSSNE

SEQ ID NO: 2621186 - protein, 6 aa, Entamoeba histolytica
FTSSNP

SEQ ID NO: 2621187 - protein, 12 aa, Entamoeba histolytica
FTSSTQPNSGFK

SEQ ID NO: 2621188 - protein, 7 aa, Entamoeba histolytica
FTSTGTC

SEQ ID NO: 2621189 - protein, 17 aa, Entamoeba histolytica
FTSTSNGIEVNADTTKY

SEQ ID NO: 2621190 - protein, 14 aa, Entamoeba histolytica
FTSTTKSSLDPELE

SEQ ID NO: 2621191 - protein, 5 aa, Entamoeba histolytica
FTTAE

SEQ ID NO: 2621192 - protein, 4 aa, Entamoeba histolytica
FTTE

SEQ ID NO: 2621193 - protein, 9 aa, Entamoeba histolytica
FTTENQEDK

SEQ ID NO: 2621194 - protein, 5 aa, Entamoeba histolytica
FTTQI

SEQ ID NO: 2621195 - protein, 15 aa, Entamoeba histolytica
FTTQRNKEENQTNIT

SEQ ID NO: 2621196 - protein, 25 aa, Entamoeba histolytica
FTTQTKPTEPTTPVMTTTQPTNQFS

SEQ ID NO: 2621197 - protein, 6 aa, Entamoeba histolytica
FTTSKG

SEQ ID NO: 2621198 - protein, 15 aa, Entamoeba histolytica
FTVNATDGDTHLGGK

SEQ ID NO: 2621199 - protein, 4 aa, Entamoeba histolytica
FTYD

SEQ ID NO: 2621200 - protein, 12 aa, Entamoeba histolytica
FTYNQKEAIEKE

SEQ ID NO: 2621201 - protein, 7 aa, Entamoeba histolytica
FTYSSDQ

SEQ ID NO: 2621202 - protein, 10 aa, Entamoeba histolytica
FVNSSSPYCQ

SEQ ID NO: 2621203 - protein, 12 aa, Entamoeba histolytica
FVPKRKKQQIEF

SEQ ID NO: 2621204 - protein, 34 aa, Entamoeba histolytica
FVPRKKKLEQQNATAAQTTTPNGPAISEDEVKQE

SEQ ID NO: 2621205 - protein, 25 aa, Entamoeba histolytica
FVRDSKDKEKGRDEETKEDKEALKK

SEQ ID NO: 2621206 - protein, 4 aa, Entamoeba histolytica
FVSG

SEQ ID NO: 2621207 - protein, 13 aa, Entamoeba histolytica
FYDHQKPLATPIE

SEQ ID NO: 2621208 - protein, 9 aa, Entamoeba histolytica
FYDSRGPRD

SEQ ID NO: 2621209 - protein, 9 aa, Entamoeba histolytica
FYDTNPSTV

SEQ ID NO: 2621210 - protein, 6 aa, Entamoeba histolytica
FYDTSK

SEQ ID NO: 2621211 - protein, 17 aa, Entamoeba histolytica
FYEEDGQPICAVCVDYD

SEQ ID NO: 2621212 - protein, 5 aa, Entamoeba histolytica
FYENG

SEQ ID NO: 2621213 - protein, 5 aa, Entamoeba histolytica
FYGNS

SEQ ID NO: 2621214 - protein, 7 aa, Entamoeba histolytica
FYGTTTE

SEQ ID NO: 2621215 - protein, 25 aa, Entamoeba histolytica
FYNEETKKYDLGKKIPADKKDPSLV

SEQ ID NO: 2621216 - protein, 5 aa, Entamoeba histolytica
FYNNK

SEQ ID NO: 2621217 - protein, 11 aa, Entamoeba histolytica
FYSEADESFKE

SEQ ID NO: 2621218 - protein, 11 aa, Entamoeba histolytica
FYTTKNDDYKN

SEQ ID NO: 2621219 - protein, 9 aa, Entamoeba histolytica
GAAAGEGLG

SEQ ID NO: 2621220 - protein, 12 aa, Entamoeba histolytica
GAAAPTTNGEFI

SEQ ID NO: 2621221 - protein, 7 aa, Entamoeba histolytica
GAAFENS

SEQ ID NO: 2621222 - protein, 14 aa, Entamoeba histolytica
GAAKPVEKETRTTV

SEQ ID NO: 2621223 - protein, 7 aa, Entamoeba histolytica
GAALKSA

SEQ ID NO: 2621224 - protein, 10 aa, Entamoeba histolytica
GADAKEIVNG

SEQ ID NO: 2621225 - protein, 11 aa, Entamoeba histolytica
GADESSIDTLE

SEQ ID NO: 2621226 - protein, 15 aa, Entamoeba histolytica
GADKTILNAQNKTAI

SEQ ID NO: 2621227 - protein, 13 aa, Entamoeba histolytica
GADPTALNNDGIS

SEQ ID NO: 2621228 - protein, 6 aa, Entamoeba histolytica
GADPTS

SEQ ID NO: 2621229 - protein, 9 aa, Entamoeba histolytica
GADTVNEKE

SEQ ID NO: 2621230 - protein, 6 aa, Entamoeba histolytica
GAEAPT

SEQ ID NO: 2621231 - protein, 5 aa, Entamoeba histolytica
GAEET

SEQ ID NO: 2621232 - protein, 5 aa, Entamoeba histolytica
GAEGL

SEQ ID NO: 2621233 - protein, 7 aa, Entamoeba histolytica
GAEGSVL

SEQ ID NO: 2621234 - protein, 8 aa, Entamoeba histolytica
GAENDDSF

SEQ ID NO: 2621235 - protein, 8 aa, Entamoeba histolytica
GAEPEPYV

SEQ ID NO: 2621236 - protein, 5 aa, Entamoeba histolytica
GAEQR

SEQ ID NO: 2621237 - protein, 13 aa, Entamoeba histolytica
GAERMKQEEVEGM

SEQ ID NO: 2621238 - protein, 9 aa, Entamoeba histolytica
GAESHAGQT

SEQ ID NO: 2621239 - protein, 12 aa, Entamoeba histolytica
GAETEESNINAG

SEQ ID NO: 2621240 - protein, 11 aa, Entamoeba histolytica
GAETGSGKTAA

SEQ ID NO: 2621241 - protein, 5 aa, Entamoeba histolytica
GAETL

SEQ ID NO: 2621242 - protein, 5 aa, Entamoeba histolytica
GAFEE

SEQ ID NO: 2621243 - protein, 6 aa, Entamoeba histolytica
GAFEEI

SEQ ID NO: 2621244 - protein, 7 aa, Entamoeba histolytica
GAGAAST

SEQ ID NO: 2621245 - protein, 6 aa, Entamoeba histolytica
GAGCGP

SEQ ID NO: 2621246 - protein, 7 aa, Entamoeba histolytica
GAGCGPT

SEQ ID NO: 2621247 - protein, 9 aa, Entamoeba histolytica
GAGGRFDPT

SEQ ID NO: 2621248 - protein, 5 aa, Entamoeba histolytica
GAGKT

SEQ ID NO: 2621249 - protein, 6 aa, Entamoeba histolytica
GAGKTS

SEQ ID NO: 2621250 - protein, 7 aa, Entamoeba histolytica
GAGKTSI

SEQ ID NO: 2621251 - protein, 6 aa, Entamoeba histolytica
GAGKTY

SEQ ID NO: 2621252 - protein, 15 aa, Entamoeba histolytica
GAGNNWAKGHYTEGT

SEQ ID NO: 2621253 - protein, 22 aa, Entamoeba histolytica
GAGQIQQLGSGLRAKQTDTTTH

SEQ ID NO: 2621254 - protein, 7 aa, Entamoeba histolytica
GAGREVG

SEQ ID NO: 2621255 - protein, 9 aa, Entamoeba histolytica
GAGSRQSIN

SEQ ID NO: 2621256 - protein, 9 aa, Entamoeba histolytica
GAGTAADLT

SEQ ID NO: 2621257 - protein, 7 aa, Entamoeba histolytica
GAGTDDE

SEQ ID NO: 2621258 - protein, 7 aa, Entamoeba histolytica
GAHAGNA

SEQ ID NO: 2621259 - protein, 13 aa, Entamoeba histolytica
GAHPWGETSELDR

SEQ ID NO: 2621260 - protein, 12 aa, Entamoeba histolytica
GAIDKEKETHIS

SEQ ID NO: 2621261 - protein, 4 aa, Entamoeba histolytica
GAIE

SEQ ID NO: 2621262 - protein, 12 aa, Entamoeba histolytica
GAIGTARQQINN

SEQ ID NO: 2621263 - protein, 7 aa, Entamoeba histolytica
GAIPNEE

SEQ ID NO: 2621264 - protein, 7 aa, Entamoeba histolytica
GAKALAE

SEQ ID NO: 2621265 - protein, 11 aa, Entamoeba histolytica
GAKDGKGRGRQ

SEQ ID NO: 2621266 - protein, 9 aa, Entamoeba histolytica
GAKDLEEKK

SEQ ID NO: 2621267 - protein, 4 aa, Entamoeba histolytica
GAKG

SEQ ID NO: 2621268 - protein, 14 aa, Entamoeba histolytica
GAKHWKKRKSSHCE

SEQ ID NO: 2621269 - protein, 13 aa, Entamoeba histolytica
GAKKEGESKPVRP

SEQ ID NO: 2621270 - protein, 13 aa, Entamoeba histolytica
GAKKMRGGREKNS

SEQ ID NO: 2621271 - protein, 9 aa, Entamoeba histolytica
GAKKTVEEA

SEQ ID NO: 2621272 - protein, 4 aa, Entamoeba histolytica
GAKL

SEQ ID NO: 2621273 - protein, 8 aa, Entamoeba histolytica
GAKMGSES

SEQ ID NO: 2621274 - protein, 14 aa, Entamoeba histolytica
GAKNKSKEKKGVMR

SEQ ID NO: 2621275 - protein, 16 aa, Entamoeba histolytica
GAKNNGGKFCSECGNK

SEQ ID NO: 2621276 - protein, 8 aa, Entamoeba histolytica
GAKSSEEI

SEQ ID NO: 2621277 - protein, 11 aa, Entamoeba histolytica
GAKTGTRPDKI

SEQ ID NO: 2621278 - protein, 11 aa, Entamoeba histolytica
GALAGKAATVA

SEQ ID NO: 2621279 - protein, 10 aa, Entamoeba histolytica
GALDKPEKLQ

SEQ ID NO: 2621280 - protein, 10 aa, Entamoeba histolytica
GALGQNPTVI

SEQ ID NO: 2621281 - protein, 7 aa, Entamoeba histolytica
GALKKDS

SEQ ID NO: 2621282 - protein, 14 aa, Entamoeba histolytica
GALNARRSDDPKGM

SEQ ID NO: 2621283 - protein, 19 aa, Entamoeba histolytica
GALQPTPGELGKGGNAGIT

SEQ ID NO: 2621284 - protein, 7 aa, Entamoeba histolytica
GALSLQD

SEQ ID NO: 2621285 - protein, 4 aa, Entamoeba histolytica
GAMK

SEQ ID NO: 2621286 - protein, 5 aa, Entamoeba histolytica
GAMKQ

SEQ ID NO: 2621287 - protein, 6 aa, Entamoeba histolytica
GAMKRR

SEQ ID NO: 2621288 - protein, 9 aa, Entamoeba histolytica
GANATNPAS

SEQ ID NO: 2621289 - protein, 6 aa, Entamoeba histolytica
GANERF

SEQ ID NO: 2621290 - protein, 6 aa, Entamoeba histolytica
GANINS

SEQ ID NO: 2621291 - protein, 8 aa, Entamoeba histolytica
GANPAQAF

SEQ ID NO: 2621292 - protein, 10 aa, Entamoeba histolytica
GANPTKQKIS

SEQ ID NO: 2621293 - protein, 5 aa, Entamoeba histolytica
GANQI

SEQ ID NO: 2621294 - protein, 9 aa, Entamoeba histolytica
GANQLTKQL

SEQ ID NO: 2621295 - protein, 6 aa, Entamoeba histolytica
GANVNA

SEQ ID NO: 2621296 - protein, 10 aa, Entamoeba histolytica
GANVNHQTNN

SEQ ID NO: 2621297 - protein, 12 aa, Entamoeba histolytica
GANVNQVTESGT

SEQ ID NO: 2621298 - protein, 4 aa, Entamoeba histolytica
GAPA

SEQ ID NO: 2621299 - protein, 8 aa, Entamoeba histolytica
GAPAPGMV

SEQ ID NO: 2621300 - protein, 6 aa, Entamoeba histolytica
GAPEEY

SEQ ID NO: 2621301 - protein, 31 aa, Entamoeba histolytica
GAPELPPCPPPPEPINEEINPKKNKMNNKEK

SEQ ID NO: 2621302 - protein, 31 aa, Entamoeba histolytica
GAPELPPCPTTPEPINEEINPKKNKMNNKEK

SEQ ID NO: 2621303 - protein, 8 aa, Entamoeba histolytica
GAPGIGKS

SEQ ID NO: 2621304 - protein, 8 aa, Entamoeba histolytica
GAPGKSGI

SEQ ID NO: 2621305 - protein, 12 aa, Entamoeba histolytica
GAPGTGKTALAQ

SEQ ID NO: 2621306 - protein, 20 aa, Entamoeba histolytica
GAPIKQKPQLPNKASKLNAT

SEQ ID NO: 2621307 - protein, 6 aa, Entamoeba histolytica
GAPLNE

SEQ ID NO: 2621308 - protein, 15 aa, Entamoeba histolytica
GAPLNQVTNGNQSSL

SEQ ID NO: 2621309 - protein, 6 aa, Entamoeba histolytica
GAPLTE

SEQ ID NO: 2621310 - protein, 26 aa, Entamoeba histolytica
GAPSNERDIPSKETDVPLTIIFENLS

SEQ ID NO: 2621311 - protein, 11 aa, Entamoeba histolytica
GAPTGSGKTVA

SEQ ID NO: 2621312 - protein, 4 aa, Entamoeba histolytica
GAPY

SEQ ID NO: 2621313 - protein, 5 aa, Entamoeba histolytica
GAPYQ

SEQ ID NO: 2621314 - protein, 10 aa, Entamoeba histolytica
GAQASSHTPQ

SEQ ID NO: 2621315 - protein, 11 aa, Entamoeba histolytica
GAQEGSALSRT

SEQ ID NO: 2621316 - protein, 5 aa, Entamoeba histolytica
GAQER

SEQ ID NO: 2621317 - protein, 13 aa, Entamoeba histolytica
GAQKETNQIEDNY

SEQ ID NO: 2621318 - protein, 14 aa, Entamoeba histolytica
GAQPGLGGLPPMGG

SEQ ID NO: 2621319 - protein, 19 aa, Entamoeba histolytica
GAQPGLGLGGGLGTQPAGL

SEQ ID NO: 2621320 - protein, 18 aa, Entamoeba histolytica
GAQQPNQSANTQKPMYNP

SEQ ID NO: 2621321 - protein, 9 aa, Entamoeba histolytica
GAQSSGKST

SEQ ID NO: 2621322 - protein, 29 aa, Entamoeba histolytica
GARGAASITRYATGLSKQYQNQEGTPEEK

SEQ ID NO: 2621323 - protein, 7 aa, Entamoeba histolytica
GARGKIQ

SEQ ID NO: 2621324 - protein, 5 aa, Entamoeba histolytica
GARIK

SEQ ID NO: 2621325 - protein, 4 aa, Entamoeba histolytica
GARQ

SEQ ID NO: 2621326 - protein, 24 aa, Entamoeba histolytica
GARQPKKEIHQQEEPEGDEEPVEP

SEQ ID NO: 2621327 - protein, 24 aa, Entamoeba histolytica
GARQPKKEVYQQEEPEGDEEPVEP

SEQ ID NO: 2621328 - protein, 6 aa, Entamoeba histolytica
GARRGR

SEQ ID NO: 2621329 - protein, 7 aa, Entamoeba histolytica
GARRWTS

SEQ ID NO: 2621330 - protein, 5 aa, Entamoeba histolytica
GASAF

SEQ ID NO: 2621331 - protein, 15 aa, Entamoeba histolytica
GASASLKYTKEAQKT

SEQ ID NO: 2621332 - protein, 6 aa, Entamoeba histolytica
GASDRK

SEQ ID NO: 2621333 - protein, 10 aa, Entamoeba histolytica
GASDRKESVG

SEQ ID NO: 2621334 - protein, 10 aa, Entamoeba histolytica
GASKRKKEQI

SEQ ID NO: 2621335 - protein, 14 aa, Entamoeba histolytica
GASLQTQTLSGTTP

SEQ ID NO: 2621336 - protein, 5 aa, Entamoeba histolytica
GASPM

SEQ ID NO: 2621337 - protein, 9 aa, Entamoeba histolytica
GASQENGAN

SEQ ID NO: 2621338 - protein, 7 aa, Entamoeba histolytica
GASSYTS

SEQ ID NO: 2621339 - protein, 5 aa, Entamoeba histolytica
GASTN

SEQ ID NO: 2621340 - protein, 5 aa, Entamoeba histolytica
GATDG

SEQ ID NO: 2621341 - protein, 7 aa, Entamoeba histolytica
GATGRCN

SEQ ID NO: 2621342 - protein, 11 aa, Entamoeba histolytica
GATGSGKTTQI

SEQ ID NO: 2621343 - protein, 4 aa, Entamoeba histolytica
GATK

SEQ ID NO: 2621344 - protein, 18 aa, Entamoeba histolytica
GATLKTQRSVEFASHISE

SEQ ID NO: 2621345 - protein, 6 aa, Entamoeba histolytica
GATNNI

SEQ ID NO: 2621346 - protein, 11 aa, Entamoeba histolytica
GATPSEVKAYE

SEQ ID NO: 2621347 - protein, 6 aa, Entamoeba histolytica
GATRAF

SEQ ID NO: 2621348 - protein, 24 aa, Entamoeba histolytica
GATRAFPPQHPDISEDYKEIGQPA

SEQ ID NO: 2621349 - protein, 5 aa, Entamoeba histolytica
GATTH

SEQ ID NO: 2621350 - protein, 8 aa, Entamoeba histolytica
GATTPKWS

SEQ ID NO: 2621351 - protein, 4 aa, Entamoeba histolytica
GAVE

SEQ ID NO: 2621352 - protein, 11 aa, Entamoeba histolytica
GAVGKTSISTQ

SEQ ID NO: 2621353 - protein, 7 aa, Entamoeba histolytica
GAVPTGM

SEQ ID NO: 2621354 - protein, 17 aa, Entamoeba histolytica
GAYGAFKDDEESSSKFC

SEQ ID NO: 2621355 - protein, 6 aa, Entamoeba histolytica
GAYHSE

SEQ ID NO: 2621356 - protein, 7 aa, Entamoeba histolytica
GAYKRNS

SEQ ID NO: 2621357 - protein, 67 aa, Entamoeba histolytica
GAYPPPPMGGCPPPMGAYPPPPMGGCPPPMPGPGGYPMGGCPPPMPGPGGYPMGGCPPPMPGPGGYP

SEQ ID NO: 2621358 - protein, 6 aa, Entamoeba histolytica
GAYTKN

SEQ ID NO: 2621359 - protein, 4 aa, Entamoeba histolytica
GCAD

SEQ ID NO: 2621360 - protein, 13 aa, Entamoeba histolytica
GCAEGEKLSRGFE

SEQ ID NO: 2621361 - protein, 5 aa, Entamoeba histolytica
GCANN

SEQ ID NO: 2621362 - protein, 13 aa, Entamoeba histolytica
GCAPGKKEDPSVV

SEQ ID NO: 2621363 - protein, 5 aa, Entamoeba histolytica
GCAQR

SEQ ID NO: 2621364 - protein, 8 aa, Entamoeba histolytica
GCDPLPQT

SEQ ID NO: 2621365 - protein, 12 aa, Entamoeba histolytica
GCEGTEKEKKTA

SEQ ID NO: 2621366 - protein, 9 aa, Entamoeba histolytica
GCEKGCEKA

SEQ ID NO: 2621367 - protein, 4 aa, Entamoeba histolytica
GCEN

SEQ ID NO: 2621368 - protein, 6 aa, Entamoeba histolytica
GCENTL

SEQ ID NO: 2621369 - protein, 6 aa, Entamoeba histolytica
GCEPTQ

SEQ ID NO: 2621370 - protein, 11 aa, Entamoeba histolytica
GCGGGRAPEGY

SEQ ID NO: 2621371 - protein, 5 aa, Entamoeba histolytica
GCGKS

SEQ ID NO: 2621372 - protein, 11 aa, Entamoeba histolytica
GCGRGTFNEGS

SEQ ID NO: 2621373 - protein, 5 aa, Entamoeba histolytica
GCGRT

SEQ ID NO: 2621374 - protein, 12 aa, Entamoeba histolytica
GCHGDKKEKHLG

SEQ ID NO: 2621375 - protein, 13 aa, Entamoeba histolytica
GCIPTNTTNQRNH

SEQ ID NO: 2621376 - protein, 7 aa, Entamoeba histolytica
GCKEGEY

SEQ ID NO: 2621377 - protein, 10 aa, Entamoeba histolytica
GCKGEIDKEY

SEQ ID NO: 2621378 - protein, 4 aa, Entamoeba histolytica
GCKS

SEQ ID NO: 2621379 - protein, 8 aa, Entamoeba histolytica
GCLETDKS

SEQ ID NO: 2621380 - protein, 5 aa, Entamoeba histolytica
GCNPG

SEQ ID NO: 2621381 - protein, 13 aa, Entamoeba histolytica
GCPKEDRTKVTSA

SEQ ID NO: 2621382 - protein, 6 aa, Entamoeba histolytica
GCPNSN

SEQ ID NO: 2621383 - protein, 11 aa, Entamoeba histolytica
GCQAAPNGSVM

SEQ ID NO: 2621384 - protein, 5 aa, Entamoeba histolytica
GCREC

SEQ ID NO: 2621385 - protein, 8 aa, Entamoeba histolytica
GCRSVNSN

SEQ ID NO: 2621386 - protein, 5 aa, Entamoeba histolytica
GCSDG

SEQ ID NO: 2621387 - protein, 6 aa, Entamoeba histolytica
GCSSDE

SEQ ID NO: 2621388 - protein, 6 aa, Entamoeba histolytica
GCTNTS

SEQ ID NO: 2621389 - protein, 7 aa, Entamoeba histolytica
GCTQPRR

SEQ ID NO: 2621390 - protein, 13 aa, Entamoeba histolytica
GCTSGEKLPNTLR

SEQ ID NO: 2621391 - protein, 10 aa, Entamoeba histolytica
GCTSKIPTSE

SEQ ID NO: 2621392 - protein, 7 aa, Entamoeba histolytica
GCVNNER

SEQ ID NO: 2621393 - protein, 5 aa, Entamoeba histolytica
GDAAG

SEQ ID NO: 2621394 - protein, 5 aa, Entamoeba histolytica
GDAAM

SEQ ID NO: 2621395 - protein, 10 aa, Entamoeba histolytica
GDADIVDEDG

SEQ ID NO: 2621396 - protein, 10 aa, Entamoeba histolytica
GDAEASVRDT

SEQ ID NO: 2621397 - protein, 9 aa, Entamoeba histolytica
GDAEKYASK

SEQ ID NO: 2621398 - protein, 9 aa, Entamoeba histolytica
GDAFEKQND

SEQ ID NO: 2621399 - protein, 7 aa, Entamoeba histolytica
GDAHGGH

SEQ ID NO: 2621400 - protein, 8 aa, Entamoeba histolytica
GDAHRASN

SEQ ID NO: 2621401 - protein, 5 aa, Entamoeba histolytica
GDAKE

SEQ ID NO: 2621402 - protein, 15 aa, Entamoeba histolytica
GDAKTIQQLSGGQKT

SEQ ID NO: 2621403 - protein, 7 aa, Entamoeba histolytica
GDANSNL

SEQ ID NO: 2621404 - protein, 18 aa, Entamoeba histolytica
GDAPENQNPKQELGSSED

SEQ ID NO: 2621405 - protein, 12 aa, Entamoeba histolytica
GDASRLPTSSTC

SEQ ID NO: 2621406 - protein, 7 aa, Entamoeba histolytica
GDAYTGD

SEQ ID NO: 2621407 - protein, 4 aa, Entamoeba histolytica
GDDC

SEQ ID NO: 2621408 - protein, 8 aa, Entamoeba histolytica
GDDDMPAH

SEQ ID NO: 2621409 - protein, 10 aa, Entamoeba histolytica
GDDEDEKAKA

SEQ ID NO: 2621410 - protein, 17 aa, Entamoeba histolytica
GDDGLDPLKVESDKYPI

SEQ ID NO: 2621411 - protein, 5 aa, Entamoeba histolytica
GDDGY

SEQ ID NO: 2621412 - protein, 9 aa, Entamoeba histolytica
GDDHSSRSC

SEQ ID NO: 2621413 - protein, 4 aa, Entamoeba histolytica
GDDI

SEQ ID NO: 2621414 - protein, 40 aa, Entamoeba histolytica
GDDISDDEINEEDSYEGEEEEEEEDSYEVPAQNRVYTLDD

SEQ ID NO: 2621415 - protein, 7 aa, Entamoeba histolytica
GDDMEET

SEQ ID NO: 2621416 - protein, 15 aa, Entamoeba histolytica
GDDNKEEKVTDTKKL

SEQ ID NO: 2621417 - protein, 5 aa, Entamoeba histolytica
GDDNY

SEQ ID NO: 2621418 - protein, 5 aa, Entamoeba histolytica
GDDQF

SEQ ID NO: 2621419 - protein, 5 aa, Entamoeba histolytica
GDDSI

SEQ ID NO: 2621420 - protein, 7 aa, Entamoeba histolytica
GDDSKLR

SEQ ID NO: 2621421 - protein, 9 aa, Entamoeba histolytica
GDDSNTNAA

SEQ ID NO: 2621422 - protein, 5 aa, Entamoeba histolytica
GDEAM

SEQ ID NO: 2621423 - protein, 9 aa, Entamoeba histolytica
GDEAQSKRG

SEQ ID NO: 2621424 - protein, 4 aa, Entamoeba histolytica
GDED

SEQ ID NO: 2621425 - protein, 4 aa, Entamoeba histolytica
GDEE

SEQ ID NO: 2621426 - protein, 21 aa, Entamoeba histolytica
GDEEELKKGKRLKKADMPEEI

SEQ ID NO: 2621427 - protein, 8 aa, Entamoeba histolytica
GDEEKTKS

SEQ ID NO: 2621428 - protein, 8 aa, Entamoeba histolytica
GDEERREI

SEQ ID NO: 2621429 - protein, 19 aa, Entamoeba histolytica
GDEESLGRKKKKEAKIKED

SEQ ID NO: 2621430 - protein, 29 aa, Entamoeba histolytica
GDEETPKKVNKRTKRKYTRRIKKENEYDK

SEQ ID NO: 2621431 - protein, 18 aa, Entamoeba histolytica
GDEFKNTRGTVDSYVSNG

SEQ ID NO: 2621432 - protein, 8 aa, Entamoeba histolytica
GDEGQDIP

SEQ ID NO: 2621433 - protein, 13 aa, Entamoeba histolytica
GDEIEKERPKEYQ

SEQ ID NO: 2621434 - protein, 8 aa, Entamoeba histolytica
GDEINLDG

SEQ ID NO: 2621435 - protein, 10 aa, Entamoeba histolytica
GDEKQRDYNQ

SEQ ID NO: 2621436 - protein, 8 aa, Entamoeba histolytica
GDELTGEN

SEQ ID NO: 2621437 - protein, 4 aa, Entamoeba histolytica
GDEM

SEQ ID NO: 2621438 - protein, 8 aa, Entamoeba histolytica
GDEMNEEE

SEQ ID NO: 2621439 - protein, 9 aa, Entamoeba histolytica
GDENDDLEI

SEQ ID NO: 2621440 - protein, 7 aa, Entamoeba histolytica
GDENDEK

SEQ ID NO: 2621441 - protein, 6 aa, Entamoeba histolytica
GDENEG

SEQ ID NO: 2621442 - protein, 5 aa, Entamoeba histolytica
GDENI

SEQ ID NO: 2621443 - protein, 7 aa, Entamoeba histolytica
GDENTTG

SEQ ID NO: 2621444 - protein, 5 aa, Entamoeba histolytica
GDENY

SEQ ID NO: 2621445 - protein, 7 aa, Entamoeba histolytica
GDENYEI

SEQ ID NO: 2621446 - protein, 6 aa, Entamoeba histolytica
GDEPTR

SEQ ID NO: 2621447 - protein, 5 aa, Entamoeba histolytica
GDEQE

SEQ ID NO: 2621448 - protein, 8 aa, Entamoeba histolytica
GDERRSRE

SEQ ID NO: 2621449 - protein, 5 aa, Entamoeba histolytica
GDESC

SEQ ID NO: 2621450 - protein, 5 aa, Entamoeba histolytica
GDESD

SEQ ID NO: 2621451 - protein, 9 aa, Entamoeba histolytica
GDESEMSNN

SEQ ID NO: 2621452 - protein, 7 aa, Entamoeba histolytica
GDESGRI

SEQ ID NO: 2621453 - protein, 8 aa, Entamoeba histolytica
GDESQWKE

SEQ ID NO: 2621454 - protein, 7 aa, Entamoeba histolytica
GDESSDY

SEQ ID NO: 2621455 - protein, 16 aa, Entamoeba histolytica
GDETTTESDVQDDSTI

SEQ ID NO: 2621456 - protein, 6 aa, Entamoeba histolytica
GDEVVK

SEQ ID NO: 2621457 - protein, 6 aa, Entamoeba histolytica
GDFERK

SEQ ID NO: 2621458 - protein, 9 aa, Entamoeba histolytica
GDFKPSPGF

SEQ ID NO: 2621459 - protein, 10 aa, Entamoeba histolytica
GDFPDDGYDY

SEQ ID NO: 2621460 - protein, 5 aa, Entamoeba histolytica
GDFPP

SEQ ID NO: 2621461 - protein, 63 aa, Entamoeba histolytica
GDGEEGTGKKHRGPWGSDASSSDEDESEEEESEDENQDENEEKEEENTEEQQKEKAVTNEDDF

SEQ ID NO: 2621462 - protein, 9 aa, Entamoeba histolytica
GDGETGKTA

SEQ ID NO: 2621463 - protein, 7 aa, Entamoeba histolytica
GDGFPGL

SEQ ID NO: 2621464 - protein, 4 aa, Entamoeba histolytica
GDGG

SEQ ID NO: 2621465 - protein, 9 aa, Entamoeba histolytica
GDGGHSEDV

SEQ ID NO: 2621466 - protein, 17 aa, Entamoeba histolytica
GDGGPIKPATQTAKGKP

SEQ ID NO: 2621467 - protein, 9 aa, Entamoeba histolytica
GDGGTGKTT

SEQ ID NO: 2621468 - protein, 5 aa, Entamoeba histolytica
GDGIL

SEQ ID NO: 2621469 - protein, 8 aa, Entamoeba histolytica
GDGKGARP

SEQ ID NO: 2621470 - protein, 10 aa, Entamoeba histolytica
GDGKQGADKC

SEQ ID NO: 2621471 - protein, 7 aa, Entamoeba histolytica
GDGMIGG

SEQ ID NO: 2621472 - protein, 8 aa, Entamoeba histolytica
GDGMPTYE

SEQ ID NO: 2621473 - protein, 8 aa, Entamoeba histolytica
GDGNDTID

SEQ ID NO: 2621474 - protein, 9 aa, Entamoeba histolytica
GDGNPIGEE

SEQ ID NO: 2621475 - protein, 6 aa, Entamoeba histolytica
GDGPFD

SEQ ID NO: 2621476 - protein, 8 aa, Entamoeba histolytica
GDGPFDKM

SEQ ID NO: 2621477 - protein, 5 aa, Entamoeba histolytica
GDGPK

SEQ ID NO: 2621478 - protein, 10 aa, Entamoeba histolytica
GDGQDSITKT

SEQ ID NO: 2621479 - protein, 7 aa, Entamoeba histolytica
GDGQYSK

SEQ ID NO: 2621480 - protein, 8 aa, Entamoeba histolytica
GDGREEHP

SEQ ID NO: 2621481 - protein, 4 aa, Entamoeba histolytica
GDGS

SEQ ID NO: 2621482 - protein, 6 aa, Entamoeba histolytica
GDGSTI

SEQ ID NO: 2621483 - protein, 16 aa, Entamoeba histolytica
GDGTLRGANAINKELR

SEQ ID NO: 2621484 - protein, 5 aa, Entamoeba histolytica
GDGTM

SEQ ID NO: 2621485 - protein, 8 aa, Entamoeba histolytica
GDGTQRNI

SEQ ID NO: 2621486 - protein, 6 aa, Entamoeba histolytica
GDGTSF

SEQ ID NO: 2621487 - protein, 5 aa, Entamoeba histolytica
GDGTV

SEQ ID NO: 2621488 - protein, 4 aa, Entamoeba histolytica
GDGV

SEQ ID NO: 2621489 - protein, 5 aa, Entamoeba histolytica
GDHCG

SEQ ID NO: 2621490 - protein, 8 aa, Entamoeba histolytica
GDHVSGGD

SEQ ID NO: 2621491 - protein, 14 aa, Entamoeba histolytica
GDIDTTPVKSTDFP

SEQ ID NO: 2621492 - protein, 4 aa, Entamoeba histolytica
GDIH

SEQ ID NO: 2621493 - protein, 5 aa, Entamoeba histolytica
GDIHT

SEQ ID NO: 2621494 - protein, 4 aa, Entamoeba histolytica
GDIK

SEQ ID NO: 2621495 - protein, 7 aa, Entamoeba histolytica
GDIQNSP

SEQ ID NO: 2621496 - protein, 4 aa, Entamoeba histolytica
GDIS

SEQ ID NO: 2621497 - protein, 16 aa, Entamoeba histolytica
GDISSALNDADKHGLK

SEQ ID NO: 2621498 - protein, 4 aa, Entamoeba histolytica
GDKC

SEQ ID NO: 2621499 - protein, 7 aa, Entamoeba histolytica
GDKDDNI

SEQ ID NO: 2621500 - protein, 6 aa, Entamoeba histolytica
GDKEAI

SEQ ID NO: 2621501 - protein, 10 aa, Entamoeba histolytica
GDKETNDMDD

SEQ ID NO: 2621502 - protein, 12 aa, Entamoeba histolytica
GDKGDEKRHIPP

SEQ ID NO: 2621503 - protein, 6 aa, Entamoeba histolytica
GDKGTV

SEQ ID NO: 2621504 - protein, 14 aa, Entamoeba histolytica
GDKIESSQITYGNR

SEQ ID NO: 2621505 - protein, 7 aa, Entamoeba histolytica
GDKIGYV

SEQ ID NO: 2621506 - protein, 10 aa, Entamoeba histolytica
GDKKEEHEGI

SEQ ID NO: 2621507 - protein, 11 aa, Entamoeba histolytica
GDKKNSKKIKE

SEQ ID NO: 2621508 - protein, 14 aa, Entamoeba histolytica
GDKLVGSKNPRYLQ

SEQ ID NO: 2621509 - protein, 5 aa, Entamoeba histolytica
GDKNT

SEQ ID NO: 2621510 - protein, 7 aa, Entamoeba histolytica
GDKPIRS

SEQ ID NO: 2621511 - protein, 12 aa, Entamoeba histolytica
GDKRENAKERKK

SEQ ID NO: 2621512 - protein, 7 aa, Entamoeba histolytica
GDKRSEK

SEQ ID NO: 2621513 - protein, 6 aa, Entamoeba histolytica
GDKSLG

SEQ ID NO: 2621514 - protein, 8 aa, Entamoeba histolytica
GDKTKRDY

SEQ ID NO: 2621515 - protein, 7 aa, Entamoeba histolytica
GDKTPAI

SEQ ID NO: 2621516 - protein, 10 aa, Entamoeba histolytica
GDKTPQGNMP

SEQ ID NO: 2621517 - protein, 7 aa, Entamoeba histolytica
GDKTPVA

SEQ ID NO: 2621518 - protein, 7 aa, Entamoeba histolytica
GDKVKGR

SEQ ID NO: 2621519 - protein, 6 aa, Entamoeba histolytica
GDKYKG

SEQ ID NO: 2621520 - protein, 5 aa, Entamoeba histolytica
GDKYN

SEQ ID NO: 2621521 - protein, 29 aa, Entamoeba histolytica
GDLDNDFKEEKQKRKKAPKPIKTRKGDSR

SEQ ID NO: 2621522 - protein, 9 aa, Entamoeba histolytica
GDLKPTNGI

SEQ ID NO: 2621523 - protein, 7 aa, Entamoeba histolytica
GDLKQTT

SEQ ID NO: 2621524 - protein, 11 aa, Entamoeba histolytica
GDLNGKVANKT

SEQ ID NO: 2621525 - protein, 11 aa, Entamoeba histolytica
GDLNSKEDNLT

SEQ ID NO: 2621526 - protein, 21 aa, Entamoeba histolytica
GDLYDPSGILTGGSKPKSSGF

SEQ ID NO: 2621527 - protein, 9 aa, Entamoeba histolytica
GDLYTDDSP

SEQ ID NO: 2621528 - protein, 15 aa, Entamoeba histolytica
GDMESNGKRITKDGK

SEQ ID NO: 2621529 - protein, 11 aa, Entamoeba histolytica
GDMPLPDTSET

SEQ ID NO: 2621530 - protein, 9 aa, Entamoeba histolytica
GDNAQLHEP

SEQ ID NO: 2621531 - protein, 8 aa, Entamoeba histolytica
GDNDKRKT

SEQ ID NO: 2621532 - protein, 6 aa, Entamoeba histolytica
GDNEAR

SEQ ID NO: 2621533 - protein, 6 aa, Entamoeba histolytica
GDNGKW

SEQ ID NO: 2621534 - protein, 5 aa, Entamoeba histolytica
GDNGN

SEQ ID NO: 2621535 - protein, 7 aa, Entamoeba histolytica
GDNGNKW

SEQ ID NO: 2621536 - protein, 8 aa, Entamoeba histolytica
GDNIDSGL

SEQ ID NO: 2621537 - protein, 4 aa, Entamoeba histolytica
GDNK

SEQ ID NO: 2621538 - protein, 18 aa, Entamoeba histolytica
GDNKEKKTQEEKEENKIS

SEQ ID NO: 2621539 - protein, 8 aa, Entamoeba histolytica
GDNMEQKE

SEQ ID NO: 2621540 - protein, 6 aa, Entamoeba histolytica
GDNNLQ

SEQ ID NO: 2621541 - protein, 7 aa, Entamoeba histolytica
GDNSFSQ

SEQ ID NO: 2621542 - protein, 14 aa, Entamoeba histolytica
GDNTSYDINQEEGT

SEQ ID NO: 2621543 - protein, 7 aa, Entamoeba histolytica
GDNYDNS

SEQ ID NO: 2621544 - protein, 9 aa, Entamoeba histolytica
GDNYKKEKS

SEQ ID NO: 2621545 - protein, 13 aa, Entamoeba histolytica
GDPDTPGYIKALL

SEQ ID NO: 2621546 - protein, 10 aa, Entamoeba histolytica
GDPEKFPTAS

SEQ ID NO: 2621547 - protein, 14 aa, Entamoeba histolytica
GDPFENKSQIQTIN

SEQ ID NO: 2621548 - protein, 12 aa, Entamoeba histolytica
GDPGENSNELNG

SEQ ID NO: 2621549 - protein, 4 aa, Entamoeba histolytica
GDPI

SEQ ID NO: 2621550 - protein, 4 aa, Entamoeba histolytica
GDPL

SEQ ID NO: 2621551 - protein, 5 aa, Entamoeba histolytica
GDPMN

SEQ ID NO: 2621552 - protein, 5 aa, Entamoeba histolytica
GDPRE

SEQ ID NO: 2621553 - protein, 7 aa, Entamoeba histolytica
GDPRTLP

SEQ ID NO: 2621554 - protein, 11 aa, Entamoeba histolytica
GDPSSGKTSSI

SEQ ID NO: 2621555 - protein, 7 aa, Entamoeba histolytica
GDQCATT

SEQ ID NO: 2621556 - protein, 7 aa, Entamoeba histolytica
GDQETRF

SEQ ID NO: 2621557 - protein, 4 aa, Entamoeba histolytica
GDQK

SEQ ID NO: 2621558 - protein, 6 aa, Entamoeba histolytica
GDQSTS

SEQ ID NO: 2621559 - protein, 9 aa, Entamoeba histolytica
GDRGTGKTC

SEQ ID NO: 2621560 - protein, 5 aa, Entamoeba histolytica
GDRIA

SEQ ID NO: 2621561 - protein, 30 aa, Entamoeba histolytica
GDRKTTKKEEEELTRRPPPPPQVPLQEDDL

SEQ ID NO: 2621562 - protein, 4 aa, Entamoeba histolytica
GDRL

SEQ ID NO: 2621563 - protein, 5 aa, Entamoeba histolytica
GDRLK

SEQ ID NO: 2621564 - protein, 16 aa, Entamoeba histolytica
GDRSIQDDISDQDTVS

SEQ ID NO: 2621565 - protein, 16 aa, Entamoeba histolytica
GDRSLHPPMTSIPTTK

SEQ ID NO: 2621566 - protein, 5 aa, Entamoeba histolytica
GDRTA

SEQ ID NO: 2621567 - protein, 15 aa, Entamoeba histolytica
GDRTITAMSEKEDEG

SEQ ID NO: 2621568 - protein, 10 aa, Entamoeba histolytica
GDRTTNDPYH

SEQ ID NO: 2621569 - protein, 4 aa, Entamoeba histolytica
GDSD

SEQ ID NO: 2621570 - protein, 8 aa, Entamoeba histolytica
GDSFSDKG

SEQ ID NO: 2621571 - protein, 11 aa, Entamoeba histolytica
GDSGLTGFPPE

SEQ ID NO: 2621572 - protein, 9 aa, Entamoeba histolytica
GDSGVGKTG

SEQ ID NO: 2621573 - protein, 17 aa, Entamoeba histolytica
GDSIPQSQVEQWKQKDN

SEQ ID NO: 2621574 - protein, 6 aa, Entamoeba histolytica
GDSKES

SEQ ID NO: 2621575 - protein, 4 aa, Entamoeba histolytica
GDSL

SEQ ID NO: 2621576 - protein, 9 aa, Entamoeba histolytica
GDSNEVNED

SEQ ID NO: 2621577 - protein, 6 aa, Entamoeba histolytica
GDSNKI

SEQ ID NO: 2621578 - protein, 22 aa, Entamoeba histolytica
GDSPNPETREVVGENGKGERND

SEQ ID NO: 2621579 - protein, 11 aa, Entamoeba histolytica
GDSPSKTFSDT

SEQ ID NO: 2621580 - protein, 9 aa, Entamoeba histolytica
GDSQEEASE

SEQ ID NO: 2621581 - protein, 7 aa, Entamoeba histolytica
GDSSKIP

SEQ ID NO: 2621582 - protein, 11 aa, Entamoeba histolytica
GDSSLDKEHKP

SEQ ID NO: 2621583 - protein, 19 aa, Entamoeba histolytica
GDSTEINKQQTGTNDSGNV

SEQ ID NO: 2621584 - protein, 7 aa, Entamoeba histolytica
GDSTKYP

SEQ ID NO: 2621585 - protein, 10 aa, Entamoeba histolytica
GDSTNGISSA

SEQ ID NO: 2621586 - protein, 12 aa, Entamoeba histolytica
GDSTPTASFTLP

SEQ ID NO: 2621587 - protein, 5 aa, Entamoeba histolytica
GDSVT

SEQ ID NO: 2621588 - protein, 12 aa, Entamoeba histolytica
GDTEFTKKKAEK

SEQ ID NO: 2621589 - protein, 11 aa, Entamoeba histolytica
GDTGCGKSTQV

SEQ ID NO: 2621590 - protein, 9 aa, Entamoeba histolytica
GDTGEISAE

SEQ ID NO: 2621591 - protein, 5 aa, Entamoeba histolytica
GDTIA

SEQ ID NO: 2621592 - protein, 7 aa, Entamoeba histolytica
GDTIAEN

SEQ ID NO: 2621593 - protein, 6 aa, Entamoeba histolytica
GDTKDG

SEQ ID NO: 2621594 - protein, 10 aa, Entamoeba histolytica
GDTLPSEDER

SEQ ID NO: 2621595 - protein, 10 aa, Entamoeba histolytica
GDTLTEEEAN

SEQ ID NO: 2621596 - protein, 4 aa, Entamoeba histolytica
GDTN

SEQ ID NO: 2621597 - protein, 4 aa, Entamoeba histolytica
GDTP

SEQ ID NO: 2621598 - protein, 5 aa, Entamoeba histolytica
GDTPD

SEQ ID NO: 2621599 - protein, 6 aa, Entamoeba histolytica
GDTPFD

SEQ ID NO: 2621600 - protein, 7 aa, Entamoeba histolytica
GDTSDID

SEQ ID NO: 2621601 - protein, 6 aa, Entamoeba histolytica
GDTTRQ

SEQ ID NO: 2621602 - protein, 21 aa, Entamoeba histolytica
GDTTTIKESNTIEQPKEKSLS

SEQ ID NO: 2621603 - protein, 5 aa, Entamoeba histolytica
GDTTY

SEQ ID NO: 2621604 - protein, 24 aa, Entamoeba histolytica
GDVDRKQTLLTSKRASTNRDAAQQ

SEQ ID NO: 2621605 - protein, 5 aa, Entamoeba histolytica
GDVDT

SEQ ID NO: 2621606 - protein, 4 aa, Entamoeba histolytica
GDVE

SEQ ID NO: 2621607 - protein, 12 aa, Entamoeba histolytica
GDVKSKNSNGIT

SEQ ID NO: 2621608 - protein, 4 aa, Entamoeba histolytica
GDVN

SEQ ID NO: 2621609 - protein, 57 aa, Entamoeba histolytica
  misc_feature (13)..(46): Xaa can be any naturally occurring amino acid
GDVNAMEEFITFXXXXXXXXXXXXXXXXXXXXXXXXXXXXXXXXXXVLQTSQIRSKR

SEQ ID NO: 2621610 - protein, 5 aa, Entamoeba histolytica
GDVNN

SEQ ID NO: 2621611 - protein, 12 aa, Entamoeba histolytica
GDWTDEERNEFG

SEQ ID NO: 2621612 - protein, 4 aa, Entamoeba histolytica
GDYD

SEQ ID NO: 2621613 - protein, 14 aa, Entamoeba histolytica
GDYDNQEDDGLFSS

SEQ ID NO: 2621614 - protein, 8 aa, Entamoeba histolytica
GDYGENGN

SEQ ID NO: 2621615 - protein, 4 aa, Entamoeba histolytica
GDYQ

SEQ ID NO: 2621616 - protein, 12 aa, Entamoeba histolytica
GDYQTNQEEQKK

SEQ ID NO: 2621617 - protein, 6 aa, Entamoeba histolytica
GDYSGA

SEQ ID NO: 2621618 - protein, 5 aa, Entamoeba histolytica
GDYTP

SEQ ID NO: 2621619 - protein, 12 aa, Entamoeba histolytica
GEAEIEEGKKTY

SEQ ID NO: 2621620 - protein, 32 aa, Entamoeba histolytica
GEAEKGYNEERKRAREDREKKREIGEKERELK

SEQ ID NO: 2621621 - protein, 6 aa, Entamoeba histolytica
GEAERA

SEQ ID NO: 2621622 - protein, 9 aa, Entamoeba histolytica
GEAGAGKSQ

SEQ ID NO: 2621623 - protein, 11 aa, Entamoeba histolytica
GEAGGSSDETE

SEQ ID NO: 2621624 - protein, 12 aa, Entamoeba histolytica
GEAGGSSDETEV

SEQ ID NO: 2621625 - protein, 9 aa, Entamoeba histolytica
GEAKPGETR

SEQ ID NO: 2621626 - protein, 13 aa, Entamoeba histolytica
GEAKSIEDGNEDL

SEQ ID NO: 2621627 - protein, 9 aa, Entamoeba histolytica
GEAKSSEVR

SEQ ID NO: 2621628 - protein, 6 aa, Entamoeba histolytica
GEANGA

SEQ ID NO: 2621629 - protein, 11 aa, Entamoeba histolytica
GEAPKQGRAHT

SEQ ID NO: 2621630 - protein, 6 aa, Entamoeba histolytica
GEARSF

SEQ ID NO: 2621631 - protein, 10 aa, Entamoeba histolytica
GEASLEITSS

SEQ ID NO: 2621632 - protein, 8 aa, Entamoeba histolytica
GEAYSELG

SEQ ID NO: 2621633 - protein, 12 aa, Entamoeba histolytica
GECDYDEANERA

SEQ ID NO: 2621634 - protein, 7 aa, Entamoeba histolytica
GECGKRG

SEQ ID NO: 2621635 - protein, 6 aa, Entamoeba histolytica
GECQGM

SEQ ID NO: 2621636 - protein, 20 aa, Entamoeba histolytica
GEDAPTKQRSFSVGIKQKQT

SEQ ID NO: 2621637 - protein, 4 aa, Entamoeba histolytica
GEDC

SEQ ID NO: 2621638 - protein, 5 aa, Entamoeba histolytica
GEDDF

SEQ ID NO: 2621639 - protein, 9 aa, Entamoeba histolytica
GEDEDIKST

SEQ ID NO: 2621640 - protein, 4 aa, Entamoeba histolytica
GEDG

SEQ ID NO: 2621641 - protein, 5 aa, Entamoeba histolytica
GEDGK

SEQ ID NO: 2621642 - protein, 10 aa, Entamoeba histolytica
GEDGQGEGGL

SEQ ID NO: 2621643 - protein, 5 aa, Entamoeba histolytica
GEDIG

SEQ ID NO: 2621644 - protein, 7 aa, Entamoeba histolytica
GEDKKEN

SEQ ID NO: 2621645 - protein, 4 aa, Entamoeba histolytica
GEDL

SEQ ID NO: 2621646 - protein, 22 aa, Entamoeba histolytica
GEDLPNRSIPELPKEHTKTSVA

SEQ ID NO: 2621647 - protein, 7 aa, Entamoeba histolytica
GEDLSKR

SEQ ID NO: 2621648 - protein, 48 aa, Entamoeba histolytica
GEDNDQSHEEDNDQSHEEDNEKKNNTETNQPEKTSQTKVIETTRKPPH

SEQ ID NO: 2621649 - protein, 19 aa, Entamoeba histolytica
GEDNEPDKLNELNTLLKDM

SEQ ID NO: 2621650 - protein, 13 aa, Entamoeba histolytica
GEDNIKDNENYST

SEQ ID NO: 2621651 - protein, 9 aa, Entamoeba histolytica
GEDNNDDLD

SEQ ID NO: 2621652 - protein, 4 aa, Entamoeba histolytica
GEDQ

SEQ ID NO: 2621653 - protein, 5 aa, Entamoeba histolytica
GEDQE

SEQ ID NO: 2621654 - protein, 6 aa, Entamoeba histolytica
GEDQQI

SEQ ID NO: 2621655 - protein, 6 aa, Entamoeba histolytica
GEDSST

SEQ ID NO: 2621656 - protein, 6 aa, Entamoeba histolytica
GEDTLN

SEQ ID NO: 2621657 - protein, 12 aa, Entamoeba histolytica
GEDTSKLPKSED

SEQ ID NO: 2621658 - protein, 7 aa, Entamoeba histolytica
GEDTTQY

SEQ ID NO: 2621659 - protein, 4 aa, Entamoeba histolytica
GEDV

SEQ ID NO: 2621660 - protein, 18 aa, Entamoeba histolytica
GEEAGPSKIEKAKEKGIP

SEQ ID NO: 2621661 - protein, 6 aa, Entamoeba histolytica
GEEAMR

SEQ ID NO: 2621662 - protein, 7 aa, Entamoeba histolytica
GEEASKH

SEQ ID NO: 2621663 - protein, 6 aa, Entamoeba histolytica
GEEATG

SEQ ID NO: 2621664 - protein, 7 aa, Entamoeba histolytica
GEEDETL

SEQ ID NO: 2621665 - protein, 8 aa, Entamoeba histolytica
GEEDGEYW

SEQ ID NO: 2621666 - protein, 9 aa, Entamoeba histolytica
GEEDIGGEG

SEQ ID NO: 2621667 - protein, 13 aa, Entamoeba histolytica
GEEDSESNKDSTY

SEQ ID NO: 2621668 - protein, 7 aa, Entamoeba histolytica
GEEEDIE

SEQ ID NO: 2621669 - protein, 7 aa, Entamoeba histolytica
GEEEEEK

SEQ ID NO: 2621670 - protein, 34 aa, Entamoeba histolytica
GEEENKNTFASNIPPEQNNEKKYSASDKRKDIAD

SEQ ID NO: 2621671 - protein, 5 aa, Entamoeba histolytica
GEEFP

SEQ ID NO: 2621672 - protein, 9 aa, Entamoeba histolytica
GEEGRISSD

SEQ ID NO: 2621673 - protein, 4 aa, Entamoeba histolytica
GEEI

SEQ ID NO: 2621674 - protein, 9 aa, Entamoeba histolytica
GEEIDCSKE

SEQ ID NO: 2621675 - protein, 14 aa, Entamoeba histolytica
GEEIEEKEMKNEEK

SEQ ID NO: 2621676 - protein, 9 aa, Entamoeba histolytica
GEEIGERET

SEQ ID NO: 2621677 - protein, 10 aa, Entamoeba histolytica
GEEIKEPMTN

SEQ ID NO: 2621678 - protein, 13 aa, Entamoeba histolytica
GEEINAKVSSKKF

SEQ ID NO: 2621679 - protein, 7 aa, Entamoeba histolytica
GEEIPNV

SEQ ID NO: 2621680 - protein, 7 aa, Entamoeba histolytica
GEEKGNV

SEQ ID NO: 2621681 - protein, 29 aa, Entamoeba histolytica
GEEKKEDDSSTPKKSTFQAGKKHEGSRAH

SEQ ID NO: 2621682 - protein, 10 aa, Entamoeba histolytica
GEEKKLKRER

SEQ ID NO: 2621683 - protein, 10 aa, Entamoeba histolytica
GEELGESERS

SEQ ID NO: 2621684 - protein, 9 aa, Entamoeba histolytica
GEELTGPEY

SEQ ID NO: 2621685 - protein, 6 aa, Entamoeba histolytica
GEEMNG

SEQ ID NO: 2621686 - protein, 10 aa, Entamoeba histolytica
GEENNNGGIC

SEQ ID NO: 2621687 - protein, 15 aa, Entamoeba histolytica
GEENYPGNRKRLYEG

SEQ ID NO: 2621688 - protein, 8 aa, Entamoeba histolytica
GEEPHQGL

SEQ ID NO: 2621689 - protein, 6 aa, Entamoeba histolytica
GEEPKV

SEQ ID NO: 2621690 - protein, 5 aa, Entamoeba histolytica
GEEPL

SEQ ID NO: 2621691 - protein, 6 aa, Entamoeba histolytica
GEEPQV

SEQ ID NO: 2621692 - protein, 4 aa, Entamoeba histolytica
GEEQ

SEQ ID NO: 2621693 - protein, 6 aa, Entamoeba histolytica
GEEQKF

SEQ ID NO: 2621694 - protein, 6 aa, Entamoeba histolytica
GEEQLE

SEQ ID NO: 2621695 - protein, 15 aa, Entamoeba histolytica
GEEQLEKGDSTYVQK

SEQ ID NO: 2621696 - protein, 7 aa, Entamoeba histolytica
GEEQLRE

SEQ ID NO: 2621697 - protein, 9 aa, Entamoeba histolytica
GEEQQEKPL

SEQ ID NO: 2621698 - protein, 5 aa, Entamoeba histolytica
GEERI

SEQ ID NO: 2621699 - protein, 6 aa, Entamoeba histolytica
GEESEK

SEQ ID NO: 2621700 - protein, 14 aa, Entamoeba histolytica
GEESKRSSERSSEK

SEQ ID NO: 2621701 - protein, 6 aa, Entamoeba histolytica
GEESPF

SEQ ID NO: 2621702 - protein, 15 aa, Entamoeba histolytica
GEETDDTHKELTDDP

SEQ ID NO: 2621703 - protein, 8 aa, Entamoeba histolytica
GEETEAAG

SEQ ID NO: 2621704 - protein, 11 aa, Entamoeba histolytica
GEETEETKKTA

SEQ ID NO: 2621705 - protein, 13 aa, Entamoeba histolytica
GEEVSEIEEEERN

SEQ ID NO: 2621706 - protein, 6 aa, Entamoeba histolytica
GEEWAE

SEQ ID NO: 2621707 - protein, 4 aa, Entamoeba histolytica
GEEY

SEQ ID NO: 2621708 - protein, 6 aa, Entamoeba histolytica
GEFEEP

SEQ ID NO: 2621709 - protein, 6 aa, Entamoeba histolytica
GEFNEA

SEQ ID NO: 2621710 - protein, 6 aa, Entamoeba histolytica
GEFNND

SEQ ID NO: 2621711 - protein, 4 aa, Entamoeba histolytica
GEFT

SEQ ID NO: 2621712 - protein, 6 aa, Entamoeba histolytica
GEFTET

SEQ ID NO: 2621713 - protein, 6 aa, Entamoeba histolytica
GEGDEQ

SEQ ID NO: 2621714 - protein, 6 aa, Entamoeba histolytica
GEGDMK

SEQ ID NO: 2621715 - protein, 7 aa, Entamoeba histolytica
GEGDRSD

SEQ ID NO: 2621716 - protein, 4 aa, Entamoeba histolytica
GEGE

SEQ ID NO: 2621717 - protein, 11 aa, Entamoeba histolytica
GEGEKYTKEAS

SEQ ID NO: 2621718 - protein, 5 aa, Entamoeba histolytica
GEGEM

SEQ ID NO: 2621719 - protein, 6 aa, Entamoeba histolytica
GEGGFG

SEQ ID NO: 2621720 - protein, 4 aa, Entamoeba histolytica
GEGK

SEQ ID NO: 2621721 - protein, 14 aa, Entamoeba histolytica
GEGMTREDHSEVSN

SEQ ID NO: 2621722 - protein, 4 aa, Entamoeba histolytica
GEGN

SEQ ID NO: 2621723 - protein, 9 aa, Entamoeba histolytica
GEGNTEEEL

SEQ ID NO: 2621724 - protein, 5 aa, Entamoeba histolytica
GEGPR

SEQ ID NO: 2621725 - protein, 4 aa, Entamoeba histolytica
GEGQ

SEQ ID NO: 2621726 - protein, 14 aa, Entamoeba histolytica
GEGQIEDNNQNKQK

SEQ ID NO: 2621727 - protein, 8 aa, Entamoeba histolytica
GEGQTSQK

SEQ ID NO: 2621728 - protein, 7 aa, Entamoeba histolytica
GEGRLED

SEQ ID NO: 2621729 - protein, 5 aa, Entamoeba histolytica
GEGSR

SEQ ID NO: 2621730 - protein, 4 aa, Entamoeba histolytica
GEGV

SEQ ID NO: 2621731 - protein, 5 aa, Entamoeba histolytica
GEGVF

SEQ ID NO: 2621732 - protein, 8 aa, Entamoeba histolytica
GEHAEFDD

SEQ ID NO: 2621733 - protein, 10 aa, Entamoeba histolytica
GEHDETDPDH

SEQ ID NO: 2621734 - protein, 8 aa, Entamoeba histolytica
GEHGSGKT

SEQ ID NO: 2621735 - protein, 5 aa, Entamoeba histolytica
GEHPC

SEQ ID NO: 2621736 - protein, 5 aa, Entamoeba histolytica
GEHPY

SEQ ID NO: 2621737 - protein, 6 aa, Entamoeba histolytica
GEIIEN

SEQ ID NO: 2621738 - protein, 11 aa, Entamoeba histolytica
GEIIGSSQQQT

SEQ ID NO: 2621739 - protein, 4 aa, Entamoeba histolytica
GEIK

SEQ ID NO: 2621740 - protein, 14 aa, Entamoeba histolytica
GEIKERIETSKITN

SEQ ID NO: 2621741 - protein, 7 aa, Entamoeba histolytica
GEIPEKG

SEQ ID NO: 2621742 - protein, 11 aa, Entamoeba histolytica
GEIPNTRPPLP

SEQ ID NO: 2621743 - protein, 20 aa, Entamoeba histolytica
GEIQFSSDERKQQVEDKKKR

SEQ ID NO: 2621744 - protein, 14 aa, Entamoeba histolytica
GEIQKGEKERKVQL

SEQ ID NO: 2621745 - protein, 17 aa, Entamoeba histolytica
GEIQNSNYSISYGKPAI

SEQ ID NO: 2621746 - protein, 13 aa, Entamoeba histolytica
GEIRQEGRQEIKE

SEQ ID NO: 2621747 - protein, 8 aa, Entamoeba histolytica
GEISNNEK

SEQ ID NO: 2621748 - protein, 13 aa, Entamoeba histolytica
GEITDKEVEEKEI

SEQ ID NO: 2621749 - protein, 8 aa, Entamoeba histolytica
GEITLPST

SEQ ID NO: 2621750 - protein, 9 aa, Entamoeba histolytica
GEITNEDKD

SEQ ID NO: 2621751 - protein, 20 aa, Entamoeba histolytica
GEIVAKGRNHTKEFQDGTQH

SEQ ID NO: 2621752 - protein, 12 aa, Entamoeba histolytica
GEIVGREKEYEE

SEQ ID NO: 2621753 - protein, 4 aa, Entamoeba histolytica
GEKA

SEQ ID NO: 2621754 - protein, 5 aa, Entamoeba histolytica
GEKDM

SEQ ID NO: 2621755 - protein, 7 aa, Entamoeba histolytica
GEKDNFK

SEQ ID NO: 2621756 - protein, 16 aa, Entamoeba histolytica
GEKEGKIKSAEDGGDD

SEQ ID NO: 2621757 - protein, 8 aa, Entamoeba histolytica
GEKELNPV

SEQ ID NO: 2621758 - protein, 11 aa, Entamoeba histolytica
GEKEMKKQTPL

SEQ ID NO: 2621759 - protein, 7 aa, Entamoeba histolytica
GEKESCQ

SEQ ID NO: 2621760 - protein, 6 aa, Entamoeba histolytica
GEKESH

SEQ ID NO: 2621761 - protein, 8 aa, Entamoeba histolytica
GEKESKTQ

SEQ ID NO: 2621762 - protein, 4 aa, Entamoeba histolytica
GEKF

SEQ ID NO: 2621763 - protein, 19 aa, Entamoeba histolytica
GEKGIKKEEEIERPIEGEK

SEQ ID NO: 2621764 - protein, 9 aa, Entamoeba histolytica
GEKGNGLTY

SEQ ID NO: 2621765 - protein, 10 aa, Entamoeba histolytica
GEKGSYVYDG

SEQ ID NO: 2621766 - protein, 4 aa, Entamoeba histolytica
GEKI

SEQ ID NO: 2621767 - protein, 5 aa, Entamoeba histolytica
GEKIG

SEQ ID NO: 2621768 - protein, 10 aa, Entamoeba histolytica
GEKKEKEDID

SEQ ID NO: 2621769 - protein, 40 aa, Entamoeba histolytica
GEKKKKKENQDIEKEVKQVKEQKEKKPRAKNQKKEVKEIK

SEQ ID NO: 2621770 - protein, 5 aa, Entamoeba histolytica
GEKKT

SEQ ID NO: 2621771 - protein, 11 aa, Entamoeba histolytica
GEKLVKGKTVG

SEQ ID NO: 2621772 - protein, 8 aa, Entamoeba histolytica
GEKNIQQG

SEQ ID NO: 2621773 - protein, 12 aa, Entamoeba histolytica
GEKNTRKAQKTV

SEQ ID NO: 2621774 - protein, 6 aa, Entamoeba histolytica
GEKPQV

SEQ ID NO: 2621775 - protein, 5 aa, Entamoeba histolytica
GEKQA

SEQ ID NO: 2621776 - protein, 11 aa, Entamoeba histolytica
GEKQKLSDNCD

SEQ ID NO: 2621777 - protein, 7 aa, Entamoeba histolytica
GEKRDDE

SEQ ID NO: 2621778 - protein, 8 aa, Entamoeba histolytica
GEKRDDES

SEQ ID NO: 2621779 - protein, 5 aa, Entamoeba histolytica
GEKSI

SEQ ID NO: 2621780 - protein, 10 aa, Entamoeba histolytica
GEKSKDGIPE

SEQ ID NO: 2621781 - protein, 8 aa, Entamoeba histolytica
GEKSPEPI

SEQ ID NO: 2621782 - protein, 13 aa, Entamoeba histolytica
GEKSSLQNGELSN

SEQ ID NO: 2621783 - protein, 6 aa, Entamoeba histolytica
GEKTKQ

SEQ ID NO: 2621784 - protein, 4 aa, Entamoeba histolytica
GEKV

SEQ ID NO: 2621785 - protein, 8 aa, Entamoeba histolytica
GEKVRRDS

SEQ ID NO: 2621786 - protein, 5 aa, Entamoeba histolytica
GEKVS

SEQ ID NO: 2621787 - protein, 4 aa, Entamoeba histolytica
GELD

SEQ ID NO: 2621788 - protein, 13 aa, Entamoeba histolytica
GELDDEMEEENNV

SEQ ID NO: 2621789 - protein, 4 aa, Entamoeba histolytica
GELE

SEQ ID NO: 2621790 - protein, 5 aa, Entamoeba histolytica
GELEE

SEQ ID NO: 2621791 - protein, 19 aa, Entamoeba histolytica
GELEEVNGKLTKKVNGMER

SEQ ID NO: 2621792 - protein, 6 aa, Entamoeba histolytica
GELEKE

SEQ ID NO: 2621793 - protein, 11 aa, Entamoeba histolytica
GELEKKNGNLP

SEQ ID NO: 2621794 - protein, 15 aa, Entamoeba histolytica
GELESKEQEVNKAGD

SEQ ID NO: 2621795 - protein, 4 aa, Entamoeba histolytica
GELI

SEQ ID NO: 2621796 - protein, 12 aa, Entamoeba histolytica
GELIKKSPGTYQ

SEQ ID NO: 2621797 - protein, 4 aa, Entamoeba histolytica
GELK

SEQ ID NO: 2621798 - protein, 10 aa, Entamoeba histolytica
GELKDKKKQQ

SEQ ID NO: 2621799 - protein, 10 aa, Entamoeba histolytica
GELKKSKKIT

SEQ ID NO: 2621800 - protein, 4 aa, Entamoeba histolytica
GELN

SEQ ID NO: 2621801 - protein, 6 aa, Entamoeba histolytica
GELNKN

SEQ ID NO: 2621802 - protein, 7 aa, Entamoeba histolytica
GELPPEI

SEQ ID NO: 2621803 - protein, 6 aa, Entamoeba histolytica
GELSER

SEQ ID NO: 2621804 - protein, 15 aa, Entamoeba histolytica
GELSPSTLQYWIQKC

SEQ ID NO: 2621805 - protein, 7 aa, Entamoeba histolytica
GELSSKN

SEQ ID NO: 2621806 - protein, 5 aa, Entamoeba histolytica
GELTG

SEQ ID NO: 2621807 - protein, 18 aa, Entamoeba histolytica
GEMDLNKSGGKKTARITG

SEQ ID NO: 2621808 - protein, 4 aa, Entamoeba histolytica
GEME

SEQ ID NO: 2621809 - protein, 4 aa, Entamoeba histolytica
GEMG

SEQ ID NO: 2621810 - protein, 5 aa, Entamoeba histolytica
GEMRE

SEQ ID NO: 2621811 - protein, 11 aa, Entamoeba histolytica
GEMRSREKIEE

SEQ ID NO: 2621812 - protein, 5 aa, Entamoeba histolytica
GEMTR

SEQ ID NO: 2621813 - protein, 11 aa, Entamoeba histolytica
GENDENDDEYI

SEQ ID NO: 2621814 - protein, 6 aa, Entamoeba histolytica
GENEDI

SEQ ID NO: 2621815 - protein, 7 aa, Entamoeba histolytica
GENEREA

SEQ ID NO: 2621816 - protein, 18 aa, Entamoeba histolytica
GENETEVPKKRENKKDID

SEQ ID NO: 2621817 - protein, 6 aa, Entamoeba histolytica
GENEYN

SEQ ID NO: 2621818 - protein, 7 aa, Entamoeba histolytica
GENEYNQ

SEQ ID NO: 2621819 - protein, 4 aa, Entamoeba histolytica
GENF

SEQ ID NO: 2621820 - protein, 7 aa, Entamoeba histolytica
GENGLGQ

SEQ ID NO: 2621821 - protein, 7 aa, Entamoeba histolytica
GENGPSK

SEQ ID NO: 2621822 - protein, 10 aa, Entamoeba histolytica
GENKEETKIV

SEQ ID NO: 2621823 - protein, 7 aa, Entamoeba histolytica
GENNEWK

SEQ ID NO: 2621824 - protein, 12 aa, Entamoeba histolytica
GENNEYKENRIP

SEQ ID NO: 2621825 - protein, 6 aa, Entamoeba histolytica
GENNSV

SEQ ID NO: 2621826 - protein, 5 aa, Entamoeba histolytica
GENPK

SEQ ID NO: 2621827 - protein, 6 aa, Entamoeba histolytica
GENPKY

SEQ ID NO: 2621828 - protein, 4 aa, Entamoeba histolytica
GENQ

SEQ ID NO: 2621829 - protein, 10 aa, Entamoeba histolytica
GENQENENYE

SEQ ID NO: 2621830 - protein, 4 aa, Entamoeba histolytica
GENS

SEQ ID NO: 2621831 - protein, 6 aa, Entamoeba histolytica
GENSLT

SEQ ID NO: 2621832 - protein, 12 aa, Entamoeba histolytica
GENTPIKSTRPI

SEQ ID NO: 2621833 - protein, 7 aa, Entamoeba histolytica
GENVEDV

SEQ ID NO: 2621834 - protein, 37 aa, Entamoeba histolytica
GENVNNPPNQSLINNSENKTQKTTQISETKKKINHSV

SEQ ID NO: 2621835 - protein, 16 aa, Entamoeba histolytica
GEPDASGRAAPVPIPG

SEQ ID NO: 2621836 - protein, 5 aa, Entamoeba histolytica
GEPET

SEQ ID NO: 2621837 - protein, 8 aa, Entamoeba histolytica
GEPFTQKS

SEQ ID NO: 2621838 - protein, 8 aa, Entamoeba histolytica
GEPGCGKS

SEQ ID NO: 2621839 - protein, 5 aa, Entamoeba histolytica
GEPIT

SEQ ID NO: 2621840 - protein, 9 aa, Entamoeba histolytica
GEPKTFQDT

SEQ ID NO: 2621841 - protein, 15 aa, Entamoeba histolytica
GEPLEKEQVELQNGE

SEQ ID NO: 2621842 - protein, 18 aa, Entamoeba histolytica
GEPLEREEEGGPNDIGYD

SEQ ID NO: 2621843 - protein, 30 aa, Entamoeba histolytica
GEPLESPQELDSMKAKSQPLRKSIKRQRDI

SEQ ID NO: 2621844 - protein, 5 aa, Entamoeba histolytica
GEPNR

SEQ ID NO: 2621845 - protein, 8 aa, Entamoeba histolytica
GEPPSVIS

SEQ ID NO: 2621846 - protein, 6 aa, Entamoeba histolytica
GEPYET

SEQ ID NO: 2621847 - protein, 7 aa, Entamoeba histolytica
GEQCTTN

SEQ ID NO: 2621848 - protein, 5 aa, Entamoeba histolytica
GEQEG

SEQ ID NO: 2621849 - protein, 13 aa, Entamoeba histolytica
GEQEQEINGVGYG

SEQ ID NO: 2621850 - protein, 6 aa, Entamoeba histolytica
GEQEQL

SEQ ID NO: 2621851 - protein, 6 aa, Entamoeba histolytica
GEQFGD

SEQ ID NO: 2621852 - protein, 5 aa, Entamoeba histolytica
GEQGM

SEQ ID NO: 2621853 - protein, 6 aa, Entamoeba histolytica
GEQKTE

SEQ ID NO: 2621854 - protein, 16 aa, Entamoeba histolytica
GEQMGGLRSGTIDTPS

SEQ ID NO: 2621855 - protein, 7 aa, Entamoeba histolytica
GEQRQNR

SEQ ID NO: 2621856 - protein, 12 aa, Entamoeba histolytica
GEQSKPIPPVPQ

SEQ ID NO: 2621857 - protein, 4 aa, Entamoeba histolytica
GEQY

SEQ ID NO: 2621858 - protein, 8 aa, Entamoeba histolytica
GERDSTIE

SEQ ID NO: 2621859 - protein, 6 aa, Entamoeba histolytica
GEREKD

SEQ ID NO: 2621860 - protein, 12 aa, Entamoeba histolytica
GERESGADVRTQ

SEQ ID NO: 2621861 - protein, 7 aa, Entamoeba histolytica
GERGNEM

SEQ ID NO: 2621862 - protein, 9 aa, Entamoeba histolytica
GERKPQQIN

SEQ ID NO: 2621863 - protein, 6 aa, Entamoeba histolytica
GERKRN

SEQ ID NO: 2621864 - protein, 4 aa, Entamoeba histolytica
GERM

SEQ ID NO: 2621865 - protein, 4 aa, Entamoeba histolytica
GERP

SEQ ID NO: 2621866 - protein, 4 aa, Entamoeba histolytica
GERR

SEQ ID NO: 2621867 - protein, 4 aa, Entamoeba histolytica
GERT

SEQ ID NO: 2621868 - protein, 6 aa, Entamoeba histolytica
GERTNH

SEQ ID NO: 2621869 - protein, 26 aa, Entamoeba histolytica
GERVKSDDPDKEEDAENKARSNAVGN

SEQ ID NO: 2621870 - protein, 7 aa, Entamoeba histolytica
GESAEEC

SEQ ID NO: 2621871 - protein, 19 aa, Entamoeba histolytica
GESDDKPNNDKINTTSSND

SEQ ID NO: 2621872 - protein, 16 aa, Entamoeba histolytica
GESDESGRAAPVPIPG

SEQ ID NO: 2621873 - protein, 10 aa, Entamoeba histolytica
GESDQAPNII

SEQ ID NO: 2621874 - protein, 6 aa, Entamoeba histolytica
GESEAN

SEQ ID NO: 2621875 - protein, 5 aa, Entamoeba histolytica
GESEK

SEQ ID NO: 2621876 - protein, 8 aa, Entamoeba histolytica
GESEKQQW

SEQ ID NO: 2621877 - protein, 6 aa, Entamoeba histolytica
GESETT

SEQ ID NO: 2621878 - protein, 4 aa, Entamoeba histolytica
GESF

SEQ ID NO: 2621879 - protein, 4 aa, Entamoeba histolytica
GESG

SEQ ID NO: 2621880 - protein, 12 aa, Entamoeba histolytica
GESGAGKTENTK

SEQ ID NO: 2621881 - protein, 10 aa, Entamoeba histolytica
GESGAGKTVA

SEQ ID NO: 2621882 - protein, 5 aa, Entamoeba histolytica
GESGK

SEQ ID NO: 2621883 - protein, 10 aa, Entamoeba histolytica
GESIAGITND

SEQ ID NO: 2621884 - protein, 10 aa, Entamoeba histolytica
GESIPPEPST

SEQ ID NO: 2621885 - protein, 8 aa, Entamoeba histolytica
GESIRNQT

SEQ ID NO: 2621886 - protein, 5 aa, Entamoeba histolytica
GESLT

SEQ ID NO: 2621887 - protein, 4 aa, Entamoeba histolytica
GESM

SEQ ID NO: 2621888 - protein, 6 aa, Entamoeba histolytica
GESNND

SEQ ID NO: 2621889 - protein, 8 aa, Entamoeba histolytica
GESNSGMT

SEQ ID NO: 2621890 - protein, 5 aa, Entamoeba histolytica
GESPF

SEQ ID NO: 2621891 - protein, 9 aa, Entamoeba histolytica
GESPTSPIS

SEQ ID NO: 2621892 - protein, 10 aa, Entamoeba histolytica
GESQNSQDSE

SEQ ID NO: 2621893 - protein, 5 aa, Entamoeba histolytica
GESSG

SEQ ID NO: 2621894 - protein, 8 aa, Entamoeba histolytica
GESSSNFG

SEQ ID NO: 2621895 - protein, 9 aa, Entamoeba histolytica
GESSVGKSS

SEQ ID NO: 2621896 - protein, 5 aa, Entamoeba histolytica
GESTD

SEQ ID NO: 2621897 - protein, 5 aa, Entamoeba histolytica
GESTI

SEQ ID NO: 2621898 - protein, 6 aa, Entamoeba histolytica
GESTRA

SEQ ID NO: 2621899 - protein, 9 aa, Entamoeba histolytica
GESYSTSQE

SEQ ID NO: 2621900 - protein, 8 aa, Entamoeba histolytica
GESYYGED

SEQ ID NO: 2621901 - protein, 9 aa, Entamoeba histolytica
GETAKDAMN

SEQ ID NO: 2621902 - protein, 9 aa, Entamoeba histolytica
GETAPSSMN

SEQ ID NO: 2621903 - protein, 5 aa, Entamoeba histolytica
GETDG

SEQ ID NO: 2621904 - protein, 5 aa, Entamoeba histolytica
GETEA

SEQ ID NO: 2621905 - protein, 8 aa, Entamoeba histolytica
GETEDKEE

SEQ ID NO: 2621906 - protein, 12 aa, Entamoeba histolytica
GETGSGKTTQLP

SEQ ID NO: 2621907 - protein, 9 aa, Entamoeba histolytica
GETHGITRK

SEQ ID NO: 2621908 - protein, 6 aa, Entamoeba histolytica
GETHRQ

SEQ ID NO: 2621909 - protein, 4 aa, Entamoeba histolytica
GETI

SEQ ID NO: 2621910 - protein, 6 aa, Entamoeba histolytica
GETITS

SEQ ID NO: 2621911 - protein, 10 aa, Entamoeba histolytica
GETKSENKKE

SEQ ID NO: 2621912 - protein, 11 aa, Entamoeba histolytica
GETLEVTQPDG

SEQ ID NO: 2621913 - protein, 7 aa, Entamoeba histolytica
GETLNEV

SEQ ID NO: 2621914 - protein, 23 aa, Entamoeba histolytica
GETLPTKGTTRQYCTTRDNQTNA

SEQ ID NO: 2621915 - protein, 9 aa, Entamoeba histolytica
GETLPTNGI

SEQ ID NO: 2621916 - protein, 5 aa, Entamoeba histolytica
GETPD

SEQ ID NO: 2621917 - protein, 8 aa, Entamoeba histolytica
GETPEIKR

SEQ ID NO: 2621918 - protein, 5 aa, Entamoeba histolytica
GETPF

SEQ ID NO: 2621919 - protein, 20 aa, Entamoeba histolytica
GETPGVTPEQAQQYVGKERH

SEQ ID NO: 2621920 - protein, 5 aa, Entamoeba histolytica
GETPL

SEQ ID NO: 2621921 - protein, 6 aa, Entamoeba histolytica
GETPQV

SEQ ID NO: 2621922 - protein, 4 aa, Entamoeba histolytica
GETQ

SEQ ID NO: 2621923 - protein, 4 aa, Entamoeba histolytica
GETR

SEQ ID NO: 2621924 - protein, 8 aa, Entamoeba histolytica
GETSIGKE

SEQ ID NO: 2621925 - protein, 7 aa, Entamoeba histolytica
GETSTIE

SEQ ID NO: 2621926 - protein, 17 aa, Entamoeba histolytica
GETTDFNGIPAVTMNKE

SEQ ID NO: 2621927 - protein, 10 aa, Entamoeba histolytica
GETTPEEEEK

SEQ ID NO: 2621928 - protein, 14 aa, Entamoeba histolytica
GETVPAYASTSSKV

SEQ ID NO: 2621929 - protein, 4 aa, Entamoeba histolytica
GETY

SEQ ID NO: 2621930 - protein, 6 aa, Entamoeba histolytica
GETYEH

SEQ ID NO: 2621931 - protein, 8 aa, Entamoeba histolytica
GEVEKESL

SEQ ID NO: 2621932 - protein, 8 aa, Entamoeba histolytica
GEVERKRI

SEQ ID NO: 2621933 - protein, 5 aa, Entamoeba histolytica
GEVID

SEQ ID NO: 2621934 - protein, 9 aa, Entamoeba histolytica
GEVLPTNGI

SEQ ID NO: 2621935 - protein, 9 aa, Entamoeba histolytica
GEVNKEGDQ

SEQ ID NO: 2621936 - protein, 7 aa, Entamoeba histolytica
GEVNRAK

SEQ ID NO: 2621937 - protein, 5 aa, Entamoeba histolytica
GEVPK

SEQ ID NO: 2621938 - protein, 6 aa, Entamoeba histolytica
GEVPSR

SEQ ID NO: 2621939 - protein, 6 aa, Entamoeba histolytica
GEVQTG

SEQ ID NO: 2621940 - protein, 4 aa, Entamoeba histolytica
GEVT

SEQ ID NO: 2621941 - protein, 18 aa, Entamoeba histolytica
GEVYGNKKKSVFGIQWNS

SEQ ID NO: 2621942 - protein, 4 aa, Entamoeba histolytica
GEWK

SEQ ID NO: 2621943 - protein, 18 aa, Entamoeba histolytica
GEWKEGTAGGSVDDPESF

SEQ ID NO: 2621944 - protein, 6 aa, Entamoeba histolytica
GEYDND

SEQ ID NO: 2621945 - protein, 8 aa, Entamoeba histolytica
GEYEEASA

SEQ ID NO: 2621946 - protein, 5 aa, Entamoeba histolytica
GEYEK

SEQ ID NO: 2621947 - protein, 6 aa, Entamoeba histolytica
GEYIST

SEQ ID NO: 2621948 - protein, 6 aa, Entamoeba histolytica
GEYKES

SEQ ID NO: 2621949 - protein, 5 aa, Entamoeba histolytica
GEYKS

SEQ ID NO: 2621950 - protein, 18 aa, Entamoeba histolytica
GEYKSLNRSGMDHNPSPF

SEQ ID NO: 2621951 - protein, 9 aa, Entamoeba histolytica
GEYNGPNGY

SEQ ID NO: 2621952 - protein, 5 aa, Entamoeba histolytica
GEYPK

SEQ ID NO: 2621953 - protein, 7 aa, Entamoeba histolytica
GEYPPQQ

SEQ ID NO: 2621954 - protein, 5 aa, Entamoeba histolytica
GEYPT

SEQ ID NO: 2621955 - protein, 7 aa, Entamoeba histolytica
GFARPEQ

SEQ ID NO: 2621956 - protein, 5 aa, Entamoeba histolytica
GFASA

SEQ ID NO: 2621957 - protein, 14 aa, Entamoeba histolytica
GFDPTKRQAKDGDY

SEQ ID NO: 2621958 - protein, 8 aa, Entamoeba histolytica
GFDQEAAT

SEQ ID NO: 2621959 - protein, 6 aa, Entamoeba histolytica
GFDQET

SEQ ID NO: 2621960 - protein, 12 aa, Entamoeba histolytica
GFDSEDETEIDR

SEQ ID NO: 2621961 - protein, 11 aa, Entamoeba histolytica
GFDSERGNTPI

SEQ ID NO: 2621962 - protein, 22 aa, Entamoeba histolytica
GFDTETSEELFDEDSDDFQENN

SEQ ID NO: 2621963 - protein, 6 aa, Entamoeba histolytica
GFDTRG

SEQ ID NO: 2621964 - protein, 5 aa, Entamoeba histolytica
GFDYN

SEQ ID NO: 2621965 - protein, 13 aa, Entamoeba histolytica
GFEDKKGKKKMIE

SEQ ID NO: 2621966 - protein, 6 aa, Entamoeba histolytica
GFEEEK

SEQ ID NO: 2621967 - protein, 10 aa, Entamoeba histolytica
GFEEPTGYAK

SEQ ID NO: 2621968 - protein, 6 aa, Entamoeba histolytica
GFEGEM

SEQ ID NO: 2621969 - protein, 10 aa, Entamoeba histolytica
GFEGKDNREA

SEQ ID NO: 2621970 - protein, 14 aa, Entamoeba histolytica
GFEQMEERQRGENY

SEQ ID NO: 2621971 - protein, 18 aa, Entamoeba histolytica
GFEQRSRGPRKGQTVQSP

SEQ ID NO: 2621972 - protein, 14 aa, Entamoeba histolytica
GFESKQTRGDRGNM

SEQ ID NO: 2621973 - protein, 5 aa, Entamoeba histolytica
GFETK

SEQ ID NO: 2621974 - protein, 9 aa, Entamoeba histolytica
GFGESKSSV

SEQ ID NO: 2621975 - protein, 16 aa, Entamoeba histolytica
GFGSESGKFNEPTSIE

SEQ ID NO: 2621976 - protein, 9 aa, Entamoeba histolytica
GFGSGPLKS

SEQ ID NO: 2621977 - protein, 5 aa, Entamoeba histolytica
GFGTP

SEQ ID NO: 2621978 - protein, 17 aa, Entamoeba histolytica
GFGTTDKKKDENTSTSI

SEQ ID NO: 2621979 - protein, 21 aa, Entamoeba histolytica
GFGTTDKKVDESSKEEQSSNN

SEQ ID NO: 2621980 - protein, 6 aa, Entamoeba histolytica
GFKEEK

SEQ ID NO: 2621981 - protein, 8 aa, Entamoeba histolytica
GFKESTKK

SEQ ID NO: 2621982 - protein, 5 aa, Entamoeba histolytica
GFKGN

SEQ ID NO: 2621983 - protein, 13 aa, Entamoeba histolytica
GFKKDGASLGSPI

SEQ ID NO: 2621984 - protein, 5 aa, Entamoeba histolytica
GFKNQ

SEQ ID NO: 2621985 - protein, 10 aa, Entamoeba histolytica
GFKNTVDKTT

SEQ ID NO: 2621986 - protein, 10 aa, Entamoeba histolytica
GFKPQQKAEM

SEQ ID NO: 2621987 - protein, 10 aa, Entamoeba histolytica
GFLPHSNESL

SEQ ID NO: 2621988 - protein, 4 aa, Entamoeba histolytica
GFMS

SEQ ID NO: 2621989 - protein, 12 aa, Entamoeba histolytica
GFNESLPKQTVP

SEQ ID NO: 2621990 - protein, 11 aa, Entamoeba histolytica
GFNETYSPQHT

SEQ ID NO: 2621991 - protein, 8 aa, Entamoeba histolytica
GFNGNGNE

SEQ ID NO: 2621992 - protein, 6 aa, Entamoeba histolytica
GFNGSH

SEQ ID NO: 2621993 - protein, 13 aa, Entamoeba histolytica
GFNQKYPGSTYPM

SEQ ID NO: 2621994 - protein, 7 aa, Entamoeba histolytica
GFPDNST

SEQ ID NO: 2621995 - protein, 20 aa, Entamoeba histolytica
GFPEDQKDGKTNTTKGIDDW

SEQ ID NO: 2621996 - protein, 7 aa, Entamoeba histolytica
GFPTGAL

SEQ ID NO: 2621997 - protein, 6 aa, Entamoeba histolytica
GFPTPI

SEQ ID NO: 2621998 - protein, 5 aa, Entamoeba histolytica
GFPTS

SEQ ID NO: 2621999 - protein, 4 aa, Entamoeba histolytica
GFQG

SEQ ID NO: 2622000 - protein, 4 aa, Entamoeba histolytica
GFSG

SEQ ID NO: 2622001 - protein, 5 aa, Entamoeba histolytica
GFSKT

SEQ ID NO: 2622002 - protein, 7 aa, Entamoeba histolytica
GFSKTDD

SEQ ID NO: 2622003 - protein, 4 aa, Entamoeba histolytica
GFSP

SEQ ID NO: 2622004 - protein, 5 aa, Entamoeba histolytica
GFSQD

SEQ ID NO: 2622005 - protein, 9 aa, Entamoeba histolytica
GFSSHEDPL

SEQ ID NO: 2622006 - protein, 12 aa, Entamoeba histolytica
GFTEEEKESMLG

SEQ ID NO: 2622007 - protein, 5 aa, Entamoeba histolytica
GFTKQ

SEQ ID NO: 2622008 - protein, 5 aa, Entamoeba histolytica
GFTPK

SEQ ID NO: 2622009 - protein, 16 aa, Entamoeba histolytica
GFTTEKCTTQVNKQTN

SEQ ID NO: 2622010 - protein, 16 aa, Entamoeba histolytica
GFTTPPINSSMNLPLT

SEQ ID NO: 2622011 - protein, 12 aa, Entamoeba histolytica
GFTTRSGSGTYD

SEQ ID NO: 2622012 - protein, 15 aa, Entamoeba histolytica
GFYDSEGIEKDNEHI

SEQ ID NO: 2622013 - protein, 8 aa, Entamoeba histolytica
GGAAKSLE

SEQ ID NO: 2622014 - protein, 7 aa, Entamoeba histolytica
GGADGRA

SEQ ID NO: 2622015 - protein, 7 aa, Entamoeba histolytica
GGAGELN

SEQ ID NO: 2622016 - protein, 5 aa, Entamoeba histolytica
GGAGW

SEQ ID NO: 2622017 - protein, 5 aa, Entamoeba histolytica
GGAPI

SEQ ID NO: 2622018 - protein, 6 aa, Entamoeba histolytica
GGAPRK

SEQ ID NO: 2622019 - protein, 4 aa, Entamoeba histolytica
GGAQ

SEQ ID NO: 2622020 - protein, 6 aa, Entamoeba histolytica
GGATNQ

SEQ ID NO: 2622021 - protein, 5 aa, Entamoeba histolytica
GGATV

SEQ ID NO: 2622022 - protein, 13 aa, Entamoeba histolytica
GGAVPGKARNVSG

SEQ ID NO: 2622023 - protein, 6 aa, Entamoeba histolytica
GGCDST

SEQ ID NO: 2622024 - protein, 13 aa, Entamoeba histolytica
GGCNGAKKQIKEE

SEQ ID NO: 2622025 - protein, 5 aa, Entamoeba histolytica
GGCRQ

SEQ ID NO: 2622026 - protein, 4 aa, Entamoeba histolytica
GGDD

SEQ ID NO: 2622027 - protein, 7 aa, Entamoeba histolytica
GGDDGEL

SEQ ID NO: 2622028 - protein, 4 aa, Entamoeba histolytica
GGDG

SEQ ID NO: 2622029 - protein, 7 aa, Entamoeba histolytica
GGDGEQI

SEQ ID NO: 2622030 - protein, 5 aa, Entamoeba histolytica
GGDGF

SEQ ID NO: 2622031 - protein, 10 aa, Entamoeba histolytica
GGDHSRYNAR

SEQ ID NO: 2622032 - protein, 5 aa, Entamoeba histolytica
GGDIL

SEQ ID NO: 2622033 - protein, 7 aa, Entamoeba histolytica
GGDLVPE

SEQ ID NO: 2622034 - protein, 13 aa, Entamoeba histolytica
GGDSKKSEKARIR

SEQ ID NO: 2622035 - protein, 8 aa, Entamoeba histolytica
GGDTPTAL

SEQ ID NO: 2622036 - protein, 5 aa, Entamoeba histolytica
GGDVL

SEQ ID NO: 2622037 - protein, 7 aa, Entamoeba histolytica
GGDVPEF

SEQ ID NO: 2622038 - protein, 5 aa, Entamoeba histolytica
GGEAF

SEQ ID NO: 2622039 - protein, 9 aa, Entamoeba histolytica
GGEDSNTTQ

SEQ ID NO: 2622040 - protein, 5 aa, Entamoeba histolytica
GGEDT

SEQ ID NO: 2622041 - protein, 8 aa, Entamoeba histolytica
GGEENTLK

SEQ ID NO: 2622042 - protein, 4 aa, Entamoeba histolytica
GGEF

SEQ ID NO: 2622043 - protein, 6 aa, Entamoeba histolytica
GGEKAG

SEQ ID NO: 2622044 - protein, 13 aa, Entamoeba histolytica
GGEKKEEEEDTSK

SEQ ID NO: 2622045 - protein, 26 aa, Entamoeba histolytica
GGEKKPGCDGHGGCHRQGGCCGGQGC

SEQ ID NO: 2622046 - protein, 10 aa, Entamoeba histolytica
GGELKPGKGF

SEQ ID NO: 2622047 - protein, 24 aa, Entamoeba histolytica
GGENSLGGSFSTATFQSETGETID

SEQ ID NO: 2622048 - protein, 13 aa, Entamoeba histolytica
GGEPNKPPFIPQS

SEQ ID NO: 2622049 - protein, 9 aa, Entamoeba histolytica
GGESENSDD

SEQ ID NO: 2622050 - protein, 14 aa, Entamoeba histolytica
GGESQTEESIQKTK

SEQ ID NO: 2622051 - protein, 6 aa, Entamoeba histolytica
GGETAR

SEQ ID NO: 2622052 - protein, 12 aa, Entamoeba histolytica
GGETKIKKNKVE

SEQ ID NO: 2622053 - protein, 20 aa, Entamoeba histolytica
GGEWRGSPESYMGHKSSVED

SEQ ID NO: 2622054 - protein, 6 aa, Entamoeba histolytica
GGEYRR

SEQ ID NO: 2622055 - protein, 5 aa, Entamoeba histolytica
GGFDT

SEQ ID NO: 2622056 - protein, 14 aa, Entamoeba histolytica
GGFETKEKNKKGEE

SEQ ID NO: 2622057 - protein, 9 aa, Entamoeba histolytica
GGFGKNNGQ

SEQ ID NO: 2622058 - protein, 21 aa, Entamoeba histolytica
GGFNKKNKERKRSLSPSQSSI

SEQ ID NO: 2622059 - protein, 34 aa, Entamoeba histolytica
GGFNTSSSGGFGFNQNQQNQNTTQTVKPVPGEPD

SEQ ID NO: 2622060 - protein, 11 aa, Entamoeba histolytica
GGFQPTIPETK

SEQ ID NO: 2622061 - protein, 16 aa, Entamoeba histolytica
GGFTQSSPRKNTENKS

SEQ ID NO: 2622062 - protein, 7 aa, Entamoeba histolytica
GGGATDV

SEQ ID NO: 2622063 - protein, 8 aa, Entamoeba histolytica
GGGEGPAL

SEQ ID NO: 2622064 - protein, 4 aa, Entamoeba histolytica
GGGI

SEQ ID NO: 2622065 - protein, 5 aa, Entamoeba histolytica
GGGIF

SEQ ID NO: 2622066 - protein, 5 aa, Entamoeba histolytica
GGGIK

SEQ ID NO: 2622067 - protein, 8 aa, Entamoeba histolytica
GGGIRDRT

SEQ ID NO: 2622068 - protein, 4 aa, Entamoeba histolytica
GGGQ

SEQ ID NO: 2622069 - protein, 8 aa, Entamoeba histolytica
GGGSANKS

SEQ ID NO: 2622070 - protein, 6 aa, Entamoeba histolytica
GGGSFG

SEQ ID NO: 2622071 - protein, 7 aa, Entamoeba histolytica
GGGSGSV

SEQ ID NO: 2622072 - protein, 4 aa, Entamoeba histolytica
GGGV

SEQ ID NO: 2622073 - protein, 4 aa, Entamoeba histolytica
GGGW

SEQ ID NO: 2622074 - protein, 12 aa, Entamoeba histolytica
GGHEKKGQLGGT

SEQ ID NO: 2622075 - protein, 11 aa, Entamoeba histolytica
GGHFGRNDPDF

SEQ ID NO: 2622076 - protein, 8 aa, Entamoeba histolytica
GGHTQGVT

SEQ ID NO: 2622077 - protein, 5 aa, Entamoeba histolytica
GGHVR

SEQ ID NO: 2622078 - protein, 11 aa, Entamoeba histolytica
GGIAKGTKAVG

SEQ ID NO: 2622079 - protein, 8 aa, Entamoeba histolytica
GGIARKRV

SEQ ID NO: 2622080 - protein, 4 aa, Entamoeba histolytica
GGID

SEQ ID NO: 2622081 - protein, 7 aa, Entamoeba histolytica
GGIDSSV

SEQ ID NO: 2622082 - protein, 5 aa, Entamoeba histolytica
GGIEA

SEQ ID NO: 2622083 - protein, 13 aa, Entamoeba histolytica
GGIGAARETRRTL

SEQ ID NO: 2622084 - protein, 9 aa, Entamoeba histolytica
GGIGKSIPQ

SEQ ID NO: 2622085 - protein, 5 aa, Entamoeba histolytica
GGIGQ

SEQ ID NO: 2622086 - protein, 30 aa, Entamoeba histolytica
GGIKRKKEENKDNNGKKIKHEENELDILNP

SEQ ID NO: 2622087 - protein, 45 aa, Entamoeba histolytica
GGINETSSEESTQEELPPPVPEKTYVEQEEGTEVPPPVPAPRRGL

SEQ ID NO: 2622088 - protein, 6 aa, Entamoeba histolytica
GGINKD

SEQ ID NO: 2622089 - protein, 7 aa, Entamoeba histolytica
GGINLKP

SEQ ID NO: 2622090 - protein, 6 aa, Entamoeba histolytica
GGIPDY

SEQ ID NO: 2622091 - protein, 21 aa, Entamoeba histolytica
GGIQKEEKHDKIDNKFNKTEK

SEQ ID NO: 2622092 - protein, 5 aa, Entamoeba histolytica
GGIRN

SEQ ID NO: 2622093 - protein, 14 aa, Entamoeba histolytica
GGIRPDVEAPKNKI

SEQ ID NO: 2622094 - protein, 5 aa, Entamoeba histolytica
GGISP

SEQ ID NO: 2622095 - protein, 9 aa, Entamoeba histolytica
GGISSVSPG

SEQ ID NO: 2622096 - protein, 8 aa, Entamoeba histolytica
GGITEEKE

SEQ ID NO: 2622097 - protein, 7 aa, Entamoeba histolytica
GGITLGK

SEQ ID NO: 2622098 - protein, 8 aa, Entamoeba histolytica
GGITQSLS

SEQ ID NO: 2622099 - protein, 15 aa, Entamoeba histolytica
GGITTDEYKKNKDVV

SEQ ID NO: 2622100 - protein, 6 aa, Entamoeba histolytica
GGITTE

SEQ ID NO: 2622101 - protein, 14 aa, Entamoeba histolytica
GGKALVDEKQSPNC

SEQ ID NO: 2622102 - protein, 5 aa, Entamoeba histolytica
GGKEG

SEQ ID NO: 2622103 - protein, 8 aa, Entamoeba histolytica
GGKEGASA

SEQ ID NO: 2622104 - protein, 9 aa, Entamoeba histolytica
GGKEGASGL

SEQ ID NO: 2622105 - protein, 11 aa, Entamoeba histolytica
GGKEIKNLTGK

SEQ ID NO: 2622106 - protein, 13 aa, Entamoeba histolytica
GGKELAKDASGRR

SEQ ID NO: 2622107 - protein, 9 aa, Entamoeba histolytica
GGKGCGKST

SEQ ID NO: 2622108 - protein, 7 aa, Entamoeba histolytica
GGKGGFG

SEQ ID NO: 2622109 - protein, 8 aa, Entamoeba histolytica
GGKGSPQF

SEQ ID NO: 2622110 - protein, 39 aa, Entamoeba histolytica; identical to SEQ ID NO: 2426612

SEQ ID NO: 2622111 - protein, 7 aa, Entamoeba histolytica
GGKHGWS

SEQ ID NO: 2622112 - protein, 10 aa, Entamoeba histolytica
GGKHPDPNLT

SEQ ID NO: 2622113 - protein, 15 aa, Entamoeba histolytica
GGKIRKPGTKMSQRD

SEQ ID NO: 2622114 - protein, 9 aa, Entamoeba histolytica
GGKKESQKL

SEQ ID NO: 2622115 - protein, 10 aa, Entamoeba histolytica
GGKKKKELKG

SEQ ID NO: 2622116 - protein, 7 aa, Entamoeba histolytica
GGKKQNW

SEQ ID NO: 2622117 - protein, 24 aa, Entamoeba histolytica
GGKNDNIAKAEPNQDDIEDKDYRD

SEQ ID NO: 2622118 - protein, 7 aa, Entamoeba histolytica
GGKREGH

SEQ ID NO: 2622119 - protein, 24 aa, Entamoeba histolytica
GGKRKGGTTKENRTFSETTCLVNL

SEQ ID NO: 2622120 - protein, 7 aa, Entamoeba histolytica
GGKSSSA

SEQ ID NO: 2622121 - protein, 6 aa, Entamoeba histolytica
GGKTNV

SEQ ID NO: 2622122 - protein, 6 aa, Entamoeba histolytica
GGKVKT

SEQ ID NO: 2622123 - protein, 10 aa, Entamoeba histolytica
GGKWDVSKGN

SEQ ID NO: 2622124 - protein, 5 aa, Entamoeba histolytica
GGKWK

SEQ ID NO: 2622125 - protein, 11 aa, Entamoeba histolytica
GGLDTINGKTG

SEQ ID NO: 2622126 - protein, 10 aa, Entamoeba histolytica
GGLEQTKNEL

SEQ ID NO: 2622127 - protein, 9 aa, Entamoeba histolytica
GGLERNTTR

SEQ ID NO: 2622128 - protein, 69 aa, Entamoeba histolytica
GGLGLGGGLGQPQGLGLGGGLGQPSGLPSLGQPSMPVTSEQGSAGISGGELQMKGTGKKTIKKKKMGVA

SEQ ID NO: 2622129 - protein, 34 aa, Entamoeba histolytica
GGLGLGGGLGQPQGLGLGQPQGLGLGQPQGLGLG

SEQ ID NO: 2622130 - protein, 7 aa, Entamoeba histolytica
GGLGSGC

SEQ ID NO: 2622131 - protein, 4 aa, Entamoeba histolytica
GGLK

SEQ ID NO: 2622132 - protein, 11 aa, Entamoeba histolytica
GGLKDGKKVPI

SEQ ID NO: 2622133 - protein, 11 aa, Entamoeba histolytica
GGLPGADNLAG

SEQ ID NO: 2622134 - protein, 4 aa, Entamoeba histolytica
GGLS

SEQ ID NO: 2622135 - protein, 8 aa, Entamoeba histolytica
GGLSTISP

SEQ ID NO: 2622136 - protein, 7 aa, Entamoeba histolytica
GGLTKNQ

SEQ ID NO: 2622137 - protein, 9 aa, Entamoeba histolytica
GGLTNEQKK

SEQ ID NO: 2622138 - protein, 4 aa, Entamoeba histolytica
GGMG

SEQ ID NO: 2622139 - protein, 6 aa, Entamoeba histolytica
GGMKEE

SEQ ID NO: 2622140 - protein, 4 aa, Entamoeba histolytica
GGMN

SEQ ID NO: 2622141 - protein, 6 aa, Entamoeba histolytica
GGMTQG

SEQ ID NO: 2622142 - protein, 5 aa, Entamoeba histolytica
GGNAS

SEQ ID NO: 2622143 - protein, 10 aa, Entamoeba histolytica
GGNEKEEEEI

SEQ ID NO: 2622144 - protein, 13 aa, Entamoeba histolytica
GGNESEKKGQLTS

SEQ ID NO: 2622145 - protein, 7 aa, Entamoeba histolytica
GGNGKKI

SEQ ID NO: 2622146 - protein, 4 aa, Entamoeba histolytica
GGNI

SEQ ID NO: 2622147 - protein, 9 aa, Entamoeba histolytica
GGNKTDQQL

SEQ ID NO: 2622148 - protein, 5 aa, Entamoeba histolytica
GGNLD

SEQ ID NO: 2622149 - protein, 7 aa, Entamoeba histolytica
GGNLGPS

SEQ ID NO: 2622150 - protein, 13 aa, Entamoeba histolytica
GGNLPTQQQSTSL

SEQ ID NO: 2622151 - protein, 5 aa, Entamoeba histolytica
GGNNM

SEQ ID NO: 2622152 - protein, 6 aa, Entamoeba histolytica
GGNPLV

SEQ ID NO: 2622153 - protein, 11 aa, Entamoeba histolytica
GGNSQQEPNLS

SEQ ID NO: 2622154 - protein, 5 aa, Entamoeba histolytica
GGNTP

SEQ ID NO: 2622155 - protein, 12 aa, Entamoeba histolytica
GGNTTNKEYMKE

SEQ ID NO: 2622156 - protein, 4 aa, Entamoeba histolytica
GGNV

SEQ ID NO: 2622157 - protein, 9 aa, Entamoeba histolytica
GGNVQQTVQ

SEQ ID NO: 2622158 - protein, 10 aa, Entamoeba histolytica
GGNVTRNVSS

SEQ ID NO: 2622159 - protein, 9 aa, Entamoeba histolytica
GGPAAGGHN

SEQ ID NO: 2622160 - protein, 4 aa, Entamoeba histolytica
GGPF

SEQ ID NO: 2622161 - protein, 4 aa, Entamoeba histolytica
GGPN

SEQ ID NO: 2622162 - protein, 9 aa, Entamoeba histolytica
GGPNPFESP

SEQ ID NO: 2622163 - protein, 7 aa, Entamoeba histolytica
GGPQSAV

SEQ ID NO: 2622164 - protein, 18 aa, Entamoeba histolytica
GGPSGLAAAKAALETKKD

SEQ ID NO: 2622165 - protein, 6 aa, Entamoeba histolytica
GGQASQ

SEQ ID NO: 2622166 - protein, 9 aa, Entamoeba histolytica
GGQIPEGIT

SEQ ID NO: 2622167 - protein, 4 aa, Entamoeba histolytica
GGQL

SEQ ID NO: 2622168 - protein, 7 aa, Entamoeba histolytica
GGQNYDG

SEQ ID NO: 2622169 - protein, 10 aa, Entamoeba histolytica
GGQPGIGMQP

SEQ ID NO: 2622170 - protein, 10 aa, Entamoeba histolytica
GGQQSTVNSS

SEQ ID NO: 2622171 - protein, 8 aa, Entamoeba histolytica
GGQRSERK

SEQ ID NO: 2622172 - protein, 13 aa, Entamoeba histolytica
GGQSHSTDISNAA

SEQ ID NO: 2622173 - protein, 16 aa, Entamoeba histolytica
GGQSISSAKLRASRPK

SEQ ID NO: 2622174 - protein, 6 aa, Entamoeba histolytica
GGQSKI

SEQ ID NO: 2622175 - protein, 10 aa, Entamoeba histolytica
GGQTPYAPKN

SEQ ID NO: 2622176 - protein, 7 aa, Entamoeba histolytica
GGQYDPS

SEQ ID NO: 2622177 - protein, 9 aa, Entamoeba histolytica
GGRDNSSTE

SEQ ID NO: 2622178 - protein, 5 aa, Entamoeba histolytica
GGREG

SEQ ID NO: 2622179 - protein, 8 aa, Entamoeba histolytica
GGRKLKGK

SEQ ID NO: 2622180 - protein, 5 aa, Entamoeba histolytica
GGRSD

SEQ ID NO: 2622181 - protein, 13 aa, Entamoeba histolytica
GGRSLNSSKNTSK

SEQ ID NO: 2622182 - protein, 6 aa, Entamoeba histolytica
GGRVEQ

SEQ ID NO: 2622183 - protein, 9 aa, Entamoeba histolytica
GGSAIDAAK

SEQ ID NO: 2622184 - protein, 4 aa, Entamoeba histolytica
GGSD

SEQ ID NO: 2622185 - protein, 5 aa, Entamoeba histolytica
GGSDL

SEQ ID NO: 2622186 - protein, 13 aa, Entamoeba histolytica
GGSDLGPVMVTES

SEQ ID NO: 2622187 - protein, 10 aa, Entamoeba histolytica
GGSDSYTQIQ

SEQ ID NO: 2622188 - protein, 13 aa, Entamoeba histolytica
GGSEDTTELEEFV

SEQ ID NO: 2622189 - protein, 7 aa, Entamoeba histolytica
GGSGNYC

SEQ ID NO: 2622190 - protein, 12 aa, Entamoeba histolytica
GGSGTNDGGTGM

SEQ ID NO: 2622191 - protein, 9 aa, Entamoeba histolytica
GGSIKKNGI

SEQ ID NO: 2622192 - protein, 5 aa, Entamoeba histolytica
GGSIR

SEQ ID NO: 2622193 - protein, 9 aa, Entamoeba histolytica
GGSKPASEL

SEQ ID NO: 2622194 - protein, 6 aa, Entamoeba histolytica
GGSKQK

SEQ ID NO: 2622195 - protein, 16 aa, Entamoeba histolytica
GGSKSSEVKEKESCKT

SEQ ID NO: 2622196 - protein, 7 aa, Entamoeba histolytica
GGSPGQV

SEQ ID NO: 2622197 - protein, 7 aa, Entamoeba histolytica
GGSPSAE

SEQ ID NO: 2622198 - protein, 4 aa, Entamoeba histolytica
GGSR

SEQ ID NO: 2622199 - protein, 5 aa, Entamoeba histolytica
GGSRA

SEQ ID NO: 2622200 - protein, 15 aa, Entamoeba histolytica
GGSRYDSKKKSLYVG

SEQ ID NO: 2622201 - protein, 12 aa, Entamoeba histolytica
GGSSNLIGTASK

SEQ ID NO: 2622202 - protein, 16 aa, Entamoeba histolytica
GGSTIGPHVASTTGIT

SEQ ID NO: 2622203 - protein, 23 aa, Entamoeba histolytica
GGSVAEENKRVEEEKKKEENIKK

SEQ ID NO: 2622204 - protein, 8 aa, Entamoeba histolytica
GGSVDESE

SEQ ID NO: 2622205 - protein, 8 aa, Entamoeba histolytica
GGSVVDGT

SEQ ID NO: 2622206 - protein, 5 aa, Entamoeba histolytica
GGSWK

SEQ ID NO: 2622207 - protein, 7 aa, Entamoeba histolytica
GGTEGFQ

SEQ ID NO: 2622208 - protein, 11 aa, Entamoeba histolytica
GGTGDGKSSLG

SEQ ID NO: 2622209 - protein, 8 aa, Entamoeba histolytica
GGTGRAPN

SEQ ID NO: 2622210 - protein, 9 aa, Entamoeba histolytica
GGTGSGLGS

SEQ ID NO: 2622211 - protein, 9 aa, Entamoeba histolytica
GGTHSTDPI

SEQ ID NO: 2622212 - protein, 24 aa, Entamoeba histolytica
GGTHSTDPNIRNACGGTAYGKPIT

SEQ ID NO: 2622213 - protein, 12 aa, Entamoeba histolytica
GGTIDNGRVNGN

SEQ ID NO: 2622214 - protein, 4 aa, Entamoeba histolytica
GGTL

SEQ ID NO: 2622215 - protein, 5 aa, Entamoeba histolytica
GGTLD

SEQ ID NO: 2622216 - protein, 9 aa, Entamoeba histolytica
GGTNPAYEP

SEQ ID NO: 2622217 - protein, 7 aa, Entamoeba histolytica
GGTPPQT

SEQ ID NO: 2622218 - protein, 7 aa, Entamoeba histolytica
GGTQTPL

SEQ ID NO: 2622219 - protein, 20 aa, Entamoeba histolytica
GGTRESREDCRKENFDKDKL

SEQ ID NO: 2622220 - protein, 9 aa, Entamoeba histolytica
GGTRSRKEH

SEQ ID NO: 2622221 - protein, 8 aa, Entamoeba histolytica
GGTSGIGE

SEQ ID NO: 2622222 - protein, 12 aa, Entamoeba histolytica
GGTTGTKGNTQS

SEQ ID NO: 2622223 - protein, 6 aa, Entamoeba histolytica
GGTTHR

SEQ ID NO: 2622224 - protein, 9 aa, Entamoeba histolytica
GGTTRTGDL

SEQ ID NO: 2622225 - protein, 4 aa, Entamoeba histolytica
GGVE

SEQ ID NO: 2622226 - protein, 6 aa, Entamoeba histolytica
GGVGDE

SEQ ID NO: 2622227 - protein, 5 aa, Entamoeba histolytica
GGVGG

SEQ ID NO: 2622228 - protein, 8 aa, Entamoeba histolytica
GGVGPSEL

SEQ ID NO: 2622229 - protein, 7 aa, Entamoeba histolytica
GGVGRVT

SEQ ID NO: 2622230 - protein, 45 aa, Entamoeba histolytica
GGVKTRNEGNEQPEDLDTPGSRVPKAFNEGEDDEDEDDIVSRIAN

SEQ ID NO: 2622231 - protein, 4 aa, Entamoeba histolytica
GGVN

SEQ ID NO: 2622232 - protein, 6 aa, Entamoeba histolytica
GGVPGI

SEQ ID NO: 2622233 - protein, 4 aa, Entamoeba histolytica
GGWK

SEQ ID NO: 2622234 - protein, 9 aa, Entamoeba histolytica
GGYETEEDY

SEQ ID NO: 2622235 - protein, 11 aa, Entamoeba histolytica
GGYGNEPGKFN

SEQ ID NO: 2622236 - protein, 6 aa, Entamoeba histolytica
GGYKGN

SEQ ID NO: 2622237 - protein, 9 aa, Entamoeba histolytica
GGYKTEEDT

SEQ ID NO: 2622238 - protein, 7 aa, Entamoeba histolytica
GGYQQGM

SEQ ID NO: 2622239 - protein, 11 aa, Entamoeba histolytica
GGYSDGEIGEY

SEQ ID NO: 2622240 - protein, 4 aa, Entamoeba histolytica
GGYT

SEQ ID NO: 2622241 - protein, 28 aa, Entamoeba histolytica
GGYTSTPVNQPKPATKPKPAPKKSNNDW

SEQ ID NO: 2622242 - protein, 7 aa, Entamoeba histolytica
GGYTVSN

SEQ ID NO: 2622243 - protein, 11 aa, Entamoeba histolytica
GHAQKHSLKRG

SEQ ID NO: 2622244 - protein, 6 aa, Entamoeba histolytica
GHASPV

SEQ ID NO: 2622245 - protein, 6 aa, Entamoeba histolytica
GHCNDN

SEQ ID NO: 2622246 - protein, 5 aa, Entamoeba histolytica
GHDAD

SEQ ID NO: 2622247 - protein, 8 aa, Entamoeba histolytica
GHEDEQKP

SEQ ID NO: 2622248 - protein, 6 aa, Entamoeba histolytica
GHEFNP

SEQ ID NO: 2622249 - protein, 4 aa, Entamoeba histolytica
GHEG

SEQ ID NO: 2622250 - protein, 5 aa, Entamoeba histolytica
GHEKF

SEQ ID NO: 2622251 - protein, 6 aa, Entamoeba histolytica
GHERSN

SEQ ID NO: 2622252 - protein, 5 aa, Entamoeba histolytica
GHEYQ

SEQ ID NO: 2622253 - protein, 13 aa, Entamoeba histolytica
GHEYVGSDSITKN

SEQ ID NO: 2622254 - protein, 9 aa, Entamoeba histolytica
GHGGAESSN

SEQ ID NO: 2622255 - protein, 11 aa, Entamoeba histolytica
GHGGSGTSQAA

SEQ ID NO: 2622256 - protein, 8 aa, Entamoeba histolytica
GHGNAQYK

SEQ ID NO: 2622257 - protein, 19 aa, Entamoeba histolytica
GHGSNTTIREAKKSNMICF

SEQ ID NO: 2622258 - protein, 9 aa, Entamoeba histolytica
GHHEEEEDK

SEQ ID NO: 2622259 - protein, 7 aa, Entamoeba histolytica
GHHEGHE

SEQ ID NO: 2622260 - protein, 25 aa, Entamoeba histolytica
GHIQTKAQKDLNPVYGKQSKIKKIG

SEQ ID NO: 2622261 - protein, 11 aa, Entamoeba histolytica
GHISKDCPNAE

SEQ ID NO: 2622262 - protein, 4 aa, Entamoeba histolytica
GHIT

SEQ ID NO: 2622263 - protein, 23 aa, Entamoeba histolytica
GHITDKTEDKHTKLRSSQAPLDP

SEQ ID NO: 2622264 - protein, 5 aa, Entamoeba histolytica
GHLKP

SEQ ID NO: 2622265 - protein, 7 aa, Entamoeba histolytica
GHLNPSP

SEQ ID NO: 2622266 - protein, 13 aa, Entamoeba histolytica
GHLPNDSSSEYVD

SEQ ID NO: 2622267 - protein, 15 aa, Entamoeba histolytica
GHMVSGEQGSNGSSS

SEQ ID NO: 2622268 - protein, 10 aa, Entamoeba histolytica
GHNGDSAARI

SEQ ID NO: 2622269 - protein, 7 aa, Entamoeba histolytica
GHNGKDA

SEQ ID NO: 2622270 - protein, 5 aa, Entamoeba histolytica
GHNGM

SEQ ID NO: 2622271 - protein, 10 aa, Entamoeba histolytica
GHNGSDAAKL

SEQ ID NO: 2622272 - protein, 6 aa, Entamoeba histolytica
GHNGSI

SEQ ID NO: 2622273 - protein, 13 aa, Entamoeba histolytica
GHNSEFETDSSQT

SEQ ID NO: 2622274 - protein, 7 aa, Entamoeba histolytica
GHPDDRL

SEQ ID NO: 2622275 - protein, 14 aa, Entamoeba histolytica
GHPIGEKEIESTKK

SEQ ID NO: 2622276 - protein, 5 aa, Entamoeba histolytica
GHPNK

SEQ ID NO: 2622277 - protein, 10 aa, Entamoeba histolytica
GHPTRTKTGE

SEQ ID NO: 2622278 - protein, 8 aa, Entamoeba histolytica
GHPYPKSK

SEQ ID NO: 2622279 - protein, 5 aa, Entamoeba histolytica
GHQQR

SEQ ID NO: 2622280 - protein, 4 aa, Entamoeba histolytica
GHRT

SEQ ID NO: 2622281 - protein, 5 aa, Entamoeba histolytica
GHSAA

SEQ ID NO: 2622282 - protein, 11 aa, Entamoeba histolytica
GHSFEENQRYN

SEQ ID NO: 2622283 - protein, 6 aa, Entamoeba histolytica
GHSGDV

SEQ ID NO: 2622284 - protein, 6 aa, Entamoeba histolytica
GHSGQI

SEQ ID NO: 2622285 - protein, 5 aa, Entamoeba histolytica
GHSGS

SEQ ID NO: 2622286 - protein, 13 aa, Entamoeba histolytica
GHSINEQQIKEIT

SEQ ID NO: 2622287 - protein, 8 aa, Entamoeba histolytica
GHSKGVED

SEQ ID NO: 2622288 - protein, 5 aa, Entamoeba histolytica
GHSKY

SEQ ID NO: 2622289 - protein, 6 aa, Entamoeba histolytica
GHSNAV

SEQ ID NO: 2622290 - protein, 6 aa, Entamoeba histolytica
GHSNDT

SEQ ID NO: 2622291 - protein, 11 aa, Entamoeba histolytica
GHSNELNDLPK

SEQ ID NO: 2622292 - protein, 6 aa, Entamoeba histolytica
GHSNNT

SEQ ID NO: 2622293 - protein, 5 aa, Entamoeba histolytica
GHSNP

SEQ ID NO: 2622294 - protein, 5 aa, Entamoeba histolytica
GHSSE

SEQ ID NO: 2622295 - protein, 6 aa, Entamoeba histolytica
GHTGRK

SEQ ID NO: 2622296 - protein, 5 aa, Entamoeba histolytica
GHTKD

SEQ ID NO: 2622297 - protein, 16 aa, Entamoeba histolytica
GHTSKDCPQNENKGSD

SEQ ID NO: 2622298 - protein, 9 aa, Entamoeba histolytica
GHTSTATTH

SEQ ID NO: 2622299 - protein, 21 aa, Entamoeba histolytica
GIAASTGSACASESLQANPTF

SEQ ID NO: 2622300 - protein, 9 aa, Entamoeba histolytica
GIAKEGIEA

SEQ ID NO: 2622301 - protein, 13 aa, Entamoeba histolytica
GIAPSANINPERT

SEQ ID NO: 2622302 - protein, 5 aa, Entamoeba histolytica
GIASG

SEQ ID NO: 2622303 - protein, 7 aa, Entamoeba histolytica
GIATKSG

SEQ ID NO: 2622304 - protein, 4 aa, Entamoeba histolytica
GIDD

SEQ ID NO: 2622305 - protein, 4 aa, Entamoeba histolytica
GIDE

SEQ ID NO: 2622306 - protein, 15 aa, Entamoeba histolytica
GIDENDSKKSKRQLE

SEQ ID NO: 2622307 - protein, 10 aa, Entamoeba histolytica
GIDESGNTYY

SEQ ID NO: 2622308 - protein, 7 aa, Entamoeba histolytica
GIDETSK

SEQ ID NO: 2622309 - protein, 8 aa, Entamoeba histolytica
GIDETTKH

SEQ ID NO: 2622310 - protein, 21 aa, Entamoeba histolytica
GIDGGSLANRNDDIFISKRSM

SEQ ID NO: 2622311 - protein, 11 aa, Entamoeba histolytica
GIDKKRKGSEY

SEQ ID NO: 2622312 - protein, 9 aa, Entamoeba histolytica
GIDKQTEEE

SEQ ID NO: 2622313 - protein, 10 aa, Entamoeba histolytica
GIDKTEGSID

SEQ ID NO: 2622314 - protein, 11 aa, Entamoeba histolytica
GIDLNEESGTE

SEQ ID NO: 2622315 - protein, 8 aa, Entamoeba histolytica
GIDNNRKG

SEQ ID NO: 2622316 - protein, 17 aa, Entamoeba histolytica
GIDNTQFENKKEKKSVG

SEQ ID NO: 2622317 - protein, 4 aa, Entamoeba histolytica
GIDP

SEQ ID NO: 2622318 - protein, 9 aa, Entamoeba histolytica
GIDPNDGRI

SEQ ID NO: 2622319 - protein, 10 aa, Entamoeba histolytica
GIDQTHNPEF

SEQ ID NO: 2622320 - protein, 12 aa, Entamoeba histolytica
GIDSETRHCKSE

SEQ ID NO: 2622321 - protein, 8 aa, Entamoeba histolytica
GIDSKSNE

SEQ ID NO: 2622322 - protein, 8 aa, Entamoeba histolytica
GIDTKSGK

SEQ ID NO: 2622323 - protein, 10 aa, Entamoeba histolytica
GIDTSNEAEM

SEQ ID NO: 2622324 - protein, 7 aa, Entamoeba histolytica
GIEASPK

SEQ ID NO: 2622325 - protein, 10 aa, Entamoeba histolytica
GIEDDDETIQ

SEQ ID NO: 2622326 - protein, 10 aa, Entamoeba histolytica
GIEDDISNGH

SEQ ID NO: 2622327 - protein, 6 aa, Entamoeba histolytica
GIEDGC

SEQ ID NO: 2622328 - protein, 5 aa, Entamoeba histolytica
GIEDK

SEQ ID NO: 2622329 - protein, 4 aa, Entamoeba histolytica
GIEE

SEQ ID NO: 2622330 - protein, 8 aa, Entamoeba histolytica
GIEEDDQI

SEQ ID NO: 2622331 - protein, 9 aa, Entamoeba histolytica
GIEEDTDEE

SEQ ID NO: 2622332 - protein, 5 aa, Entamoeba histolytica
GIEEG

SEQ ID NO: 2622333 - protein, 6 aa, Entamoeba histolytica
GIEEND

SEQ ID NO: 2622334 - protein, 12 aa, Entamoeba histolytica
GIEESMNQCESG

SEQ ID NO: 2622335 - protein, 6 aa, Entamoeba histolytica
GIEGRT

SEQ ID NO: 2622336 - protein, 10 aa, Entamoeba histolytica
GIEGYSSQNG

SEQ ID NO: 2622337 - protein, 9 aa, Entamoeba histolytica
GIEKKECGG

SEQ ID NO: 2622338 - protein, 7 aa, Entamoeba histolytica
GIEMTEE

SEQ ID NO: 2622339 - protein, 8 aa, Entamoeba histolytica
GIEPGASE

SEQ ID NO: 2622340 - protein, 7 aa, Entamoeba histolytica
GIEQNEV

SEQ ID NO: 2622341 - protein, 6 aa, Entamoeba histolytica
GIERGV

SEQ ID NO: 2622342 - protein, 23 aa, Entamoeba histolytica
GIERSDDDDFVEETEEQKEERER

SEQ ID NO: 2622343 - protein, 5 aa, Entamoeba histolytica
GIESG

SEQ ID NO: 2622344 - protein, 8 aa, Entamoeba histolytica
GIESKERK

SEQ ID NO: 2622345 - protein, 6 aa, Entamoeba histolytica
GIESND

SEQ ID NO: 2622346 - protein, 7 aa, Entamoeba histolytica
GIEYTSK

SEQ ID NO: 2622347 - protein, 17 aa, Entamoeba histolytica
GIFPKSYGKNTFQLTSK

SEQ ID NO: 2622348 - protein, 4 aa, Entamoeba histolytica
GIGE

SEQ ID NO: 2622349 - protein, 7 aa, Entamoeba histolytica
GIGGTSF

SEQ ID NO: 2622350 - protein, 5 aa, Entamoeba histolytica
GIGKQ

SEQ ID NO: 2622351 - protein, 11 aa, Entamoeba histolytica
GIGKSDSSRSK

SEQ ID NO: 2622352 - protein, 126 aa, Entamoeba histolytica
GIGNSKDPNEERGRKGSGNDRRDGGERRRDGNDRRRDGNDRRRDGNDRRRDGNDRRRDGGERRRDGGERRRDGGERRRDGGERRRDGGERRRDGNDRKKSENDKKDRKRYGNNKSDGNSSRKGHIT

SEQ ID NO: 2622353 - protein, 17 aa, Entamoeba histolytica
GIGSETQLSQNQIPSIR

SEQ ID NO: 2622354 - protein, 4 aa, Entamoeba histolytica
GIGT

SEQ ID NO: 2622355 - protein, 7 aa, Entamoeba histolytica
GIGTRKE

SEQ ID NO: 2622356 - protein, 5 aa, Entamoeba histolytica
GIHPD

SEQ ID NO: 2622357 - protein, 15 aa, Entamoeba histolytica
GIHSDDGKVFNENGK

SEQ ID NO: 2622358 - protein, 20 aa, Entamoeba histolytica
GIISEEKEEKIKKEIEKKGI

SEQ ID NO: 2622359 - protein, 5 aa, Entamoeba histolytica
GIITG

SEQ ID NO: 2622360 - protein, 4 aa, Entamoeba histolytica
GIKE

SEQ ID NO: 2622361 - protein, 10 aa, Entamoeba histolytica
GIKEDNDYAP

SEQ ID NO: 2622362 - protein, 6 aa, Entamoeba histolytica
GIKEET

SEQ ID NO: 2622363 - protein, 8 aa, Entamoeba histolytica
GIKGEEDS

SEQ ID NO: 2622364 - protein, 13 aa, Entamoeba histolytica
GIKKRRSKKTECP

SEQ ID NO: 2622365 - protein, 10 aa, Entamoeba histolytica
GIKKRTGKLR

SEQ ID NO: 2622366 - protein, 24 aa, Entamoeba histolytica
GIKNENAGQQSQIGTQQAAMMPQV

SEQ ID NO: 2622367 - protein, 9 aa, Entamoeba histolytica
GIKNENQEL

SEQ ID NO: 2622368 - protein, 7 aa, Entamoeba histolytica
GIKPDLY

SEQ ID NO: 2622369 - protein, 7 aa, Entamoeba histolytica
GIKPNEP

SEQ ID NO: 2622370 - protein, 30 aa, Entamoeba histolytica
GIKPQSKQESSKKNGKKDTSKKEKKGVCIL

SEQ ID NO: 2622371 - protein, 14 aa, Entamoeba histolytica
GIKPRRFQRTTNTS

SEQ ID NO: 2622372 - protein, 10 aa, Entamoeba histolytica
GIKPSLKDNF

SEQ ID NO: 2622373 - protein, 12 aa, Entamoeba histolytica
GIKQKQDHSGKT

SEQ ID NO: 2622374 - protein, 12 aa, Entamoeba histolytica
GIKQKTEDDTII

SEQ ID NO: 2622375 - protein, 8 aa, Entamoeba histolytica
GIKQNNNE

SEQ ID NO: 2622376 - protein, 10 aa, Entamoeba histolytica
GIKQSNSILN

SEQ ID NO: 2622377 - protein, 8 aa, Entamoeba histolytica
GIKRQKAS

SEQ ID NO: 2622378 - protein, 6 aa, Entamoeba histolytica
GIKSGD

SEQ ID NO: 2622379 - protein, 9 aa, Entamoeba histolytica
GIKSNKAKT

SEQ ID NO: 2622380 - protein, 6 aa, Entamoeba histolytica
GIKSTG

SEQ ID NO: 2622381 - protein, 9 aa, Entamoeba histolytica
GIKTPKHNL

SEQ ID NO: 2622382 - protein, 8 aa, Entamoeba histolytica
GIKTQTED

SEQ ID NO: 2622383 - protein, 4 aa, Entamoeba histolytica
GIND

SEQ ID NO: 2622384 - protein, 4 aa, Entamoeba histolytica
GINE

SEQ ID NO: 2622385 - protein, 11 aa, Entamoeba histolytica
GINEAKTKYEE

SEQ ID NO: 2622386 - protein, 24 aa, Entamoeba histolytica
GINEEFKKSHNEGEEQNLSPSLAD

SEQ ID NO: 2622387 - protein, 6 aa, Entamoeba histolytica
GINEGD

SEQ ID NO: 2622388 - protein, 5 aa, Entamoeba histolytica
GINEI

SEQ ID NO: 2622389 - protein, 6 aa, Entamoeba histolytica
GINENN

SEQ ID NO: 2622390 - protein, 6 aa, Entamoeba histolytica
GINKED

SEQ ID NO: 2622391 - protein, 6 aa, Entamoeba histolytica
GINKGR

SEQ ID NO: 2622392 - protein, 10 aa, Entamoeba histolytica
GINKSDRADI

SEQ ID NO: 2622393 - protein, 8 aa, Entamoeba histolytica
GINNNQNI

SEQ ID NO: 2622394 - protein, 11 aa, Entamoeba histolytica
GINNPRSKAKI

SEQ ID NO: 2622395 - protein, 20 aa, Entamoeba histolytica
GINPDNDEKQIQINEQPTNH

SEQ ID NO: 2622396 - protein, 18 aa, Entamoeba histolytica
GINQYTEVKESNEKTEEV

SEQ ID NO: 2622397 - protein, 5 aa, Entamoeba histolytica
GINSK

SEQ ID NO: 2622398 - protein, 21 aa, Entamoeba histolytica
GINSKKEEINSKKEEKDINIP

SEQ ID NO: 2622399 - protein, 5 aa, Entamoeba histolytica
GINSS

SEQ ID NO: 2622400 - protein, 6 aa, Entamoeba histolytica
GINYNK

SEQ ID NO: 2622401 - protein, 9 aa, Entamoeba histolytica
GIPDDERKE

SEQ ID NO: 2622402 - protein, 6 aa, Entamoeba histolytica
GIPDQA

SEQ ID NO: 2622403 - protein, 11 aa, Entamoeba histolytica
GIPEGKNGRQT

SEQ ID NO: 2622404 - protein, 6 aa, Entamoeba histolytica
GIPEGW

SEQ ID NO: 2622405 - protein, 9 aa, Entamoeba histolytica
GIPENNSKI

SEQ ID NO: 2622406 - protein, 5 aa, Entamoeba histolytica
GIPER

SEQ ID NO: 2622407 - protein, 16 aa, Entamoeba histolytica
GIPFDKKEKKEDGSEN

SEQ ID NO: 2622408 - protein, 9 aa, Entamoeba histolytica
GIPGDNDPI

SEQ ID NO: 2622409 - protein, 18 aa, Entamoeba histolytica
GIPGRRAITSQHSRTINE

SEQ ID NO: 2622410 - protein, 4 aa, Entamoeba histolytica
GIPN

SEQ ID NO: 2622411 - protein, 10 aa, Entamoeba histolytica
GIPPAPRGVP

SEQ ID NO: 2622412 - protein, 6 aa, Entamoeba histolytica
GIPPDK

SEQ ID NO: 2622413 - protein, 6 aa, Entamoeba histolytica
GIPPEW

SEQ ID NO: 2622414 - protein, 11 aa, Entamoeba histolytica
GIPPLKDKEKW

SEQ ID NO: 2622415 - protein, 13 aa, Entamoeba histolytica
GIPPLKERDSWSP

SEQ ID NO: 2622416 - protein, 14 aa, Entamoeba histolytica
GIPPLKNAEKWSRD

SEQ ID NO: 2622417 - protein, 65 aa, Entamoeba histolytica
GIPPPPPPARGTGCGAPPPPPPLNAPPPPPPPAHGTGCGVPPPPPPSLNNPPSNISTPKASAPSL

SEQ ID NO: 2622418 - protein, 5 aa, Entamoeba histolytica
GIPQP

SEQ ID NO: 2622419 - protein, 13 aa, Entamoeba histolytica
GIPQPSSSTPQRR

SEQ ID NO: 2622420 - protein, 14 aa, Entamoeba histolytica
GIPRSNQTKYKPFN

SEQ ID NO: 2622421 - protein, 13 aa, Entamoeba histolytica
GIPRSTRQQYKPF

SEQ ID NO: 2622422 - protein, 10 aa, Entamoeba histolytica
GIPSGKAGEQ

SEQ ID NO: 2622423 - protein, 11 aa, Entamoeba histolytica
GIPSGKAGEQS

SEQ ID NO: 2622424 - protein, 4 aa, Entamoeba histolytica
GIQG

SEQ ID NO: 2622425 - protein, 9 aa, Entamoeba histolytica
GIQKQEKSL

SEQ ID NO: 2622426 - protein, 23 aa, Entamoeba histolytica
GIQLDPSGRASVSQKQGNSDGGC

SEQ ID NO: 2622427 - protein, 6 aa, Entamoeba histolytica
GIQPLT

SEQ ID NO: 2622428 - protein, 4 aa, Entamoeba histolytica
GIQQ

SEQ ID NO: 2622429 - protein, 8 aa, Entamoeba histolytica
GIQSDTSF

SEQ ID NO: 2622430 - protein, 10 aa, Entamoeba histolytica
GIQSSHTPHN

SEQ ID NO: 2622431 - protein, 19 aa, Entamoeba histolytica
GIQTETANEWKQGITNEPN

SEQ ID NO: 2622432 - protein, 18 aa, Entamoeba histolytica
GIQTKGTLRKPKQVRPKF

SEQ ID NO: 2622433 - protein, 4 aa, Entamoeba histolytica
GIRK

SEQ ID NO: 2622434 - protein, 15 aa, Entamoeba histolytica
GIRKKDLSDKETRDK

SEQ ID NO: 2622435 - protein, 8 aa, Entamoeba histolytica
GIRKTSHS

SEQ ID NO: 2622436 - protein, 5 aa, Entamoeba histolytica
GIRSI

SEQ ID NO: 2622437 - protein, 9 aa, Entamoeba histolytica
GIRTANDER

SEQ ID NO: 2622438 - protein, 12 aa, Entamoeba histolytica
GISDNSKTATFC

SEQ ID NO: 2622439 - protein, 7 aa, Entamoeba histolytica
GISEEEK

SEQ ID NO: 2622440 - protein, 8 aa, Entamoeba histolytica
GISEESDT

SEQ ID NO: 2622441 - protein, 4 aa, Entamoeba histolytica
GISK

SEQ ID NO: 2622442 - protein, 5 aa, Entamoeba histolytica
GISKP

SEQ ID NO: 2622443 - protein, 7 aa, Entamoeba histolytica
GISPKLN

SEQ ID NO: 2622444 - protein, 6 aa, Entamoeba histolytica
GISPQL

SEQ ID NO: 2622445 - protein, 20 aa, Entamoeba histolytica
GISPSQTPKLEEENEEDKEN

SEQ ID NO: 2622446 - protein, 8 aa, Entamoeba histolytica
GISQSTIY

SEQ ID NO: 2622447 - protein, 15 aa, Entamoeba histolytica
GISQYGSELFNKLQQ

SEQ ID NO: 2622448 - protein, 16 aa, Entamoeba histolytica
GISRIDKESKTKTRGT

SEQ ID NO: 2622449 - protein, 7 aa, Entamoeba histolytica
GISSDKI

SEQ ID NO: 2622450 - protein, 12 aa, Entamoeba histolytica
GISSNSKSYFTG

SEQ ID NO: 2622451 - protein, 7 aa, Entamoeba histolytica
GISTDDL

SEQ ID NO: 2622452 - protein, 6 aa, Entamoeba histolytica
GISTER

SEQ ID NO: 2622453 - protein, 8 aa, Entamoeba histolytica
GISTRRNT

SEQ ID NO: 2622454 - protein, 18 aa, Entamoeba histolytica
GISTSAGIPDFRTPGTGL

SEQ ID NO: 2622455 - protein, 8 aa, Entamoeba histolytica
GITDEEHG

SEQ ID NO: 2622456 - protein, 6 aa, Entamoeba histolytica
GITDHT

SEQ ID NO: 2622457 - protein, 5 aa, Entamoeba histolytica
GITEE

SEQ ID NO: 2622458 - protein, 7 aa, Entamoeba histolytica
GITEEDF

SEQ ID NO: 2622459 - protein, 19 aa, Entamoeba histolytica
GITEQKTSEKIKEDRSAWG

SEQ ID NO: 2622460 - protein, 9 aa, Entamoeba histolytica
GITGSDDAY

SEQ ID NO: 2622461 - protein, 4 aa, Entamoeba histolytica
GITH

SEQ ID NO: 2622462 - protein, 16 aa, Entamoeba histolytica
GITLGSTSSEKEIARQ

SEQ ID NO: 2622463 - protein, 4 aa, Entamoeba histolytica
GITN

SEQ ID NO: 2622464 - protein, 4 aa, Entamoeba histolytica
GITP

SEQ ID NO: 2622465 - protein, 6 aa, Entamoeba histolytica
GITPEQ

SEQ ID NO: 2622466 - protein, 4 aa, Entamoeba histolytica
GITS

SEQ ID NO: 2622467 - protein, 18 aa, Entamoeba histolytica
GITSASITKTQRPKPGKR

SEQ ID NO: 2622468 - protein, 5 aa, Entamoeba histolytica
GITSI

SEQ ID NO: 2622469 - protein, 6 aa, Entamoeba histolytica
GITSKR

SEQ ID NO: 2622470 - protein, 5 aa, Entamoeba histolytica
GITSN

SEQ ID NO: 2622471 - protein, 12 aa, Entamoeba histolytica
GITSNNSDPSLR

SEQ ID NO: 2622472 - protein, 16 aa, Entamoeba histolytica
GITTSNEKTKTNEEVE

SEQ ID NO: 2622473 - protein, 16 aa, Entamoeba histolytica
GIVTDKQSPSFASRQL

SEQ ID NO: 2622474 - protein, 7 aa, Entamoeba histolytica
GKAEIST

SEQ ID NO: 2622475 - protein, 26 aa, Entamoeba histolytica
GKAGADNLKSIQQDVEEENQKDLTER

SEQ ID NO: 2622476 - protein, 7 aa, Entamoeba histolytica
GKAGAHS

SEQ ID NO: 2622477 - protein, 6 aa, Entamoeba histolytica
GKAKEI

SEQ ID NO: 2622478 - protein, 9 aa, Entamoeba histolytica
GKALADKYG

SEQ ID NO: 2622479 - protein, 8 aa, Entamoeba histolytica
GKAQNEIL

SEQ ID NO: 2622480 - protein, 8 aa, Entamoeba histolytica
GKAQQAGY

SEQ ID NO: 2622481 - protein, 11 aa, Entamoeba histolytica
GKAQTGSGKTI

SEQ ID NO: 2622482 - protein, 8 aa, Entamoeba histolytica
GKARRPVE

SEQ ID NO: 2622483 - protein, 8 aa, Entamoeba histolytica
GKASRTEV

SEQ ID NO: 2622484 - protein, 8 aa, Entamoeba histolytica
GKATGAKV

SEQ ID NO: 2622485 - protein, 9 aa, Entamoeba histolytica
GKAVAEATK

SEQ ID NO: 2622486 - protein, 8 aa, Entamoeba histolytica
GKCERENC

SEQ ID NO: 2622487 - protein, 8 aa, Entamoeba histolytica
GKCPGGSV

SEQ ID NO: 2622488 - protein, 7 aa, Entamoeba histolytica
GKCSDDQ

SEQ ID NO: 2622489 - protein, 8 aa, Entamoeba histolytica
GKDAQSIK

SEQ ID NO: 2622490 - protein, 8 aa, Entamoeba histolytica
GKDATRQE

SEQ ID NO: 2622491 - protein, 8 aa, Entamoeba histolytica
GKDDRETD

SEQ ID NO: 2622492 - protein, 8 aa, Entamoeba histolytica
GKDEIKGS

SEQ ID NO: 2622493 - protein, 15 aa, Entamoeba histolytica
GKDEKASLGVGKVMV

SEQ ID NO: 2622494 - protein, 8 aa, Entamoeba histolytica
GKDENEDI

SEQ ID NO: 2622495 - protein, 8 aa, Entamoeba histolytica
GKDFTKKE

SEQ ID NO: 2622496 - protein, 5 aa, Entamoeba histolytica
GKDGL

SEQ ID NO: 2622497 - protein, 6 aa, Entamoeba histolytica
GKDGNF

SEQ ID NO: 2622498 - protein, 10 aa, Entamoeba histolytica
GKDGNLPQTV

SEQ ID NO: 2622499 - protein, 9 aa, Entamoeba histolytica
GKDGSEDII

SEQ ID NO: 2622500 - protein, 11 aa, Entamoeba histolytica
GKDGSRLTQSH

SEQ ID NO: 2622501 - protein, 17 aa, Entamoeba histolytica
GKDHPVNTGYEKNEEMN

SEQ ID NO: 2622502 - protein, 19 aa, Entamoeba histolytica
GKDISTVSVGGDKNLGGND

SEQ ID NO: 2622503 - protein, 20 aa, Entamoeba histolytica
GKDISTVSVGGDKNVGGNDF

SEQ ID NO: 2622504 - protein, 7 aa, Entamoeba histolytica
GKDKQIK

SEQ ID NO: 2622505 - protein, 5 aa, Entamoeba histolytica
GKDLR

SEQ ID NO: 2622506 - protein, 7 aa, Entamoeba histolytica
GKDPKHL

SEQ ID NO: 2622507 - protein, 7 aa, Entamoeba histolytica
GKDQKTM

SEQ ID NO: 2622508 - protein, 11 aa, Entamoeba histolytica
GKDRTEQTPIL

SEQ ID NO: 2622509 - protein, 14 aa, Entamoeba histolytica
GKDSDRSTSITSFG

SEQ ID NO: 2622510 - protein, 5 aa, Entamoeba histolytica
GKDSF

SEQ ID NO: 2622511 - protein, 7 aa, Entamoeba histolytica
GKDSFPA

SEQ ID NO: 2622512 - protein, 6 aa, Entamoeba histolytica
GKDSNF

SEQ ID NO: 2622513 - protein, 5 aa, Entamoeba histolytica
GKDSR

SEQ ID NO: 2622514 - protein, 9 aa, Entamoeba histolytica
GKDSSGRQV

SEQ ID NO: 2622515 - protein, 5 aa, Entamoeba histolytica
GKDTC

SEQ ID NO: 2622516 - protein, 5 aa, Entamoeba histolytica
GKDTY

SEQ ID NO: 2622517 - protein, 7 aa, Entamoeba histolytica
GKDYGTN

SEQ ID NO: 2622518 - protein, 11 aa, Entamoeba histolytica
GKEAFSGSSQL

SEQ ID NO: 2622519 - protein, 6 aa, Entamoeba histolytica
GKEDEY

SEQ ID NO: 2622520 - protein, 7 aa, Entamoeba histolytica
GKEDFFS

SEQ ID NO: 2622521 - protein, 7 aa, Entamoeba histolytica
GKEDRIQ

SEQ ID NO: 2622522 - protein, 7 aa, Entamoeba histolytica
GKEDRTM

SEQ ID NO: 2622523 - protein, 9 aa, Entamoeba histolytica
GKEEENKKG

SEQ ID NO: 2622524 - protein, 22 aa, Entamoeba histolytica
GKEEKKSYSKIEADDEWRNDEL

SEQ ID NO: 2622525 - protein, 9 aa, Entamoeba histolytica
GKEENTKEM

SEQ ID NO: 2622526 - protein, 18 aa, Entamoeba histolytica
GKEEQGDLDRYESIPSKL

SEQ ID NO: 2622527 - protein, 5 aa, Entamoeba histolytica
GKEEY

SEQ ID NO: 2622528 - protein, 8 aa, Entamoeba histolytica
GKEEYEDN

SEQ ID NO: 2622529 - protein, 4 aa, Entamoeba histolytica
GKEF

SEQ ID NO: 2622530 - protein, 6 aa, Entamoeba histolytica
GKEFEG

SEQ ID NO: 2622531 - protein, 5 aa, Entamoeba histolytica
GKEGT

SEQ ID NO: 2622532 - protein, 7 aa, Entamoeba histolytica
GKEGTED

SEQ ID NO: 2622533 - protein, 9 aa, Entamoeba histolytica
GKEGTRDGS

SEQ ID NO: 2622534 - protein, 9 aa, Entamoeba histolytica
GKEHSEDNI

SEQ ID NO: 2622535 - protein, 4 aa, Entamoeba histolytica
GKEI

SEQ ID NO: 2622536 - protein, 5 aa, Entamoeba histolytica
GKEIE

SEQ ID NO: 2622537 - protein, 10 aa, Entamoeba histolytica
GKEIEPNRKV

SEQ ID NO: 2622538 - protein, 13 aa, Entamoeba histolytica
GKEIGKHKNNHSY

SEQ ID NO: 2622539 - protein, 9 aa, Entamoeba histolytica
GKEINNDYE

SEQ ID NO: 2622540 - protein, 6 aa, Entamoeba histolytica
GKEIPH

SEQ ID NO: 2622541 - protein, 15 aa, Entamoeba histolytica
GKEIPKSSVEYEEAN

SEQ ID NO: 2622542 - protein, 7 aa, Entamoeba histolytica
GKEKAPY

SEQ ID NO: 2622543 - protein, 7 aa, Entamoeba histolytica
GKEKEEE

SEQ ID NO: 2622544 - protein, 7 aa, Entamoeba histolytica
GKEKKQL

SEQ ID NO: 2622545 - protein, 9 aa, Entamoeba histolytica
GKEKKRNPM

SEQ ID NO: 2622546 - protein, 5 aa, Entamoeba histolytica
GKEKL

SEQ ID NO: 2622547 - protein, 19 aa, Entamoeba histolytica
GKEKQQKETLEGAHGSLQP

SEQ ID NO: 2622548 - protein, 20 aa, Entamoeba histolytica
GKEKQYQKKIRARDRKRNDQ

SEQ ID NO: 2622549 - protein, 4 aa, Entamoeba histolytica
GKEL

SEQ ID NO: 2622550 - protein, 31 aa, Entamoeba histolytica
GKELHEPKKSDKNKTSSFKTSDEIIQEEKEK

SEQ ID NO: 2622551 - protein, 6 aa, Entamoeba histolytica
GKELSV

SEQ ID NO: 2622552 - protein, 12 aa, Entamoeba histolytica
GKEMTENEKRQH

SEQ ID NO: 2622553 - protein, 6 aa, Entamoeba histolytica
GKENEH

SEQ ID NO: 2622554 - protein, 10 aa, Entamoeba histolytica
GKENIEKQKS

SEQ ID NO: 2622555 - protein, 11 aa, Entamoeba histolytica
GKENLTKDVND

SEQ ID NO: 2622556 - protein, 5 aa, Entamoeba histolytica
GKENM

SEQ ID NO: 2622557 - protein, 14 aa, Entamoeba histolytica
GKEPNKSINPDEAV

SEQ ID NO: 2622558 - protein, 10 aa, Entamoeba histolytica
GKEPTREEIS

SEQ ID NO: 2622559 - protein, 5 aa, Entamoeba histolytica
GKEQF

SEQ ID NO: 2622560 - protein, 4 aa, Entamoeba histolytica
GKES

SEQ ID NO: 2622561 - protein, 9 aa, Entamoeba histolytica
GKESENSDD

SEQ ID NO: 2622562 - protein, 6 aa, Entamoeba histolytica
GKESHD

SEQ ID NO: 2622563 - protein, 5 aa, Entamoeba histolytica
GKESN

SEQ ID NO: 2622564 - protein, 7 aa, Entamoeba histolytica
GKESSYN

SEQ ID NO: 2622565 - protein, 14 aa, Entamoeba histolytica
GKESYGSNGTSYIN

SEQ ID NO: 2622566 - protein, 4 aa, Entamoeba histolytica
GKET

SEQ ID NO: 2622567 - protein, 8 aa, Entamoeba histolytica
GKETLKRK

SEQ ID NO: 2622568 - protein, 8 aa, Entamoeba histolytica
GKETNQSQ

SEQ ID NO: 2622569 - protein, 16 aa, Entamoeba histolytica
GKETPTKIEVDNQEDI

SEQ ID NO: 2622570 - protein, 8 aa, Entamoeba histolytica
GKETSGIH

SEQ ID NO: 2622571 - protein, 13 aa, Entamoeba histolytica
GKEVPKYSHLVIQ

SEQ ID NO: 2622572 - protein, 19 aa, Entamoeba histolytica
GKEVQKKERKEREEDREFE

SEQ ID NO: 2622573 - protein, 5 aa, Entamoeba histolytica
GKEYE

SEQ ID NO: 2622574 - protein, 10 aa, Entamoeba histolytica
GKEYKAKSIP

SEQ ID NO: 2622575 - protein, 9 aa, Entamoeba histolytica
GKEYPGNSR

SEQ ID NO: 2622576 - protein, 13 aa, Entamoeba histolytica
GKEYPKHDKSDAI

SEQ ID NO: 2622577 - protein, 7 aa, Entamoeba histolytica
GKFEGER

SEQ ID NO: 2622578 - protein, 7 aa, Entamoeba histolytica
GKFERKP

SEQ ID NO: 2622579 - protein, 8 aa, Entamoeba histolytica
GKFEVSEE

SEQ ID NO: 2622580 - protein, 8 aa, Entamoeba histolytica
GKFNDGNK

SEQ ID NO: 2622581 - protein, 10 aa, Entamoeba histolytica
GKFNSKEEMT

SEQ ID NO: 2622582 - protein, 6 aa, Entamoeba histolytica
GKFNTR

SEQ ID NO: 2622583 - protein, 4 aa, Entamoeba histolytica
GKFT

SEQ ID NO: 2622584 - protein, 6 aa, Entamoeba histolytica
GKFTKD

SEQ ID NO: 2622585 - protein, 11 aa, Entamoeba histolytica
GKFTNGRGRAV

SEQ ID NO: 2622586 - protein, 4 aa, Entamoeba histolytica
GKGA

SEQ ID NO: 2622587 - protein, 17 aa, Entamoeba histolytica
GKGAMNRTELADYRKQS

SEQ ID NO: 2622588 - protein, 5 aa, Entamoeba histolytica
GKGAY

SEQ ID NO: 2622589 - protein, 4 aa, Entamoeba histolytica
GKGD

SEQ ID NO: 2622590 - protein, 7 aa, Entamoeba histolytica
GKGDRSD

SEQ ID NO: 2622591 - protein, 7 aa, Entamoeba histolytica
GKGDSTI

SEQ ID NO: 2622592 - protein, 8 aa, Entamoeba histolytica
GKGEKEVK

SEQ ID NO: 2622593 - protein, 10 aa, Entamoeba histolytica
GKGEKPQSGL

SEQ ID NO: 2622594 - protein, 5 aa, Entamoeba histolytica
GKGGF

SEQ ID NO: 2622595 - protein, 6 aa, Entamoeba histolytica
GKGGFG

SEQ ID NO: 2622596 - protein, 7 aa, Entamoeba histolytica
GKGGFGD

SEQ ID NO: 2622597 - protein, 12 aa, Entamoeba histolytica
GKGGMTSESPII

SEQ ID NO: 2622598 - protein, 8 aa, Entamoeba histolytica
GKGGRAMN

SEQ ID NO: 2622599 - protein, 11 aa, Entamoeba histolytica
GKGGSRLTQSH

SEQ ID NO: 2622600 - protein, 11 aa, Entamoeba histolytica
GKGGVGKSTFA

SEQ ID NO: 2622601 - protein, 10 aa, Entamoeba histolytica
GKGGVGKSTI

SEQ ID NO: 2622602 - protein, 12 aa, Entamoeba histolytica
GKGGVGKTTTSC

SEQ ID NO: 2622603 - protein, 9 aa, Entamoeba histolytica
GKGKGENKD

SEQ ID NO: 2622604 - protein, 9 aa, Entamoeba histolytica
GKGKNKISA

SEQ ID NO: 2622605 - protein, 9 aa, Entamoeba histolytica
GKGKQHEIS

SEQ ID NO: 2622606 - protein, 7 aa, Entamoeba histolytica
GKGKVKK

SEQ ID NO: 2622607 - protein, 13 aa, Entamoeba histolytica
GKGKYSDEEQLGK

SEQ ID NO: 2622608 - protein, 6 aa, Entamoeba histolytica
GKGMGG

SEQ ID NO: 2622609 - protein, 16 aa, Entamoeba histolytica
GKGMNQTDNDVPVTDE

SEQ ID NO: 2622610 - protein, 5 aa, Entamoeba histolytica
GKGNE

SEQ ID NO: 2622611 - protein, 8 aa, Entamoeba histolytica
GKGNEKDN

SEQ ID NO: 2622612 - protein, 5 aa, Entamoeba histolytica
GKGNN

SEQ ID NO: 2622613 - protein, 5 aa, Entamoeba histolytica
GKGPY

SEQ ID NO: 2622614 - protein, 28 aa, Entamoeba histolytica
GKGRNPVKSPAPSQSTSPNIPTSSTPVV

SEQ ID NO: 2622615 - protein, 4 aa, Entamoeba histolytica
GKGS

SEQ ID NO: 2622616 - protein, 16 aa, Entamoeba histolytica
GKGSDEIKRNEEEIKK

SEQ ID NO: 2622617 - protein, 7 aa, Entamoeba histolytica
GKGSHGV

SEQ ID NO: 2622618 - protein, 8 aa, Entamoeba histolytica
GKGSRSSL

SEQ ID NO: 2622619 - protein, 7 aa, Entamoeba histolytica
GKGSTQF

SEQ ID NO: 2622620 - protein, 7 aa, Entamoeba histolytica
GKGSYGT

SEQ ID NO: 2622621 - protein, 6 aa, Entamoeba histolytica
GKGTFG

SEQ ID NO: 2622622 - protein, 7 aa, Entamoeba histolytica
GKGTGHW

SEQ ID NO: 2622623 - protein, 11 aa, Entamoeba histolytica
GKGTRFNATKR

SEQ ID NO: 2622624 - protein, 5 aa, Entamoeba histolytica
GKGVQ

SEQ ID NO: 2622625 - protein, 7 aa, Entamoeba histolytica
GKHDHDK

SEQ ID NO: 2622626 - protein, 55 aa, Entamoeba histolytica
GKHDSSENSEDKSEEHMSSSKQDKKIPPTPETPSSSSQSPSSTKAQSPRTSNQNI

SEQ ID NO: 2622627 - protein, 7 aa, Entamoeba histolytica
GKHDSVG

SEQ ID NO: 2622628 - protein, 6 aa, Entamoeba histolytica
GKHGRF

SEQ ID NO: 2622629 - protein, 8 aa, Entamoeba histolytica
GKHKETLA

SEQ ID NO: 2622630 - protein, 8 aa, Entamoeba histolytica
GKHLGEEK

SEQ ID NO: 2622631 - protein, 8 aa, Entamoeba histolytica
GKHSPDEL

SEQ ID NO: 2622632 - protein, 8 aa, Entamoeba histolytica
GKHSSRRG

SEQ ID NO: 2622633 - protein, 30 aa, Entamoeba histolytica
GKIANADPSLVSNSAKSRGYKQVGTLGSGN

SEQ ID NO: 2622634 - protein, 8 aa, Entamoeba histolytica
GKIDPKKH

SEQ ID NO: 2622635 - protein, 6 aa, Entamoeba histolytica
GKIDPM

SEQ ID NO: 2622636 - protein, 12 aa, Entamoeba histolytica
GKIDPNTLEPFK

SEQ ID NO: 2622637 - protein, 10 aa, Entamoeba histolytica
GKIEELSGNE

SEQ ID NO: 2622638 - protein, 12 aa, Entamoeba histolytica
GKIETKQNERNE

SEQ ID NO: 2622639 - protein, 12 aa, Entamoeba histolytica
GKIGKSSKALVQ

SEQ ID NO: 2622640 - protein, 9 aa, Entamoeba histolytica
GKIKGNECE

SEQ ID NO: 2622641 - protein, 9 aa, Entamoeba histolytica
GKIKSSVGG

SEQ ID NO: 2622642 - protein, 4 aa, Entamoeba histolytica
GKIN

SEQ ID NO: 2622643 - protein, 10 aa, Entamoeba histolytica
GKIPEDGSKF

SEQ ID NO: 2622644 - protein, 36 aa, Entamoeba histolytica
GKIPEPKKEEPKSEEKPMEEEKKEEETAKEKPMEED

SEQ ID NO: 2622645 - protein, 7 aa, Entamoeba histolytica
GKIPKKL

SEQ ID NO: 2622646 - protein, 5 aa, Entamoeba histolytica
GKIPV

SEQ ID NO: 2622647 - protein, 4 aa, Entamoeba histolytica
GKIQ

SEQ ID NO: 2622648 - protein, 9 aa, Entamoeba histolytica
GKIQDRDRF

SEQ ID NO: 2622649 - protein, 4 aa, Entamoeba histolytica
GKIS

SEQ ID NO: 2622650 - protein, 8 aa, Entamoeba histolytica
GKISEEEF

SEQ ID NO: 2622651 - protein, 5 aa, Entamoeba histolytica
GKISG

SEQ ID NO: 2622652 - protein, 14 aa, Entamoeba histolytica
GKISPLPDEKIRKE

SEQ ID NO: 2622653 - protein, 14 aa, Entamoeba histolytica
GKISQTKPVGHKTK

SEQ ID NO: 2622654 - protein, 19 aa, Entamoeba histolytica
GKISRRSVSGPKGRRRPTM

SEQ ID NO: 2622655 - protein, 11 aa, Entamoeba histolytica
GKITKAKMTSV

SEQ ID NO: 2622656 - protein, 9 aa, Entamoeba histolytica
GKITNKINN

SEQ ID NO: 2622657 - protein, 9 aa, Entamoeba histolytica
GKITNTKRI

SEQ ID NO: 2622658 - protein, 8 aa, Entamoeba histolytica
GKIVESEY

SEQ ID NO: 2622659 - protein, 7 aa, Entamoeba histolytica
GKIYNAE

SEQ ID NO: 2622660 - protein, 14 aa, Entamoeba histolytica
GKIYPSSNTYPRKY

SEQ ID NO: 2622661 - protein, 9 aa, Entamoeba histolytica
GKKCEVKAD

SEQ ID NO: 2622662 - protein, 66 aa, Entamoeba histolytica
GKKDEVISQEDEKKSASNKENEDEKEYTSSQEQDNDNQLISSQNDEDEKEYTSNQNDEDENRRFNS

SEQ ID NO: 2622663 - protein, 7 aa, Entamoeba histolytica
GKKDFRQ

SEQ ID NO: 2622664 - protein, 7 aa, Entamoeba histolytica
GKKDSGL

SEQ ID NO: 2622665 - protein, 8 aa, Entamoeba histolytica
GKKEKQGK

SEQ ID NO: 2622666 - protein, 7 aa, Entamoeba histolytica
GKKELKE

SEQ ID NO: 2622667 - protein, 12 aa, Entamoeba histolytica
GKKESNKGKFNP

SEQ ID NO: 2622668 - protein, 8 aa, Entamoeba histolytica
GKKETGDL

SEQ ID NO: 2622669 - protein, 15 aa, Entamoeba histolytica
GKKFEGDATQLLPDS

SEQ ID NO: 2622670 - protein, 4 aa, Entamoeba histolytica
GKKG

SEQ ID NO: 2622671 - protein, 8 aa, Entamoeba histolytica
GKKGEKEI

SEQ ID NO: 2622672 - protein, 10 aa, Entamoeba histolytica
GKKGENKYRI

SEQ ID NO: 2622673 - protein, 7 aa, Entamoeba histolytica
GKKGGMA

SEQ ID NO: 2622674 - protein, 10 aa, Entamoeba histolytica
GKKGKFNEGS

SEQ ID NO: 2622675 - protein, 9 aa, Entamoeba histolytica
GKKGNRKTV

SEQ ID NO: 2622676 - protein, 5 aa, Entamoeba histolytica
GKKGQ

SEQ ID NO: 2622677 - protein, 6 aa, Entamoeba histolytica
GKKGTI

SEQ ID NO: 2622678 - protein, 8 aa, Entamoeba histolytica
GKKGTRKT

SEQ ID NO: 2622679 - protein, 6 aa, Entamoeba histolytica
GKKHPQ

SEQ ID NO: 2622680 - protein, 10 aa, Entamoeba histolytica
GKKKDAQEEV

SEQ ID NO: 2622681 - protein, 10 aa, Entamoeba histolytica
GKKKENKENT

SEQ ID NO: 2622682 - protein, 45 aa, Entamoeba histolytica
GKKKESKKETHDSKEEIKEEVTDIKKQNEVTQEEKQKQDNQEEGN

SEQ ID NO: 2622683 - protein, 16 aa, Entamoeba histolytica
GKKKRDASLCETSRTA

SEQ ID NO: 2622684 - protein, 17 aa, Entamoeba histolytica
GKKKSTKKELKKTNKRI

SEQ ID NO: 2622685 - protein, 20 aa, Entamoeba histolytica
GKKKVEGSAPEGAIMKKWGE

SEQ ID NO: 2622686 - protein, 23 aa, Entamoeba histolytica
GKKLQRAQQNTVSTEEKPEQEVE

SEQ ID NO: 2622687 - protein, 7 aa, Entamoeba histolytica
GKKLSKK

SEQ ID NO: 2622688 - protein, 12 aa, Entamoeba histolytica
GKKNISNKLGQA

SEQ ID NO: 2622689 - protein, 7 aa, Entamoeba histolytica
GKKNKKQ

SEQ ID NO: 2622690 - protein, 7 aa, Entamoeba histolytica
GKKPETL

SEQ ID NO: 2622691 - protein, 7 aa, Entamoeba histolytica
GKKPKVI

SEQ ID NO: 2622692 - protein, 8 aa, Entamoeba histolytica
GKKPLEDD

SEQ ID NO: 2622693 - protein, 5 aa, Entamoeba histolytica
GKKPM

SEQ ID NO: 2622694 - protein, 11 aa, Entamoeba histolytica
GKKQGEPNADS

SEQ ID NO: 2622695 - protein, 10 aa, Entamoeba histolytica
GKKQGGSVKT

SEQ ID NO: 2622696 - protein, 10 aa, Entamoeba histolytica
GKKQKLISTA

SEQ ID NO: 2622697 - protein, 6 aa, Entamoeba histolytica
GKKQQP

SEQ ID NO: 2622698 - protein, 6 aa, Entamoeba histolytica
GKKQRI

SEQ ID NO: 2622699 - protein, 5 aa, Entamoeba histolytica
GKKQV

SEQ ID NO: 2622700 - protein, 8 aa, Entamoeba histolytica
GKKREVLG

SEQ ID NO: 2622701 - protein, 8 aa, Entamoeba histolytica
GKKRGNPI

SEQ ID NO: 2622702 - protein, 58 aa, Entamoeba histolytica
GKKRNSSNPDDPTLTSGSQKADESSSSLEKSEKSHNSKDLSKKTPEKEDKEKKGVFAS

SEQ ID NO: 2622703 - protein, 18 aa, Entamoeba histolytica
GKKRRQGKSEYAQNRAEY

SEQ ID NO: 2622704 - protein, 6 aa, Entamoeba histolytica
GKKSFD

SEQ ID NO: 2622705 - protein, 9 aa, Entamoeba histolytica
GKKSGDYSK

SEQ ID NO: 2622706 - protein, 8 aa, Entamoeba histolytica
GKKSGSEM

SEQ ID NO: 2622707 - protein, 11 aa, Entamoeba histolytica
GKKSKGETFPG

SEQ ID NO: 2622708 - protein, 7 aa, Entamoeba histolytica
GKKSQNI

SEQ ID NO: 2622709 - protein, 8 aa, Entamoeba histolytica
GKKSTKYY

SEQ ID NO: 2622710 - protein, 6 aa, Entamoeba histolytica
GKKSTV

SEQ ID NO: 2622711 - protein, 4 aa, Entamoeba histolytica
GKKT

SEQ ID NO: 2622712 - protein, 6 aa, Entamoeba histolytica
GKKTGI

SEQ ID NO: 2622713 - protein, 9 aa, Entamoeba histolytica
GKKTIDQTK

SEQ ID NO: 2622714 - protein, 21 aa, Entamoeba histolytica
GKKTNGSRVNKKEKKEVPTEF

SEQ ID NO: 2622715 - protein, 7 aa, Entamoeba histolytica
GKKVNAR

SEQ ID NO: 2622716 - protein, 5 aa, Entamoeba histolytica
GKKYH

SEQ ID NO: 2622717 - protein, 10 aa, Entamoeba histolytica
GKKYKKDSQK

SEQ ID NO: 2622718 - protein, 6 aa, Entamoeba histolytica
GKKYRK

SEQ ID NO: 2622719 - protein, 9 aa, Entamoeba histolytica
GKLANKGGV

SEQ ID NO: 2622720 - protein, 14 aa, Entamoeba histolytica
GKLDKKHDQVEEAK

SEQ ID NO: 2622721 - protein, 20 aa, Entamoeba histolytica
GKLKEVNEENELIKEDEVKK

SEQ ID NO: 2622722 - protein, 13 aa, Entamoeba histolytica
GKLKPDIDDEKGL

SEQ ID NO: 2622723 - protein, 14 aa, Entamoeba histolytica
GKLKPDIDDEKGLT

SEQ ID NO: 2622724 - protein, 25 aa, Entamoeba histolytica
GKLPQQTNSTIPQQPTTSFPKSKNT

SEQ ID NO: 2622725 - protein, 7 aa, Entamoeba histolytica
GKLQNRR

SEQ ID NO: 2622726 - protein, 21 aa, Entamoeba histolytica
GKLQRQTQTIESPSARRQHTR

SEQ ID NO: 2622727 - protein, 8 aa, Entamoeba histolytica
GKLRGEPI

SEQ ID NO: 2622728 - protein, 7 aa, Entamoeba histolytica
GKLTSRS

SEQ ID NO: 2622729 - protein, 7 aa, Entamoeba histolytica
GKMDEHE

SEQ ID NO: 2622730 - protein, 9 aa, Entamoeba histolytica
GKMKQKHRE

SEQ ID NO: 2622731 - protein, 6 aa, Entamoeba histolytica
GKMSDS

SEQ ID NO: 2622732 - protein, 16 aa, Entamoeba histolytica
GKNCPEQEVPESSDQV

SEQ ID NO: 2622733 - protein, 4 aa, Entamoeba histolytica
GKND

SEQ ID NO: 2622734 - protein, 6 aa, Entamoeba histolytica
GKNEEI

SEQ ID NO: 2622735 - protein, 7 aa, Entamoeba histolytica
GKNFGNQ

SEQ ID NO: 2622736 - protein, 7 aa, Entamoeba histolytica
GKNGIGK

SEQ ID NO: 2622737 - protein, 8 aa, Entamoeba histolytica
GKNGNLKQ

SEQ ID NO: 2622738 - protein, 6 aa, Entamoeba histolytica
GKNGRQ

SEQ ID NO: 2622739 - protein, 6 aa, Entamoeba histolytica
GKNGSL

SEQ ID NO: 2622740 - protein, 14 aa, Entamoeba histolytica
GKNHTTSDAEIREK

SEQ ID NO: 2622741 - protein, 4 aa, Entamoeba histolytica
GKNI

SEQ ID NO: 2622742 - protein, 7 aa, Entamoeba histolytica
GKNIETN

SEQ ID NO: 2622743 - protein, 5 aa, Entamoeba histolytica
GKNIP

SEQ ID NO: 2622744 - protein, 8 aa, Entamoeba histolytica
GKNIQRKY

SEQ ID NO: 2622745 - protein, 18 aa, Entamoeba histolytica
GKNIQTKQSRDKKTKEVA

SEQ ID NO: 2622746 - protein, 15 aa, Entamoeba histolytica
GKNKKVEDKKEIKDK

SEQ ID NO: 2622747 - protein, 13 aa, Entamoeba histolytica
GKNKQTTTRRLEK

SEQ ID NO: 2622748 - protein, 9 aa, Entamoeba histolytica
GKNNEPTII

SEQ ID NO: 2622749 - protein, 9 aa, Entamoeba histolytica
GKNNKTGEI

SEQ ID NO: 2622750 - protein, 7 aa, Entamoeba histolytica
GKNNPTW

SEQ ID NO: 2622751 - protein, 7 aa, Entamoeba histolytica
GKNNQND

SEQ ID NO: 2622752 - protein, 7 aa, Entamoeba histolytica
GKNPPGM

SEQ ID NO: 2622753 - protein, 6 aa, Entamoeba histolytica
GKNPSE

SEQ ID NO: 2622754 - protein, 17 aa, Entamoeba histolytica
GKNPSKNKIKRTNKLRA

SEQ ID NO: 2622755 - protein, 5 aa, Entamoeba histolytica
GKNPT

SEQ ID NO: 2622756 - protein, 13 aa, Entamoeba histolytica
GKNPYDNMTTRQE

SEQ ID NO: 2622757 - protein, 4 aa, Entamoeba histolytica
GKNR

SEQ ID NO: 2622758 - protein, 9 aa, Entamoeba histolytica
GKNSKGEKV

SEQ ID NO: 2622759 - protein, 11 aa, Entamoeba histolytica
GKNSKSEGIEL

SEQ ID NO: 2622760 - protein, 10 aa, Entamoeba histolytica
GKNSNEESRR

SEQ ID NO: 2622761 - protein, 8 aa, Entamoeba histolytica
GKNTASKI

SEQ ID NO: 2622762 - protein, 13 aa, Entamoeba histolytica
GKPAEVLPPSSTQ

SEQ ID NO: 2622763 - protein, 4 aa, Entamoeba histolytica
GKPC

SEQ ID NO: 2622764 - protein, 11 aa, Entamoeba histolytica
GKPCVSGAEGI

SEQ ID NO: 2622765 - protein, 18 aa, Entamoeba histolytica
GKPFNKDEEKTKRNKKNE

SEQ ID NO: 2622766 - protein, 6 aa, Entamoeba histolytica
GKPGEG

SEQ ID NO: 2622767 - protein, 9 aa, Entamoeba histolytica
GKPGTGKTA

SEQ ID NO: 2622768 - protein, 5 aa, Entamoeba histolytica
GKPGY

SEQ ID NO: 2622769 - protein, 5 aa, Entamoeba histolytica
GKPIF

SEQ ID NO: 2622770 - protein, 7 aa, Entamoeba histolytica
GKPKEET

SEQ ID NO: 2622771 - protein, 28 aa, Entamoeba histolytica
GKPLKGGISQQLTEELSGSKNEIRTEAK

SEQ ID NO: 2622772 - protein, 20 aa, Entamoeba histolytica
GKPLNAREIAPSKVKENHEF

SEQ ID NO: 2622773 - protein, 8 aa, Entamoeba histolytica
GKPMTSHT

SEQ ID NO: 2622774 - protein, 13 aa, Entamoeba histolytica
GKPNKSINPDEAV

SEQ ID NO: 2622775 - protein, 7 aa, Entamoeba histolytica
GKPNQKM

SEQ ID NO: 2622776 - protein, 7 aa, Entamoeba histolytica
GKPNSMR

SEQ ID NO: 2622777 - protein, 26 aa, Entamoeba histolytica
GKPPEMKDGELHKRKENAQKAQEQLD

SEQ ID NO: 2622778 - protein, 7 aa, Entamoeba histolytica
GKPPSTK

SEQ ID NO: 2622779 - protein, 8 aa, Entamoeba histolytica
GKPTGYKG

SEQ ID NO: 2622780 - protein, 6 aa, Entamoeba histolytica
GKPTIV

SEQ ID NO: 2622781 - protein, 10 aa, Entamoeba histolytica
GKPTTTQSGL

SEQ ID NO: 2622782 - protein, 8 aa, Entamoeba histolytica
GKQDEDGL

SEQ ID NO: 2622783 - protein, 8 aa, Entamoeba histolytica
GKQDSLSD

SEQ ID NO: 2622784 - protein, 8 aa, Entamoeba histolytica
GKQEEIDG

SEQ ID NO: 2622785 - protein, 11 aa, Entamoeba histolytica
GKQEVDTSTNM

SEQ ID NO: 2622786 - protein, 9 aa, Entamoeba histolytica
GKQGAGKTT

SEQ ID NO: 2622787 - protein, 10 aa, Entamoeba histolytica
GKQGTESKAW

SEQ ID NO: 2622788 - protein, 9 aa, Entamoeba histolytica
GKQIAGGAY

SEQ ID NO: 2622789 - protein, 8 aa, Entamoeba histolytica
GKQLDPSE

SEQ ID NO: 2622790 - protein, 5 aa, Entamoeba histolytica
GKQLK

SEQ ID NO: 2622791 - protein, 6 aa, Entamoeba histolytica
GKQPIT

SEQ ID NO: 2622792 - protein, 7 aa, Entamoeba histolytica
GKQRIQP

SEQ ID NO: 2622793 - protein, 5 aa, Entamoeba histolytica
GKQRN

SEQ ID NO: 2622794 - protein, 8 aa, Entamoeba histolytica
GKQSGKTF

SEQ ID NO: 2622795 - protein, 15 aa, Entamoeba histolytica
GKQSKYTNKPQPIVK

SEQ ID NO: 2622796 - protein, 25 aa, Entamoeba histolytica
GKQTGLNKNIKTKGGITAADLQSAK

SEQ ID NO: 2622797 - protein, 4 aa, Entamoeba histolytica
GKQV

SEQ ID NO: 2622798 - protein, 13 aa, Entamoeba histolytica
GKQVTLSGAVSSS

SEQ ID NO: 2622799 - protein, 4 aa, Entamoeba histolytica
GKQY

SEQ ID NO: 2622800 - protein, 5 aa, Entamoeba histolytica
GKQYD

SEQ ID NO: 2622801 - protein, 8 aa, Entamoeba histolytica
GKQYPEQS

SEQ ID NO: 2622802 - protein, 5 aa, Entamoeba histolytica
GKRCA

SEQ ID NO: 2622803 - protein, 7 aa, Entamoeba histolytica
GKREPNI

SEQ ID NO: 2622804 - protein, 8 aa, Entamoeba histolytica
GKRFSGNK

SEQ ID NO: 2622805 - protein, 14 aa, Entamoeba histolytica
GKRGLVPANFIDYI

SEQ ID NO: 2622806 - protein, 5 aa, Entamoeba histolytica
GKRIK

SEQ ID NO: 2622807 - protein, 29 aa, Entamoeba histolytica
GKRKGAATLQQDIKDEETFMTENQNSKYS

SEQ ID NO: 2622808 - protein, 11 aa, Entamoeba histolytica
GKRNGDDRDHL

SEQ ID NO: 2622809 - protein, 9 aa, Entamoeba histolytica
GKRPKQTTV

SEQ ID NO: 2622810 - protein, 8 aa, Entamoeba histolytica
GKRPQEKL

SEQ ID NO: 2622811 - protein, 10 aa, Entamoeba histolytica
GKRPSRTQQM

SEQ ID NO: 2622812 - protein, 11 aa, Entamoeba histolytica
GKRPTNEDTEI

SEQ ID NO: 2622813 - protein, 15 aa, Entamoeba histolytica
GKRQIERTDALDGFK

SEQ ID NO: 2622814 - protein, 7 aa, Entamoeba histolytica
GKRRKET

SEQ ID NO: 2622815 - protein, 7 aa, Entamoeba histolytica
GKRRKST

SEQ ID NO: 2622816 - protein, 15 aa, Entamoeba histolytica
GKRSAGTSCNYNSSG

SEQ ID NO: 2622817 - protein, 6 aa, Entamoeba histolytica
GKRSDL

SEQ ID NO: 2622818 - protein, 10 aa, Entamoeba histolytica
GKRSEAAESH

SEQ ID NO: 2622819 - protein, 11 aa, Entamoeba histolytica
GKRSSSEHEAV

SEQ ID NO: 2622820 - protein, 7 aa, Entamoeba histolytica
GKRTEGV

SEQ ID NO: 2622821 - protein, 13 aa, Entamoeba histolytica
GKRTNSNSLTKSS

SEQ ID NO: 2622822 - protein, 13 aa, Entamoeba histolytica
GKRTSQNENETLR

SEQ ID NO: 2622823 - protein, 14 aa, Entamoeba histolytica
GKSADELKEFVDSI

SEQ ID NO: 2622824 - protein, 7 aa, Entamoeba histolytica
GKSADEM

SEQ ID NO: 2622825 - protein, 6 aa, Entamoeba histolytica
GKSDDS

SEQ ID NO: 2622826 - protein, 5 aa, Entamoeba histolytica
GKSDE

SEQ ID NO: 2622827 - protein, 8 aa, Entamoeba histolytica
GKSDVGDV

SEQ ID NO: 2622828 - protein, 10 aa, Entamoeba histolytica
GKSEEGGTVL

SEQ ID NO: 2622829 - protein, 5 aa, Entamoeba histolytica
GKSEK

SEQ ID NO: 2622830 - protein, 6 aa, Entamoeba histolytica
GKSELE

SEQ ID NO: 2622831 - protein, 10 aa, Entamoeba histolytica
GKSEQETENK

SEQ ID NO: 2622832 - protein, 7 aa, Entamoeba histolytica
GKSEREQ

SEQ ID NO: 2622833 - protein, 8 aa, Entamoeba histolytica
GKSESRGF

SEQ ID NO: 2622834 - protein, 5 aa, Entamoeba histolytica
GKSGY

SEQ ID NO: 2622835 - protein, 9 aa, Entamoeba histolytica
GKSHSPKVD

SEQ ID NO: 2622836 - protein, 4 aa, Entamoeba histolytica
GKSI

SEQ ID NO: 2622837 - protein, 5 aa, Entamoeba histolytica
GKSIE

SEQ ID NO: 2622838 - protein, 14 aa, Entamoeba histolytica
GKSIEQAQKLASKV

SEQ ID NO: 2622839 - protein, 10 aa, Entamoeba histolytica
GKSIKDRTET

SEQ ID NO: 2622840 - protein, 7 aa, Entamoeba histolytica
GKSINGL

SEQ ID NO: 2622841 - protein, 22 aa, Entamoeba histolytica
GKSISSKHNRHSGGLNTTKIPS

SEQ ID NO: 2622842 - protein, 9 aa, Entamoeba histolytica
GKSKTVKHP

SEQ ID NO: 2622843 - protein, 110 aa, Entamoeba histolytica
GKSLKEGEKKEENKPQLPEKKQSHAEPIKTTTQKHERQSLPSNPEKKERYKPTLPARNTPSIAQPSKPSTQPKQSCLDTSKQEKEDKPTPPPKKDSIKPKVPEKKEEPIT

SEQ ID NO: 2622844 - protein, 60 aa, Entamoeba histolytica
GKSLKEGEKKEETKEITSIKPTTPPKNKTVGSPTQSPQSKQSTKSPLPKKEFKKEEEPIT

SEQ ID NO: 2622845 - protein, 9 aa, Entamoeba histolytica
GKSLKKSVG

SEQ ID NO: 2622846 - protein, 7 aa, Entamoeba histolytica
GKSMEER

SEQ ID NO: 2622847 - protein, 6 aa, Entamoeba histolytica
GKSMKG

SEQ ID NO: 2622848 - protein, 7 aa, Entamoeba histolytica
GKSNEEF

SEQ ID NO: 2622849 - protein, 13 aa, Entamoeba histolytica
GKSNPGDKGSYEE

SEQ ID NO: 2622850 - protein, 13 aa, Entamoeba histolytica
GKSNPTPTDLPSV

SEQ ID NO: 2622851 - protein, 6 aa, Entamoeba histolytica
GKSNTT

SEQ ID NO: 2622852 - protein, 7 aa, Entamoeba histolytica
GKSPDEL

SEQ ID NO: 2622853 - protein, 7 aa, Entamoeba histolytica
GKSQSQD

SEQ ID NO: 2622854 - protein, 6 aa, Entamoeba histolytica
GKSRCE

SEQ ID NO: 2622855 - protein, 7 aa, Entamoeba histolytica
GKSRSAS

SEQ ID NO: 2622856 - protein, 22 aa, Entamoeba histolytica
GKSSEGAAAAMSHTGSLAGNDA

SEQ ID NO: 2622857 - protein, 7 aa, Entamoeba histolytica
GKSSFGG

SEQ ID NO: 2622858 - protein, 9 aa, Entamoeba histolytica
GKSSPYTEN

SEQ ID NO: 2622859 - protein, 6 aa, Entamoeba histolytica
GKSSWN

SEQ ID NO: 2622860 - protein, 4 aa, Entamoeba histolytica
GKST

SEQ ID NO: 2622861 - protein, 8 aa, Entamoeba histolytica
GKSTASTL

SEQ ID NO: 2622862 - protein, 13 aa, Entamoeba histolytica
GKSTEKQQDTFTG

SEQ ID NO: 2622863 - protein, 20 aa, Entamoeba histolytica
GKSTSKKGSPEELSKEINEQ

SEQ ID NO: 2622864 - protein, 9 aa, Entamoeba histolytica
GKSTTHPEA

SEQ ID NO: 2622865 - protein, 7 aa, Entamoeba histolytica
GKSVSVQ

SEQ ID NO: 2622866 - protein, 7 aa, Entamoeba histolytica
GKTAGEV

SEQ ID NO: 2622867 - protein, 6 aa, Entamoeba histolytica
GKTAQL

SEQ ID NO: 2622868 - protein, 6 aa, Entamoeba histolytica
GKTDPL

SEQ ID NO: 2622869 - protein, 8 aa, Entamoeba histolytica
GKTDTVIS

SEQ ID NO: 2622870 - protein, 24 aa, Entamoeba histolytica
GKTEEEASEILDKSGGDISFSKIK

SEQ ID NO: 2622871 - protein, 25 aa, Entamoeba histolytica
GKTEEEASEILDKSGGDISFSKIKL

SEQ ID NO: 2622872 - protein, 6 aa, Entamoeba histolytica
GKTEEL

SEQ ID NO: 2622873 - protein, 6 aa, Entamoeba histolytica
GKTEFT

SEQ ID NO: 2622874 - protein, 6 aa, Entamoeba histolytica
GKTEKA

SEQ ID NO: 2622875 - protein, 8 aa, Entamoeba histolytica
GKTENEQL

SEQ ID NO: 2622876 - protein, 7 aa, Entamoeba histolytica
GKTETEK

SEQ ID NO: 2622877 - protein, 4 aa, Entamoeba histolytica
GKTF

SEQ ID NO: 2622878 - protein, 9 aa, Entamoeba histolytica
GKTFKTQID

SEQ ID NO: 2622879 - protein, 10 aa, Entamoeba histolytica
GKTGNVAENV

SEQ ID NO: 2622880 - protein, 8 aa, Entamoeba histolytica
GKTGRPNV

SEQ ID NO: 2622881 - protein, 6 aa, Entamoeba histolytica
GKTKDI

SEQ ID NO: 2622882 - protein, 9 aa, Entamoeba histolytica
GKTKEKDEI

SEQ ID NO: 2622883 - protein, 8 aa, Entamoeba histolytica
GKTKEKTV

SEQ ID NO: 2622884 - protein, 7 aa, Entamoeba histolytica
GKTKESD

SEQ ID NO: 2622885 - protein, 4 aa, Entamoeba histolytica
GKTL

SEQ ID NO: 2622886 - protein, 8 aa, Entamoeba histolytica
GKTNTNAS

SEQ ID NO: 2622887 - protein, 8 aa, Entamoeba histolytica
GKTPEEIR

SEQ ID NO: 2622888 - protein, 6 aa, Entamoeba histolytica
GKTPQI

SEQ ID NO: 2622889 - protein, 5 aa, Entamoeba histolytica
GKTPR

SEQ ID NO: 2622890 - protein, 4 aa, Entamoeba histolytica
GKTS

SEQ ID NO: 2622891 - protein, 13 aa, Entamoeba histolytica
GKTSDKSTSITTF

SEQ ID NO: 2622892 - protein, 15 aa, Entamoeba histolytica
GKTSEIKAEESSKAI

SEQ ID NO: 2622893 - protein, 5 aa, Entamoeba histolytica
GKTSH

SEQ ID NO: 2622894 - protein, 5 aa, Entamoeba histolytica
GKTSI

SEQ ID NO: 2622895 - protein, 9 aa, Entamoeba histolytica
GKTSQKQRD

SEQ ID NO: 2622896 - protein, 7 aa, Entamoeba histolytica
GKTSVET

SEQ ID NO: 2622897 - protein, 4 aa, Entamoeba histolytica
GKTT

SEQ ID NO: 2622898 - protein, 5 aa, Entamoeba histolytica
GKTTE

SEQ ID NO: 2622899 - protein, 10 aa, Entamoeba histolytica
GKTTEGNNKH

SEQ ID NO: 2622900 - protein, 8 aa, Entamoeba histolytica
GKTTPNYI

SEQ ID NO: 2622901 - protein, 25 aa, Entamoeba histolytica
GKTVDESKSHYTKYNKRNHTAATNN

SEQ ID NO: 2622902 - protein, 9 aa, Entamoeba histolytica
GKTYEETDT

SEQ ID NO: 2622903 - protein, 6 aa, Entamoeba histolytica
GKTYQL

SEQ ID NO: 2622904 - protein, 6 aa, Entamoeba histolytica
GKVASN

SEQ ID NO: 2622905 - protein, 6 aa, Entamoeba histolytica
GKVDTN

SEQ ID NO: 2622906 - protein, 6 aa, Entamoeba histolytica
GKVFSN

SEQ ID NO: 2622907 - protein, 9 aa, Entamoeba histolytica
GKVGEAEQA

SEQ ID NO: 2622908 - protein, 6 aa, Entamoeba histolytica
GKVGKT

SEQ ID NO: 2622909 - protein, 9 aa, Entamoeba histolytica
GKVLSEPGP

SEQ ID NO: 2622910 - protein, 7 aa, Entamoeba histolytica
GKVPATV

SEQ ID NO: 2622911 - protein, 10 aa, Entamoeba histolytica
GKVPKTNTDV

SEQ ID NO: 2622912 - protein, 50 aa, Entamoeba histolytica
GKVRNQTKKVEQEQTGRKKHPSGRANLREKYNKRQELLNGETKKYKFNAQ

SEQ ID NO: 2622913 - protein, 10 aa, Entamoeba histolytica
GKVRSKTSEY

SEQ ID NO: 2622914 - protein, 7 aa, Entamoeba histolytica
GKVSGTT

SEQ ID NO: 2622915 - protein, 7 aa, Entamoeba histolytica
GKVSPDK

SEQ ID NO: 2622916 - protein, 13 aa, Entamoeba histolytica
GKVTSRPRNVRTV

SEQ ID NO: 2622917 - protein, 12 aa, Entamoeba histolytica
GKVYGTMGTDGF

SEQ ID NO: 2622918 - protein, 5 aa, Entamoeba histolytica
GKVYK

SEQ ID NO: 2622919 - protein, 8 aa, Entamoeba histolytica
GKWKEKKE

SEQ ID NO: 2622920 - protein, 4 aa, Entamoeba histolytica
GKYE

SEQ ID NO: 2622921 - protein, 5 aa, Entamoeba histolytica
GKYEE

SEQ ID NO: 2622922 - protein, 8 aa, Entamoeba histolytica
GKYGFDQG

SEQ ID NO: 2622923 - protein, 29 aa, Entamoeba histolytica
GKYGKDKKKGNKTFGNSSFKKKGNKKHKK

SEQ ID NO: 2622924 - protein, 5 aa, Entamoeba histolytica
GKYIR

SEQ ID NO: 2622925 - protein, 6 aa, Entamoeba histolytica
GKYNED

SEQ ID NO: 2622926 - protein, 6 aa, Entamoeba histolytica
GKYNGE

SEQ ID NO: 2622927 - protein, 6 aa, Entamoeba histolytica
GKYNTQ

SEQ ID NO: 2622928 - protein, 10 aa, Entamoeba histolytica
GKYPALTQSS

SEQ ID NO: 2622929 - protein, 7 aa, Entamoeba histolytica
GKYQIEK

SEQ ID NO: 2622930 - protein, 13 aa, Entamoeba histolytica
GKYQTNSDASSKQ

SEQ ID NO: 2622931 - protein, 15 aa, Entamoeba histolytica
GKYSWPSSINPSNEL

SEQ ID NO: 2622932 - protein, 14 aa, Entamoeba histolytica
GKYTFPVSKDEKKI

SEQ ID NO: 2622933 - protein, 13 aa, Entamoeba histolytica
GKYTGTEKASVSC

SEQ ID NO: 2622934 - protein, 6 aa, Entamoeba histolytica
GLASPK

SEQ ID NO: 2622935 - protein, 5 aa, Entamoeba histolytica
GLAST

SEQ ID NO: 2622936 - protein, 6 aa, Entamoeba histolytica
GLATED

SEQ ID NO: 2622937 - protein, 17 aa, Entamoeba histolytica
GLDDDDGNNDDEEQTVI

SEQ ID NO: 2622938 - protein, 10 aa, Entamoeba histolytica
GLDDDNGRKF

SEQ ID NO: 2622939 - protein, 17 aa, Entamoeba histolytica
GLDEAAKEAVAKEVEET

SEQ ID NO: 2622940 - protein, 52 aa, Entamoeba histolytica
GLDEDEEISEEEGKRKVTKKSRKKAKKTKSKKIIEDKKRIERQKEREKRLNE

SEQ ID NO: 2622941 - protein, 30 aa, Entamoeba histolytica
GLDETQKMTELNKDNKESTKPQTTKTCKKK

SEQ ID NO: 2622942 - protein, 7 aa, Entamoeba histolytica
GLDHGGV

SEQ ID NO: 2622943 - protein, 4 aa, Entamoeba histolytica
GLDN

SEQ ID NO: 2622944 - protein, 7 aa, Entamoeba histolytica
GLDNERN

SEQ ID NO: 2622945 - protein, 9 aa, Entamoeba histolytica
GLDPSSLDS

SEQ ID NO: 2622946 - protein, 9 aa, Entamoeba histolytica
GLDQHRREM

SEQ ID NO: 2622947 - protein, 10 aa, Entamoeba histolytica
GLEEDIKQEE

SEQ ID NO: 2622948 - protein, 12 aa, Entamoeba histolytica
GLEEEDKIADGN

SEQ ID NO: 2622949 - protein, 11 aa, Entamoeba histolytica
GLEERVGQTLA

SEQ ID NO: 2622950 - protein, 5 aa, Entamoeba histolytica
GLEHK

SEQ ID NO: 2622951 - protein, 8 aa, Entamoeba histolytica
GLEKEGIN

SEQ ID NO: 2622952 - protein, 5 aa, Entamoeba histolytica
GLEKN

SEQ ID NO: 2622953 - protein, 6 aa, Entamoeba histolytica
GLEKTT

SEQ ID NO: 2622954 - protein, 4 aa, Entamoeba histolytica
GLEN

SEQ ID NO: 2622955 - protein, 7 aa, Entamoeba histolytica
GLEQGTN

SEQ ID NO: 2622956 - protein, 7 aa, Entamoeba histolytica
GLESTKD

SEQ ID NO: 2622957 - protein, 11 aa, Entamoeba histolytica
GLFNSKDNKIT

SEQ ID NO: 2622958 - protein, 11 aa, Entamoeba histolytica
GLGEDEKQERV

SEQ ID NO: 2622959 - protein, 28 aa, Entamoeba histolytica
GLGESTKEALTFSNEKSNEEKAKEEQEN

SEQ ID NO: 2622960 - protein, 9 aa, Entamoeba histolytica
GLGGISNSP

SEQ ID NO: 2622961 - protein, 7 aa, Entamoeba histolytica
GLGPNGA

SEQ ID NO: 2622962 - protein, 8 aa, Entamoeba histolytica
GLGPQDTM

SEQ ID NO: 2622963 - protein, 6 aa, Entamoeba histolytica
GLGRSG

SEQ ID NO: 2622964 - protein, 13 aa, Entamoeba histolytica
GLGTSKDSDAKAY

SEQ ID NO: 2622965 - protein, 13 aa, Entamoeba histolytica
GLGTSMGCTGPKS

SEQ ID NO: 2622966 - protein, 12 aa, Entamoeba histolytica
GLIKAGESSEEL

SEQ ID NO: 2622967 - protein, 36 aa, Entamoeba histolytica
GLKDEEETVQFGKENKVGLEEEREVQNENDKKMEEE

SEQ ID NO: 2622968 - protein, 6 aa, Entamoeba histolytica
GLKDGT

SEQ ID NO: 2622969 - protein, 4 aa, Entamoeba histolytica
GLKE

SEQ ID NO: 2622970 - protein, 10 aa, Entamoeba histolytica
GLKEETASKR

SEQ ID NO: 2622971 - protein, 7 aa, Entamoeba histolytica
GLKEQEA

SEQ ID NO: 2622972 - protein, 10 aa, Entamoeba histolytica
GLKKQSNDAR

SEQ ID NO: 2622973 - protein, 7 aa, Entamoeba histolytica
GLKKSNT

SEQ ID NO: 2622974 - protein, 11 aa, Entamoeba histolytica
GLKKSSSEEKV

SEQ ID NO: 2622975 - protein, 9 aa, Entamoeba histolytica
GLKKTAKSF

SEQ ID NO: 2622976 - protein, 7 aa, Entamoeba histolytica
GLKPSQR

SEQ ID NO: 2622977 - protein, 9 aa, Entamoeba histolytica
GLKQTQQLG

SEQ ID NO: 2622978 - protein, 8 aa, Entamoeba histolytica
GLKSTTQS

SEQ ID NO: 2622979 - protein, 5 aa, Entamoeba histolytica
GLNDA

SEQ ID NO: 2622980 - protein, 8 aa, Entamoeba histolytica
GLNDTAEN

SEQ ID NO: 2622981 - protein, 10 aa, Entamoeba histolytica
GLNEEEAVDA

SEQ ID NO: 2622982 - protein, 18 aa, Entamoeba histolytica
GLNEYQRKTQNLSSNINT

SEQ ID NO: 2622983 - protein, 10 aa, Entamoeba histolytica
GLNGSGKSNI

SEQ ID NO: 2622984 - protein, 6 aa, Entamoeba histolytica
GLNSNR

SEQ ID NO: 2622985 - protein, 17 aa, Entamoeba histolytica
GLNTTYDPDNGEDEYFE

SEQ ID NO: 2622986 - protein, 5 aa, Entamoeba histolytica
GLPAK

SEQ ID NO: 2622987 - protein, 5 aa, Entamoeba histolytica
GLPEF

SEQ ID NO: 2622988 - protein, 5 aa, Entamoeba histolytica
GLPEP

SEQ ID NO: 2622989 - protein, 12 aa, Entamoeba histolytica
GLPGEDDINAKE

SEQ ID NO: 2622990 - protein, 57 aa, Entamoeba histolytica
GLPKETDTTPGSYNSSVSSYAAPTASSSNNYSAPPMKSAPPAPQVAAPPPPKPKLPQ

SEQ ID NO: 2622991 - protein, 12 aa, Entamoeba histolytica
GLPKKGGEIGEY

SEQ ID NO: 2622992 - protein, 32 aa, Entamoeba histolytica
GLPPLGVNAPQEETVTEVEQVGEKKKRKRQKK

SEQ ID NO: 2622993 - protein, 6 aa, Entamoeba histolytica
GLPPQQ

SEQ ID NO: 2622994 - protein, 12 aa, Entamoeba histolytica
GLPQNVSQDLST

SEQ ID NO: 2622995 - protein, 9 aa, Entamoeba histolytica
GLPQQTGQP

SEQ ID NO: 2622996 - protein, 6 aa, Entamoeba histolytica
GLPRGS

SEQ ID NO: 2622997 - protein, 5 aa, Entamoeba histolytica
GLPSE

SEQ ID NO: 2622998 - protein, 7 aa, Entamoeba histolytica
GLQPDAR

SEQ ID NO: 2622999 - protein, 6 aa, Entamoeba histolytica
GLQPNT

SEQ ID NO: 2623000 - protein, 13 aa, Entamoeba histolytica
GLQSSKPEESWNE

SEQ ID NO: 2623001 - protein, 4 aa, Entamoeba histolytica
GLRH

SEQ ID NO: 2623002 - protein, 4 aa, Entamoeba histolytica
GLRP

SEQ ID NO: 2623003 - protein, 21 aa, Entamoeba histolytica
GLRSKRNERIDDRRKKREQLM

SEQ ID NO: 2623004 - protein, 11 aa, Entamoeba histolytica
GLSDNPFEGID

SEQ ID NO: 2623005 - protein, 9 aa, Entamoeba histolytica
GLSDPESEI

SEQ ID NO: 2623006 - protein, 21 aa, Entamoeba histolytica
GLSEEEAEKKVDKRWKKAGHE

SEQ ID NO: 2623007 - protein, 10 aa, Entamoeba histolytica
GLSGGEAKDD

SEQ ID NO: 2623008 - protein, 5 aa, Entamoeba histolytica
GLSIP

SEQ ID NO: 2623009 - protein, 6 aa, Entamoeba histolytica
GLSIPK

SEQ ID NO: 2623010 - protein, 13 aa, Entamoeba histolytica
GLSKCDSKTELSN

SEQ ID NO: 2623011 - protein, 15 aa, Entamoeba histolytica
GLSKGGQSVANARQQ

SEQ ID NO: 2623012 - protein, 5 aa, Entamoeba histolytica
GLSNE

SEQ ID NO: 2623013 - protein, 9 aa, Entamoeba histolytica
GLSPDKINE

SEQ ID NO: 2623014 - protein, 8 aa, Entamoeba histolytica
GLSPEQKK

SEQ ID NO: 2623015 - protein, 7 aa, Entamoeba histolytica
GLSPNEQ

SEQ ID NO: 2623016 - protein, 6 aa, Entamoeba histolytica
GLSQNE

SEQ ID NO: 2623017 - protein, 6 aa, Entamoeba histolytica
GLSREI

SEQ ID NO: 2623018 - protein, 7 aa, Entamoeba histolytica
GLSSLGN

SEQ ID NO: 2623019 - protein, 7 aa, Entamoeba histolytica
GLSSNAL

SEQ ID NO: 2623020 - protein, 13 aa, Entamoeba histolytica
GLSTSVDPHTETT

SEQ ID NO: 2623021 - protein, 10 aa, Entamoeba histolytica
GLSTTKNGIR

SEQ ID NO: 2623022 - protein, 4 aa, Entamoeba histolytica
GLSV

SEQ ID NO: 2623023 - protein, 12 aa, Entamoeba histolytica
GLTEKDQTNTFC

SEQ ID NO: 2623024 - protein, 6 aa, Entamoeba histolytica
GLTETQ

SEQ ID NO: 2623025 - protein, 9 aa, Entamoeba histolytica
GLTKRDNYI

SEQ ID NO: 2623026 - protein, 10 aa, Entamoeba histolytica
GLTPAESAIN

SEQ ID NO: 2623027 - protein, 8 aa, Entamoeba histolytica
GLTPGGRV

SEQ ID NO: 2623028 - protein, 11 aa, Entamoeba histolytica
GLTPRDVTNSG

SEQ ID NO: 2623029 - protein, 6 aa, Entamoeba histolytica
GLTSAE

SEQ ID NO: 2623030 - protein, 11 aa, Entamoeba histolytica
GLTSDKARHAK

SEQ ID NO: 2623031 - protein, 10 aa, Entamoeba histolytica
GLTSDKASHA

SEQ ID NO: 2623032 - protein, 8 aa, Entamoeba histolytica
GLTSPNDG

SEQ ID NO: 2623033 - protein, 6 aa, Entamoeba histolytica
GLVESR

SEQ ID NO: 2623034 - protein, 11 aa, Entamoeba histolytica
GLYKTKEDFKK

SEQ ID NO: 2623035 - protein, 4 aa, Entamoeba histolytica
GLYP

SEQ ID NO: 2623036 - protein, 6 aa, Entamoeba histolytica
GLYPPS

SEQ ID NO: 2623037 - protein, 7 aa, Entamoeba histolytica
GMAPPSY

SEQ ID NO: 2623038 - protein, 11 aa, Entamoeba histolytica
GMASPAGYRTA

SEQ ID NO: 2623039 - protein, 10 aa, Entamoeba histolytica
GMDTKGDGEG

SEQ ID NO: 2623040 - protein, 5 aa, Entamoeba histolytica
GMDYT

SEQ ID NO: 2623041 - protein, 8 aa, Entamoeba histolytica
GMEETQRK

SEQ ID NO: 2623042 - protein, 5 aa, Entamoeba histolytica
GMEPS

SEQ ID NO: 2623043 - protein, 6 aa, Entamoeba histolytica
GMETGE

SEQ ID NO: 2623044 - protein, 15 aa, Entamoeba histolytica
GMGGFGQQPNNSMGG

SEQ ID NO: 2623045 - protein, 11 aa, Entamoeba histolytica
GMGKRPATSAH

SEQ ID NO: 2623046 - protein, 7 aa, Entamoeba histolytica
GMGTGSA

SEQ ID NO: 2623047 - protein, 8 aa, Entamoeba histolytica
GMGTGSTE

SEQ ID NO: 2623048 - protein, 6 aa, Entamoeba histolytica
GMISTK

SEQ ID NO: 2623049 - protein, 6 aa, Entamoeba histolytica
GMKEEE

SEQ ID NO: 2623050 - protein, 7 aa, Entamoeba histolytica
GMKPQTI

SEQ ID NO: 2623051 - protein, 6 aa, Entamoeba histolytica
GMKRTS

SEQ ID NO: 2623052 - protein, 11 aa, Entamoeba histolytica
GMKSEERETIQ

SEQ ID NO: 2623053 - protein, 5 aa, Entamoeba histolytica
GMNDT

SEQ ID NO: 2623054 - protein, 5 aa, Entamoeba histolytica
GMNDY

SEQ ID NO: 2623055 - protein, 13 aa, Entamoeba histolytica
GMNEAQKRSVQQV

SEQ ID NO: 2623056 - protein, 8 aa, Entamoeba histolytica
GMNEEEEI

SEQ ID NO: 2623057 - protein, 17 aa, Entamoeba histolytica
GMNTTYDPDNGEDEYFE

SEQ ID NO: 2623058 - protein, 5 aa, Entamoeba histolytica
GMPGG

SEQ ID NO: 2623059 - protein, 13 aa, Entamoeba histolytica
GMPIRKSPGNYGD

SEQ ID NO: 2623060 - protein, 46 aa, Entamoeba histolytica
GMPPQGYPPMQQPGMPPMGYPPMQQPGMPPQGYPPMGYPPMQPGAQ

SEQ ID NO: 2623061 - protein, 33 aa, Entamoeba histolytica
GMPQGGRYTFNTGDDSSMDEGFGKQKGEDVTSN

SEQ ID NO: 2623062 - protein, 8 aa, Entamoeba histolytica
GMQGPYKG

SEQ ID NO: 2623063 - protein, 6 aa, Entamoeba histolytica
GMQPPT

SEQ ID NO: 2623064 - protein, 6 aa, Entamoeba histolytica
GMRPNV

SEQ ID NO: 2623065 - protein, 6 aa, Entamoeba histolytica
GMRSYT

SEQ ID NO: 2623066 - protein, 10 aa, Entamoeba histolytica
GMSGESESKI

SEQ ID NO: 2623067 - protein, 8 aa, Entamoeba histolytica
GMSKQTNQ

SEQ ID NO: 2623068 - protein, 9 aa, Entamoeba histolytica
GMSTETNGL

SEQ ID NO: 2623069 - protein, 14 aa, Entamoeba histolytica
GMTKYEKLDDEEIR

SEQ ID NO: 2623070 - protein, 6 aa, Entamoeba histolytica
GMTPSI

SEQ ID NO: 2623071 - protein, 7 aa, Entamoeba histolytica
GMTTNNN

SEQ ID NO: 2623072 - protein, 4 aa, Entamoeba histolytica
GMYG

SEQ ID NO: 2623073 - protein, 7 aa, Entamoeba histolytica
GNAASQV

SEQ ID NO: 2623074 - protein, 9 aa, Entamoeba histolytica
GNADPRSTV

SEQ ID NO: 2623075 - protein, 18 aa, Entamoeba histolytica
GNAEVTNNKRGKGTYEKA

SEQ ID NO: 2623076 - protein, 10 aa, Entamoeba histolytica
GNAFTQKSDV

SEQ ID NO: 2623077 - protein, 8 aa, Entamoeba histolytica
GNAGDSRS

SEQ ID NO: 2623078 - protein, 6 aa, Entamoeba histolytica
GNAGYG

SEQ ID NO: 2623079 - protein, 9 aa, Entamoeba histolytica
GNAPTGDPF

SEQ ID NO: 2623080 - protein, 13 aa, Entamoeba histolytica
GNAQPTEDELEGY

SEQ ID NO: 2623081 - protein, 9 aa, Entamoeba histolytica
GNASDDKIQ

SEQ ID NO: 2623082 - protein, 13 aa, Entamoeba histolytica
GNATNMNLEETED

SEQ ID NO: 2623083 - protein, 4 aa, Entamoeba histolytica
GNCE

SEQ ID NO: 2623084 - protein, 5 aa, Entamoeba histolytica
GNCGG

SEQ ID NO: 2623085 - protein, 6 aa, Entamoeba histolytica
GNCGGT

SEQ ID NO: 2623086 - protein, 6 aa, Entamoeba histolytica
GNCHQR

SEQ ID NO: 2623087 - protein, 5 aa, Entamoeba histolytica
GNCPG

SEQ ID NO: 2623088 - protein, 8 aa, Entamoeba histolytica
GNCTGGHY

SEQ ID NO: 2623089 - protein, 4 aa, Entamoeba histolytica
GNDA

SEQ ID NO: 2623090 - protein, 5 aa, Entamoeba histolytica
GNDGT

SEQ ID NO: 2623091 - protein, 4 aa, Entamoeba histolytica
GNDI

SEQ ID NO: 2623092 - protein, 7 aa, Entamoeba histolytica
GNDIDQR

SEQ ID NO: 2623093 - protein, 5 aa, Entamoeba histolytica
GNDIY

SEQ ID NO: 2623094 - protein, 4 aa, Entamoeba histolytica
GNDL

SEQ ID NO: 2623095 - protein, 13 aa, Entamoeba histolytica
GNDLINKDKHGNT

SEQ ID NO: 2623096 - protein, 5 aa, Entamoeba histolytica
GNDNA

SEQ ID NO: 2623097 - protein, 11 aa, Entamoeba histolytica
GNDNEIKTQTL

SEQ ID NO: 2623098 - protein, 6 aa, Entamoeba histolytica
GNDNYS

SEQ ID NO: 2623099 - protein, 4 aa, Entamoeba histolytica
GNDQ

SEQ ID NO: 2623100 - protein, 5 aa, Entamoeba histolytica
GNDRQ

SEQ ID NO: 2623101 - protein, 8 aa, Entamoeba histolytica
GNDSSSTD

SEQ ID NO: 2623102 - protein, 8 aa, Entamoeba histolytica
GNDSVTQY

SEQ ID NO: 2623103 - protein, 4 aa, Entamoeba histolytica
GNDT

SEQ ID NO: 2623104 - protein, 4 aa, Entamoeba histolytica
GNDV

SEQ ID NO: 2623105 - protein, 15 aa, Entamoeba histolytica
GNEDSPENIKKYEKY

SEQ ID NO: 2623106 - protein, 5 aa, Entamoeba histolytica
GNEDV

SEQ ID NO: 2623107 - protein, 18 aa, Entamoeba histolytica
GNEEEDNIKKKTKSIWDD

SEQ ID NO: 2623108 - protein, 24 aa, Entamoeba histolytica
GNEEEEEPEKLDEEELKRKRKKEI

SEQ ID NO: 2623109 - protein, 7 aa, Entamoeba histolytica
GNEEEIR

SEQ ID NO: 2623110 - protein, 11 aa, Entamoeba histolytica
GNEEESESREI

SEQ ID NO: 2623111 - protein, 7 aa, Entamoeba histolytica
GNEELSD

SEQ ID NO: 2623112 - protein, 6 aa, Entamoeba histolytica
GNEELV

SEQ ID NO: 2623113 - protein, 5 aa, Entamoeba histolytica
GNEEM

SEQ ID NO: 2623114 - protein, 5 aa, Entamoeba histolytica
GNEEN

SEQ ID NO: 2623115 - protein, 16 aa, Entamoeba histolytica
GNEEPQQIKKELTGSI

SEQ ID NO: 2623116 - protein, 10 aa, Entamoeba histolytica
GNEFSNEAAQ

SEQ ID NO: 2623117 - protein, 4 aa, Entamoeba histolytica
GNEG

SEQ ID NO: 2623118 - protein, 5 aa, Entamoeba histolytica
GNEIE

SEQ ID NO: 2623119 - protein, 5 aa, Entamoeba histolytica
GNEIN

SEQ ID NO: 2623120 - protein, 7 aa, Entamoeba histolytica
GNEIPNS

SEQ ID NO: 2623121 - protein, 4 aa, Entamoeba histolytica
GNEK

SEQ ID NO: 2623122 - protein, 8 aa, Entamoeba histolytica
GNEKSEFN

SEQ ID NO: 2623123 - protein, 5 aa, Entamoeba histolytica
GNEKV

SEQ ID NO: 2623124 - protein, 5 aa, Entamoeba histolytica
GNELP

SEQ ID NO: 2623125 - protein, 4 aa, Entamoeba histolytica
GNEN

SEQ ID NO: 2623126 - protein, 20 aa, Entamoeba histolytica
GNENEGDGEVGMPELSKSGK

SEQ ID NO: 2623127 - protein, 5 aa, Entamoeba histolytica
GNENI

SEQ ID NO: 2623128 - protein, 5 aa, Entamoeba histolytica
GNENL

SEQ ID NO: 2623129 - protein, 4 aa, Entamoeba histolytica
GNEQ

SEQ ID NO: 2623130 - protein, 6 aa, Entamoeba histolytica
GNEQYR

SEQ ID NO: 2623131 - protein, 9 aa, Entamoeba histolytica
GNESDEITV

SEQ ID NO: 2623132 - protein, 16 aa, Entamoeba histolytica
GNESTPLKKTVSNNTH

SEQ ID NO: 2623133 - protein, 6 aa, Entamoeba histolytica
GNESVD

SEQ ID NO: 2623134 - protein, 6 aa, Entamoeba histolytica
GNETID

SEQ ID NO: 2623135 - protein, 16 aa, Entamoeba histolytica
GNETNAATGKISDTGI

SEQ ID NO: 2623136 - protein, 13 aa, Entamoeba histolytica
GNETPASKSRLPL

SEQ ID NO: 2623137 - protein, 15 aa, Entamoeba histolytica
GNETYDEIVQLIKNE

SEQ ID NO: 2623138 - protein, 21 aa, Entamoeba histolytica
GNFDDEPEEENGVNDEIAEKT

SEQ ID NO: 2623139 - protein, 6 aa, Entamoeba histolytica
GNFDED

SEQ ID NO: 2623140 - protein, 17 aa, Entamoeba histolytica
GNFETNTTTDLQQTNGF

SEQ ID NO: 2623141 - protein, 5 aa, Entamoeba histolytica
GNFPK

SEQ ID NO: 2623142 - protein, 4 aa, Entamoeba histolytica
GNFT

SEQ ID NO: 2623143 - protein, 5 aa, Entamoeba histolytica
GNGAS

SEQ ID NO: 2623144 - protein, 4 aa, Entamoeba histolytica
GNGC

SEQ ID NO: 2623145 - protein, 12 aa, Entamoeba histolytica
GNGCKGKTPKKF

SEQ ID NO: 2623146 - protein, 7 aa, Entamoeba histolytica
GNGDHPI

SEQ ID NO: 2623147 - protein, 8 aa, Entamoeba histolytica
GNGEGGND

SEQ ID NO: 2623148 - protein, 6 aa, Entamoeba histolytica
GNGESV

SEQ ID NO: 2623149 - protein, 9 aa, Entamoeba histolytica
GNGGGKGSI

SEQ ID NO: 2623150 - protein, 12 aa, Entamoeba histolytica
GNGIEKGNDGSK

SEQ ID NO: 2623151 - protein, 6 aa, Entamoeba histolytica
GNGIIH

SEQ ID NO: 2623152 - protein, 5 aa, Entamoeba histolytica
GNGIK

SEQ ID NO: 2623153 - protein, 48 aa, Entamoeba histolytica
GNGLGTNSLGGNGLGTNTMGGNTFGTNSLGGNTFGTNSLGGNGLGTNV

SEQ ID NO: 2623154 - protein, 6 aa, Entamoeba histolytica
GNGLTK

SEQ ID NO: 2623155 - protein, 7 aa, Entamoeba histolytica
GNGNYRS

SEQ ID NO: 2623156 - protein, 9 aa, Entamoeba histolytica
GNGPNEKKL

SEQ ID NO: 2623157 - protein, 10 aa, Entamoeba histolytica
GNGTLKDEKS

SEQ ID NO: 2623158 - protein, 8 aa, Entamoeba histolytica
GNGVEKND

SEQ ID NO: 2623159 - protein, 7 aa, Entamoeba histolytica
GNHDPTT

SEQ ID NO: 2623160 - protein, 4 aa, Entamoeba histolytica
GNHE

SEQ ID NO: 2623161 - protein, 10 aa, Entamoeba histolytica
GNHEDKELNT

SEQ ID NO: 2623162 - protein, 7 aa, Entamoeba histolytica
GNHETRA

SEQ ID NO: 2623163 - protein, 8 aa, Entamoeba histolytica
GNHNQYGK

SEQ ID NO: 2623164 - protein, 8 aa, Entamoeba histolytica
GNHRTRGD

SEQ ID NO: 2623165 - protein, 6 aa, Entamoeba histolytica
GNHYPS

SEQ ID NO: 2623166 - protein, 13 aa, Entamoeba histolytica
GNIDEKTKSNQKI

SEQ ID NO: 2623167 - protein, 5 aa, Entamoeba histolytica
GNIDQ

SEQ ID NO: 2623168 - protein, 20 aa, Entamoeba histolytica
GNIEESQHHRVTNNQSFEQR

SEQ ID NO: 2623169 - protein, 22 aa, Entamoeba histolytica
GNIEPISPSKRRNSLTSFNESR

SEQ ID NO: 2623170 - protein, 4 aa, Entamoeba histolytica
GNIH

SEQ ID NO: 2623171 - protein, 5 aa, Entamoeba histolytica
GNINN

SEQ ID NO: 2623172 - protein, 15 aa, Entamoeba histolytica
GNIPNKIGTQSIDTA

SEQ ID NO: 2623173 - protein, 5 aa, Entamoeba histolytica
GNISY

SEQ ID NO: 2623174 - protein, 12 aa, Entamoeba histolytica
GNITGGVPDNDI

SEQ ID NO: 2623175 - protein, 6 aa, Entamoeba histolytica
GNITRD

SEQ ID NO: 2623176 - protein, 10 aa, Entamoeba histolytica
GNKAFKQAGF

SEQ ID NO: 2623177 - protein, 4 aa, Entamoeba histolytica
GNKC

SEQ ID NO: 2623178 - protein, 22 aa, Entamoeba histolytica
GNKDVDEVNEIEDYPRKYVKEE

SEQ ID NO: 2623179 - protein, 9 aa, Entamoeba histolytica
GNKEERTNM

SEQ ID NO: 2623180 - protein, 7 aa, Entamoeba histolytica
GNKEEYT

SEQ ID NO: 2623181 - protein, 5 aa, Entamoeba histolytica
GNKEQ

SEQ ID NO: 2623182 - protein, 12 aa, Entamoeba histolytica
GNKFDNVPTPIP

SEQ ID NO: 2623183 - protein, 9 aa, Entamoeba histolytica
GNKGEEPMD

SEQ ID NO: 2623184 - protein, 6 aa, Entamoeba histolytica
GNKIGE

SEQ ID NO: 2623185 - protein, 7 aa, Entamoeba histolytica
GNKKGTI

SEQ ID NO: 2623186 - protein, 8 aa, Entamoeba histolytica
GNKKRGQL

SEQ ID NO: 2623187 - protein, 13 aa, Entamoeba histolytica
GNKKSVKSTPQNT

SEQ ID NO: 2623188 - protein, 6 aa, Entamoeba histolytica
GNKLNT

SEQ ID NO: 2623189 - protein, 9 aa, Entamoeba histolytica
GNKNEEKLL

SEQ ID NO: 2623190 - protein, 7 aa, Entamoeba histolytica
GNKRAKE

SEQ ID NO: 2623191 - protein, 9 aa, Entamoeba histolytica
GNKRNEAKQ

SEQ ID NO: 2623192 - protein, 6 aa, Entamoeba histolytica
GNKSEA

SEQ ID NO: 2623193 - protein, 24 aa, Entamoeba histolytica
GNKSGQLQIDETRKTNDEIEEIPT

SEQ ID NO: 2623194 - protein, 5 aa, Entamoeba histolytica
GNKYR

SEQ ID NO: 2623195 - protein, 4 aa, Entamoeba histolytica
GNLE

SEQ ID NO: 2623196 - protein, 6 aa, Entamoeba histolytica
GNLETS

SEQ ID NO: 2623197 - protein, 64 aa, Entamoeba histolytica
GNLIEPGDDEEWEYEEDEIEEEKPEETEENNKGNEPKEDNESNETENGEKEQEVDNEKEEEEKK

SEQ ID NO: 2623198 - protein, 8 aa, Entamoeba histolytica
GNLPPQQI

SEQ ID NO: 2623199 - protein, 10 aa, Entamoeba histolytica
GNLPSKASKI

SEQ ID NO: 2623200 - protein, 7 aa, Entamoeba histolytica
GNLRPTS

SEQ ID NO: 2623201 - protein, 12 aa, Entamoeba histolytica
GNLSNQQQSTPF

SEQ ID NO: 2623202 - protein, 7 aa, Entamoeba histolytica
GNLSSTL

SEQ ID NO: 2623203 - protein, 15 aa, Entamoeba histolytica
GNLSSYDSTMSNNTK

SEQ ID NO: 2623204 - protein, 9 aa, Entamoeba histolytica
GNLSTDSDN

SEQ ID NO: 2623205 - protein, 10 aa, Entamoeba histolytica
GNLTTLKPRP

SEQ ID NO: 2623206 - protein, 4 aa, Entamoeba histolytica
GNLY

SEQ ID NO: 2623207 - protein, 5 aa, Entamoeba histolytica
GNLYN

SEQ ID NO: 2623208 - protein, 9 aa, Entamoeba histolytica
GNMNPTDRS

SEQ ID NO: 2623209 - protein, 9 aa, Entamoeba histolytica
GNMPKVSSA

SEQ ID NO: 2623210 - protein, 12 aa, Entamoeba histolytica
GNNDKKNDADES

SEQ ID NO: 2623211 - protein, 4 aa, Entamoeba histolytica
GNNE

SEQ ID NO: 2623212 - protein, 11 aa, Entamoeba histolytica
GNNEQQQLSPI

SEQ ID NO: 2623213 - protein, 23 aa, Entamoeba histolytica
GNNERRIKRDKPYNKRKKQIVSS

SEQ ID NO: 2623214 - protein, 6 aa, Entamoeba histolytica
GNNIAE

SEQ ID NO: 2623215 - protein, 6 aa, Entamoeba histolytica
GNNIEK

SEQ ID NO: 2623216 - protein, 7 aa, Entamoeba histolytica
GNNIKPM

SEQ ID NO: 2623217 - protein, 10 aa, Entamoeba histolytica
GNNKEQRSEG

SEQ ID NO: 2623218 - protein, 23 aa, Entamoeba histolytica
GNNKKENSSSSTSDYDDGEDTTL

SEQ ID NO: 2623219 - protein, 10 aa, Entamoeba histolytica
GNNKLESKAL

SEQ ID NO: 2623220 - protein, 6 aa, Entamoeba histolytica
GNNKSE

SEQ ID NO: 2623221 - protein, 4 aa, Entamoeba histolytica
GNNL

SEQ ID NO: 2623222 - protein, 19 aa, Entamoeba histolytica
GNNLERKRNISNKENTKSI

SEQ ID NO: 2623223 - protein, 9 aa, Entamoeba histolytica
GNNLPETNL

SEQ ID NO: 2623224 - protein, 4 aa, Entamoeba histolytica
GNNN

SEQ ID NO: 2623225 - protein, 6 aa, Entamoeba histolytica
GNNNAA

SEQ ID NO: 2623226 - protein, 11 aa, Entamoeba histolytica
GNNPKTKSKKK

SEQ ID NO: 2623227 - protein, 8 aa, Entamoeba histolytica
GNNQNDAS

SEQ ID NO: 2623228 - protein, 6 aa, Entamoeba histolytica
GNNQWN

SEQ ID NO: 2623229 - protein, 4 aa, Entamoeba histolytica
GNNR

SEQ ID NO: 2623230 - protein, 6 aa, Entamoeba histolytica
GNNSDI

SEQ ID NO: 2623231 - protein, 5 aa, Entamoeba histolytica
GNNSI

SEQ ID NO: 2623232 - protein, 5 aa, Entamoeba histolytica
GNNTL

SEQ ID NO: 2623233 - protein, 21 aa, Entamoeba histolytica
GNNTSFGNTNIPNFGSSTNNV

SEQ ID NO: 2623234 - protein, 7 aa, Entamoeba histolytica
GNNVGYV

SEQ ID NO: 2623235 - protein, 4 aa, Entamoeba histolytica
GNNY

SEQ ID NO: 2623236 - protein, 25 aa, Entamoeba histolytica
GNPARVKRRVSEHPGWTIENRDVPL

SEQ ID NO: 2623237 - protein, 6 aa, Entamoeba histolytica
GNPDLE

SEQ ID NO: 2623238 - protein, 10 aa, Entamoeba histolytica
GNPDLHANES

SEQ ID NO: 2623239 - protein, 9 aa, Entamoeba histolytica
GNPDYEKTH

SEQ ID NO: 2623240 - protein, 20 aa, Entamoeba histolytica
GNPGEDSYQRKISLLCVDAP

SEQ ID NO: 2623241 - protein, 7 aa, Entamoeba histolytica
GNPNGPI

SEQ ID NO: 2623242 - protein, 12 aa, Entamoeba histolytica
GNPNIRDGSAFY

SEQ ID NO: 2623243 - protein, 5 aa, Entamoeba histolytica
GNPNS

SEQ ID NO: 2623244 - protein, 7 aa, Entamoeba histolytica
GNPNWQA

SEQ ID NO: 2623245 - protein, 6 aa, Entamoeba histolytica
GNPPLR

SEQ ID NO: 2623246 - protein, 6 aa, Entamoeba histolytica
GNPPSA

SEQ ID NO: 2623247 - protein, 7 aa, Entamoeba histolytica
GNPPYYD

SEQ ID NO: 2623248 - protein, 4 aa, Entamoeba histolytica
GNPR

SEQ ID NO: 2623249 - protein, 7 aa, Entamoeba histolytica
GNPSAEQ

SEQ ID NO: 2623250 - protein, 12 aa, Entamoeba histolytica
GNPSDANKMTTE

SEQ ID NO: 2623251 - protein, 6 aa, Entamoeba histolytica
GNPSIP

SEQ ID NO: 2623252 - protein, 4 aa, Entamoeba histolytica
GNPT

SEQ ID NO: 2623253 - protein, 7 aa, Entamoeba histolytica
GNPTAEM

SEQ ID NO: 2623254 - protein, 7 aa, Entamoeba histolytica
GNPTTGY

SEQ ID NO: 2623255 - protein, 4 aa, Entamoeba histolytica
GNPV

SEQ ID NO: 2623256 - protein, 17 aa, Entamoeba histolytica
GNPVQSQNTQPQPQKDI

SEQ ID NO: 2623257 - protein, 6 aa, Entamoeba histolytica
GNPYSG

SEQ ID NO: 2623258 - protein, 6 aa, Entamoeba histolytica
GNQDPY

SEQ ID NO: 2623259 - protein, 9 aa, Entamoeba histolytica
GNQETDGYG

SEQ ID NO: 2623260 - protein, 9 aa, Entamoeba histolytica
GNQIQQEDQ

SEQ ID NO: 2623261 - protein, 6 aa, Entamoeba histolytica
GNQIRR

SEQ ID NO: 2623262 - protein, 4 aa, Entamoeba histolytica
GNQK

SEQ ID NO: 2623263 - protein, 5 aa, Entamoeba histolytica
GNQLP

SEQ ID NO: 2623264 - protein, 6 aa, Entamoeba histolytica
GNQPAA

SEQ ID NO: 2623265 - protein, 7 aa, Entamoeba histolytica
GNQSRTS

SEQ ID NO: 2623266 - protein, 15 aa, Entamoeba histolytica
GNQTPPVNSNKQALQ

SEQ ID NO: 2623267 - protein, 5 aa, Entamoeba histolytica
GNQVG

SEQ ID NO: 2623268 - protein, 13 aa, Entamoeba histolytica
GNRGLPDNFDTDK

SEQ ID NO: 2623269 - protein, 4 aa, Entamoeba histolytica
GNRK

SEQ ID NO: 2623270 - protein, 4 aa, Entamoeba histolytica
GNRL

SEQ ID NO: 2623271 - protein, 7 aa, Entamoeba histolytica
GNRREKG

SEQ ID NO: 2623272 - protein, 5 aa, Entamoeba histolytica
GNRTI

SEQ ID NO: 2623273 - protein, 12 aa, Entamoeba histolytica
GNSDFTKKKAEK

SEQ ID NO: 2623274 - protein, 7 aa, Entamoeba histolytica
GNSGRGV

SEQ ID NO: 2623275 - protein, 20 aa, Entamoeba histolytica
GNSHKIGGYQSTKTPKTGSW

SEQ ID NO: 2623276 - protein, 5 aa, Entamoeba histolytica
GNSHL

SEQ ID NO: 2623277 - protein, 7 aa, Entamoeba histolytica
GNSHNET

SEQ ID NO: 2623278 - protein, 5 aa, Entamoeba histolytica
GNSIS

SEQ ID NO: 2623279 - protein, 6 aa, Entamoeba histolytica
GNSIYQ

SEQ ID NO: 2623280 - protein, 18 aa, Entamoeba histolytica
GNSKGGEQSSGSVEPTET

SEQ ID NO: 2623281 - protein, 7 aa, Entamoeba histolytica
GNSLAEN

SEQ ID NO: 2623282 - protein, 7 aa, Entamoeba histolytica
GNSLSRQ

SEQ ID NO: 2623283 - protein, 4 aa, Entamoeba histolytica
GNSN

SEQ ID NO: 2623284 - protein, 10 aa, Entamoeba histolytica
GNSNGYSRDK

SEQ ID NO: 2623285 - protein, 6 aa, Entamoeba histolytica
GNSNIP

SEQ ID NO: 2623286 - protein, 5 aa, Entamoeba histolytica
GNSPL

SEQ ID NO: 2623287 - protein, 7 aa, Entamoeba histolytica
GNSPMNE

SEQ ID NO: 2623288 - protein, 5 aa, Entamoeba histolytica
GNSQP

SEQ ID NO: 2623289 - protein, 6 aa, Entamoeba histolytica
GNSQPI

SEQ ID NO: 2623290 - protein, 6 aa, Entamoeba histolytica
GNSQTI

SEQ ID NO: 2623291 - protein, 11 aa, Entamoeba histolytica
GNSSDSINQEQ

SEQ ID NO: 2623292 - protein, 5 aa, Entamoeba histolytica
GNSSN

SEQ ID NO: 2623293 - protein, 8 aa, Entamoeba histolytica
GNSTELSS

SEQ ID NO: 2623294 - protein, 17 aa, Entamoeba histolytica
GNSTGNVSLVKLTDMPG

SEQ ID NO: 2623295 - protein, 7 aa, Entamoeba histolytica
GNSTTEI

SEQ ID NO: 2623296 - protein, 11 aa, Entamoeba histolytica
GNSVSGCSNTD

SEQ ID NO: 2623297 - protein, 4 aa, Entamoeba histolytica
GNTA

SEQ ID NO: 2623298 - protein, 10 aa, Entamoeba histolytica
GNTANKSYEI

SEQ ID NO: 2623299 - protein, 6 aa, Entamoeba histolytica
GNTDIT

SEQ ID NO: 2623300 - protein, 6 aa, Entamoeba histolytica
GNTEGC

SEQ ID NO: 2623301 - protein, 7 aa, Entamoeba histolytica
GNTEQDV

SEQ ID NO: 2623302 - protein, 4 aa, Entamoeba histolytica
GNTG

SEQ ID NO: 2623303 - protein, 13 aa, Entamoeba histolytica
GNTGDPGVEKSLD

SEQ ID NO: 2623304 - protein, 7 aa, Entamoeba histolytica
GNTIDDR

SEQ ID NO: 2623305 - protein, 6 aa, Entamoeba histolytica
GNTIET

SEQ ID NO: 2623306 - protein, 9 aa, Entamoeba histolytica
GNTKPNEIS

SEQ ID NO: 2623307 - protein, 45 aa, Entamoeba histolytica
GNTKTEEIEEKKIDYKPRQAIRTSKNQDNSFDESTQPNGSTQIPS

SEQ ID NO: 2623308 - protein, 4 aa, Entamoeba histolytica
GNTL

SEQ ID NO: 2623309 - protein, 10 aa, Entamoeba histolytica
GNTMDIASDP

SEQ ID NO: 2623310 - protein, 6 aa, Entamoeba histolytica
GNTPVQ

SEQ ID NO: 2623311 - protein, 10 aa, Entamoeba histolytica
GNTQPKGDKC

SEQ ID NO: 2623312 - protein, 10 aa, Entamoeba histolytica
GNTQVPKNAK

SEQ ID NO: 2623313 - protein, 8 aa, Entamoeba histolytica
GNTRKKTL

SEQ ID NO: 2623314 - protein, 10 aa, Entamoeba histolytica
GNTSLDDGSV

SEQ ID NO: 2623315 - protein, 4 aa, Entamoeba histolytica
GNTT

SEQ ID NO: 2623316 - protein, 19 aa, Entamoeba histolytica
GNTTKKTAKRRIQPTKRRE

SEQ ID NO: 2623317 - protein, 4 aa, Entamoeba histolytica
GNTV

SEQ ID NO: 2623318 - protein, 11 aa, Entamoeba histolytica
GNVEKSIPPKE

SEQ ID NO: 2623319 - protein, 12 aa, Entamoeba histolytica
GNVGDKASETEA

SEQ ID NO: 2623320 - protein, 6 aa, Entamoeba histolytica
GNVKKD

SEQ ID NO: 2623321 - protein, 5 aa, Entamoeba histolytica
GNVTK

SEQ ID NO: 2623322 - protein, 7 aa, Entamoeba histolytica
GNWNPAK

SEQ ID NO: 2623323 - protein, 4 aa, Entamoeba histolytica
GNYE

SEQ ID NO: 2623324 - protein, 7 aa, Entamoeba histolytica
GNYGDDY

SEQ ID NO: 2623325 - protein, 26 aa, Entamoeba histolytica
GNYIESDDDEWYDQTKKEDKGEELSS

SEQ ID NO: 2623326 - protein, 10 aa, Entamoeba histolytica
GNYKGAAEAL

SEQ ID NO: 2623327 - protein, 22 aa, Entamoeba histolytica
GNYPPKDTQSPRTHQRDPTTRY

SEQ ID NO: 2623328 - protein, 14 aa, Entamoeba histolytica
GNYPSYQSQPSIGI

SEQ ID NO: 2623329 - protein, 4 aa, Entamoeba histolytica
GNYR

SEQ ID NO: 2623330 - protein, 7 aa, Entamoeba histolytica
GNYTEYS

SEQ ID NO: 2623331 - protein, 5 aa, Entamoeba histolytica
GNYTL

SEQ ID NO: 2623332 - protein, 6 aa, Entamoeba histolytica
GNYTYQ

SEQ ID NO: 2623333 - protein, 5 aa, Entamoeba histolytica
GPAAM

SEQ ID NO: 2623334 - protein, 4 aa, Entamoeba histolytica
GPAG

SEQ ID NO: 2623335 - protein, 7 aa, Entamoeba histolytica
GPAHPTN

SEQ ID NO: 2623336 - protein, 4 aa, Entamoeba histolytica
GPAL

SEQ ID NO: 2623337 - protein, 9 aa, Entamoeba histolytica
GPARSGKTT

SEQ ID NO: 2623338 - protein, 5 aa, Entamoeba histolytica
GPDIN

SEQ ID NO: 2623339 - protein, 5 aa, Entamoeba histolytica
GPDIP

SEQ ID NO: 2623340 - protein, 11 aa, Entamoeba histolytica
GPDSSAPSPIY

SEQ ID NO: 2623341 - protein, 7 aa, Entamoeba histolytica
GPDTVSK

SEQ ID NO: 2623342 - protein, 5 aa, Entamoeba histolytica
GPECN

SEQ ID NO: 2623343 - protein, 14 aa, Entamoeba histolytica
GPEGIDKKKENQVD

SEQ ID NO: 2623344 - protein, 9 aa, Entamoeba histolytica
GPEGQNSFV

SEQ ID NO: 2623345 - protein, 9 aa, Entamoeba histolytica
GPEGSGKYT

SEQ ID NO: 2623346 - protein, 8 aa, Entamoeba histolytica
GPEKSGKS

SEQ ID NO: 2623347 - protein, 4 aa, Entamoeba histolytica
GPEM

SEQ ID NO: 2623348 - protein, 10 aa, Entamoeba histolytica
GPENGFMPSR

SEQ ID NO: 2623349 - protein, 9 aa, Entamoeba histolytica
GPESPENEF

SEQ ID NO: 2623350 - protein, 7 aa, Entamoeba histolytica
GPEVKNK

SEQ ID NO: 2623351 - protein, 8 aa, Entamoeba histolytica
GPFPNNEG

SEQ ID NO: 2623352 - protein, 13 aa, Entamoeba histolytica
GPFYPQPEKSKNE

SEQ ID NO: 2623353 - protein, 11 aa, Entamoeba histolytica
GPGAGKGTQCD

SEQ ID NO: 2623354 - protein, 11 aa, Entamoeba histolytica
GPGAGKGTQCQ

SEQ ID NO: 2623355 - protein, 8 aa, Entamoeba histolytica
GPGDVTGI

SEQ ID NO: 2623356 - protein, 6 aa, Entamoeba histolytica
GPGNVT

SEQ ID NO: 2623357 - protein, 7 aa, Entamoeba histolytica
GPGTGNL

SEQ ID NO: 2623358 - protein, 7 aa, Entamoeba histolytica
GPGVPSL

SEQ ID NO: 2623359 - protein, 30 aa, Entamoeba histolytica
GPHAQQKKKLVAEGKLEKYGKPNDKTPAEY

SEQ ID NO: 2623360 - protein, 9 aa, Entamoeba histolytica
GPHTTFEDE

SEQ ID NO: 2623361 - protein, 7 aa, Entamoeba histolytica
GPHVENP

SEQ ID NO: 2623362 - protein, 4 aa, Entamoeba histolytica
GPID

SEQ ID NO: 2623363 - protein, 4 aa, Entamoeba histolytica
GPIE

SEQ ID NO: 2623364 - protein, 6 aa, Entamoeba histolytica
GPIGEN

SEQ ID NO: 2623365 - protein, 6 aa, Entamoeba histolytica
GPKGYI

SEQ ID NO: 2623366 - protein, 8 aa, Entamoeba histolytica
GPKKGAAI

SEQ ID NO: 2623367 - protein, 7 aa, Entamoeba histolytica
GPKKNSL

SEQ ID NO: 2623368 - protein, 4 aa, Entamoeba histolytica
GPKT

SEQ ID NO: 2623369 - protein, 12 aa, Entamoeba histolytica
GPLPDQGTNNVS

SEQ ID NO: 2623370 - protein, 6 aa, Entamoeba histolytica
GPLPLP

SEQ ID NO: 2623371 - protein, 5 aa, Entamoeba histolytica
GPLSQ

SEQ ID NO: 2623372 - protein, 10 aa, Entamoeba histolytica
GPLSSKITNS

SEQ ID NO: 2623373 - protein, 15 aa, Entamoeba histolytica
GPLTRTPGERMERDE

SEQ ID NO: 2623374 - protein, 24 aa, Entamoeba histolytica
GPLTSGNKKTSSVSPTSVAVGGTS

SEQ ID NO: 2623375 - protein, 6 aa, Entamoeba histolytica
GPLTSS

SEQ ID NO: 2623376 - protein, 16 aa, Entamoeba histolytica
GPMNSSQEQESRLEEN

SEQ ID NO: 2623377 - protein, 5 aa, Entamoeba histolytica
GPMTC

SEQ ID NO: 2623378 - protein, 9 aa, Entamoeba histolytica
GPNANEDAL

SEQ ID NO: 2623379 - protein, 4 aa, Entamoeba histolytica
GPND

SEQ ID NO: 2623380 - protein, 5 aa, Entamoeba histolytica
GPNDK

SEQ ID NO: 2623381 - protein, 4 aa, Entamoeba histolytica
GPNE

SEQ ID NO: 2623382 - protein, 4 aa, Entamoeba histolytica
GPNG

SEQ ID NO: 2623383 - protein, 10 aa, Entamoeba histolytica
GPNGAGKSNL

SEQ ID NO: 2623384 - protein, 9 aa, Entamoeba histolytica
GPNGAGKSS

SEQ ID NO: 2623385 - protein, 8 aa, Entamoeba histolytica
GPNGCGKT

SEQ ID NO: 2623386 - protein, 8 aa, Entamoeba histolytica
GPNGKPNL

SEQ ID NO: 2623387 - protein, 6 aa, Entamoeba histolytica
GPNKTD

SEQ ID NO: 2623388 - protein, 4 aa, Entamoeba histolytica
GPNQ

SEQ ID NO: 2623389 - protein, 4 aa, Entamoeba histolytica
GPNR

SEQ ID NO: 2623390 - protein, 8 aa, Entamoeba histolytica
GPNSLTNQ

SEQ ID NO: 2623391 - protein, 9 aa, Entamoeba histolytica
GPNSTNIPG

SEQ ID NO: 2623392 - protein, 4 aa, Entamoeba histolytica
GPPE

SEQ ID NO: 2623393 - protein, 9 aa, Entamoeba histolytica
GPPGCGKTT

SEQ ID NO: 2623394 - protein, 18 aa, Entamoeba histolytica
GPPGNSKTMQAKALASEA

SEQ ID NO: 2623395 - protein, 10 aa, Entamoeba histolytica
GPPGSGKTTI

SEQ ID NO: 2623396 - protein, 8 aa, Entamoeba histolytica
GPPGTGKS

SEQ ID NO: 2623397 - protein, 9 aa, Entamoeba histolytica
GPPGTGKTM

SEQ ID NO: 2623398 - protein, 9 aa, Entamoeba histolytica
GPPGTGKTT

SEQ ID NO: 2623399 - protein, 7 aa, Entamoeba histolytica
GPPPTEM

SEQ ID NO: 2623400 - protein, 5 aa, Entamoeba histolytica
GPQEV

SEQ ID NO: 2623401 - protein, 7 aa, Entamoeba histolytica
GPQGSVR

SEQ ID NO: 2623402 - protein, 4 aa, Entamoeba histolytica
GPQL

SEQ ID NO: 2623403 - protein, 9 aa, Entamoeba histolytica
GPQQACTTR

SEQ ID NO: 2623404 - protein, 10 aa, Entamoeba histolytica
GPQRTQLSPS

SEQ ID NO: 2623405 - protein, 4 aa, Entamoeba histolytica
GPQT

SEQ ID NO: 2623406 - protein, 4 aa, Entamoeba histolytica
GPRQ

SEQ ID NO: 2623407 - protein, 4 aa, Entamoeba histolytica
GPRV

SEQ ID NO: 2623408 - protein, 8 aa, Entamoeba histolytica
GPRVENPD

SEQ ID NO: 2623409 - protein, 5 aa, Entamoeba histolytica
GPSAD

SEQ ID NO: 2623410 - protein, 8 aa, Entamoeba histolytica
GPSERPGK

SEQ ID NO: 2623411 - protein, 4 aa, Entamoeba histolytica
GPSF

SEQ ID NO: 2623412 - protein, 9 aa, Entamoeba histolytica
GPSGGGKTT

SEQ ID NO: 2623413 - protein, 6 aa, Entamoeba histolytica
GPSGLR

SEQ ID NO: 2623414 - protein, 8 aa, Entamoeba histolytica
GPSGTGKS

SEQ ID NO: 2623415 - protein, 6 aa, Entamoeba histolytica
GPSKQL

SEQ ID NO: 2623416 - protein, 6 aa, Entamoeba histolytica
GPSNKI

SEQ ID NO: 2623417 - protein, 10 aa, Entamoeba histolytica
GPSSSGKTTF

SEQ ID NO: 2623418 - protein, 68 aa, Entamoeba histolytica
GPSSSTSSGYRKGGNAAGPMASKGTWAATTDIGKTAAVGADTYEAGYRKGGNAAGPMASKGTWAATTD

SEQ ID NO: 2623419 - protein, 34 aa, Entamoeba histolytica
GPSSSTTSGYRRPGSDAAGPMASRGTWAATTDIG

SEQ ID NO: 2623420 - protein, 8 aa, Entamoeba histolytica
GPTGANEI

SEQ ID NO: 2623421 - protein, 9 aa, Entamoeba histolytica
GPTKEKSSI

SEQ ID NO: 2623422 - protein, 5 aa, Entamoeba histolytica
GPTLP

SEQ ID NO: 2623423 - protein, 10 aa, Entamoeba histolytica
GPTNGNVPGN

SEQ ID NO: 2623424 - protein, 8 aa, Entamoeba histolytica
GPTPTDIE

SEQ ID NO: 2623425 - protein, 4 aa, Entamoeba histolytica
GPTY

SEQ ID NO: 2623426 - protein, 11 aa, Entamoeba histolytica
GPVDDDYQGNE

SEQ ID NO: 2623427 - protein, 5 aa, Entamoeba histolytica
GPVDS

SEQ ID NO: 2623428 - protein, 6 aa, Entamoeba histolytica
GPVPSY

SEQ ID NO: 2623429 - protein, 5 aa, Entamoeba histolytica
GPVTI

SEQ ID NO: 2623430 - protein, 6 aa, Entamoeba histolytica
GPYEEG

SEQ ID NO: 2623431 - protein, 8 aa, Entamoeba histolytica
GPYLTSEE

SEQ ID NO: 2623432 - protein, 10 aa, Entamoeba histolytica
GPYSTNFTGN

SEQ ID NO: 2623433 - protein, 4 aa, Entamoeba histolytica
GQAG

SEQ ID NO: 2623434 - protein, 10 aa, Entamoeba histolytica
GQASNQSEFK

SEQ ID NO: 2623435 - protein, 4 aa, Entamoeba histolytica
GQCA

SEQ ID NO: 2623436 - protein, 6 aa, Entamoeba histolytica
GQCGVT

SEQ ID NO: 2623437 - protein, 12 aa, Entamoeba histolytica
GQDDEVIPEETK

SEQ ID NO: 2623438 - protein, 10 aa, Entamoeba histolytica
GQDESSRSCG

SEQ ID NO: 2623439 - protein, 61 aa, Entamoeba histolytica
GQDEVKETPKPAAQPQKEVAKPTTSTPAKQPTTPAKTPATVAPSTPSKTEPTPASPSKPKF

SEQ ID NO: 2623440 - protein, 23 aa, Entamoeba histolytica
GQDGFGNAEVPNTKLKPSSNRHA

SEQ ID NO: 2623441 - protein, 5 aa, Entamoeba histolytica
GQDIH

SEQ ID NO: 2623442 - protein, 13 aa, Entamoeba histolytica
GQDPKTIQTKPTI

SEQ ID NO: 2623443 - protein, 24 aa, Entamoeba histolytica
GQDRNFQNENNDALPEKKPFIKPK

SEQ ID NO: 2623444 - protein, 6 aa, Entamoeba histolytica
GQDVSY

SEQ ID NO: 2623445 - protein, 4 aa, Entamoeba histolytica
GQEA

SEQ ID NO: 2623446 - protein, 6 aa, Entamoeba histolytica
GQEAKP

SEQ ID NO: 2623447 - protein, 4 aa, Entamoeba histolytica
GQEF

SEQ ID NO: 2623448 - protein, 6 aa, Entamoeba histolytica
GQEGDI

SEQ ID NO: 2623449 - protein, 8 aa, Entamoeba histolytica
GQENAREA

SEQ ID NO: 2623450 - protein, 5 aa, Entamoeba histolytica
GQENL

SEQ ID NO: 2623451 - protein, 4 aa, Entamoeba histolytica
GQEQ

SEQ ID NO: 2623452 - protein, 6 aa, Entamoeba histolytica
GQERFR

SEQ ID NO: 2623453 - protein, 5 aa, Entamoeba histolytica
GQESF

SEQ ID NO: 2623454 - protein, 8 aa, Entamoeba histolytica
GQESQEAK

SEQ ID NO: 2623455 - protein, 5 aa, Entamoeba histolytica
GQESV

SEQ ID NO: 2623456 - protein, 9 aa, Entamoeba histolytica
GQETGFTPQ

SEQ ID NO: 2623457 - protein, 16 aa, Entamoeba histolytica
GQFGSRLGGGKDQAAA

SEQ ID NO: 2623458 - protein, 5 aa, Entamoeba histolytica
GQGAS

SEQ ID NO: 2623459 - protein, 6 aa, Entamoeba histolytica
GQGIKS

SEQ ID NO: 2623460 - protein, 7 aa, Entamoeba histolytica
GQGPSKL

SEQ ID NO: 2623461 - protein, 24 aa, Entamoeba histolytica
GQGSDEQLGGYGRHRNAKKWNKLS

SEQ ID NO: 2623462 - protein, 5 aa, Entamoeba histolytica
GQHAD

SEQ ID NO: 2623463 - protein, 9 aa, Entamoeba histolytica
GQHFSDEIT

SEQ ID NO: 2623464 - protein, 5 aa, Entamoeba histolytica
GQHIG

SEQ ID NO: 2623465 - protein, 13 aa, Entamoeba histolytica
GQHPDNIGIVLCR

SEQ ID NO: 2623466 - protein, 5 aa, Entamoeba histolytica
GQHYT

SEQ ID NO: 2623467 - protein, 10 aa, Entamoeba histolytica
GQIEKYSGHG

SEQ ID NO: 2623468 - protein, 19 aa, Entamoeba histolytica
GQIEPKQTAVSDHSSYKYE

SEQ ID NO: 2623469 - protein, 10 aa, Entamoeba histolytica
GQIGNKQVRN

SEQ ID NO: 2623470 - protein, 7 aa, Entamoeba histolytica
GQIIPEN

SEQ ID NO: 2623471 - protein, 5 aa, Entamoeba histolytica
GQIIQ

SEQ ID NO: 2623472 - protein, 5 aa, Entamoeba histolytica
GQIIS

SEQ ID NO: 2623473 - protein, 8 aa, Entamoeba histolytica
GQINGAPR

SEQ ID NO: 2623474 - protein, 22 aa, Entamoeba histolytica
GQITTGRRNQSQKKKRKENKEL

SEQ ID NO: 2623475 - protein, 33 aa, Entamoeba histolytica
GQKEAKKEETFEEFPDRSEFDKKYTKENEIGQG

SEQ ID NO: 2623476 - protein, 7 aa, Entamoeba histolytica
GQKEEEW

SEQ ID NO: 2623477 - protein, 8 aa, Entamoeba histolytica
GQKEESQK

SEQ ID NO: 2623478 - protein, 7 aa, Entamoeba histolytica
GQKEQSL

SEQ ID NO: 2623479 - protein, 7 aa, Entamoeba histolytica
GQKHQNI

SEQ ID NO: 2623480 - protein, 16 aa, Entamoeba histolytica
GQKKQIESEEHVEGNI

SEQ ID NO: 2623481 - protein, 9 aa, Entamoeba histolytica
GQKLSPQAA

SEQ ID NO: 2623482 - protein, 8 aa, Entamoeba histolytica
GQKLTPQA

SEQ ID NO: 2623483 - protein, 29 aa, Entamoeba histolytica
GQKPESRSVPPQLSERTLTTTDIESTRSH

SEQ ID NO: 2623484 - protein, 10 aa, Entamoeba histolytica
GQKSEQIKKN

SEQ ID NO: 2623485 - protein, 9 aa, Entamoeba histolytica
GQKSEVNGE

SEQ ID NO: 2623486 - protein, 8 aa, Entamoeba histolytica
GQKTGEPI

SEQ ID NO: 2623487 - protein, 5 aa, Entamoeba histolytica
GQKTL

SEQ ID NO: 2623488 - protein, 9 aa, Entamoeba histolytica
GQLDQDKRT

SEQ ID NO: 2623489 - protein, 12 aa, Entamoeba histolytica
GQLEKADEINNS

SEQ ID NO: 2623490 - protein, 4 aa, Entamoeba histolytica
GQLP

SEQ ID NO: 2623491 - protein, 21 aa, Entamoeba histolytica
GQLQQQKEETFNSIKNEGEKV

SEQ ID NO: 2623492 - protein, 4 aa, Entamoeba histolytica
GQLR

SEQ ID NO: 2623493 - protein, 7 aa, Entamoeba histolytica
GQLRQKS

SEQ ID NO: 2623494 - protein, 9 aa, Entamoeba histolytica
GQMKEYSEE

SEQ ID NO: 2623495 - protein, 7 aa, Entamoeba histolytica
GQNDNGY

SEQ ID NO: 2623496 - protein, 10 aa, Entamoeba histolytica
GQNDNLEDLE

SEQ ID NO: 2623497 - protein, 5 aa, Entamoeba histolytica
GQNEI

SEQ ID NO: 2623498 - protein, 5 aa, Entamoeba histolytica
GQNKL

SEQ ID NO: 2623499 - protein, 8 aa, Entamoeba histolytica
GQNNIQSD

SEQ ID NO: 2623500 - protein, 13 aa, Entamoeba histolytica
GQNNRYSHPAQTS

SEQ ID NO: 2623501 - protein, 9 aa, Entamoeba histolytica
GQNPDRVEE

SEQ ID NO: 2623502 - protein, 6 aa, Entamoeba histolytica
GQNPPL

SEQ ID NO: 2623503 - protein, 13 aa, Entamoeba histolytica
GQNQELTENDVTQ

SEQ ID NO: 2623504 - protein, 11 aa, Entamoeba histolytica
GQPAKKSTVTQ

SEQ ID NO: 2623505 - protein, 21 aa, Entamoeba histolytica
GQPASQKPYVEEKDRQDMKKN

SEQ ID NO: 2623506 - protein, 7 aa, Entamoeba histolytica
GQPEGVR

SEQ ID NO: 2623507 - protein, 10 aa, Entamoeba histolytica
GQPFSSEQEA

SEQ ID NO: 2623508 - protein, 8 aa, Entamoeba histolytica
GQPHSEPA

SEQ ID NO: 2623509 - protein, 4 aa, Entamoeba histolytica
GQPI

SEQ ID NO: 2623510 - protein, 9 aa, Entamoeba histolytica
GQPINPANR

SEQ ID NO: 2623511 - protein, 5 aa, Entamoeba histolytica
GQPMY

SEQ ID NO: 2623512 - protein, 5 aa, Entamoeba histolytica
GQPPD

SEQ ID NO: 2623513 - protein, 12 aa, Entamoeba histolytica
GQPPHGLVQCLA

SEQ ID NO: 2623514 - protein, 5 aa, Entamoeba histolytica
GQPPN

SEQ ID NO: 2623515 - protein, 7 aa, Entamoeba histolytica
GQQADSV

SEQ ID NO: 2623516 - protein, 35 aa, Entamoeba histolytica
GQQRVEVSPSHSIKSPRATSTDREEEPKRERRTPL

SEQ ID NO: 2623517 - protein, 7 aa, Entamoeba histolytica
GQRRRQY

SEQ ID NO: 2623518 - protein, 11 aa, Entamoeba histolytica
GQSAMERTNAI

SEQ ID NO: 2623519 - protein, 15 aa, Entamoeba histolytica
GQSGAAEESTADESV

SEQ ID NO: 2623520 - protein, 6 aa, Entamoeba histolytica
GQSGIN

SEQ ID NO: 2623521 - protein, 8 aa, Entamoeba histolytica
GQSGYKER

SEQ ID NO: 2623522 - protein, 5 aa, Entamoeba histolytica
GQSIE

SEQ ID NO: 2623523 - protein, 16 aa, Entamoeba histolytica
GQSMKHDNESKDKQVT

SEQ ID NO: 2623524 - protein, 9 aa, Entamoeba histolytica
GQSNPNEEQ

SEQ ID NO: 2623525 - protein, 9 aa, Entamoeba histolytica
GQSRYTLSS

SEQ ID NO: 2623526 - protein, 4 aa, Entamoeba histolytica
GQSS

SEQ ID NO: 2623527 - protein, 16 aa, Entamoeba histolytica
GQSSLSDQPKEELEKK

SEQ ID NO: 2623528 - protein, 11 aa, Entamoeba histolytica
GQSTIYRNTTS

SEQ ID NO: 2623529 - protein, 11 aa, Entamoeba histolytica
GQTGSGKTFTT

SEQ ID NO: 2623530 - protein, 9 aa, Entamoeba histolytica
GQTGSGKTY

SEQ ID NO: 2623531 - protein, 20 aa, Entamoeba histolytica
GQTGSGKTYTMEGTNDKPGM

SEQ ID NO: 2623532 - protein, 5 aa, Entamoeba histolytica
GQTIN

SEQ ID NO: 2623533 - protein, 8 aa, Entamoeba histolytica
GQTISKKN

SEQ ID NO: 2623534 - protein, 4 aa, Entamoeba histolytica
GQTK

SEQ ID NO: 2623535 - protein, 4 aa, Entamoeba histolytica
GQTN

SEQ ID NO: 2623536 - protein, 6 aa, Entamoeba histolytica
GQTNEV

SEQ ID NO: 2623537 - protein, 8 aa, Entamoeba histolytica
GQTPGSNA

SEQ ID NO: 2623538 - protein, 8 aa, Entamoeba histolytica
GQTPPPVT

SEQ ID NO: 2623539 - protein, 6 aa, Entamoeba histolytica
GQTPQV

SEQ ID NO: 2623540 - protein, 7 aa, Entamoeba histolytica
GQTPTLQ

SEQ ID NO: 2623541 - protein, 9 aa, Entamoeba histolytica
GQTQSALED

SEQ ID NO: 2623542 - protein, 5 aa, Entamoeba histolytica
GQTRL

SEQ ID NO: 2623543 - protein, 11 aa, Entamoeba histolytica
GQTSGAAFTQT

SEQ ID NO: 2623544 - protein, 7 aa, Entamoeba histolytica
GQTSHQI

SEQ ID NO: 2623545 - protein, 11 aa, Entamoeba histolytica
GQTSPDDESIQ

SEQ ID NO: 2623546 - protein, 7 aa, Entamoeba histolytica
GQTTGNG

SEQ ID NO: 2623547 - protein, 5 aa, Entamoeba histolytica
GQTTN

SEQ ID NO: 2623548 - protein, 5 aa, Entamoeba histolytica
GQTVP

SEQ ID NO: 2623549 - protein, 11 aa, Entamoeba histolytica
GQVDEVSNGSY

SEQ ID NO: 2623550 - protein, 19 aa, Entamoeba histolytica
GQVDNEKATKAAIEQASNY

SEQ ID NO: 2623551 - protein, 8 aa, Entamoeba histolytica
GQVEEKDK

SEQ ID NO: 2623552 - protein, 4 aa, Entamoeba histolytica
GQVI

SEQ ID NO: 2623553 - protein, 5 aa, Entamoeba histolytica
GQVNP

SEQ ID NO: 2623554 - protein, 6 aa, Entamoeba histolytica
GQVPTG

SEQ ID NO: 2623555 - protein, 6 aa, Entamoeba histolytica
GQVSEN

SEQ ID NO: 2623556 - protein, 9 aa, Entamoeba histolytica
GQYEPKEEE

SEQ ID NO: 2623557 - protein, 13 aa, Entamoeba histolytica
GQYTASNKADGLV

SEQ ID NO: 2623558 - protein, 16 aa, Entamoeba histolytica
GRAEEKEKTSKEGCVV

SEQ ID NO: 2623559 - protein, 13 aa, Entamoeba histolytica
GRAGRRGKDDQGT

SEQ ID NO: 2623560 - protein, 12 aa, Entamoeba histolytica
GRAGRTSQARRN

SEQ ID NO: 2623561 - protein, 5 aa, Entamoeba histolytica
GRAGV

SEQ ID NO: 2623562 - protein, 7 aa, Entamoeba histolytica
GRANKEC

SEQ ID NO: 2623563 - protein, 8 aa, Entamoeba histolytica
GRAPNSIK

SEQ ID NO: 2623564 - protein, 5 aa, Entamoeba histolytica
GRAPT

SEQ ID NO: 2623565 - protein, 16 aa, Entamoeba histolytica
GRCSTQNGIKEIGNKL

SEQ ID NO: 2623566 - protein, 11 aa, Entamoeba histolytica
GRDEKDALSTS

SEQ ID NO: 2623567 - protein, 19 aa, Entamoeba histolytica
GRDELETSKGQTRKSNIGE

SEQ ID NO: 2623568 - protein, 9 aa, Entamoeba histolytica
GRDYQEKVR

SEQ ID NO: 2623569 - protein, 14 aa, Entamoeba histolytica
GREDEQDKIIETEN

SEQ ID NO: 2623570 - protein, 5 aa, Entamoeba histolytica
GREDV

SEQ ID NO: 2623571 - protein, 6 aa, Entamoeba histolytica
GREEQT

SEQ ID NO: 2623572 - protein, 6 aa, Entamoeba histolytica
GREGLV

SEQ ID NO: 2623573 - protein, 4 aa, Entamoeba histolytica
GREI

SEQ ID NO: 2623574 - protein, 4 aa, Entamoeba histolytica
GREN

SEQ ID NO: 2623575 - protein, 6 aa, Entamoeba histolytica
GRENEA

SEQ ID NO: 2623576 - protein, 9 aa, Entamoeba histolytica
GRERKDEKY

SEQ ID NO: 2623577 - protein, 11 aa, Entamoeba histolytica
GRESGTPFGNI

SEQ ID NO: 2623578 - protein, 7 aa, Entamoeba histolytica
GRESKLS

SEQ ID NO: 2623579 - protein, 5 aa, Entamoeba histolytica
GRETE

SEQ ID NO: 2623580 - protein, 10 aa, Entamoeba histolytica
GRFDERTAAR

SEQ ID NO: 2623581 - protein, 9 aa, Entamoeba histolytica
GRFGKYEED

SEQ ID NO: 2623582 - protein, 7 aa, Entamoeba histolytica
GRFSDPT

SEQ ID NO: 2623583 - protein, 9 aa, Entamoeba histolytica
GRGANTALR

SEQ ID NO: 2623584 - protein, 9 aa, Entamoeba histolytica
GRGITEKGT

SEQ ID NO: 2623585 - protein, 7 aa, Entamoeba histolytica
GRGKNEL

SEQ ID NO: 2623586 - protein, 6 aa, Entamoeba histolytica
GRGKYS

SEQ ID NO: 2623587 - protein, 5 aa, Entamoeba histolytica
GRGQE

SEQ ID NO: 2623588 - protein, 18 aa, Entamoeba histolytica
GRGRASFGGRDQQPSGEL

SEQ ID NO: 2623589 - protein, 8 aa, Entamoeba histolytica
GRGRRQKG

SEQ ID NO: 2623590 - protein, 8 aa, Entamoeba histolytica
GRGRTGTV

SEQ ID NO: 2623591 - protein, 9 aa, Entamoeba histolytica
GRGTSTHDG

SEQ ID NO: 2623592 - protein, 4 aa, Entamoeba histolytica
GRGV

SEQ ID NO: 2623593 - protein, 8 aa, Entamoeba histolytica
GRGYSTST

SEQ ID NO: 2623594 - protein, 9 aa, Entamoeba histolytica
GRHEEENNY

SEQ ID NO: 2623595 - protein, 13 aa, Entamoeba histolytica
GRHSSHEDLPEHT

SEQ ID NO: 2623596 - protein, 10 aa, Entamoeba histolytica
GRIDQAGDDI

SEQ ID NO: 2623597 - protein, 5 aa, Entamoeba histolytica
GRIET

SEQ ID NO: 2623598 - protein, 12 aa, Entamoeba histolytica
GRIGSRINKKEG

SEQ ID NO: 2623599 - protein, 6 aa, Entamoeba histolytica
GRINEK

SEQ ID NO: 2623600 - protein, 9 aa, Entamoeba histolytica
GRIPITPQS

SEQ ID NO: 2623601 - protein, 7 aa, Entamoeba histolytica
GRIPPSP

SEQ ID NO: 2623602 - protein, 6 aa, Entamoeba histolytica
GRIPTT

SEQ ID NO: 2623603 - protein, 14 aa, Entamoeba histolytica
GRITSSSANGNSKV

SEQ ID NO: 2623604 - protein, 19 aa, Entamoeba histolytica
GRKDTVDKFNERDKNKVES

SEQ ID NO: 2623605 - protein, 5 aa, Entamoeba histolytica
GRKES

SEQ ID NO: 2623606 - protein, 17 aa, Entamoeba histolytica
GRKFEGSKYLKNIEENT

SEQ ID NO: 2623607 - protein, 5 aa, Entamoeba histolytica
GRKGE

SEQ ID NO: 2623608 - protein, 9 aa, Entamoeba histolytica
GRKGSFPVP

SEQ ID NO: 2623609 - protein, 7 aa, Entamoeba histolytica
GRKGSPW

SEQ ID NO: 2623610 - protein, 4 aa, Entamoeba histolytica
GRKH

SEQ ID NO: 2623611 - protein, 23 aa, Entamoeba histolytica
GRKHNKTKPGTKVTQTNGIESLE

SEQ ID NO: 2623612 - protein, 7 aa, Entamoeba histolytica
GRKLRKE

SEQ ID NO: 2623613 - protein, 11 aa, Entamoeba histolytica
GRKMKEDQEKI

SEQ ID NO: 2623614 - protein, 7 aa, Entamoeba histolytica
GRKPTLS

SEQ ID NO: 2623615 - protein, 12 aa, Entamoeba histolytica
GRKRKQSNEDVI

SEQ ID NO: 2623616 - protein, 4 aa, Entamoeba histolytica
GRLA

SEQ ID NO: 2623617 - protein, 13 aa, Entamoeba histolytica
GRLEESKGERIEI

SEQ ID NO: 2623618 - protein, 18 aa, Entamoeba histolytica
GRLSPKKINHDQNNPSLK

SEQ ID NO: 2623619 - protein, 11 aa, Entamoeba histolytica
GRNAPTAYDEQ

SEQ ID NO: 2623620 - protein, 8 aa, Entamoeba histolytica
GRNATEPI

SEQ ID NO: 2623621 - protein, 10 aa, Entamoeba histolytica
GRNDKGEIDF

SEQ ID NO: 2623622 - protein, 8 aa, Entamoeba histolytica
GRNEESEI

SEQ ID NO: 2623623 - protein, 20 aa, Entamoeba histolytica
GRNEIKGERTGEYKEEAEKL

SEQ ID NO: 2623624 - protein, 12 aa, Entamoeba histolytica
GRNENNSLKNKI

SEQ ID NO: 2623625 - protein, 5 aa, Entamoeba histolytica
GRNEP

SEQ ID NO: 2623626 - protein, 7 aa, Entamoeba histolytica
GRNGSIV

SEQ ID NO: 2623627 - protein, 7 aa, Entamoeba histolytica
GRNKEGQ

SEQ ID NO: 2623628 - protein, 4 aa, Entamoeba histolytica
GRNL

SEQ ID NO: 2623629 - protein, 10 aa, Entamoeba histolytica
GRNNAKLSSR

SEQ ID NO: 2623630 - protein, 5 aa, Entamoeba histolytica
GRNND

SEQ ID NO: 2623631 - protein, 9 aa, Entamoeba histolytica
GRNRAKSGL

SEQ ID NO: 2623632 - protein, 6 aa, Entamoeba histolytica
GRNRAP

SEQ ID NO: 2623633 - protein, 9 aa, Entamoeba histolytica
GRNTYEAQK

SEQ ID NO: 2623634 - protein, 7 aa, Entamoeba histolytica
GRNYDEA

SEQ ID NO: 2623635 - protein, 6 aa, Entamoeba histolytica
GRPDSI

SEQ ID NO: 2623636 - protein, 4 aa, Entamoeba histolytica
GRPL

SEQ ID NO: 2623637 - protein, 6 aa, Entamoeba histolytica
GRPLKG

SEQ ID NO: 2623638 - protein, 7 aa, Entamoeba histolytica
GRPPHSE

SEQ ID NO: 2623639 - protein, 12 aa, Entamoeba histolytica
GRPSINQLNTNT

SEQ ID NO: 2623640 - protein, 6 aa, Entamoeba histolytica
GRPTQR

SEQ ID NO: 2623641 - protein, 12 aa, Entamoeba histolytica
GRPYNPPLPDES

SEQ ID NO: 2623642 - protein, 7 aa, Entamoeba histolytica
GRPYNYG

SEQ ID NO: 2623643 - protein, 6 aa, Entamoeba histolytica
GRPYPT

SEQ ID NO: 2623644 - protein, 4 aa, Entamoeba histolytica
GRQE

SEQ ID NO: 2623645 - protein, 11 aa, Entamoeba histolytica
GRQETINERQL

SEQ ID NO: 2623646 - protein, 5 aa, Entamoeba histolytica
GRQGD

SEQ ID NO: 2623647 - protein, 4 aa, Entamoeba histolytica
GRQI

SEQ ID NO: 2623648 - protein, 8 aa, Entamoeba histolytica
GRQTSINQ

SEQ ID NO: 2623649 - protein, 21 aa, Entamoeba histolytica
GRQVSSPRHSNITPLSLSANS

SEQ ID NO: 2623650 - protein, 8 aa, Entamoeba histolytica
GRRAAETA

SEQ ID NO: 2623651 - protein, 7 aa, Entamoeba histolytica
GRRDFRK

SEQ ID NO: 2623652 - protein, 7 aa, Entamoeba histolytica
GRRGKME

SEQ ID NO: 2623653 - protein, 6 aa, Entamoeba histolytica
GRRGSL

SEQ ID NO: 2623654 - protein, 8 aa, Entamoeba histolytica
GRRKRIPL

SEQ ID NO: 2623655 - protein, 4 aa, Entamoeba histolytica
GRRN

SEQ ID NO: 2623656 - protein, 7 aa, Entamoeba histolytica
GRRNNHD

SEQ ID NO: 2623657 - protein, 8 aa, Entamoeba histolytica
GRSDPRIT

SEQ ID NO: 2623658 - protein, 7 aa, Entamoeba histolytica
GRSEHDI

SEQ ID NO: 2623659 - protein, 9 aa, Entamoeba histolytica
GRSKDGDEF

SEQ ID NO: 2623660 - protein, 10 aa, Entamoeba histolytica
GRSKNTHTTQ

SEQ ID NO: 2623661 - protein, 17 aa, Entamoeba histolytica
GRSKYTGKDYNRADRTC

SEQ ID NO: 2623662 - protein, 11 aa, Entamoeba histolytica
GRSLKKQQYSV

SEQ ID NO: 2623663 - protein, 13 aa, Entamoeba histolytica
GRSPKSHDEEDYK

SEQ ID NO: 2623664 - protein, 11 aa, Entamoeba histolytica
GRSRLKEAQEG

SEQ ID NO: 2623665 - protein, 7 aa, Entamoeba histolytica
GRSRSGT

SEQ ID NO: 2623666 - protein, 7 aa, Entamoeba histolytica
GRSRTTH

SEQ ID NO: 2623667 - protein, 11 aa, Entamoeba histolytica
GRSSNKNELSK

SEQ ID NO: 2623668 - protein, 6 aa, Entamoeba histolytica
GRTAHA

SEQ ID NO: 2623669 - protein, 8 aa, Entamoeba histolytica
GRTAVEET

SEQ ID NO: 2623670 - protein, 10 aa, Entamoeba histolytica
GRTDNQNTLE

SEQ ID NO: 2623671 - protein, 13 aa, Entamoeba histolytica
GRTGRAGKKGTAI

SEQ ID NO: 2623672 - protein, 12 aa, Entamoeba histolytica
GRTGRAGKRGKA

SEQ ID NO: 2623673 - protein, 5 aa, Entamoeba histolytica
GRTGY

SEQ ID NO: 2623674 - protein, 5 aa, Entamoeba histolytica
GRTKV

SEQ ID NO: 2623675 - protein, 12 aa, Entamoeba histolytica
GRTNSKKSNDVE

SEQ ID NO: 2623676 - protein, 4 aa, Entamoeba histolytica
GRTP

SEQ ID NO: 2623677 - protein, 32 aa, Entamoeba histolytica
GRTPQRSTASTETNKSIPQQTHGNSNKPHQEV

SEQ ID NO: 2623678 - protein, 12 aa, Entamoeba histolytica
GRTRDQRYTKSA

SEQ ID NO: 2623679 - protein, 7 aa, Entamoeba histolytica
GRTSTHF

SEQ ID NO: 2623680 - protein, 7 aa, Entamoeba histolytica
GRTYERN

SEQ ID NO: 2623681 - protein, 10 aa, Entamoeba histolytica
GRVNGSRPLH

SEQ ID NO: 2623682 - protein, 6 aa, Entamoeba histolytica
GRVPET

SEQ ID NO: 2623683 - protein, 5 aa, Entamoeba histolytica
GRVPK

SEQ ID NO: 2623684 - protein, 8 aa, Entamoeba histolytica
GRVTPDGK

SEQ ID NO: 2623685 - protein, 4 aa, Entamoeba histolytica
GRYE

SEQ ID NO: 2623686 - protein, 7 aa, Entamoeba histolytica
GRYEKSI

SEQ ID NO: 2623687 - protein, 5 aa, Entamoeba histolytica
GRYHS

SEQ ID NO: 2623688 - protein, 12 aa, Entamoeba histolytica
GRYSEPEIQRSP

SEQ ID NO: 2623689 - protein, 18 aa, Entamoeba histolytica
GRYTTSKSIEGDTYGYRG

SEQ ID NO: 2623690 - protein, 9 aa, Entamoeba histolytica
GSADKSAKL

SEQ ID NO: 2623691 - protein, 7 aa, Entamoeba histolytica
GSADKSI

SEQ ID NO: 2623692 - protein, 6 aa, Entamoeba histolytica
GSADKT

SEQ ID NO: 2623693 - protein, 6 aa, Entamoeba histolytica
GSADRT

SEQ ID NO: 2623694 - protein, 4 aa, Entamoeba histolytica
GSAE

SEQ ID NO: 2623695 - protein, 7 aa, Entamoeba histolytica
GSAEKDV

SEQ ID NO: 2623696 - protein, 8 aa, Entamoeba histolytica
GSAEKKGC

SEQ ID NO: 2623697 - protein, 6 aa, Entamoeba histolytica
GSANEI

SEQ ID NO: 2623698 - protein, 6 aa, Entamoeba histolytica
GSANKL

SEQ ID NO: 2623699 - protein, 15 aa, Entamoeba histolytica
GSANTGDLKNIQQGE

SEQ ID NO: 2623700 - protein, 6 aa, Entamoeba histolytica
GSAPAT

SEQ ID NO: 2623701 - protein, 8 aa, Entamoeba histolytica
GSAPPRLR

SEQ ID NO: 2623702 - protein, 39 aa, Entamoeba histolytica
GSAPVAAAPAAQNEATEEKKEDKKEEEEAEEDFGGFGDL

SEQ ID NO: 2623703 - protein, 10 aa, Entamoeba histolytica
GSASGEYQNE

SEQ ID NO: 2623704 - protein, 4 aa, Entamoeba histolytica
GSAT

SEQ ID NO: 2623705 - protein, 15 aa, Entamoeba histolytica
GSATFRKTKRSKQTV

SEQ ID NO: 2623706 - protein, 20 aa, Entamoeba histolytica
GSATSFEGPYYSANPDTVSR

SEQ ID NO: 2623707 - protein, 6 aa, Entamoeba histolytica
GSCDPE

SEQ ID NO: 2623708 - protein, 7 aa, Entamoeba histolytica
GSCEEIS

SEQ ID NO: 2623709 - protein, 5 aa, Entamoeba histolytica
GSCSQ

SEQ ID NO: 2623710 - protein, 10 aa, Entamoeba histolytica
GSDAQGISKT

SEQ ID NO: 2623711 - protein, 5 aa, Entamoeba histolytica
GSDAY

SEQ ID NO: 2623712 - protein, 15 aa, Entamoeba histolytica
GSDDEVSCSPPSNFK

SEQ ID NO: 2623713 - protein, 8 aa, Entamoeba histolytica
GSDDINTI

SEQ ID NO: 2623714 - protein, 8 aa, Entamoeba histolytica
GSDEENAR

SEQ ID NO: 2623715 - protein, 7 aa, Entamoeba histolytica
GSDESTY

SEQ ID NO: 2623716 - protein, 9 aa, Entamoeba histolytica
GSDEVYDTE

SEQ ID NO: 2623717 - protein, 4 aa, Entamoeba histolytica
GSDG

SEQ ID NO: 2623718 - protein, 5 aa, Entamoeba histolytica
GSDGG

SEQ ID NO: 2623719 - protein, 16 aa, Entamoeba histolytica
GSDHKGHDYSITESSN

SEQ ID NO: 2623720 - protein, 4 aa, Entamoeba histolytica
GSDK

SEQ ID NO: 2623721 - protein, 15 aa, Entamoeba histolytica
GSDLPKLKEQLGDDV

SEQ ID NO: 2623722 - protein, 5 aa, Entamoeba histolytica
GSDNE

SEQ ID NO: 2623723 - protein, 7 aa, Entamoeba histolytica
GSDNITQ

SEQ ID NO: 2623724 - protein, 7 aa, Entamoeba histolytica
GSDNKKY

SEQ ID NO: 2623725 - protein, 10 aa, Entamoeba histolytica
GSDNPAISPI

SEQ ID NO: 2623726 - protein, 6 aa, Entamoeba histolytica
GSDQGT

SEQ ID NO: 2623727 - protein, 5 aa, Entamoeba histolytica
GSDRG

SEQ ID NO: 2623728 - protein, 14 aa, Entamoeba histolytica
GSDSHSQKKMKKQR

SEQ ID NO: 2623729 - protein, 4 aa, Entamoeba histolytica
GSDV

SEQ ID NO: 2623730 - protein, 19 aa, Entamoeba histolytica
GSDVITNEDEQLLESKSKE

SEQ ID NO: 2623731 - protein, 5 aa, Entamoeba histolytica
GSEAT

SEQ ID NO: 2623732 - protein, 10 aa, Entamoeba histolytica
GSECKGDEGL

SEQ ID NO: 2623733 - protein, 4 aa, Entamoeba histolytica
GSED

SEQ ID NO: 2623734 - protein, 5 aa, Entamoeba histolytica
GSEDC

SEQ ID NO: 2623735 - protein, 9 aa, Entamoeba histolytica
GSEDETVVE

SEQ ID NO: 2623736 - protein, 9 aa, Entamoeba histolytica
GSEDTTPIT

SEQ ID NO: 2623737 - protein, 21 aa, Entamoeba histolytica
GSEDTTPSKPNNSKYQSNDEE

SEQ ID NO: 2623738 - protein, 5 aa, Entamoeba histolytica
GSEDV

SEQ ID NO: 2623739 - protein, 13 aa, Entamoeba histolytica
GSEEEEEERNSNS

SEQ ID NO: 2623740 - protein, 23 aa, Entamoeba histolytica
GSEEIGEETFNEDNNQLKPKSIE

SEQ ID NO: 2623741 - protein, 8 aa, Entamoeba histolytica
GSEEKDKV

SEQ ID NO: 2623742 - protein, 4 aa, Entamoeba histolytica
GSEF

SEQ ID NO: 2623743 - protein, 11 aa, Entamoeba histolytica
GSEGKSSFRWT

SEQ ID NO: 2623744 - protein, 10 aa, Entamoeba histolytica
GSEGNNYLGG

SEQ ID NO: 2623745 - protein, 4 aa, Entamoeba histolytica
GSEI

SEQ ID NO: 2623746 - protein, 7 aa, Entamoeba histolytica
GSEINGT

SEQ ID NO: 2623747 - protein, 9 aa, Entamoeba histolytica
GSEKEISIT

SEQ ID NO: 2623748 - protein, 7 aa, Entamoeba histolytica
GSEKSNL

SEQ ID NO: 2623749 - protein, 11 aa, Entamoeba histolytica
GSENGKPLREE

SEQ ID NO: 2623750 - protein, 4 aa, Entamoeba histolytica
GSEP

SEQ ID NO: 2623751 - protein, 5 aa, Entamoeba histolytica
GSEPL

SEQ ID NO: 2623752 - protein, 6 aa, Entamoeba histolytica
GSEQEI

SEQ ID NO: 2623753 - protein, 9 aa, Entamoeba histolytica
GSERASQIN

SEQ ID NO: 2623754 - protein, 24 aa, Entamoeba histolytica
GSERIERSGVIGTGKLEAGNINKT

SEQ ID NO: 2623755 - protein, 14 aa, Entamoeba histolytica
GSERQSNTGAKGKL

SEQ ID NO: 2623756 - protein, 5 aa, Entamoeba histolytica
GSETD

SEQ ID NO: 2623757 - protein, 16 aa, Entamoeba histolytica
GSETSSKKVVKTRDNT

SEQ ID NO: 2623758 - protein, 7 aa, Entamoeba histolytica
GSEVSKK

SEQ ID NO: 2623759 - protein, 6 aa, Entamoeba histolytica
GSFEER

SEQ ID NO: 2623760 - protein, 5 aa, Entamoeba histolytica
GSFGQ

SEQ ID NO: 2623761 - protein, 17 aa, Entamoeba histolytica
GSFGRTTKKQSDTSTEV

SEQ ID NO: 2623762 - protein, 8 aa, Entamoeba histolytica
GSFKASEQ

SEQ ID NO: 2623763 - protein, 13 aa, Entamoeba histolytica
GSFKPDEKSTIGA

SEQ ID NO: 2623764 - protein, 4 aa, Entamoeba histolytica
GSFN

SEQ ID NO: 2623765 - protein, 13 aa, Entamoeba histolytica
GSFNETLSTTIDD

SEQ ID NO: 2623766 - protein, 6 aa, Entamoeba histolytica
GSFNGQ

SEQ ID NO: 2623767 - protein, 5 aa, Entamoeba histolytica
GSFNP

SEQ ID NO: 2623768 - protein, 5 aa, Entamoeba histolytica
GSFPN

SEQ ID NO: 2623769 - protein, 5 aa, Entamoeba histolytica
GSFPT

SEQ ID NO: 2623770 - protein, 7 aa, Entamoeba histolytica
GSFRSRQ

SEQ ID NO: 2623771 - protein, 9 aa, Entamoeba histolytica
GSFTEADAS

SEQ ID NO: 2623772 - protein, 5 aa, Entamoeba histolytica
GSFYG

SEQ ID NO: 2623773 - protein, 7 aa, Entamoeba histolytica
GSGASGI

SEQ ID NO: 2623774 - protein, 6 aa, Entamoeba histolytica
GSGEEI

SEQ ID NO: 2623775 - protein, 14 aa, Entamoeba histolytica
GSGEKMTAEERRTK

SEQ ID NO: 2623776 - protein, 6 aa, Entamoeba histolytica
GSGEQF

SEQ ID NO: 2623777 - protein, 11 aa, Entamoeba histolytica
GSGFGQKDNTY

SEQ ID NO: 2623778 - protein, 11 aa, Entamoeba histolytica
GSGFGQKKGTY

SEQ ID NO: 2623779 - protein, 4 aa, Entamoeba histolytica
GSGG

SEQ ID NO: 2623780 - protein, 7 aa, Entamoeba histolytica
GSGGRDS

SEQ ID NO: 2623781 - protein, 4 aa, Entamoeba histolytica
GSGI

SEQ ID NO: 2623782 - protein, 5 aa, Entamoeba histolytica
GSGIE

SEQ ID NO: 2623783 - protein, 11 aa, Entamoeba histolytica
GSGIERENARK

SEQ ID NO: 2623784 - protein, 6 aa, Entamoeba histolytica
GSGIND

SEQ ID NO: 2623785 - protein, 5 aa, Entamoeba histolytica
GSGKG

SEQ ID NO: 2623786 - protein, 12 aa, Entamoeba histolytica
GSGKPVDKGPNV

SEQ ID NO: 2623787 - protein, 58 aa, Entamoeba histolytica
  misc_feature (23)..(56): Xaa can be any naturally occurring amino acid
GSGKPVDKGPNVIAEDYLDINGXXXXXXXXXXXXXXXXXXXXXXXXXXXXXXXXXXNF

SEQ ID NO: 2623788 - protein, 6 aa, Entamoeba histolytica
GSGKTT

SEQ ID NO: 2623789 - protein, 4 aa, Entamoeba histolytica
GSGM

SEQ ID NO: 2623790 - protein, 9 aa, Entamoeba histolytica
GSGNEITEK

SEQ ID NO: 2623791 - protein, 8 aa, Entamoeba histolytica
GSGNGKYH

SEQ ID NO: 2623792 - protein, 14 aa, Entamoeba histolytica
GSGQIYATGSEDRT

SEQ ID NO: 2623793 - protein, 8 aa, Entamoeba histolytica
GSGQSNPL

SEQ ID NO: 2623794 - protein, 13 aa, Entamoeba histolytica
GSGRTKIETEEQF

SEQ ID NO: 2623795 - protein, 10 aa, Entamoeba histolytica
GSGSEEVYND

SEQ ID NO: 2623796 - protein, 5 aa, Entamoeba histolytica
GSGSF

SEQ ID NO: 2623797 - protein, 8 aa, Entamoeba histolytica
GSGSIAAT

SEQ ID NO: 2623798 - protein, 7 aa, Entamoeba histolytica
GSGSPYA

SEQ ID NO: 2623799 - protein, 13 aa, Entamoeba histolytica
GSGSVTKEIQDPN

SEQ ID NO: 2623800 - protein, 5 aa, Entamoeba histolytica
GSGTF

SEQ ID NO: 2623801 - protein, 14 aa, Entamoeba histolytica
GSGTYIGTGANDNS

SEQ ID NO: 2623802 - protein, 7 aa, Entamoeba histolytica
GSGTYST

SEQ ID NO: 2623803 - protein, 8 aa, Entamoeba histolytica
GSGVGKTT

SEQ ID NO: 2623804 - protein, 10 aa, Entamoeba histolytica
GSGWTKEPLK

SEQ ID NO: 2623805 - protein, 13 aa, Entamoeba histolytica
GSGYSGETIEENG

SEQ ID NO: 2623806 - protein, 10 aa, Entamoeba histolytica
GSHDSGTSTI

SEQ ID NO: 2623807 - protein, 7 aa, Entamoeba histolytica
GSHKAQS

SEQ ID NO: 2623808 - protein, 15 aa, Entamoeba histolytica
GSHPTKGEGKLNPLT

SEQ ID NO: 2623809 - protein, 8 aa, Entamoeba histolytica
GSIDKQEK

SEQ ID NO: 2623810 - protein, 7 aa, Entamoeba histolytica
GSIDTTK

SEQ ID NO: 2623811 - protein, 11 aa, Entamoeba histolytica
GSIEERKEYGK

SEQ ID NO: 2623812 - protein, 10 aa, Entamoeba histolytica
GSIERKRASS

SEQ ID NO: 2623813 - protein, 12 aa, Entamoeba histolytica
GSIESVPEGIDR

SEQ ID NO: 2623814 - protein, 14 aa, Entamoeba histolytica
GSIGTDPYPYKCMK

SEQ ID NO: 2623815 - protein, 6 aa, Entamoeba histolytica
GSIKKY

SEQ ID NO: 2623816 - protein, 11 aa, Entamoeba histolytica
GSIKSEDRQNA

SEQ ID NO: 2623817 - protein, 4 aa, Entamoeba histolytica
GSIP

SEQ ID NO: 2623818 - protein, 5 aa, Entamoeba histolytica
GSIPT

SEQ ID NO: 2623819 - protein, 6 aa, Entamoeba histolytica
GSIRED

SEQ ID NO: 2623820 - protein, 8 aa, Entamoeba histolytica
GSISSNEI

SEQ ID NO: 2623821 - protein, 8 aa, Entamoeba histolytica
GSITGGGN

SEQ ID NO: 2623822 - protein, 9 aa, Entamoeba histolytica
GSITSSITN

SEQ ID NO: 2623823 - protein, 4 aa, Entamoeba histolytica
GSKD

SEQ ID NO: 2623824 - protein, 5 aa, Entamoeba histolytica
GSKDM

SEQ ID NO: 2623825 - protein, 10 aa, Entamoeba histolytica
GSKDSHKNIQ

SEQ ID NO: 2623826 - protein, 6 aa, Entamoeba histolytica
GSKDST

SEQ ID NO: 2623827 - protein, 6 aa, Entamoeba histolytica
GSKDVL

SEQ ID NO: 2623828 - protein, 9 aa, Entamoeba histolytica
GSKECTGNG

SEQ ID NO: 2623829 - protein, 11 aa, Entamoeba histolytica
GSKEFGDEGES

SEQ ID NO: 2623830 - protein, 9 aa, Entamoeba histolytica
GSKESDIEI

SEQ ID NO: 2623831 - protein, 12 aa, Entamoeba histolytica
GSKESSLTQLPN

SEQ ID NO: 2623832 - protein, 9 aa, Entamoeba histolytica
GSKEVEVEG

SEQ ID NO: 2623833 - protein, 10 aa, Entamoeba histolytica
GSKGKNVKEP

SEQ ID NO: 2623834 - protein, 10 aa, Entamoeba histolytica
GSKGSQFTNN

SEQ ID NO: 2623835 - protein, 6 aa, Entamoeba histolytica
GSKGSV

SEQ ID NO: 2623836 - protein, 13 aa, Entamoeba histolytica
GSKIEPDQEKVKE

SEQ ID NO: 2623837 - protein, 7 aa, Entamoeba histolytica
GSKIQTG

SEQ ID NO: 2623838 - protein, 6 aa, Entamoeba histolytica
GSKITE

SEQ ID NO: 2623839 - protein, 23 aa, Entamoeba histolytica
GSKKATKKKDIHETRKTKKVTDI

SEQ ID NO: 2623840 - protein, 8 aa, Entamoeba histolytica
GSKKEEEV

SEQ ID NO: 2623841 - protein, 5 aa, Entamoeba histolytica
GSKKI

SEQ ID NO: 2623842 - protein, 8 aa, Entamoeba histolytica
GSKKTYST

SEQ ID NO: 2623843 - protein, 5 aa, Entamoeba histolytica
GSKKY

SEQ ID NO: 2623844 - protein, 7 aa, Entamoeba histolytica
GSKNINS

SEQ ID NO: 2623845 - protein, 10 aa, Entamoeba histolytica
GSKNKRVKTE

SEQ ID NO: 2623846 - protein, 7 aa, Entamoeba histolytica
GSKPEEF

SEQ ID NO: 2623847 - protein, 9 aa, Entamoeba histolytica
GSKSHENSP

SEQ ID NO: 2623848 - protein, 8 aa, Entamoeba histolytica
GSKSNTPL

SEQ ID NO: 2623849 - protein, 7 aa, Entamoeba histolytica
GSKSYTA

SEQ ID NO: 2623850 - protein, 13 aa, Entamoeba histolytica
GSKTMESESRKNV

SEQ ID NO: 2623851 - protein, 11 aa, Entamoeba histolytica
GSKTMKREARR

SEQ ID NO: 2623852 - protein, 7 aa, Entamoeba histolytica
GSKTNNY

SEQ ID NO: 2623853 - protein, 7 aa, Entamoeba histolytica
GSKTQNK

SEQ ID NO: 2623854 - protein, 8 aa, Entamoeba histolytica
GSLAAKTK

SEQ ID NO: 2623855 - protein, 6 aa, Entamoeba histolytica
GSLDGT

SEQ ID NO: 2623856 - protein, 22 aa, Entamoeba histolytica
GSLEVNESSSLESSSLDEEEEE

SEQ ID NO: 2623857 - protein, 4 aa, Entamoeba histolytica
GSLG

SEQ ID NO: 2623858 - protein, 6 aa, Entamoeba histolytica
GSLGGG

SEQ ID NO: 2623859 - protein, 7 aa, Entamoeba histolytica
GSLGHRA

SEQ ID NO: 2623860 - protein, 8 aa, Entamoeba histolytica
GSLGKDTG

SEQ ID NO: 2623861 - protein, 11 aa, Entamoeba histolytica
GSLKPTPKSSK

SEQ ID NO: 2623862 - protein, 21 aa, Entamoeba histolytica
GSLLSQTRNRLDKGKDIDPSE

SEQ ID NO: 2623863 - protein, 12 aa, Entamoeba histolytica
GSLQKSKDGEVE

SEQ ID NO: 2623864 - protein, 8 aa, Entamoeba histolytica
GSLSDRYK

SEQ ID NO: 2623865 - protein, 8 aa, Entamoeba histolytica
GSLTESEA

SEQ ID NO: 2623866 - protein, 8 aa, Entamoeba histolytica
GSLTKRSK

SEQ ID NO: 2623867 - protein, 5 aa, Entamoeba histolytica
GSMDC

SEQ ID NO: 2623868 - protein, 6 aa, Entamoeba histolytica
GSMEGN

SEQ ID NO: 2623869 - protein, 6 aa, Entamoeba histolytica
GSMEPA

SEQ ID NO: 2623870 - protein, 6 aa, Entamoeba histolytica
GSMGET

SEQ ID NO: 2623871 - protein, 10 aa, Entamoeba histolytica
GSMQKQYTKK

SEQ ID NO: 2623872 - protein, 4 aa, Entamoeba histolytica
GSNA

SEQ ID NO: 2623873 - protein, 7 aa, Entamoeba histolytica
GSNELHQ

SEQ ID NO: 2623874 - protein, 6 aa, Entamoeba histolytica
GSNETM

SEQ ID NO: 2623875 - protein, 6 aa, Entamoeba histolytica
GSNGTV

SEQ ID NO: 2623876 - protein, 5 aa, Entamoeba histolytica
GSNHL

SEQ ID NO: 2623877 - protein, 6 aa, Entamoeba histolytica
GSNIGE

SEQ ID NO: 2623878 - protein, 15 aa, Entamoeba histolytica
GSNIKKAEEEEGGSL

SEQ ID NO: 2623879 - protein, 8 aa, Entamoeba histolytica
GSNKANID

SEQ ID NO: 2623880 - protein, 23 aa, Entamoeba histolytica
GSNKEKKNSQRIKTLSENNKGAI

SEQ ID NO: 2623881 - protein, 5 aa, Entamoeba histolytica
GSNKF

SEQ ID NO: 2623882 - protein, 6 aa, Entamoeba histolytica
GSNKME

SEQ ID NO: 2623883 - protein, 4 aa, Entamoeba histolytica
GSNL

SEQ ID NO: 2623884 - protein, 5 aa, Entamoeba histolytica
GSNLM

SEQ ID NO: 2623885 - protein, 5 aa, Entamoeba histolytica
GSNMA

SEQ ID NO: 2623886 - protein, 8 aa, Entamoeba histolytica
GSNNYPGC

SEQ ID NO: 2623887 - protein, 7 aa, Entamoeba histolytica
GSNRDTI

SEQ ID NO: 2623888 - protein, 10 aa, Entamoeba histolytica
GSNRTHLPSV

SEQ ID NO: 2623889 - protein, 5 aa, Entamoeba histolytica
GSNSS

SEQ ID NO: 2623890 - protein, 8 aa, Entamoeba histolytica
GSNTINET

SEQ ID NO: 2623891 - protein, 5 aa, Entamoeba histolytica
GSNTQ

SEQ ID NO: 2623892 - protein, 4 aa, Entamoeba histolytica
GSNV

SEQ ID NO: 2623893 - protein, 7 aa, Entamoeba histolytica
GSNVDLG

SEQ ID NO: 2623894 - protein, 6 aa, Entamoeba histolytica
GSNVPN

SEQ ID NO: 2623895 - protein, 4 aa, Entamoeba histolytica
GSNY

SEQ ID NO: 2623896 - protein, 6 aa, Entamoeba histolytica
GSNYET

SEQ ID NO: 2623897 - protein, 8 aa, Entamoeba histolytica
GSPAEPPI

SEQ ID NO: 2623898 - protein, 8 aa, Entamoeba histolytica
GSPARPIR

SEQ ID NO: 2623899 - protein, 7 aa, Entamoeba histolytica
GSPATTF

SEQ ID NO: 2623900 - protein, 9 aa, Entamoeba histolytica
GSPDSGKTA

SEQ ID NO: 2623901 - protein, 6 aa, Entamoeba histolytica
GSPEDN

SEQ ID NO: 2623902 - protein, 8 aa, Entamoeba histolytica
GSPEEQIE

SEQ ID NO: 2623903 - protein, 6 aa, Entamoeba histolytica
GSPEIS

SEQ ID NO: 2623904 - protein, 6 aa, Entamoeba histolytica
GSPFTP

SEQ ID NO: 2623905 - protein, 8 aa, Entamoeba histolytica
GSPGVGKT

SEQ ID NO: 2623906 - protein, 13 aa, Entamoeba histolytica
GSPIGGCKSTYGT

SEQ ID NO: 2623907 - protein, 7 aa, Entamoeba histolytica
GSPIQNN

SEQ ID NO: 2623908 - protein, 12 aa, Entamoeba histolytica
GSPKSSSTSGIK

SEQ ID NO: 2623909 - protein, 6 aa, Entamoeba histolytica
GSPMGR

SEQ ID NO: 2623910 - protein, 7 aa, Entamoeba histolytica
GSPNKTQ

SEQ ID NO: 2623911 - protein, 22 aa, Entamoeba histolytica
GSPNNSTIPGNSLTGSTKSDIS

SEQ ID NO: 2623912 - protein, 9 aa, Entamoeba histolytica
GSPNPNIAS

SEQ ID NO: 2623913 - protein, 4 aa, Entamoeba histolytica
GSPQ

SEQ ID NO: 2623914 - protein, 17 aa, Entamoeba histolytica
GSPRAEEYKDNSRIPEI

SEQ ID NO: 2623915 - protein, 9 aa, Entamoeba histolytica
GSPRENGNT

SEQ ID NO: 2623916 - protein, 14 aa, Entamoeba histolytica
GSPRRCGGQGDVLS

SEQ ID NO: 2623917 - protein, 6 aa, Entamoeba histolytica
GSPSYV

SEQ ID NO: 2623918 - protein, 5 aa, Entamoeba histolytica
GSPYA

SEQ ID NO: 2623919 - protein, 7 aa, Entamoeba histolytica
GSQDTEV

SEQ ID NO: 2623920 - protein, 16 aa, Entamoeba histolytica
GSQEDHPTGKTKNGSF

SEQ ID NO: 2623921 - protein, 8 aa, Entamoeba histolytica
GSQETLDI

SEQ ID NO: 2623922 - protein, 84 aa, Entamoeba histolytica
GSQPVKSTPEWEEKPIDKWKKTTTQEISEPKEKKGRKSSKAESEKKFKTQEDTSTSKLKSTFSPYNPSQTQKEKHTQKGRKEKK

SEQ ID NO: 2623923 - protein, 4 aa, Entamoeba histolytica
GSRD

SEQ ID NO: 2623924 - protein, 8 aa, Entamoeba histolytica
GSREASNK

SEQ ID NO: 2623925 - protein, 4 aa, Entamoeba histolytica
GSRI

SEQ ID NO: 2623926 - protein, 8 aa, Entamoeba histolytica
GSRISHNH

SEQ ID NO: 2623927 - protein, 54 aa, Entamoeba histolytica
GSRKKALEQGEDDDEGDDEQDDDDDTEEDDTEEEEEDDTEEDDSDDGDDTMVIR

SEQ ID NO: 2623928 - protein, 7 aa, Entamoeba histolytica
GSRNEAD

SEQ ID NO: 2623929 - protein, 20 aa, Entamoeba histolytica
GSRPQSVPGNYNQSELTVPK

SEQ ID NO: 2623930 - protein, 7 aa, Entamoeba histolytica
GSRQIRG

SEQ ID NO: 2623931 - protein, 10 aa, Entamoeba histolytica
GSRRGKSATL

SEQ ID NO: 2623932 - protein, 10 aa, Entamoeba histolytica
GSRSRKQCRE

SEQ ID NO: 2623933 - protein, 4 aa, Entamoeba histolytica
GSSC

SEQ ID NO: 2623934 - protein, 4 aa, Entamoeba histolytica
GSSE

SEQ ID NO: 2623935 - protein, 8 aa, Entamoeba histolytica
GSSEHNQL

SEQ ID NO: 2623936 - protein, 7 aa, Entamoeba histolytica
GSSEYHQ

SEQ ID NO: 2623937 - protein, 4 aa, Entamoeba histolytica
GSSF

SEQ ID NO: 2623938 - protein, 7 aa, Entamoeba histolytica
GSSFNDH

SEQ ID NO: 2623939 - protein, 18 aa, Entamoeba histolytica
GSSFPRLGGNTTTNHSEV

SEQ ID NO: 2623940 - protein, 5 aa, Entamoeba histolytica
GSSFT

SEQ ID NO: 2623941 - protein, 7 aa, Entamoeba histolytica
GSSIEKK

SEQ ID NO: 2623942 - protein, 7 aa, Entamoeba histolytica
GSSISMP

SEQ ID NO: 2623943 - protein, 9 aa, Entamoeba histolytica
GSSKDSDVA

SEQ ID NO: 2623944 - protein, 10 aa, Entamoeba histolytica
GSSKELQLSQ

SEQ ID NO: 2623945 - protein, 15 aa, Entamoeba histolytica
GSSKKKEEEALKKGA

SEQ ID NO: 2623946 - protein, 14 aa, Entamoeba histolytica
GSSKKLAKELTPIK

SEQ ID NO: 2623947 - protein, 12 aa, Entamoeba histolytica
GSSKKPSNYPDE

SEQ ID NO: 2623948 - protein, 13 aa, Entamoeba histolytica
GSSLDKIRSQNWA

SEQ ID NO: 2623949 - protein, 14 aa, Entamoeba histolytica
GSSLGSKKVSKNQF

SEQ ID NO: 2623950 - protein, 7 aa, Entamoeba histolytica
GSSLKEQ

SEQ ID NO: 2623951 - protein, 6 aa, Entamoeba histolytica
GSSLRT

SEQ ID NO: 2623952 - protein, 4 aa, Entamoeba histolytica
GSSM

SEQ ID NO: 2623953 - protein, 4 aa, Entamoeba histolytica
GSSN

SEQ ID NO: 2623954 - protein, 8 aa, Entamoeba histolytica
GSSNEKNK

SEQ ID NO: 2623955 - protein, 31 aa, Entamoeba histolytica
GSSNSDSEDPSRARSASSLQSPSTSQSPRLS

SEQ ID NO: 2623956 - protein, 7 aa, Entamoeba histolytica
GSSNTDL

SEQ ID NO: 2623957 - protein, 42 aa, Entamoeba histolytica
GSSNVNPSNEKNTTSFGQSNSSLAGFSNTQTTPSSTAQGPLT

SEQ ID NO: 2623958 - protein, 16 aa, Entamoeba histolytica
GSSQADNITVTNDGAT

SEQ ID NO: 2623959 - protein, 7 aa, Entamoeba histolytica
GSSQDNI

SEQ ID NO: 2623960 - protein, 9 aa, Entamoeba histolytica
GSSQSTPSF

SEQ ID NO: 2623961 - protein, 4 aa, Entamoeba histolytica
GSSR

SEQ ID NO: 2623962 - protein, 16 aa, Entamoeba histolytica
GSSRIKKTQKEQRGLN

SEQ ID NO: 2623963 - protein, 7 aa, Entamoeba histolytica
GSSSCEA

SEQ ID NO: 2623964 - protein, 9 aa, Entamoeba histolytica
GSSSEFGKW

SEQ ID NO: 2623965 - protein, 18 aa, Entamoeba histolytica
GSSSGASYQPTVSDDKTE

SEQ ID NO: 2623966 - protein, 18 aa, Entamoeba histolytica
GSSSKLQKHVSHAHSREI

SEQ ID NO: 2623967 - protein, 6 aa, Entamoeba histolytica
GSSSLT

SEQ ID NO: 2623968 - protein, 12 aa, Entamoeba histolytica
GSSSPSTRKNAT

SEQ ID NO: 2623969 - protein, 11 aa, Entamoeba histolytica
GSSTDNPTSLL

SEQ ID NO: 2623970 - protein, 7 aa, Entamoeba histolytica
GSSTIQQ

SEQ ID NO: 2623971 - protein, 9 aa, Entamoeba histolytica
GSSTNPHYR

SEQ ID NO: 2623972 - protein, 9 aa, Entamoeba histolytica
GSSTPSTLL

SEQ ID NO: 2623973 - protein, 12 aa, Entamoeba histolytica
GSSTRVSKESVD

SEQ ID NO: 2623974 - protein, 15 aa, Entamoeba histolytica
GSSVETDKKEKEGIS

SEQ ID NO: 2623975 - protein, 16 aa, Entamoeba histolytica
GSSVSPGTPSSEISNP

SEQ ID NO: 2623976 - protein, 5 aa, Entamoeba histolytica
GSTDY

SEQ ID NO: 2623977 - protein, 6 aa, Entamoeba histolytica
GSTEHD

SEQ ID NO: 2623978 - protein, 16 aa, Entamoeba histolytica
GSTELKQKVESCNGNI

SEQ ID NO: 2623979 - protein, 9 aa, Entamoeba histolytica
GSTEQAEQG

SEQ ID NO: 2623980 - protein, 4 aa, Entamoeba histolytica
GSTF

SEQ ID NO: 2623981 - protein, 5 aa, Entamoeba histolytica
GSTFT

SEQ ID NO: 2623982 - protein, 8 aa, Entamoeba histolytica
GSTKIPKI

SEQ ID NO: 2623983 - protein, 31 aa, Entamoeba histolytica
GSTKSSPFGSSTEPPRDKDTTSSTGEAARDV

SEQ ID NO: 2623984 - protein, 8 aa, Entamoeba histolytica
GSTNASLR

SEQ ID NO: 2623985 - protein, 6 aa, Entamoeba histolytica
GSTPEA

SEQ ID NO: 2623986 - protein, 15 aa, Entamoeba histolytica
GSTPKHEEVKENAQI

SEQ ID NO: 2623987 - protein, 13 aa, Entamoeba histolytica
GSTPSQPKQQPNT

SEQ ID NO: 2623988 - protein, 17 aa, Entamoeba histolytica
GSTPTITKTQSSDTLHP

SEQ ID NO: 2623989 - protein, 4 aa, Entamoeba histolytica
GSTQ

SEQ ID NO: 2623990 - protein, 15 aa, Entamoeba histolytica
GSTQGSQGTNPGTID

SEQ ID NO: 2623991 - protein, 7 aa, Entamoeba histolytica
GSTRGYD

SEQ ID NO: 2623992 - protein, 7 aa, Entamoeba histolytica
GSTSLKS

SEQ ID NO: 2623993 - protein, 8 aa, Entamoeba histolytica
GSTSLKSI

SEQ ID NO: 2623994 - protein, 12 aa, Entamoeba histolytica
GSTSSSSLSEEK

SEQ ID NO: 2623995 - protein, 10 aa, Entamoeba histolytica
GSTVPVPLPE

SEQ ID NO: 2623996 - protein, 6 aa, Entamoeba histolytica
GSTYDG

SEQ ID NO: 2623997 - protein, 6 aa, Entamoeba histolytica
GSTYSK

SEQ ID NO: 2623998 - protein, 6 aa, Entamoeba histolytica
GSVDDK

SEQ ID NO: 2623999 - protein, 6 aa, Entamoeba histolytica
GSVGKS

SEQ ID NO: 2624000 - protein, 4 aa, Entamoeba histolytica
GSVI

SEQ ID NO: 2624001 - protein, 6 aa, Entamoeba histolytica
GSVIDG

SEQ ID NO: 2624002 - protein, 10 aa, Entamoeba histolytica
GSVKYTSSQG

SEQ ID NO: 2624003 - protein, 14 aa, Entamoeba histolytica
GSVPDINKAPFFCD

SEQ ID NO: 2624004 - protein, 7 aa, Entamoeba histolytica
GSVPLKE

SEQ ID NO: 2624005 - protein, 6 aa, Entamoeba histolytica
GSVPPS

SEQ ID NO: 2624006 - protein, 6 aa, Entamoeba histolytica
GSVPQY

SEQ ID NO: 2624007 - protein, 8 aa, Entamoeba histolytica
GSVQRSKK

SEQ ID NO: 2624008 - protein, 4 aa, Entamoeba histolytica
GSVT

SEQ ID NO: 2624009 - protein, 5 aa, Entamoeba histolytica
GSWNY

SEQ ID NO: 2624010 - protein, 8 aa, Entamoeba histolytica
GSYDGSVK

SEQ ID NO: 2624011 - protein, 6 aa, Entamoeba histolytica
GSYEFT

SEQ ID NO: 2624012 - protein, 7 aa, Entamoeba histolytica
GSYGRTD

SEQ ID NO: 2624013 - protein, 6 aa, Entamoeba histolytica
GSYKAA

SEQ ID NO: 2624014 - protein, 12 aa, Entamoeba histolytica
GSYKKPSPIKKE

SEQ ID NO: 2624015 - protein, 12 aa, Entamoeba histolytica
GSYKNKKGKEQH

SEQ ID NO: 2624016 - protein, 10 aa, Entamoeba histolytica
GSYNEKSATG

SEQ ID NO: 2624017 - protein, 8 aa, Entamoeba histolytica
GSYPPDID

SEQ ID NO: 2624018 - protein, 9 aa, Entamoeba histolytica
GSYPPKNEF

SEQ ID NO: 2624019 - protein, 16 aa, Entamoeba histolytica
GSYSFKKGQIQLVNAL

SEQ ID NO: 2624020 - protein, 6 aa, Entamoeba histolytica
GSYTSA

SEQ ID NO: 2624021 - protein, 10 aa, Entamoeba histolytica
GTAAHSETIG

SEQ ID NO: 2624022 - protein, 6 aa, Entamoeba histolytica
GTAEAH

SEQ ID NO: 2624023 - protein, 12 aa, Entamoeba histolytica
GTAEKGNERKKL

SEQ ID NO: 2624024 - protein, 5 aa, Entamoeba histolytica
GTAEQ

SEQ ID NO: 2624025 - protein, 7 aa, Entamoeba histolytica
GTAEQNN

SEQ ID NO: 2624026 - protein, 11 aa, Entamoeba histolytica
GTAFGGDKLDD

SEQ ID NO: 2624027 - protein, 4 aa, Entamoeba histolytica
GTAG

SEQ ID NO: 2624028 - protein, 5 aa, Entamoeba histolytica
GTAGT

SEQ ID NO: 2624029 - protein, 5 aa, Entamoeba histolytica
GTAIA

SEQ ID NO: 2624030 - protein, 10 aa, Entamoeba histolytica
GTAKKDDAGR

SEQ ID NO: 2624031 - protein, 11 aa, Entamoeba histolytica
GTALPAEGSAL

SEQ ID NO: 2624032 - protein, 8 aa, Entamoeba histolytica
GTANEKAI

SEQ ID NO: 2624033 - protein, 9 aa, Entamoeba histolytica
GTANQPNDY

SEQ ID NO: 2624034 - protein, 13 aa, Entamoeba histolytica
GTAPKVLGRSKDL

SEQ ID NO: 2624035 - protein, 5 aa, Entamoeba histolytica
GTAQR

SEQ ID NO: 2624036 - protein, 7 aa, Entamoeba histolytica
GTAQTIG

SEQ ID NO: 2624037 - protein, 8 aa, Entamoeba histolytica
GTASDTIK

SEQ ID NO: 2624038 - protein, 8 aa, Entamoeba histolytica
GTASPHAM

SEQ ID NO: 2624039 - protein, 6 aa, Entamoeba histolytica
GTCKYG

SEQ ID NO: 2624040 - protein, 5 aa, Entamoeba histolytica
GTCRY

SEQ ID NO: 2624041 - protein, 5 aa, Entamoeba histolytica
GTCTR

SEQ ID NO: 2624042 - protein, 5 aa, Entamoeba histolytica
GTDEI

SEQ ID NO: 2624043 - protein, 7 aa, Entamoeba histolytica
GTDETKV

SEQ ID NO: 2624044 - protein, 15 aa, Entamoeba histolytica
GTDGSAREDDYSFER

SEQ ID NO: 2624045 - protein, 5 aa, Entamoeba histolytica
GTDIT

SEQ ID NO: 2624046 - protein, 7 aa, Entamoeba histolytica
GTDKTGV

SEQ ID NO: 2624047 - protein, 8 aa, Entamoeba histolytica
GTDLSRDD

SEQ ID NO: 2624048 - protein, 6 aa, Entamoeba histolytica
GTDPQT

SEQ ID NO: 2624049 - protein, 4 aa, Entamoeba histolytica
GTDQ

SEQ ID NO: 2624050 - protein, 5 aa, Entamoeba histolytica
GTDSF

SEQ ID NO: 2624051 - protein, 17 aa, Entamoeba histolytica
GTDSPDQIKQKDSASKE

SEQ ID NO: 2624052 - protein, 12 aa, Entamoeba histolytica
GTEASEEQQQEM

SEQ ID NO: 2624053 - protein, 8 aa, Entamoeba histolytica
GTEDFAPH

SEQ ID NO: 2624054 - protein, 9 aa, Entamoeba histolytica
GTEDGFSAE

SEQ ID NO: 2624055 - protein, 42 aa, Entamoeba histolytica
GTEEEIKEFNEAKEKEMKSIEERKNKENKTKKVERKKRRVDD

SEQ ID NO: 2624056 - protein, 6 aa, Entamoeba histolytica
GTEEEM

SEQ ID NO: 2624057 - protein, 9 aa, Entamoeba histolytica
GTEFRNEQG

SEQ ID NO: 2624058 - protein, 7 aa, Entamoeba histolytica
GTEGDYN

SEQ ID NO: 2624059 - protein, 4 aa, Entamoeba histolytica
GTEH

SEQ ID NO: 2624060 - protein, 6 aa, Entamoeba histolytica
GTEINH

SEQ ID NO: 2624061 - protein, 5 aa, Entamoeba histolytica
GTEIP

SEQ ID NO: 2624062 - protein, 11 aa, Entamoeba histolytica
GTEKQYTITTT

SEQ ID NO: 2624063 - protein, 9 aa, Entamoeba histolytica
GTEPNSSLI

SEQ ID NO: 2624064 - protein, 16 aa, Entamoeba histolytica
GTEPPGYKKPKVSSNT

SEQ ID NO: 2624065 - protein, 9 aa, Entamoeba histolytica
GTEQKEQEV

SEQ ID NO: 2624066 - protein, 10 aa, Entamoeba histolytica
GTEQKIPKQL

SEQ ID NO: 2624067 - protein, 11 aa, Entamoeba histolytica
GTERAKELTNK

SEQ ID NO: 2624068 - protein, 7 aa, Entamoeba histolytica
GTETGET

SEQ ID NO: 2624069 - protein, 6 aa, Entamoeba histolytica
GTEVKK

SEQ ID NO: 2624070 - protein, 44 aa, Entamoeba histolytica
GTFGQQQNTGMGGFGQQQNNGMGGFGQQQNNGMGGFGQPQTGSS

SEQ ID NO: 2624071 - protein, 13 aa, Entamoeba histolytica
GTFKSDEKSTIGA

SEQ ID NO: 2624072 - protein, 13 aa, Entamoeba histolytica
GTFNEEQSATVGA

SEQ ID NO: 2624073 - protein, 6 aa, Entamoeba histolytica
GTFNGC

SEQ ID NO: 2624074 - protein, 9 aa, Entamoeba histolytica
GTFQRKPFG

SEQ ID NO: 2624075 - protein, 6 aa, Entamoeba histolytica
GTFRPE

SEQ ID NO: 2624076 - protein, 9 aa, Entamoeba histolytica
GTGDDVEDY

SEQ ID NO: 2624077 - protein, 12 aa, Entamoeba histolytica
GTGDERFQSPAT

SEQ ID NO: 2624078 - protein, 10 aa, Entamoeba histolytica
GTGDGKSSLG

SEQ ID NO: 2624079 - protein, 10 aa, Entamoeba histolytica
GTGFSDSTIK

SEQ ID NO: 2624080 - protein, 6 aa, Entamoeba histolytica
GTGGSS

SEQ ID NO: 2624081 - protein, 16 aa, Entamoeba histolytica
GTGGTWPLKPSENIEL

SEQ ID NO: 2624082 - protein, 4 aa, Entamoeba histolytica
GTGH

SEQ ID NO: 2624083 - protein, 7 aa, Entamoeba histolytica
GTGHPDI

SEQ ID NO: 2624084 - protein, 8 aa, Entamoeba histolytica
GTGISNQI

SEQ ID NO: 2624085 - protein, 6 aa, Entamoeba histolytica
GTGNDL

SEQ ID NO: 2624086 - protein, 6 aa, Entamoeba histolytica
GTGNGC

SEQ ID NO: 2624087 - protein, 4 aa, Entamoeba histolytica
GTGP

SEQ ID NO: 2624088 - protein, 5 aa, Entamoeba histolytica
GTGSF

SEQ ID NO: 2624089 - protein, 8 aa, Entamoeba histolytica
GTGSGKTV

SEQ ID NO: 2624090 - protein, 5 aa, Entamoeba histolytica
GTGSV

SEQ ID NO: 2624091 - protein, 7 aa, Entamoeba histolytica
GTGSVGA

SEQ ID NO: 2624092 - protein, 8 aa, Entamoeba histolytica
GTGTGKTV

SEQ ID NO: 2624093 - protein, 7 aa, Entamoeba histolytica
GTGTSGK

SEQ ID NO: 2624094 - protein, 8 aa, Entamoeba histolytica
GTGTSGYV

SEQ ID NO: 2624095 - protein, 7 aa, Entamoeba histolytica
GTGWGEK

SEQ ID NO: 2624096 - protein, 7 aa, Entamoeba histolytica
GTGYTKI

SEQ ID NO: 2624097 - protein, 5 aa, Entamoeba histolytica
GTHSP

SEQ ID NO: 2624098 - protein, 29 aa, Entamoeba histolytica
GTHVPKPKGDAPVIEDRPNGKKEVVSGDK

SEQ ID NO: 2624099 - protein, 5 aa, Entamoeba histolytica
GTHVT

SEQ ID NO: 2624100 - protein, 10 aa, Entamoeba histolytica
GTIDNNEQIA

SEQ ID NO: 2624101 - protein, 6 aa, Entamoeba histolytica
GTIESN

SEQ ID NO: 2624102 - protein, 10 aa, Entamoeba histolytica
GTIKRNTATL

SEQ ID NO: 2624103 - protein, 8 aa, Entamoeba histolytica
GTINDAQP

SEQ ID NO: 2624104 - protein, 6 aa, Entamoeba histolytica
GTINSK

SEQ ID NO: 2624105 - protein, 8 aa, Entamoeba histolytica
GTISQTTK

SEQ ID NO: 2624106 - protein, 21 aa, Entamoeba histolytica
GTITKDNRNLQDSNSNQQLTD

SEQ ID NO: 2624107 - protein, 15 aa, Entamoeba histolytica
GTIVTDEKKRWFECC

SEQ ID NO: 2624108 - protein, 7 aa, Entamoeba histolytica
GTKDFEG

SEQ ID NO: 2624109 - protein, 10 aa, Entamoeba histolytica
GTKEGLEGAK

SEQ ID NO: 2624110 - protein, 6 aa, Entamoeba histolytica
GTKEGN

SEQ ID NO: 2624111 - protein, 8 aa, Entamoeba histolytica
GTKENVQQ

SEQ ID NO: 2624112 - protein, 11 aa, Entamoeba histolytica
GTKEPENVTLS

SEQ ID NO: 2624113 - protein, 8 aa, Entamoeba histolytica
GTKEQKHS

SEQ ID NO: 2624114 - protein, 8 aa, Entamoeba histolytica
GTKESFGK

SEQ ID NO: 2624115 - protein, 10 aa, Entamoeba histolytica
GTKFDNNDKL

SEQ ID NO: 2624116 - protein, 12 aa, Entamoeba histolytica
GTKHRTNDGIQE

SEQ ID NO: 2624117 - protein, 8 aa, Entamoeba histolytica
GTKINSSN

SEQ ID NO: 2624118 - protein, 7 aa, Entamoeba histolytica
GTKPDFH

SEQ ID NO: 2624119 - protein, 14 aa, Entamoeba histolytica
GTKQRAQKKQEEFT

SEQ ID NO: 2624120 - protein, 55 aa, Entamoeba histolytica
GTKRKHPQFARRKQKKTEQKENEDNNDQQQNEFNEEQNESIKPVKKTKKNLSQQE

SEQ ID NO: 2624121 - protein, 30 aa, Entamoeba histolytica
GTKSEIDKQTQENGLDNKTEKTLPDIDDTK

SEQ ID NO: 2624122 - protein, 7 aa, Entamoeba histolytica
GTKSEIK

SEQ ID NO: 2624123 - protein, 24 aa, Entamoeba histolytica
GTKSRKEINEECEEVDEKDEGELT

SEQ ID NO: 2624124 - protein, 9 aa, Entamoeba histolytica
GTKTALSND

SEQ ID NO: 2624125 - protein, 6 aa, Entamoeba histolytica
GTKTTA

SEQ ID NO: 2624126 - protein, 7 aa, Entamoeba histolytica
GTKTVSS

SEQ ID NO: 2624127 - protein, 7 aa, Entamoeba histolytica
GTKVDGS

SEQ ID NO: 2624128 - protein, 4 aa, Entamoeba histolytica
GTKY

SEQ ID NO: 2624129 - protein, 8 aa, Entamoeba histolytica
GTKYQELK

SEQ ID NO: 2624130 - protein, 4 aa, Entamoeba histolytica
GTLE

SEQ ID NO: 2624131 - protein, 9 aa, Entamoeba histolytica
GTLENKGEA

SEQ ID NO: 2624132 - protein, 10 aa, Entamoeba histolytica
GTLGSGVNGY

SEQ ID NO: 2624133 - protein, 4 aa, Entamoeba histolytica
GTLI

SEQ ID NO: 2624134 - protein, 4 aa, Entamoeba histolytica
GTLK

SEQ ID NO: 2624135 - protein, 6 aa, Entamoeba histolytica
GTLNPS

SEQ ID NO: 2624136 - protein, 33 aa, Entamoeba histolytica
GTLPPVPPKPRSGLMNESAPSSEDNEDSPIKRR

SEQ ID NO: 2624137 - protein, 8 aa, Entamoeba histolytica
GTLQDTST

SEQ ID NO: 2624138 - protein, 13 aa, Entamoeba histolytica
GTLQRLDQTTSTT

SEQ ID NO: 2624139 - protein, 6 aa, Entamoeba histolytica
GTLSPL

SEQ ID NO: 2624140 - protein, 10 aa, Entamoeba histolytica
GTLSPTYHQQ

SEQ ID NO: 2624141 - protein, 4 aa, Entamoeba histolytica
GTLT

SEQ ID NO: 2624142 - protein, 8 aa, Entamoeba histolytica
GTMENGSD

SEQ ID NO: 2624143 - protein, 9 aa, Entamoeba histolytica
GTMGERSQE

SEQ ID NO: 2624144 - protein, 7 aa, Entamoeba histolytica
GTMPEKG

SEQ ID NO: 2624145 - protein, 7 aa, Entamoeba histolytica
GTMTSRD

SEQ ID NO: 2624146 - protein, 14 aa, Entamoeba histolytica
GTNAASGKKNKVYT

SEQ ID NO: 2624147 - protein, 11 aa, Entamoeba histolytica
GTNDKSGKNTI

SEQ ID NO: 2624148 - protein, 4 aa, Entamoeba histolytica
GTNE

SEQ ID NO: 2624149 - protein, 6 aa, Entamoeba histolytica
GTNEEC

SEQ ID NO: 2624150 - protein, 6 aa, Entamoeba histolytica
GTNEQR

SEQ ID NO: 2624151 - protein, 15 aa, Entamoeba histolytica
GTNETAKSENTSNGF

SEQ ID NO: 2624152 - protein, 6 aa, Entamoeba histolytica
GTNGEN

SEQ ID NO: 2624153 - protein, 14 aa, Entamoeba histolytica
GTNIDQYKPDLKNS

SEQ ID NO: 2624154 - protein, 15 aa, Entamoeba histolytica
GTNIKTKENRHTTMA

SEQ ID NO: 2624155 - protein, 7 aa, Entamoeba histolytica
GTNKEEL

SEQ ID NO: 2624156 - protein, 9 aa, Entamoeba histolytica
GTNKHTPTV

SEQ ID NO: 2624157 - protein, 12 aa, Entamoeba histolytica
GTNKNNPDGISG

SEQ ID NO: 2624158 - protein, 14 aa, Entamoeba histolytica
GTNLKTTNPNGNTA

SEQ ID NO: 2624159 - protein, 11 aa, Entamoeba histolytica
GTNLNSKEESG

SEQ ID NO: 2624160 - protein, 18 aa, Entamoeba histolytica
GTNNETNEDETKQTTDNF

SEQ ID NO: 2624161 - protein, 11 aa, Entamoeba histolytica
GTNPGYRRERE

SEQ ID NO: 2624162 - protein, 17 aa, Entamoeba histolytica
GTNPYTVDGEGRGPAWG

SEQ ID NO: 2624163 - protein, 10 aa, Entamoeba histolytica
GTNQTNNTNL

SEQ ID NO: 2624164 - protein, 5 aa, Entamoeba histolytica
GTNSG

SEQ ID NO: 2624165 - protein, 5 aa, Entamoeba histolytica
GTNSI

SEQ ID NO: 2624166 - protein, 12 aa, Entamoeba histolytica
GTPAKERSEYAK

SEQ ID NO: 2624167 - protein, 7 aa, Entamoeba histolytica
GTPDYTA

SEQ ID NO: 2624168 - protein, 7 aa, Entamoeba histolytica
GTPEAVE

SEQ ID NO: 2624169 - protein, 4 aa, Entamoeba histolytica
GTPG

SEQ ID NO: 2624170 - protein, 6 aa, Entamoeba histolytica
GTPGFS

SEQ ID NO: 2624171 - protein, 6 aa, Entamoeba histolytica
GTPGRV

SEQ ID NO: 2624172 - protein, 8 aa, Entamoeba histolytica
GTPGTGKS

SEQ ID NO: 2624173 - protein, 8 aa, Entamoeba histolytica
GTPGTGKT

SEQ ID NO: 2624174 - protein, 18 aa, Entamoeba histolytica
GTPGYTAPEVSSGDYDTS

SEQ ID NO: 2624175 - protein, 6 aa, Entamoeba histolytica
GTPHPV

SEQ ID NO: 2624176 - protein, 7 aa, Entamoeba histolytica
GTPIPYE

SEQ ID NO: 2624177 - protein, 7 aa, Entamoeba histolytica
GTPIQNN

SEQ ID NO: 2624178 - protein, 8 aa, Entamoeba histolytica
GTPKNITN

SEQ ID NO: 2624179 - protein, 10 aa, Entamoeba histolytica
GTPKNLGSSI

SEQ ID NO: 2624180 - protein, 7 aa, Entamoeba histolytica
GTPKPIS

SEQ ID NO: 2624181 - protein, 4 aa, Entamoeba histolytica
GTPL

SEQ ID NO: 2624182 - protein, 14 aa, Entamoeba histolytica
GTPLENKTDEELCK

SEQ ID NO: 2624183 - protein, 6 aa, Entamoeba histolytica
GTPPFS

SEQ ID NO: 2624184 - protein, 8 aa, Entamoeba histolytica
GTPPSEIE

SEQ ID NO: 2624185 - protein, 8 aa, Entamoeba histolytica
GTPQKAQI

SEQ ID NO: 2624186 - protein, 7 aa, Entamoeba histolytica
GTPSGQM

SEQ ID NO: 2624187 - protein, 9 aa, Entamoeba histolytica
GTPSTKQTT

SEQ ID NO: 2624188 - protein, 5 aa, Entamoeba histolytica
GTPSY

SEQ ID NO: 2624189 - protein, 5 aa, Entamoeba histolytica
GTPTH

SEQ ID NO: 2624190 - protein, 7 aa, Entamoeba histolytica
GTPTQKE

SEQ ID NO: 2624191 - protein, 6 aa, Entamoeba histolytica
GTPTSY

SEQ ID NO: 2624192 - protein, 5 aa, Entamoeba histolytica
GTPTY

SEQ ID NO: 2624193 - protein, 9 aa, Entamoeba histolytica
GTPVPKGIS

SEQ ID NO: 2624194 - protein, 5 aa, Entamoeba histolytica
GTPYW

SEQ ID NO: 2624195 - protein, 16 aa, Entamoeba histolytica
GTQALRRASEKEVENG

SEQ ID NO: 2624196 - protein, 4 aa, Entamoeba histolytica
GTQF

SEQ ID NO: 2624197 - protein, 11 aa, Entamoeba histolytica
GTQGEKEMEEL

SEQ ID NO: 2624198 - protein, 9 aa, Entamoeba histolytica
GTQINKDPA

SEQ ID NO: 2624199 - protein, 6 aa, Entamoeba histolytica
GTQKEL

SEQ ID NO: 2624200 - protein, 6 aa, Entamoeba histolytica
GTQLDP

SEQ ID NO: 2624201 - protein, 6 aa, Entamoeba histolytica
GTQNND

SEQ ID NO: 2624202 - protein, 4 aa, Entamoeba histolytica
GTQQ

SEQ ID NO: 2624203 - protein, 26 aa, Entamoeba histolytica
GTQREENKNQSRINEAKQAGIKAFNK

SEQ ID NO: 2624204 - protein, 6 aa, Entamoeba histolytica
GTRAPA

SEQ ID NO: 2624205 - protein, 4 aa, Entamoeba histolytica
GTRE

SEQ ID NO: 2624206 - protein, 6 aa, Entamoeba histolytica
GTRFER

SEQ ID NO: 2624207 - protein, 5 aa, Entamoeba histolytica
GTRNE

SEQ ID NO: 2624208 - protein, 6 aa, Entamoeba histolytica
GTRSAK

SEQ ID NO: 2624209 - protein, 9 aa, Entamoeba histolytica
GTRSRKQCR

SEQ ID NO: 2624210 - protein, 6 aa, Entamoeba histolytica
GTRSSI

SEQ ID NO: 2624211 - protein, 9 aa, Entamoeba histolytica
GTSAEKNLE

SEQ ID NO: 2624212 - protein, 5 aa, Entamoeba histolytica
GTSAG

SEQ ID NO: 2624213 - protein, 6 aa, Entamoeba histolytica
GTSDEL

SEQ ID NO: 2624214 - protein, 20 aa, Entamoeba histolytica
GTSDVKPEINVSSTPLAEGT

SEQ ID NO: 2624215 - protein, 8 aa, Entamoeba histolytica
GTSGIPKG

SEQ ID NO: 2624216 - protein, 6 aa, Entamoeba histolytica
GTSHGA

SEQ ID NO: 2624217 - protein, 16 aa, Entamoeba histolytica
GTSHGAYKFKPGMHPR

SEQ ID NO: 2624218 - protein, 10 aa, Entamoeba histolytica
GTSKDKNYTY

SEQ ID NO: 2624219 - protein, 7 aa, Entamoeba histolytica
GTSKQIN

SEQ ID NO: 2624220 - protein, 5 aa, Entamoeba histolytica
GTSLD

SEQ ID NO: 2624221 - protein, 4 aa, Entamoeba histolytica
GTSM

SEQ ID NO: 2624222 - protein, 4 aa, Entamoeba histolytica
GTSN

SEQ ID NO: 2624223 - protein, 11 aa, Entamoeba histolytica
GTSNAETDEER

SEQ ID NO: 2624224 - protein, 10 aa, Entamoeba histolytica
GTSNNEIKSV

SEQ ID NO: 2624225 - protein, 11 aa, Entamoeba histolytica
GTSNRTSTLQL

SEQ ID NO: 2624226 - protein, 24 aa, Entamoeba histolytica
GTSPANARTKKQTKIEIWKKQMFV

SEQ ID NO: 2624227 - protein, 14 aa, Entamoeba histolytica
GTSPSQGGMSQQTK

SEQ ID NO: 2624228 - protein, 18 aa, Entamoeba histolytica
GTSQPNSHELDEDSLTSF

SEQ ID NO: 2624229 - protein, 21 aa, Entamoeba histolytica
GTSRFTKKNNTNSGDKGLGTP

SEQ ID NO: 2624230 - protein, 6 aa, Entamoeba histolytica
GTSSGL

SEQ ID NO: 2624231 - protein, 9 aa, Entamoeba histolytica
GTSSKLKPV

SEQ ID NO: 2624232 - protein, 14 aa, Entamoeba histolytica
GTSSTARLQTIGET

SEQ ID NO: 2624233 - protein, 6 aa, Entamoeba histolytica
GTSTAN

SEQ ID NO: 2624234 - protein, 16 aa, Entamoeba histolytica
GTSTGVKTDPQEVRDV

SEQ ID NO: 2624235 - protein, 15 aa, Entamoeba histolytica
GTSTLPYSPTYGATN

SEQ ID NO: 2624236 - protein, 6 aa, Entamoeba histolytica
GTSTVS

SEQ ID NO: 2624237 - protein, 6 aa, Entamoeba histolytica
GTSVPH

SEQ ID NO: 2624238 - protein, 4 aa, Entamoeba histolytica
GTSY

SEQ ID NO: 2624239 - protein, 5 aa, Entamoeba histolytica
GTTAD

SEQ ID NO: 2624240 - protein, 7 aa, Entamoeba histolytica
GTTAEEA

SEQ ID NO: 2624241 - protein, 15 aa, Entamoeba histolytica
GTTANFNDKISGKQN

SEQ ID NO: 2624242 - protein, 5 aa, Entamoeba histolytica
GTTAT

SEQ ID NO: 2624243 - protein, 4 aa, Entamoeba histolytica
GTTD

SEQ ID NO: 2624244 - protein, 7 aa, Entamoeba histolytica
GTTDENN

SEQ ID NO: 2624245 - protein, 9 aa, Entamoeba histolytica
GTTEFSEDS

SEQ ID NO: 2624246 - protein, 6 aa, Entamoeba histolytica
GTTEMG

SEQ ID NO: 2624247 - protein, 7 aa, Entamoeba histolytica
GTTENSG

SEQ ID NO: 2624248 - protein, 9 aa, Entamoeba histolytica
GTTGKDGKA

SEQ ID NO: 2624249 - protein, 6 aa, Entamoeba histolytica
GTTGNG

SEQ ID NO: 2624250 - protein, 12 aa, Entamoeba histolytica
GTTGSGKSTQLP

SEQ ID NO: 2624251 - protein, 4 aa, Entamoeba histolytica
GTTH

SEQ ID NO: 2624252 - protein, 4 aa, Entamoeba histolytica
GTTI

SEQ ID NO: 2624253 - protein, 5 aa, Entamoeba histolytica
GTTIK

SEQ ID NO: 2624254 - protein, 6 aa, Entamoeba histolytica
GTTIKQ

SEQ ID NO: 2624255 - protein, 7 aa, Entamoeba histolytica
GTTKEAV

SEQ ID NO: 2624256 - protein, 7 aa, Entamoeba histolytica
GTTKKTF

SEQ ID NO: 2624257 - protein, 12 aa, Entamoeba histolytica
GTTNNSVVIFEN

SEQ ID NO: 2624258 - protein, 5 aa, Entamoeba histolytica
GTTNS

SEQ ID NO: 2624259 - protein, 11 aa, Entamoeba histolytica
GTTQADKTVDC

SEQ ID NO: 2624260 - protein, 8 aa, Entamoeba histolytica
GTTQTFES

SEQ ID NO: 2624261 - protein, 7 aa, Entamoeba histolytica
GTTQTSL

SEQ ID NO: 2624262 - protein, 4 aa, Entamoeba histolytica
GTTR

SEQ ID NO: 2624263 - protein, 5 aa, Entamoeba histolytica
GTTRT

SEQ ID NO: 2624264 - protein, 6 aa, Entamoeba histolytica
GTTSGT

SEQ ID NO: 2624265 - protein, 6 aa, Entamoeba histolytica
GTTSMD

SEQ ID NO: 2624266 - protein, 4 aa, Entamoeba histolytica
GTTT

SEQ ID NO: 2624267 - protein, 5 aa, Entamoeba histolytica
GTTTA

SEQ ID NO: 2624268 - protein, 6 aa, Entamoeba histolytica
GTTTAV

SEQ ID NO: 2624269 - protein, 7 aa, Entamoeba histolytica
GTTTSPG

SEQ ID NO: 2624270 - protein, 4 aa, Entamoeba histolytica
GTTV

SEQ ID NO: 2624271 - protein, 6 aa, Entamoeba histolytica
GTTVGP

SEQ ID NO: 2624272 - protein, 7 aa, Entamoeba histolytica
GTVEDTA

SEQ ID NO: 2624273 - protein, 7 aa, Entamoeba histolytica
GTVESTR

SEQ ID NO: 2624274 - protein, 9 aa, Entamoeba histolytica
GTVKEEVND

SEQ ID NO: 2624275 - protein, 6 aa, Entamoeba histolytica
GTVKPS

SEQ ID NO: 2624276 - protein, 4 aa, Entamoeba histolytica
GTVP

SEQ ID NO: 2624277 - protein, 18 aa, Entamoeba histolytica
GTVRGGKGRENKNKREAD

SEQ ID NO: 2624278 - protein, 8 aa, Entamoeba histolytica
GTVRGQPV

SEQ ID NO: 2624279 - protein, 17 aa, Entamoeba histolytica
GTVRNTFPDMNETDIPQ

SEQ ID NO: 2624280 - protein, 6 aa, Entamoeba histolytica
GTVRSA

SEQ ID NO: 2624281 - protein, 10 aa, Entamoeba histolytica
GTVSTGKEAN

SEQ ID NO: 2624282 - protein, 4 aa, Entamoeba histolytica
GTVT

SEQ ID NO: 2624283 - protein, 12 aa, Entamoeba histolytica
GTWEESKEIEEE

SEQ ID NO: 2624284 - protein, 19 aa, Entamoeba histolytica
GTWPEQYKETRRHKFREGN

SEQ ID NO: 2624285 - protein, 4 aa, Entamoeba histolytica
GTYA

SEQ ID NO: 2624286 - protein, 8 aa, Entamoeba histolytica
GTYEETEP

SEQ ID NO: 2624287 - protein, 4 aa, Entamoeba histolytica
GTYF

SEQ ID NO: 2624288 - protein, 4 aa, Entamoeba histolytica
GTYG

SEQ ID NO: 2624289 - protein, 5 aa, Entamoeba histolytica
GTYNR

SEQ ID NO: 2624290 - protein, 18 aa, Entamoeba histolytica
GTYPDNTLAGSTECLPEN

SEQ ID NO: 2624291 - protein, 7 aa, Entamoeba histolytica
GTYSKAS

SEQ ID NO: 2624292 - protein, 4 aa, Entamoeba histolytica
GTYV

SEQ ID NO: 2624293 - protein, 10 aa, Entamoeba histolytica
GVADDTDVKA

SEQ ID NO: 2624294 - protein, 9 aa, Entamoeba histolytica
GVANPNDRR

SEQ ID NO: 2624295 - protein, 10 aa, Entamoeba histolytica
GVARKQGEIY

SEQ ID NO: 2624296 - protein, 4 aa, Entamoeba histolytica
GVAS

SEQ ID NO: 2624297 - protein, 14 aa, Entamoeba histolytica
GVATDPLYPTGVEY

SEQ ID NO: 2624298 - protein, 4 aa, Entamoeba histolytica
GVCN

SEQ ID NO: 2624299 - protein, 8 aa, Entamoeba histolytica
GVDASTRP

SEQ ID NO: 2624300 - protein, 6 aa, Entamoeba histolytica
GVDDGA

SEQ ID NO: 2624301 - protein, 10 aa, Entamoeba histolytica
GVDENSIKSA

SEQ ID NO: 2624302 - protein, 5 aa, Entamoeba histolytica
GVDGE

SEQ ID NO: 2624303 - protein, 9 aa, Entamoeba histolytica
GVDGKTTTE

SEQ ID NO: 2624304 - protein, 9 aa, Entamoeba histolytica
GVDNQKSGV

SEQ ID NO: 2624305 - protein, 7 aa, Entamoeba histolytica
GVDPATL

SEQ ID NO: 2624306 - protein, 8 aa, Entamoeba histolytica
GVDPSRTT

SEQ ID NO: 2624307 - protein, 7 aa, Entamoeba histolytica
GVDQNNG

SEQ ID NO: 2624308 - protein, 6 aa, Entamoeba histolytica
GVDQSK

SEQ ID NO: 2624309 - protein, 12 aa, Entamoeba histolytica
GVDTESKNKDGI

SEQ ID NO: 2624310 - protein, 12 aa, Entamoeba histolytica
GVEAKKQYMRGG

SEQ ID NO: 2624311 - protein, 6 aa, Entamoeba histolytica
GVECNK

SEQ ID NO: 2624312 - protein, 5 aa, Entamoeba histolytica
GVEDT

SEQ ID NO: 2624313 - protein, 9 aa, Entamoeba histolytica
GVEEADAAR

SEQ ID NO: 2624314 - protein, 5 aa, Entamoeba histolytica
GVEEC

SEQ ID NO: 2624315 - protein, 33 aa, Entamoeba histolytica
GVEEKNKTTTFTENENKISKFQTNQQEEQSEDS

SEQ ID NO: 2624316 - protein, 36 aa, Entamoeba histolytica
GVEENNNSQYNSEEDGIEEDGIEEDEIEEDIVDDEL

SEQ ID NO: 2624317 - protein, 8 aa, Entamoeba histolytica
GVEGLNDE

SEQ ID NO: 2624318 - protein, 6 aa, Entamoeba histolytica
GVEKAV

SEQ ID NO: 2624319 - protein, 9 aa, Entamoeba histolytica
GVEPKIADE

SEQ ID NO: 2624320 - protein, 4 aa, Entamoeba histolytica
GVEQ

SEQ ID NO: 2624321 - protein, 87 aa, Entamoeba histolytica
GVGADTYEAGYRKGGNAAGPMASKGTWEATTDIGKTAAVGADTYEAGYRRGADAAGPMASKGTWAATTDSGITAPCSGTEPIPDSYE

SEQ ID NO: 2624322 - protein, 8 aa, Entamoeba histolytica
GVGKDSKE

SEQ ID NO: 2624323 - protein, 10 aa, Entamoeba histolytica
GVGKRSDDCM

SEQ ID NO: 2624324 - protein, 6 aa, Entamoeba histolytica
GVGKSS

SEQ ID NO: 2624325 - protein, 6 aa, Entamoeba histolytica
GVGKST

SEQ ID NO: 2624326 - protein, 5 aa, Entamoeba histolytica
GVGPK

SEQ ID NO: 2624327 - protein, 5 aa, Entamoeba histolytica
GVGRT

SEQ ID NO: 2624328 - protein, 5 aa, Entamoeba histolytica
GVGSN

SEQ ID NO: 2624329 - protein, 6 aa, Entamoeba histolytica
GVGVGK

SEQ ID NO: 2624330 - protein, 12 aa, Entamoeba histolytica
GVHQKPVDVKLK

SEQ ID NO: 2624331 - protein, 10 aa, Entamoeba histolytica
GVIGQTELGS

SEQ ID NO: 2624332 - protein, 14 aa, Entamoeba histolytica
GVIKRGTKRHPTVG

SEQ ID NO: 2624333 - protein, 4 aa, Entamoeba histolytica
GVKD

SEQ ID NO: 2624334 - protein, 32 aa, Entamoeba histolytica
GVKEEVKEKPKEETTETQNQPRQEPNQQQGGF

SEQ ID NO: 2624335 - protein, 12 aa, Entamoeba histolytica
GVKGKALQDTPE

SEQ ID NO: 2624336 - protein, 12 aa, Entamoeba histolytica
GVKHRDGDPVAD

SEQ ID NO: 2624337 - protein, 17 aa, Entamoeba histolytica
GVKKDSDIKIRDETANK

SEQ ID NO: 2624338 - protein, 14 aa, Entamoeba histolytica
GVKKKDLQNPETRK

SEQ ID NO: 2624339 - protein, 10 aa, Entamoeba histolytica
GVKKRFAKKE

SEQ ID NO: 2624340 - protein, 5 aa, Entamoeba histolytica
GVKKS

SEQ ID NO: 2624341 - protein, 4 aa, Entamoeba histolytica
GVKN

SEQ ID NO: 2624342 - protein, 9 aa, Entamoeba histolytica
GVKPDSYNV

SEQ ID NO: 2624343 - protein, 9 aa, Entamoeba histolytica
GVKQDERHL

SEQ ID NO: 2624344 - protein, 5 aa, Entamoeba histolytica
GVKRN

SEQ ID NO: 2624345 - protein, 12 aa, Entamoeba histolytica
GVKRSEQDESYN

SEQ ID NO: 2624346 - protein, 4 aa, Entamoeba histolytica
GVKS

SEQ ID NO: 2624347 - protein, 7 aa, Entamoeba histolytica
GVLPDGI

SEQ ID NO: 2624348 - protein, 12 aa, Entamoeba histolytica
GVNDSTKTLKEQ

SEQ ID NO: 2624349 - protein, 5 aa, Entamoeba histolytica
GVNEI

SEQ ID NO: 2624350 - protein, 12 aa, Entamoeba histolytica
GVNGAEPAKAEL

SEQ ID NO: 2624351 - protein, 6 aa, Entamoeba histolytica
GVNGSF

SEQ ID NO: 2624352 - protein, 4 aa, Entamoeba histolytica
GVNK

SEQ ID NO: 2624353 - protein, 4 aa, Entamoeba histolytica
GVNN

SEQ ID NO: 2624354 - protein, 6 aa, Entamoeba histolytica
GVNQAQ

SEQ ID NO: 2624355 - protein, 15 aa, Entamoeba histolytica
GVNSDSGSQPAPIRT

SEQ ID NO: 2624356 - protein, 5 aa, Entamoeba histolytica
GVNSE

SEQ ID NO: 2624357 - protein, 11 aa, Entamoeba histolytica
GVNSQQKKDSM

SEQ ID NO: 2624358 - protein, 8 aa, Entamoeba histolytica
GVNTTERG

SEQ ID NO: 2624359 - protein, 6 aa, Entamoeba histolytica
GVPAQE

SEQ ID NO: 2624360 - protein, 7 aa, Entamoeba histolytica
GVPDSWR

SEQ ID NO: 2624361 - protein, 7 aa, Entamoeba histolytica
GVPESDE

SEQ ID NO: 2624362 - protein, 12 aa, Entamoeba histolytica
GVPKGGRGKRSF

SEQ ID NO: 2624363 - protein, 8 aa, Entamoeba histolytica
GVPKTAAY

SEQ ID NO: 2624364 - protein, 6 aa, Entamoeba histolytica
GVPLDD

SEQ ID NO: 2624365 - protein, 4 aa, Entamoeba histolytica
GVPP

SEQ ID NO: 2624366 - protein, 26 aa, Entamoeba histolytica
GVPPPPPPARGTGCGAPPPPPPPAFD

SEQ ID NO: 2624367 - protein, 12 aa, Entamoeba histolytica
GVPQLNKEKKYI

SEQ ID NO: 2624368 - protein, 5 aa, Entamoeba histolytica
GVPTG

SEQ ID NO: 2624369 - protein, 20 aa, Entamoeba histolytica
GVQDSLNATLTKKSQEALTS

SEQ ID NO: 2624370 - protein, 10 aa, Entamoeba histolytica
GVQEDGSKTI

SEQ ID NO: 2624371 - protein, 5 aa, Entamoeba histolytica
GVQRD

SEQ ID NO: 2624372 - protein, 4 aa, Entamoeba histolytica
GVQT

SEQ ID NO: 2624373 - protein, 9 aa, Entamoeba histolytica
GVQTNDRDV

SEQ ID NO: 2624374 - protein, 13 aa, Entamoeba histolytica
GVRDKEKKVDEER

SEQ ID NO: 2624375 - protein, 6 aa, Entamoeba histolytica
GVRGDS

SEQ ID NO: 2624376 - protein, 9 aa, Entamoeba histolytica
GVRGGKSKM

SEQ ID NO: 2624377 - protein, 7 aa, Entamoeba histolytica
GVSDGKS

SEQ ID NO: 2624378 - protein, 8 aa, Entamoeba histolytica
GVSEEAKD

SEQ ID NO: 2624379 - protein, 92 aa, Entamoeba histolytica
GVSGEEAEEKVNEESEDVQEKINKGKVIEEEVPEEEQNEMSEEEIETEEKSGSSSSSEEEEKEEKKSPLEEEKEEIKEKPNLVEKEEKGKKQ

SEQ ID NO: 2624380 - protein, 5 aa, Entamoeba histolytica
GVSGV

SEQ ID NO: 2624381 - protein, 4 aa, Entamoeba histolytica
GVSM

SEQ ID NO: 2624382 - protein, 8 aa, Entamoeba histolytica
GVSRPNKF

SEQ ID NO: 2624383 - protein, 6 aa, Entamoeba histolytica
GVSRSA

SEQ ID NO: 2624384 - protein, 6 aa, Entamoeba histolytica
GVSSHA

SEQ ID NO: 2624385 - protein, 12 aa, Entamoeba histolytica
GVSTTVEVQPSQ

SEQ ID NO: 2624386 - protein, 10 aa, Entamoeba histolytica
GVSYASSKMN

SEQ ID NO: 2624387 - protein, 12 aa, Entamoeba histolytica
GVSYGYDAEQKL

SEQ ID NO: 2624388 - protein, 5 aa, Entamoeba histolytica
GVTEF

SEQ ID NO: 2624389 - protein, 8 aa, Entamoeba histolytica
GVTEGYQL

SEQ ID NO: 2624390 - protein, 8 aa, Entamoeba histolytica
GVTNEEEI

SEQ ID NO: 2624391 - protein, 13 aa, Entamoeba histolytica
GVTPENVNEYSSA

SEQ ID NO: 2624392 - protein, 10 aa, Entamoeba histolytica
GVTPPPVPPL

SEQ ID NO: 2624393 - protein, 14 aa, Entamoeba histolytica
GVTQKRLNVPSKSI

SEQ ID NO: 2624394 - protein, 8 aa, Entamoeba histolytica
GVTRRAQD

SEQ ID NO: 2624395 - protein, 11 aa, Entamoeba histolytica
GVTSTPGKTKH

SEQ ID NO: 2624396 - protein, 7 aa, Entamoeba histolytica
GVTVNGK

SEQ ID NO: 2624397 - protein, 4 aa, Entamoeba histolytica
GVTY

SEQ ID NO: 2624398 - protein, 4 aa, Entamoeba histolytica
GVVE

SEQ ID NO: 2624399 - protein, 4 aa, Entamoeba histolytica
GVVK

SEQ ID NO: 2624400 - protein, 7 aa, Entamoeba histolytica
GVYDEPK

SEQ ID NO: 2624401 - protein, 7 aa, Entamoeba histolytica
GWDRTAQ

SEQ ID NO: 2624402 - protein, 13 aa, Entamoeba histolytica
GWGEKSSKAAISA

SEQ ID NO: 2624403 - protein, 6 aa, Entamoeba histolytica
GWGNSI

SEQ ID NO: 2624404 - protein, 7 aa, Entamoeba histolytica
GWNPQDV

SEQ ID NO: 2624405 - protein, 8 aa, Entamoeba histolytica
GWPAEPNN

SEQ ID NO: 2624406 - protein, 6 aa, Entamoeba histolytica
GWPEGS

SEQ ID NO: 2624407 - protein, 10 aa, Entamoeba histolytica
GWSGEGVGNL

SEQ ID NO: 2624408 - protein, 11 aa, Entamoeba histolytica
GWTETTKGEVT

SEQ ID NO: 2624409 - protein, 14 aa, Entamoeba histolytica
GWVPPEGVRGPVQT

SEQ ID NO: 2624410 - protein, 5 aa, Entamoeba histolytica
GYAEG

SEQ ID NO: 2624411 - protein, 14 aa, Entamoeba histolytica
GYAQSIKRKEVHEE

SEQ ID NO: 2624412 - protein, 4 aa, Entamoeba histolytica
GYDA

SEQ ID NO: 2624413 - protein, 4 aa, Entamoeba histolytica
GYDD

SEQ ID NO: 2624414 - protein, 6 aa, Entamoeba histolytica
GYDEDP

SEQ ID NO: 2624415 - protein, 4 aa, Entamoeba histolytica
GYDI

SEQ ID NO: 2624416 - protein, 8 aa, Entamoeba histolytica
GYDPVNGA

SEQ ID NO: 2624417 - protein, 10 aa, Entamoeba histolytica
GYDQKRIEEL

SEQ ID NO: 2624418 - protein, 5 aa, Entamoeba histolytica
GYDRT

SEQ ID NO: 2624419 - protein, 7 aa, Entamoeba histolytica
GYDSPNP

SEQ ID NO: 2624420 - protein, 5 aa, Entamoeba histolytica
GYDTE

SEQ ID NO: 2624421 - protein, 20 aa, Entamoeba histolytica
GYECGDNGEWSSKCVLAYCD

SEQ ID NO: 2624422 - protein, 6 aa, Entamoeba histolytica
GYEERK

SEQ ID NO: 2624423 - protein, 6 aa, Entamoeba histolytica
GYEIEE

SEQ ID NO: 2624424 - protein, 12 aa, Entamoeba histolytica
GYENAQKDGGLV

SEQ ID NO: 2624425 - protein, 20 aa, Entamoeba histolytica
GYESEDENEEKDERKRMIES

SEQ ID NO: 2624426 - protein, 5 aa, Entamoeba histolytica
GYESN

SEQ ID NO: 2624427 - protein, 6 aa, Entamoeba histolytica
GYETIT

SEQ ID NO: 2624428 - protein, 5 aa, Entamoeba histolytica
GYEVR

SEQ ID NO: 2624429 - protein, 4 aa, Entamoeba histolytica
GYEY

SEQ ID NO: 2624430 - protein, 4 aa, Entamoeba histolytica
GYFG

SEQ ID NO: 2624431 - protein, 11 aa, Entamoeba histolytica
GYGDESPNVEA

SEQ ID NO: 2624432 - protein, 10 aa, Entamoeba histolytica
GYGLNKNKKD

SEQ ID NO: 2624433 - protein, 13 aa, Entamoeba histolytica
GYGLNKNKKDVSM

SEQ ID NO: 2624434 - protein, 11 aa, Entamoeba histolytica
GYGRENGEKGH

SEQ ID NO: 2624435 - protein, 9 aa, Entamoeba histolytica
GYGSQDGQD

SEQ ID NO: 2624436 - protein, 8 aa, Entamoeba histolytica
GYGTNNRA

SEQ ID NO: 2624437 - protein, 9 aa, Entamoeba histolytica
GYGTSETGS

SEQ ID NO: 2624438 - protein, 6 aa, Entamoeba histolytica
GYHDNF

SEQ ID NO: 2624439 - protein, 7 aa, Entamoeba histolytica
GYITENG

SEQ ID NO: 2624440 - protein, 7 aa, Entamoeba histolytica
GYKDNKK

SEQ ID NO: 2624441 - protein, 7 aa, Entamoeba histolytica
GYKGANA

SEQ ID NO: 2624442 - protein, 5 aa, Entamoeba histolytica
GYKGD

SEQ ID NO: 2624443 - protein, 12 aa, Entamoeba histolytica
GYKGSKATPITI

SEQ ID NO: 2624444 - protein, 7 aa, Entamoeba histolytica
GYKPGDK

SEQ ID NO: 2624445 - protein, 4 aa, Entamoeba histolytica
GYKQ

SEQ ID NO: 2624446 - protein, 13 aa, Entamoeba histolytica
GYKRQEGIKSIHD

SEQ ID NO: 2624447 - protein, 4 aa, Entamoeba histolytica
GYLP

SEQ ID NO: 2624448 - protein, 11 aa, Entamoeba histolytica
GYLPKETKRLG

SEQ ID NO: 2624449 - protein, 8 aa, Entamoeba histolytica
GYNEISQS

SEQ ID NO: 2624450 - protein, 6 aa, Entamoeba histolytica
GYNENS

SEQ ID NO: 2624451 - protein, 6 aa, Entamoeba histolytica
GYNESR

SEQ ID NO: 2624452 - protein, 6 aa, Entamoeba histolytica
GYNGET

SEQ ID NO: 2624453 - protein, 10 aa, Entamoeba histolytica
GYNGKTLSPI

SEQ ID NO: 2624454 - protein, 8 aa, Entamoeba histolytica
GYNKDDRR

SEQ ID NO: 2624455 - protein, 7 aa, Entamoeba histolytica
GYNQEDS

SEQ ID NO: 2624456 - protein, 12 aa, Entamoeba histolytica
GYNSNQFQSKSS

SEQ ID NO: 2624457 - protein, 7 aa, Entamoeba histolytica
GYNTGYL

SEQ ID NO: 2624458 - protein, 12 aa, Entamoeba histolytica
GYNTSLKSTRAT

SEQ ID NO: 2624459 - protein, 7 aa, Entamoeba histolytica
GYPEADT

SEQ ID NO: 2624460 - protein, 6 aa, Entamoeba histolytica
GYPEYA

SEQ ID NO: 2624461 - protein, 5 aa, Entamoeba histolytica
GYPGE

SEQ ID NO: 2624462 - protein, 7 aa, Entamoeba histolytica
GYPKTAP

SEQ ID NO: 2624463 - protein, 8 aa, Entamoeba histolytica
GYPKTQKR

SEQ ID NO: 2624464 - protein, 5 aa, Entamoeba histolytica
GYPPT

SEQ ID NO: 2624465 - protein, 6 aa, Entamoeba histolytica
GYPSDL

SEQ ID NO: 2624466 - protein, 6 aa, Entamoeba histolytica
GYPSSM

SEQ ID NO: 2624467 - protein, 5 aa, Entamoeba histolytica
GYPTI

SEQ ID NO: 2624468 - protein, 5 aa, Entamoeba histolytica
GYPTK

SEQ ID NO: 2624469 - protein, 5 aa, Entamoeba histolytica
GYPYT

SEQ ID NO: 2624470 - protein, 5 aa, Entamoeba histolytica
GYQEG

SEQ ID NO: 2624471 - protein, 10 aa, Entamoeba histolytica
GYQGKGADYM

SEQ ID NO: 2624472 - protein, 7 aa, Entamoeba histolytica
GYQNYRD

SEQ ID NO: 2624473 - protein, 7 aa, Entamoeba histolytica
GYQPNGR

SEQ ID NO: 2624474 - protein, 5 aa, Entamoeba histolytica
GYRAR

SEQ ID NO: 2624475 - protein, 5 aa, Entamoeba histolytica
GYRDA

SEQ ID NO: 2624476 - protein, 5 aa, Entamoeba histolytica
GYRED

SEQ ID NO: 2624477 - protein, 10 aa, Entamoeba histolytica
GYREKDGEGK

SEQ ID NO: 2624478 - protein, 5 aa, Entamoeba histolytica
GYRGG

SEQ ID NO: 2624479 - protein, 8 aa, Entamoeba histolytica
GYRNSPAF

SEQ ID NO: 2624480 - protein, 10 aa, Entamoeba histolytica
GYRQYSPESK

SEQ ID NO: 2624481 - protein, 30 aa, Entamoeba histolytica
GYRSNEVKCGGPVSPKAKKLTFKPKDIDDL

SEQ ID NO: 2624482 - protein, 6 aa, Entamoeba histolytica
GYRTTK

SEQ ID NO: 2624483 - protein, 5 aa, Entamoeba histolytica
GYSIP

SEQ ID NO: 2624484 - protein, 7 aa, Entamoeba histolytica
GYSNDNP

SEQ ID NO: 2624485 - protein, 9 aa, Entamoeba histolytica
GYSNGQGIV

SEQ ID NO: 2624486 - protein, 7 aa, Entamoeba histolytica
GYSNNEY

SEQ ID NO: 2624487 - protein, 5 aa, Entamoeba histolytica
GYSNS

SEQ ID NO: 2624488 - protein, 4 aa, Entamoeba histolytica
GYSP

SEQ ID NO: 2624489 - protein, 7 aa, Entamoeba histolytica
GYSPNEI

SEQ ID NO: 2624490 - protein, 7 aa, Entamoeba histolytica
GYSPQQT

SEQ ID NO: 2624491 - protein, 8 aa, Entamoeba histolytica
GYSPSTTL

SEQ ID NO: 2624492 - protein, 5 aa, Entamoeba histolytica
GYSRL

SEQ ID NO: 2624493 - protein, 7 aa, Entamoeba histolytica
GYSTESV

SEQ ID NO: 2624494 - protein, 14 aa, Entamoeba histolytica
GYSVSEEYEKEKQM

SEQ ID NO: 2624495 - protein, 5 aa, Entamoeba histolytica
GYTDS

SEQ ID NO: 2624496 - protein, 5 aa, Entamoeba histolytica
GYTEK

SEQ ID NO: 2624497 - protein, 6 aa, Entamoeba histolytica
GYTNGK

SEQ ID NO: 2624498 - protein, 4 aa, Entamoeba histolytica
GYTP

SEQ ID NO: 2624499 - protein, 5 aa, Entamoeba histolytica
GYTPN

SEQ ID NO: 2624500 - protein, 7 aa, Entamoeba histolytica
GYTPNGV

SEQ ID NO: 2624501 - protein, 5 aa, Entamoeba histolytica
GYTSQ

SEQ ID NO: 2624502 - protein, 14 aa, Entamoeba histolytica
GYVPTTKTTKEEHA

SEQ ID NO: 2624503 - protein, 5 aa, Entamoeba histolytica
GYVST

SEQ ID NO: 2624504 - protein, 5 aa, Entamoeba histolytica
GYYQG

SEQ ID NO: 2624505 - protein, 5 aa, Entamoeba histolytica
GYYYG

SEQ ID NO: 2624506 - protein, 8 aa, Entamoeba histolytica
HADPVGGT

SEQ ID NO: 2624507 - protein, 10 aa, Entamoeba histolytica
HAEENGTLSE

SEQ ID NO: 2624508 - protein, 4 aa, Entamoeba histolytica
HAEK

SEQ ID NO: 2624509 - protein, 13 aa, Entamoeba histolytica
HAEKIKEPSIGTK

SEQ ID NO: 2624510 - protein, 7 aa, Entamoeba histolytica
HAEQYSR

SEQ ID NO: 2624511 - protein, 5 aa, Entamoeba histolytica
HAGEG

SEQ ID NO: 2624512 - protein, 4 aa, Entamoeba histolytica
HAGP

SEQ ID NO: 2624513 - protein, 8 aa, Entamoeba histolytica
HAGRASTQ

SEQ ID NO: 2624514 - protein, 8 aa, Entamoeba histolytica
HAKDIKRH

SEQ ID NO: 2624515 - protein, 7 aa, Entamoeba histolytica
HAKKAWE

SEQ ID NO: 2624516 - protein, 10 aa, Entamoeba histolytica
HAKNKDEIDV

SEQ ID NO: 2624517 - protein, 5 aa, Entamoeba histolytica
HAKNN

SEQ ID NO: 2624518 - protein, 10 aa, Entamoeba histolytica
HALKDERGKW

SEQ ID NO: 2624519 - protein, 6 aa, Entamoeba histolytica
HANEAN

SEQ ID NO: 2624520 - protein, 40 aa, Entamoeba histolytica
HANLTEGLESPSGIKTEHTENSNSGNTDTHSNGSVEISDK

SEQ ID NO: 2624521 - protein, 10 aa, Entamoeba histolytica
HANNSIQNAG

SEQ ID NO: 2624522 - protein, 9 aa, Entamoeba histolytica
HANSYEELA

SEQ ID NO: 2624523 - protein, 93 aa, Entamoeba histolytica
HANTEQTTKEITEPEPPPKRKQLGGKQKKVDEISDTPKRKALNPKKSSKLKNCISSGKKETTTNEKQPQSKVPVTKQLPSDEIGSPKSPRAHI

SEQ ID NO: 2624524 - protein, 13 aa, Entamoeba histolytica
HAQNPSQEGYTTK

SEQ ID NO: 2624525 - protein, 5 aa, Entamoeba histolytica
HAQPI

SEQ ID NO: 2624526 - protein, 10 aa, Entamoeba histolytica
HAQRTDPKEI

SEQ ID NO: 2624527 - protein, 20 aa, Entamoeba histolytica
HAQSTTHIKGSGYYKSTDGE

SEQ ID NO: 2624528 - protein, 24 aa, Entamoeba histolytica
HAQVEEKIRNAEAEISQLHARMDN

SEQ ID NO: 2624529 - protein, 5 aa, Entamoeba histolytica
HARDE

SEQ ID NO: 2624530 - protein, 32 aa, Entamoeba histolytica
HARSRSNSREKTKRSYSKEGYENYERRNDKEC

SEQ ID NO: 2624531 - protein, 15 aa, Entamoeba histolytica
HASAKEVDTENKTKT

SEQ ID NO: 2624532 - protein, 10 aa, Entamoeba histolytica
HASGADEFTY

SEQ ID NO: 2624533 - protein, 5 aa, Entamoeba histolytica
HASPH

SEQ ID NO: 2624534 - protein, 42 aa, Entamoeba histolytica
HASQDKKKSQHSQESITNNQDVQHSQKEPKSPKEPKSSSRHS

SEQ ID NO: 2624535 - protein, 6 aa, Entamoeba histolytica
HASSKV

SEQ ID NO: 2624536 - protein, 5 aa, Entamoeba histolytica
HASVQ

SEQ ID NO: 2624537 - protein, 72 aa, Entamoeba histolytica
HATQPQQSPLENQQTVHSQTVNTMNNNSQSQQNTNQNGLREEQQRRETNQPQINPIPSSNQNNNSSNSNNTL

SEQ ID NO: 2624538 - protein, 7 aa, Entamoeba histolytica
HATSSQY

SEQ ID NO: 2624539 - protein, 8 aa, Entamoeba histolytica
HATTSERM

SEQ ID NO: 2624540 - protein, 10 aa, Entamoeba histolytica
HCGETGDPMH

SEQ ID NO: 2624541 - protein, 5 aa, Entamoeba histolytica
HCGKE

SEQ ID NO: 2624542 - protein, 4 aa, Entamoeba histolytica
HCKP

SEQ ID NO: 2624543 - protein, 4 aa, Entamoeba histolytica
HCNE

SEQ ID NO: 2624544 - protein, 6 aa, Entamoeba histolytica
HCSGEI

SEQ ID NO: 2624545 - protein, 7 aa, Entamoeba histolytica
HCTEPSL

SEQ ID NO: 2624546 - protein, 4 aa, Entamoeba histolytica
HDAH

SEQ ID NO: 2624547 - protein, 8 aa, Entamoeba histolytica
HDAKRDKE

SEQ ID NO: 2624548 - protein, 10 aa, Entamoeba histolytica
HDANDKSAVI

SEQ ID NO: 2624549 - protein, 7 aa, Entamoeba histolytica
HDASKAA

SEQ ID NO: 2624550 - protein, 5 aa, Entamoeba histolytica
HDDAK

SEQ ID NO: 2624551 - protein, 11 aa, Entamoeba histolytica
HDDEIKVQAGN

SEQ ID NO: 2624552 - protein, 9 aa, Entamoeba histolytica
HDDKANSSL

SEQ ID NO: 2624553 - protein, 7 aa, Entamoeba histolytica
HDDQEAT

SEQ ID NO: 2624554 - protein, 9 aa, Entamoeba histolytica
HDDRNGPAE

SEQ ID NO: 2624555 - protein, 23 aa, Entamoeba histolytica
HDDRRDSHRDERRDSHRDDDKNY

SEQ ID NO: 2624556 - protein, 7 aa, Entamoeba histolytica
HDDSKAV

SEQ ID NO: 2624557 - protein, 4 aa, Entamoeba histolytica
HDDT

SEQ ID NO: 2624558 - protein, 9 aa, Entamoeba histolytica
HDEEPTGEI

SEQ ID NO: 2624559 - protein, 12 aa, Entamoeba histolytica
HDEETLSKTRNE

SEQ ID NO: 2624560 - protein, 5 aa, Entamoeba histolytica
HDEFN

SEQ ID NO: 2624561 - protein, 6 aa, Entamoeba histolytica
HDENRE

SEQ ID NO: 2624562 - protein, 6 aa, Entamoeba histolytica
HDEQKQ

SEQ ID NO: 2624563 - protein, 9 aa, Entamoeba histolytica
HDEQNNKEV

SEQ ID NO: 2624564 - protein, 4 aa, Entamoeba histolytica
HDGK

SEQ ID NO: 2624565 - protein, 5 aa, Entamoeba histolytica
HDGKS

SEQ ID NO: 2624566 - protein, 7 aa, Entamoeba histolytica
HDGKTKK

SEQ ID NO: 2624567 - protein, 4 aa, Entamoeba histolytica
HDGP

SEQ ID NO: 2624568 - protein, 4 aa, Entamoeba histolytica
HDGS

SEQ ID NO: 2624569 - protein, 26 aa, Entamoeba histolytica
HDGTPSKNTYNNTALTTKKGKKKEIR

SEQ ID NO: 2624570 - protein, 12 aa, Entamoeba histolytica
HDGWTYQKFLNI

SEQ ID NO: 2624571 - protein, 9 aa, Entamoeba histolytica
HDHEEIGNQ

SEQ ID NO: 2624572 - protein, 7 aa, Entamoeba histolytica
HDIGPEQ

SEQ ID NO: 2624573 - protein, 6 aa, Entamoeba histolytica
HDIPSG

SEQ ID NO: 2624574 - protein, 6 aa, Entamoeba histolytica
HDISSS

SEQ ID NO: 2624575 - protein, 12 aa, Entamoeba histolytica
HDKKKEKKLQLQ

SEQ ID NO: 2624576 - protein, 12 aa, Entamoeba histolytica
HDKKNKKNHLNK

SEQ ID NO: 2624577 - protein, 6 aa, Entamoeba histolytica
HDKQQE

SEQ ID NO: 2624578 - protein, 15 aa, Entamoeba histolytica
HDKSCETSKSGTTST

SEQ ID NO: 2624579 - protein, 5 aa, Entamoeba histolytica
HDKSI

SEQ ID NO: 2624580 - protein, 33 aa, Entamoeba histolytica
HDKYESIAKKAPEKQNGLAEAETRYNEAKDNYD

SEQ ID NO: 2624581 - protein, 16 aa, Entamoeba histolytica
HDLSSSSDEVLPRPDV

SEQ ID NO: 2624582 - protein, 8 aa, Entamoeba histolytica
HDLTKTQN

SEQ ID NO: 2624583 - protein, 11 aa, Entamoeba histolytica
HDMEQKKAELT

SEQ ID NO: 2624584 - protein, 18 aa, Entamoeba histolytica
HDNEPTEGNRNSNDALST

SEQ ID NO: 2624585 - protein, 32 aa, Entamoeba histolytica
HDNIQPNKKVTESEGPSPASVPNKTNSPSTRV

SEQ ID NO: 2624586 - protein, 4 aa, Entamoeba histolytica
HDNK

SEQ ID NO: 2624587 - protein, 20 aa, Entamoeba histolytica
HDNNNKEPIKDDSQQQPVVQ

SEQ ID NO: 2624588 - protein, 20 aa, Entamoeba histolytica
HDNPKMNRNETKEPFSFGKS

SEQ ID NO: 2624589 - protein, 8 aa, Entamoeba histolytica
HDPETSKM

SEQ ID NO: 2624590 - protein, 4 aa, Entamoeba histolytica
HDPL

SEQ ID NO: 2624591 - protein, 13 aa, Entamoeba histolytica
HDPNDEPSAPGKI

SEQ ID NO: 2624592 - protein, 8 aa, Entamoeba histolytica
HDPNGDDL

SEQ ID NO: 2624593 - protein, 8 aa, Entamoeba histolytica
HDPVDPET

SEQ ID NO: 2624594 - protein, 6 aa, Entamoeba histolytica
HDQKDA

SEQ ID NO: 2624595 - protein, 19 aa, Entamoeba histolytica
HDQPRQVSRWGNDTKYRIE

SEQ ID NO: 2624596 - protein, 4 aa, Entamoeba histolytica
HDQT

SEQ ID NO: 2624597 - protein, 5 aa, Entamoeba histolytica
HDQTT

SEQ ID NO: 2624598 - protein, 10 aa, Entamoeba histolytica
HDRYKHPSTS

SEQ ID NO: 2624599 - protein, 9 aa, Entamoeba histolytica
HDSDDKNAV

SEQ ID NO: 2624600 - protein, 5 aa, Entamoeba histolytica
HDSLD

SEQ ID NO: 2624601 - protein, 5 aa, Entamoeba histolytica
HDSNS

SEQ ID NO: 2624602 - protein, 9 aa, Entamoeba histolytica
HDSPTEQTY

SEQ ID NO: 2624603 - protein, 14 aa, Entamoeba histolytica
HDSQNEKTDKISDE

SEQ ID NO: 2624604 - protein, 10 aa, Entamoeba histolytica
HDTAEMDKTL

SEQ ID NO: 2624605 - protein, 16 aa, Entamoeba histolytica
HDTEELKEDNTPIPSR

SEQ ID NO: 2624606 - protein, 5 aa, Entamoeba histolytica
HDTEK

SEQ ID NO: 2624607 - protein, 6 aa, Entamoeba histolytica
HDTFQN

SEQ ID NO: 2624608 - protein, 8 aa, Entamoeba histolytica
HDTPQHPK

SEQ ID NO: 2624609 - protein, 6 aa, Entamoeba histolytica
HDTPYN

SEQ ID NO: 2624610 - protein, 8 aa, Entamoeba histolytica
HDTSKRKG

SEQ ID NO: 2624611 - protein, 15 aa, Entamoeba histolytica
HDTTAKNKGSKIIPR

SEQ ID NO: 2624612 - protein, 5 aa, Entamoeba histolytica
HEAAK

SEQ ID NO: 2624613 - protein, 5 aa, Entamoeba histolytica
HEAKN

SEQ ID NO: 2624614 - protein, 13 aa, Entamoeba histolytica
HEAKSQLNQKSKQ

SEQ ID NO: 2624615 - protein, 16 aa, Entamoeba histolytica
HEAPTKKQQRIKEQHS

SEQ ID NO: 2624616 - protein, 7 aa, Entamoeba histolytica
HECLPPS

SEQ ID NO: 2624617 - protein, 5 aa, Entamoeba histolytica
HEDAI

SEQ ID NO: 2624618 - protein, 5 aa, Entamoeba histolytica
HEDDC

SEQ ID NO: 2624619 - protein, 10 aa, Entamoeba histolytica
HEDPEGSYRE

SEQ ID NO: 2624620 - protein, 7 aa, Entamoeba histolytica
HEDPQKA

SEQ ID NO: 2624621 - protein, 6 aa, Entamoeba histolytica
HEDSTR

SEQ ID NO: 2624622 - protein, 7 aa, Entamoeba histolytica
HEDTQMD

SEQ ID NO: 2624623 - protein, 9 aa, Entamoeba histolytica
HEEATPIEE

SEQ ID NO: 2624624 - protein, 6 aa, Entamoeba histolytica
HEEDYT

SEQ ID NO: 2624625 - protein, 4 aa, Entamoeba histolytica
HEEE

SEQ ID NO: 2624626 - protein, 7 aa, Entamoeba histolytica
HEEEDEK

SEQ ID NO: 2624627 - protein, 10 aa, Entamoeba histolytica
HEEEDGEYSQ

SEQ ID NO: 2624628 - protein, 7 aa, Entamoeba histolytica
HEEEETK

SEQ ID NO: 2624629 - protein, 10 aa, Entamoeba histolytica
HEEEEVNKEE

SEQ ID NO: 2624630 - protein, 20 aa, Entamoeba histolytica
HEEEGYSVSVSNPSNSSDGI

SEQ ID NO: 2624631 - protein, 5 aa, Entamoeba histolytica
HEEEM

SEQ ID NO: 2624632 - protein, 5 aa, Entamoeba histolytica
HEEEQ

SEQ ID NO: 2624633 - protein, 9 aa, Entamoeba histolytica
HEEEQTIPN

SEQ ID NO: 2624634 - protein, 34 aa, Entamoeba histolytica
HEEKKEKERERNKKRQIPKLQASRRAREYETQQQ

SEQ ID NO: 2624635 - protein, 4 aa, Entamoeba histolytica
HEEQ

SEQ ID NO: 2624636 - protein, 29 aa, Entamoeba histolytica
HEEQEHEQRIAEEERKSEEIKQKRREEEK

SEQ ID NO: 2624637 - protein, 22 aa, Entamoeba histolytica
HEEQKKAADIRRKKNEKRYGKK

SEQ ID NO: 2624638 - protein, 6 aa, Entamoeba histolytica
HEEQSA

SEQ ID NO: 2624639 - protein, 28 aa, Entamoeba histolytica
HEESEAKLRDVSTKCKELDSQLSEKSIQ

SEQ ID NO: 2624640 - protein, 8 aa, Entamoeba histolytica
HEESKELN

SEQ ID NO: 2624641 - protein, 22 aa, Entamoeba histolytica
HEESVEASNEESPVKKRMPVGA

SEQ ID NO: 2624642 - protein, 6 aa, Entamoeba histolytica
HEETPD

SEQ ID NO: 2624643 - protein, 10 aa, Entamoeba histolytica
HEEYETSNEK

SEQ ID NO: 2624644 - protein, 8 aa, Entamoeba histolytica
HEEYKNNT

SEQ ID NO: 2624645 - protein, 6 aa, Entamoeba histolytica
HEGNSI

SEQ ID NO: 2624646 - protein, 16 aa, Entamoeba histolytica
HEKDNNISESVTKKLT

SEQ ID NO: 2624647 - protein, 14 aa, Entamoeba histolytica
HEKEYQAKKNWNQQ

SEQ ID NO: 2624648 - protein, 6 aa, Entamoeba histolytica
HEKPIT

SEQ ID NO: 2624649 - protein, 9 aa, Entamoeba histolytica
HEKRKQKDD

SEQ ID NO: 2624650 - protein, 4 aa, Entamoeba histolytica
HEKT

SEQ ID NO: 2624651 - protein, 9 aa, Entamoeba histolytica
HEKYEEEGI

SEQ ID NO: 2624652 - protein, 11 aa, Entamoeba histolytica
HELDPKNPTYR

SEQ ID NO: 2624653 - protein, 9 aa, Entamoeba histolytica
HENEEKANA

SEQ ID NO: 2624654 - protein, 12 aa, Entamoeba histolytica
HENGEVSAVETC

SEQ ID NO: 2624655 - protein, 5 aa, Entamoeba histolytica
HENGL

SEQ ID NO: 2624656 - protein, 6 aa, Entamoeba histolytica
HENGLK

SEQ ID NO: 2624657 - protein, 70 aa, Entamoeba histolytica
HENKKVNDSNPFDDDSDSDNTKENKEITQPNLNPFDDGTDSSEHETKTPQVKMSSNTDGEGSSRHISPKI

SEQ ID NO: 2624658 - protein, 11 aa, Entamoeba histolytica
HENKPPKQPFR

SEQ ID NO: 2624659 - protein, 19 aa, Entamoeba histolytica
HENKYHDDENTQNQTYNRL

SEQ ID NO: 2624660 - protein, 140 aa, Entamoeba histolytica
HENKYHDDENTQNQTYNRTSPASPQQQNQPSSVSTPSGNGQKTEKSNEQKPQKEDSKGQPQQPPSQPNSSAKPSEETSPTQTTNNPTQISPSTSTQQPKGNKDTQQKDEPPKEQQQNHPQQNEKQDNKNTTTSDISHDKT

SEQ ID NO: 2624661 - protein, 18 aa, Entamoeba histolytica
HENKYNDDENTQNQTYNR

SEQ ID NO: 2624662 - protein, 19 aa, Entamoeba histolytica
HENKYNDDENTQNQTYNRL

SEQ ID NO: 2624663 - protein, 12 aa, Entamoeba histolytica
HENRNKSDDSSQ

SEQ ID NO: 2624664 - protein, 11 aa, Entamoeba histolytica
HENRRKNTSYF

SEQ ID NO: 2624665 - protein, 5 aa, Entamoeba histolytica
HENVD

SEQ ID NO: 2624666 - protein, 11 aa, Entamoeba histolytica
HEPKDTLDDQD

SEQ ID NO: 2624667 - protein, 6 aa, Entamoeba histolytica
HEPNIS

SEQ ID NO: 2624668 - protein, 20 aa, Entamoeba histolytica
HEPNQKTDEILQGKSRYADV

SEQ ID NO: 2624669 - protein, 6 aa, Entamoeba histolytica
HEPPKD

SEQ ID NO: 2624670 - protein, 8 aa, Entamoeba histolytica
HEQELPKE

SEQ ID NO: 2624671 - protein, 4 aa, Entamoeba histolytica
HEQG

SEQ ID NO: 2624672 - protein, 7 aa, Entamoeba histolytica
HEQLASA

SEQ ID NO: 2624673 - protein, 4 aa, Entamoeba histolytica
HEQP

SEQ ID NO: 2624674 - protein, 24 aa, Entamoeba histolytica
HEQPTTLTQNENHEITKEEEKRKL

SEQ ID NO: 2624675 - protein, 10 aa, Entamoeba histolytica
HEQQNQSRQE

SEQ ID NO: 2624676 - protein, 5 aa, Entamoeba histolytica
HEQQT

SEQ ID NO: 2624677 - protein, 13 aa, Entamoeba histolytica
HERASNDIDLQTS

SEQ ID NO: 2624678 - protein, 6 aa, Entamoeba histolytica
HERDLD

SEQ ID NO: 2624679 - protein, 9 aa, Entamoeba histolytica
HERGDNGRV

SEQ ID NO: 2624680 - protein, 17 aa, Entamoeba histolytica
HERGKSDTTSDQTQEKV

SEQ ID NO: 2624681 - protein, 5 aa, Entamoeba histolytica
HERIN

SEQ ID NO: 2624682 - protein, 15 aa, Entamoeba histolytica
HERNEKMNNGRRKDS

SEQ ID NO: 2624683 - protein, 6 aa, Entamoeba histolytica
HERSLN

SEQ ID NO: 2624684 - protein, 56 aa, Entamoeba histolytica
HERSRSRSRGRNYSDRRRHSSHSRRNSRRRNRSHKSRSRSHERLRDRSRERSRDRR

SEQ ID NO: 2624685 - protein, 4 aa, Entamoeba histolytica
HERT

SEQ ID NO: 2624686 - protein, 5 aa, Entamoeba histolytica
HERTI

SEQ ID NO: 2624687 - protein, 6 aa, Entamoeba histolytica
HERTVS

SEQ ID NO: 2624688 - protein, 10 aa, Entamoeba histolytica
HESDSELEEE

SEQ ID NO: 2624689 - protein, 7 aa, Entamoeba histolytica
HESKDDI

SEQ ID NO: 2624690 - protein, 6 aa, Entamoeba histolytica
HESPEA

SEQ ID NO: 2624691 - protein, 5 aa, Entamoeba histolytica
HESRI

SEQ ID NO: 2624692 - protein, 6 aa, Entamoeba histolytica
HESRKN

SEQ ID NO: 2624693 - protein, 5 aa, Entamoeba histolytica
HESRM

SEQ ID NO: 2624694 - protein, 21 aa, Entamoeba histolytica
HESSPIPTDKEEGLIDEEEKS

SEQ ID NO: 2624695 - protein, 10 aa, Entamoeba histolytica
HETEKEYPFD

SEQ ID NO: 2624696 - protein, 7 aa, Entamoeba histolytica
HETESKH

SEQ ID NO: 2624697 - protein, 14 aa, Entamoeba histolytica
HETKEQLAQHNIFL

SEQ ID NO: 2624698 - protein, 9 aa, Entamoeba histolytica
HETKFSTDQ

SEQ ID NO: 2624699 - protein, 7 aa, Entamoeba histolytica
HETNTYS

SEQ ID NO: 2624700 - protein, 8 aa, Entamoeba histolytica
HETQTARP

SEQ ID NO: 2624701 - protein, 12 aa, Entamoeba histolytica
HETRSVTTQNQF

SEQ ID NO: 2624702 - protein, 5 aa, Entamoeba histolytica
HETSA

SEQ ID NO: 2624703 - protein, 24 aa, Entamoeba histolytica
HETSTQRRKIADSNNTDDNNQIND

SEQ ID NO: 2624704 - protein, 11 aa, Entamoeba histolytica
HETTNRSVMSE

SEQ ID NO: 2624705 - protein, 8 aa, Entamoeba histolytica
HFDKSKSS

SEQ ID NO: 2624706 - protein, 4 aa, Entamoeba histolytica
HFDR

SEQ ID NO: 2624707 - protein, 42 aa, Entamoeba histolytica
HFDTPTKKVQPQIKQNSPSIQSPSEFQPKSFNTPIKRRSEYV

SEQ ID NO: 2624708 - protein, 5 aa, Entamoeba histolytica
HFEDS

SEQ ID NO: 2624709 - protein, 4 aa, Entamoeba histolytica
HFGG

SEQ ID NO: 2624710 - protein, 4 aa, Entamoeba histolytica
HFNT

SEQ ID NO: 2624711 - protein, 12 aa, Entamoeba histolytica
HFSDKHEKLKKS

SEQ ID NO: 2624712 - protein, 6 aa, Entamoeba histolytica
HGCMPQ

SEQ ID NO: 2624713 - protein, 13 aa, Entamoeba histolytica
HGCSEKTATRRQE

SEQ ID NO: 2624714 - protein, 16 aa, Entamoeba histolytica
HGDACNKTHIKPESSQ

SEQ ID NO: 2624715 - protein, 17 aa, Entamoeba histolytica
HGDENSRGMLTTGGTES

SEQ ID NO: 2624716 - protein, 5 aa, Entamoeba histolytica
HGDES

SEQ ID NO: 2624717 - protein, 8 aa, Entamoeba histolytica
HGDGDGLC

SEQ ID NO: 2624718 - protein, 10 aa, Entamoeba histolytica
HGDGVEEAFK

SEQ ID NO: 2624719 - protein, 5 aa, Entamoeba histolytica
HGDKF

SEQ ID NO: 2624720 - protein, 14 aa, Entamoeba histolytica
HGDMSSRKFSKDKR

SEQ ID NO: 2624721 - protein, 8 aa, Entamoeba histolytica
HGDSCTRN

SEQ ID NO: 2624722 - protein, 6 aa, Entamoeba histolytica
HGEAKK

SEQ ID NO: 2624723 - protein, 11 aa, Entamoeba histolytica
HGEDENSSDYD

SEQ ID NO: 2624724 - protein, 6 aa, Entamoeba histolytica
HGEDQW

SEQ ID NO: 2624725 - protein, 4 aa, Entamoeba histolytica
HGEI

SEQ ID NO: 2624726 - protein, 6 aa, Entamoeba histolytica
HGEKVD

SEQ ID NO: 2624727 - protein, 6 aa, Entamoeba histolytica
HGEPRT

SEQ ID NO: 2624728 - protein, 9 aa, Entamoeba histolytica
HGGDEDSVN

SEQ ID NO: 2624729 - protein, 7 aa, Entamoeba histolytica
HGGDQVA

SEQ ID NO: 2624730 - protein, 9 aa, Entamoeba histolytica
HGGDTVSKL

SEQ ID NO: 2624731 - protein, 6 aa, Entamoeba histolytica
HGGDYG

SEQ ID NO: 2624732 - protein, 5 aa, Entamoeba histolytica
HGGEF

SEQ ID NO: 2624733 - protein, 6 aa, Entamoeba histolytica
HGGIQA

SEQ ID NO: 2624734 - protein, 13 aa, Entamoeba histolytica
HGGKEINGKKNEL

SEQ ID NO: 2624735 - protein, 14 aa, Entamoeba histolytica
HGGNNADVSSCNYE

SEQ ID NO: 2624736 - protein, 6 aa, Entamoeba histolytica
HGGPSH

SEQ ID NO: 2624737 - protein, 7 aa, Entamoeba histolytica
HGGSETS

SEQ ID NO: 2624738 - protein, 15 aa, Entamoeba histolytica
HGGVDDGIKEDDEID

SEQ ID NO: 2624739 - protein, 7 aa, Entamoeba histolytica
HGGVETE

SEQ ID NO: 2624740 - protein, 12 aa, Entamoeba histolytica
HGHRNDVPEQKR

SEQ ID NO: 2624741 - protein, 6 aa, Entamoeba histolytica
HGIGKR

SEQ ID NO: 2624742 - protein, 6 aa, Entamoeba histolytica
HGIPNA

SEQ ID NO: 2624743 - protein, 9 aa, Entamoeba histolytica
HGKEVRDEK

SEQ ID NO: 2624744 - protein, 7 aa, Entamoeba histolytica
HGKKSEI

SEQ ID NO: 2624745 - protein, 8 aa, Entamoeba histolytica
HGKPTNKM

SEQ ID NO: 2624746 - protein, 20 aa, Entamoeba histolytica
HGKRRTRGVVSNPFHLITME

SEQ ID NO: 2624747 - protein, 5 aa, Entamoeba histolytica
HGKSA

SEQ ID NO: 2624748 - protein, 9 aa, Entamoeba histolytica
HGKSNDSYM

SEQ ID NO: 2624749 - protein, 6 aa, Entamoeba histolytica
HGKSQD

SEQ ID NO: 2624750 - protein, 6 aa, Entamoeba histolytica
HGKSTV

SEQ ID NO: 2624751 - protein, 5 aa, Entamoeba histolytica
HGKTS

SEQ ID NO: 2624752 - protein, 12 aa, Entamoeba histolytica
HGKVDPKTIDPE

SEQ ID NO: 2624753 - protein, 6 aa, Entamoeba histolytica
HGLENG

SEQ ID NO: 2624754 - protein, 8 aa, Entamoeba histolytica
HGLSPDGI

SEQ ID NO: 2624755 - protein, 12 aa, Entamoeba histolytica
HGNDVDKFKETG

SEQ ID NO: 2624756 - protein, 11 aa, Entamoeba histolytica
HGNGETKRYSR

SEQ ID NO: 2624757 - protein, 10 aa, Entamoeba histolytica
HGNNNNPEVD

SEQ ID NO: 2624758 - protein, 8 aa, Entamoeba histolytica
HGNSIPKH

SEQ ID NO: 2624759 - protein, 4 aa, Entamoeba histolytica
HGNT

SEQ ID NO: 2624760 - protein, 5 aa, Entamoeba histolytica
HGNVE

SEQ ID NO: 2624761 - protein, 4 aa, Entamoeba histolytica
HGNY

SEQ ID NO: 2624762 - protein, 7 aa, Entamoeba histolytica
HGPEDTH

SEQ ID NO: 2624763 - protein, 5 aa, Entamoeba histolytica
HGPKG

SEQ ID NO: 2624764 - protein, 7 aa, Entamoeba histolytica
HGPTKDG

SEQ ID NO: 2624765 - protein, 7 aa, Entamoeba histolytica
HGQRTAE

SEQ ID NO: 2624766 - protein, 58 aa, Entamoeba histolytica
HGRGLTRGRKPQNARTKMRAKYEKRTKKIKQINTESHSFNYKGEKKIEDGKKLSRKLD

SEQ ID NO: 2624767 - protein, 19 aa, Entamoeba histolytica
HGRSSSRSCSYDSQDSCNF

SEQ ID NO: 2624768 - protein, 8 aa, Entamoeba histolytica
HGSDDYKA

SEQ ID NO: 2624769 - protein, 7 aa, Entamoeba histolytica
HGSDETS

SEQ ID NO: 2624770 - protein, 10 aa, Entamoeba histolytica
HGSDPELSTV

SEQ ID NO: 2624771 - protein, 9 aa, Entamoeba histolytica
HGSEHSNNL

SEQ ID NO: 2624772 - protein, 10 aa, Entamoeba histolytica
HGSEIPEYVP

SEQ ID NO: 2624773 - protein, 9 aa, Entamoeba histolytica
HGSETTFNE

SEQ ID NO: 2624774 - protein, 5 aa, Entamoeba histolytica
HGSGK

SEQ ID NO: 2624775 - protein, 11 aa, Entamoeba histolytica
HGSLHSPTNSV

SEQ ID NO: 2624776 - protein, 8 aa, Entamoeba histolytica
HGSTTDNI

SEQ ID NO: 2624777 - protein, 8 aa, Entamoeba histolytica
HGTELDTM

SEQ ID NO: 2624778 - protein, 6 aa, Entamoeba histolytica
HGTGHG

SEQ ID NO: 2624779 - protein, 18 aa, Entamoeba histolytica
HGTKDRTIAGNETEYQSR

SEQ ID NO: 2624780 - protein, 9 aa, Entamoeba histolytica
HGTPNYLPP

SEQ ID NO: 2624781 - protein, 5 aa, Entamoeba histolytica
HGTRS

SEQ ID NO: 2624782 - protein, 6 aa, Entamoeba histolytica
HGTSDG

SEQ ID NO: 2624783 - protein, 4 aa, Entamoeba histolytica
HGTT

SEQ ID NO: 2624784 - protein, 9 aa, Entamoeba histolytica
HGTVPSSEE

SEQ ID NO: 2624785 - protein, 4 aa, Entamoeba histolytica
HGVS

SEQ ID NO: 2624786 - protein, 10 aa, Entamoeba histolytica
HGYGEESHQW

SEQ ID NO: 2624787 - protein, 8 aa, Entamoeba histolytica
HGYQQTCE

SEQ ID NO: 2624788 - protein, 10 aa, Entamoeba histolytica
HHEATPEAYY

SEQ ID NO: 2624789 - protein, 5 aa, Entamoeba histolytica
HHESQ

SEQ ID NO: 2624790 - protein, 7 aa, Entamoeba histolytica
HHGQDAA

SEQ ID NO: 2624791 - protein, 36 aa, Entamoeba histolytica
HHHHDKKKEEKKKTTTTSSTPVTPVNAAPPPPTPIT

SEQ ID NO: 2624792 - protein, 9 aa, Entamoeba histolytica
HHNNNENDL

SEQ ID NO: 2624793 - protein, 5 aa, Entamoeba histolytica
HHPGA

SEQ ID NO: 2624794 - protein, 4 aa, Entamoeba histolytica
HHPP

SEQ ID NO: 2624795 - protein, 15 aa, Entamoeba histolytica
HHQREHSRPPTSNLR

SEQ ID NO: 2624796 - protein, 17 aa, Entamoeba histolytica
HHSNKSNEEHPSSQHPL

SEQ ID NO: 2624797 - protein, 12 aa, Entamoeba histolytica
HHSTSPKQFETP

SEQ ID NO: 2624798 - protein, 6 aa, Entamoeba histolytica
HHTQEQ

SEQ ID NO: 2624799 - protein, 39 aa, Entamoeba histolytica
HHTQKAEIKSPSENTGKIISNDKEKDSVPSQQQRSSLQI

SEQ ID NO: 2624800 - protein, 4 aa, Entamoeba histolytica
HHTS

SEQ ID NO: 2624801 - protein, 16 aa, Entamoeba histolytica
HHTTEEGRNLSKTNSS

SEQ ID NO: 2624802 - protein, 4 aa, Entamoeba histolytica
HHYP

SEQ ID NO: 2624803 - protein, 30 aa, Entamoeba histolytica
HIEEEQEEVNQNEQEINQNGNSNDTSNDEF

SEQ ID NO: 2624804 - protein, 6 aa, Entamoeba histolytica
HIGDST

SEQ ID NO: 2624805 - protein, 8 aa, Entamoeba histolytica
HIGNKKSD

SEQ ID NO: 2624806 - protein, 7 aa, Entamoeba histolytica
HIGQPKS

SEQ ID NO: 2624807 - protein, 6 aa, Entamoeba histolytica
HIGSTN

SEQ ID NO: 2624808 - protein, 38 aa, Entamoeba histolytica; identical to SEQ ID NO: 2429280

SEQ ID NO: 2624809 - protein, 8 aa, Entamoeba histolytica
HIKDKNIQ

SEQ ID NO: 2624810 - protein, 10 aa, Entamoeba histolytica
HIKDKTNIEE

SEQ ID NO: 2624811 - protein, 12 aa, Entamoeba histolytica
HIKSSSTQNLKS

SEQ ID NO: 2624812 - protein, 9 aa, Entamoeba histolytica
HIKTTTKSL

SEQ ID NO: 2624813 - protein, 33 aa, Entamoeba histolytica
HINNSTNSSTNTTHINNSTKPFTNTTHVNNSTK

SEQ ID NO: 2624814 - protein, 7 aa, Entamoeba histolytica
HINPQEK

SEQ ID NO: 2624815 - protein, 6 aa, Entamoeba histolytica
HIPDGT

SEQ ID NO: 2624816 - protein, 4 aa, Entamoeba histolytica
HIPQ

SEQ ID NO: 2624817 - protein, 6 aa, Entamoeba histolytica
HIPTKT

SEQ ID NO: 2624818 - protein, 6 aa, Entamoeba histolytica
HISNEA

SEQ ID NO: 2624819 - protein, 12 aa, Entamoeba histolytica
HISNKENSTFGI

SEQ ID NO: 2624820 - protein, 10 aa, Entamoeba histolytica
HKATDPKEEE

SEQ ID NO: 2624821 - protein, 6 aa, Entamoeba histolytica
HKCSPQ

SEQ ID NO: 2624822 - protein, 22 aa, Entamoeba histolytica
HKDIEAAKKAVYTAKKNAEING

SEQ ID NO: 2624823 - protein, 41 aa, Entamoeba histolytica
HKDKKGIKKKAKKEQEDSSSEESEEEKVSKKKAKKEKKEEL

SEQ ID NO: 2624824 - protein, 8 aa, Entamoeba histolytica
HKDKRSQV

SEQ ID NO: 2624825 - protein, 8 aa, Entamoeba histolytica
HKDLKYSD

SEQ ID NO: 2624826 - protein, 5 aa, Entamoeba histolytica
HKDNL

SEQ ID NO: 2624827 - protein, 7 aa, Entamoeba histolytica
HKDQYHS

SEQ ID NO: 2624828 - protein, 4 aa, Entamoeba histolytica
HKDS

SEQ ID NO: 2624829 - protein, 4 aa, Entamoeba histolytica
HKEC

SEQ ID NO: 2624830 - protein, 7 aa, Entamoeba histolytica
HKECNEN

SEQ ID NO: 2624831 - protein, 6 aa, Entamoeba histolytica
HKEDED

SEQ ID NO: 2624832 - protein, 10 aa, Entamoeba histolytica
HKEDPFKTQN

SEQ ID NO: 2624833 - protein, 11 aa, Entamoeba histolytica
HKEEDKKEEIE

SEQ ID NO: 2624834 - protein, 5 aa, Entamoeba histolytica
HKEEG

SEQ ID NO: 2624835 - protein, 7 aa, Entamoeba histolytica
HKEENTV

SEQ ID NO: 2624836 - protein, 6 aa, Entamoeba histolytica
HKEEQI

SEQ ID NO: 2624837 - protein, 4 aa, Entamoeba histolytica
HKEG

SEQ ID NO: 2624838 - protein, 5 aa, Entamoeba histolytica
HKELT

SEQ ID NO: 2624839 - protein, 9 aa, Entamoeba histolytica
HKENKSEYI

SEQ ID NO: 2624840 - protein, 7 aa, Entamoeba histolytica
HKENNDK

SEQ ID NO: 2624841 - protein, 10 aa, Entamoeba histolytica
HKEPNPSTFT

SEQ ID NO: 2624842 - protein, 9 aa, Entamoeba histolytica
HKEQEDKLN

SEQ ID NO: 2624843 - protein, 7 aa, Entamoeba histolytica
HKESAIE

SEQ ID NO: 2624844 - protein, 15 aa, Entamoeba histolytica
HKESGLSEAQIDEYE

SEQ ID NO: 2624845 - protein, 18 aa, Entamoeba histolytica
HKETEEEKEERIKKEEHC

SEQ ID NO: 2624846 - protein, 12 aa, Entamoeba histolytica
HKETELDDKNNV

SEQ ID NO: 2624847 - protein, 12 aa, Entamoeba histolytica
HKETQKPNKVNQ

SEQ ID NO: 2624848 - protein, 8 aa, Entamoeba histolytica
HKFKTNDS

SEQ ID NO: 2624849 - protein, 5 aa, Entamoeba histolytica
HKGAC

SEQ ID NO: 2624850 - protein, 5 aa, Entamoeba histolytica
HKGDR

SEQ ID NO: 2624851 - protein, 37 aa, Entamoeba histolytica
HKGEDAPNTTSPSTEKKSEKNEKPKKEKGKKKGGCIM

SEQ ID NO: 2624852 - protein, 13 aa, Entamoeba histolytica
HKGEITDIQSDAN

SEQ ID NO: 2624853 - protein, 6 aa, Entamoeba histolytica
HKGELE

SEQ ID NO: 2624854 - protein, 28 aa, Entamoeba histolytica
HKGKSLDFSSSKALSESLDKCGTNEDPI

SEQ ID NO: 2624855 - protein, 9 aa, Entamoeba histolytica
HKGNDLNKY

SEQ ID NO: 2624856 - protein, 10 aa, Entamoeba histolytica
HKGNGTGETI

SEQ ID NO: 2624857 - protein, 14 aa, Entamoeba histolytica
HKGPTVMKEEERNI

SEQ ID NO: 2624858 - protein, 6 aa, Entamoeba histolytica
HKGPVR

SEQ ID NO: 2624859 - protein, 19 aa, Entamoeba histolytica
HKHEAPPIPEHKHEAPPIP

SEQ ID NO: 2624860 - protein, 11 aa, Entamoeba histolytica
HKIKNPNAEIS

SEQ ID NO: 2624861 - protein, 9 aa, Entamoeba histolytica
HKINNEEYI

SEQ ID NO: 2624862 - protein, 34 aa, Entamoeba histolytica
HKITTSSSTGSTSVSAKHVPEKTLPKTPSKPSLM

SEQ ID NO: 2624863 - protein, 10 aa, Entamoeba histolytica
HKKEQKAPFY

SEQ ID NO: 2624864 - protein, 16 aa, Entamoeba histolytica
HKKESQRIKTKQHENF

SEQ ID NO: 2624865 - protein, 14 aa, Entamoeba histolytica
HKKINQQKERNRKW

SEQ ID NO: 2624866 - protein, 9 aa, Entamoeba histolytica
HKKISTTQT

SEQ ID NO: 2624867 - protein, 25 aa, Entamoeba histolytica
HKKKSGEDQTISDDVRHKQKHEENV

SEQ ID NO: 2624868 - protein, 9 aa, Entamoeba histolytica
HKKQSSIKK

SEQ ID NO: 2624869 - protein, 10 aa, Entamoeba histolytica
HKKSKKDYYY

SEQ ID NO: 2624870 - protein, 41 aa, Entamoeba histolytica
HKKSKKQLKQLEKKTKIKYQQAKRQGIQKAKQIKRNATRKA

SEQ ID NO: 2624871 - protein, 15 aa, Entamoeba histolytica
HKKTKKEREEEKKPI

SEQ ID NO: 2624872 - protein, 8 aa, Entamoeba histolytica
HKKTTTVF

SEQ ID NO: 2624873 - protein, 4 aa, Entamoeba histolytica
HKKV

SEQ ID NO: 2624874 - protein, 4 aa, Entamoeba histolytica
HKKY

SEQ ID NO: 2624875 - protein, 11 aa, Entamoeba histolytica
HKLQSSQSQDF

SEQ ID NO: 2624876 - protein, 20 aa, Entamoeba histolytica
HKMPKKKKEQLIKHSKRHQT

SEQ ID NO: 2624877 - protein, 4 aa, Entamoeba histolytica
HKMS

SEQ ID NO: 2624878 - protein, 12 aa, Entamoeba histolytica
HKNCERAADSLF

SEQ ID NO: 2624879 - protein, 5 aa, Entamoeba histolytica
HKNDS

SEQ ID NO: 2624880 - protein, 4 aa, Entamoeba histolytica
HKNE

SEQ ID NO: 2624881 - protein, 13 aa, Entamoeba histolytica
HKNEEKPREDEEI

SEQ ID NO: 2624882 - protein, 6 aa, Entamoeba histolytica
HKNFRN

SEQ ID NO: 2624883 - protein, 5 aa, Entamoeba histolytica
HKNIN

SEQ ID NO: 2624884 - protein, 4 aa, Entamoeba histolytica
HKNQ

SEQ ID NO: 2624885 - protein, 5 aa, Entamoeba histolytica
HKNQL

SEQ ID NO: 2624886 - protein, 5 aa, Entamoeba histolytica
HKNSP

SEQ ID NO: 2624887 - protein, 52 aa, Entamoeba histolytica
HKPDTGMTKKQKEVPNTTKKSTYTPQKQINSPIEKTIPKTTTTNHPYSPTFQ

SEQ ID NO: 2624888 - protein, 6 aa, Entamoeba histolytica
HKPINK

SEQ ID NO: 2624889 - protein, 4 aa, Entamoeba histolytica
HKPL

SEQ ID NO: 2624890 - protein, 7 aa, Entamoeba histolytica
HKPNEEG

SEQ ID NO: 2624891 - protein, 6 aa, Entamoeba histolytica
HKPRLS

SEQ ID NO: 2624892 - protein, 8 aa, Entamoeba histolytica
HKPSLQSE

SEQ ID NO: 2624893 - protein, 10 aa, Entamoeba histolytica
HKQDKKERKF

SEQ ID NO: 2624894 - protein, 15 aa, Entamoeba histolytica
HKQEETGNYPTTSEH

SEQ ID NO: 2624895 - protein, 7 aa, Entamoeba histolytica
HKQETIR

SEQ ID NO: 2624896 - protein, 6 aa, Entamoeba histolytica
HKQPTF

SEQ ID NO: 2624897 - protein, 8 aa, Entamoeba histolytica
HKQQIDTE

SEQ ID NO: 2624898 - protein, 12 aa, Entamoeba histolytica
HKQRDETKPKKN

SEQ ID NO: 2624899 - protein, 17 aa, Entamoeba histolytica
HKQSSLSTTKLRRQTVD

SEQ ID NO: 2624900 - protein, 8 aa, Entamoeba histolytica
HKQTGEKI

SEQ ID NO: 2624901 - protein, 9 aa, Entamoeba histolytica
HKREPNPID

SEQ ID NO: 2624902 - protein, 7 aa, Entamoeba histolytica
HKRKGGL

SEQ ID NO: 2624903 - protein, 8 aa, Entamoeba histolytica
HKRKVPEN

SEQ ID NO: 2624904 - protein, 6 aa, Entamoeba histolytica
HKRLSA

SEQ ID NO: 2624905 - protein, 7 aa, Entamoeba histolytica
HKRNSHK

SEQ ID NO: 2624906 - protein, 6 aa, Entamoeba histolytica
HKRPIT

SEQ ID NO: 2624907 - protein, 23 aa, Entamoeba histolytica
HKRTTTSISCEKNGNRFLSGGND

SEQ ID NO: 2624908 - protein, 7 aa, Entamoeba histolytica
HKSEISN

SEQ ID NO: 2624909 - protein, 27 aa, Entamoeba histolytica
HKSGNVASSPSGKYPAGGNDPVSYPGS

SEQ ID NO: 2624910 - protein, 17 aa, Entamoeba histolytica
HKSKYKFSNDDKSITKS

SEQ ID NO: 2624911 - protein, 4 aa, Entamoeba histolytica
HKSR

SEQ ID NO: 2624912 - protein, 8 aa, Entamoeba histolytica
HKSSRGAG

SEQ ID NO: 2624913 - protein, 9 aa, Entamoeba histolytica
HKSSSTRGQ

SEQ ID NO: 2624914 - protein, 5 aa, Entamoeba histolytica
HKSYD

SEQ ID NO: 2624915 - protein, 8 aa, Entamoeba histolytica
HKTAPINV

SEQ ID NO: 2624916 - protein, 8 aa, Entamoeba histolytica
HKTIADTQ

SEQ ID NO: 2624917 - protein, 6 aa, Entamoeba histolytica
HKTKDF

SEQ ID NO: 2624918 - protein, 8 aa, Entamoeba histolytica
HKTKESKN

SEQ ID NO: 2624919 - protein, 17 aa, Entamoeba histolytica
HKTNFTASDEEKEKQEV

SEQ ID NO: 2624920 - protein, 6 aa, Entamoeba histolytica
HKTNGK

SEQ ID NO: 2624921 - protein, 8 aa, Entamoeba histolytica
HKTNITEE

SEQ ID NO: 2624922 - protein, 7 aa, Entamoeba histolytica
HKTQEPT

SEQ ID NO: 2624923 - protein, 28 aa, Entamoeba histolytica
HKTQESTSTESIDLNEDTKEEDMDSDEL

SEQ ID NO: 2624924 - protein, 13 aa, Entamoeba histolytica
HKTTGAESQRYKQ

SEQ ID NO: 2624925 - protein, 9 aa, Entamoeba histolytica
HKTTKEGIA

SEQ ID NO: 2624926 - protein, 15 aa, Entamoeba histolytica
HKVTSACEQKRMKEA

SEQ ID NO: 2624927 - protein, 10 aa, Entamoeba histolytica
HKYTEAQKAI

SEQ ID NO: 2624928 - protein, 21 aa, Entamoeba histolytica
HLDEEDDDNTTLKNSVNAQRK

SEQ ID NO: 2624929 - protein, 9 aa, Entamoeba histolytica
HLEDDNESL

SEQ ID NO: 2624930 - protein, 51 aa, Entamoeba histolytica
HLEETKDIQETTPKTNVLTNEQPNETNQPQKENNKKQENESSEEVKKPLNY

SEQ ID NO: 2624931 - protein, 10 aa, Entamoeba histolytica
HLGAGEKSHC

SEQ ID NO: 2624932 - protein, 10 aa, Entamoeba histolytica
HLKEEKPNIP

SEQ ID NO: 2624933 - protein, 10 aa, Entamoeba histolytica
HLNETSQIEN

SEQ ID NO: 2624934 - protein, 10 aa, Entamoeba histolytica
HLNSSNELDR

SEQ ID NO: 2624935 - protein, 6 aa, Entamoeba histolytica
HLPESE

SEQ ID NO: 2624936 - protein, 7 aa, Entamoeba histolytica
HLPTDTV

SEQ ID NO: 2624937 - protein, 14 aa, Entamoeba histolytica
HLPTKQKQSPPSLM

SEQ ID NO: 2624938 - protein, 7 aa, Entamoeba histolytica
HLPTSPD

SEQ ID NO: 2624939 - protein, 8 aa, Entamoeba histolytica
HLSDDARD

SEQ ID NO: 2624940 - protein, 5 aa, Entamoeba histolytica
HLSEA

SEQ ID NO: 2624941 - protein, 7 aa, Entamoeba histolytica
HLSENTK

SEQ ID NO: 2624942 - protein, 11 aa, Entamoeba histolytica
HLTPEEARTKA

SEQ ID NO: 2624943 - protein, 15 aa, Entamoeba histolytica
HLTSGNNVPEAKKTL

SEQ ID NO: 2624944 - protein, 5 aa, Entamoeba histolytica
HMNSK

SEQ ID NO: 2624945 - protein, 7 aa, Entamoeba histolytica
HNAIPSH

SEQ ID NO: 2624946 - protein, 11 aa, Entamoeba histolytica
HNAKEDKSLKE

SEQ ID NO: 2624947 - protein, 7 aa, Entamoeba histolytica
HNCTEQE

SEQ ID NO: 2624948 - protein, 13 aa, Entamoeba histolytica
HNDDSETQTDENI

SEQ ID NO: 2624949 - protein, 5 aa, Entamoeba histolytica
HNDEI

SEQ ID NO: 2624950 - protein, 34 aa, Entamoeba histolytica
HNDENIELNEDEEEIEEDIEEVEEPEIEYEYEYE

SEQ ID NO: 2624951 - protein, 33 aa, Entamoeba histolytica
HNDENVDVNEEEEIEEDIEEVEEPEIEYEYEYE

SEQ ID NO: 2624952 - protein, 30 aa, Entamoeba histolytica
HNDENVDVNEGEEDIEEIEEPEIEYEYEYE

SEQ ID NO: 2624953 - protein, 34 aa, Entamoeba histolytica
HNDENVDVNEGEEEIEQGIEEVEEPEIEYEYEYE

SEQ ID NO: 2624954 - protein, 8 aa, Entamoeba histolytica
HNDGSGRL

SEQ ID NO: 2624955 - protein, 4 aa, Entamoeba histolytica
HNDI

SEQ ID NO: 2624956 - protein, 17 aa, Entamoeba histolytica
HNDNKSDNEEEKLIPNS

SEQ ID NO: 2624957 - protein, 8 aa, Entamoeba histolytica
HNDTEVKQ

SEQ ID NO: 2624958 - protein, 10 aa, Entamoeba histolytica
HNEEDEDDYD

SEQ ID NO: 2624959 - protein, 4 aa, Entamoeba histolytica
HNEH

SEQ ID NO: 2624960 - protein, 5 aa, Entamoeba histolytica
HNEHD

SEQ ID NO: 2624961 - protein, 9 aa, Entamoeba histolytica
HNEKEDKNI

SEQ ID NO: 2624962 - protein, 27 aa, Entamoeba histolytica
HNEKRQYRDRFESRTERPREKDYYSSD

SEQ ID NO: 2624963 - protein, 5 aa, Entamoeba histolytica
HNEKS

SEQ ID NO: 2624964 - protein, 5 aa, Entamoeba histolytica
HNERR

SEQ ID NO: 2624965 - protein, 11 aa, Entamoeba histolytica
HNETDNQMDEE

SEQ ID NO: 2624966 - protein, 7 aa, Entamoeba histolytica
HNETPIK

SEQ ID NO: 2624967 - protein, 8 aa, Entamoeba histolytica
HNFGNKGA

SEQ ID NO: 2624968 - protein, 4 aa, Entamoeba histolytica
HNGA

SEQ ID NO: 2624969 - protein, 11 aa, Entamoeba histolytica
HNGEHSAENEL

SEQ ID NO: 2624970 - protein, 7 aa, Entamoeba histolytica
HNGHEAA

SEQ ID NO: 2624971 - protein, 4 aa, Entamoeba histolytica
HNGK

SEQ ID NO: 2624972 - protein, 11 aa, Entamoeba histolytica
HNGKDAAKKAM

SEQ ID NO: 2624973 - protein, 12 aa, Entamoeba histolytica
HNGNKNIEIDGT

SEQ ID NO: 2624974 - protein, 7 aa, Entamoeba histolytica
HNGPNGQ

SEQ ID NO: 2624975 - protein, 7 aa, Entamoeba histolytica
HNGQGAA

SEQ ID NO: 2624976 - protein, 7 aa, Entamoeba histolytica
HNGSSVG

SEQ ID NO: 2624977 - protein, 16 aa, Entamoeba histolytica
HNIEPSKYEPNKNNND

SEQ ID NO: 2624978 - protein, 6 aa, Entamoeba histolytica
HNINDS

SEQ ID NO: 2624979 - protein, 11 aa, Entamoeba histolytica
HNKEKSTLVDT

SEQ ID NO: 2624980 - protein, 8 aa, Entamoeba histolytica
HNKGEAEN

SEQ ID NO: 2624981 - protein, 4 aa, Entamoeba histolytica
HNKK

SEQ ID NO: 2624982 - protein, 6 aa, Entamoeba histolytica
HNKLEE

SEQ ID NO: 2624983 - protein, 6 aa, Entamoeba histolytica
HNKPSE

SEQ ID NO: 2624984 - protein, 6 aa, Entamoeba histolytica
HNKQGQ

SEQ ID NO: 2624985 - protein, 9 aa, Entamoeba histolytica
HNKTNENSP

SEQ ID NO: 2624986 - protein, 13 aa, Entamoeba histolytica
HNLATKKRYGNYN

SEQ ID NO: 2624987 - protein, 6 aa, Entamoeba histolytica
HNNERL

SEQ ID NO: 2624988 - protein, 7 aa, Entamoeba histolytica
HNNNKQG

SEQ ID NO: 2624989 - protein, 23 aa, Entamoeba histolytica
HNNRRNDNRIKRNTNERRQPRMS

SEQ ID NO: 2624990 - protein, 6 aa, Entamoeba histolytica
HNNSLE

SEQ ID NO: 2624991 - protein, 6 aa, Entamoeba histolytica
HNNSSD

SEQ ID NO: 2624992 - protein, 9 aa, Entamoeba histolytica
HNNTSGTKT

SEQ ID NO: 2624993 - protein, 16 aa, Entamoeba histolytica
HNNTVKNQENTQRTNA

SEQ ID NO: 2624994 - protein, 11 aa, Entamoeba histolytica
HNPAGKEHGDF

SEQ ID NO: 2624995 - protein, 4 aa, Entamoeba histolytica
HNPE

SEQ ID NO: 2624996 - protein, 6 aa, Entamoeba histolytica
HNPPEG

SEQ ID NO: 2624997 - protein, 5 aa, Entamoeba histolytica
HNPRL

SEQ ID NO: 2624998 - protein, 6 aa, Entamoeba histolytica
HNPSNL

SEQ ID NO: 2624999 - protein, 5 aa, Entamoeba histolytica
HNPSS

SEQ ID NO: 2625000 - protein, 24 aa, Entamoeba histolytica
HNPTTIEPTITQSDISDASIRTSV

SEQ ID NO: 2625001 - protein, 7 aa, Entamoeba histolytica
HNQNNDK

SEQ ID NO: 2625002 - protein, 8 aa, Entamoeba histolytica
HNQQKDEN

SEQ ID NO: 2625003 - protein, 7 aa, Entamoeba histolytica
HNQQSEA

SEQ ID NO: 2625004 - protein, 6 aa, Entamoeba histolytica
HNQSGI

SEQ ID NO: 2625005 - protein, 9 aa, Entamoeba histolytica
HNQSNTHST

SEQ ID NO: 2625006 - protein, 9 aa, Entamoeba histolytica
HNQSPRNTY

SEQ ID NO: 2625007 - protein, 6 aa, Entamoeba histolytica
HNRGSA

SEQ ID NO: 2625008 - protein, 10 aa, Entamoeba histolytica
HNSEKNKMNA

SEQ ID NO: 2625009 - protein, 9 aa, Entamoeba histolytica
HNSKEKGRV

SEQ ID NO: 2625010 - protein, 7 aa, Entamoeba histolytica
HNSNYSR

SEQ ID NO: 2625011 - protein, 4 aa, Entamoeba histolytica
HNSP

SEQ ID NO: 2625012 - protein, 8 aa, Entamoeba histolytica
HNSPNTPL

SEQ ID NO: 2625013 - protein, 21 aa, Entamoeba histolytica
HNSQNESQRDLNQLNKQKLNN

SEQ ID NO: 2625014 - protein, 12 aa, Entamoeba histolytica
HNSVDKESRTFS

SEQ ID NO: 2625015 - protein, 5 aa, Entamoeba histolytica
HNSYS

SEQ ID NO: 2625016 - protein, 5 aa, Entamoeba histolytica
HNTDI

SEQ ID NO: 2625017 - protein, 19 aa, Entamoeba histolytica
HNTDLDAQTQTLKEETQKK

SEQ ID NO: 2625018 - protein, 4 aa, Entamoeba histolytica
HNTG

SEQ ID NO: 2625019 - protein, 8 aa, Entamoeba histolytica
HNTGKEGD

SEQ ID NO: 2625020 - protein, 4 aa, Entamoeba histolytica
HNTI

SEQ ID NO: 2625021 - protein, 5 aa, Entamoeba histolytica
HNTPC

SEQ ID NO: 2625022 - protein, 14 aa, Entamoeba histolytica
HNTPQDKWKSQPID

SEQ ID NO: 2625023 - protein, 4 aa, Entamoeba histolytica
HNTS

SEQ ID NO: 2625024 - protein, 6 aa, Entamoeba histolytica
HNTSGT

SEQ ID NO: 2625025 - protein, 5 aa, Entamoeba histolytica
HNTTM

SEQ ID NO: 2625026 - protein, 8 aa, Entamoeba histolytica
HNTVEYPK

SEQ ID NO: 2625027 - protein, 9 aa, Entamoeba histolytica
HNVDGSKGF

SEQ ID NO: 2625028 - protein, 12 aa, Entamoeba histolytica
HNVEKKEKEDEI

SEQ ID NO: 2625029 - protein, 8 aa, Entamoeba histolytica
HNVSDSEV

SEQ ID NO: 2625030 - protein, 6 aa, Entamoeba histolytica
HNYEPT

SEQ ID NO: 2625031 - protein, 6 aa, Entamoeba histolytica
HNYYPS

SEQ ID NO: 2625032 - protein, 6 aa, Entamoeba histolytica
HPASGY

SEQ ID NO: 2625033 - protein, 8 aa, Entamoeba histolytica
HPASGYVQ

SEQ ID NO: 2625034 - protein, 6 aa, Entamoeba histolytica
HPDDEY

SEQ ID NO: 2625035 - protein, 8 aa, Entamoeba histolytica
HPDHENVK

SEQ ID NO: 2625036 - protein, 13 aa, Entamoeba histolytica
HPDKHPDDKESLE

SEQ ID NO: 2625037 - protein, 15 aa, Entamoeba histolytica
HPDKNPGDTVAEENF

SEQ ID NO: 2625038 - protein, 18 aa, Entamoeba histolytica
HPDKNPGNKAAEEKFKEI

SEQ ID NO: 2625039 - protein, 17 aa, Entamoeba histolytica
HPDKNPGNKSAEEKFKE

SEQ ID NO: 2625040 - protein, 11 aa, Entamoeba histolytica
HPDKRVSADSM

SEQ ID NO: 2625041 - protein, 13 aa, Entamoeba histolytica
HPDPNNENSINYN

SEQ ID NO: 2625042 - protein, 17 aa, Entamoeba histolytica
HPDSKIRKLTNAAFDSL

SEQ ID NO: 2625043 - protein, 6 aa, Entamoeba histolytica
HPDSSE

SEQ ID NO: 2625044 - protein, 19 aa, Entamoeba histolytica
HPDTDRIEHQKQIEKARGY

SEQ ID NO: 2625045 - protein, 4 aa, Entamoeba histolytica
HPED

SEQ ID NO: 2625046 - protein, 7 aa, Entamoeba histolytica
HPEDVSS

SEQ ID NO: 2625047 - protein, 25 aa, Entamoeba histolytica
HPEEEGSSIVDGKKVKADPEKVKEF

SEQ ID NO: 2625048 - protein, 5 aa, Entamoeba histolytica
HPEEH

SEQ ID NO: 2625049 - protein, 8 aa, Entamoeba histolytica
HPEETKEN

SEQ ID NO: 2625050 - protein, 12 aa, Entamoeba histolytica
HPEFSKPNTYPI

SEQ ID NO: 2625051 - protein, 4 aa, Entamoeba histolytica
HPEI

SEQ ID NO: 2625052 - protein, 11 aa, Entamoeba histolytica
HPEKKDENGDY

SEQ ID NO: 2625053 - protein, 8 aa, Entamoeba histolytica
HPEKYEPV

SEQ ID NO: 2625054 - protein, 6 aa, Entamoeba histolytica
HPENSS

SEQ ID NO: 2625055 - protein, 7 aa, Entamoeba histolytica
HPEQGSV

SEQ ID NO: 2625056 - protein, 5 aa, Entamoeba histolytica
HPERD

SEQ ID NO: 2625057 - protein, 6 aa, Entamoeba histolytica
HPETAE

SEQ ID NO: 2625058 - protein, 8 aa, Entamoeba histolytica
HPEVDENG

SEQ ID NO: 2625059 - protein, 7 aa, Entamoeba histolytica
HPEYNKK

SEQ ID NO: 2625060 - protein, 6 aa, Entamoeba histolytica
HPFDPS

SEQ ID NO: 2625061 - protein, 7 aa, Entamoeba histolytica
HPGDTKF

SEQ ID NO: 2625062 - protein, 4 aa, Entamoeba histolytica
HPGG

SEQ ID NO: 2625063 - protein, 10 aa, Entamoeba histolytica
HPGGSTYTYS

SEQ ID NO: 2625064 - protein, 8 aa, Entamoeba histolytica
HPGKTINT

SEQ ID NO: 2625065 - protein, 6 aa, Entamoeba histolytica
HPGTSI

SEQ ID NO: 2625066 - protein, 4 aa, Entamoeba histolytica
HPIA

SEQ ID NO: 2625067 - protein, 26 aa, Entamoeba histolytica
HPITPPPKPKYSLGDKPLYEAPKYKK

SEQ ID NO: 2625068 - protein, 21 aa, Entamoeba histolytica
HPKAQPQFYDAENGEISIETE

SEQ ID NO: 2625069 - protein, 10 aa, Entamoeba histolytica
HPKDFDPRQY

SEQ ID NO: 2625070 - protein, 15 aa, Entamoeba histolytica
HPKELQQKRSKKERR

SEQ ID NO: 2625071 - protein, 15 aa, Entamoeba histolytica
HPKEPLVATGGGDGK

SEQ ID NO: 2625072 - protein, 6 aa, Entamoeba histolytica
HPKPDD

SEQ ID NO: 2625073 - protein, 19 aa, Entamoeba histolytica
HPKPKKGQKAIVNEPPKEA

SEQ ID NO: 2625074 - protein, 7 aa, Entamoeba histolytica
HPKPSAD

SEQ ID NO: 2625075 - protein, 5 aa, Entamoeba histolytica
HPKQE

SEQ ID NO: 2625076 - protein, 4 aa, Entamoeba histolytica
HPKS

SEQ ID NO: 2625077 - protein, 9 aa, Entamoeba histolytica
HPKSIEGEF

SEQ ID NO: 2625078 - protein, 12 aa, Entamoeba histolytica
HPKSSPPSPKKQ

SEQ ID NO: 2625079 - protein, 12 aa, Entamoeba histolytica
HPKTKLPESMAG

SEQ ID NO: 2625080 - protein, 5 aa, Entamoeba histolytica
HPKTY

SEQ ID NO: 2625081 - protein, 11 aa, Entamoeba histolytica
HPKYNDQFEET

SEQ ID NO: 2625082 - protein, 7 aa, Entamoeba histolytica
HPKYPES

SEQ ID NO: 2625083 - protein, 17 aa, Entamoeba histolytica
HPLPPKQQNYPIPPPQD

SEQ ID NO: 2625084 - protein, 11 aa, Entamoeba histolytica
HPLSPSKTTNY

SEQ ID NO: 2625085 - protein, 8 aa, Entamoeba histolytica
HPMNSSVE

SEQ ID NO: 2625086 - protein, 6 aa, Entamoeba histolytica
HPNCTE

SEQ ID NO: 2625087 - protein, 4 aa, Entamoeba histolytica
HPND

SEQ ID NO: 2625088 - protein, 4 aa, Entamoeba histolytica
HPNE

SEQ ID NO: 2625089 - protein, 24 aa, Entamoeba histolytica
HPNEEEHKRSRSHSRERNQHEKKR

SEQ ID NO: 2625090 - protein, 14 aa, Entamoeba histolytica
HPNIGKKDELPPAS

SEQ ID NO: 2625091 - protein, 29 aa, Entamoeba histolytica
HPNQQKTSFPQQQLQTKQEPNQLPQMPQQ

SEQ ID NO: 2625092 - protein, 5 aa, Entamoeba histolytica
HPNSD

SEQ ID NO: 2625093 - protein, 13 aa, Entamoeba histolytica
HPPDKCQRRKEVG

SEQ ID NO: 2625094 - protein, 4 aa, Entamoeba histolytica
HPPG

SEQ ID NO: 2625095 - protein, 7 aa, Entamoeba histolytica
HPPGQKC

SEQ ID NO: 2625096 - protein, 9 aa, Entamoeba histolytica
HPPKEHKEH

SEQ ID NO: 2625097 - protein, 9 aa, Entamoeba histolytica
HPPKKEKRK

SEQ ID NO: 2625098 - protein, 7 aa, Entamoeba histolytica
HPPPDEH

SEQ ID NO: 2625099 - protein, 6 aa, Entamoeba histolytica
HPPPPL

SEQ ID NO: 2625100 - protein, 15 aa, Entamoeba histolytica
HPPPTFKNKEENSEE

SEQ ID NO: 2625101 - protein, 4 aa, Entamoeba histolytica
HPPQ

SEQ ID NO: 2625102 - protein, 5 aa, Entamoeba histolytica
HPPQS

SEQ ID NO: 2625103 - protein, 7 aa, Entamoeba histolytica
HPPRSSV

SEQ ID NO: 2625104 - protein, 7 aa, Entamoeba histolytica
HPPSGLS

SEQ ID NO: 2625105 - protein, 6 aa, Entamoeba histolytica
HPPSTL

SEQ ID NO: 2625106 - protein, 34 aa, Entamoeba histolytica
HPPTTIKNQPTSVSESISASFSSGQCNSSPIFSL

SEQ ID NO: 2625107 - protein, 13 aa, Entamoeba histolytica
HPQEGYTSGGTHV

SEQ ID NO: 2625108 - protein, 28 aa, Entamoeba histolytica
HPQNEENEDSNELVSGEEESKLDSQPIS

SEQ ID NO: 2625109 - protein, 7 aa, Entamoeba histolytica
HPQTDER

SEQ ID NO: 2625110 - protein, 13 aa, Entamoeba histolytica
HPQYTPNQYPSLS

SEQ ID NO: 2625111 - protein, 6 aa, Entamoeba histolytica
HPREAA

SEQ ID NO: 2625112 - protein, 34 aa, Entamoeba histolytica
HPRRGINRKPFNRNGTDDKHNTSDNKNEENNELS

SEQ ID NO: 2625113 - protein, 24 aa, Entamoeba histolytica
HPRSPTPPPKEPTPPPKQEPQQQA

SEQ ID NO: 2625114 - protein, 5 aa, Entamoeba histolytica
HPRTH

SEQ ID NO: 2625115 - protein, 8 aa, Entamoeba histolytica
HPSEVQSQ

SEQ ID NO: 2625116 - protein, 14 aa, Entamoeba histolytica
HPSISESEKYLKER

SEQ ID NO: 2625117 - protein, 4 aa, Entamoeba histolytica
HPSK

SEQ ID NO: 2625118 - protein, 8 aa, Entamoeba histolytica
HPSKNDLN

SEQ ID NO: 2625119 - protein, 15 aa, Entamoeba histolytica
HPSLTYAPNIDNLYL

SEQ ID NO: 2625120 - protein, 6 aa, Entamoeba histolytica
HPSNPE

SEQ ID NO: 2625121 - protein, 9 aa, Entamoeba histolytica
HPSNYYEEN

SEQ ID NO: 2625122 - protein, 15 aa, Entamoeba histolytica
HPSSNSIELPDSPTC

SEQ ID NO: 2625123 - protein, 4 aa, Entamoeba histolytica
HPST

SEQ ID NO: 2625124 - protein, 5 aa, Entamoeba histolytica
HPSTN

SEQ ID NO: 2625125 - protein, 11 aa, Entamoeba histolytica
HPTGITASQSS

SEQ ID NO: 2625126 - protein, 5 aa, Entamoeba histolytica
HPTHS

SEQ ID NO: 2625127 - protein, 5 aa, Entamoeba histolytica
HPTIE

SEQ ID NO: 2625128 - protein, 5 aa, Entamoeba histolytica
HPTLS

SEQ ID NO: 2625129 - protein, 13 aa, Entamoeba histolytica
HPTRTNELKQEGY

SEQ ID NO: 2625130 - protein, 24 aa, Entamoeba histolytica
HPTTDRNDEQVNDSYSCSNESNEK

SEQ ID NO: 2625131 - protein, 7 aa, Entamoeba histolytica
HPTTRNE

SEQ ID NO: 2625132 - protein, 31 aa, Entamoeba histolytica
HPTVSPTGKKRIPMRKRTKKTTSSDTGLSLS

SEQ ID NO: 2625133 - protein, 4 aa, Entamoeba histolytica
HPWP

SEQ ID NO: 2625134 - protein, 5 aa, Entamoeba histolytica
HPYKD

SEQ ID NO: 2625135 - protein, 9 aa, Entamoeba histolytica
HPYNPDTDS

SEQ ID NO: 2625136 - protein, 9 aa, Entamoeba histolytica
HQAPNDIES

SEQ ID NO: 2625137 - protein, 38 aa, Entamoeba histolytica
HQARYQSVYSKKGKIKEEEDDEYEDTSISVNSENEEIN

SEQ ID NO: 2625138 - protein, 5 aa, Entamoeba histolytica
HQASG

SEQ ID NO: 2625139 - protein, 6 aa, Entamoeba histolytica
HQEDGN

SEQ ID NO: 2625140 - protein, 4 aa, Entamoeba histolytica
HQEG

SEQ ID NO: 2625141 - protein, 8 aa, Entamoeba histolytica
HQEGKEKD

SEQ ID NO: 2625142 - protein, 11 aa, Entamoeba histolytica
HQEGSKVQQEV

SEQ ID NO: 2625143 - protein, 10 aa, Entamoeba histolytica
HQEKEELEKK

SEQ ID NO: 2625144 - protein, 25 aa, Entamoeba histolytica
HQEKTKPKTKPKNKPKMVKAPLKKK

SEQ ID NO: 2625145 - protein, 4 aa, Entamoeba histolytica
HQEQ

SEQ ID NO: 2625146 - protein, 6 aa, Entamoeba histolytica
HQERAA

SEQ ID NO: 2625147 - protein, 21 aa, Entamoeba histolytica
HQERPQRQPRAEGEKKEDDGL

SEQ ID NO: 2625148 - protein, 12 aa, Entamoeba histolytica
HQESIKEMKETS

SEQ ID NO: 2625149 - protein, 4 aa, Entamoeba histolytica
HQEV

SEQ ID NO: 2625150 - protein, 19 aa, Entamoeba histolytica
HQEYADKAYQKTQDATRAS

SEQ ID NO: 2625151 - protein, 7 aa, Entamoeba histolytica
HQFKGSA

SEQ ID NO: 2625152 - protein, 4 aa, Entamoeba histolytica
HQGA

SEQ ID NO: 2625153 - protein, 5 aa, Entamoeba histolytica
HQGIP

SEQ ID NO: 2625154 - protein, 8 aa, Entamoeba histolytica
HQGNADDY

SEQ ID NO: 2625155 - protein, 21 aa, Entamoeba histolytica
HQGYDHSGKPLPKPTKGRLDS

SEQ ID NO: 2625156 - protein, 5 aa, Entamoeba histolytica
HQGYP

SEQ ID NO: 2625157 - protein, 6 aa, Entamoeba histolytica
HQKCSE

SEQ ID NO: 2625158 - protein, 17 aa, Entamoeba histolytica
HQKELEAKIQSEDGFKE

SEQ ID NO: 2625159 - protein, 18 aa, Entamoeba histolytica
HQKGGSILGTSRGAQSPE

SEQ ID NO: 2625160 - protein, 6 aa, Entamoeba histolytica
HQKRYQ

SEQ ID NO: 2625161 - protein, 10 aa, Entamoeba histolytica
HQKVDESTKE

SEQ ID NO: 2625162 - protein, 4 aa, Entamoeba histolytica
HQLS

SEQ ID NO: 2625163 - protein, 4 aa, Entamoeba histolytica
HQMK

SEQ ID NO: 2625164 - protein, 9 aa, Entamoeba histolytica
HQNEDNELT

SEQ ID NO: 2625165 - protein, 9 aa, Entamoeba histolytica
HQNEEKSNE

SEQ ID NO: 2625166 - protein, 19 aa, Entamoeba histolytica
HQNELSQKKIEEIEKTQNE

SEQ ID NO: 2625167 - protein, 7 aa, Entamoeba histolytica
HQNEYDN

SEQ ID NO: 2625168 - protein, 18 aa, Entamoeba histolytica
HQNNPTKRRRDGLPGKLD

SEQ ID NO: 2625169 - protein, 5 aa, Entamoeba histolytica
HQNQS

SEQ ID NO: 2625170 - protein, 5 aa, Entamoeba histolytica
HQNQY

SEQ ID NO: 2625171 - protein, 11 aa, Entamoeba histolytica
HQNTVDKELNE

SEQ ID NO: 2625172 - protein, 14 aa, Entamoeba histolytica
HQNTYEKPKKQKEK

SEQ ID NO: 2625173 - protein, 5 aa, Entamoeba histolytica
HQPEG

SEQ ID NO: 2625174 - protein, 12 aa, Entamoeba histolytica
HQPEINKRNRNF

SEQ ID NO: 2625175 - protein, 7 aa, Entamoeba histolytica
HQPHSKS

SEQ ID NO: 2625176 - protein, 11 aa, Entamoeba histolytica
HQPISKTGITN

SEQ ID NO: 2625177 - protein, 4 aa, Entamoeba histolytica
HQPK

SEQ ID NO: 2625178 - protein, 10 aa, Entamoeba histolytica
HQPMGKQNGE

SEQ ID NO: 2625179 - protein, 5 aa, Entamoeba histolytica
HQPTA

SEQ ID NO: 2625180 - protein, 20 aa, Entamoeba histolytica
HQQESEKPVAQQQVKGNVSA

SEQ ID NO: 2625181 - protein, 7 aa, Entamoeba histolytica
HQQGTEI

SEQ ID NO: 2625182 - protein, 17 aa, Entamoeba histolytica
HQQITGQPLQQSQQQYQ

SEQ ID NO: 2625183 - protein, 6 aa, Entamoeba histolytica
HQQTKQ

SEQ ID NO: 2625184 - protein, 4 aa, Entamoeba histolytica
HQRA

SEQ ID NO: 2625185 - protein, 6 aa, Entamoeba histolytica
HQRGGT

SEQ ID NO: 2625186 - protein, 7 aa, Entamoeba histolytica
HQRGGTI

SEQ ID NO: 2625187 - protein, 4 aa, Entamoeba histolytica
HQRP

SEQ ID NO: 2625188 - protein, 17 aa, Entamoeba histolytica
HQSACKKTLKRRKDLNR

SEQ ID NO: 2625189 - protein, 15 aa, Entamoeba histolytica
HQSAPPVVEIATTPV

SEQ ID NO: 2625190 - protein, 5 aa, Entamoeba histolytica
HQSDI

SEQ ID NO: 2625191 - protein, 6 aa, Entamoeba histolytica
HQSGNP

SEQ ID NO: 2625192 - protein, 7 aa, Entamoeba histolytica
HQSLKEQ

SEQ ID NO: 2625193 - protein, 8 aa, Entamoeba histolytica
HQSNENND

SEQ ID NO: 2625194 - protein, 11 aa, Entamoeba histolytica
HQSNISPLNSS

SEQ ID NO: 2625195 - protein, 6 aa, Entamoeba histolytica
HQSPCT

SEQ ID NO: 2625196 - protein, 5 aa, Entamoeba histolytica
HQSPS

SEQ ID NO: 2625197 - protein, 6 aa, Entamoeba histolytica
HQSQKD

SEQ ID NO: 2625198 - protein, 22 aa, Entamoeba histolytica
HQSQQSNNSHTQPSPQKDSQPI

SEQ ID NO: 2625199 - protein, 6 aa, Entamoeba histolytica
HQSSHG

SEQ ID NO: 2625200 - protein, 16 aa, Entamoeba histolytica
HQSSNSNSPTASQGGC

SEQ ID NO: 2625201 - protein, 5 aa, Entamoeba histolytica
HQSSS

SEQ ID NO: 2625202 - protein, 5 aa, Entamoeba histolytica
HQSVT

SEQ ID NO: 2625203 - protein, 15 aa, Entamoeba histolytica
HQTDEDEMFGNTDGC

SEQ ID NO: 2625204 - protein, 9 aa, Entamoeba histolytica
HQTEPSFNS

SEQ ID NO: 2625205 - protein, 14 aa, Entamoeba histolytica
HQTFPTTKKLNGEP

SEQ ID NO: 2625206 - protein, 5 aa, Entamoeba histolytica
HQTIN

SEQ ID NO: 2625207 - protein, 21 aa, Entamoeba histolytica
HQTLKQRKGNKSKIEKKGLTT

SEQ ID NO: 2625208 - protein, 7 aa, Entamoeba histolytica
HQTRVEK

SEQ ID NO: 2625209 - protein, 8 aa, Entamoeba histolytica
HQTRVEKA

SEQ ID NO: 2625210 - protein, 5 aa, Entamoeba histolytica
HQTSG

SEQ ID NO: 2625211 - protein, 11 aa, Entamoeba histolytica
HQTTSNSSFDF

SEQ ID NO: 2625212 - protein, 7 aa, Entamoeba histolytica
HQTTSTV

SEQ ID NO: 2625213 - protein, 10 aa, Entamoeba histolytica
HQTTTPTIHQ

SEQ ID NO: 2625214 - protein, 10 aa, Entamoeba histolytica
HQWPTYSDDE

SEQ ID NO: 2625215 - protein, 8 aa, Entamoeba histolytica
HQYTEGSR

SEQ ID NO: 2625216 - protein, 5 aa, Entamoeba histolytica
HRDLK

SEQ ID NO: 2625217 - protein, 17 aa, Entamoeba histolytica
HRDNGGSRTIVVTLNGI

SEQ ID NO: 2625218 - protein, 6 aa, Entamoeba histolytica
HRDPTI

SEQ ID NO: 2625219 - protein, 7 aa, Entamoeba histolytica
HRDPTVA

SEQ ID NO: 2625220 - protein, 27 aa, Entamoeba histolytica
HRDSQQKNETSNPRKSQLQETEDSESI

SEQ ID NO: 2625221 - protein, 4 aa, Entamoeba histolytica
HRET

SEQ ID NO: 2625222 - protein, 14 aa, Entamoeba histolytica
HRGEDDAPLNTSEY

SEQ ID NO: 2625223 - protein, 10 aa, Entamoeba histolytica
HRGEVGESKA

SEQ ID NO: 2625224 - protein, 11 aa, Entamoeba histolytica
HRISTAPGTQT

SEQ ID NO: 2625225 - protein, 14 aa, Entamoeba histolytica
HRKDETLKPTEKKP

SEQ ID NO: 2625226 - protein, 4 aa, Entamoeba histolytica
HRKK

SEQ ID NO: 2625227 - protein, 11 aa, Entamoeba histolytica
HRKKGNVTKNN

SEQ ID NO: 2625228 - protein, 16 aa, Entamoeba histolytica
HRKRKNEDVSQEEEEH

SEQ ID NO: 2625229 - protein, 11 aa, Entamoeba histolytica
HRKTDNVERKK

SEQ ID NO: 2625230 - protein, 10 aa, Entamoeba histolytica
HRLKNKDSKL

SEQ ID NO: 2625231 - protein, 4 aa, Entamoeba histolytica
HRLN

SEQ ID NO: 2625232 - protein, 8 aa, Entamoeba histolytica
HRLSPTDK

SEQ ID NO: 2625233 - protein, 9 aa, Entamoeba histolytica
HRNEEKNVQ

SEQ ID NO: 2625234 - protein, 10 aa, Entamoeba histolytica
HRNERIRSEG

SEQ ID NO: 2625235 - protein, 5 aa, Entamoeba histolytica
HRNNN

SEQ ID NO: 2625236 - protein, 7 aa, Entamoeba histolytica
HRNSGKQ

SEQ ID NO: 2625237 - protein, 6 aa, Entamoeba histolytica
HRNSRL

SEQ ID NO: 2625238 - protein, 4 aa, Entamoeba histolytica
HRPA

SEQ ID NO: 2625239 - protein, 15 aa, Entamoeba histolytica
HRPSNKTEYKRIREN

SEQ ID NO: 2625240 - protein, 10 aa, Entamoeba histolytica
HRQEGKTNEL

SEQ ID NO: 2625241 - protein, 4 aa, Entamoeba histolytica
HRQS

SEQ ID NO: 2625242 - protein, 14 aa, Entamoeba histolytica
HRQTREQKKKTMGE

SEQ ID NO: 2625243 - protein, 7 aa, Entamoeba histolytica
HRRKGMG

SEQ ID NO: 2625244 - protein, 11 aa, Entamoeba histolytica
HRRYNADDNLV

SEQ ID NO: 2625245 - protein, 8 aa, Entamoeba histolytica
HRSEPELT

SEQ ID NO: 2625246 - protein, 12 aa, Entamoeba histolytica
HRSGCNAVDGRD

SEQ ID NO: 2625247 - protein, 9 aa, Entamoeba histolytica
HRSGETEDT

SEQ ID NO: 2625248 - protein, 9 aa, Entamoeba histolytica
HRSHTKLNR

SEQ ID NO: 2625249 - protein, 6 aa, Entamoeba histolytica
HRSPED

SEQ ID NO: 2625250 - protein, 15 aa, Entamoeba histolytica
HRSRRRTRKNHEEED

SEQ ID NO: 2625251 - protein, 4 aa, Entamoeba histolytica
HRTE

SEQ ID NO: 2625252 - protein, 4 aa, Entamoeba histolytica
HRTL

SEQ ID NO: 2625253 - protein, 12 aa, Entamoeba histolytica
HRTLSRKGWYTY

SEQ ID NO: 2625254 - protein, 5 aa, Entamoeba histolytica
HRTQT

SEQ ID NO: 2625255 - protein, 4 aa, Entamoeba histolytica
HRYG

SEQ ID NO: 2625256 - protein, 5 aa, Entamoeba histolytica
HSAAE

SEQ ID NO: 2625257 - protein, 9 aa, Entamoeba histolytica
HSAGKHLET

SEQ ID NO: 2625258 - protein, 10 aa, Entamoeba histolytica
HSAKNENTRF

SEQ ID NO: 2625259 - protein, 5 aa, Entamoeba histolytica
HSAPG

SEQ ID NO: 2625260 - protein, 25 aa, Entamoeba histolytica
HSASIDDEDDSIDNSKPKTRKLPDA

SEQ ID NO: 2625261 - protein, 26 aa, Entamoeba histolytica
HSATDITSQRDKKISTNPQPTVESSI

SEQ ID NO: 2625262 - protein, 11 aa, Entamoeba histolytica
HSDEEDPTKQG

SEQ ID NO: 2625263 - protein, 11 aa, Entamoeba histolytica
HSDENDDDNVV

SEQ ID NO: 2625264 - protein, 8 aa, Entamoeba histolytica
HSDGTKQT

SEQ ID NO: 2625265 - protein, 8 aa, Entamoeba histolytica
HSDGTQQT

SEQ ID NO: 2625266 - protein, 7 aa, Entamoeba histolytica
HSDGTRQ

SEQ ID NO: 2625267 - protein, 8 aa, Entamoeba histolytica
HSDHASGI

SEQ ID NO: 2625268 - protein, 11 aa, Entamoeba histolytica
HSDKKDSSLSL

SEQ ID NO: 2625269 - protein, 11 aa, Entamoeba histolytica
HSDNTNINLSS

SEQ ID NO: 2625270 - protein, 9 aa, Entamoeba histolytica
HSDNYRNER

SEQ ID NO: 2625271 - protein, 9 aa, Entamoeba histolytica
HSDPNATYC

SEQ ID NO: 2625272 - protein, 10 aa, Entamoeba histolytica
HSDPSNAESY

SEQ ID NO: 2625273 - protein, 7 aa, Entamoeba histolytica
HSDQSDE

SEQ ID NO: 2625274 - protein, 5 aa, Entamoeba histolytica
HSDSS

SEQ ID NO: 2625275 - protein, 15 aa, Entamoeba histolytica
HSDTYEGKTAFSQEK

SEQ ID NO: 2625276 - protein, 4 aa, Entamoeba histolytica
HSDY

SEQ ID NO: 2625277 - protein, 11 aa, Entamoeba histolytica
HSEAKSAKNGI

SEQ ID NO: 2625278 - protein, 4 aa, Entamoeba histolytica
HSEC

SEQ ID NO: 2625279 - protein, 7 aa, Entamoeba histolytica
HSEDTFK

SEQ ID NO: 2625280 - protein, 13 aa, Entamoeba histolytica
HSEGTTNTKTITT

SEQ ID NO: 2625281 - protein, 4 aa, Entamoeba histolytica
HSEH

SEQ ID NO: 2625282 - protein, 5 aa, Entamoeba histolytica
HSEKC

SEQ ID NO: 2625283 - protein, 5 aa, Entamoeba histolytica
HSEKE

SEQ ID NO: 2625284 - protein, 9 aa, Entamoeba histolytica
HSEKERRKL

SEQ ID NO: 2625285 - protein, 6 aa, Entamoeba histolytica
HSEPHP

SEQ ID NO: 2625286 - protein, 12 aa, Entamoeba histolytica
HSEPKPQLSKYP

SEQ ID NO: 2625287 - protein, 5 aa, Entamoeba histolytica
HSERT

SEQ ID NO: 2625288 - protein, 10 aa, Entamoeba histolytica
HSESEPSLNP

SEQ ID NO: 2625289 - protein, 8 aa, Entamoeba histolytica
HSESPGVS

SEQ ID NO: 2625290 - protein, 13 aa, Entamoeba histolytica
HSEVDYVSKENYQ

SEQ ID NO: 2625291 - protein, 5 aa, Entamoeba histolytica
HSFNG

SEQ ID NO: 2625292 - protein, 6 aa, Entamoeba histolytica
HSFPDE

SEQ ID NO: 2625293 - protein, 6 aa, Entamoeba histolytica
HSGGED

SEQ ID NO: 2625294 - protein, 8 aa, Entamoeba histolytica
HSGRTSSG

SEQ ID NO: 2625295 - protein, 17 aa, Entamoeba histolytica
HSGSQIKKRRNSFNTSK

SEQ ID NO: 2625296 - protein, 11 aa, Entamoeba histolytica
HSHQQIENTTL

SEQ ID NO: 2625297 - protein, 5 aa, Entamoeba histolytica
HSHSR

SEQ ID NO: 2625298 - protein, 4 aa, Entamoeba histolytica
HSHT

SEQ ID NO: 2625299 - protein, 4 aa, Entamoeba histolytica
HSID

SEQ ID NO: 2625300 - protein, 7 aa, Entamoeba histolytica
HSIDETK

SEQ ID NO: 2625301 - protein, 6 aa, Entamoeba histolytica
HSIENE

SEQ ID NO: 2625302 - protein, 10 aa, Entamoeba histolytica
HSITLEQKDT

SEQ ID NO: 2625303 - protein, 8 aa, Entamoeba histolytica
HSKEENKR

SEQ ID NO: 2625304 - protein, 10 aa, Entamoeba histolytica
HSKETNKLEN

SEQ ID NO: 2625305 - protein, 5 aa, Entamoeba histolytica
HSKGE

SEQ ID NO: 2625306 - protein, 8 aa, Entamoeba histolytica
HSKGKTTC

SEQ ID NO: 2625307 - protein, 8 aa, Entamoeba histolytica
HSKKGDSL

SEQ ID NO: 2625308 - protein, 11 aa, Entamoeba histolytica
HSKKSKQTQLI

SEQ ID NO: 2625309 - protein, 10 aa, Entamoeba histolytica
HSKKTNKEGV

SEQ ID NO: 2625310 - protein, 7 aa, Entamoeba histolytica
HSKPIGE

SEQ ID NO: 2625311 - protein, 8 aa, Entamoeba histolytica
HSKPSSPV

SEQ ID NO: 2625312 - protein, 4 aa, Entamoeba histolytica
HSKT

SEQ ID NO: 2625313 - protein, 4 aa, Entamoeba histolytica
HSLE

SEQ ID NO: 2625314 - protein, 6 aa, Entamoeba histolytica
HSLEND

SEQ ID NO: 2625315 - protein, 11 aa, Entamoeba histolytica
HSLNQSDSDDF

SEQ ID NO: 2625316 - protein, 18 aa, Entamoeba histolytica
HSLSESAELNQKKWLDDG

SEQ ID NO: 2625317 - protein, 5 aa, Entamoeba histolytica
HSMND

SEQ ID NO: 2625318 - protein, 34 aa, Entamoeba histolytica
HSNENTNNNENTNNNENTNNNDHSSSKSSEEESV

SEQ ID NO: 2625319 - protein, 5 aa, Entamoeba histolytica
HSNEP

SEQ ID NO: 2625320 - protein, 9 aa, Entamoeba histolytica
HSNETDSDT

SEQ ID NO: 2625321 - protein, 20 aa, Entamoeba histolytica
HSNETQKLTPSSQLSSTPLS

SEQ ID NO: 2625322 - protein, 4 aa, Entamoeba histolytica
HSNG

SEQ ID NO: 2625323 - protein, 5 aa, Entamoeba histolytica
HSNGG

SEQ ID NO: 2625324 - protein, 8 aa, Entamoeba histolytica
HSNGKTKY

SEQ ID NO: 2625325 - protein, 4 aa, Entamoeba histolytica
HSNL

SEQ ID NO: 2625326 - protein, 8 aa, Entamoeba histolytica
HSNNSLPS

SEQ ID NO: 2625327 - protein, 5 aa, Entamoeba histolytica
HSNNT

SEQ ID NO: 2625328 - protein, 10 aa, Entamoeba histolytica
HSNNTQKDQT

SEQ ID NO: 2625329 - protein, 6 aa, Entamoeba histolytica
HSNPLN

SEQ ID NO: 2625330 - protein, 10 aa, Entamoeba histolytica
HSNPNTVNEN

SEQ ID NO: 2625331 - protein, 4 aa, Entamoeba histolytica
HSNS

SEQ ID NO: 2625332 - protein, 12 aa, Entamoeba histolytica
HSNTHKKWSAGE

SEQ ID NO: 2625333 - protein, 8 aa, Entamoeba histolytica
HSNTTKPI

SEQ ID NO: 2625334 - protein, 8 aa, Entamoeba histolytica
HSNVSSPS

SEQ ID NO: 2625335 - protein, 11 aa, Entamoeba histolytica
HSPAGGKEPIR

SEQ ID NO: 2625336 - protein, 12 aa, Entamoeba histolytica
HSPDASQSKLRN

SEQ ID NO: 2625337 - protein, 6 aa, Entamoeba histolytica
HSPEQQ

SEQ ID NO: 2625338 - protein, 7 aa, Entamoeba histolytica
HSPEVTQ

SEQ ID NO: 2625339 - protein, 4 aa, Entamoeba histolytica
HSPI

SEQ ID NO: 2625340 - protein, 7 aa, Entamoeba histolytica
HSPITSN

SEQ ID NO: 2625341 - protein, 10 aa, Entamoeba histolytica
HSPKGIDNDR

SEQ ID NO: 2625342 - protein, 4 aa, Entamoeba histolytica
HSPL

SEQ ID NO: 2625343 - protein, 30 aa, Entamoeba histolytica
HSPSGTPETPQTLDQKKEQNKTDNPNPKKV

SEQ ID NO: 2625344 - protein, 6 aa, Entamoeba histolytica
HSPSTN

SEQ ID NO: 2625345 - protein, 8 aa, Entamoeba histolytica
HSPTPPFQ

SEQ ID NO: 2625346 - protein, 4 aa, Entamoeba histolytica
HSQE

SEQ ID NO: 2625347 - protein, 6 aa, Entamoeba histolytica
HSQEID

SEQ ID NO: 2625348 - protein, 17 aa, Entamoeba histolytica
HSQEINNKKEDVIEQSQ

SEQ ID NO: 2625349 - protein, 5 aa, Entamoeba histolytica
HSQER

SEQ ID NO: 2625350 - protein, 100 aa, Entamoeba histolytica
HSQKTKENEKTESKVKEKDSRGREVERKSSEGRGDNKRNSENKSPRRSKRSNSRSSRRHSHSQKTKEEDSKKKLSERNLSEDARTLKHKGDKLSSKERID

SEQ ID NO: 2625351 - protein, 10 aa, Entamoeba histolytica
HSQNNTKAFG

SEQ ID NO: 2625352 - protein, 9 aa, Entamoeba histolytica
HSQQETSSI

SEQ ID NO: 2625353 - protein, 11 aa, Entamoeba histolytica
HSQSKNQQEIE

SEQ ID NO: 2625354 - protein, 10 aa, Entamoeba histolytica
HSQSTTRHSA

SEQ ID NO: 2625355 - protein, 4 aa, Entamoeba histolytica
HSQT

SEQ ID NO: 2625356 - protein, 4 aa, Entamoeba histolytica
HSQV

SEQ ID NO: 2625357 - protein, 11 aa, Entamoeba histolytica
HSRKDEIKGVS

SEQ ID NO: 2625358 - protein, 7 aa, Entamoeba histolytica
HSRKPDW

SEQ ID NO: 2625359 - protein, 5 aa, Entamoeba histolytica
HSRRG

SEQ ID NO: 2625360 - protein, 7 aa, Entamoeba histolytica
HSRRTTK

SEQ ID NO: 2625361 - protein, 24 aa, Entamoeba histolytica
HSSAYTGSQFENADSQNDPFYSAL

SEQ ID NO: 2625362 - protein, 8 aa, Entamoeba histolytica
HSSDESLP

SEQ ID NO: 2625363 - protein, 12 aa, Entamoeba histolytica
HSSDPRRARAAT

SEQ ID NO: 2625364 - protein, 10 aa, Entamoeba histolytica
HSSDSCKNYN

SEQ ID NO: 2625365 - protein, 9 aa, Entamoeba histolytica
HSSFSQKIE

SEQ ID NO: 2625366 - protein, 5 aa, Entamoeba histolytica
HSSHC

SEQ ID NO: 2625367 - protein, 11 aa, Entamoeba histolytica
HSSKKTPSLKF

SEQ ID NO: 2625368 - protein, 9 aa, Entamoeba histolytica
HSSKLNSKI

SEQ ID NO: 2625369 - protein, 4 aa, Entamoeba histolytica
HSSN

SEQ ID NO: 2625370 - protein, 13 aa, Entamoeba histolytica
HSSNDKRAAEDDS

SEQ ID NO: 2625371 - protein, 5 aa, Entamoeba histolytica
HSSNQ

SEQ ID NO: 2625372 - protein, 20 aa, Entamoeba histolytica
HSSNSLNTSSFNPIKRTNPI

SEQ ID NO: 2625373 - protein, 8 aa, Entamoeba histolytica
HSSQDSSF

SEQ ID NO: 2625374 - protein, 16 aa, Entamoeba histolytica
HSSQHNAKISEEPIQK

SEQ ID NO: 2625375 - protein, 7 aa, Entamoeba histolytica
HSSQSNN

SEQ ID NO: 2625376 - protein, 5 aa, Entamoeba histolytica
HSSQT

SEQ ID NO: 2625377 - protein, 8 aa, Entamoeba histolytica
HSSSSSSS

SEQ ID NO: 2625378 - protein, 4 aa, Entamoeba histolytica
HSST

SEQ ID NO: 2625379 - protein, 4 aa, Entamoeba histolytica
HSTA

SEQ ID NO: 2625380 - protein, 10 aa, Entamoeba histolytica
HSTGSGKSLT

SEQ ID NO: 2625381 - protein, 4 aa, Entamoeba histolytica
HSTK

SEQ ID NO: 2625382 - protein, 45 aa, Entamoeba histolytica
HSTKEETLKEEDNENVLKEEDNENNTIENEQSEENDTIERRKERT

SEQ ID NO: 2625383 - protein, 5 aa, Entamoeba histolytica
HSTKQ

SEQ ID NO: 2625384 - protein, 4 aa, Entamoeba histolytica
HSTN

SEQ ID NO: 2625385 - protein, 13 aa, Entamoeba histolytica
HSTNIEATPRPRL

SEQ ID NO: 2625386 - protein, 8 aa, Entamoeba histolytica
HSTPTEEN

SEQ ID NO: 2625387 - protein, 8 aa, Entamoeba histolytica
HSTPTNAE

SEQ ID NO: 2625388 - protein, 9 aa, Entamoeba histolytica
HSTPYKISD

SEQ ID NO: 2625389 - protein, 36 aa, Entamoeba histolytica
HSTSSLSTLPQHYSNEPIISPRSTRREIRATNSSAT

SEQ ID NO: 2625390 - protein, 6 aa, Entamoeba histolytica
HSTTGQ

SEQ ID NO: 2625391 - protein, 5 aa, Entamoeba histolytica
HSTTM

SEQ ID NO: 2625392 - protein, 8 aa, Entamoeba histolytica
HSVAPADK

SEQ ID NO: 2625393 - protein, 5 aa, Entamoeba histolytica
HSVEN

SEQ ID NO: 2625394 - protein, 12 aa, Entamoeba histolytica
HSVESSDPLPPR

SEQ ID NO: 2625395 - protein, 10 aa, Entamoeba histolytica
HSVNDPSLSQ

SEQ ID NO: 2625396 - protein, 9 aa, Entamoeba histolytica
HSVTPQDIS

SEQ ID NO: 2625397 - protein, 85 aa, Entamoeba histolytica
HSYHGRSYDRSRSRSSRRRSRSRSSRRRYRSRSNRRHNRSRSRSSRRRYNRSRSVSSYSKSRRDKSSGGRSGSSSPKRGERKSFR

SEQ ID NO: 2625398 - protein, 12 aa, Entamoeba histolytica
HSYKNEDYNDLP

SEQ ID NO: 2625399 - protein, 8 aa, Entamoeba histolytica
HSYRSPRN

SEQ ID NO: 2625400 - protein, 9 aa, Entamoeba histolytica
HSYTSEETI

SEQ ID NO: 2625401 - protein, 7 aa, Entamoeba histolytica
HTDEDIE

SEQ ID NO: 2625402 - protein, 8 aa, Entamoeba histolytica
HTDEDMEK

SEQ ID NO: 2625403 - protein, 6 aa, Entamoeba histolytica
HTDEKL

SEQ ID NO: 2625404 - protein, 12 aa, Entamoeba histolytica
HTDKEKSPEIYQ

SEQ ID NO: 2625405 - protein, 9 aa, Entamoeba histolytica
HTDKNYQQG

SEQ ID NO: 2625406 - protein, 9 aa, Entamoeba histolytica
HTDRNDPLF

SEQ ID NO: 2625407 - protein, 6 aa, Entamoeba histolytica
HTDYND

SEQ ID NO: 2625408 - protein, 9 aa, Entamoeba histolytica
HTEIEGKQG

SEQ ID NO: 2625409 - protein, 7 aa, Entamoeba histolytica
HTELQGK

SEQ ID NO: 2625410 - protein, 22 aa, Entamoeba histolytica
HTENESNNDEKINEINQKIEEN

SEQ ID NO: 2625411 - protein, 13 aa, Entamoeba histolytica
HTENKEQKETKFE

SEQ ID NO: 2625412 - protein, 16 aa, Entamoeba histolytica
HTENKNKMRPTNLTGK

SEQ ID NO: 2625413 - protein, 5 aa, Entamoeba histolytica
HTERM

SEQ ID NO: 2625414 - protein, 5 aa, Entamoeba histolytica
HTETA

SEQ ID NO: 2625415 - protein, 5 aa, Entamoeba histolytica
HTEVD

SEQ ID NO: 2625416 - protein, 7 aa, Entamoeba histolytica
HTEYDEQ

SEQ ID NO: 2625417 - protein, 10 aa, Entamoeba histolytica
HTGEREYAGQ

SEQ ID NO: 2625418 - protein, 4 aa, Entamoeba histolytica
HTGK

SEQ ID NO: 2625419 - protein, 7 aa, Entamoeba histolytica
HTGQVTA

SEQ ID NO: 2625420 - protein, 8 aa, Entamoeba histolytica
HTGSEKRI

SEQ ID NO: 2625421 - protein, 5 aa, Entamoeba histolytica
HTGSI

SEQ ID NO: 2625422 - protein, 4 aa, Entamoeba histolytica
HTHD

SEQ ID NO: 2625423 - protein, 7 aa, Entamoeba histolytica
HTHSTKT

SEQ ID NO: 2625424 - protein, 5 aa, Entamoeba histolytica
HTIDQ

SEQ ID NO: 2625425 - protein, 12 aa, Entamoeba histolytica
HTISLNEKTSMK

SEQ ID NO: 2625426 - protein, 22 aa, Entamoeba histolytica
HTKEKKDKKHSDKKKEKRKSFV

SEQ ID NO: 2625427 - protein, 23 aa, Entamoeba histolytica
HTKKTGQSGKTDYKPRSRTSKAV

SEQ ID NO: 2625428 - protein, 10 aa, Entamoeba histolytica
HTKNTSKEYT

SEQ ID NO: 2625429 - protein, 6 aa, Entamoeba histolytica
HTKPGM

SEQ ID NO: 2625430 - protein, 9 aa, Entamoeba histolytica
HTKQAEYYK

SEQ ID NO: 2625431 - protein, 9 aa, Entamoeba histolytica
HTKSSVQSY

SEQ ID NO: 2625432 - protein, 4 aa, Entamoeba histolytica
HTLA

SEQ ID NO: 2625433 - protein, 10 aa, Entamoeba histolytica
HTLAESDSEI

SEQ ID NO: 2625434 - protein, 19 aa, Entamoeba histolytica
HTLTDQTQIKNDKSPVTVG

SEQ ID NO: 2625435 - protein, 15 aa, Entamoeba histolytica
HTLTEESSPMKRRRS

SEQ ID NO: 2625436 - protein, 6 aa, Entamoeba histolytica
HTNEDK

SEQ ID NO: 2625437 - protein, 31 aa, Entamoeba histolytica
HTNEEEQKDQDDSLTCNDNNESSSKTSYESD

SEQ ID NO: 2625438 - protein, 18 aa, Entamoeba histolytica
HTNEKETKAVAESDEKTN

SEQ ID NO: 2625439 - protein, 17 aa, Entamoeba histolytica
HTNERSHRYSRTEDPYS

SEQ ID NO: 2625440 - protein, 7 aa, Entamoeba histolytica
HTNKGEN

SEQ ID NO: 2625441 - protein, 7 aa, Entamoeba histolytica
HTNQREM

SEQ ID NO: 2625442 - protein, 4 aa, Entamoeba histolytica
HTPA

SEQ ID NO: 2625443 - protein, 6 aa, Entamoeba histolytica
HTPFQT

SEQ ID NO: 2625444 - protein, 9 aa, Entamoeba histolytica
HTPQNHPDF

SEQ ID NO: 2625445 - protein, 4 aa, Entamoeba histolytica
HTPS

SEQ ID NO: 2625446 - protein, 10 aa, Entamoeba histolytica
HTPTDHPDYN

SEQ ID NO: 2625447 - protein, 6 aa, Entamoeba histolytica
HTPTNH

SEQ ID NO: 2625448 - protein, 14 aa, Entamoeba histolytica
HTPYIDSSEQSIVE

SEQ ID NO: 2625449 - protein, 12 aa, Entamoeba histolytica
HTPYTERGYKGS

SEQ ID NO: 2625450 - protein, 5 aa, Entamoeba histolytica
HTQEE

SEQ ID NO: 2625451 - protein, 12 aa, Entamoeba histolytica
HTQGKRHQQNLR

SEQ ID NO: 2625452 - protein, 6 aa, Entamoeba histolytica
HTQQSH

SEQ ID NO: 2625453 - protein, 4 aa, Entamoeba histolytica
HTRP

SEQ ID NO: 2625454 - protein, 10 aa, Entamoeba histolytica
HTSAGKTAVA

SEQ ID NO: 2625455 - protein, 7 aa, Entamoeba histolytica
HTSDSKV

SEQ ID NO: 2625456 - protein, 5 aa, Entamoeba histolytica
HTSDV

SEQ ID NO: 2625457 - protein, 12 aa, Entamoeba histolytica
HTSIKSKGKTSM

SEQ ID NO: 2625458 - protein, 6 aa, Entamoeba histolytica
HTSNAD

SEQ ID NO: 2625459 - protein, 8 aa, Entamoeba histolytica
HTSPIDSD

SEQ ID NO: 2625460 - protein, 16 aa, Entamoeba histolytica
HTSQQKGGAKSKQSTM

SEQ ID NO: 2625461 - protein, 9 aa, Entamoeba histolytica
HTSQTFDDS

SEQ ID NO: 2625462 - protein, 4 aa, Entamoeba histolytica
HTST

SEQ ID NO: 2625463 - protein, 5 aa, Entamoeba histolytica
HTSTT

SEQ ID NO: 2625464 - protein, 9 aa, Entamoeba histolytica
HTSTTHPIS

SEQ ID NO: 2625465 - protein, 7 aa, Entamoeba histolytica
HTTDDSL

SEQ ID NO: 2625466 - protein, 15 aa, Entamoeba histolytica
HTTGIEKEEEQEMGQ

SEQ ID NO: 2625467 - protein, 4 aa, Entamoeba histolytica
HTTI

SEQ ID NO: 2625468 - protein, 4 aa, Entamoeba histolytica
HTTM

SEQ ID NO: 2625469 - protein, 56 aa, Entamoeba histolytica
HTTNEEKKEKKEKKEKEKKEKEEAKEKKKGHGRNESQNLKTPPIAANPKVAGYATG

SEQ ID NO: 2625470 - protein, 4 aa, Entamoeba histolytica
HTTQ

SEQ ID NO: 2625471 - protein, 5 aa, Entamoeba histolytica
HTTQN

SEQ ID NO: 2625472 - protein, 6 aa, Entamoeba histolytica
HTTQNA

SEQ ID NO: 2625473 - protein, 14 aa, Entamoeba histolytica
HTTRKPRGKEQNGV

SEQ ID NO: 2625474 - protein, 38 aa, Entamoeba histolytica
HTTSEEKKEKKEKKEKSKKEKKEAKEKKLTSEETSKLQ

SEQ ID NO: 2625475 - protein, 13 aa, Entamoeba histolytica
HTTSETSTPRKGF

SEQ ID NO: 2625476 - protein, 5 aa, Entamoeba histolytica
HTTSL

SEQ ID NO: 2625477 - protein, 11 aa, Entamoeba histolytica
HTTSQLKYPDE

SEQ ID NO: 2625478 - protein, 15 aa, Entamoeba histolytica
HTTTPMPQSNQTTVR

SEQ ID NO: 2625479 - protein, 6 aa, Entamoeba histolytica
HTWEET

SEQ ID NO: 2625480 - protein, 5 aa, Entamoeba histolytica
HTYEG

SEQ ID NO: 2625481 - protein, 27 aa, Entamoeba histolytica
HVEEKQIKKYGKNFKPDYKIDDNDDDF

SEQ ID NO: 2625482 - protein, 24 aa, Entamoeba histolytica
HVEKKTEKPKPVEEKKEETKPVEV

SEQ ID NO: 2625483 - protein, 6 aa, Entamoeba histolytica
HVENPD

SEQ ID NO: 2625484 - protein, 6 aa, Entamoeba histolytica
HVENPE

SEQ ID NO: 2625485 - protein, 4 aa, Entamoeba histolytica
HVGN

SEQ ID NO: 2625486 - protein, 7 aa, Entamoeba histolytica
HVGQEKY

SEQ ID NO: 2625487 - protein, 4 aa, Entamoeba histolytica
HVKT

SEQ ID NO: 2625488 - protein, 12 aa, Entamoeba histolytica
HVNKKAKDQYKG

SEQ ID NO: 2625489 - protein, 6 aa, Entamoeba histolytica
HVPGED

SEQ ID NO: 2625490 - protein, 6 aa, Entamoeba histolytica
HVSEDA

SEQ ID NO: 2625491 - protein, 29 aa, Entamoeba histolytica
HVSEEEEEKETLKTKTSFKQNHYHSCCTV

SEQ ID NO: 2625492 - protein, 7 aa, Entamoeba histolytica
HVSSTVE

SEQ ID NO: 2625493 - protein, 6 aa, Entamoeba histolytica
HVSTNP

SEQ ID NO: 2625494 - protein, 10 aa, Entamoeba histolytica
HVSTTPKTSD

SEQ ID NO: 2625495 - protein, 14 aa, Entamoeba histolytica
HVTQKHDKPLEVSQ

SEQ ID NO: 2625496 - protein, 11 aa, Entamoeba histolytica
HVTSTGGAPSA

SEQ ID NO: 2625497 - protein, 10 aa, Entamoeba histolytica
HVYEEKKQNI

SEQ ID NO: 2625498 - protein, 11 aa, Entamoeba histolytica
HWSAGEKDDIE

SEQ ID NO: 2625499 - protein, 14 aa, Entamoeba histolytica
HYDEDDELKDSDLI

SEQ ID NO: 2625500 - protein, 7 aa, Entamoeba histolytica
HYDGTPD

SEQ ID NO: 2625501 - protein, 5 aa, Entamoeba histolytica
HYDNE

SEQ ID NO: 2625502 - protein, 5 aa, Entamoeba histolytica
HYEKE

SEQ ID NO: 2625503 - protein, 6 aa, Entamoeba histolytica
HYGAQK

SEQ ID NO: 2625504 - protein, 11 aa, Entamoeba histolytica
HYGEPDSKVKE

SEQ ID NO: 2625505 - protein, 4 aa, Entamoeba histolytica
HYKS

SEQ ID NO: 2625506 - protein, 5 aa, Entamoeba histolytica
HYNEE

SEQ ID NO: 2625507 - protein, 33 aa, Entamoeba histolytica
HYPKFQKEENKTVNKKTSKRERKMKININKKPK

SEQ ID NO: 2625508 - protein, 4 aa, Entamoeba histolytica
HYQT

SEQ ID NO: 2625509 - protein, 9 aa, Entamoeba histolytica
HYQYTQTRI

SEQ ID NO: 2625510 - protein, 18 aa, Entamoeba histolytica
HYRGNNKESNTIIKPSEK

SEQ ID NO: 2625511 - protein, 5 aa, Entamoeba histolytica
HYRSP

SEQ ID NO: 2625512 - protein, 6 aa, Entamoeba histolytica
HYRTGT

SEQ ID NO: 2625513 - protein, 5 aa, Entamoeba histolytica
HYSDK

SEQ ID NO: 2625514 - protein, 12 aa, Entamoeba histolytica
HYSDQSSDSISL

SEQ ID NO: 2625515 - protein, 4 aa, Entamoeba histolytica
HYSL

SEQ ID NO: 2625516 - protein, 5 aa, Entamoeba histolytica
HYSQQ

SEQ ID NO: 2625517 - protein, 11 aa, Entamoeba histolytica
HYSSQEGKNKV

SEQ ID NO: 2625518 - protein, 51 aa, Entamoeba histolytica
HYTPNDTKTTVIQSSEDDDQEYDDEFSSEHTEDGTYSNEQEEEYNQSQEEE

SEQ ID NO: 2625519 - protein, 8 aa, Entamoeba histolytica
HYTSNQSK

SEQ ID NO: 2625520 - protein, 11 aa, Entamoeba histolytica
IAADPKTLQTE

SEQ ID NO: 2625521 - protein, 10 aa, Entamoeba histolytica
IAAEDKTTIE

SEQ ID NO: 2625522 - protein, 4 aa, Entamoeba histolytica
IAAR

SEQ ID NO: 2625523 - protein, 17 aa, Entamoeba histolytica
IADKSQEEVVNKEDLDR

SEQ ID NO: 2625524 - protein, 13 aa, Entamoeba histolytica
IADRKRSKEEKEL

SEQ ID NO: 2625525 - protein, 17 aa, Entamoeba histolytica
IADSKEQEVQSIKNEYE

SEQ ID NO: 2625526 - protein, 6 aa, Entamoeba histolytica
IADSTS

SEQ ID NO: 2625527 - protein, 7 aa, Entamoeba histolytica
IAEEKRQ

SEQ ID NO: 2625528 - protein, 5 aa, Entamoeba histolytica
IAEFN

SEQ ID NO: 2625529 - protein, 10 aa, Entamoeba histolytica
IAEGKLSNEL

SEQ ID NO: 2625530 - protein, 10 aa, Entamoeba histolytica
IAEKEDPKQY

SEQ ID NO: 2625531 - protein, 6 aa, Entamoeba histolytica
IAEKPR

SEQ ID NO: 2625532 - protein, 10 aa, Entamoeba histolytica
IAEKTPGYSG

SEQ ID NO: 2625533 - protein, 4 aa, Entamoeba histolytica
IAEN

SEQ ID NO: 2625534 - protein, 19 aa, Entamoeba histolytica
IAEQNGLKQEVKKANVKKT

SEQ ID NO: 2625535 - protein, 8 aa, Entamoeba histolytica
IAESSITV

SEQ ID NO: 2625536 - protein, 40 aa, Entamoeba histolytica
IAETDTEKIKNQEENLTTKQEDKKDKGLEKQSRLEQTTKK

SEQ ID NO: 2625537 - protein, 9 aa, Entamoeba histolytica
IAETGSGKT

SEQ ID NO: 2625538 - protein, 9 aa, Entamoeba histolytica
IAETSITIP

SEQ ID NO: 2625539 - protein, 4 aa, Entamoeba histolytica
IAGG

SEQ ID NO: 2625540 - protein, 5 aa, Entamoeba histolytica
IAGGA

SEQ ID NO: 2625541 - protein, 15 aa, Entamoeba histolytica
IAGGEEKKLTEEYPS

SEQ ID NO: 2625542 - protein, 17 aa, Entamoeba histolytica
IAGKDGKTKFSIENTTH

SEQ ID NO: 2625543 - protein, 8 aa, Entamoeba histolytica
IAGKPVTV

SEQ ID NO: 2625544 - protein, 20 aa, Entamoeba histolytica
IAGSSGDDMGTGKGSSKAAK

SEQ ID NO: 2625545 - protein, 54 aa, Entamoeba histolytica
IAGTSKQTTKKDDITKKQLKQLKKSEKVVKKTEKKQLKKANKAIQKAEKKGRRM

SEQ ID NO: 2625546 - protein, 4 aa, Entamoeba histolytica
IAHS

SEQ ID NO: 2625547 - protein, 8 aa, Entamoeba histolytica
IAHTQQPK

SEQ ID NO: 2625548 - protein, 10 aa, Entamoeba histolytica
IAKDAGATSF

SEQ ID NO: 2625549 - protein, 12 aa, Entamoeba histolytica
IAKDGTEKAEID

SEQ ID NO: 2625550 - protein, 7 aa, Entamoeba histolytica
IAKDPSQ

SEQ ID NO: 2625551 - protein, 15 aa, Entamoeba histolytica
IAKEDGLSSSKLHGK

SEQ ID NO: 2625552 - protein, 17 aa, Entamoeba histolytica
IAKEREYKQRRTISQTG

SEQ ID NO: 2625553 - protein, 19 aa, Entamoeba histolytica
IAKESDYPYTGSDSTCRSD

SEQ ID NO: 2625554 - protein, 5 aa, Entamoeba histolytica
IAKET

SEQ ID NO: 2625555 - protein, 20 aa, Entamoeba histolytica
IAKEVASKVNDRSGDGTTTA

SEQ ID NO: 2625556 - protein, 11 aa, Entamoeba histolytica
IAKGSGGVENV

SEQ ID NO: 2625557 - protein, 12 aa, Entamoeba histolytica
IAKKPKKPQSFL

SEQ ID NO: 2625558 - protein, 11 aa, Entamoeba histolytica
IAKKPWSKEED

SEQ ID NO: 2625559 - protein, 11 aa, Entamoeba histolytica
IAKNANKEVTP

SEQ ID NO: 2625560 - protein, 7 aa, Entamoeba histolytica
IAKNSGV

SEQ ID NO: 2625561 - protein, 146 aa, Entamoeba histolytica
IAKPEIKEEKEKKEEHKHSKKDKKEKKKDKKEKKKEKDNDKEEEQKEKNTTEVTKMEEDTKEEIAKDEKEQEKNEKEESVNDKKEEQVKKEQVKEEQVKEEQVKKEECHEEEQEELVNDKKKEEIKEEEKTQKKEIKKEEPQEEEV

SEQ ID NO: 2625562 - protein, 10 aa, Entamoeba histolytica
IAKTANRRRT

SEQ ID NO: 2625563 - protein, 6 aa, Entamoeba histolytica
IANEAA

SEQ ID NO: 2625564 - protein, 7 aa, Entamoeba histolytica
IANEERF

SEQ ID NO: 2625565 - protein, 32 aa, Entamoeba histolytica
IANERKPKLDNGKKKKFDSEEDDQNNQHMEEE

SEQ ID NO: 2625566 - protein, 33 aa, Entamoeba histolytica; identical to SEQ ID NO: 2430018

SEQ ID NO: 2625567 - protein, 6 aa, Entamoeba histolytica
IANGEE

SEQ ID NO: 2625568 - protein, 10 aa, Entamoeba histolytica
IANNSNSTVA

SEQ ID NO: 2625569 - protein, 7 aa, Entamoeba histolytica
IANSRPD

SEQ ID NO: 2625570 - protein, 6 aa, Entamoeba histolytica
IANTPR

SEQ ID NO: 2625571 - protein, 14 aa, Entamoeba histolytica
IAPDPNESVGIDTE

SEQ ID NO: 2625572 - protein, 13 aa, Entamoeba histolytica
IAPDQQRKGYGSQ

SEQ ID NO: 2625573 - protein, 8 aa, Entamoeba histolytica
IAPDTGKK

SEQ ID NO: 2625574 - protein, 8 aa, Entamoeba histolytica
IAPDTSKK

SEQ ID NO: 2625575 - protein, 10 aa, Entamoeba histolytica
IAPGNETQYH

SEQ ID NO: 2625576 - protein, 7 aa, Entamoeba histolytica
IAPGSSL

SEQ ID NO: 2625577 - protein, 31 aa, Entamoeba histolytica; identical to SEQ ID NO: 2430030

SEQ ID NO: 2625578 - protein, 8 aa, Entamoeba histolytica
IAPNTPKY

SEQ ID NO: 2625579 - protein, 12 aa, Entamoeba histolytica
IAPPEAPCNGYR

SEQ ID NO: 2625580 - protein, 6 aa, Entamoeba histolytica
IAPRNG

SEQ ID NO: 2625581 - protein, 5 aa, Entamoeba histolytica
IAPSI

SEQ ID NO: 2625582 - protein, 11 aa, Entamoeba histolytica
IAPTHSTYETV

SEQ ID NO: 2625583 - protein, 8 aa, Entamoeba histolytica
IAPTTGTP

SEQ ID NO: 2625584 - protein, 6 aa, Entamoeba histolytica
IAPTTS

SEQ ID NO: 2625585 - protein, 4 aa, Entamoeba histolytica
IAQE

SEQ ID NO: 2625586 - protein, 8 aa, Entamoeba histolytica
IAQKGNYG

SEQ ID NO: 2625587 - protein, 5 aa, Entamoeba histolytica
IAQKT

SEQ ID NO: 2625588 - protein, 7 aa, Entamoeba histolytica
IAQPTPL

SEQ ID NO: 2625589 - protein, 9 aa, Entamoeba histolytica
IAQRTQEEN

SEQ ID NO: 2625590 - protein, 11 aa, Entamoeba histolytica
IAQSKSSQSLY

SEQ ID NO: 2625591 - protein, 13 aa, Entamoeba histolytica
IAQSQSGTGKTAT

SEQ ID NO: 2625592 - protein, 17 aa, Entamoeba histolytica
IAQSRGSNNGDSGVSDR

SEQ ID NO: 2625593 - protein, 12 aa, Entamoeba histolytica
IAQTKRNRRNAG

SEQ ID NO: 2625594 - protein, 11 aa, Entamoeba histolytica
IAQTSSSKMDE

SEQ ID NO: 2625595 - protein, 6 aa, Entamoeba histolytica
IARAWK

SEQ ID NO: 2625596 - protein, 9 aa, Entamoeba histolytica
IAREEESTL

SEQ ID NO: 2625597 - protein, 9 aa, Entamoeba histolytica
IAREEHGSD

SEQ ID NO: 2625598 - protein, 15 aa, Entamoeba histolytica
IARENNLNSFRSDEA

SEQ ID NO: 2625599 - protein, 7 aa, Entamoeba histolytica
IARSKKL

SEQ ID NO: 2625600 - protein, 24 aa, Entamoeba histolytica
IASEKEKHESQIKLNESAKPYYER

SEQ ID NO: 2625601 - protein, 5 aa, Entamoeba histolytica
IASEN

SEQ ID NO: 2625602 - protein, 10 aa, Entamoeba histolytica
IASERKGGSV

SEQ ID NO: 2625603 - protein, 5 aa, Entamoeba histolytica
IASKT

SEQ ID NO: 2625604 - protein, 24 aa, Entamoeba histolytica
IASKTEQPKRSYDEINNETSSQNC

SEQ ID NO: 2625605 - protein, 7 aa, Entamoeba histolytica
IASNGKK

SEQ ID NO: 2625606 - protein, 9 aa, Entamoeba histolytica
IASNNNSVT

SEQ ID NO: 2625607 - protein, 10 aa, Entamoeba histolytica
IASQSEEDLN

SEQ ID NO: 2625608 - protein, 7 aa, Entamoeba histolytica
IASQSNA

SEQ ID NO: 2625609 - protein, 7 aa, Entamoeba histolytica
IASSDVT

SEQ ID NO: 2625610 - protein, 7 aa, Entamoeba histolytica
IASSGGI

SEQ ID NO: 2625611 - protein, 19 aa, Entamoeba histolytica
IASSKQVVGGDKSTLDTSG

SEQ ID NO: 2625612 - protein, 7 aa, Entamoeba histolytica
IASTEEP

SEQ ID NO: 2625613 - protein, 19 aa, Entamoeba histolytica
IASTPEEVKEAYETCRKNG

SEQ ID NO: 2625614 - protein, 13 aa, Entamoeba histolytica
IASTYNSNSKVRG

SEQ ID NO: 2625615 - protein, 10 aa, Entamoeba histolytica
IATASDDKTV

SEQ ID NO: 2625616 - protein, 8 aa, Entamoeba histolytica
IATEDQPI

SEQ ID NO: 2625617 - protein, 8 aa, Entamoeba histolytica
IATGSNDK

SEQ ID NO: 2625618 - protein, 16 aa, Entamoeba histolytica
IATKRHDAQNGADREV

SEQ ID NO: 2625619 - protein, 13 aa, Entamoeba histolytica
IATNKPSEEEKQE

SEQ ID NO: 2625620 - protein, 14 aa, Entamoeba histolytica
IATQEPSLYETNET

SEQ ID NO: 2625621 - protein, 9 aa, Entamoeba histolytica
IATQNGTTP

SEQ ID NO: 2625622 - protein, 13 aa, Entamoeba histolytica
IATRTEDKVKQLQ

SEQ ID NO: 2625623 - protein, 9 aa, Entamoeba histolytica
IATSSAKTI

SEQ ID NO: 2625624 - protein, 21 aa, Entamoeba histolytica
IATTRSTSIQSLNASSKEPSC

SEQ ID NO: 2625625 - protein, 11 aa, Entamoeba histolytica
IATTTKGRVSS

SEQ ID NO: 2625626 - protein, 6 aa, Entamoeba histolytica
IAYSPC

SEQ ID NO: 2625627 - protein, 9 aa, Entamoeba histolytica
ICNKESEEL

SEQ ID NO: 2625628 - protein, 21 aa, Entamoeba histolytica
ICPGNTPSGDTSDNNDDSASS

SEQ ID NO: 2625629 - protein, 13 aa, Entamoeba histolytica
ICSRPEKKRKVER

SEQ ID NO: 2625630 - protein, 6 aa, Entamoeba histolytica
IDAEGV

SEQ ID NO: 2625631 - protein, 12 aa, Entamoeba histolytica
IDARDRKVTKEM

SEQ ID NO: 2625632 - protein, 7 aa, Entamoeba histolytica
IDATSYE

SEQ ID NO: 2625633 - protein, 16 aa, Entamoeba histolytica
IDCEPNKREVSQEQAR

SEQ ID NO: 2625634 - protein, 4 aa, Entamoeba histolytica
IDCS

SEQ ID NO: 2625635 - protein, 11 aa, Entamoeba histolytica
IDDDENQLPIT

SEQ ID NO: 2625636 - protein, 11 aa, Entamoeba histolytica
IDDDTSRKNSS

SEQ ID NO: 2625637 - protein, 4 aa, Entamoeba histolytica
IDDE

SEQ ID NO: 2625638 - protein, 5 aa, Entamoeba histolytica
IDDED

SEQ ID NO: 2625639 - protein, 12 aa, Entamoeba histolytica
IDDEDKKDDLYE

SEQ ID NO: 2625640 - protein, 7 aa, Entamoeba histolytica
IDDETKE

SEQ ID NO: 2625641 - protein, 17 aa, Entamoeba histolytica
IDDETQQTLRPKSPSKL

SEQ ID NO: 2625642 - protein, 5 aa, Entamoeba histolytica
IDDGT

SEQ ID NO: 2625643 - protein, 21 aa, Entamoeba histolytica
IDDKTGTTTMKYPTNKEKWKY

SEQ ID NO: 2625644 - protein, 6 aa, Entamoeba histolytica
IDDKVG

SEQ ID NO: 2625645 - protein, 11 aa, Entamoeba histolytica
IDDNDTEGITE

SEQ ID NO: 2625646 - protein, 7 aa, Entamoeba histolytica
IDDNDTR

SEQ ID NO: 2625647 - protein, 8 aa, Entamoeba histolytica
IDDNGNSY

SEQ ID NO: 2625648 - protein, 9 aa, Entamoeba histolytica
IDDNNEYDD

SEQ ID NO: 2625649 - protein, 4 aa, Entamoeba histolytica
IDDP

SEQ ID NO: 2625650 - protein, 7 aa, Entamoeba histolytica
IDDPEKE

SEQ ID NO: 2625651 - protein, 5 aa, Entamoeba histolytica
IDDPP

SEQ ID NO: 2625652 - protein, 4 aa, Entamoeba histolytica
IDDQ

SEQ ID NO: 2625653 - protein, 5 aa, Entamoeba histolytica
IDDRI

SEQ ID NO: 2625654 - protein, 14 aa, Entamoeba histolytica
IDDRIEKKEEETVN

SEQ ID NO: 2625655 - protein, 16 aa, Entamoeba histolytica
IDDSDDDSKDKDKKKI

SEQ ID NO: 2625656 - protein, 40 aa, Entamoeba histolytica
IDDSDEGEDDDDNEQEEDGDDDTEDEISDDTSSELIGKGK

SEQ ID NO: 2625657 - protein, 6 aa, Entamoeba histolytica
IDDSEL

SEQ ID NO: 2625658 - protein, 8 aa, Entamoeba histolytica
IDDSSKIV

SEQ ID NO: 2625659 - protein, 12 aa, Entamoeba histolytica
IDDTGTDPVPHY

SEQ ID NO: 2625660 - protein, 5 aa, Entamoeba histolytica
IDEDD

SEQ ID NO: 2625661 - protein, 5 aa, Entamoeba histolytica
IDEDE

SEQ ID NO: 2625662 - protein, 24 aa, Entamoeba histolytica
IDEDEDKKIVTKDMDGNSLLQTFV

SEQ ID NO: 2625663 - protein, 9 aa, Entamoeba histolytica
IDEDGDGKI

SEQ ID NO: 2625664 - protein, 9 aa, Entamoeba histolytica
IDEDGKDVG

SEQ ID NO: 2625665 - protein, 12 aa, Entamoeba histolytica
IDEDIEKSSIDG

SEQ ID NO: 2625666 - protein, 10 aa, Entamoeba histolytica
IDEDSDNINN

SEQ ID NO: 2625667 - protein, 12 aa, Entamoeba histolytica
IDEDSDTAEELK

SEQ ID NO: 2625668 - protein, 7 aa, Entamoeba histolytica
IDEDTKI

SEQ ID NO: 2625669 - protein, 5 aa, Entamoeba histolytica
IDEED

SEQ ID NO: 2625670 - protein, 6 aa, Entamoeba histolytica
IDEEGI

SEQ ID NO: 2625671 - protein, 11 aa, Entamoeba histolytica
IDEEGVDTPMS

SEQ ID NO: 2625672 - protein, 5 aa, Entamoeba histolytica
IDEEI

SEQ ID NO: 2625673 - protein, 15 aa, Entamoeba histolytica
IDEEKENKRSSISSP

SEQ ID NO: 2625674 - protein, 20 aa, Entamoeba histolytica
IDEENKKQKEEEHQKSIPGW

SEQ ID NO: 2625675 - protein, 7 aa, Entamoeba histolytica
IDEETDE

SEQ ID NO: 2625676 - protein, 7 aa, Entamoeba histolytica
IDEETKN

SEQ ID NO: 2625677 - protein, 6 aa, Entamoeba histolytica
IDEIEK

SEQ ID NO: 2625678 - protein, 7 aa, Entamoeba histolytica
IDEINDE

SEQ ID NO: 2625679 - protein, 11 aa, Entamoeba histolytica
IDEITSSMNEL

SEQ ID NO: 2625680 - protein, 6 aa, Entamoeba histolytica
IDEKAG

SEQ ID NO: 2625681 - protein, 9 aa, Entamoeba histolytica
IDEKQRGKL

SEQ ID NO: 2625682 - protein, 8 aa, Entamoeba histolytica
IDEKTSNG

SEQ ID NO: 2625683 - protein, 22 aa, Entamoeba histolytica
IDELKKEDKQITKEVEKAEKDV

SEQ ID NO: 2625684 - protein, 16 aa, Entamoeba histolytica
IDELKQKQHKKEIKQN

SEQ ID NO: 2625685 - protein, 4 aa, Entamoeba histolytica
IDEN

SEQ ID NO: 2625686 - protein, 5 aa, Entamoeba histolytica
IDENI

SEQ ID NO: 2625687 - protein, 11 aa, Entamoeba histolytica
IDENKEKRRRE

SEQ ID NO: 2625688 - protein, 8 aa, Entamoeba histolytica
IDENNSPI

SEQ ID NO: 2625689 - protein, 4 aa, Entamoeba histolytica
IDEP

SEQ ID NO: 2625690 - protein, 8 aa, Entamoeba histolytica
IDEPQKEK

SEQ ID NO: 2625691 - protein, 10 aa, Entamoeba histolytica
IDEPQTVKDA

SEQ ID NO: 2625692 - protein, 5 aa, Entamoeba histolytica
IDEQA

SEQ ID NO: 2625693 - protein, 5 aa, Entamoeba histolytica
IDEQG

SEQ ID NO: 2625694 - protein, 6 aa, Entamoeba histolytica
IDEQSG

SEQ ID NO: 2625695 - protein, 9 aa, Entamoeba histolytica
IDERGSNKF

SEQ ID NO: 2625696 - protein, 12 aa, Entamoeba histolytica
IDERSKIDDGSF

SEQ ID NO: 2625697 - protein, 36 aa, Entamoeba histolytica
IDESIEKEENEKEIEKRKNEMKDDDDWGEYDQFKEE

SEQ ID NO: 2625698 - protein, 17 aa, Entamoeba histolytica
IDESMKDPSKTSFERNQ

SEQ ID NO: 2625699 - protein, 7 aa, Entamoeba histolytica
IDESNSH

SEQ ID NO: 2625700 - protein, 8 aa, Entamoeba histolytica
IDESSSKY

SEQ ID NO: 2625701 - protein, 5 aa, Entamoeba histolytica
IDESY

SEQ ID NO: 2625702 - protein, 6 aa, Entamoeba histolytica
IDETSK

SEQ ID NO: 2625703 - protein, 7 aa, Entamoeba histolytica
IDETTQQ

SEQ ID NO: 2625704 - protein, 12 aa, Entamoeba histolytica
IDEVDGDISDSK

SEQ ID NO: 2625705 - protein, 8 aa, Entamoeba histolytica
IDFEPRKD

SEQ ID NO: 2625706 - protein, 6 aa, Entamoeba histolytica
IDGDPV

SEQ ID NO: 2625707 - protein, 9 aa, Entamoeba histolytica
IDGDTTDVE

SEQ ID NO: 2625708 - protein, 11 aa, Entamoeba histolytica
IDGEDVSSDEV

SEQ ID NO: 2625709 - protein, 7 aa, Entamoeba histolytica
IDGENTQ

SEQ ID NO: 2625710 - protein, 18 aa, Entamoeba histolytica
IDGGAGVWDSATASLEYP

SEQ ID NO: 2625711 - protein, 9 aa, Entamoeba histolytica
IDGGTSGFI

SEQ ID NO: 2625712 - protein, 4 aa, Entamoeba histolytica
IDGK

SEQ ID NO: 2625713 - protein, 9 aa, Entamoeba histolytica
IDGKKNNVQ

SEQ ID NO: 2625714 - protein, 19 aa, Entamoeba histolytica
IDGKPGTNVGITKGDVKRI

SEQ ID NO: 2625715 - protein, 9 aa, Entamoeba histolytica
IDGLEGGNV

SEQ ID NO: 2625716 - protein, 8 aa, Entamoeba histolytica
IDGLTTRA

SEQ ID NO: 2625717 - protein, 6 aa, Entamoeba histolytica
IDGNPL

SEQ ID NO: 2625718 - protein, 13 aa, Entamoeba histolytica
IDGNTSTEPNKSC

SEQ ID NO: 2625719 - protein, 4 aa, Entamoeba histolytica
IDGT

SEQ ID NO: 2625720 - protein, 6 aa, Entamoeba histolytica
IDGTCT

SEQ ID NO: 2625721 - protein, 8 aa, Entamoeba histolytica
IDGVNEEE

SEQ ID NO: 2625722 - protein, 4 aa, Entamoeba histolytica
IDHE

SEQ ID NO: 2625723 - protein, 11 aa, Entamoeba histolytica
IDHNTSNEEEV

SEQ ID NO: 2625724 - protein, 6 aa, Entamoeba histolytica
IDHSKK

SEQ ID NO: 2625725 - protein, 15 aa, Entamoeba histolytica
IDHTEYDSDDEDLNC

SEQ ID NO: 2625726 - protein, 4 aa, Entamoeba histolytica
IDIA

SEQ ID NO: 2625727 - protein, 36 aa, Entamoeba histolytica
IDIEQPEKQIDIPKSNSEMSKSVTQKVNPPEPISTS

SEQ ID NO: 2625728 - protein, 23 aa, Entamoeba histolytica
IDKERQDEISKIRNKHKNEEMNI

SEQ ID NO: 2625729 - protein, 8 aa, Entamoeba histolytica
IDKERTEK

SEQ ID NO: 2625730 - protein, 11 aa, Entamoeba histolytica
IDKEYYKNKGN

SEQ ID NO: 2625731 - protein, 13 aa, Entamoeba histolytica
IDKFKNKKAAIDG

SEQ ID NO: 2625732 - protein, 10 aa, Entamoeba histolytica
IDKGMSRNKQ

SEQ ID NO: 2625733 - protein, 10 aa, Entamoeba histolytica
IDKGSVISKE

SEQ ID NO: 2625734 - protein, 8 aa, Entamoeba histolytica
IDKKEKTM

SEQ ID NO: 2625735 - protein, 25 aa, Entamoeba histolytica
IDKKESSTISKTFSAQEQIKASQCR

SEQ ID NO: 2625736 - protein, 9 aa, Entamoeba histolytica
IDKKETNKL

SEQ ID NO: 2625737 - protein, 9 aa, Entamoeba histolytica
IDKKGQDFS

SEQ ID NO: 2625738 - protein, 5 aa, Entamoeba histolytica
IDKND

SEQ ID NO: 2625739 - protein, 9 aa, Entamoeba histolytica
IDKNSKPFY

SEQ ID NO: 2625740 - protein, 8 aa, Entamoeba histolytica
IDKPSKGD

SEQ ID NO: 2625741 - protein, 18 aa, Entamoeba histolytica
IDKQEQYYSSQVTSPELS

SEQ ID NO: 2625742 - protein, 15 aa, Entamoeba histolytica
IDKQNAQNYSKNSIT

SEQ ID NO: 2625743 - protein, 18 aa, Entamoeba histolytica
IDKQSKIISTKEAERFAN

SEQ ID NO: 2625744 - protein, 14 aa, Entamoeba histolytica
IDKSSDDKNLTGVE

SEQ ID NO: 2625745 - protein, 6 aa, Entamoeba histolytica
IDKTAR

SEQ ID NO: 2625746 - protein, 5 aa, Entamoeba histolytica
IDKTD

SEQ ID NO: 2625747 - protein, 9 aa, Entamoeba histolytica
IDKTKDMEN

SEQ ID NO: 2625748 - protein, 13 aa, Entamoeba histolytica
IDKYGRNVEQEDH

SEQ ID NO: 2625749 - protein, 6 aa, Entamoeba histolytica
IDLPEG

SEQ ID NO: 2625750 - protein, 8 aa, Entamoeba histolytica
IDLPPSLK

SEQ ID NO: 2625751 - protein, 5 aa, Entamoeba histolytica
IDLTE

SEQ ID NO: 2625752 - protein, 6 aa, Entamoeba histolytica
IDNDGA

SEQ ID NO: 2625753 - protein, 28 aa, Entamoeba histolytica
IDNDKERAASRVREEVEKYTKRFGDEGL

SEQ ID NO: 2625754 - protein, 20 aa, Entamoeba histolytica
IDNDSERSAKTLSGGERSYS

SEQ ID NO: 2625755 - protein, 4 aa, Entamoeba histolytica
IDNE

SEQ ID NO: 2625756 - protein, 12 aa, Entamoeba histolytica
IDNENKRKEIEQ

SEQ ID NO: 2625757 - protein, 6 aa, Entamoeba histolytica
IDNENP

SEQ ID NO: 2625758 - protein, 10 aa, Entamoeba histolytica
IDNENQIEQE

SEQ ID NO: 2625759 - protein, 7 aa, Entamoeba histolytica
IDNEPEG

SEQ ID NO: 2625760 - protein, 13 aa, Entamoeba histolytica
IDNESDSASTLNQ

SEQ ID NO: 2625761 - protein, 11 aa, Entamoeba histolytica
IDNEVKTGSTV

SEQ ID NO: 2625762 - protein, 8 aa, Entamoeba histolytica
IDNGDQEE

SEQ ID NO: 2625763 - protein, 12 aa, Entamoeba histolytica
IDNGEQNTSIGE

SEQ ID NO: 2625764 - protein, 17 aa, Entamoeba histolytica
IDNGQLNQQSDDDEELK

SEQ ID NO: 2625765 - protein, 8 aa, Entamoeba histolytica
IDNGTVSV

SEQ ID NO: 2625766 - protein, 4 aa, Entamoeba histolytica
IDNI

SEQ ID NO: 2625767 - protein, 26 aa, Entamoeba histolytica
IDNNKMEEEDVNIQQKAAKIAREYET

SEQ ID NO: 2625768 - protein, 10 aa, Entamoeba histolytica
IDNNSSLPQF

SEQ ID NO: 2625769 - protein, 9 aa, Entamoeba histolytica
IDNNTQNRE

SEQ ID NO: 2625770 - protein, 15 aa, Entamoeba histolytica
IDNSLETEKTTNSFT

SEQ ID NO: 2625771 - protein, 8 aa, Entamoeba histolytica
IDNSNDTV

SEQ ID NO: 2625772 - protein, 5 aa, Entamoeba histolytica
IDNSP

SEQ ID NO: 2625773 - protein, 13 aa, Entamoeba histolytica
IDNSPRLNPPSSA

SEQ ID NO: 2625774 - protein, 6 aa, Entamoeba histolytica
IDNTDC

SEQ ID NO: 2625775 - protein, 8 aa, Entamoeba histolytica
IDNTNDPI

SEQ ID NO: 2625776 - protein, 15 aa, Entamoeba histolytica
IDPAPYSFDAIIDSM

SEQ ID NO: 2625777 - protein, 14 aa, Entamoeba histolytica
IDPDYVPPKDDPRR

SEQ ID NO: 2625778 - protein, 7 aa, Entamoeba histolytica
IDPEEMH

SEQ ID NO: 2625779 - protein, 14 aa, Entamoeba histolytica
IDPEKAIKEIPSKR

SEQ ID NO: 2625780 - protein, 8 aa, Entamoeba histolytica
IDPERRKL

SEQ ID NO: 2625781 - protein, 10 aa, Entamoeba histolytica
IDPESDKFET

SEQ ID NO: 2625782 - protein, 9 aa, Entamoeba histolytica
IDPETGVKK

SEQ ID NO: 2625783 - protein, 13 aa, Entamoeba histolytica
IDPGEGNENQRDA

SEQ ID NO: 2625784 - protein, 6 aa, Entamoeba histolytica
IDPHAI

SEQ ID NO: 2625785 - protein, 10 aa, Entamoeba histolytica
IDPKKDTQKI

SEQ ID NO: 2625786 - protein, 5 aa, Entamoeba histolytica
IDPKY

SEQ ID NO: 2625787 - protein, 5 aa, Entamoeba histolytica
IDPND

SEQ ID NO: 2625788 - protein, 8 aa, Entamoeba histolytica
IDPNETVE

SEQ ID NO: 2625789 - protein, 14 aa, Entamoeba histolytica
IDPNNAEATSGITT

SEQ ID NO: 2625790 - protein, 4 aa, Entamoeba histolytica
IDPP

SEQ ID NO: 2625791 - protein, 9 aa, Entamoeba histolytica
IDPPGCTDI

SEQ ID NO: 2625792 - protein, 5 aa, Entamoeba histolytica
IDPPR

SEQ ID NO: 2625793 - protein, 10 aa, Entamoeba histolytica
IDPQKDTQKI

SEQ ID NO: 2625794 - protein, 20 aa, Entamoeba histolytica
IDPRTPYQYTPYSRRYDQDY

SEQ ID NO: 2625795 - protein, 8 aa, Entamoeba histolytica
IDPSNPKA

SEQ ID NO: 2625796 - protein, 9 aa, Entamoeba histolytica
IDPSNPNPY

SEQ ID NO: 2625797 - protein, 5 aa, Entamoeba histolytica
IDPTK

SEQ ID NO: 2625798 - protein, 6 aa, Entamoeba histolytica
IDPTMT

SEQ ID NO: 2625799 - protein, 8 aa, Entamoeba histolytica
IDPTNPEF

SEQ ID NO: 2625800 - protein, 7 aa, Entamoeba histolytica
IDPTNQT

SEQ ID NO: 2625801 - protein, 6 aa, Entamoeba histolytica
IDPTQR

SEQ ID NO: 2625802 - protein, 7 aa, Entamoeba histolytica
IDQANGS

SEQ ID NO: 2625803 - protein, 23 aa, Entamoeba histolytica
IDQEEQKITQQQEKQLKEVEEEK

SEQ ID NO: 2625804 - protein, 7 aa, Entamoeba histolytica
IDQEHKN

SEQ ID NO: 2625805 - protein, 11 aa, Entamoeba histolytica
IDQGYDPKEEI

SEQ ID NO: 2625806 - protein, 6 aa, Entamoeba histolytica
IDQIGE

SEQ ID NO: 2625807 - protein, 4 aa, Entamoeba histolytica
IDQL

SEQ ID NO: 2625808 - protein, 7 aa, Entamoeba histolytica
IDQMSGD

SEQ ID NO: 2625809 - protein, 5 aa, Entamoeba histolytica
IDQNE

SEQ ID NO: 2625810 - protein, 17 aa, Entamoeba histolytica
IDQNGKIITQTDQHSTL

SEQ ID NO: 2625811 - protein, 10 aa, Entamoeba histolytica
IDQPQNKPFV

SEQ ID NO: 2625812 - protein, 9 aa, Entamoeba histolytica
IDQQDDVEE

SEQ ID NO: 2625813 - protein, 32 aa, Entamoeba histolytica
IDQQQATSYAGSNITLPGSTSDGSMAGSWSTQ

SEQ ID NO: 2625814 - protein, 6 aa, Entamoeba histolytica
IDQQSI

SEQ ID NO: 2625815 - protein, 35 aa, Entamoeba histolytica
IDQQTNINTEEFTKEEGNEVQEELTPENDNGLMKE

SEQ ID NO: 2625816 - protein, 12 aa, Entamoeba histolytica
IDQRGDLDSLFH

SEQ ID NO: 2625817 - protein, 10 aa, Entamoeba histolytica
IDQRKTKWIN

SEQ ID NO: 2625818 - protein, 12 aa, Entamoeba histolytica
IDQSQQSKSIYF

SEQ ID NO: 2625819 - protein, 4 aa, Entamoeba histolytica
IDQY

SEQ ID NO: 2625820 - protein, 6 aa, Entamoeba histolytica
IDRDSQ

SEQ ID NO: 2625821 - protein, 7 aa, Entamoeba histolytica
IDRQPNT

SEQ ID NO: 2625822 - protein, 10 aa, Entamoeba histolytica
IDRSNSGDFN

SEQ ID NO: 2625823 - protein, 9 aa, Entamoeba histolytica
IDRTEEEDR

SEQ ID NO: 2625824 - protein, 8 aa, Entamoeba histolytica
IDSDEDEL

SEQ ID NO: 2625825 - protein, 8 aa, Entamoeba histolytica
IDSDGRLA

SEQ ID NO: 2625826 - protein, 9 aa, Entamoeba histolytica
IDSDNEDIN

SEQ ID NO: 2625827 - protein, 17 aa, Entamoeba histolytica
IDSDQKSVKESLSQQYQ

SEQ ID NO: 2625828 - protein, 11 aa, Entamoeba histolytica
IDSDSSVTGNV

SEQ ID NO: 2625829 - protein, 19 aa, Entamoeba histolytica
IDSDTEKKIKENEAKSRAE

SEQ ID NO: 2625830 - protein, 10 aa, Entamoeba histolytica
IDSDVKGKEV

SEQ ID NO: 2625831 - protein, 8 aa, Entamoeba histolytica
IDSDWEKQ

SEQ ID NO: 2625832 - protein, 15 aa, Entamoeba histolytica
IDSDYTEHRSDDFAD

SEQ ID NO: 2625833 - protein, 11 aa, Entamoeba histolytica
IDSEESDEKKD

SEQ ID NO: 2625834 - protein, 8 aa, Entamoeba histolytica
IDSEGNNY

SEQ ID NO: 2625835 - protein, 5 aa, Entamoeba histolytica
IDSEH

SEQ ID NO: 2625836 - protein, 5 aa, Entamoeba histolytica
IDSEN

SEQ ID NO: 2625837 - protein, 14 aa, Entamoeba histolytica
IDSEPSLENNNPFL

SEQ ID NO: 2625838 - protein, 7 aa, Entamoeba histolytica
IDSGDGV

SEQ ID NO: 2625839 - protein, 7 aa, Entamoeba histolytica
IDSGKTS

SEQ ID NO: 2625840 - protein, 5 aa, Entamoeba histolytica
IDSGT

SEQ ID NO: 2625841 - protein, 5 aa, Entamoeba histolytica
IDSIN

SEQ ID NO: 2625842 - protein, 22 aa, Entamoeba histolytica
IDSKPLNLGTLEGKSAKDVGLE

SEQ ID NO: 2625843 - protein, 6 aa, Entamoeba histolytica
IDSLND

SEQ ID NO: 2625844 - protein, 7 aa, Entamoeba histolytica
IDSNEAN

SEQ ID NO: 2625845 - protein, 4 aa, Entamoeba histolytica
IDSQ

SEQ ID NO: 2625846 - protein, 5 aa, Entamoeba histolytica
IDSQH

SEQ ID NO: 2625847 - protein, 6 aa, Entamoeba histolytica
IDSQPL

SEQ ID NO: 2625848 - protein, 6 aa, Entamoeba histolytica
IDSQPT

SEQ ID NO: 2625849 - protein, 7 aa, Entamoeba histolytica
IDSQRNP

SEQ ID NO: 2625850 - protein, 5 aa, Entamoeba histolytica
IDSSE

SEQ ID NO: 2625851 - protein, 8 aa, Entamoeba histolytica
IDSSEREK

SEQ ID NO: 2625852 - protein, 6 aa, Entamoeba histolytica
IDSSFA

SEQ ID NO: 2625853 - protein, 7 aa, Entamoeba histolytica
IDSSNKA

SEQ ID NO: 2625854 - protein, 6 aa, Entamoeba histolytica
IDSSQN

SEQ ID NO: 2625855 - protein, 7 aa, Entamoeba histolytica
IDSSSQE

SEQ ID NO: 2625856 - protein, 10 aa, Entamoeba histolytica
IDSSSQWKSQ

SEQ ID NO: 2625857 - protein, 8 aa, Entamoeba histolytica
IDSTAPSD

SEQ ID NO: 2625858 - protein, 10 aa, Entamoeba histolytica
IDSTDANKIL

SEQ ID NO: 2625859 - protein, 11 aa, Entamoeba histolytica
IDSTKQGNITL

SEQ ID NO: 2625860 - protein, 13 aa, Entamoeba histolytica
IDSTPIVDENEPY

SEQ ID NO: 2625861 - protein, 19 aa, Entamoeba histolytica
IDSTQRDVTDSMSESYAHS

SEQ ID NO: 2625862 - protein, 8 aa, Entamoeba histolytica
IDSTSEYY

SEQ ID NO: 2625863 - protein, 9 aa, Entamoeba histolytica
IDSTTHQKS

SEQ ID NO: 2625864 - protein, 15 aa, Entamoeba histolytica
IDSTTPKRQSNAPVP

SEQ ID NO: 2625865 - protein, 8 aa, Entamoeba histolytica
IDTARKEK

SEQ ID NO: 2625866 - protein, 6 aa, Entamoeba histolytica
IDTDKK

SEQ ID NO: 2625867 - protein, 10 aa, Entamoeba histolytica
IDTDNREKAM

SEQ ID NO: 2625868 - protein, 6 aa, Entamoeba histolytica
IDTESP

SEQ ID NO: 2625869 - protein, 18 aa, Entamoeba histolytica
IDTGDKDTEKSNNQEENL

SEQ ID NO: 2625870 - protein, 7 aa, Entamoeba histolytica
IDTKQAT

SEQ ID NO: 2625871 - protein, 12 aa, Entamoeba histolytica
IDTKSYSPIGTN

SEQ ID NO: 2625872 - protein, 7 aa, Entamoeba histolytica
IDTLSQG

SEQ ID NO: 2625873 - protein, 6 aa, Entamoeba histolytica
IDTNKI

SEQ ID NO: 2625874 - protein, 7 aa, Entamoeba histolytica
IDTNNGA

SEQ ID NO: 2625875 - protein, 6 aa, Entamoeba histolytica
IDTNQK

SEQ ID NO: 2625876 - protein, 6 aa, Entamoeba histolytica
IDTNSK

SEQ ID NO: 2625877 - protein, 6 aa, Entamoeba histolytica
IDTNSN

SEQ ID NO: 2625878 - protein, 12 aa, Entamoeba histolytica
IDTQKKEETELI

SEQ ID NO: 2625879 - protein, 7 aa, Entamoeba histolytica
IDTQPSQ

SEQ ID NO: 2625880 - protein, 11 aa, Entamoeba histolytica
IDTSDVRVETQ

SEQ ID NO: 2625881 - protein, 6 aa, Entamoeba histolytica
IDTSGE

SEQ ID NO: 2625882 - protein, 14 aa, Entamoeba histolytica
IDTSNTNHSTTATL

SEQ ID NO: 2625883 - protein, 6 aa, Entamoeba histolytica
IDTSSQ

SEQ ID NO: 2625884 - protein, 10 aa, Entamoeba histolytica
IDTTGAGDAF

SEQ ID NO: 2625885 - protein, 16 aa, Entamoeba histolytica
IDTTNNRYGYCDDSGN

SEQ ID NO: 2625886 - protein, 6 aa, Entamoeba histolytica
IDTTSH

SEQ ID NO: 2625887 - protein, 10 aa, Entamoeba histolytica
IDTTTTGYLS

SEQ ID NO: 2625888 - protein, 5 aa, Entamoeba histolytica
IDTYS

SEQ ID NO: 2625889 - protein, 6 aa, Entamoeba histolytica
IDVDEN

SEQ ID NO: 2625890 - protein, 9 aa, Entamoeba histolytica
IDVNGDNIE

SEQ ID NO: 2625891 - protein, 5 aa, Entamoeba histolytica
IDVSK

SEQ ID NO: 2625892 - protein, 7 aa, Entamoeba histolytica
IDYPPTK

SEQ ID NO: 2625893 - protein, 5 aa, Entamoeba histolytica
IEACG

SEQ ID NO: 2625894 - protein, 14 aa, Entamoeba histolytica
IEAENSNTAIDEER

SEQ ID NO: 2625895 - protein, 14 aa, Entamoeba histolytica
IEAKYDSNLKEENE

SEQ ID NO: 2625896 - protein, 6 aa, Entamoeba histolytica
IEANNE

SEQ ID NO: 2625897 - protein, 26 aa, Entamoeba histolytica
IEAQKKAKEAEKLAKEKAKQKKTLKS

SEQ ID NO: 2625898 - protein, 5 aa, Entamoeba histolytica
IEARG

SEQ ID NO: 2625899 - protein, 10 aa, Entamoeba histolytica
IEASKAEPRA

SEQ ID NO: 2625900 - protein, 5 aa, Entamoeba histolytica
IEASV

SEQ ID NO: 2625901 - protein, 6 aa, Entamoeba histolytica
IEAYEN

SEQ ID NO: 2625902 - protein, 5 aa, Entamoeba histolytica
IEDDA

SEQ ID NO: 2625903 - protein, 6 aa, Entamoeba histolytica
IEDDSI

SEQ ID NO: 2625904 - protein, 11 aa, Entamoeba histolytica
IEDEINTKNDI

SEQ ID NO: 2625905 - protein, 11 aa, Entamoeba histolytica
IEDERKNHAET

SEQ ID NO: 2625906 - protein, 10 aa, Entamoeba histolytica
IEDGKETDIG

SEQ ID NO: 2625907 - protein, 7 aa, Entamoeba histolytica
IEDGNNG

SEQ ID NO: 2625908 - protein, 4 aa, Entamoeba histolytica
IEDH

SEQ ID NO: 2625909 - protein, 5 aa, Entamoeba histolytica
IEDHR

SEQ ID NO: 2625910 - protein, 16 aa, Entamoeba histolytica
IEDIEQKEIKEKEEEM

SEQ ID NO: 2625911 - protein, 5 aa, Entamoeba histolytica
IEDKD

SEQ ID NO: 2625912 - protein, 11 aa, Entamoeba histolytica
IEDKETAKKEL

SEQ ID NO: 2625913 - protein, 7 aa, Entamoeba histolytica
IEDKKEV

SEQ ID NO: 2625914 - protein, 23 aa, Entamoeba histolytica
IEDLNREKEPQKKKKQSQQKKNQ

SEQ ID NO: 2625915 - protein, 26 aa, Entamoeba histolytica
IEDNGEEKAKEDEGKEKKKKTRKEKK

SEQ ID NO: 2625916 - protein, 10 aa, Entamoeba histolytica
IEDPEDNVKV

SEQ ID NO: 2625917 - protein, 46 aa, Entamoeba histolytica
IEDPKTTERYLEEERKRKELEKELEKEKEEKEEKAKKGKELGWTGQ

SEQ ID NO: 2625918 - protein, 18 aa, Entamoeba histolytica
IEDQRSNKRRGKEENKKW

SEQ ID NO: 2625919 - protein, 6 aa, Entamoeba histolytica
IEDQYK

SEQ ID NO: 2625920 - protein, 5 aa, Entamoeba histolytica
IEDRL

SEQ ID NO: 2625921 - protein, 6 aa, Entamoeba histolytica
IEDRTD

SEQ ID NO: 2625922 - protein, 4 aa, Entamoeba histolytica
IEDS

SEQ ID NO: 2625923 - protein, 7 aa, Entamoeba histolytica
IEDSSSV

SEQ ID NO: 2625924 - protein, 5 aa, Entamoeba histolytica
IEDTY

SEQ ID NO: 2625925 - protein, 12 aa, Entamoeba histolytica
IEDVGEDEEMTS

SEQ ID NO: 2625926 - protein, 6 aa, Entamoeba histolytica
IEEATD

SEQ ID NO: 2625927 - protein, 6 aa, Entamoeba histolytica
IEECND

SEQ ID NO: 2625928 - protein, 7 aa, Entamoeba histolytica
IEEDDMN

SEQ ID NO: 2625929 - protein, 12 aa, Entamoeba histolytica
IEEDEKENKESS

SEQ ID NO: 2625930 - protein, 19 aa, Entamoeba histolytica
IEEDNEKEKNGDSEKEDLS

SEQ ID NO: 2625931 - protein, 7 aa, Entamoeba histolytica
IEEDQDK

SEQ ID NO: 2625932 - protein, 9 aa, Entamoeba histolytica
IEEDQQAIE

SEQ ID NO: 2625933 - protein, 21 aa, Entamoeba histolytica
IEEDSEDEEIHRGPTPSAYKG

SEQ ID NO: 2625934 - protein, 11 aa, Entamoeba histolytica
IEEDSKEQLSS

SEQ ID NO: 2625935 - protein, 8 aa, Entamoeba histolytica
IEEEAEVD

SEQ ID NO: 2625936 - protein, 19 aa, Entamoeba histolytica
IEEEDRENDRFQDKEKEVV

SEQ ID NO: 2625937 - protein, 11 aa, Entamoeba histolytica
IEEEECSVDTK

SEQ ID NO: 2625938 - protein, 10 aa, Entamoeba histolytica
IEEEEDSDYD

SEQ ID NO: 2625939 - protein, 20 aa, Entamoeba histolytica
IEEEEKKFYKEKEEFKRKTE

SEQ ID NO: 2625940 - protein, 10 aa, Entamoeba histolytica
IEEEEPPPIR

SEQ ID NO: 2625941 - protein, 19 aa, Entamoeba histolytica
IEEEESSEEEEESSEEEEE

SEQ ID NO: 2625942 - protein, 7 aa, Entamoeba histolytica
IEEEEVK

SEQ ID NO: 2625943 - protein, 5 aa, Entamoeba histolytica
IEEEH

SEQ ID NO: 2625944 - protein, 7 aa, Entamoeba histolytica
IEEEIEQ

SEQ ID NO: 2625945 - protein, 6 aa, Entamoeba histolytica
IEEEIN

SEQ ID NO: 2625946 - protein, 13 aa, Entamoeba histolytica
IEEEKNSSTEKME

SEQ ID NO: 2625947 - protein, 18 aa, Entamoeba histolytica
IEEEKRKEEQRTKFQSNN

SEQ ID NO: 2625948 - protein, 11 aa, Entamoeba histolytica
IEEEKSKGITI

SEQ ID NO: 2625949 - protein, 5 aa, Entamoeba histolytica
IEEEN

SEQ ID NO: 2625950 - protein, 7 aa, Entamoeba histolytica
IEEENDG

SEQ ID NO: 2625951 - protein, 35 aa, Entamoeba histolytica
IEEENERVKEEEKQTNKKKKADSSRDTEIKESKNM

SEQ ID NO: 2625952 - protein, 11 aa, Entamoeba histolytica
IEEESEEDKKT

SEQ ID NO: 2625953 - protein, 8 aa, Entamoeba histolytica
IEEESEPL

SEQ ID NO: 2625954 - protein, 7 aa, Entamoeba histolytica
IEEETGL

SEQ ID NO: 2625955 - protein, 8 aa, Entamoeba histolytica
IEEETPNI

SEQ ID NO: 2625956 - protein, 6 aa, Entamoeba histolytica
IEEEVN

SEQ ID NO: 2625957 - protein, 16 aa, Entamoeba histolytica
IEEGAKTQSAVNQKEL

SEQ ID NO: 2625958 - protein, 5 aa, Entamoeba histolytica
IEEGE

SEQ ID NO: 2625959 - protein, 18 aa, Entamoeba histolytica
IEEGEEEIGITEKEKERI

SEQ ID NO: 2625960 - protein, 13 aa, Entamoeba histolytica
IEEGGKSKIQEKL

SEQ ID NO: 2625961 - protein, 22 aa, Entamoeba histolytica
IEEGIESKESVDQKESDKDNIQ

SEQ ID NO: 2625962 - protein, 11 aa, Entamoeba histolytica
IEEGKKKKECR

SEQ ID NO: 2625963 - protein, 10 aa, Entamoeba histolytica
IEEGLKDEEY

SEQ ID NO: 2625964 - protein, 17 aa, Entamoeba histolytica
IEEGNNEKGNSKLKGEL

SEQ ID NO: 2625965 - protein, 11 aa, Entamoeba histolytica
IEEGNNNKRQE

SEQ ID NO: 2625966 - protein, 8 aa, Entamoeba histolytica
IEEGTRRI

SEQ ID NO: 2625967 - protein, 15 aa, Entamoeba histolytica
IEEHHQKELSSSQNV

SEQ ID NO: 2625968 - protein, 7 aa, Entamoeba histolytica
IEEHNKQ

SEQ ID NO: 2625969 - protein, 6 aa, Entamoeba histolytica
IEEIGT

SEQ ID NO: 2625970 - protein, 5 aa, Entamoeba histolytica
IEEIK

SEQ ID NO: 2625971 - protein, 5 aa, Entamoeba histolytica
IEEIN

SEQ ID NO: 2625972 - protein, 4 aa, Entamoeba histolytica
IEEK

SEQ ID NO: 2625973 - protein, 10 aa, Entamoeba histolytica
IEEKAAPVEM

SEQ ID NO: 2625974 - protein, 7 aa, Entamoeba histolytica
IEEKAEG

SEQ ID NO: 2625975 - protein, 16 aa, Entamoeba histolytica
IEEKDKKKRGKVNKKN

SEQ ID NO: 2625976 - protein, 5 aa, Entamoeba histolytica
IEEKE

SEQ ID NO: 2625977 - protein, 17 aa, Entamoeba histolytica
IEEKETEEEKKDNGIIE

SEQ ID NO: 2625978 - protein, 7 aa, Entamoeba histolytica
IEEKGEE

SEQ ID NO: 2625979 - protein, 14 aa, Entamoeba histolytica
IEEKKEKGKIIKET

SEQ ID NO: 2625980 - protein, 6 aa, Entamoeba histolytica
IEEKMR

SEQ ID NO: 2625981 - protein, 19 aa, Entamoeba histolytica
IEEKNERRRELENQNENIT

SEQ ID NO: 2625982 - protein, 8 aa, Entamoeba histolytica
IEEKNQEF

SEQ ID NO: 2625983 - protein, 8 aa, Entamoeba histolytica
IEEKRKTS

SEQ ID NO: 2625984 - protein, 10 aa, Entamoeba histolytica
IEEKTKKGLT

SEQ ID NO: 2625985 - protein, 9 aa, Entamoeba histolytica
IEELKEEQG

SEQ ID NO: 2625986 - protein, 4 aa, Entamoeba histolytica
IEEM

SEQ ID NO: 2625987 - protein, 14 aa, Entamoeba histolytica
IEEMKTEVNQSASQ

SEQ ID NO: 2625988 - protein, 22 aa, Entamoeba histolytica
IEENARGALEKQKEKNKRELEE

SEQ ID NO: 2625989 - protein, 6 aa, Entamoeba histolytica
IEENEK

SEQ ID NO: 2625990 - protein, 16 aa, Entamoeba histolytica
IEENKEQETEEEENEL

SEQ ID NO: 2625991 - protein, 36 aa, Entamoeba histolytica
IEENNFDEEVQKDDTIKQHKVNEEDMKRRKSDGANI

SEQ ID NO: 2625992 - protein, 11 aa, Entamoeba histolytica
IEENNKNTKDA

SEQ ID NO: 2625993 - protein, 5 aa, Entamoeba histolytica
IEENS

SEQ ID NO: 2625994 - protein, 15 aa, Entamoeba histolytica
IEEPQPKEIKEVNNK

SEQ ID NO: 2625995 - protein, 19 aa, Entamoeba histolytica
IEEPQSTVQRKDDFHEETE

SEQ ID NO: 2625996 - protein, 12 aa, Entamoeba histolytica
IEEQEKRQQEIN

SEQ ID NO: 2625997 - protein, 11 aa, Entamoeba histolytica
IEEQEKSIPDL

SEQ ID NO: 2625998 - protein, 5 aa, Entamoeba histolytica
IEEQN

SEQ ID NO: 2625999 - protein, 6 aa, Entamoeba histolytica
IEEQPK

SEQ ID NO: 2626000 - protein, 7 aa, Entamoeba histolytica
IEEQSIA

SEQ ID NO: 2626001 - protein, 5 aa, Entamoeba histolytica
IEEQT

SEQ ID NO: 2626002 - protein, 4 aa, Entamoeba histolytica
IEER

SEQ ID NO: 2626003 - protein, 24 aa, Entamoeba histolytica
IEERNEKMEDCDENELERKSEAER

SEQ ID NO: 2626004 - protein, 4 aa, Entamoeba histolytica
IEES

SEQ ID NO: 2626005 - protein, 9 aa, Entamoeba histolytica
IEESAVDRK

SEQ ID NO: 2626006 - protein, 5 aa, Entamoeba histolytica
IEESI

SEQ ID NO: 2626007 - protein, 8 aa, Entamoeba histolytica
IEESIRRE

SEQ ID NO: 2626008 - protein, 8 aa, Entamoeba histolytica
IEESKPSE

SEQ ID NO: 2626009 - protein, 10 aa, Entamoeba histolytica
IEESNQSEYH

SEQ ID NO: 2626010 - protein, 6 aa, Entamoeba histolytica
IEESQR

SEQ ID NO: 2626011 - protein, 7 aa, Entamoeba histolytica
IEETDNK

SEQ ID NO: 2626012 - protein, 12 aa, Entamoeba histolytica
IEETKRNEEAEE

SEQ ID NO: 2626013 - protein, 5 aa, Entamoeba histolytica
IEEVE

SEQ ID NO: 2626014 - protein, 27 aa, Entamoeba histolytica
IEEWKEKSSETEELKKELAKKEEEIKE

SEQ ID NO: 2626015 - protein, 7 aa, Entamoeba histolytica
IEEYPEQ

SEQ ID NO: 2626016 - protein, 7 aa, Entamoeba histolytica
IEGADKG

SEQ ID NO: 2626017 - protein, 5 aa, Entamoeba histolytica
IEGAE

SEQ ID NO: 2626018 - protein, 11 aa, Entamoeba histolytica
IEGDAEEAQRI

SEQ ID NO: 2626019 - protein, 9 aa, Entamoeba histolytica
IEGDGDHNS

SEQ ID NO: 2626020 - protein, 12 aa, Entamoeba histolytica
IEGDKAVKEYTK

SEQ ID NO: 2626021 - protein, 7 aa, Entamoeba histolytica
IEGDQQK

SEQ ID NO: 2626022 - protein, 8 aa, Entamoeba histolytica
IEGDVKSN

SEQ ID NO: 2626023 - protein, 9 aa, Entamoeba histolytica
IEGEGEKYH

SEQ ID NO: 2626024 - protein, 5 aa, Entamoeba histolytica
IEGEK

SEQ ID NO: 2626025 - protein, 6 aa, Entamoeba histolytica
IEGENL

SEQ ID NO: 2626026 - protein, 11 aa, Entamoeba histolytica
IEGESPAGEIQ

SEQ ID NO: 2626027 - protein, 7 aa, Entamoeba histolytica
IEGESTE

SEQ ID NO: 2626028 - protein, 24 aa, Entamoeba histolytica
IEGETEISTQLDPDEIKEEKKIGE

SEQ ID NO: 2626029 - protein, 26 aa, Entamoeba histolytica
IEGETEISTRLDPDEIKEEKKIGEGP

SEQ ID NO: 2626030 - protein, 26 aa, Entamoeba histolytica
IEGETEISTRLDPDEIKEEKKIGEGT

SEQ ID NO: 2626031 - protein, 7 aa, Entamoeba histolytica
IEGGDKV

SEQ ID NO: 2626032 - protein, 26 aa, Entamoeba histolytica
IEGGTEISTRLDPDEIKEEKKIGEGT

SEQ ID NO: 2626033 - protein, 5 aa, Entamoeba histolytica
IEGIG

SEQ ID NO: 2626034 - protein, 10 aa, Entamoeba histolytica
IEGKQPKFLS

SEQ ID NO: 2626035 - protein, 9 aa, Entamoeba histolytica
IEGKTKGVP

SEQ ID NO: 2626036 - protein, 12 aa, Entamoeba histolytica
IEGNKNATKETV

SEQ ID NO: 2626037 - protein, 8 aa, Entamoeba histolytica
IEGQNGTV

SEQ ID NO: 2626038 - protein, 5 aa, Entamoeba histolytica
IEGRK

SEQ ID NO: 2626039 - protein, 11 aa, Entamoeba histolytica
IEGSESTSQVS

SEQ ID NO: 2626040 - protein, 6 aa, Entamoeba histolytica
IEGTNI

SEQ ID NO: 2626041 - protein, 9 aa, Entamoeba histolytica
IEGTSDAEW

SEQ ID NO: 2626042 - protein, 4 aa, Entamoeba histolytica
IEGY

SEQ ID NO: 2626043 - protein, 13 aa, Entamoeba histolytica
IEHPAKQETIDTG

SEQ ID NO: 2626044 - protein, 17 aa, Entamoeba histolytica
IEHPNDRKFKNPDFKGF

SEQ ID NO: 2626045 - protein, 10 aa, Entamoeba histolytica
IEHSSQVDSD

SEQ ID NO: 2626046 - protein, 4 aa, Entamoeba histolytica
IEIE

SEQ ID NO: 2626047 - protein, 9 aa, Entamoeba histolytica
IEIKGETSI

SEQ ID NO: 2626048 - protein, 12 aa, Entamoeba histolytica
IEIPDSKEKGYG

SEQ ID NO: 2626049 - protein, 20 aa, Entamoeba histolytica
IEIPQNEALNEKEEDQNNEI

SEQ ID NO: 2626050 - protein, 5 aa, Entamoeba histolytica
IEIQE

SEQ ID NO: 2626051 - protein, 10 aa, Entamoeba histolytica
IEKAQGISEN

SEQ ID NO: 2626052 - protein, 8 aa, Entamoeba histolytica
IEKDDPNN

SEQ ID NO: 2626053 - protein, 7 aa, Entamoeba histolytica
IEKDKKD

SEQ ID NO: 2626054 - protein, 13 aa, Entamoeba histolytica
IEKDSEGKEVEKQ

SEQ ID NO: 2626055 - protein, 10 aa, Entamoeba histolytica
IEKDSKNINV

SEQ ID NO: 2626056 - protein, 8 aa, Entamoeba histolytica
IEKDTGQK

SEQ ID NO: 2626057 - protein, 48 aa, Entamoeba histolytica
IEKEADKKKKKGGKKNLAKPATTGKKYTERVEDQLEDDYYDDEDDYDF

SEQ ID NO: 2626058 - protein, 12 aa, Entamoeba histolytica
IEKEIQNNGTRE

SEQ ID NO: 2626059 - protein, 23 aa, Entamoeba histolytica
IEKEKIKQQQFEARAKTAAMEKA

SEQ ID NO: 2626060 - protein, 6 aa, Entamoeba histolytica
IEKEKK

SEQ ID NO: 2626061 - protein, 11 aa, Entamoeba histolytica
IEKENNKLGKE

SEQ ID NO: 2626062 - protein, 9 aa, Entamoeba histolytica
IEKERTEKL

SEQ ID NO: 2626063 - protein, 9 aa, Entamoeba histolytica
IEKESEKEI

SEQ ID NO: 2626064 - protein, 10 aa, Entamoeba histolytica
IEKETRITGR

SEQ ID NO: 2626065 - protein, 8 aa, Entamoeba histolytica
IEKGDEKQ

SEQ ID NO: 2626066 - protein, 7 aa, Entamoeba histolytica
IEKGNTG

SEQ ID NO: 2626067 - protein, 10 aa, Entamoeba histolytica
IEKGTSELEK

SEQ ID NO: 2626068 - protein, 8 aa, Entamoeba histolytica
IEKIGKGG

SEQ ID NO: 2626069 - protein, 4 aa, Entamoeba histolytica
IEKK

SEQ ID NO: 2626070 - protein, 22 aa, Entamoeba histolytica
IEKKEKQRQLEEEKKRKEEELK

SEQ ID NO: 2626071 - protein, 33 aa, Entamoeba histolytica
IEKKENLNCKAKQQVKDNTPSLSKEDNKETKEL

SEQ ID NO: 2626072 - protein, 15 aa, Entamoeba histolytica
IEKKKNYSPFPPERD

SEQ ID NO: 2626073 - protein, 20 aa, Entamoeba histolytica
IEKKTESPTTNSSSNNSLNT

SEQ ID NO: 2626074 - protein, 13 aa, Entamoeba histolytica
IEKLPESLKNYPN

SEQ ID NO: 2626075 - protein, 11 aa, Entamoeba histolytica
IEKNEEMSQEF

SEQ ID NO: 2626076 - protein, 10 aa, Entamoeba histolytica
IEKNEKTGKN

SEQ ID NO: 2626077 - protein, 8 aa, Entamoeba histolytica
IEKNENHQ

SEQ ID NO: 2626078 - protein, 7 aa, Entamoeba histolytica
IEKNETS

SEQ ID NO: 2626079 - protein, 8 aa, Entamoeba histolytica
IEKNPEKG

SEQ ID NO: 2626080 - protein, 14 aa, Entamoeba histolytica
IEKPKKEPPPEEDD

SEQ ID NO: 2626081 - protein, 5 aa, Entamoeba histolytica
IEKPS

SEQ ID NO: 2626082 - protein, 9 aa, Entamoeba histolytica
IEKQNNEYF

SEQ ID NO: 2626083 - protein, 10 aa, Entamoeba histolytica
IEKRKKEGKK

SEQ ID NO: 2626084 - protein, 4 aa, Entamoeba histolytica
IEKS

SEQ ID NO: 2626085 - protein, 6 aa, Entamoeba histolytica
IEKSKR

SEQ ID NO: 2626086 - protein, 11 aa, Entamoeba histolytica
IEKSKTLTKEA

SEQ ID NO: 2626087 - protein, 8 aa, Entamoeba histolytica
IEKSPITK

SEQ ID NO: 2626088 - protein, 25 aa, Entamoeba histolytica
IEKSQKEEELNKIKEEKQQVEDEKA

SEQ ID NO: 2626089 - protein, 6 aa, Entamoeba histolytica
IEKTED

SEQ ID NO: 2626090 - protein, 23 aa, Entamoeba histolytica
IEKTNTSLNSNTSETPITSKPLQ

SEQ ID NO: 2626091 - protein, 29 aa, Entamoeba histolytica
IEKTQNDSERKIENHTEADELTKQTPNLL

SEQ ID NO: 2626092 - protein, 9 aa, Entamoeba histolytica
IEKWGTDQA

SEQ ID NO: 2626093 - protein, 5 aa, Entamoeba histolytica
IEKYS

SEQ ID NO: 2626094 - protein, 12 aa, Entamoeba histolytica
IELKPKKLDSNN

SEQ ID NO: 2626095 - protein, 15 aa, Entamoeba histolytica
IELKRSQEHQSSGVS

SEQ ID NO: 2626096 - protein, 7 aa, Entamoeba histolytica
IELPENG

SEQ ID NO: 2626097 - protein, 7 aa, Entamoeba histolytica
IELSSSN

SEQ ID NO: 2626098 - protein, 6 aa, Entamoeba histolytica
IELSTE

SEQ ID NO: 2626099 - protein, 7 aa, Entamoeba histolytica
IELTSSS

SEQ ID NO: 2626100 - protein, 15 aa, Entamoeba histolytica
IEMDSESSGGDNLSE

SEQ ID NO: 2626101 - protein, 23 aa, Entamoeba histolytica
IEMTEKQEEADKNNTNKAEEKKN

SEQ ID NO: 2626102 - protein, 7 aa, Entamoeba histolytica
IENDSVK

SEQ ID NO: 2626103 - protein, 6 aa, Entamoeba histolytica
IENEDK

SEQ ID NO: 2626104 - protein, 5 aa, Entamoeba histolytica
IENEE

SEQ ID NO: 2626105 - protein, 7 aa, Entamoeba histolytica
IENEEEQ

SEQ ID NO: 2626106 - protein, 10 aa, Entamoeba histolytica
IENEGKDKIS

SEQ ID NO: 2626107 - protein, 14 aa, Entamoeba histolytica
IENESLEKEKKEEF

SEQ ID NO: 2626108 - protein, 9 aa, Entamoeba histolytica
IENETQVSV

SEQ ID NO: 2626109 - protein, 18 aa, Entamoeba histolytica
IENGNSIASINNQGGFDI

SEQ ID NO: 2626110 - protein, 10 aa, Entamoeba histolytica
IENGRKPTTL

SEQ ID NO: 2626111 - protein, 14 aa, Entamoeba histolytica
IENIDSGKYKHDKR

SEQ ID NO: 2626112 - protein, 4 aa, Entamoeba histolytica
IENK

SEQ ID NO: 2626113 - protein, 36 aa, Entamoeba histolytica
IENKEKEVNKRCQEKESRQKNYNERNEKRNKEIKTI

SEQ ID NO: 2626114 - protein, 11 aa, Entamoeba histolytica
IENKGGEKWEE

SEQ ID NO: 2626115 - protein, 6 aa, Entamoeba histolytica
IENKNK

SEQ ID NO: 2626116 - protein, 10 aa, Entamoeba histolytica
IENKQTVSGP

SEQ ID NO: 2626117 - protein, 12 aa, Entamoeba histolytica
IENNDDPNNPYI

SEQ ID NO: 2626118 - protein, 11 aa, Entamoeba histolytica
IENNEKNVKIR

SEQ ID NO: 2626119 - protein, 6 aa, Entamoeba histolytica
IENNGG

SEQ ID NO: 2626120 - protein, 11 aa, Entamoeba histolytica
IENNKQNEDIN

SEQ ID NO: 2626121 - protein, 20 aa, Entamoeba histolytica
IENNNQSKNDIETTEQHTTE

SEQ ID NO: 2626122 - protein, 6 aa, Entamoeba histolytica
IENNST

SEQ ID NO: 2626123 - protein, 6 aa, Entamoeba histolytica
IENPSK

SEQ ID NO: 2626124 - protein, 19 aa, Entamoeba histolytica
IENSETSDISDSIKSQTFK

SEQ ID NO: 2626125 - protein, 20 aa, Entamoeba histolytica
IENSNTDLSIDTSTISSSDS

SEQ ID NO: 2626126 - protein, 5 aa, Entamoeba histolytica
IENTF

SEQ ID NO: 2626127 - protein, 32 aa, Entamoeba histolytica
IENTKDNNVTEKSKKTEATKPKKTLPENSQQV

SEQ ID NO: 2626128 - protein, 9 aa, Entamoeba histolytica
IENTSPTKT

SEQ ID NO: 2626129 - protein, 7 aa, Entamoeba histolytica
IENVNDE

SEQ ID NO: 2626130 - protein, 20 aa, Entamoeba histolytica
IENYQSDNPLGMSKENYRQF

SEQ ID NO: 2626131 - protein, 5 aa, Entamoeba histolytica
IEPDE

SEQ ID NO: 2626132 - protein, 4 aa, Entamoeba histolytica
IEPE

SEQ ID NO: 2626133 - protein, 9 aa, Entamoeba histolytica
IEPEKKDDD

SEQ ID NO: 2626134 - protein, 7 aa, Entamoeba histolytica
IEPESGE

SEQ ID NO: 2626135 - protein, 10 aa, Entamoeba histolytica
IEPETTTVGE

SEQ ID NO: 2626136 - protein, 8 aa, Entamoeba histolytica
IEPHPITK

SEQ ID NO: 2626137 - protein, 5 aa, Entamoeba histolytica
IEPKE

SEQ ID NO: 2626138 - protein, 5 aa, Entamoeba histolytica
IEPKG

SEQ ID NO: 2626139 - protein, 25 aa, Entamoeba histolytica
IEPKISKTKQNSHHHHKQRKESAPF

SEQ ID NO: 2626140 - protein, 12 aa, Entamoeba histolytica
IEPKTTENGGKL

SEQ ID NO: 2626141 - protein, 11 aa, Entamoeba histolytica
IEPNDAKLPTE

SEQ ID NO: 2626142 - protein, 11 aa, Entamoeba histolytica
IEPNEDSQRTE

SEQ ID NO: 2626143 - protein, 5 aa, Entamoeba histolytica
IEPNK

SEQ ID NO: 2626144 - protein, 8 aa, Entamoeba histolytica
IEPNPAHE

SEQ ID NO: 2626145 - protein, 8 aa, Entamoeba histolytica
IEPNPSHE

SEQ ID NO: 2626146 - protein, 6 aa, Entamoeba histolytica
IEPNQE

SEQ ID NO: 2626147 - protein, 10 aa, Entamoeba histolytica
IEPNSEKHTI

SEQ ID NO: 2626148 - protein, 22 aa, Entamoeba histolytica
IEPNSFNEKEYKKSKSALPYTS

SEQ ID NO: 2626149 - protein, 21 aa, Entamoeba histolytica
IEPPPKEEAVRDKSKYDGLDP

SEQ ID NO: 2626150 - protein, 21 aa, Entamoeba histolytica
IEPPPKEESVQDKSKYDGLDP

SEQ ID NO: 2626151 - protein, 12 aa, Entamoeba histolytica
IEPPPQEPQESV

SEQ ID NO: 2626152 - protein, 5 aa, Entamoeba histolytica
IEPPR

SEQ ID NO: 2626153 - protein, 4 aa, Entamoeba histolytica
IEPQ

SEQ ID NO: 2626154 - protein, 5 aa, Entamoeba histolytica
IEPQD

SEQ ID NO: 2626155 - protein, 6 aa, Entamoeba histolytica
IEPQSN

SEQ ID NO: 2626156 - protein, 7 aa, Entamoeba histolytica
IEPRTSS

SEQ ID NO: 2626157 - protein, 25 aa, Entamoeba histolytica
IEPSPIKASTSKFLKSETKKKEVPD

SEQ ID NO: 2626158 - protein, 6 aa, Entamoeba histolytica
IEPSTT

SEQ ID NO: 2626159 - protein, 4 aa, Entamoeba histolytica
IEPT

SEQ ID NO: 2626160 - protein, 10 aa, Entamoeba histolytica
IEPTAQKANS

SEQ ID NO: 2626161 - protein, 9 aa, Entamoeba histolytica
IEPTTKAIT

SEQ ID NO: 2626162 - protein, 10 aa, Entamoeba histolytica
IEQADEDIKT

SEQ ID NO: 2626163 - protein, 10 aa, Entamoeba histolytica
IEQAENDEWK

SEQ ID NO: 2626164 - protein, 6 aa, Entamoeba histolytica
IEQDED

SEQ ID NO: 2626165 - protein, 6 aa, Entamoeba histolytica
IEQDGK

SEQ ID NO: 2626166 - protein, 5 aa, Entamoeba histolytica
IEQEE

SEQ ID NO: 2626167 - protein, 13 aa, Entamoeba histolytica
IEQEEDDDNDENE

SEQ ID NO: 2626168 - protein, 15 aa, Entamoeba histolytica
IEQEETISSQTPKEA

SEQ ID NO: 2626169 - protein, 8 aa, Entamoeba histolytica
IEQELSQK

SEQ ID NO: 2626170 - protein, 9 aa, Entamoeba histolytica
IEQENEESM

SEQ ID NO: 2626171 - protein, 11 aa, Entamoeba histolytica
IEQENNGMKQE

SEQ ID NO: 2626172 - protein, 9 aa, Entamoeba histolytica
IEQGTSDFD

SEQ ID NO: 2626173 - protein, 4 aa, Entamoeba histolytica
IEQK

SEQ ID NO: 2626174 - protein, 13 aa, Entamoeba histolytica
IEQKEKDKRIKED

SEQ ID NO: 2626175 - protein, 16 aa, Entamoeba histolytica
IEQKKAKGKELSRAEG

SEQ ID NO: 2626176 - protein, 20 aa, Entamoeba histolytica
IEQKRFSGADRNALKQMVET

SEQ ID NO: 2626177 - protein, 20 aa, Entamoeba histolytica
IEQKTEQTPFPEKKSGCCVL

SEQ ID NO: 2626178 - protein, 12 aa, Entamoeba histolytica
IEQMQSGDINFD

SEQ ID NO: 2626179 - protein, 10 aa, Entamoeba histolytica
IEQNDDSLPE

SEQ ID NO: 2626180 - protein, 9 aa, Entamoeba histolytica
IEQNEPNQE

SEQ ID NO: 2626181 - protein, 5 aa, Entamoeba histolytica
IEQNK

SEQ ID NO: 2626182 - protein, 7 aa, Entamoeba histolytica
IEQNKPL

SEQ ID NO: 2626183 - protein, 6 aa, Entamoeba histolytica
IEQNNH

SEQ ID NO: 2626184 - protein, 5 aa, Entamoeba histolytica
IEQPE

SEQ ID NO: 2626185 - protein, 17 aa, Entamoeba histolytica
IEQPNSVDFRTSKEKER

SEQ ID NO: 2626186 - protein, 20 aa, Entamoeba histolytica
IEQPSQSNQALTINGGSSSV

SEQ ID NO: 2626187 - protein, 16 aa, Entamoeba histolytica
IEQQHQQSSNTTIPSI

SEQ ID NO: 2626188 - protein, 10 aa, Entamoeba histolytica
IEQQKKVNNI

SEQ ID NO: 2626189 - protein, 22 aa, Entamoeba histolytica
IEQQPDPCPFGDEAKRLKARTQ

SEQ ID NO: 2626190 - protein, 5 aa, Entamoeba histolytica
IEQRH

SEQ ID NO: 2626191 - protein, 7 aa, Entamoeba histolytica
IEQRPNI

SEQ ID NO: 2626192 - protein, 4 aa, Entamoeba histolytica
IEQS

SEQ ID NO: 2626193 - protein, 5 aa, Entamoeba histolytica
IEQSI

SEQ ID NO: 2626194 - protein, 4 aa, Entamoeba histolytica
IEQT

SEQ ID NO: 2626195 - protein, 7 aa, Entamoeba histolytica
IEQTDKG

SEQ ID NO: 2626196 - protein, 6 aa, Entamoeba histolytica
IEQTES

SEQ ID NO: 2626197 - protein, 5 aa, Entamoeba histolytica
IEQTQ

SEQ ID NO: 2626198 - protein, 4 aa, Entamoeba histolytica
IEQY

SEQ ID NO: 2626199 - protein, 7 aa, Entamoeba histolytica
IEQYNTQ

SEQ ID NO: 2626200 - protein, 10 aa, Entamoeba histolytica
IERAKKGFDQ

SEQ ID NO: 2626201 - protein, 4 aa, Entamoeba histolytica
IERD

SEQ ID NO: 2626202 - protein, 11 aa, Entamoeba histolytica
IERENVEKTVK

SEQ ID NO: 2626203 - protein, 18 aa, Entamoeba histolytica
IEREQDKRKKIEIKDEYG

SEQ ID NO: 2626204 - protein, 12 aa, Entamoeba histolytica
IERGFGHGSQYK

SEQ ID NO: 2626205 - protein, 12 aa, Entamoeba histolytica
IERGQTGHVKAE

SEQ ID NO: 2626206 - protein, 10 aa, Entamoeba histolytica
IERGVEKRGR

SEQ ID NO: 2626207 - protein, 34 aa, Entamoeba histolytica
IERKEKKINEIESDEYEKQLKEEEEFRKKRKCDT

SEQ ID NO: 2626208 - protein, 6 aa, Entamoeba histolytica
IERKKE

SEQ ID NO: 2626209 - protein, 12 aa, Entamoeba histolytica
IERKQNEVSLLS

SEQ ID NO: 2626210 - protein, 11 aa, Entamoeba histolytica
IERKRETTEWQ

SEQ ID NO: 2626211 - protein, 7 aa, Entamoeba histolytica
IERPISA

SEQ ID NO: 2626212 - protein, 5 aa, Entamoeba histolytica
IERQN

SEQ ID NO: 2626213 - protein, 18 aa, Entamoeba histolytica
IERQQKELTEKERNESLS

SEQ ID NO: 2626214 - protein, 9 aa, Entamoeba histolytica
IERQSKEKI

SEQ ID NO: 2626215 - protein, 11 aa, Entamoeba histolytica
IERRDDTIEKM

SEQ ID NO: 2626216 - protein, 8 aa, Entamoeba histolytica
IERSGKGG

SEQ ID NO: 2626217 - protein, 9 aa, Entamoeba histolytica
IERSPPDVE

SEQ ID NO: 2626218 - protein, 5 aa, Entamoeba histolytica
IERTE

SEQ ID NO: 2626219 - protein, 12 aa, Entamoeba histolytica
IERTFSKEGVSN

SEQ ID NO: 2626220 - protein, 9 aa, Entamoeba histolytica
IERTNSQRL

SEQ ID NO: 2626221 - protein, 10 aa, Entamoeba histolytica
IESDDPDGMV

SEQ ID NO: 2626222 - protein, 12 aa, Entamoeba histolytica
IESDKLKKQIQT

SEQ ID NO: 2626223 - protein, 5 aa, Entamoeba histolytica
IESDM

SEQ ID NO: 2626224 - protein, 12 aa, Entamoeba histolytica
IESDSESNSEDY

SEQ ID NO: 2626225 - protein, 10 aa, Entamoeba histolytica
IESDVKGKEV

SEQ ID NO: 2626226 - protein, 10 aa, Entamoeba histolytica
IESEEEEENI

SEQ ID NO: 2626227 - protein, 12 aa, Entamoeba histolytica
IESEEKSTKIEP

SEQ ID NO: 2626228 - protein, 6 aa, Entamoeba histolytica
IESEER

SEQ ID NO: 2626229 - protein, 8 aa, Entamoeba histolytica
IESEETTT

SEQ ID NO: 2626230 - protein, 11 aa, Entamoeba histolytica
IESEGLSPYSD

SEQ ID NO: 2626231 - protein, 16 aa, Entamoeba histolytica
IESEKQNEIKKQEIER

SEQ ID NO: 2626232 - protein, 6 aa, Entamoeba histolytica
IESEQS

SEQ ID NO: 2626233 - protein, 35 aa, Entamoeba histolytica
IESETDYSTTNSEDEYSGEDKEETDTEEVDDGFIE

SEQ ID NO: 2626234 - protein, 7 aa, Entamoeba histolytica
IESEYGT

SEQ ID NO: 2626235 - protein, 14 aa, Entamoeba histolytica
IESFNEKKTENERV

SEQ ID NO: 2626236 - protein, 9 aa, Entamoeba histolytica
IESGDQNKY

SEQ ID NO: 2626237 - protein, 5 aa, Entamoeba histolytica
IESGI

SEQ ID NO: 2626238 - protein, 9 aa, Entamoeba histolytica
IESGKEKYE

SEQ ID NO: 2626239 - protein, 9 aa, Entamoeba histolytica
IESGKENYE

SEQ ID NO: 2626240 - protein, 8 aa, Entamoeba histolytica
IESGLSKK

SEQ ID NO: 2626241 - protein, 13 aa, Entamoeba histolytica
IESHENKKEEEPK

SEQ ID NO: 2626242 - protein, 10 aa, Entamoeba histolytica
IESHSSSEIV

SEQ ID NO: 2626243 - protein, 5 aa, Entamoeba histolytica
IESKE

SEQ ID NO: 2626244 - protein, 28 aa, Entamoeba histolytica
IESKTSTNESFSDESTETSVELEKQKVE

SEQ ID NO: 2626245 - protein, 10 aa, Entamoeba histolytica
IESLKRKEEL

SEQ ID NO: 2626246 - protein, 14 aa, Entamoeba histolytica
IESLNTTINEKDSV

SEQ ID NO: 2626247 - protein, 5 aa, Entamoeba histolytica
IESNE

SEQ ID NO: 2626248 - protein, 8 aa, Entamoeba histolytica
IESNETDE

SEQ ID NO: 2626249 - protein, 56 aa, Entamoeba histolytica
IESNNEQDEKSTIKNDTTENKENNKNELTNEEEQTEHYSRKRIKESSLSSEPKRCF

SEQ ID NO: 2626250 - protein, 7 aa, Entamoeba histolytica
IESNNES

SEQ ID NO: 2626251 - protein, 6 aa, Entamoeba histolytica
IESNQK

SEQ ID NO: 2626252 - protein, 22 aa, Entamoeba histolytica
IESPNLSQTKEFKKQNDSEKEI

SEQ ID NO: 2626253 - protein, 22 aa, Entamoeba histolytica
IESSDKPKVITKKDSKSINAGS

SEQ ID NO: 2626254 - protein, 9 aa, Entamoeba histolytica
IESSETQTL

SEQ ID NO: 2626255 - protein, 6 aa, Entamoeba histolytica
IESSIN

SEQ ID NO: 2626256 - protein, 5 aa, Entamoeba histolytica
IESSP

SEQ ID NO: 2626257 - protein, 16 aa, Entamoeba histolytica
IESTCDNRKNQGKQWG

SEQ ID NO: 2626258 - protein, 18 aa, Entamoeba histolytica
IESTESSREVSRENSPHL

SEQ ID NO: 2626259 - protein, 10 aa, Entamoeba histolytica
IESTNKCMSD

SEQ ID NO: 2626260 - protein, 6 aa, Entamoeba histolytica
IESTPS

SEQ ID NO: 2626261 - protein, 7 aa, Entamoeba histolytica
IETAPTE

SEQ ID NO: 2626262 - protein, 7 aa, Entamoeba histolytica
IETCEND

SEQ ID NO: 2626263 - protein, 9 aa, Entamoeba histolytica
IETDEQNGF

SEQ ID NO: 2626264 - protein, 4 aa, Entamoeba histolytica
IETE

SEQ ID NO: 2626265 - protein, 11 aa, Entamoeba histolytica
IETEENEVVKE

SEQ ID NO: 2626266 - protein, 8 aa, Entamoeba histolytica
IETEGNGV

SEQ ID NO: 2626267 - protein, 5 aa, Entamoeba histolytica
IETEN

SEQ ID NO: 2626268 - protein, 6 aa, Entamoeba histolytica
IETENQ

SEQ ID NO: 2626269 - protein, 6 aa, Entamoeba histolytica
IETIPT

SEQ ID NO: 2626270 - protein, 4 aa, Entamoeba histolytica
IETK

SEQ ID NO: 2626271 - protein, 10 aa, Entamoeba histolytica
IETKAGSKNV

SEQ ID NO: 2626272 - protein, 9 aa, Entamoeba histolytica
IETKDKKKY

SEQ ID NO: 2626273 - protein, 20 aa, Entamoeba histolytica
IETKEEKGVSSIVAMEEENK

SEQ ID NO: 2626274 - protein, 7 aa, Entamoeba histolytica
IETKNEF

SEQ ID NO: 2626275 - protein, 6 aa, Entamoeba histolytica
IETKNV

SEQ ID NO: 2626276 - protein, 11 aa, Entamoeba histolytica
IETKPISETQT

SEQ ID NO: 2626277 - protein, 12 aa, Entamoeba histolytica
IETKSKGTQYER

SEQ ID NO: 2626278 - protein, 9 aa, Entamoeba histolytica
IETLGEGTY

SEQ ID NO: 2626279 - protein, 4 aa, Entamoeba histolytica
IETN

SEQ ID NO: 2626280 - protein, 11 aa, Entamoeba histolytica
IETNKGNYEYE

SEQ ID NO: 2626281 - protein, 8 aa, Entamoeba histolytica
IETNQNSV

SEQ ID NO: 2626282 - protein, 6 aa, Entamoeba histolytica
IETPFK

SEQ ID NO: 2626283 - protein, 5 aa, Entamoeba histolytica
IETPK

SEQ ID NO: 2626284 - protein, 10 aa, Entamoeba histolytica
IETPQPNDVI

SEQ ID NO: 2626285 - protein, 11 aa, Entamoeba histolytica
IETPSKDIEKI

SEQ ID NO: 2626286 - protein, 10 aa, Entamoeba histolytica
IETPSTSRSV

SEQ ID NO: 2626287 - protein, 6 aa, Entamoeba histolytica
IETPSW

SEQ ID NO: 2626288 - protein, 10 aa, Entamoeba histolytica
IETPTKSMDA

SEQ ID NO: 2626289 - protein, 7 aa, Entamoeba histolytica
IETPTRT

SEQ ID NO: 2626290 - protein, 7 aa, Entamoeba histolytica
IETQGLQ

SEQ ID NO: 2626291 - protein, 6 aa, Entamoeba histolytica
IETQIE

SEQ ID NO: 2626292 - protein, 5 aa, Entamoeba histolytica
IETRE

SEQ ID NO: 2626293 - protein, 5 aa, Entamoeba histolytica
IETSD

SEQ ID NO: 2626294 - protein, 8 aa, Entamoeba histolytica
IETSNQNK

SEQ ID NO: 2626295 - protein, 11 aa, Entamoeba histolytica
IETSRDVTNGV

SEQ ID NO: 2626296 - protein, 13 aa, Entamoeba histolytica
IETSSKENTNVQE

SEQ ID NO: 2626297 - protein, 14 aa, Entamoeba histolytica
IETSSTKDKTVNSK

SEQ ID NO: 2626298 - protein, 8 aa, Entamoeba histolytica
IETSTTER

SEQ ID NO: 2626299 - protein, 4 aa, Entamoeba histolytica
IETT

SEQ ID NO: 2626300 - protein, 14 aa, Entamoeba histolytica
IETTGAIEKYGDTK

SEQ ID NO: 2626301 - protein, 7 aa, Entamoeba histolytica
IETTNYN

SEQ ID NO: 2626302 - protein, 9 aa, Entamoeba histolytica
IETTRGKQT

SEQ ID NO: 2626303 - protein, 7 aa, Entamoeba histolytica
IEVEGEN

SEQ ID NO: 2626304 - protein, 10 aa, Entamoeba histolytica
IEVERKEENE

SEQ ID NO: 2626305 - protein, 10 aa, Entamoeba histolytica
IEVGGQNIDE

SEQ ID NO: 2626306 - protein, 16 aa, Entamoeba histolytica
IEVSNKKQKDKQANLP

SEQ ID NO: 2626307 - protein, 5 aa, Entamoeba histolytica
IEYNT

SEQ ID NO: 2626308 - protein, 4 aa, Entamoeba histolytica
IFER

SEQ ID NO: 2626309 - protein, 10 aa, Entamoeba histolytica
IFESEKTKQI

SEQ ID NO: 2626310 - protein, 16 aa, Entamoeba histolytica
IFGEEGFGERIKSEEE

SEQ ID NO: 2626311 - protein, 4 aa, Entamoeba histolytica
IFGG

SEQ ID NO: 2626312 - protein, 8 aa, Entamoeba histolytica
IFNDEEST

SEQ ID NO: 2626313 - protein, 6 aa, Entamoeba histolytica
IFNGEK

SEQ ID NO: 2626314 - protein, 4 aa, Entamoeba histolytica
IFPP

SEQ ID NO: 2626315 - protein, 4 aa, Entamoeba histolytica
IFPS

SEQ ID NO: 2626316 - protein, 5 aa, Entamoeba histolytica
IFSQQ

SEQ ID NO: 2626317 - protein, 6 aa, Entamoeba histolytica
IGAKGH

SEQ ID NO: 2626318 - protein, 9 aa, Entamoeba histolytica
IGANQLDDN

SEQ ID NO: 2626319 - protein, 14 aa, Entamoeba histolytica
IGAVKNDKFDEERF

SEQ ID NO: 2626320 - protein, 21 aa, Entamoeba histolytica
IGDDKTCSKSLSKFSKFQFEK

SEQ ID NO: 2626321 - protein, 15 aa, Entamoeba histolytica
IGDDTTNDNPSSMDP

SEQ ID NO: 2626322 - protein, 6 aa, Entamoeba histolytica
IGDEYK

SEQ ID NO: 2626323 - protein, 4 aa, Entamoeba histolytica
IGDG

SEQ ID NO: 2626324 - protein, 10 aa, Entamoeba histolytica
IGDGKKSVHA

SEQ ID NO: 2626325 - protein, 7 aa, Entamoeba histolytica
IGDHSKV

SEQ ID NO: 2626326 - protein, 4 aa, Entamoeba histolytica
IGDK

SEQ ID NO: 2626327 - protein, 6 aa, Entamoeba histolytica
IGDKNE

SEQ ID NO: 2626328 - protein, 12 aa, Entamoeba histolytica
IGDNRKGTATYD

SEQ ID NO: 2626329 - protein, 14 aa, Entamoeba histolytica
IGDPSLHPPLTTEP

SEQ ID NO: 2626330 - protein, 4 aa, Entamoeba histolytica
IGDQ

SEQ ID NO: 2626331 - protein, 8 aa, Entamoeba histolytica
IGDQEPIA

SEQ ID NO: 2626332 - protein, 60 aa, Entamoeba histolytica
IGDSGRGEETEKLDESKEEDRAKIEEARAKRKEEKKEHQRNLAEEAHSKKKGGANETKYH

SEQ ID NO: 2626333 - protein, 35 aa, Entamoeba histolytica
IGDSNPTNKPRVNTLNEEYKKAAAEDEEAAEKGII

SEQ ID NO: 2626334 - protein, 9 aa, Entamoeba histolytica
IGDSSEKKM

SEQ ID NO: 2626335 - protein, 9 aa, Entamoeba histolytica
IGDTSVKNT

SEQ ID NO: 2626336 - protein, 5 aa, Entamoeba histolytica
IGECK

SEQ ID NO: 2626337 - protein, 9 aa, Entamoeba histolytica
IGEDAGQTV

SEQ ID NO: 2626338 - protein, 6 aa, Entamoeba histolytica
IGEEIK

SEQ ID NO: 2626339 - protein, 11 aa, Entamoeba histolytica
IGEETKKGIKE

SEQ ID NO: 2626340 - protein, 4 aa, Entamoeba histolytica
IGEG

SEQ ID NO: 2626341 - protein, 7 aa, Entamoeba histolytica
IGEGAAG

SEQ ID NO: 2626342 - protein, 9 aa, Entamoeba histolytica
IGEGKEGKI

SEQ ID NO: 2626343 - protein, 6 aa, Entamoeba histolytica
IGEGTY

SEQ ID NO: 2626344 - protein, 4 aa, Entamoeba histolytica
IGEH

SEQ ID NO: 2626345 - protein, 15 aa, Entamoeba histolytica
IGEIKTGEIPPPPPL

SEQ ID NO: 2626346 - protein, 4 aa, Entamoeba histolytica
IGEK

SEQ ID NO: 2626347 - protein, 7 aa, Entamoeba histolytica
IGEKKSD

SEQ ID NO: 2626348 - protein, 8 aa, Entamoeba histolytica
IGEKVNGS

SEQ ID NO: 2626349 - protein, 15 aa, Entamoeba histolytica
IGENKAGNSNLINKI

SEQ ID NO: 2626350 - protein, 9 aa, Entamoeba histolytica
IGENKGRME

SEQ ID NO: 2626351 - protein, 6 aa, Entamoeba histolytica
IGEPNE

SEQ ID NO: 2626352 - protein, 5 aa, Entamoeba histolytica
IGEPV

SEQ ID NO: 2626353 - protein, 4 aa, Entamoeba histolytica
IGER

SEQ ID NO: 2626354 - protein, 8 aa, Entamoeba histolytica
IGERDSEI

SEQ ID NO: 2626355 - protein, 4 aa, Entamoeba histolytica
IGES

SEQ ID NO: 2626356 - protein, 7 aa, Entamoeba histolytica
IGESGLS

SEQ ID NO: 2626357 - protein, 27 aa, Entamoeba histolytica
IGESSQSAQPGIVDPTQQTQPTESTGC

SEQ ID NO: 2626358 - protein, 18 aa, Entamoeba histolytica
IGETRNCGGKLGSTENYI

SEQ ID NO: 2626359 - protein, 11 aa, Entamoeba histolytica
IGEYAKKNGQW

SEQ ID NO: 2626360 - protein, 6 aa, Entamoeba histolytica
IGEYQP

SEQ ID NO: 2626361 - protein, 14 aa, Entamoeba histolytica
IGFNETSAKKRINV

SEQ ID NO: 2626362 - protein, 8 aa, Entamoeba histolytica
IGGDGKLL

SEQ ID NO: 2626363 - protein, 4 aa, Entamoeba histolytica
IGGE

SEQ ID NO: 2626364 - protein, 7 aa, Entamoeba histolytica
IGGEEGE

SEQ ID NO: 2626365 - protein, 9 aa, Entamoeba histolytica
IGGEGNGGV

SEQ ID NO: 2626366 - protein, 4 aa, Entamoeba histolytica
IGGG

SEQ ID NO: 2626367 - protein, 9 aa, Entamoeba histolytica
IGGKGQIDW

SEQ ID NO: 2626368 - protein, 10 aa, Entamoeba histolytica
IGGKNRHSPF

SEQ ID NO: 2626369 - protein, 12 aa, Entamoeba histolytica
IGGKSEKEDIKA

SEQ ID NO: 2626370 - protein, 10 aa, Entamoeba histolytica
IGGNEEIKQR

SEQ ID NO: 2626371 - protein, 10 aa, Entamoeba histolytica
IGGNERTQTA

SEQ ID NO: 2626372 - protein, 5 aa, Entamoeba histolytica
IGGPS

SEQ ID NO: 2626373 - protein, 10 aa, Entamoeba histolytica
IGGQGFGGGV

SEQ ID NO: 2626374 - protein, 7 aa, Entamoeba histolytica
IGGQGYD

SEQ ID NO: 2626375 - protein, 15 aa, Entamoeba histolytica
IGGSCGVPEKGKYPL

SEQ ID NO: 2626376 - protein, 8 aa, Entamoeba histolytica
IGGSDGLR

SEQ ID NO: 2626377 - protein, 21 aa, Entamoeba histolytica
IGGSNLSVQGNTSNGNPFSSF

SEQ ID NO: 2626378 - protein, 8 aa, Entamoeba histolytica
IGGTIDDT

SEQ ID NO: 2626379 - protein, 9 aa, Entamoeba histolytica
IGGTKTTIE

SEQ ID NO: 2626380 - protein, 4 aa, Entamoeba histolytica
IGGV

SEQ ID NO: 2626381 - protein, 8 aa, Entamoeba histolytica
IGHRDLKP

SEQ ID NO: 2626382 - protein, 7 aa, Entamoeba histolytica
IGHSTEP

SEQ ID NO: 2626383 - protein, 5 aa, Entamoeba histolytica
IGIDP

SEQ ID NO: 2626384 - protein, 5 aa, Entamoeba histolytica
IGIET

SEQ ID NO: 2626385 - protein, 30 aa, Entamoeba histolytica
IGITRKENEENSLGISQTTPKKIKQPKSLV

SEQ ID NO: 2626386 - protein, 7 aa, Entamoeba histolytica
IGITSNP

SEQ ID NO: 2626387 - protein, 9 aa, Entamoeba histolytica
IGKCKTTRE

SEQ ID NO: 2626388 - protein, 5 aa, Entamoeba histolytica
IGKDK

SEQ ID NO: 2626389 - protein, 14 aa, Entamoeba histolytica
IGKEDPDTDVNGAA

SEQ ID NO: 2626390 - protein, 8 aa, Entamoeba histolytica
IGKEGTSL

SEQ ID NO: 2626391 - protein, 6 aa, Entamoeba histolytica
IGKERS

SEQ ID NO: 2626392 - protein, 4 aa, Entamoeba histolytica
IGKG

SEQ ID NO: 2626393 - protein, 11 aa, Entamoeba histolytica
IGKGEGSSSEL

SEQ ID NO: 2626394 - protein, 12 aa, Entamoeba histolytica
IGKGESEEEKMA

SEQ ID NO: 2626395 - protein, 10 aa, Entamoeba histolytica
IGKGKQCTKA

SEQ ID NO: 2626396 - protein, 6 aa, Entamoeba histolytica
IGKGNE

SEQ ID NO: 2626397 - protein, 7 aa, Entamoeba histolytica
IGKHGRI

SEQ ID NO: 2626398 - protein, 9 aa, Entamoeba histolytica
IGKKGKELC

SEQ ID NO: 2626399 - protein, 57 aa, Entamoeba histolytica
IGKKKKRTIKRKTAIKEEPKVETKAVDEDDEIKRLEEEQRKLEEEMKKEEEEQEAEL

SEQ ID NO: 2626400 - protein, 11 aa, Entamoeba histolytica
IGKKLNNGNGR

SEQ ID NO: 2626401 - protein, 9 aa, Entamoeba histolytica
IGKKPTMED

SEQ ID NO: 2626402 - protein, 9 aa, Entamoeba histolytica
IGKLASPSI

SEQ ID NO: 2626403 - protein, 4 aa, Entamoeba histolytica
IGKP

SEQ ID NO: 2626404 - protein, 5 aa, Entamoeba histolytica
IGKQI

SEQ ID NO: 2626405 - protein, 6 aa, Entamoeba histolytica
IGKSAS

SEQ ID NO: 2626406 - protein, 5 aa, Entamoeba histolytica
IGKSE

SEQ ID NO: 2626407 - protein, 11 aa, Entamoeba histolytica
IGKSLAEKGHD

SEQ ID NO: 2626408 - protein, 8 aa, Entamoeba histolytica
IGKSNIGK

SEQ ID NO: 2626409 - protein, 8 aa, Entamoeba histolytica
IGKSSKQT

SEQ ID NO: 2626410 - protein, 7 aa, Entamoeba histolytica
IGKTNEE

SEQ ID NO: 2626411 - protein, 9 aa, Entamoeba histolytica
IGKYNQPDC

SEQ ID NO: 2626412 - protein, 11 aa, Entamoeba histolytica
IGMADTSATTV

SEQ ID NO: 2626413 - protein, 11 aa, Entamoeba histolytica
IGNDDSMKPIQ

SEQ ID NO: 2626414 - protein, 6 aa, Entamoeba histolytica
IGNDEI

SEQ ID NO: 2626415 - protein, 7 aa, Entamoeba histolytica
IGNDSSV

SEQ ID NO: 2626416 - protein, 8 aa, Entamoeba histolytica
IGNESKDI

SEQ ID NO: 2626417 - protein, 6 aa, Entamoeba histolytica
IGNESL

SEQ ID NO: 2626418 - protein, 10 aa, Entamoeba histolytica
IGNEYDHDSD

SEQ ID NO: 2626419 - protein, 11 aa, Entamoeba histolytica
IGNKDEQKKRL

SEQ ID NO: 2626420 - protein, 11 aa, Entamoeba histolytica
IGNKNLNSVSR

SEQ ID NO: 2626421 - protein, 20 aa, Entamoeba histolytica
IGNKRKRQVRSEFGKNRAEC

SEQ ID NO: 2626422 - protein, 4 aa, Entamoeba histolytica
IGNN

SEQ ID NO: 2626423 - protein, 8 aa, Entamoeba histolytica
IGNNGGKE

SEQ ID NO: 2626424 - protein, 6 aa, Entamoeba histolytica
IGNNPP

SEQ ID NO: 2626425 - protein, 6 aa, Entamoeba histolytica
IGNNTI

SEQ ID NO: 2626426 - protein, 5 aa, Entamoeba histolytica
IGNPN

SEQ ID NO: 2626427 - protein, 10 aa, Entamoeba histolytica
IGNTPSENIN

SEQ ID NO: 2626428 - protein, 12 aa, Entamoeba histolytica
IGPAEGKNPSLR

SEQ ID NO: 2626429 - protein, 6 aa, Entamoeba histolytica
IGPAGD

SEQ ID NO: 2626430 - protein, 12 aa, Entamoeba histolytica
IGPERNSVTDQT

SEQ ID NO: 2626431 - protein, 10 aa, Entamoeba histolytica
IGPGPSPIEK

SEQ ID NO: 2626432 - protein, 6 aa, Entamoeba histolytica
IGPKSI

SEQ ID NO: 2626433 - protein, 7 aa, Entamoeba histolytica
IGPPPQM

SEQ ID NO: 2626434 - protein, 9 aa, Entamoeba histolytica
IGPSAPAFL

SEQ ID NO: 2626435 - protein, 12 aa, Entamoeba histolytica
IGPSATNSAQTY

SEQ ID NO: 2626436 - protein, 6 aa, Entamoeba histolytica
IGPSSD

SEQ ID NO: 2626437 - protein, 10 aa, Entamoeba histolytica
IGPSTLKDGL

SEQ ID NO: 2626438 - protein, 5 aa, Entamoeba histolytica
IGPTE

SEQ ID NO: 2626439 - protein, 5 aa, Entamoeba histolytica
IGPYT

SEQ ID NO: 2626440 - protein, 6 aa, Entamoeba histolytica
IGQEKT

SEQ ID NO: 2626441 - protein, 18 aa, Entamoeba histolytica
IGQGKSILKGEEEDEEDE

SEQ ID NO: 2626442 - protein, 9 aa, Entamoeba histolytica
IGQKELDNF

SEQ ID NO: 2626443 - protein, 10 aa, Entamoeba histolytica
IGQPHRPTDV

SEQ ID NO: 2626444 - protein, 18 aa, Entamoeba histolytica
IGRARGGGAGDAGGSADR

SEQ ID NO: 2626445 - protein, 11 aa, Entamoeba histolytica
IGRDEGEVNYE

SEQ ID NO: 2626446 - protein, 14 aa, Entamoeba histolytica
IGRDESDVSYEDRA

SEQ ID NO: 2626447 - protein, 18 aa, Entamoeba histolytica
IGRDGAVDIETGKGTKDI

SEQ ID NO: 2626448 - protein, 6 aa, Entamoeba histolytica
IGRGAY

SEQ ID NO: 2626449 - protein, 17 aa, Entamoeba histolytica
IGRGSKTLITNTGAGIL

SEQ ID NO: 2626450 - protein, 15 aa, Entamoeba histolytica
IGRKGGRNSFSRRGR

SEQ ID NO: 2626451 - protein, 9 aa, Entamoeba histolytica
IGRNEKGLE

SEQ ID NO: 2626452 - protein, 5 aa, Entamoeba histolytica
IGRPE

SEQ ID NO: 2626453 - protein, 7 aa, Entamoeba histolytica
IGRQAQS

SEQ ID NO: 2626454 - protein, 4 aa, Entamoeba histolytica
IGRS

SEQ ID NO: 2626455 - protein, 19 aa, Entamoeba histolytica
IGRSDKSITEYNSLLEILE

SEQ ID NO: 2626456 - protein, 9 aa, Entamoeba histolytica
IGRSSSFSK

SEQ ID NO: 2626457 - protein, 13 aa, Entamoeba histolytica
IGRTGRASKKGTA

SEQ ID NO: 2626458 - protein, 4 aa, Entamoeba histolytica
IGRV

SEQ ID NO: 2626459 - protein, 17 aa, Entamoeba histolytica
IGSASYNASYKKSIPHL

SEQ ID NO: 2626460 - protein, 17 aa, Entamoeba histolytica
IGSENKTHKTISATTRQ

SEQ ID NO: 2626461 - protein, 6 aa, Entamoeba histolytica
IGSGAS

SEQ ID NO: 2626462 - protein, 6 aa, Entamoeba histolytica
IGSGDL

SEQ ID NO: 2626463 - protein, 5 aa, Entamoeba histolytica
IGSGS

SEQ ID NO: 2626464 - protein, 12 aa, Entamoeba histolytica
IGSGSSTPRRES

SEQ ID NO: 2626465 - protein, 5 aa, Entamoeba histolytica
IGSKE

SEQ ID NO: 2626466 - protein, 13 aa, Entamoeba histolytica
IGSKEDVSSGKGI

SEQ ID NO: 2626467 - protein, 5 aa, Entamoeba histolytica
IGSKG

SEQ ID NO: 2626468 - protein, 5 aa, Entamoeba histolytica
IGSLS

SEQ ID NO: 2626469 - protein, 19 aa, Entamoeba histolytica
IGSNDPGGRIGIQGTNKRM

SEQ ID NO: 2626470 - protein, 9 aa, Entamoeba histolytica
IGSNESQYK

SEQ ID NO: 2626471 - protein, 5 aa, Entamoeba histolytica
IGSNQ

SEQ ID NO: 2626472 - protein, 4 aa, Entamoeba histolytica
IGSQ

SEQ ID NO: 2626473 - protein, 6 aa, Entamoeba histolytica
IGSRNR

SEQ ID NO: 2626474 - protein, 5 aa, Entamoeba histolytica
IGSRR

SEQ ID NO: 2626475 - protein, 7 aa, Entamoeba histolytica
IGSTHKG

SEQ ID NO: 2626476 - protein, 10 aa, Entamoeba histolytica
IGSVKGSELL

SEQ ID NO: 2626477 - protein, 10 aa, Entamoeba histolytica
IGTATSFDSG

SEQ ID NO: 2626478 - protein, 18 aa, Entamoeba histolytica
IGTDIDPYGVGNKTEHSF

SEQ ID NO: 2626479 - protein, 5 aa, Entamoeba histolytica
IGTEG

SEQ ID NO: 2626480 - protein, 5 aa, Entamoeba histolytica
IGTEQ

SEQ ID NO: 2626481 - protein, 10 aa, Entamoeba histolytica
IGTESASTNY

SEQ ID NO: 2626482 - protein, 4 aa, Entamoeba histolytica
IGTG

SEQ ID NO: 2626483 - protein, 7 aa, Entamoeba histolytica
IGTGKTT

SEQ ID NO: 2626484 - protein, 9 aa, Entamoeba histolytica
IGTGSNSTI

SEQ ID NO: 2626485 - protein, 5 aa, Entamoeba histolytica
IGTKI

SEQ ID NO: 2626486 - protein, 17 aa, Entamoeba histolytica
IGTKRTESEHSGDREIQ

SEQ ID NO: 2626487 - protein, 5 aa, Entamoeba histolytica
IGTLK

SEQ ID NO: 2626488 - protein, 6 aa, Entamoeba histolytica
IGTLQS

SEQ ID NO: 2626489 - protein, 7 aa, Entamoeba histolytica
IGTNQEY

SEQ ID NO: 2626490 - protein, 15 aa, Entamoeba histolytica
IGTNVSKDKQNKEKS

SEQ ID NO: 2626491 - protein, 6 aa, Entamoeba histolytica
IGTPIS

SEQ ID NO: 2626492 - protein, 6 aa, Entamoeba histolytica
IGTPPL

SEQ ID NO: 2626493 - protein, 8 aa, Entamoeba histolytica
IGTQSEYA

SEQ ID NO: 2626494 - protein, 5 aa, Entamoeba histolytica
IGTSD

SEQ ID NO: 2626495 - protein, 11 aa, Entamoeba histolytica
IGTSDSGTTII

SEQ ID NO: 2626496 - protein, 6 aa, Entamoeba histolytica
IGTTDN

SEQ ID NO: 2626497 - protein, 16 aa, Entamoeba histolytica
IGTTGKRGDLYLIIKF

SEQ ID NO: 2626498 - protein, 36 aa, Entamoeba histolytica
IGTYTGEKKAPPPQTGKPVVKKEEPKPTTSKEPELI

SEQ ID NO: 2626499 - protein, 6 aa, Entamoeba histolytica
IGVGKE

SEQ ID NO: 2626500 - protein, 19 aa, Entamoeba histolytica
IGVHSDDGKLFNQNGTGVN

SEQ ID NO: 2626501 - protein, 7 aa, Entamoeba histolytica
IGVPEGT

SEQ ID NO: 2626502 - protein, 4 aa, Entamoeba histolytica
IGVS

SEQ ID NO: 2626503 - protein, 6 aa, Entamoeba histolytica
IGYTTY

SEQ ID NO: 2626504 - protein, 6 aa, Entamoeba histolytica
IHDDNQ

SEQ ID NO: 2626505 - protein, 9 aa, Entamoeba histolytica
IHDNPSESI

SEQ ID NO: 2626506 - protein, 13 aa, Entamoeba histolytica
IHDPNSKKYSCPE

SEQ ID NO: 2626507 - protein, 5 aa, Entamoeba histolytica
IHDPQ

SEQ ID NO: 2626508 - protein, 7 aa, Entamoeba histolytica
IHDTSPK

SEQ ID NO: 2626509 - protein, 30 aa, Entamoeba histolytica
IHEDSEGLEEEDSSQDFEESDDIDDEESQV

SEQ ID NO: 2626510 - protein, 13 aa, Entamoeba histolytica
IHEEENKPETQPN

SEQ ID NO: 2626511 - protein, 4 aa, Entamoeba histolytica
IHEN

SEQ ID NO: 2626512 - protein, 5 aa, Entamoeba histolytica
IHNDN

SEQ ID NO: 2626513 - protein, 6 aa, Entamoeba histolytica
IHNEEK

SEQ ID NO: 2626514 - protein, 17 aa, Entamoeba histolytica
IHNESQKDKADQISHPL

SEQ ID NO: 2626515 - protein, 9 aa, Entamoeba histolytica
IHNQQPDVG

SEQ ID NO: 2626516 - protein, 7 aa, Entamoeba histolytica
IHNSKAQ

SEQ ID NO: 2626517 - protein, 7 aa, Entamoeba histolytica
IHPDQPR

SEQ ID NO: 2626518 - protein, 4 aa, Entamoeba histolytica
IHPN

SEQ ID NO: 2626519 - protein, 7 aa, Entamoeba histolytica
IHPPPVQ

SEQ ID NO: 2626520 - protein, 6 aa, Entamoeba histolytica
IHPTDN

SEQ ID NO: 2626521 - protein, 7 aa, Entamoeba histolytica
IHQAEEK

SEQ ID NO: 2626522 - protein, 26 aa, Entamoeba histolytica
IHQNENVQEEKIKEETKENNNQPNDL

SEQ ID NO: 2626523 - protein, 12 aa, Entamoeba histolytica
IHSEEENNGDDD

SEQ ID NO: 2626524 - protein, 11 aa, Entamoeba histolytica
IHSKNESNQPI

SEQ ID NO: 2626525 - protein, 4 aa, Entamoeba histolytica
IHSP

SEQ ID NO: 2626526 - protein, 11 aa, Entamoeba histolytica
IHSQNSNTQLS

SEQ ID NO: 2626527 - protein, 9 aa, Entamoeba histolytica
IHTGTKENT

SEQ ID NO: 2626528 - protein, 4 aa, Entamoeba histolytica
IHTP

SEQ ID NO: 2626529 - protein, 6 aa, Entamoeba histolytica
IHTSSV

SEQ ID NO: 2626530 - protein, 66 aa, Entamoeba histolytica
IIDSSSQKENEEKTKRKEGSKERPKSLKEKLSPRKESKEEKKVKDTKKKKEVIDKEQHAEERHKND

SEQ ID NO: 2626531 - protein, 66 aa, Entamoeba histolytica
IIDSSSQKKNEEKTKRKEGSKERPKSLKEKLSPRKESKEEKKVKDTKKKKEVIDKEQHAEERHKND

SEQ ID NO: 2626532 - protein, 6 aa, Entamoeba histolytica
IIENET

SEQ ID NO: 2626533 - protein, 99 aa, Entamoeba histolytica
IIENQQPSLEQKEVKNKHKHRRHSYSDDSSEDTEQNSKRKRKHHRSHSRHSKRKHYKKSVSASSDTSSYEDHYKKRKGYKHKRHSISSYDQSSKSLSED

SEQ ID NO: 2626534 - protein, 11 aa, Entamoeba histolytica
IIENSANRFGS

SEQ ID NO: 2626535 - protein, 9 aa, Entamoeba histolytica
IIEQTQTDK

SEQ ID NO: 2626536 - protein, 29 aa, Entamoeba histolytica
IIGEESEEEEDDDNQIQEQQKTKEETEIE

SEQ ID NO: 2626537 - protein, 142 aa, Entamoeba histolytica
IIGEPAQKHDESGSNETEEKESKQEESKQEESKQEESKQEESKQEESKQEESKQEESKQEESKQEESKQEESKQEESKQEESKQEESKQEESKQEESKQEESKQEESKQEESKQEESKQEESKQTTETETKEESKKSESSVA

SEQ ID NO: 2626538 - protein, 6 aa, Entamoeba histolytica
IIGKSD

SEQ ID NO: 2626539 - protein, 5 aa, Entamoeba histolytica
IIGSE

SEQ ID NO: 2626540 - protein, 8 aa, Entamoeba histolytica
IIGSGNKT

SEQ ID NO: 2626541 - protein, 16 aa, Entamoeba histolytica
IIGTKKKIEENGKEEY

SEQ ID NO: 2626542 - protein, 11 aa, Entamoeba histolytica
IIGTSSSEISE

SEQ ID NO: 2626543 - protein, 21 aa, Entamoeba histolytica
IIKGRNKDISRKKCKGITKDR

SEQ ID NO: 2626544 - protein, 11 aa, Entamoeba histolytica
IIKNKTKAFNE

SEQ ID NO: 2626545 - protein, 10 aa, Entamoeba histolytica
IIKSTDSTII

SEQ ID NO: 2626546 - protein, 5 aa, Entamoeba histolytica
IINEQ

SEQ ID NO: 2626547 - protein, 7 aa, Entamoeba histolytica
IINGSAP

SEQ ID NO: 2626548 - protein, 9 aa, Entamoeba histolytica
IINGTKEKP

SEQ ID NO: 2626549 - protein, 7 aa, Entamoeba histolytica
IINPNSQ

SEQ ID NO: 2626550 - protein, 13 aa, Entamoeba histolytica
IINSESKNENQFI

SEQ ID NO: 2626551 - protein, 13 aa, Entamoeba histolytica
IIPSSSKNPIHAE

SEQ ID NO: 2626552 - protein, 19 aa, Entamoeba histolytica
IIPTPTLTNNSSSNPNQIE

SEQ ID NO: 2626553 - protein, 5 aa, Entamoeba histolytica
IIPTQ

SEQ ID NO: 2626554 - protein, 16 aa, Entamoeba histolytica
IIQKQKEIKQKRKGCY

SEQ ID NO: 2626555 - protein, 5 aa, Entamoeba histolytica
IIQPN

SEQ ID NO: 2626556 - protein, 6 aa, Entamoeba histolytica
IISKGS

SEQ ID NO: 2626557 - protein, 11 aa, Entamoeba histolytica
IISQPKPIRQS

SEQ ID NO: 2626558 - protein, 9 aa, Entamoeba histolytica
IISRRGKTV

SEQ ID NO: 2626559 - protein, 17 aa, Entamoeba histolytica
IISTENKKKKKGSGFNT

SEQ ID NO: 2626560 - protein, 57 aa, Entamoeba histolytica
IISTQEESDSVGSEVSPRSPRMSKSEKKDKQDKKKDKKKGKKSDSDDNNDNSQQTKV

SEQ ID NO: 2626561 - protein, 7 aa, Entamoeba histolytica
IITGSQD

SEQ ID NO: 2626562 - protein, 20 aa, Entamoeba histolytica
IITKPEPKKISPSTSPGLAD

SEQ ID NO: 2626563 - protein, 13 aa, Entamoeba histolytica
IITSSGDTLLGAD

SEQ ID NO: 2626564 - protein, 36 aa, Entamoeba histolytica
IKADKLEDLEDNNSPKDIQDNLQEEPDEEVDESNKF

SEQ ID NO: 2626565 - protein, 7 aa, Entamoeba histolytica
IKAFTKT

SEQ ID NO: 2626566 - protein, 12 aa, Entamoeba histolytica
IKAGLSNEELPS

SEQ ID NO: 2626567 - protein, 8 aa, Entamoeba histolytica
IKAINNTE

SEQ ID NO: 2626568 - protein, 8 aa, Entamoeba histolytica
IKAKPDDM

SEQ ID NO: 2626569 - protein, 10 aa, Entamoeba histolytica
IKANEQTNSF

SEQ ID NO: 2626570 - protein, 15 aa, Entamoeba histolytica
IKAPPASYLSFLEKL

SEQ ID NO: 2626571 - protein, 12 aa, Entamoeba histolytica
IKAQNKAKEPFM

SEQ ID NO: 2626572 - protein, 13 aa, Entamoeba histolytica
IKARDEENTYKVE

SEQ ID NO: 2626573 - protein, 7 aa, Entamoeba histolytica
IKARENK

SEQ ID NO: 2626574 - protein, 10 aa, Entamoeba histolytica
IKASTATNSM

SEQ ID NO: 2626575 - protein, 20 aa, Entamoeba histolytica
IKATKELQELTQQEKSISKK

SEQ ID NO: 2626576 - protein, 9 aa, Entamoeba histolytica
IKDATVEEA

SEQ ID NO: 2626577 - protein, 10 aa, Entamoeba histolytica
IKDDKTTNLA

SEQ ID NO: 2626578 - protein, 10 aa, Entamoeba histolytica
IKDDSDYPME

SEQ ID NO: 2626579 - protein, 7 aa, Entamoeba histolytica
IKDEEEA

SEQ ID NO: 2626580 - protein, 8 aa, Entamoeba histolytica
IKDEHNEL

SEQ ID NO: 2626581 - protein, 7 aa, Entamoeba histolytica
IKDEMSN

SEQ ID NO: 2626582 - protein, 6 aa, Entamoeba histolytica
IKDGER

SEQ ID NO: 2626583 - protein, 7 aa, Entamoeba histolytica
IKDGRTV

SEQ ID NO: 2626584 - protein, 7 aa, Entamoeba histolytica
IKDKEIS

SEQ ID NO: 2626585 - protein, 8 aa, Entamoeba histolytica
IKDKERVG

SEQ ID NO: 2626586 - protein, 8 aa, Entamoeba histolytica
IKDKTKDI

SEQ ID NO: 2626587 - protein, 11 aa, Entamoeba histolytica
IKDNKDTDKIQ

SEQ ID NO: 2626588 - protein, 12 aa, Entamoeba histolytica
IKDNKNNYTDKD

SEQ ID NO: 2626589 - protein, 7 aa, Entamoeba histolytica
IKDNSEL

SEQ ID NO: 2626590 - protein, 6 aa, Entamoeba histolytica
IKDPQQ

SEQ ID NO: 2626591 - protein, 8 aa, Entamoeba histolytica
IKDQDTEN

SEQ ID NO: 2626592 - protein, 13 aa, Entamoeba histolytica
IKDQPRMAVVNMN

SEQ ID NO: 2626593 - protein, 6 aa, Entamoeba histolytica
IKDQQK

SEQ ID NO: 2626594 - protein, 8 aa, Entamoeba histolytica
IKDSETAI

SEQ ID NO: 2626595 - protein, 8 aa, Entamoeba histolytica
IKDSKSNR

SEQ ID NO: 2626596 - protein, 9 aa, Entamoeba histolytica
IKDTDKKTN

SEQ ID NO: 2626597 - protein, 12 aa, Entamoeba histolytica
IKDTNKEERKRR

SEQ ID NO: 2626598 - protein, 7 aa, Entamoeba histolytica
IKEATGY

SEQ ID NO: 2626599 - protein, 4 aa, Entamoeba histolytica
IKED

SEQ ID NO: 2626600 - protein, 8 aa, Entamoeba histolytica
IKEDEERS

SEQ ID NO: 2626601 - protein, 6 aa, Entamoeba histolytica
IKEDGT

SEQ ID NO: 2626602 - protein, 10 aa, Entamoeba histolytica
IKEDNVNSDE

SEQ ID NO: 2626603 - protein, 4 aa, Entamoeba histolytica
IKEE

SEQ ID NO: 2626604 - protein, 233 aa, Entamoeba histolytica
IKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEAKAKEEAEKKAKEEVKEENKEEVKEEVKEEVKEEVKEENKEENKEENKEENKEENKEENKEENKEESEVQDTTPSERVMSKGEKKARKALE

SEQ ID NO: 2626605 - protein, 9 aa, Entamoeba histolytica
IKEEDDGLP

SEQ ID NO: 2626606 - protein, 19 aa, Entamoeba histolytica
IKEEDNKEEIKEEEDKDIG

SEQ ID NO: 2626607 - protein, 8 aa, Entamoeba histolytica
IKEEEECE

SEQ ID NO: 2626608 - protein, 9 aa, Entamoeba histolytica
IKEEEEEKI

SEQ ID NO: 2626609 - protein, 8 aa, Entamoeba histolytica
IKEEENNL

SEQ ID NO: 2626610 - protein, 15 aa, Entamoeba histolytica
IKEEETTQNGNVTEA

SEQ ID NO: 2626611 - protein, 17 aa, Entamoeba histolytica
IKEEGSDTTTNLSQSPL

SEQ ID NO: 2626612 - protein, 10 aa, Entamoeba histolytica
IKEEHENNIT

SEQ ID NO: 2626613 - protein, 10 aa, Entamoeba histolytica
IKEEKDKQMK

SEQ ID NO: 2626614 - protein, 20 aa, Entamoeba histolytica
IKEEKEEQENKKLKETLEEI

SEQ ID NO: 2626615 - protein, 11 aa, Entamoeba histolytica
IKEEKEISPVK

SEQ ID NO: 2626616 - protein, 12 aa, Entamoeba histolytica
IKEEKKDEIPHS

SEQ ID NO: 2626617 - protein, 11 aa, Entamoeba histolytica
IKEEKKIGEGS

SEQ ID NO: 2626618 - protein, 12 aa, Entamoeba histolytica
IKEEKQKIEDEK

SEQ ID NO: 2626619 - protein, 23 aa, Entamoeba histolytica
IKEELKDIKEKKDSLTKEYEQKK

SEQ ID NO: 2626620 - protein, 9 aa, Entamoeba histolytica
IKEENKSKS

SEQ ID NO: 2626621 - protein, 11 aa, Entamoeba histolytica
IKEENQPIKEE

SEQ ID NO: 2626622 - protein, 11 aa, Entamoeba histolytica
IKEEPQKYSTP

SEQ ID NO: 2626623 - protein, 14 aa, Entamoeba histolytica
IKEESDDSDTVDDL

SEQ ID NO: 2626624 - protein, 7 aa, Entamoeba histolytica
IKEESKD

SEQ ID NO: 2626625 - protein, 8 aa, Entamoeba histolytica
IKEETQTI

SEQ ID NO: 2626626 - protein, 7 aa, Entamoeba histolytica
IKEGEDK

SEQ ID NO: 2626627 - protein, 9 aa, Entamoeba histolytica
IKEGEDMAK

SEQ ID NO: 2626628 - protein, 6 aa, Entamoeba histolytica
IKEGID

SEQ ID NO: 2626629 - protein, 24 aa, Entamoeba histolytica
IKEGISKGTLKDSVKCPANGNQNE

SEQ ID NO: 2626630 - protein, 11 aa, Entamoeba histolytica
IKEGITDSNEY

SEQ ID NO: 2626631 - protein, 21 aa, Entamoeba histolytica
IKEGKELKKAETNDRSAPVIP

SEQ ID NO: 2626632 - protein, 20 aa, Entamoeba histolytica
IKEGKELKKVESNDRSAPVI

SEQ ID NO: 2626633 - protein, 7 aa, Entamoeba histolytica
IKEGKNA

SEQ ID NO: 2626634 - protein, 6 aa, Entamoeba histolytica
IKEGNS

SEQ ID NO: 2626635 - protein, 6 aa, Entamoeba histolytica
IKEGQA

SEQ ID NO: 2626636 - protein, 24 aa, Entamoeba histolytica
IKEGSSNSCDSPSPRKEDNDLFEQ

SEQ ID NO: 2626637 - protein, 4 aa, Entamoeba histolytica
IKEK

SEQ ID NO: 2626638 - protein, 20 aa, Entamoeba histolytica
IKEKDDKIIEERKEERNIEK

SEQ ID NO: 2626639 - protein, 9 aa, Entamoeba histolytica
IKEKDEEMK

SEQ ID NO: 2626640 - protein, 11 aa, Entamoeba histolytica
IKEKDLNKEYQ

SEQ ID NO: 2626641 - protein, 10 aa, Entamoeba histolytica
IKEKEKELEQ

SEQ ID NO: 2626642 - protein, 11 aa, Entamoeba histolytica
IKEKEKNDQII

SEQ ID NO: 2626643 - protein, 8 aa, Entamoeba histolytica
IKEKEMQD

SEQ ID NO: 2626644 - protein, 12 aa, Entamoeba histolytica
IKEKGKEIEGRK

SEQ ID NO: 2626645 - protein, 7 aa, Entamoeba histolytica
IKEKKPI

SEQ ID NO: 2626646 - protein, 8 aa, Entamoeba histolytica
IKEKMSDS

SEQ ID NO: 2626647 - protein, 9 aa, Entamoeba histolytica
IKEKNNEYF

SEQ ID NO: 2626648 - protein, 15 aa, Entamoeba histolytica
IKEKNNPQNEQPTME

SEQ ID NO: 2626649 - protein, 9 aa, Entamoeba histolytica
IKEKPNDMS

SEQ ID NO: 2626650 - protein, 10 aa, Entamoeba histolytica
IKEKRRNNRQ

SEQ ID NO: 2626651 - protein, 15 aa, Entamoeba histolytica
IKEKSIKMKEEETDG

SEQ ID NO: 2626652 - protein, 6 aa, Entamoeba histolytica
IKELNK

SEQ ID NO: 2626653 - protein, 13 aa, Entamoeba histolytica
IKELSSRRFSSRK

SEQ ID NO: 2626654 - protein, 7 aa, Entamoeba histolytica
IKENDKV

SEQ ID NO: 2626655 - protein, 5 aa, Entamoeba histolytica
IKENE

SEQ ID NO: 2626656 - protein, 7 aa, Entamoeba histolytica
IKENEIN

SEQ ID NO: 2626657 - protein, 12 aa, Entamoeba histolytica
IKENEKKKEELS

SEQ ID NO: 2626658 - protein, 11 aa, Entamoeba histolytica
IKENEQESGNA

SEQ ID NO: 2626659 - protein, 5 aa, Entamoeba histolytica
IKENI

SEQ ID NO: 2626660 - protein, 9 aa, Entamoeba histolytica
IKENKRSVK

SEQ ID NO: 2626661 - protein, 14 aa, Entamoeba histolytica
IKENNIKREESITQ

SEQ ID NO: 2626662 - protein, 9 aa, Entamoeba histolytica
IKENSETRI

SEQ ID NO: 2626663 - protein, 19 aa, Entamoeba histolytica
IKEPATPKQGKKKRRDKQG

SEQ ID NO: 2626664 - protein, 11 aa, Entamoeba histolytica
IKEQEDDEKDD

SEQ ID NO: 2626665 - protein, 5 aa, Entamoeba histolytica
IKEQK

SEQ ID NO: 2626666 - protein, 7 aa, Entamoeba histolytica
IKEQKPI

SEQ ID NO: 2626667 - protein, 5 aa, Entamoeba histolytica
IKEQP

SEQ ID NO: 2626668 - protein, 19 aa, Entamoeba histolytica
IKERERKKKPFSASEGMAQ

SEQ ID NO: 2626669 - protein, 8 aa, Entamoeba histolytica
IKERNEAL

SEQ ID NO: 2626670 - protein, 16 aa, Entamoeba histolytica
IKERQDEKARKRKQLK

SEQ ID NO: 2626671 - protein, 10 aa, Entamoeba histolytica
IKERRDEYSI

SEQ ID NO: 2626672 - protein, 11 aa, Entamoeba histolytica
IKERTRGYGTK

SEQ ID NO: 2626673 - protein, 7 aa, Entamoeba histolytica
IKESDQE

SEQ ID NO: 2626674 - protein, 10 aa, Entamoeba histolytica
IKESQPQPQK

SEQ ID NO: 2626675 - protein, 9 aa, Entamoeba histolytica
IKESTGQDV

SEQ ID NO: 2626676 - protein, 5 aa, Entamoeba histolytica
IKESV

SEQ ID NO: 2626677 - protein, 9 aa, Entamoeba histolytica
IKETEPPKQ

SEQ ID NO: 2626678 - protein, 10 aa, Entamoeba histolytica
IKETNEQPKK

SEQ ID NO: 2626679 - protein, 14 aa, Entamoeba histolytica
IKETTEKKLKEIDN

SEQ ID NO: 2626680 - protein, 19 aa, Entamoeba histolytica
IKETTHCKDETPAKEKKKK

SEQ ID NO: 2626681 - protein, 6 aa, Entamoeba histolytica
IKEVEK

SEQ ID NO: 2626682 - protein, 7 aa, Entamoeba histolytica
IKEYDDI

SEQ ID NO: 2626683 - protein, 11 aa, Entamoeba histolytica
IKEYEESKKKI

SEQ ID NO: 2626684 - protein, 7 aa, Entamoeba histolytica
IKEYTSQ

SEQ ID NO: 2626685 - protein, 17 aa, Entamoeba histolytica
IKGDGQEAADKKYEVEE

SEQ ID NO: 2626686 - protein, 6 aa, Entamoeba histolytica
IKGDKT

SEQ ID NO: 2626687 - protein, 11 aa, Entamoeba histolytica
IKGEETYKTEI

SEQ ID NO: 2626688 - protein, 13 aa, Entamoeba histolytica
IKGEGMSVNTTRE

SEQ ID NO: 2626689 - protein, 10 aa, Entamoeba histolytica
IKGEKERKNH

SEQ ID NO: 2626690 - protein, 24 aa, Entamoeba histolytica
IKGEPDGSSFPNGGLRQTYQARGY

SEQ ID NO: 2626691 - protein, 10 aa, Entamoeba histolytica
IKGGDEEIKE

SEQ ID NO: 2626692 - protein, 9 aa, Entamoeba histolytica
IKGGNAPNV

SEQ ID NO: 2626693 - protein, 9 aa, Entamoeba histolytica
IKGGNGSNQ

SEQ ID NO: 2626694 - protein, 11 aa, Entamoeba histolytica
IKGGSDKSETN

SEQ ID NO: 2626695 - protein, 7 aa, Entamoeba histolytica
IKGHKSG

SEQ ID NO: 2626696 - protein, 23 aa, Entamoeba histolytica
IKGIKSADDIKRKMRKSNRNVFG

SEQ ID NO: 2626697 - protein, 8 aa, Entamoeba histolytica
IKGITNNN

SEQ ID NO: 2626698 - protein, 5 aa, Entamoeba histolytica
IKGKN

SEQ ID NO: 2626699 - protein, 9 aa, Entamoeba histolytica
IKGKPEMKN

SEQ ID NO: 2626700 - protein, 19 aa, Entamoeba histolytica
IKGKTTKQLITEENKRQNC

SEQ ID NO: 2626701 - protein, 15 aa, Entamoeba histolytica
IKGNETGFGGDGTFT

SEQ ID NO: 2626702 - protein, 11 aa, Entamoeba histolytica
IKGNPTKPAQR

SEQ ID NO: 2626703 - protein, 6 aa, Entamoeba histolytica
IKGNPY

SEQ ID NO: 2626704 - protein, 8 aa, Entamoeba histolytica
IKGPDYNS

SEQ ID NO: 2626705 - protein, 6 aa, Entamoeba histolytica
IKGQEK

SEQ ID NO: 2626706 - protein, 9 aa, Entamoeba histolytica
IKGQQHGRS

SEQ ID NO: 2626707 - protein, 11 aa, Entamoeba histolytica
IKGRAGDKSVY

SEQ ID NO: 2626708 - protein, 14 aa, Entamoeba histolytica
IKGREEKKKKAQIQ

SEQ ID NO: 2626709 - protein, 4 aa, Entamoeba histolytica
IKGS

SEQ ID NO: 2626710 - protein, 7 aa, Entamoeba histolytica
IKGSGSV

SEQ ID NO: 2626711 - protein, 6 aa, Entamoeba histolytica
IKGSQL

SEQ ID NO: 2626712 - protein, 6 aa, Entamoeba histolytica
IKGSRI

SEQ ID NO: 2626713 - protein, 7 aa, Entamoeba histolytica
IKGSRNR

SEQ ID NO: 2626714 - protein, 7 aa, Entamoeba histolytica
IKGTNGL

SEQ ID NO: 2626715 - protein, 39 aa, Entamoeba histolytica
IKGTRTIRDREKKKIEINKNYNQPYKTEKEKKGEENKIE

SEQ ID NO: 2626716 - protein, 9 aa, Entamoeba histolytica
IKGTTKKDK

SEQ ID NO: 2626717 - protein, 10 aa, Entamoeba histolytica
IKHQKTEFNG

SEQ ID NO: 2626718 - protein, 4 aa, Entamoeba histolytica
IKHT

SEQ ID NO: 2626719 - protein, 7 aa, Entamoeba histolytica
IKIDETQ

SEQ ID NO: 2626720 - protein, 11 aa, Entamoeba histolytica
IKIEKDEQFNP

SEQ ID NO: 2626721 - protein, 12 aa, Entamoeba histolytica
IKIKADDGSQFN

SEQ ID NO: 2626722 - protein, 6 aa, Entamoeba histolytica
IKINRS

SEQ ID NO: 2626723 - protein, 11 aa, Entamoeba histolytica
IKIQTKEDQIA

SEQ ID NO: 2626724 - protein, 11 aa, Entamoeba histolytica
IKISNNNDDVI

SEQ ID NO: 2626725 - protein, 12 aa, Entamoeba histolytica
IKITENGKVNNN

SEQ ID NO: 2626726 - protein, 15 aa, Entamoeba histolytica
IKKAGGADYSFNTTS

SEQ ID NO: 2626727 - protein, 23 aa, Entamoeba histolytica
IKKAQEKFEKLGKDAKEQYDEHK

SEQ ID NO: 2626728 - protein, 9 aa, Entamoeba histolytica
IKKASGSGI

SEQ ID NO: 2626729 - protein, 58 aa, Entamoeba histolytica
IKKDEPNQRRQTQKLQSLTEQKKEQSKPQISTKIEKQENNSIKKVEQQPNSKKRAVKN

SEQ ID NO: 2626730 - protein, 13 aa, Entamoeba histolytica
IKKDITNNYAEAK

SEQ ID NO: 2626731 - protein, 33 aa, Entamoeba histolytica
IKKDSDLPQATPQVRTKAKLSKCNSETNLTPAL

SEQ ID NO: 2626732 - protein, 8 aa, Entamoeba histolytica
IKKEDKGS

SEQ ID NO: 2626733 - protein, 11 aa, Entamoeba histolytica
IKKEDKKETIS

SEQ ID NO: 2626734 - protein, 5 aa, Entamoeba histolytica
IKKEE

SEQ ID NO: 2626735 - protein, 15 aa, Entamoeba histolytica
IKKEEDKYEDKQPTM

SEQ ID NO: 2626736 - protein, 8 aa, Entamoeba histolytica
IKKEEEKL

SEQ ID NO: 2626737 - protein, 17 aa, Entamoeba histolytica
IKKEEKKEQEISKPPTL

SEQ ID NO: 2626738 - protein, 8 aa, Entamoeba histolytica
IKKEENPL

SEQ ID NO: 2626739 - protein, 21 aa, Entamoeba histolytica
IKKEGGNKKIKRKNGTNEIQK

SEQ ID NO: 2626740 - protein, 25 aa, Entamoeba histolytica
IKKEISKTQEIQEKQKEQEIEEEED

SEQ ID NO: 2626741 - protein, 9 aa, Entamoeba histolytica
IKKEKEEND

SEQ ID NO: 2626742 - protein, 8 aa, Entamoeba histolytica
IKKEKEGK

SEQ ID NO: 2626743 - protein, 12 aa, Entamoeba histolytica
IKKEKNELYTKN

SEQ ID NO: 2626744 - protein, 5 aa, Entamoeba histolytica
IKKEN

SEQ ID NO: 2626745 - protein, 11 aa, Entamoeba histolytica
IKKENDSLKEN

SEQ ID NO: 2626746 - protein, 15 aa, Entamoeba histolytica
IKKENKKKEEENKEM

SEQ ID NO: 2626747 - protein, 10 aa, Entamoeba histolytica
IKKEREEQEK

SEQ ID NO: 2626748 - protein, 16 aa, Entamoeba histolytica
IKKERKKKLEKRKEQI

SEQ ID NO: 2626749 - protein, 8 aa, Entamoeba histolytica
IKKESENV

SEQ ID NO: 2626750 - protein, 22 aa, Entamoeba histolytica
IKKESKKSKKDEGNDDDDKKKL

SEQ ID NO: 2626751 - protein, 12 aa, Entamoeba histolytica
IKKESNRYDNQK

SEQ ID NO: 2626752 - protein, 24 aa, Entamoeba histolytica
IKKGAKSLKGKNISQLAKGARSSV

SEQ ID NO: 2626753 - protein, 10 aa, Entamoeba histolytica
IKKGEEKAMA

SEQ ID NO: 2626754 - protein, 8 aa, Entamoeba histolytica
IKKGENEF

SEQ ID NO: 2626755 - protein, 9 aa, Entamoeba histolytica
IKKGGDKVE

SEQ ID NO: 2626756 - protein, 24 aa, Entamoeba histolytica
IKKGQSQIDKEIENSIEGKPENTE

SEQ ID NO: 2626757 - protein, 6 aa, Entamoeba histolytica
IKKGSP

SEQ ID NO: 2626758 - protein, 18 aa, Entamoeba histolytica
IKKGTKTIVDDKPKLIKG

SEQ ID NO: 2626759 - protein, 16 aa, Entamoeba histolytica
IKKGTQEESDIVESRE

SEQ ID NO: 2626760 - protein, 7 aa, Entamoeba histolytica
IKKHGNT

SEQ ID NO: 2626761 - protein, 15 aa, Entamoeba histolytica
IKKIGGKVKGYEENI

SEQ ID NO: 2626762 - protein, 17 aa, Entamoeba histolytica
IKKITKEHKATNSAEVE

SEQ ID NO: 2626763 - protein, 10 aa, Entamoeba histolytica
IKKKDEETKI

SEQ ID NO: 2626764 - protein, 9 aa, Entamoeba histolytica
IKKKDKQNL

SEQ ID NO: 2626765 - protein, 9 aa, Entamoeba histolytica
IKKKEDESI

SEQ ID NO: 2626766 - protein, 8 aa, Entamoeba histolytica
IKKKGKIE

SEQ ID NO: 2626767 - protein, 25 aa, Entamoeba histolytica
IKKKGQKKQNGKKEAEAKYKASKET

SEQ ID NO: 2626768 - protein, 13 aa, Entamoeba histolytica
IKKKKTEAIKSKS

SEQ ID NO: 2626769 - protein, 7 aa, Entamoeba histolytica
IKKKQKA

SEQ ID NO: 2626770 - protein, 9 aa, Entamoeba histolytica
IKKNGEGYF

SEQ ID NO: 2626771 - protein, 6 aa, Entamoeba histolytica
IKKNKE

SEQ ID NO: 2626772 - protein, 32 aa, Entamoeba histolytica
IKKNKKRYSSYSTNTKPRKSSEKKAVKRTISP

SEQ ID NO: 2626773 - protein, 7 aa, Entamoeba histolytica
IKKNNSK

SEQ ID NO: 2626774 - protein, 12 aa, Entamoeba histolytica
IKKNQEDKASFL

SEQ ID NO: 2626775 - protein, 6 aa, Entamoeba histolytica
IKKNYK

SEQ ID NO: 2626776 - protein, 22 aa, Entamoeba histolytica
IKKPGKTKQEKMQEKELKERQK

SEQ ID NO: 2626777 - protein, 9 aa, Entamoeba histolytica
IKKPKNEIS

SEQ ID NO: 2626778 - protein, 6 aa, Entamoeba histolytica
IKKPLT

SEQ ID NO: 2626779 - protein, 11 aa, Entamoeba histolytica
IKKQEERKYAK

SEQ ID NO: 2626780 - protein, 9 aa, Entamoeba histolytica
IKKQTDQML

SEQ ID NO: 2626781 - protein, 10 aa, Entamoeba histolytica
IKKRGSELEA

SEQ ID NO: 2626782 - protein, 7 aa, Entamoeba histolytica
IKKRKGY

SEQ ID NO: 2626783 - protein, 8 aa, Entamoeba histolytica
IKKSEELK

SEQ ID NO: 2626784 - protein, 21 aa, Entamoeba histolytica
IKKSESDNKKIRRKNNVNEET

SEQ ID NO: 2626785 - protein, 7 aa, Entamoeba histolytica
IKKSFSE

SEQ ID NO: 2626786 - protein, 12 aa, Entamoeba histolytica
IKKSIERQGEIT

SEQ ID NO: 2626787 - protein, 11 aa, Entamoeba histolytica
IKKSNGSNGNK

SEQ ID NO: 2626788 - protein, 24 aa, Entamoeba histolytica
IKKSNSKTMKTSIQNTGNDDIKKT

SEQ ID NO: 2626789 - protein, 7 aa, Entamoeba histolytica
IKKSTSV

SEQ ID NO: 2626790 - protein, 11 aa, Entamoeba histolytica
IKKSTTSIGES

SEQ ID NO: 2626791 - protein, 12 aa, Entamoeba histolytica
IKKTEWTSTEEE

SEQ ID NO: 2626792 - protein, 14 aa, Entamoeba histolytica
IKKTKSLDDDDNNV

SEQ ID NO: 2626793 - protein, 8 aa, Entamoeba histolytica
IKKTPSVG

SEQ ID NO: 2626794 - protein, 7 aa, Entamoeba histolytica
IKKVGKD

SEQ ID NO: 2626795 - protein, 13 aa, Entamoeba histolytica
IKLKKESGITKDE

SEQ ID NO: 2626796 - protein, 12 aa, Entamoeba histolytica
IKLKTKTRKSGE

SEQ ID NO: 2626797 - protein, 11 aa, Entamoeba histolytica
IKLPNPERQKR

SEQ ID NO: 2626798 - protein, 13 aa, Entamoeba histolytica
IKLSEKKGNSYYK

SEQ ID NO: 2626799 - protein, 14 aa, Entamoeba histolytica
IKMPKMNNKDPQAG

SEQ ID NO: 2626800 - protein, 4 aa, Entamoeba histolytica
IKNA

SEQ ID NO: 2626801 - protein, 7 aa, Entamoeba histolytica
IKNAEEV

SEQ ID NO: 2626802 - protein, 4 aa, Entamoeba histolytica
IKND

SEQ ID NO: 2626803 - protein, 8 aa, Entamoeba histolytica
IKNDEQTL

SEQ ID NO: 2626804 - protein, 10 aa, Entamoeba histolytica
IKNDKGETPF

SEQ ID NO: 2626805 - protein, 7 aa, Entamoeba histolytica
IKNDRET

SEQ ID NO: 2626806 - protein, 5 aa, Entamoeba histolytica
IKNED

SEQ ID NO: 2626807 - protein, 8 aa, Entamoeba histolytica
IKNEDEDD

SEQ ID NO: 2626808 - protein, 8 aa, Entamoeba histolytica
IKNEEDKK

SEQ ID NO: 2626809 - protein, 8 aa, Entamoeba histolytica
IKNEEGKG

SEQ ID NO: 2626810 - protein, 6 aa, Entamoeba histolytica
IKNEEI

SEQ ID NO: 2626811 - protein, 11 aa, Entamoeba histolytica
IKNEEQAKEEY

SEQ ID NO: 2626812 - protein, 10 aa, Entamoeba histolytica
IKNEKTSYEE

SEQ ID NO: 2626813 - protein, 29 aa, Entamoeba histolytica
IKNESRPETPSSCQTDNTKEINEQTSPIG

SEQ ID NO: 2626814 - protein, 13 aa, Entamoeba histolytica
IKNFGDNGLDLVQ

SEQ ID NO: 2626815 - protein, 6 aa, Entamoeba histolytica
IKNGEE

SEQ ID NO: 2626816 - protein, 10 aa, Entamoeba histolytica
IKNGEGYKFN

SEQ ID NO: 2626817 - protein, 7 aa, Entamoeba histolytica
IKNGKDI

SEQ ID NO: 2626818 - protein, 8 aa, Entamoeba histolytica
IKNGPSQL

SEQ ID NO: 2626819 - protein, 8 aa, Entamoeba histolytica
IKNGTEQV

SEQ ID NO: 2626820 - protein, 5 aa, Entamoeba histolytica
IKNIG

SEQ ID NO: 2626821 - protein, 15 aa, Entamoeba histolytica
IKNIQKDELTPPKLN

SEQ ID NO: 2626822 - protein, 9 aa, Entamoeba histolytica
IKNKGGESL

SEQ ID NO: 2626823 - protein, 17 aa, Entamoeba histolytica
IKNKNQLTEAKKQIEER

SEQ ID NO: 2626824 - protein, 4 aa, Entamoeba histolytica
IKNN

SEQ ID NO: 2626825 - protein, 9 aa, Entamoeba histolytica
IKNNEEYNR

SEQ ID NO: 2626826 - protein, 7 aa, Entamoeba histolytica
IKNNEQA

SEQ ID NO: 2626827 - protein, 8 aa, Entamoeba histolytica
IKNNKPDI

SEQ ID NO: 2626828 - protein, 10 aa, Entamoeba histolytica
IKNNNKIEEI

SEQ ID NO: 2626829 - protein, 7 aa, Entamoeba histolytica
IKNNPDA

SEQ ID NO: 2626830 - protein, 10 aa, Entamoeba histolytica
IKNNTDKQDL

SEQ ID NO: 2626831 - protein, 12 aa, Entamoeba histolytica
IKNNTGSENGFN

SEQ ID NO: 2626832 - protein, 7 aa, Entamoeba histolytica
IKNPDDC

SEQ ID NO: 2626833 - protein, 7 aa, Entamoeba histolytica
IKNPGAV

SEQ ID NO: 2626834 - protein, 8 aa, Entamoeba histolytica
IKNPKNAL

SEQ ID NO: 2626835 - protein, 9 aa, Entamoeba histolytica
IKNQEPKHE

SEQ ID NO: 2626836 - protein, 5 aa, Entamoeba histolytica
IKNQI

SEQ ID NO: 2626837 - protein, 16 aa, Entamoeba histolytica
IKNQKEEVKKEKGNLV

SEQ ID NO: 2626838 - protein, 7 aa, Entamoeba histolytica
IKNQSNG

SEQ ID NO: 2626839 - protein, 10 aa, Entamoeba histolytica
IKNSDNDTYG

SEQ ID NO: 2626840 - protein, 29 aa, Entamoeba histolytica
IKNSSLTEDSSINEENSLSADEKSNLDKI

SEQ ID NO: 2626841 - protein, 8 aa, Entamoeba histolytica
IKNSTFSN

SEQ ID NO: 2626842 - protein, 12 aa, Entamoeba histolytica
IKNVNNENEKEV

SEQ ID NO: 2626843 - protein, 20 aa, Entamoeba histolytica
IKNYPKHKLPSSSSKTIPPY

SEQ ID NO: 2626844 - protein, 9 aa, Entamoeba histolytica
IKPADISQD

SEQ ID NO: 2626845 - protein, 5 aa, Entamoeba histolytica
IKPED

SEQ ID NO: 2626846 - protein, 6 aa, Entamoeba histolytica
IKPEEK

SEQ ID NO: 2626847 - protein, 7 aa, Entamoeba histolytica
IKPEGRN

SEQ ID NO: 2626848 - protein, 16 aa, Entamoeba histolytica
IKPGESTTVSTSNGEA

SEQ ID NO: 2626849 - protein, 9 aa, Entamoeba histolytica
IKPINKKDI

SEQ ID NO: 2626850 - protein, 27 aa, Entamoeba histolytica
IKPISDSKVEIDKTPEEQQTPKKSGCA

SEQ ID NO: 2626851 - protein, 6 aa, Entamoeba histolytica
IKPKPK

SEQ ID NO: 2626852 - protein, 22 aa, Entamoeba histolytica
IKPKPSSAEQGSSKKSKKEYEE

SEQ ID NO: 2626853 - protein, 7 aa, Entamoeba histolytica
IKPKTQV

SEQ ID NO: 2626854 - protein, 5 aa, Entamoeba histolytica
IKPKV

SEQ ID NO: 2626855 - protein, 14 aa, Entamoeba histolytica
IKPLANSDITPQLG

SEQ ID NO: 2626856 - protein, 7 aa, Entamoeba histolytica
IKPLSSL

SEQ ID NO: 2626857 - protein, 11 aa, Entamoeba histolytica
IKPNSSSIEEK

SEQ ID NO: 2626858 - protein, 5 aa, Entamoeba histolytica
IKPPK

SEQ ID NO: 2626859 - protein, 6 aa, Entamoeba histolytica
IKPPKG

SEQ ID NO: 2626860 - protein, 19 aa, Entamoeba histolytica
IKPPMTNPSSLNPASQQQI

SEQ ID NO: 2626861 - protein, 28 aa, Entamoeba histolytica
IKPPNDESSGNTLLEDGGDTRDSSFEDT

SEQ ID NO: 2626862 - protein, 7 aa, Entamoeba histolytica
IKPPQIA

SEQ ID NO: 2626863 - protein, 5 aa, Entamoeba histolytica
IKPPR

SEQ ID NO: 2626864 - protein, 4 aa, Entamoeba histolytica
IKPQ

SEQ ID NO: 2626865 - protein, 16 aa, Entamoeba histolytica
IKPQEYSKPPETESQG

SEQ ID NO: 2626866 - protein, 6 aa, Entamoeba histolytica
IKPQVD

SEQ ID NO: 2626867 - protein, 27 aa, Entamoeba histolytica
IKPRKHKGTDKKRRFEAQSKKEQKKPL

SEQ ID NO: 2626868 - protein, 4 aa, Entamoeba histolytica
IKPS

SEQ ID NO: 2626869 - protein, 8 aa, Entamoeba histolytica
IKPSTESL

SEQ ID NO: 2626870 - protein, 12 aa, Entamoeba histolytica
IKPTNKTWDEIN

SEQ ID NO: 2626871 - protein, 6 aa, Entamoeba histolytica
IKPTTS

SEQ ID NO: 2626872 - protein, 16 aa, Entamoeba histolytica
IKQAENKQERVAKEKK

SEQ ID NO: 2626873 - protein, 8 aa, Entamoeba histolytica
IKQANEDS

SEQ ID NO: 2626874 - protein, 8 aa, Entamoeba histolytica
IKQDDKTN

SEQ ID NO: 2626875 - protein, 9 aa, Entamoeba histolytica
IKQDPTNYT

SEQ ID NO: 2626876 - protein, 4 aa, Entamoeba histolytica
IKQE

SEQ ID NO: 2626877 - protein, 23 aa, Entamoeba histolytica
IKQEEENKRKVVENKPLKDKKEW

SEQ ID NO: 2626878 - protein, 26 aa, Entamoeba histolytica
IKQEESKTKKVEVKNTKVKDYDHKHS

SEQ ID NO: 2626879 - protein, 35 aa, Entamoeba histolytica; identical to SEQ ID NO: 2431369

SEQ ID NO: 2626880 - protein, 10 aa, Entamoeba histolytica
IKQELRDADE

SEQ ID NO: 2626881 - protein, 13 aa, Entamoeba histolytica
IKQEREDDGIPVT

SEQ ID NO: 2626882 - protein, 6 aa, Entamoeba histolytica
IKQIET

SEQ ID NO: 2626883 - protein, 9 aa, Entamoeba histolytica
IKQKEAINY

SEQ ID NO: 2626884 - protein, 14 aa, Entamoeba histolytica
IKQKEDTNNTIYQE

SEQ ID NO: 2626885 - protein, 9 aa, Entamoeba histolytica
IKQKGTKSI

SEQ ID NO: 2626886 - protein, 8 aa, Entamoeba histolytica
IKQKRKRK

SEQ ID NO: 2626887 - protein, 99 aa, Entamoeba histolytica
IKQKRLEEVKKKNQITSEKSKTASLSSKQKEPEEIETKKQELDDQAKKIEEEKQRKEKELKLQQEEEKKKREIEKTKQEEEKKKRDEEFKQQKEREENL

SEQ ID NO: 2626888 - protein, 12 aa, Entamoeba histolytica
IKQKSDKEAEEL

SEQ ID NO: 2626889 - protein, 10 aa, Entamoeba histolytica
IKQNKKPKAN

SEQ ID NO: 2626890 - protein, 15 aa, Entamoeba histolytica
IKQNSQNSPNQKDSC

SEQ ID NO: 2626891 - protein, 8 aa, Entamoeba histolytica
IKQNTEQI

SEQ ID NO: 2626892 - protein, 7 aa, Entamoeba histolytica
IKQPKDV

SEQ ID NO: 2626893 - protein, 11 aa, Entamoeba histolytica
IKQPSTQHSIH

SEQ ID NO: 2626894 - protein, 9 aa, Entamoeba histolytica
IKQQNQTDV

SEQ ID NO: 2626895 - protein, 19 aa, Entamoeba histolytica
IKQQQQAQYEALEKERSAR

SEQ ID NO: 2626896 - protein, 15 aa, Entamoeba histolytica
IKQRSEEKVKELKET

SEQ ID NO: 2626897 - protein, 11 aa, Entamoeba histolytica
IKQSGDEKNEL

SEQ ID NO: 2626898 - protein, 7 aa, Entamoeba histolytica
IKQTPEN

SEQ ID NO: 2626899 - protein, 4 aa, Entamoeba histolytica
IKRE

SEQ ID NO: 2626900 - protein, 5 aa, Entamoeba histolytica
IKREE

SEQ ID NO: 2626901 - protein, 11 aa, Entamoeba histolytica
IKRESTNREHL

SEQ ID NO: 2626902 - protein, 9 aa, Entamoeba histolytica
IKRHKNANK

SEQ ID NO: 2626903 - protein, 12 aa, Entamoeba histolytica
IKRKPSQQNIQV

SEQ ID NO: 2626904 - protein, 35 aa, Entamoeba histolytica
IKRKQQEEDNKKKAKEEKERIKEETRRKREEERQR

SEQ ID NO: 2626905 - protein, 4 aa, Entamoeba histolytica
IKRN

SEQ ID NO: 2626906 - protein, 9 aa, Entamoeba histolytica
IKRNEGKEE

SEQ ID NO: 2626907 - protein, 9 aa, Entamoeba histolytica
IKRNPNDHL

SEQ ID NO: 2626908 - protein, 14 aa, Entamoeba histolytica
IKRNTQKKAAAIRR

SEQ ID NO: 2626909 - protein, 9 aa, Entamoeba histolytica
IKRPTENPL

SEQ ID NO: 2626910 - protein, 9 aa, Entamoeba histolytica
IKRQSTKSV

SEQ ID NO: 2626911 - protein, 13 aa, Entamoeba histolytica
IKRRGRKPKTQPI

SEQ ID NO: 2626912 - protein, 13 aa, Entamoeba histolytica
IKRRNETTYLFPH

SEQ ID NO: 2626913 - protein, 5 aa, Entamoeba histolytica
IKRRP

SEQ ID NO: 2626914 - protein, 9 aa, Entamoeba histolytica
IKRSKGKDV

SEQ ID NO: 2626915 - protein, 9 aa, Entamoeba histolytica
IKRSTTTSQ

SEQ ID NO: 2626916 - protein, 14 aa, Entamoeba histolytica
IKRTKNSNRETSLK

SEQ ID NO: 2626917 - protein, 4 aa, Entamoeba histolytica
IKRV

SEQ ID NO: 2626918 - protein, 4 aa, Entamoeba histolytica
IKRY

SEQ ID NO: 2626919 - protein, 14 aa, Entamoeba histolytica
IKSDELKEYQQENK

SEQ ID NO: 2626920 - protein, 8 aa, Entamoeba histolytica
IKSEDEIT

SEQ ID NO: 2626921 - protein, 7 aa, Entamoeba histolytica
IKSEDGS

SEQ ID NO: 2626922 - protein, 7 aa, Entamoeba histolytica
IKSEEKE

SEQ ID NO: 2626923 - protein, 5 aa, Entamoeba histolytica
IKSEF

SEQ ID NO: 2626924 - protein, 13 aa, Entamoeba histolytica
IKSEKSSRKVSEF

SEQ ID NO: 2626925 - protein, 10 aa, Entamoeba histolytica
IKSENIARKV

SEQ ID NO: 2626926 - protein, 9 aa, Entamoeba histolytica
IKSENSRTE

SEQ ID NO: 2626927 - protein, 25 aa, Entamoeba histolytica
IKSEQITKESKEDLPLKTKKIDPDQ

SEQ ID NO: 2626928 - protein, 19 aa, Entamoeba histolytica
IKSERQKIQNSRGTAHRPS

SEQ ID NO: 2626929 - protein, 11 aa, Entamoeba histolytica
IKSEVTDGTSL

SEQ ID NO: 2626930 - protein, 14 aa, Entamoeba histolytica
IKSFGGKTELGYPP

SEQ ID NO: 2626931 - protein, 8 aa, Entamoeba histolytica
IKSFTSKS

SEQ ID NO: 2626932 - protein, 4 aa, Entamoeba histolytica
IKSG

SEQ ID NO: 2626933 - protein, 5 aa, Entamoeba histolytica
IKSGD

SEQ ID NO: 2626934 - protein, 10 aa, Entamoeba histolytica
IKSGEYSDSS

SEQ ID NO: 2626935 - protein, 9 aa, Entamoeba histolytica
IKSGNSGKS

SEQ ID NO: 2626936 - protein, 14 aa, Entamoeba histolytica
IKSKKISEEDKNYL

SEQ ID NO: 2626937 - protein, 17 aa, Entamoeba histolytica
IKSKKISEEDKNYLNET

SEQ ID NO: 2626938 - protein, 18 aa, Entamoeba histolytica
IKSKNEHKPIVTKKESAL

SEQ ID NO: 2626939 - protein, 15 aa, Entamoeba histolytica
IKSKPGKRKQITKEG

SEQ ID NO: 2626940 - protein, 15 aa, Entamoeba histolytica
IKSNEYNTIQQEGNY

SEQ ID NO: 2626941 - protein, 5 aa, Entamoeba histolytica
IKSNG

SEQ ID NO: 2626942 - protein, 9 aa, Entamoeba histolytica
IKSNNINEA

SEQ ID NO: 2626943 - protein, 7 aa, Entamoeba histolytica
IKSNNSQ

SEQ ID NO: 2626944 - protein, 6 aa, Entamoeba histolytica
IKSNPK

SEQ ID NO: 2626945 - protein, 11 aa, Entamoeba histolytica
IKSNSSQGVIK

SEQ ID NO: 2626946 - protein, 5 aa, Entamoeba histolytica
IKSNV

SEQ ID NO: 2626947 - protein, 4 aa, Entamoeba histolytica
IKSP

SEQ ID NO: 2626948 - protein, 5 aa, Entamoeba histolytica
IKSPE

SEQ ID NO: 2626949 - protein, 8 aa, Entamoeba histolytica
IKSPENIS

SEQ ID NO: 2626950 - protein, 18 aa, Entamoeba histolytica
IKSPFDKCNGDVISKQSS

SEQ ID NO: 2626951 - protein, 9 aa, Entamoeba histolytica
IKSPNDRKL

SEQ ID NO: 2626952 - protein, 6 aa, Entamoeba histolytica
IKSPNK

SEQ ID NO: 2626953 - protein, 27 aa, Entamoeba histolytica
IKSPPNEEINNEIKEETKLEVQNQPKK

SEQ ID NO: 2626954 - protein, 57 aa, Entamoeba histolytica
IKSPTQQVKTSLSPVQKQQPSPHQTTTQTCKGENKNQTLQRTSNTPTKQTTECTSPV

SEQ ID NO: 2626955 - protein, 6 aa, Entamoeba histolytica
IKSRDQ

SEQ ID NO: 2626956 - protein, 8 aa, Entamoeba histolytica
IKSRGGLN

SEQ ID NO: 2626957 - protein, 12 aa, Entamoeba histolytica
IKSRISKASSVL

SEQ ID NO: 2626958 - protein, 4 aa, Entamoeba histolytica
IKSS

SEQ ID NO: 2626959 - protein, 19 aa, Entamoeba histolytica
IKSSQPQKPQGGLSSSDNI

SEQ ID NO: 2626960 - protein, 7 aa, Entamoeba histolytica
IKSSSNE

SEQ ID NO: 2626961 - protein, 8 aa, Entamoeba histolytica
IKSSSSEL

SEQ ID NO: 2626962 - protein, 11 aa, Entamoeba histolytica
IKSSTRPVSIG

SEQ ID NO: 2626963 - protein, 14 aa, Entamoeba histolytica
IKSTMTTKPNTTNV

SEQ ID NO: 2626964 - protein, 10 aa, Entamoeba histolytica
IKSTNDNQVL

SEQ ID NO: 2626965 - protein, 10 aa, Entamoeba histolytica
IKSTQESNYP

SEQ ID NO: 2626966 - protein, 22 aa, Entamoeba histolytica
IKSTSENQTTKQLSNKKETMDE

SEQ ID NO: 2626967 - protein, 16 aa, Entamoeba histolytica
IKSVQEQLKGLSENTL

SEQ ID NO: 2626968 - protein, 10 aa, Entamoeba histolytica
IKSYEENTKT

SEQ ID NO: 2626969 - protein, 12 aa, Entamoeba histolytica
IKTAGKKITGIG

SEQ ID NO: 2626970 - protein, 7 aa, Entamoeba histolytica
IKTDDGK

SEQ ID NO: 2626971 - protein, 6 aa, Entamoeba histolytica
IKTDEQ

SEQ ID NO: 2626972 - protein, 5 aa, Entamoeba histolytica
IKTDS

SEQ ID NO: 2626973 - protein, 24 aa, Entamoeba histolytica
IKTEEPSNNKVHEPEKKEEQTDDV

SEQ ID NO: 2626974 - protein, 17 aa, Entamoeba histolytica
IKTEKSSEREEDEEDEE

SEQ ID NO: 2626975 - protein, 9 aa, Entamoeba histolytica
IKTGAPCRS

SEQ ID NO: 2626976 - protein, 6 aa, Entamoeba histolytica
IKTGDY

SEQ ID NO: 2626977 - protein, 7 aa, Entamoeba histolytica
IKTGEVN

SEQ ID NO: 2626978 - protein, 9 aa, Entamoeba histolytica
IKTGGNGNN

SEQ ID NO: 2626979 - protein, 9 aa, Entamoeba histolytica
IKTKDGRKI

SEQ ID NO: 2626980 - protein, 10 aa, Entamoeba histolytica
IKTKEGEDEK

SEQ ID NO: 2626981 - protein, 11 aa, Entamoeba histolytica
IKTKETKEELF

SEQ ID NO: 2626982 - protein, 5 aa, Entamoeba histolytica
IKTKT

SEQ ID NO: 2626983 - protein, 11 aa, Entamoeba histolytica
IKTLDNKTDVK

SEQ ID NO: 2626984 - protein, 7 aa, Entamoeba histolytica
IKTLEEK

SEQ ID NO: 2626985 - protein, 13 aa, Entamoeba histolytica
IKTMEKKEEYDRK

SEQ ID NO: 2626986 - protein, 6 aa, Entamoeba histolytica
IKTPEN

SEQ ID NO: 2626987 - protein, 6 aa, Entamoeba histolytica
IKTPIK

SEQ ID NO: 2626988 - protein, 6 aa, Entamoeba histolytica
IKTPPL

SEQ ID NO: 2626989 - protein, 9 aa, Entamoeba histolytica
IKTPRSIAE

SEQ ID NO: 2626990 - protein, 9 aa, Entamoeba histolytica
IKTPRSSLR

SEQ ID NO: 2626991 - protein, 8 aa, Entamoeba histolytica
IKTQEGQI

SEQ ID NO: 2626992 - protein, 8 aa, Entamoeba histolytica
IKTQKQME

SEQ ID NO: 2626993 - protein, 8 aa, Entamoeba histolytica
IKTRISDE

SEQ ID NO: 2626994 - protein, 14 aa, Entamoeba histolytica
IKTSKQIKDQEQQR

SEQ ID NO: 2626995 - protein, 8 aa, Entamoeba histolytica
IKTSNGNE

SEQ ID NO: 2626996 - protein, 5 aa, Entamoeba histolytica
IKTSS

SEQ ID NO: 2626997 - protein, 11 aa, Entamoeba histolytica
IKTTNSGEVST

SEQ ID NO: 2626998 - protein, 18 aa, Entamoeba histolytica
IKTTPNKGLNHTTQFSSQ

SEQ ID NO: 2626999 - protein, 6 aa, Entamoeba histolytica
IKTTPV

SEQ ID NO: 2627000 - protein, 6 aa, Entamoeba histolytica
IKTTQD

SEQ ID NO: 2627001 - protein, 13 aa, Entamoeba histolytica
IKTTSKQMNNKPD

SEQ ID NO: 2627002 - protein, 5 aa, Entamoeba histolytica
IKTTT

SEQ ID NO: 2627003 - protein, 17 aa, Entamoeba histolytica
IKVESSGGDQDLGGNDF

SEQ ID NO: 2627004 - protein, 10 aa, Entamoeba histolytica
IKVGEKENKT

SEQ ID NO: 2627005 - protein, 6 aa, Entamoeba histolytica
IKVNKQ

SEQ ID NO: 2627006 - protein, 11 aa, Entamoeba histolytica
IKVTGPRGTLT

SEQ ID NO: 2627007 - protein, 6 aa, Entamoeba histolytica
IKVTTT

SEQ ID NO: 2627008 - protein, 8 aa, Entamoeba histolytica
IKYNADEN

SEQ ID NO: 2627009 - protein, 6 aa, Entamoeba histolytica
IKYPER

SEQ ID NO: 2627010 - protein, 21 aa, Entamoeba histolytica
IKYYSSTNSTPRSRCSPRNSI

SEQ ID NO: 2627011 - protein, 6 aa, Entamoeba histolytica
ILAGDR

SEQ ID NO: 2627012 - protein, 5 aa, Entamoeba histolytica
ILDDN

SEQ ID NO: 2627013 - protein, 9 aa, Entamoeba histolytica
ILDSSEPNV

SEQ ID NO: 2627014 - protein, 5 aa, Entamoeba histolytica
ILDTQ

SEQ ID NO: 2627015 - protein, 7 aa, Entamoeba histolytica
ILKEQNE

SEQ ID NO: 2627016 - protein, 13 aa, Entamoeba histolytica
ILKRGTKRHPTVG

SEQ ID NO: 2627017 - protein, 11 aa, Entamoeba histolytica
ILNGNGKKQKV

SEQ ID NO: 2627018 - protein, 8 aa, Entamoeba histolytica
ILNKETSK

SEQ ID NO: 2627019 - protein, 4 aa, Entamoeba histolytica
ILPE

SEQ ID NO: 2627020 - protein, 12 aa, Entamoeba histolytica
ILPSSGGNAQHA

SEQ ID NO: 2627021 - protein, 9 aa, Entamoeba histolytica
ILPSSSKTF

SEQ ID NO: 2627022 - protein, 10 aa, Entamoeba histolytica
ILSDNEARTN

SEQ ID NO: 2627023 - protein, 11 aa, Entamoeba histolytica
ILSEKKNNLDD

SEQ ID NO: 2627024 - protein, 5 aa, Entamoeba histolytica
ILSSE

SEQ ID NO: 2627025 - protein, 13 aa, Entamoeba histolytica
IMGTGSDVDGKEI

SEQ ID NO: 2627026 - protein, 12 aa, Entamoeba histolytica
IMNGSKQVDTIQ

SEQ ID NO: 2627027 - protein, 11 aa, Entamoeba histolytica
IMSRGEINTKK

SEQ ID NO: 2627028 - protein, 10 aa, Entamoeba histolytica
INAEDMTTKE

SEQ ID NO: 2627029 - protein, 5 aa, Entamoeba histolytica
INAET

SEQ ID NO: 2627030 - protein, 11 aa, Entamoeba histolytica
INAKDEDYHKH

SEQ ID NO: 2627031 - protein, 10 aa, Entamoeba histolytica
INAQSKEQGF

SEQ ID NO: 2627032 - protein, 8 aa, Entamoeba histolytica
INAQTAPK

SEQ ID NO: 2627033 - protein, 10 aa, Entamoeba histolytica
INARTESQKA

SEQ ID NO: 2627034 - protein, 12 aa, Entamoeba histolytica
INATNKPKEMDD

SEQ ID NO: 2627035 - protein, 15 aa, Entamoeba histolytica
INATSLSFNSLIDLL

SEQ ID NO: 2627036 - protein, 10 aa, Entamoeba histolytica
INDAGKSIYR

SEQ ID NO: 2627037 - protein, 26 aa, Entamoeba histolytica
INDAINKEHQKNEKIQIETDEQISSQ

SEQ ID NO: 2627038 - protein, 10 aa, Entamoeba histolytica
INDDDKEYIQ

SEQ ID NO: 2627039 - protein, 5 aa, Entamoeba histolytica
INDDE

SEQ ID NO: 2627040 - protein, 5 aa, Entamoeba histolytica
INDEE

SEQ ID NO: 2627041 - protein, 9 aa, Entamoeba histolytica
INDESRNNI

SEQ ID NO: 2627042 - protein, 12 aa, Entamoeba histolytica
INDFSANDSARN

SEQ ID NO: 2627043 - protein, 6 aa, Entamoeba histolytica
INDKDT

SEQ ID NO: 2627044 - protein, 6 aa, Entamoeba histolytica
INDKGT

SEQ ID NO: 2627045 - protein, 9 aa, Entamoeba histolytica
INDKQEKIE

SEQ ID NO: 2627046 - protein, 9 aa, Entamoeba histolytica
INDKRTNIF

SEQ ID NO: 2627047 - protein, 9 aa, Entamoeba histolytica
INDKSADPV

SEQ ID NO: 2627048 - protein, 5 aa, Entamoeba histolytica
INDLN

SEQ ID NO: 2627049 - protein, 6 aa, Entamoeba histolytica
INDNIG

SEQ ID NO: 2627050 - protein, 16 aa, Entamoeba histolytica
INDNSNGNKGKNRNKI

SEQ ID NO: 2627051 - protein, 24 aa, Entamoeba histolytica
INDNTPSQSPRIPEISNEEYNKEF

SEQ ID NO: 2627052 - protein, 9 aa, Entamoeba histolytica
INDPSIPMN

SEQ ID NO: 2627053 - protein, 8 aa, Entamoeba histolytica
INDQQHQE

SEQ ID NO: 2627054 - protein, 11 aa, Entamoeba histolytica
INDRDGDNSPC

SEQ ID NO: 2627055 - protein, 24 aa, Entamoeba histolytica
INDSNTFIKDSKDEKKAEQANKAI

SEQ ID NO: 2627056 - protein, 7 aa, Entamoeba histolytica
INDSSNL

SEQ ID NO: 2627057 - protein, 7 aa, Entamoeba histolytica
INDTEGI

SEQ ID NO: 2627058 - protein, 9 aa, Entamoeba histolytica
INEDKGEMS

SEQ ID NO: 2627059 - protein, 16 aa, Entamoeba histolytica
INEDLNKQIKSTENIK

SEQ ID NO: 2627060 - protein, 11 aa, Entamoeba histolytica
INEDPKNKSKG

SEQ ID NO: 2627061 - protein, 6 aa, Entamoeba histolytica
INEDSI

SEQ ID NO: 2627062 - protein, 22 aa, Entamoeba histolytica
INEDSIKEGEEENSNDEDNNTN

SEQ ID NO: 2627063 - protein, 4 aa, Entamoeba histolytica
INEE

SEQ ID NO: 2627064 - protein, 6 aa, Entamoeba histolytica
INEEAT

SEQ ID NO: 2627065 - protein, 31 aa, Entamoeba histolytica
INEEIKKKEEDNNKKEIETKPKKERPQVGVS

SEQ ID NO: 2627066 - protein, 25 aa, Entamoeba histolytica
INEEKNQLQNDYDTVQQEKENIQKE

SEQ ID NO: 2627067 - protein, 18 aa, Entamoeba histolytica
INEEKSSDHKRKNKNLEE

SEQ ID NO: 2627068 - protein, 14 aa, Entamoeba histolytica
INEELKEESEENDM

SEQ ID NO: 2627069 - protein, 6 aa, Entamoeba histolytica
INEENS

SEQ ID NO: 2627070 - protein, 38 aa, Entamoeba histolytica
INEEPKQETKTEMGKVDHQEETTETKQNNQIKRQSSEL

SEQ ID NO: 2627071 - protein, 33 aa, Entamoeba histolytica
INEESQLSSSQSNKDENDLYNQEESESSDDEFR

SEQ ID NO: 2627072 - protein, 9 aa, Entamoeba histolytica
INEGETKEI

SEQ ID NO: 2627073 - protein, 6 aa, Entamoeba histolytica
INEGKD

SEQ ID NO: 2627074 - protein, 11 aa, Entamoeba histolytica
INEHPKDDIYE

SEQ ID NO: 2627075 - protein, 33 aa, Entamoeba histolytica
INEKEKEEITFKQSSEDDSKMECEEQDKTNGFG

SEQ ID NO: 2627076 - protein, 7 aa, Entamoeba histolytica
INEKETN

SEQ ID NO: 2627077 - protein, 8 aa, Entamoeba histolytica
INEKGGYY

SEQ ID NO: 2627078 - protein, 8 aa, Entamoeba histolytica
INEKGKEH

SEQ ID NO: 2627079 - protein, 12 aa, Entamoeba histolytica
INEKKEKKIDEF

SEQ ID NO: 2627080 - protein, 5 aa, Entamoeba histolytica
INEKW

SEQ ID NO: 2627081 - protein, 4 aa, Entamoeba histolytica
INEN

SEQ ID NO: 2627082 - protein, 15 aa, Entamoeba histolytica
INENDKNTSLKTTRK

SEQ ID NO: 2627083 - protein, 8 aa, Entamoeba histolytica
INENGDTP

SEQ ID NO: 2627084 - protein, 9 aa, Entamoeba histolytica
INENKEAKE

SEQ ID NO: 2627085 - protein, 5 aa, Entamoeba histolytica
INENN

SEQ ID NO: 2627086 - protein, 11 aa, Entamoeba histolytica
INENTEKGNKI

SEQ ID NO: 2627087 - protein, 7 aa, Entamoeba histolytica
INENTKK

SEQ ID NO: 2627088 - protein, 6 aa, Entamoeba histolytica
INEPKF

SEQ ID NO: 2627089 - protein, 11 aa, Entamoeba histolytica
INEPNSQEQYE

SEQ ID NO: 2627090 - protein, 7 aa, Entamoeba histolytica
INEQGEL

SEQ ID NO: 2627091 - protein, 7 aa, Entamoeba histolytica
INEQRKD

SEQ ID NO: 2627092 - protein, 7 aa, Entamoeba histolytica
INEQSQL

SEQ ID NO: 2627093 - protein, 18 aa, Entamoeba histolytica
INERKSGSIEKRSHDIKT

SEQ ID NO: 2627094 - protein, 13 aa, Entamoeba histolytica
INERNQRNTKEYN

SEQ ID NO: 2627095 - protein, 15 aa, Entamoeba histolytica
INESDEDEYQIKRKL

SEQ ID NO: 2627096 - protein, 9 aa, Entamoeba histolytica
INESESKKY

SEQ ID NO: 2627097 - protein, 8 aa, Entamoeba histolytica
INESHTSK

SEQ ID NO: 2627098 - protein, 7 aa, Entamoeba histolytica
INESKAK

SEQ ID NO: 2627099 - protein, 12 aa, Entamoeba histolytica
INESLDENDEEI

SEQ ID NO: 2627100 - protein, 15 aa, Entamoeba histolytica
INESNDDKTIEERAV

SEQ ID NO: 2627101 - protein, 9 aa, Entamoeba histolytica
INESPSRLK

SEQ ID NO: 2627102 - protein, 11 aa, Entamoeba histolytica
INESQKINNEQ

SEQ ID NO: 2627103 - protein, 19 aa, Entamoeba histolytica
INESSLTNKLYDKEEQTIY

SEQ ID NO: 2627104 - protein, 5 aa, Entamoeba histolytica
INEST

SEQ ID NO: 2627105 - protein, 7 aa, Entamoeba histolytica
INETEVK

SEQ ID NO: 2627106 - protein, 20 aa, Entamoeba histolytica
INETGRKINTKTETDESERI

SEQ ID NO: 2627107 - protein, 14 aa, Entamoeba histolytica
INETIKQKNERYKE

SEQ ID NO: 2627108 - protein, 6 aa, Entamoeba histolytica
INETLK

SEQ ID NO: 2627109 - protein, 12 aa, Entamoeba histolytica
INETNKNEFQGK

SEQ ID NO: 2627110 - protein, 7 aa, Entamoeba histolytica
INETPKV

SEQ ID NO: 2627111 - protein, 18 aa, Entamoeba histolytica
INETTNKAFNSNEKNEKL

SEQ ID NO: 2627112 - protein, 28 aa, Entamoeba histolytica
INEYEDKKFKEETIKRREKKKEEAEKRR

SEQ ID NO: 2627113 - protein, 11 aa, Entamoeba histolytica
INGAAKGARAI

SEQ ID NO: 2627114 - protein, 9 aa, Entamoeba histolytica
INGADSHSS

SEQ ID NO: 2627115 - protein, 5 aa, Entamoeba histolytica
INGDG

SEQ ID NO: 2627116 - protein, 50 aa, Entamoeba histolytica
INGDTASYTSASMNTETKSVSQSCANTDTVSVTSLDKTEKETKKESKFRR

SEQ ID NO: 2627117 - protein, 4 aa, Entamoeba histolytica
INGE

SEQ ID NO: 2627118 - protein, 6 aa, Entamoeba histolytica
INGERT

SEQ ID NO: 2627119 - protein, 7 aa, Entamoeba histolytica
INGESGY

SEQ ID NO: 2627120 - protein, 13 aa, Entamoeba histolytica
INGESVKTQENES

SEQ ID NO: 2627121 - protein, 6 aa, Entamoeba histolytica
INGETP

SEQ ID NO: 2627122 - protein, 5 aa, Entamoeba histolytica
INGFE

SEQ ID NO: 2627123 - protein, 6 aa, Entamoeba histolytica
INGFNK

SEQ ID NO: 2627124 - protein, 7 aa, Entamoeba histolytica
INGIEKD

SEQ ID NO: 2627125 - protein, 9 aa, Entamoeba histolytica
INGKEGHEL

SEQ ID NO: 2627126 - protein, 12 aa, Entamoeba histolytica
INGKNQNLTNQN

SEQ ID NO: 2627127 - protein, 7 aa, Entamoeba histolytica
INGKNYN

SEQ ID NO: 2627128 - protein, 12 aa, Entamoeba histolytica
INGNEEKKEAIE

SEQ ID NO: 2627129 - protein, 12 aa, Entamoeba histolytica
INGNEGNELKYR

SEQ ID NO: 2627130 - protein, 18 aa, Entamoeba histolytica
INGNEGNELKYRGANLSS

SEQ ID NO: 2627131 - protein, 6 aa, Entamoeba histolytica
INGNES

SEQ ID NO: 2627132 - protein, 7 aa, Entamoeba histolytica
INGNGNN

SEQ ID NO: 2627133 - protein, 5 aa, Entamoeba histolytica
INGPE

SEQ ID NO: 2627134 - protein, 6 aa, Entamoeba histolytica
INGPLS

SEQ ID NO: 2627135 - protein, 4 aa, Entamoeba histolytica
INGQ

SEQ ID NO: 2627136 - protein, 4 aa, Entamoeba histolytica
INGR

SEQ ID NO: 2627137 - protein, 8 aa, Entamoeba histolytica
INGSNGEG

SEQ ID NO: 2627138 - protein, 6 aa, Entamoeba histolytica
INGSQI

SEQ ID NO: 2627139 - protein, 9 aa, Entamoeba histolytica
INGSQINTQ

SEQ ID NO: 2627140 - protein, 4 aa, Entamoeba histolytica
INGT

SEQ ID NO: 2627141 - protein, 6 aa, Entamoeba histolytica
INGTAT

SEQ ID NO: 2627142 - protein, 5 aa, Entamoeba histolytica
INGTP

SEQ ID NO: 2627143 - protein, 6 aa, Entamoeba histolytica
INGYGK

SEQ ID NO: 2627144 - protein, 10 aa, Entamoeba histolytica
INHNTKDSPQ

SEQ ID NO: 2627145 - protein, 14 aa, Entamoeba histolytica
INHPEASQKRESIA

SEQ ID NO: 2627146 - protein, 6 aa, Entamoeba histolytica
INHPNS

SEQ ID NO: 2627147 - protein, 6 aa, Entamoeba histolytica
INIGGR

SEQ ID NO: 2627148 - protein, 6 aa, Entamoeba histolytica
INIPPS

SEQ ID NO: 2627149 - protein, 11 aa, Entamoeba histolytica
INIPTSVSKIG

SEQ ID NO: 2627150 - protein, 14 aa, Entamoeba histolytica
INIPTSVSKLGYEC

SEQ ID NO: 2627151 - protein, 4 aa, Entamoeba histolytica
INIS

SEQ ID NO: 2627152 - protein, 12 aa, Entamoeba histolytica
INISNNAPSPVP

SEQ ID NO: 2627153 - protein, 4 aa, Entamoeba histolytica
INKD

SEQ ID NO: 2627154 - protein, 11 aa, Entamoeba histolytica
INKDGKLQPDI

SEQ ID NO: 2627155 - protein, 27 aa, Entamoeba histolytica
INKDPSETENDSKDMSQEEKDYDPIKE

SEQ ID NO: 2627156 - protein, 9 aa, Entamoeba histolytica
INKEKEVLK

SEQ ID NO: 2627157 - protein, 22 aa, Entamoeba histolytica
INKEKTKEGYETIRKDNECQNQ

SEQ ID NO: 2627158 - protein, 11 aa, Entamoeba histolytica
INKEPNQAIKN

SEQ ID NO: 2627159 - protein, 7 aa, Entamoeba histolytica
INKEQEE

SEQ ID NO: 2627160 - protein, 7 aa, Entamoeba histolytica
INKETTA

SEQ ID NO: 2627161 - protein, 41 aa, Entamoeba histolytica
INKGNDIRKEESERIKENTENVEIKENTEKKEEEYKENTEF

SEQ ID NO: 2627162 - protein, 11 aa, Entamoeba histolytica
INKGNDNEEIR

SEQ ID NO: 2627163 - protein, 11 aa, Entamoeba histolytica
INKKEINKEGF

SEQ ID NO: 2627164 - protein, 6 aa, Entamoeba histolytica
INKKHS

SEQ ID NO: 2627165 - protein, 7 aa, Entamoeba histolytica
INKLPQT

SEQ ID NO: 2627166 - protein, 12 aa, Entamoeba histolytica
INKNKRLREREA

SEQ ID NO: 2627167 - protein, 7 aa, Entamoeba histolytica
INKNKTP

SEQ ID NO: 2627168 - protein, 4 aa, Entamoeba histolytica
INKP

SEQ ID NO: 2627169 - protein, 7 aa, Entamoeba histolytica
INKPADT

SEQ ID NO: 2627170 - protein, 11 aa, Entamoeba histolytica
INKPPPAKAPV

SEQ ID NO: 2627171 - protein, 19 aa, Entamoeba histolytica
INKQKRYHKGSIEYSGLAE

SEQ ID NO: 2627172 - protein, 5 aa, Entamoeba histolytica
INKQR

SEQ ID NO: 2627173 - protein, 5 aa, Entamoeba histolytica
INKQS

SEQ ID NO: 2627174 - protein, 12 aa, Entamoeba histolytica
INKQTDTNNEEL

SEQ ID NO: 2627175 - protein, 9 aa, Entamoeba histolytica
INKQTTPQL

SEQ ID NO: 2627176 - protein, 7 aa, Entamoeba histolytica
INKRKTS

SEQ ID NO: 2627177 - protein, 7 aa, Entamoeba histolytica
INKRNGN

SEQ ID NO: 2627178 - protein, 20 aa, Entamoeba histolytica
INKTEDNGKKKKKEKIDEEN

SEQ ID NO: 2627179 - protein, 21 aa, Entamoeba histolytica
INKTGKMRTTPMSDHEQHVRM

SEQ ID NO: 2627180 - protein, 5 aa, Entamoeba histolytica
INKTI

SEQ ID NO: 2627181 - protein, 8 aa, Entamoeba histolytica
INKTSPKM

SEQ ID NO: 2627182 - protein, 9 aa, Entamoeba histolytica
INKYSAEDV

SEQ ID NO: 2627183 - protein, 4 aa, Entamoeba histolytica
INLP

SEQ ID NO: 2627184 - protein, 8 aa, Entamoeba histolytica
INLPPEES

SEQ ID NO: 2627185 - protein, 4 aa, Entamoeba histolytica
INLQ

SEQ ID NO: 2627186 - protein, 7 aa, Entamoeba histolytica
INNDKKS

SEQ ID NO: 2627187 - protein, 9 aa, Entamoeba histolytica
INNDPTNEL

SEQ ID NO: 2627188 - protein, 6 aa, Entamoeba histolytica
INNEEN

SEQ ID NO: 2627189 - protein, 15 aa, Entamoeba histolytica
INNEKEQLNQECNEL

SEQ ID NO: 2627190 - protein, 8 aa, Entamoeba histolytica
INNEKNQM

SEQ ID NO: 2627191 - protein, 12 aa, Entamoeba histolytica
INNENHQEMEES

SEQ ID NO: 2627192 - protein, 8 aa, Entamoeba histolytica
INNGSREL

SEQ ID NO: 2627193 - protein, 6 aa, Entamoeba histolytica
INNKDT

SEQ ID NO: 2627194 - protein, 8 aa, Entamoeba histolytica
INNKETTQ

SEQ ID NO: 2627195 - protein, 10 aa, Entamoeba histolytica
INNKGKSQER

SEQ ID NO: 2627196 - protein, 4 aa, Entamoeba histolytica
INNL

SEQ ID NO: 2627197 - protein, 5 aa, Entamoeba histolytica
INNLP

SEQ ID NO: 2627198 - protein, 8 aa, Entamoeba histolytica
INNNEREM

SEQ ID NO: 2627199 - protein, 31 aa, Entamoeba histolytica
INNNNPKDEQKDEQKDVENQYETSEQQTTNI

SEQ ID NO: 2627200 - protein, 4 aa, Entamoeba histolytica
INNP

SEQ ID NO: 2627201 - protein, 19 aa, Entamoeba histolytica
INNPQNELTKSKIEPNTFK

SEQ ID NO: 2627202 - protein, 29 aa, Entamoeba histolytica
INNPQPQSAAQPNAFASYSPQVNSPNQHL

SEQ ID NO: 2627203 - protein, 5 aa, Entamoeba histolytica
INNQK

SEQ ID NO: 2627204 - protein, 14 aa, Entamoeba histolytica
INNQKRNKPNNTGL

SEQ ID NO: 2627205 - protein, 6 aa, Entamoeba histolytica
INNQNE

SEQ ID NO: 2627206 - protein, 11 aa, Entamoeba histolytica
INNQQSNGFGG

SEQ ID NO: 2627207 - protein, 5 aa, Entamoeba histolytica
INNQR

SEQ ID NO: 2627208 - protein, 5 aa, Entamoeba histolytica
INNQS

SEQ ID NO: 2627209 - protein, 10 aa, Entamoeba histolytica
INNQTKPNEV

SEQ ID NO: 2627210 - protein, 6 aa, Entamoeba histolytica
INNRSA

SEQ ID NO: 2627211 - protein, 6 aa, Entamoeba histolytica
INNSIN

SEQ ID NO: 2627212 - protein, 10 aa, Entamoeba histolytica
INNSTQRQSI

SEQ ID NO: 2627213 - protein, 8 aa, Entamoeba histolytica
INNTGSHQ

SEQ ID NO: 2627214 - protein, 20 aa, Entamoeba histolytica
INNTPGEVNKESEKLSKEDI

SEQ ID NO: 2627215 - protein, 4 aa, Entamoeba histolytica
INNV

SEQ ID NO: 2627216 - protein, 12 aa, Entamoeba histolytica
INNYNKGIDYDS

SEQ ID NO: 2627217 - protein, 7 aa, Entamoeba histolytica
INPDANE

SEQ ID NO: 2627218 - protein, 16 aa, Entamoeba histolytica
INPDELSQNYKKKRTL

SEQ ID NO: 2627219 - protein, 6 aa, Entamoeba histolytica
INPDKP

SEQ ID NO: 2627220 - protein, 4 aa, Entamoeba histolytica
INPE

SEQ ID NO: 2627221 - protein, 8 aa, Entamoeba histolytica
INPEEQSI

SEQ ID NO: 2627222 - protein, 10 aa, Entamoeba histolytica
INPGVTPLPS

SEQ ID NO: 2627223 - protein, 7 aa, Entamoeba histolytica
INPKEIA

SEQ ID NO: 2627224 - protein, 9 aa, Entamoeba histolytica
INPKTGEIE

SEQ ID NO: 2627225 - protein, 4 aa, Entamoeba histolytica
INPN

SEQ ID NO: 2627226 - protein, 5 aa, Entamoeba histolytica
INPNF

SEQ ID NO: 2627227 - protein, 9 aa, Entamoeba histolytica
INPNQQPSL

SEQ ID NO: 2627228 - protein, 6 aa, Entamoeba histolytica
INPNSS

SEQ ID NO: 2627229 - protein, 5 aa, Entamoeba histolytica
INPPL

SEQ ID NO: 2627230 - protein, 5 aa, Entamoeba histolytica
INPQE

SEQ ID NO: 2627231 - protein, 10 aa, Entamoeba histolytica
INPQEESTQL

SEQ ID NO: 2627232 - protein, 14 aa, Entamoeba histolytica
INPQSDSYISSTEN

SEQ ID NO: 2627233 - protein, 6 aa, Entamoeba histolytica
INPRPE

SEQ ID NO: 2627234 - protein, 7 aa, Entamoeba histolytica
INPSNVS

SEQ ID NO: 2627235 - protein, 9 aa, Entamoeba histolytica
INPSRKATE

SEQ ID NO: 2627236 - protein, 7 aa, Entamoeba histolytica
INPSRLS

SEQ ID NO: 2627237 - protein, 14 aa, Entamoeba histolytica
INPSVSKDSSSLNE

SEQ ID NO: 2627238 - protein, 6 aa, Entamoeba histolytica
INPTDA

SEQ ID NO: 2627239 - protein, 9 aa, Entamoeba histolytica
INPTVTDDW

SEQ ID NO: 2627240 - protein, 6 aa, Entamoeba histolytica
INQDNK

SEQ ID NO: 2627241 - protein, 5 aa, Entamoeba histolytica
INQHT

SEQ ID NO: 2627242 - protein, 18 aa, Entamoeba histolytica
INQKGRNVKTLSGGERSF

SEQ ID NO: 2627243 - protein, 4 aa, Entamoeba histolytica
INQL

SEQ ID NO: 2627244 - protein, 19 aa, Entamoeba histolytica
INQNKEEEKRHSQEENQIN

SEQ ID NO: 2627245 - protein, 6 aa, Entamoeba histolytica
INQNQE

SEQ ID NO: 2627246 - protein, 7 aa, Entamoeba histolytica
INQNTGD

SEQ ID NO: 2627247 - protein, 15 aa, Entamoeba histolytica
INQPPIEPISTTINN

SEQ ID NO: 2627248 - protein, 5 aa, Entamoeba histolytica
INQPT

SEQ ID NO: 2627249 - protein, 7 aa, Entamoeba histolytica
INQQETT

SEQ ID NO: 2627250 - protein, 12 aa, Entamoeba histolytica
INQQNQKISLQQ

SEQ ID NO: 2627251 - protein, 6 aa, Entamoeba histolytica
INQRTG

SEQ ID NO: 2627252 - protein, 8 aa, Entamoeba histolytica
INQRTPCN

SEQ ID NO: 2627253 - protein, 22 aa, Entamoeba histolytica
INQSKPGCNTYSKITRLLVIQF

SEQ ID NO: 2627254 - protein, 10 aa, Entamoeba histolytica
INQSSKKKIF

SEQ ID NO: 2627255 - protein, 39 aa, Entamoeba histolytica
INQTDDFKRTTQINKKHSLTHSSLENTETQPQNIETTTV

SEQ ID NO: 2627256 - protein, 18 aa, Entamoeba histolytica
INQTSKSTPVTPELPNSY

SEQ ID NO: 2627257 - protein, 8 aa, Entamoeba histolytica
INQVSPDV

SEQ ID NO: 2627258 - protein, 10 aa, Entamoeba histolytica
INRENDEDIN

SEQ ID NO: 2627259 - protein, 4 aa, Entamoeba histolytica
INRG

SEQ ID NO: 2627260 - protein, 10 aa, Entamoeba histolytica
INRKSTSLPR

SEQ ID NO: 2627261 - protein, 6 aa, Entamoeba histolytica
INRNDM

SEQ ID NO: 2627262 - protein, 9 aa, Entamoeba histolytica
INRNEIKQR

SEQ ID NO: 2627263 - protein, 10 aa, Entamoeba histolytica
INRNEIKTTK

SEQ ID NO: 2627264 - protein, 4 aa, Entamoeba histolytica
INRS

SEQ ID NO: 2627265 - protein, 17 aa, Entamoeba histolytica
INRTQSTKIITSPQSVD

SEQ ID NO: 2627266 - protein, 17 aa, Entamoeba histolytica
INRTQSTKIVTSPQSVD

SEQ ID NO: 2627267 - protein, 7 aa, Entamoeba histolytica
INSDEDD

SEQ ID NO: 2627268 - protein, 8 aa, Entamoeba histolytica
INSDEEGA

SEQ ID NO: 2627269 - protein, 4 aa, Entamoeba histolytica
INSE

SEQ ID NO: 2627270 - protein, 10 aa, Entamoeba histolytica
INSEGGTTDF

SEQ ID NO: 2627271 - protein, 10 aa, Entamoeba histolytica
INSENEKAYV

SEQ ID NO: 2627272 - protein, 16 aa, Entamoeba histolytica
INSESEKIGQKHLETA

SEQ ID NO: 2627273 - protein, 7 aa, Entamoeba histolytica
INSIESE

SEQ ID NO: 2627274 - protein, 12 aa, Entamoeba histolytica
INSINNKSLSDN

SEQ ID NO: 2627275 - protein, 4 aa, Entamoeba histolytica
INSK

SEQ ID NO: 2627276 - protein, 11 aa, Entamoeba histolytica
INSKEKEKTTL

SEQ ID NO: 2627277 - protein, 11 aa, Entamoeba histolytica
INSKGKAVTYN

SEQ ID NO: 2627278 - protein, 9 aa, Entamoeba histolytica
INSKKKELK

SEQ ID NO: 2627279 - protein, 17 aa, Entamoeba histolytica
INSKPNSNISSPHKNTI

SEQ ID NO: 2627280 - protein, 4 aa, Entamoeba histolytica
INSN

SEQ ID NO: 2627281 - protein, 15 aa, Entamoeba histolytica
INSNDTAVVAAGKDN

SEQ ID NO: 2627282 - protein, 12 aa, Entamoeba histolytica
INSNETLQDEEI

SEQ ID NO: 2627283 - protein, 10 aa, Entamoeba histolytica
INSNGENTVA

SEQ ID NO: 2627284 - protein, 5 aa, Entamoeba histolytica
INSNI

SEQ ID NO: 2627285 - protein, 16 aa, Entamoeba histolytica
INSNKLKKNSISNSQN

SEQ ID NO: 2627286 - protein, 7 aa, Entamoeba histolytica
INSNSNV

SEQ ID NO: 2627287 - protein, 7 aa, Entamoeba histolytica
INSNSQR

SEQ ID NO: 2627288 - protein, 5 aa, Entamoeba histolytica
INSNY

SEQ ID NO: 2627289 - protein, 6 aa, Entamoeba histolytica
INSPFP

SEQ ID NO: 2627290 - protein, 20 aa, Entamoeba histolytica
INSQHNTTPIPTVKSSHSIR

SEQ ID NO: 2627291 - protein, 6 aa, Entamoeba histolytica
INSQNA

SEQ ID NO: 2627292 - protein, 10 aa, Entamoeba histolytica
INSRKEECAD

SEQ ID NO: 2627293 - protein, 7 aa, Entamoeba histolytica
INSSLRN

SEQ ID NO: 2627294 - protein, 18 aa, Entamoeba histolytica
INSSNGNKKPDHAHHCSL

SEQ ID NO: 2627295 - protein, 9 aa, Entamoeba histolytica
INSSPSSET

SEQ ID NO: 2627296 - protein, 16 aa, Entamoeba histolytica
INSSRKEKKQHVTGSS

SEQ ID NO: 2627297 - protein, 10 aa, Entamoeba histolytica
INSSTSEKDI

SEQ ID NO: 2627298 - protein, 6 aa, Entamoeba histolytica
INSSTT

SEQ ID NO: 2627299 - protein, 13 aa, Entamoeba histolytica
INSTFKNDMKEPN

SEQ ID NO: 2627300 - protein, 7 aa, Entamoeba histolytica
INSTGTF

SEQ ID NO: 2627301 - protein, 7 aa, Entamoeba histolytica
INSTNKL

SEQ ID NO: 2627302 - protein, 9 aa, Entamoeba histolytica
INSTPNLLP

SEQ ID NO: 2627303 - protein, 7 aa, Entamoeba histolytica
INSTTNK

SEQ ID NO: 2627304 - protein, 11 aa, Entamoeba histolytica
INSTTNSKNTV

SEQ ID NO: 2627305 - protein, 11 aa, Entamoeba histolytica
INSYTNGKVEN

SEQ ID NO: 2627306 - protein, 4 aa, Entamoeba histolytica
INTE

SEQ ID NO: 2627307 - protein, 16 aa, Entamoeba histolytica
INTEEKEEKMEEDKDV

SEQ ID NO: 2627308 - protein, 18 aa, Entamoeba histolytica
INTEQVGQTKRDNEESKM

SEQ ID NO: 2627309 - protein, 9 aa, Entamoeba histolytica
INTETKNDT

SEQ ID NO: 2627310 - protein, 4 aa, Entamoeba histolytica
INTG

SEQ ID NO: 2627311 - protein, 8 aa, Entamoeba histolytica
INTGEREP

SEQ ID NO: 2627312 - protein, 4 aa, Entamoeba histolytica
INTI

SEQ ID NO: 2627313 - protein, 8 aa, Entamoeba histolytica
INTIPKGI

SEQ ID NO: 2627314 - protein, 4 aa, Entamoeba histolytica
INTK

SEQ ID NO: 2627315 - protein, 7 aa, Entamoeba histolytica
INTKEDY

SEQ ID NO: 2627316 - protein, 16 aa, Entamoeba histolytica
INTKEGETVEGKTHEE

SEQ ID NO: 2627317 - protein, 15 aa, Entamoeba histolytica
INTNNRSQQSHSPRS

SEQ ID NO: 2627318 - protein, 7 aa, Entamoeba histolytica
INTQGKR

SEQ ID NO: 2627319 - protein, 9 aa, Entamoeba histolytica
INTRKERGF

SEQ ID NO: 2627320 - protein, 12 aa, Entamoeba histolytica
INTRNNTNSIQE

SEQ ID NO: 2627321 - protein, 24 aa, Entamoeba histolytica
INTSISQQQIKPQPTNVPLFDFTL

SEQ ID NO: 2627322 - protein, 7 aa, Entamoeba histolytica
INTSNIP

SEQ ID NO: 2627323 - protein, 11 aa, Entamoeba histolytica
INTSQTLRNEN

SEQ ID NO: 2627324 - protein, 4 aa, Entamoeba histolytica
INTT

SEQ ID NO: 2627325 - protein, 10 aa, Entamoeba histolytica
INTTNSLQST

SEQ ID NO: 2627326 - protein, 4 aa, Entamoeba histolytica
INTV

SEQ ID NO: 2627327 - protein, 39 aa, Entamoeba histolytica
INTVEENQIKNEAEIKELKEEKNQIIDSNEKKEKKSKIP

SEQ ID NO: 2627328 - protein, 4 aa, Entamoeba histolytica
INTY

SEQ ID NO: 2627329 - protein, 4 aa, Entamoeba histolytica
INVE

SEQ ID NO: 2627330 - protein, 9 aa, Entamoeba histolytica
INVEQQDDA

SEQ ID NO: 2627331 - protein, 11 aa, Entamoeba histolytica
INVKKNPQKAV

SEQ ID NO: 2627332 - protein, 7 aa, Entamoeba histolytica
INYKTDD

SEQ ID NO: 2627333 - protein, 7 aa, Entamoeba histolytica
INYPTSL

SEQ ID NO: 2627334 - protein, 5 aa, Entamoeba histolytica
INYQN

SEQ ID NO: 2627335 - protein, 8 aa, Entamoeba histolytica
IPAGSKVG

SEQ ID NO: 2627336 - protein, 12 aa, Entamoeba histolytica
IPAKEIQNKSSS

SEQ ID NO: 2627337 - protein, 19 aa, Entamoeba histolytica
IPAPFKPDMSQDGKTNFGE

SEQ ID NO: 2627338 - protein, 4 aa, Entamoeba histolytica
IPCD

SEQ ID NO: 2627339 - protein, 7 aa, Entamoeba histolytica
IPDDGNF

SEQ ID NO: 2627340 - protein, 13 aa, Entamoeba histolytica
IPDDSSPSESTLS

SEQ ID NO: 2627341 - protein, 4 aa, Entamoeba histolytica
IPDE

SEQ ID NO: 2627342 - protein, 7 aa, Entamoeba histolytica
IPDFRSR

SEQ ID NO: 2627343 - protein, 6 aa, Entamoeba histolytica
IPDGSL

SEQ ID NO: 2627344 - protein, 12 aa, Entamoeba histolytica
IPDIGTKETKVE

SEQ ID NO: 2627345 - protein, 9 aa, Entamoeba histolytica
IPDKRTDTW

SEQ ID NO: 2627346 - protein, 12 aa, Entamoeba histolytica
IPDKSLTQSKYA

SEQ ID NO: 2627347 - protein, 20 aa, Entamoeba histolytica
IPDNKSKSQIQDEIKRKENA

SEQ ID NO: 2627348 - protein, 10 aa, Entamoeba histolytica
IPDNRADSEE

SEQ ID NO: 2627349 - protein, 5 aa, Entamoeba histolytica
IPDNT

SEQ ID NO: 2627350 - protein, 6 aa, Entamoeba histolytica
IPDNTQ

SEQ ID NO: 2627351 - protein, 7 aa, Entamoeba histolytica
IPDPGAN

SEQ ID NO: 2627352 - protein, 12 aa, Entamoeba histolytica
IPDPKTPRETSS

SEQ ID NO: 2627353 - protein, 6 aa, Entamoeba histolytica
IPDPNS

SEQ ID NO: 2627354 - protein, 13 aa, Entamoeba histolytica
IPDQYSNTSKEGF

SEQ ID NO: 2627355 - protein, 8 aa, Entamoeba histolytica
IPDTEGRK

SEQ ID NO: 2627356 - protein, 13 aa, Entamoeba histolytica
IPDTQSPNEMSNT

SEQ ID NO: 2627357 - protein, 4 aa, Entamoeba histolytica
IPEC

SEQ ID NO: 2627358 - protein, 5 aa, Entamoeba histolytica
IPECG

SEQ ID NO: 2627359 - protein, 4 aa, Entamoeba histolytica
IPED

SEQ ID NO: 2627360 - protein, 9 aa, Entamoeba histolytica
IPEDADDEL

SEQ ID NO: 2627361 - protein, 6 aa, Entamoeba histolytica
IPEDRK

SEQ ID NO: 2627362 - protein, 9 aa, Entamoeba histolytica
IPEENKNDV

SEQ ID NO: 2627363 - protein, 15 aa, Entamoeba histolytica
IPEENKYGSTSINND

SEQ ID NO: 2627364 - protein, 6 aa, Entamoeba histolytica
IPEEPF

SEQ ID NO: 2627365 - protein, 9 aa, Entamoeba histolytica
IPEETKKEI

SEQ ID NO: 2627366 - protein, 4 aa, Entamoeba histolytica
IPEG

SEQ ID NO: 2627367 - protein, 9 aa, Entamoeba histolytica
IPEGEYDAF

SEQ ID NO: 2627368 - protein, 5 aa, Entamoeba histolytica
IPEGK

SEQ ID NO: 2627369 - protein, 9 aa, Entamoeba histolytica
IPEHRKKRN

SEQ ID NO: 2627370 - protein, 5 aa, Entamoeba histolytica
IPEND

SEQ ID NO: 2627371 - protein, 10 aa, Entamoeba histolytica
IPENDPENQF

SEQ ID NO: 2627372 - protein, 15 aa, Entamoeba histolytica
IPEQKETIERINKSE

SEQ ID NO: 2627373 - protein, 6 aa, Entamoeba histolytica
IPEQTQ

SEQ ID NO: 2627374 - protein, 6 aa, Entamoeba histolytica
IPERSP

SEQ ID NO: 2627375 - protein, 5 aa, Entamoeba histolytica
IPERY

SEQ ID NO: 2627376 - protein, 5 aa, Entamoeba histolytica
IPESD

SEQ ID NO: 2627377 - protein, 11 aa, Entamoeba histolytica
IPESDGFGSVP

SEQ ID NO: 2627378 - protein, 27 aa, Entamoeba histolytica
IPESERKKIIEEDKTKLKRKKKQEKEL

SEQ ID NO: 2627379 - protein, 4 aa, Entamoeba histolytica
IPET

SEQ ID NO: 2627380 - protein, 11 aa, Entamoeba histolytica
IPETVKSGNWY

SEQ ID NO: 2627381 - protein, 4 aa, Entamoeba histolytica
IPFA

SEQ ID NO: 2627382 - protein, 6 aa, Entamoeba histolytica
IPFEPK

SEQ ID NO: 2627383 - protein, 6 aa, Entamoeba histolytica
IPGAAA

SEQ ID NO: 2627384 - protein, 12 aa, Entamoeba histolytica
IPGAEIKECPEN

SEQ ID NO: 2627385 - protein, 9 aa, Entamoeba histolytica
IPGDDHRDP

SEQ ID NO: 2627386 - protein, 9 aa, Entamoeba histolytica
IPGEPIEDA

SEQ ID NO: 2627387 - protein, 8 aa, Entamoeba histolytica
IPGGATAR

SEQ ID NO: 2627388 - protein, 19 aa, Entamoeba histolytica
IPGGKALPKGYKMSKDKTV

SEQ ID NO: 2627389 - protein, 11 aa, Entamoeba histolytica
IPGHDKNSDPI

SEQ ID NO: 2627390 - protein, 6 aa, Entamoeba histolytica
IPGINK

SEQ ID NO: 2627391 - protein, 6 aa, Entamoeba histolytica
IPGKGR

SEQ ID NO: 2627392 - protein, 8 aa, Entamoeba histolytica
IPGLPKTR

SEQ ID NO: 2627393 - protein, 7 aa, Entamoeba histolytica
IPGNISR

SEQ ID NO: 2627394 - protein, 8 aa, Entamoeba histolytica
IPGSKAEL

SEQ ID NO: 2627395 - protein, 6 aa, Entamoeba histolytica
IPGTNQ

SEQ ID NO: 2627396 - protein, 15 aa, Entamoeba histolytica
IPIEGSTRLTSHENG

SEQ ID NO: 2627397 - protein, 5 aa, Entamoeba histolytica
IPIEH

SEQ ID NO: 2627398 - protein, 29 aa, Entamoeba histolytica
IPIEQENKQKTYDLSTESCSPKITTESFG

SEQ ID NO: 2627399 - protein, 26 aa, Entamoeba histolytica
IPIKPRRTTTPILSSNDQQPKKKPLF

SEQ ID NO: 2627400 - protein, 6 aa, Entamoeba histolytica
IPINSK

SEQ ID NO: 2627401 - protein, 5 aa, Entamoeba histolytica
IPIPE

SEQ ID NO: 2627402 - protein, 10 aa, Entamoeba histolytica
IPIPGSGSAV

SEQ ID NO: 2627403 - protein, 8 aa, Entamoeba histolytica
IPITPNEQ

SEQ ID NO: 2627404 - protein, 5 aa, Entamoeba histolytica
IPKAN

SEQ ID NO: 2627405 - protein, 4 aa, Entamoeba histolytica
IPKD

SEQ ID NO: 2627406 - protein, 11 aa, Entamoeba histolytica
IPKDKRPKNGG

SEQ ID NO: 2627407 - protein, 4 aa, Entamoeba histolytica
IPKE

SEQ ID NO: 2627408 - protein, 5 aa, Entamoeba histolytica
IPKED

SEQ ID NO: 2627409 - protein, 5 aa, Entamoeba histolytica
IPKEE

SEQ ID NO: 2627410 - protein, 6 aa, Entamoeba histolytica
IPKEED

SEQ ID NO: 2627411 - protein, 23 aa, Entamoeba histolytica
IPKEENEKKRIEEAGGKVYNNNG

SEQ ID NO: 2627412 - protein, 29 aa, Entamoeba histolytica
IPKEKIQENNDEIKTGAHEEFHQENNGIK

SEQ ID NO: 2627413 - protein, 11 aa, Entamoeba histolytica
IPKEKRAKGLI

SEQ ID NO: 2627414 - protein, 6 aa, Entamoeba histolytica
IPKENK

SEQ ID NO: 2627415 - protein, 26 aa, Entamoeba histolytica
IPKEPAKDPVKDEPTKTTEKPVNNEQ

SEQ ID NO: 2627416 - protein, 11 aa, Entamoeba histolytica
IPKESKEAENI

SEQ ID NO: 2627417 - protein, 10 aa, Entamoeba histolytica
IPKGSKTGDI

SEQ ID NO: 2627418 - protein, 9 aa, Entamoeba histolytica
IPKGTTQVS

SEQ ID NO: 2627419 - protein, 4 aa, Entamoeba histolytica
IPKI

SEQ ID NO: 2627420 - protein, 7 aa, Entamoeba histolytica
IPKKGTA

SEQ ID NO: 2627421 - protein, 5 aa, Entamoeba histolytica
IPKKI

SEQ ID NO: 2627422 - protein, 14 aa, Entamoeba histolytica
IPKKKGGKSSVDDD

SEQ ID NO: 2627423 - protein, 62 aa, Entamoeba histolytica
IPKKRQPKTSGGTNGSTNKSIGETRARTNVSTNLSQQSSTGASQRSSSTSTNPSHPQQNAQT

SEQ ID NO: 2627424 - protein, 15 aa, Entamoeba histolytica
IPKLSSLANKQQPAT

SEQ ID NO: 2627425 - protein, 8 aa, Entamoeba histolytica
IPKNGSSS

SEQ ID NO: 2627426 - protein, 5 aa, Entamoeba histolytica
IPKNK

SEQ ID NO: 2627427 - protein, 29 aa, Entamoeba histolytica
IPKNNTEDIIGSNYSSNISSPRSDNEEET

SEQ ID NO: 2627428 - protein, 8 aa, Entamoeba histolytica
IPKNNTKS

SEQ ID NO: 2627429 - protein, 19 aa, Entamoeba histolytica
IPKNTGANLKLSSDKNHGI

SEQ ID NO: 2627430 - protein, 7 aa, Entamoeba histolytica
IPKNTNK

SEQ ID NO: 2627431 - protein, 4 aa, Entamoeba histolytica
IPKP

SEQ ID NO: 2627432 - protein, 8 aa, Entamoeba histolytica
IPKPIPRR

SEQ ID NO: 2627433 - protein, 10 aa, Entamoeba histolytica
IPKPTTEEEM

SEQ ID NO: 2627434 - protein, 7 aa, Entamoeba histolytica
IPKQPRM

SEQ ID NO: 2627435 - protein, 8 aa, Entamoeba histolytica
IPKQTSEK

SEQ ID NO: 2627436 - protein, 6 aa, Entamoeba histolytica
IPKSER

SEQ ID NO: 2627437 - protein, 9 aa, Entamoeba histolytica
IPKSHSSKR

SEQ ID NO: 2627438 - protein, 10 aa, Entamoeba histolytica
IPKSKSPINI

SEQ ID NO: 2627439 - protein, 6 aa, Entamoeba histolytica
IPKTGQ

SEQ ID NO: 2627440 - protein, 6 aa, Entamoeba histolytica
IPKTHP

SEQ ID NO: 2627441 - protein, 27 aa, Entamoeba histolytica
IPKTNEEVTEEKKNEAESHKAKGNDLF

SEQ ID NO: 2627442 - protein, 11 aa, Entamoeba histolytica
IPKTNTVITTN

SEQ ID NO: 2627443 - protein, 8 aa, Entamoeba histolytica
IPLEPPQS

SEQ ID NO: 2627444 - protein, 9 aa, Entamoeba histolytica
IPLESSDGD

SEQ ID NO: 2627445 - protein, 12 aa, Entamoeba histolytica
IPLKETDDSLKT

SEQ ID NO: 2627446 - protein, 19 aa, Entamoeba histolytica
IPLKQKKKSWKKVKTQCVV

SEQ ID NO: 2627447 - protein, 12 aa, Entamoeba histolytica
IPLPKKSSESLK

SEQ ID NO: 2627448 - protein, 20 aa, Entamoeba histolytica
IPLPNPSYTGHIPTETSEFN

SEQ ID NO: 2627449 - protein, 5 aa, Entamoeba histolytica
IPLPS

SEQ ID NO: 2627450 - protein, 8 aa, Entamoeba histolytica
IPNDPTNA

SEQ ID NO: 2627451 - protein, 12 aa, Entamoeba histolytica
IPNEGNNEHPDF

SEQ ID NO: 2627452 - protein, 20 aa, Entamoeba histolytica
IPNEKVEEEVKEESEEDDGY

SEQ ID NO: 2627453 - protein, 10 aa, Entamoeba histolytica
IPNFETPERA

SEQ ID NO: 2627454 - protein, 13 aa, Entamoeba histolytica
IPNHQSQDKLTQL

SEQ ID NO: 2627455 - protein, 4 aa, Entamoeba histolytica
IPNI

SEQ ID NO: 2627456 - protein, 7 aa, Entamoeba histolytica
IPNKEEK

SEQ ID NO: 2627457 - protein, 10 aa, Entamoeba histolytica
IPNKPLPNIP

SEQ ID NO: 2627458 - protein, 11 aa, Entamoeba histolytica
IPNKTRKQCRE

SEQ ID NO: 2627459 - protein, 5 aa, Entamoeba histolytica
IPNLP

SEQ ID NO: 2627460 - protein, 7 aa, Entamoeba histolytica
IPNNSSL

SEQ ID NO: 2627461 - protein, 18 aa, Entamoeba histolytica
IPNPTSKKPVKNINTEKS

SEQ ID NO: 2627462 - protein, 6 aa, Entamoeba histolytica
IPNQDT

SEQ ID NO: 2627463 - protein, 11 aa, Entamoeba histolytica
IPNRTRKQCRE

SEQ ID NO: 2627464 - protein, 5 aa, Entamoeba histolytica
IPNRV

SEQ ID NO: 2627465 - protein, 4 aa, Entamoeba histolytica
IPNS

SEQ ID NO: 2627466 - protein, 124 aa, Entamoeba histolytica
IPNSNKNTAIPSTNSPQTVKKPECELETPSAPIIPSNNETPEPNTQTRRPPPPLPSRKVPPTLPSRSDNNIPPTSGNPPPPPNLNVPPPPPNLNVPPPPPPTLNTTSPNPKTTPAVSLPTGGRS

SEQ ID NO: 2627467 - protein, 6 aa, Entamoeba histolytica
IPNSQP

SEQ ID NO: 2627468 - protein, 6 aa, Entamoeba histolytica
IPNSRT

SEQ ID NO: 2627469 - protein, 36 aa, Entamoeba histolytica
IPNSSTKQRKTRKGNTETRQQEVKEVKEPSQESEEI

SEQ ID NO: 2627470 - protein, 7 aa, Entamoeba histolytica
IPNSTKS

SEQ ID NO: 2627471 - protein, 8 aa, Entamoeba histolytica
IPNSVSSL

SEQ ID NO: 2627472 - protein, 4 aa, Entamoeba histolytica
IPNT

SEQ ID NO: 2627473 - protein, 5 aa, Entamoeba histolytica
IPNTE

SEQ ID NO: 2627474 - protein, 8 aa, Entamoeba histolytica
IPNTREQL

SEQ ID NO: 2627475 - protein, 4 aa, Entamoeba histolytica
IPPA

SEQ ID NO: 2627476 - protein, 12 aa, Entamoeba histolytica
IPPAQKKDYESY

SEQ ID NO: 2627477 - protein, 13 aa, Entamoeba histolytica
IPPDPSTIEPPLP

SEQ ID NO: 2627478 - protein, 6 aa, Entamoeba histolytica
IPPDRS

SEQ ID NO: 2627479 - protein, 7 aa, Entamoeba histolytica
IPPEKSY

SEQ ID NO: 2627480 - protein, 9 aa, Entamoeba histolytica
IPPEPNTSY

SEQ ID NO: 2627481 - protein, 7 aa, Entamoeba histolytica
IPPITGP

SEQ ID NO: 2627482 - protein, 4 aa, Entamoeba histolytica
IPPK

SEQ ID NO: 2627483 - protein, 12 aa, Entamoeba histolytica
IPPKPPRENRNT

SEQ ID NO: 2627484 - protein, 6 aa, Entamoeba histolytica
IPPKSH

SEQ ID NO: 2627485 - protein, 6 aa, Entamoeba histolytica
IPPKTE

SEQ ID NO: 2627486 - protein, 7 aa, Entamoeba histolytica
IPPLPGD

SEQ ID NO: 2627487 - protein, 7 aa, Entamoeba histolytica
IPPNNTL

SEQ ID NO: 2627488 - protein, 11 aa, Entamoeba histolytica
IPPNRTEDGNT

SEQ ID NO: 2627489 - protein, 8 aa, Entamoeba histolytica
IPPPNQLQ

SEQ ID NO: 2627490 - protein, 11 aa, Entamoeba histolytica
IPPPNTNLSNT

SEQ ID NO: 2627491 - protein, 10 aa, Entamoeba histolytica
IPPPPPRPQQ

SEQ ID NO: 2627492 - protein, 62 aa, Entamoeba histolytica
IPPPPPVAPAIGNPPPPPPIAPPKQAGNPPPPPPIRSTNSAGNPPPPPPARQTAAPAPANGN

SEQ ID NO: 2627493 - protein, 12 aa, Entamoeba histolytica
IPPPQPDSAQVG

SEQ ID NO: 2627494 - protein, 8 aa, Entamoeba histolytica
IPPPTDEL

SEQ ID NO: 2627495 - protein, 9 aa, Entamoeba histolytica
IPPPTPPRL

SEQ ID NO: 2627496 - protein, 6 aa, Entamoeba histolytica
IPPQNI

SEQ ID NO: 2627497 - protein, 11 aa, Entamoeba histolytica
IPPRPPRENRH

SEQ ID NO: 2627498 - protein, 5 aa, Entamoeba histolytica
IPPRS

SEQ ID NO: 2627499 - protein, 8 aa, Entamoeba histolytica
IPPSDSSR

SEQ ID NO: 2627500 - protein, 9 aa, Entamoeba histolytica
IPPSPYPEF

SEQ ID NO: 2627501 - protein, 11 aa, Entamoeba histolytica
IPPSQQKSIPF

SEQ ID NO: 2627502 - protein, 6 aa, Entamoeba histolytica
IPPSVS

SEQ ID NO: 2627503 - protein, 7 aa, Entamoeba histolytica
IPPSVTK

SEQ ID NO: 2627504 - protein, 5 aa, Entamoeba histolytica
IPPTE

SEQ ID NO: 2627505 - protein, 7 aa, Entamoeba histolytica
IPPTENN

SEQ ID NO: 2627506 - protein, 12 aa, Entamoeba histolytica
IPPTRNEEDPGT

SEQ ID NO: 2627507 - protein, 5 aa, Entamoeba histolytica
IPPTT

SEQ ID NO: 2627508 - protein, 60 aa, Entamoeba histolytica
IPPTVPPKRKTQKTLTQEEGVKQENQPLKRNDSKTLQQDKPSSIETQQKEQPSSNKQEPI

SEQ ID NO: 2627509 - protein, 5 aa, Entamoeba histolytica
IPQAL

SEQ ID NO: 2627510 - protein, 8 aa, Entamoeba histolytica
IPQDESDT

SEQ ID NO: 2627511 - protein, 6 aa, Entamoeba histolytica
IPQENQ

SEQ ID NO: 2627512 - protein, 15 aa, Entamoeba histolytica
IPQETKEVQQKENME

SEQ ID NO: 2627513 - protein, 4 aa, Entamoeba histolytica
IPQI

SEQ ID NO: 2627514 - protein, 4 aa, Entamoeba histolytica
IPQK

SEQ ID NO: 2627515 - protein, 6 aa, Entamoeba histolytica
IPQNIQ

SEQ ID NO: 2627516 - protein, 5 aa, Entamoeba histolytica
IPQNP

SEQ ID NO: 2627517 - protein, 8 aa, Entamoeba histolytica
IPQNRPSF

SEQ ID NO: 2627518 - protein, 11 aa, Entamoeba histolytica
IPQNSQPEINA

SEQ ID NO: 2627519 - protein, 5 aa, Entamoeba histolytica
IPQNT

SEQ ID NO: 2627520 - protein, 11 aa, Entamoeba histolytica
IPQPKISQPDS

SEQ ID NO: 2627521 - protein, 13 aa, Entamoeba histolytica
IPQPPGNPAKKDK

SEQ ID NO: 2627522 - protein, 6 aa, Entamoeba histolytica
IPQPPN

SEQ ID NO: 2627523 - protein, 14 aa, Entamoeba histolytica
IPQPSSYDHHEPRK

SEQ ID NO: 2627524 - protein, 14 aa, Entamoeba histolytica
IPQQDETVGYEKDP

SEQ ID NO: 2627525 - protein, 13 aa, Entamoeba histolytica
IPQQEDSEPYKEY

SEQ ID NO: 2627526 - protein, 13 aa, Entamoeba histolytica
IPQQQTNIRYQPQ

SEQ ID NO: 2627527 - protein, 11 aa, Entamoeba histolytica
IPQRGYGYGEG

SEQ ID NO: 2627528 - protein, 11 aa, Entamoeba histolytica
IPQRPSQINDL

SEQ ID NO: 2627529 - protein, 17 aa, Entamoeba histolytica
IPQSDIETSLQTKKDHP

SEQ ID NO: 2627530 - protein, 8 aa, Entamoeba histolytica
IPQSSFSQ

SEQ ID NO: 2627531 - protein, 5 aa, Entamoeba histolytica
IPQST

SEQ ID NO: 2627532 - protein, 52 aa, Entamoeba histolytica
IPQTETPKKFSKELKELKDDNYKGIVETKPKKVSLEEKTDKKFIEDEKKFPK

SEQ ID NO: 2627533 - protein, 5 aa, Entamoeba histolytica
IPQTG

SEQ ID NO: 2627534 - protein, 6 aa, Entamoeba histolytica
IPQTMT

SEQ ID NO: 2627535 - protein, 8 aa, Entamoeba histolytica
IPQYDPNE

SEQ ID NO: 2627536 - protein, 6 aa, Entamoeba histolytica
IPRANE

SEQ ID NO: 2627537 - protein, 7 aa, Entamoeba histolytica
IPRGEQT

SEQ ID NO: 2627538 - protein, 5 aa, Entamoeba histolytica
IPRGT

SEQ ID NO: 2627539 - protein, 24 aa, Entamoeba histolytica
IPRHSETSTTRIEPDLRSRFENDK

SEQ ID NO: 2627540 - protein, 10 aa, Entamoeba histolytica
IPRKDVPDSL

SEQ ID NO: 2627541 - protein, 5 aa, Entamoeba histolytica
IPRKT

SEQ ID NO: 2627542 - protein, 9 aa, Entamoeba histolytica
IPRNISKKT

SEQ ID NO: 2627543 - protein, 8 aa, Entamoeba histolytica
IPRPFNSA

SEQ ID NO: 2627544 - protein, 5 aa, Entamoeba histolytica
IPRPS

SEQ ID NO: 2627545 - protein, 15 aa, Entamoeba histolytica
IPRPTEENKKPSGLG

SEQ ID NO: 2627546 - protein, 12 aa, Entamoeba histolytica
IPRRSGAREAPS

SEQ ID NO: 2627547 - protein, 5 aa, Entamoeba histolytica
IPRSG

SEQ ID NO: 2627548 - protein, 5 aa, Entamoeba histolytica
IPRTE

SEQ ID NO: 2627549 - protein, 13 aa, Entamoeba histolytica
IPRTVEEIEAFMK

SEQ ID NO: 2627550 - protein, 8 aa, Entamoeba histolytica
IPRVGNKR

SEQ ID NO: 2627551 - protein, 11 aa, Entamoeba histolytica
IPRYGATRISE

SEQ ID NO: 2627552 - protein, 5 aa, Entamoeba histolytica
IPSDE

SEQ ID NO: 2627553 - protein, 4 aa, Entamoeba histolytica
IPSE

SEQ ID NO: 2627554 - protein, 10 aa, Entamoeba histolytica
IPSEDKEISK

SEQ ID NO: 2627555 - protein, 14 aa, Entamoeba histolytica
IPSEEETDKYNEYR

SEQ ID NO: 2627556 - protein, 6 aa, Entamoeba histolytica
IPSELS

SEQ ID NO: 2627557 - protein, 9 aa, Entamoeba histolytica
IPSESQRRQ

SEQ ID NO: 2627558 - protein, 12 aa, Entamoeba histolytica
IPSETAKQRVSK

SEQ ID NO: 2627559 - protein, 4 aa, Entamoeba histolytica
IPSI

SEQ ID NO: 2627560 - protein, 11 aa, Entamoeba histolytica
IPSIPSRKTIE

SEQ ID NO: 2627561 - protein, 8 aa, Entamoeba histolytica
IPSITSNS

SEQ ID NO: 2627562 - protein, 4 aa, Entamoeba histolytica
IPSK

SEQ ID NO: 2627563 - protein, 9 aa, Entamoeba histolytica
IPSKEDTEK

SEQ ID NO: 2627564 - protein, 9 aa, Entamoeba histolytica
IPSKSQQPL

SEQ ID NO: 2627565 - protein, 5 aa, Entamoeba histolytica
IPSKY

SEQ ID NO: 2627566 - protein, 8 aa, Entamoeba histolytica
IPSKYQQQ

SEQ ID NO: 2627567 - protein, 4 aa, Entamoeba histolytica
IPSN

SEQ ID NO: 2627568 - protein, 7 aa, Entamoeba histolytica
IPSNAQR

SEQ ID NO: 2627569 - protein, 9 aa, Entamoeba histolytica
IPSNDESPQ

SEQ ID NO: 2627570 - protein, 8 aa, Entamoeba histolytica
IPSNERQI

SEQ ID NO: 2627571 - protein, 9 aa, Entamoeba histolytica
IPSNETKSK

SEQ ID NO: 2627572 - protein, 20 aa, Entamoeba histolytica
IPSNNARNRMTSFNSSGQTF

SEQ ID NO: 2627573 - protein, 8 aa, Entamoeba histolytica
IPSPEKRS

SEQ ID NO: 2627574 - protein, 13 aa, Entamoeba histolytica
IPSPNFKETATSL

SEQ ID NO: 2627575 - protein, 19 aa, Entamoeba histolytica
IPSPSSTLPPRQRYSSQLQ

SEQ ID NO: 2627576 - protein, 8 aa, Entamoeba histolytica
IPSPTKSS

SEQ ID NO: 2627577 - protein, 5 aa, Entamoeba histolytica
IPSPY

SEQ ID NO: 2627578 - protein, 21 aa, Entamoeba histolytica
IPSQEKKDELTESSSSCLTTT

SEQ ID NO: 2627579 - protein, 5 aa, Entamoeba histolytica
IPSQG

SEQ ID NO: 2627580 - protein, 28 aa, Entamoeba histolytica
IPSQGDFNGVSSFGSGTKQNQSNPFASG

SEQ ID NO: 2627581 - protein, 11 aa, Entamoeba histolytica
IPSQNHKNQLN

SEQ ID NO: 2627582 - protein, 147 aa, Entamoeba histolytica
IPSQNLPPQSLPPQNLPPQSLPPQSLPPQSLPPQSLPPQSLPPQSLPPQSLPPQSLPPQSLPPQSLPPQSLPPQSLPPQSLPPQSLPPQSLPPQSLPPQSLPPQSLPPQSLPPQSLPPQNIPSQNIPSQSVSSQSLPSQSLPPQNLP

SEQ ID NO: 2627583 - protein, 26 aa, Entamoeba histolytica
IPSQPISKTSSFNVNEQKNKTKNEVT

SEQ ID NO: 2627584 - protein, 9 aa, Entamoeba histolytica
IPSQPSTGH

SEQ ID NO: 2627585 - protein, 7 aa, Entamoeba histolytica
IPSRGEV

SEQ ID NO: 2627586 - protein, 12 aa, Entamoeba histolytica
IPSRKISSKIKT

SEQ ID NO: 2627587 - protein, 14 aa, Entamoeba histolytica
IPSRPQPDNYSTFE

SEQ ID NO: 2627588 - protein, 4 aa, Entamoeba histolytica
IPSS

SEQ ID NO: 2627589 - protein, 32 aa, Entamoeba histolytica
IPSSFSSQQFTQSQESSSNPHLKQNSPTKQVK

SEQ ID NO: 2627590 - protein, 15 aa, Entamoeba histolytica
IPSSHKTIPTTTKPM

SEQ ID NO: 2627591 - protein, 12 aa, Entamoeba histolytica
IPSSISSIGDSY

SEQ ID NO: 2627592 - protein, 12 aa, Entamoeba histolytica
IPSSMSKLKSST

SEQ ID NO: 2627593 - protein, 5 aa, Entamoeba histolytica
IPSSN

SEQ ID NO: 2627594 - protein, 6 aa, Entamoeba histolytica
IPSSQI

SEQ ID NO: 2627595 - protein, 5 aa, Entamoeba histolytica
IPSST

SEQ ID NO: 2627596 - protein, 9 aa, Entamoeba histolytica
IPSSVSKIG

SEQ ID NO: 2627597 - protein, 8 aa, Entamoeba histolytica
IPSSVTSL

SEQ ID NO: 2627598 - protein, 15 aa, Entamoeba histolytica
IPSTITEESLNNQNI

SEQ ID NO: 2627599 - protein, 9 aa, Entamoeba histolytica
IPSTKKEIK

SEQ ID NO: 2627600 - protein, 5 aa, Entamoeba histolytica
IPSTV

SEQ ID NO: 2627601 - protein, 8 aa, Entamoeba histolytica
IPSTYNSE

SEQ ID NO: 2627602 - protein, 4 aa, Entamoeba histolytica
IPSY

SEQ ID NO: 2627603 - protein, 5 aa, Entamoeba histolytica
IPTDD

SEQ ID NO: 2627604 - protein, 7 aa, Entamoeba histolytica
IPTDKGK

SEQ ID NO: 2627605 - protein, 7 aa, Entamoeba histolytica
IPTEKKI

SEQ ID NO: 2627606 - protein, 27 aa, Entamoeba histolytica
IPTESKTQEIKEEQKKEEDNDKSDEEI

SEQ ID NO: 2627607 - protein, 9 aa, Entamoeba histolytica
IPTGSYQAY

SEQ ID NO: 2627608 - protein, 4 aa, Entamoeba histolytica
IPTH

SEQ ID NO: 2627609 - protein, 4 aa, Entamoeba histolytica
IPTI

SEQ ID NO: 2627610 - protein, 13 aa, Entamoeba histolytica
IPTINNEASQCAS

SEQ ID NO: 2627611 - protein, 5 aa, Entamoeba histolytica
IPTKD

SEQ ID NO: 2627612 - protein, 6 aa, Entamoeba histolytica
IPTNGL

SEQ ID NO: 2627613 - protein, 27 aa, Entamoeba histolytica
IPTNPPTQEINPPIPTIPTSTPILPKT

SEQ ID NO: 2627614 - protein, 6 aa, Entamoeba histolytica
IPTNVS

SEQ ID NO: 2627615 - protein, 8 aa, Entamoeba histolytica
IPTNVSKI

SEQ ID NO: 2627616 - protein, 12 aa, Entamoeba histolytica
IPTPLNSTSTTN

SEQ ID NO: 2627617 - protein, 4 aa, Entamoeba histolytica
IPTR

SEQ ID NO: 2627618 - protein, 9 aa, Entamoeba histolytica
IPTRDNAKE

SEQ ID NO: 2627619 - protein, 17 aa, Entamoeba histolytica
IPTRQRDFSEDSSINEG

SEQ ID NO: 2627620 - protein, 43 aa, Entamoeba histolytica
IPTSASNQINQQSVSSTSQPPLSDNTTSQPHFQTSSSHSFSPQ

SEQ ID NO: 2627621 - protein, 7 aa, Entamoeba histolytica
IPTSNGR

SEQ ID NO: 2627622 - protein, 5 aa, Entamoeba histolytica
IPTST

SEQ ID NO: 2627623 - protein, 6 aa, Entamoeba histolytica
IPTSTP

SEQ ID NO: 2627624 - protein, 7 aa, Entamoeba histolytica
IPTSVGK

SEQ ID NO: 2627625 - protein, 8 aa, Entamoeba histolytica
IPTSVGKI

SEQ ID NO: 2627626 - protein, 8 aa, Entamoeba histolytica
IPTSVSQI

SEQ ID NO: 2627627 - protein, 7 aa, Entamoeba histolytica
IPTSVST

SEQ ID NO: 2627628 - protein, 7 aa, Entamoeba histolytica
IPTSVTK

SEQ ID NO: 2627629 - protein, 5 aa, Entamoeba histolytica
IPTTC

SEQ ID NO: 2627630 - protein, 6 aa, Entamoeba histolytica
IPTTDV

SEQ ID NO: 2627631 - protein, 6 aa, Entamoeba histolytica
IPTTKR

SEQ ID NO: 2627632 - protein, 9 aa, Entamoeba histolytica
IPTTSKEKI

SEQ ID NO: 2627633 - protein, 6 aa, Entamoeba histolytica
IPTTYG

SEQ ID NO: 2627634 - protein, 6 aa, Entamoeba histolytica
IPTVPD

SEQ ID NO: 2627635 - protein, 4 aa, Entamoeba histolytica
IPTW

SEQ ID NO: 2627636 - protein, 4 aa, Entamoeba histolytica
IPVA

SEQ ID NO: 2627637 - protein, 6 aa, Entamoeba histolytica
IPVNTK

SEQ ID NO: 2627638 - protein, 51 aa, Entamoeba histolytica
IPVPQKKQPKRVETQEEREERRRKKFERPLESPKRSNSTVSTSSTPLPPRH

SEQ ID NO: 2627639 - protein, 4 aa, Entamoeba histolytica
IPYD

SEQ ID NO: 2627640 - protein, 6 aa, Entamoeba histolytica
IPYHTK

SEQ ID NO: 2627641 - protein, 16 aa, Entamoeba histolytica
IPYNGEDKGDHPPITP

SEQ ID NO: 2627642 - protein, 6 aa, Entamoeba histolytica
IPYPKK

SEQ ID NO: 2627643 - protein, 10 aa, Entamoeba histolytica
IPYRKKKRDI

SEQ ID NO: 2627644 - protein, 5 aa, Entamoeba histolytica
IPYTG

SEQ ID NO: 2627645 - protein, 6 aa, Entamoeba histolytica
IPYTGR

SEQ ID NO: 2627646 - protein, 6 aa, Entamoeba histolytica
IPYTPK

SEQ ID NO: 2627647 - protein, 8 aa, Entamoeba histolytica
IQAKPTDL

SEQ ID NO: 2627648 - protein, 14 aa, Entamoeba histolytica
IQAQYKNAKVGEEV

SEQ ID NO: 2627649 - protein, 9 aa, Entamoeba histolytica
IQATDAGEL

SEQ ID NO: 2627650 - protein, 9 aa, Entamoeba histolytica
IQATYEESA

SEQ ID NO: 2627651 - protein, 9 aa, Entamoeba histolytica
IQDDSERYK

SEQ ID NO: 2627652 - protein, 7 aa, Entamoeba histolytica
IQDEPEI

SEQ ID NO: 2627653 - protein, 15 aa, Entamoeba histolytica
IQDKEKGQSRKSKCI

SEQ ID NO: 2627654 - protein, 5 aa, Entamoeba histolytica
IQDKR

SEQ ID NO: 2627655 - protein, 13 aa, Entamoeba histolytica
IQDNETQKISNTK

SEQ ID NO: 2627656 - protein, 9 aa, Entamoeba histolytica
IQDNQSEKY

SEQ ID NO: 2627657 - protein, 7 aa, Entamoeba histolytica
IQDPTTN

SEQ ID NO: 2627658 - protein, 4 aa, Entamoeba histolytica
IQDS

SEQ ID NO: 2627659 - protein, 6 aa, Entamoeba histolytica
IQDSGE

SEQ ID NO: 2627660 - protein, 17 aa, Entamoeba histolytica
IQDSTNESKSTTNYSQS

SEQ ID NO: 2627661 - protein, 4 aa, Entamoeba histolytica
IQEC

SEQ ID NO: 2627662 - protein, 10 aa, Entamoeba histolytica
IQEDNSLDKQ

SEQ ID NO: 2627663 - protein, 11 aa, Entamoeba histolytica
IQEDNSLDKQE

SEQ ID NO: 2627664 - protein, 24 aa, Entamoeba histolytica
IQEEEEKQKSCQPQEMKDVDEDDD

SEQ ID NO: 2627665 - protein, 31 aa, Entamoeba histolytica
IQEEEVKEEVVEQPKEVKEEEVKKEETVNEI

SEQ ID NO: 2627666 - protein, 6 aa, Entamoeba histolytica
IQEEKE

SEQ ID NO: 2627667 - protein, 11 aa, Entamoeba histolytica
IQEEKESYLNQ

SEQ ID NO: 2627668 - protein, 39 aa, Entamoeba histolytica
IQEENSNTIIQKESKDELEIKKETKEIQKEKSINKRKGI

SEQ ID NO: 2627669 - protein, 14 aa, Entamoeba histolytica
IQEEREKQKQLEKG

SEQ ID NO: 2627670 - protein, 29 aa, Entamoeba histolytica
IQEESKNDNIEQNKENSCAIEEDENTDDD

SEQ ID NO: 2627671 - protein, 4 aa, Entamoeba histolytica
IQEG

SEQ ID NO: 2627672 - protein, 5 aa, Entamoeba histolytica
IQEGE

SEQ ID NO: 2627673 - protein, 6 aa, Entamoeba histolytica
IQEGKN

SEQ ID NO: 2627674 - protein, 9 aa, Entamoeba histolytica
IQEKKCSTD

SEQ ID NO: 2627675 - protein, 9 aa, Entamoeba histolytica
IQENGNSIE

SEQ ID NO: 2627676 - protein, 6 aa, Entamoeba histolytica
IQENPF

SEQ ID NO: 2627677 - protein, 17 aa, Entamoeba histolytica
IQEPPNSVSAGNVPRTK

SEQ ID NO: 2627678 - protein, 4 aa, Entamoeba histolytica
IQEQ

SEQ ID NO: 2627679 - protein, 13 aa, Entamoeba histolytica
IQEQEEKRNNEVD

SEQ ID NO: 2627680 - protein, 50 aa, Entamoeba histolytica
IQEQEQTKEIQHEKQITPKKENKPCQTEEVKGIETKKKYSKTRKTQSENL

SEQ ID NO: 2627681 - protein, 7 aa, Entamoeba histolytica
IQEQRLA

SEQ ID NO: 2627682 - protein, 9 aa, Entamoeba histolytica
IQEQSKEAQ

SEQ ID NO: 2627683 - protein, 7 aa, Entamoeba histolytica
IQERYPT

SEQ ID NO: 2627684 - protein, 4 aa, Entamoeba histolytica
IQES

SEQ ID NO: 2627685 - protein, 10 aa, Entamoeba histolytica
IQETAKENDA

SEQ ID NO: 2627686 - protein, 24 aa, Entamoeba histolytica
IQETPDSEENNERNEINEQKHEMS

SEQ ID NO: 2627687 - protein, 25 aa, Entamoeba histolytica
IQGEPDGSSFPNGGLRNTSQARGYS

SEQ ID NO: 2627688 - protein, 4 aa, Entamoeba histolytica
IQGG

SEQ ID NO: 2627689 - protein, 4 aa, Entamoeba histolytica
IQGN

SEQ ID NO: 2627690 - protein, 8 aa, Entamoeba histolytica
IQGNENAL

SEQ ID NO: 2627691 - protein, 10 aa, Entamoeba histolytica
IQGREYSDSS

SEQ ID NO: 2627692 - protein, 11 aa, Entamoeba histolytica
IQGTNSLPDIP

SEQ ID NO: 2627693 - protein, 5 aa, Entamoeba histolytica
IQGTP

SEQ ID NO: 2627694 - protein, 4 aa, Entamoeba histolytica
IQHE

SEQ ID NO: 2627695 - protein, 23 aa, Entamoeba histolytica
IQKDDQKDVENQYETSEEQTTNI

SEQ ID NO: 2627696 - protein, 23 aa, Entamoeba histolytica
IQKDEQKDFENQYETPEQQTTNI

SEQ ID NO: 2627697 - protein, 35 aa, Entamoeba histolytica
IQKDRVKEEETIPKEEETIPKEEETTPKEEETTKI

SEQ ID NO: 2627698 - protein, 53 aa, Entamoeba histolytica
IQKEEAEQQPPQKIQEQPQKIQEQPQKIQEQPQKIQEQQQKTQEQSSQQHDHI

SEQ ID NO: 2627699 - protein, 9 aa, Entamoeba histolytica
IQKEEPEGC

SEQ ID NO: 2627700 - protein, 9 aa, Entamoeba histolytica
IQKEESGLK

SEQ ID NO: 2627701 - protein, 9 aa, Entamoeba histolytica
IQKGGNGCF

SEQ ID NO: 2627702 - protein, 38 aa, Entamoeba histolytica
IQKGKKLNKCETIDKSKPMIEQPKGGMGGGMPMGGGNP

SEQ ID NO: 2627703 - protein, 7 aa, Entamoeba histolytica
IQKGQEL

SEQ ID NO: 2627704 - protein, 5 aa, Entamoeba histolytica
IQKGT

SEQ ID NO: 2627705 - protein, 21 aa, Entamoeba histolytica
IQKIEDKKKDLEKKAAQGTGV

SEQ ID NO: 2627706 - protein, 4 aa, Entamoeba histolytica
IQKK

SEQ ID NO: 2627707 - protein, 10 aa, Entamoeba histolytica
IQKKAEESNM

SEQ ID NO: 2627708 - protein, 26 aa, Entamoeba histolytica
IQKKEEIKQEETYPNDLEPLKDTKIN

SEQ ID NO: 2627709 - protein, 21 aa, Entamoeba histolytica
IQKKERKVKEVKKNTPKITDE

SEQ ID NO: 2627710 - protein, 17 aa, Entamoeba histolytica
IQKNKELATSSTEPWKR

SEQ ID NO: 2627711 - protein, 8 aa, Entamoeba histolytica
IQKPQQSI

SEQ ID NO: 2627712 - protein, 8 aa, Entamoeba histolytica
IQKQKNYK

SEQ ID NO: 2627713 - protein, 8 aa, Entamoeba histolytica
IQKQKTHE

SEQ ID NO: 2627714 - protein, 7 aa, Entamoeba histolytica
IQKREGF

SEQ ID NO: 2627715 - protein, 18 aa, Entamoeba histolytica
IQKRNNELLNQDSSTEEI

SEQ ID NO: 2627716 - protein, 5 aa, Entamoeba histolytica
IQKSK

SEQ ID NO: 2627717 - protein, 11 aa, Entamoeba histolytica
IQKSKSKQEEI

SEQ ID NO: 2627718 - protein, 13 aa, Entamoeba histolytica
IQKSQNDEYDKGT

SEQ ID NO: 2627719 - protein, 4 aa, Entamoeba histolytica
IQLP

SEQ ID NO: 2627720 - protein, 15 aa, Entamoeba histolytica
IQLSEDHKPNGTCER

SEQ ID NO: 2627721 - protein, 5 aa, Entamoeba histolytica
IQNDE

SEQ ID NO: 2627722 - protein, 5 aa, Entamoeba histolytica
IQNDN

SEQ ID NO: 2627723 - protein, 4 aa, Entamoeba histolytica
IQNE

SEQ ID NO: 2627724 - protein, 6 aa, Entamoeba histolytica
IQNEKI

SEQ ID NO: 2627725 - protein, 6 aa, Entamoeba histolytica
IQNEMT

SEQ ID NO: 2627726 - protein, 50 aa, Entamoeba histolytica
IQNEPKEEVNQPVLESSPSLSEGKKDEKSIISSNGDEKEIQPPNLDEQTI

SEQ ID NO: 2627727 - protein, 8 aa, Entamoeba histolytica
IQNKSQND

SEQ ID NO: 2627728 - protein, 8 aa, Entamoeba histolytica
IQNKTRDN

SEQ ID NO: 2627729 - protein, 7 aa, Entamoeba histolytica
IQNKYKE

SEQ ID NO: 2627730 - protein, 11 aa, Entamoeba histolytica
IQNNPKESDTF

SEQ ID NO: 2627731 - protein, 5 aa, Entamoeba histolytica
IQNNQ

SEQ ID NO: 2627732 - protein, 6 aa, Entamoeba histolytica
IQNPPT

SEQ ID NO: 2627733 - protein, 14 aa, Entamoeba histolytica
IQNPSTGPSASWTN

SEQ ID NO: 2627734 - protein, 7 aa, Entamoeba histolytica
IQNPTTN

SEQ ID NO: 2627735 - protein, 18 aa, Entamoeba histolytica
IQNPVNDAQTISTNLTPQ

SEQ ID NO: 2627736 - protein, 10 aa, Entamoeba histolytica
IQNQTKQEKA

SEQ ID NO: 2627737 - protein, 6 aa, Entamoeba histolytica
IQNQTQ

SEQ ID NO: 2627738 - protein, 5 aa, Entamoeba histolytica
IQNRN

SEQ ID NO: 2627739 - protein, 10 aa, Entamoeba histolytica
IQNSPPFQTE

SEQ ID NO: 2627740 - protein, 9 aa, Entamoeba histolytica
IQNSQTKKY

SEQ ID NO: 2627741 - protein, 8 aa, Entamoeba histolytica
IQNTPPSS

SEQ ID NO: 2627742 - protein, 10 aa, Entamoeba histolytica
IQNTQEQPYV

SEQ ID NO: 2627743 - protein, 4 aa, Entamoeba histolytica
IQPA

SEQ ID NO: 2627744 - protein, 32 aa, Entamoeba histolytica
IQPANTSKPSEQADLKKGGSDKKKGGKGFCSL

SEQ ID NO: 2627745 - protein, 14 aa, Entamoeba histolytica
IQPDAQPKIKQEPN

SEQ ID NO: 2627746 - protein, 19 aa, Entamoeba histolytica
IQPDGTAIANSNEKRSVIT

SEQ ID NO: 2627747 - protein, 26 aa, Entamoeba histolytica
IQPDGTAIANTNEKRSVITNDGDTAY

SEQ ID NO: 2627748 - protein, 19 aa, Entamoeba histolytica
IQPDNTKCQDSELESSVET

SEQ ID NO: 2627749 - protein, 5 aa, Entamoeba histolytica
IQPGT

SEQ ID NO: 2627750 - protein, 4 aa, Entamoeba histolytica
IQPH

SEQ ID NO: 2627751 - protein, 4 aa, Entamoeba histolytica
IQPI

SEQ ID NO: 2627752 - protein, 4 aa, Entamoeba histolytica
IQPK

SEQ ID NO: 2627753 - protein, 10 aa, Entamoeba histolytica
IQPKDSSLEI

SEQ ID NO: 2627754 - protein, 6 aa, Entamoeba histolytica
IQPKQE

SEQ ID NO: 2627755 - protein, 6 aa, Entamoeba histolytica
IQPKQS

SEQ ID NO: 2627756 - protein, 10 aa, Entamoeba histolytica
IQPKSVEQVE

SEQ ID NO: 2627757 - protein, 9 aa, Entamoeba histolytica
IQPNKQTLQ

SEQ ID NO: 2627758 - protein, 22 aa, Entamoeba histolytica
IQPNNTEDMPELPTGSPLTTPL

SEQ ID NO: 2627759 - protein, 12 aa, Entamoeba histolytica
IQPNRRKTRGFY

SEQ ID NO: 2627760 - protein, 7 aa, Entamoeba histolytica
IQPNRSV

SEQ ID NO: 2627761 - protein, 5 aa, Entamoeba histolytica
IQPPG

SEQ ID NO: 2627762 - protein, 12 aa, Entamoeba histolytica
IQPPQGDELAKK

SEQ ID NO: 2627763 - protein, 6 aa, Entamoeba histolytica
IQPPQT

SEQ ID NO: 2627764 - protein, 12 aa, Entamoeba histolytica
IQPPSDSNIERS

SEQ ID NO: 2627765 - protein, 9 aa, Entamoeba histolytica
IQPPSPEMA

SEQ ID NO: 2627766 - protein, 6 aa, Entamoeba histolytica
IQPPTI

SEQ ID NO: 2627767 - protein, 8 aa, Entamoeba histolytica
IQPQDSIG

SEQ ID NO: 2627768 - protein, 26 aa, Entamoeba histolytica
IQPQPPQTIKKDESVIQNNNTQTNPF

SEQ ID NO: 2627769 - protein, 18 aa, Entamoeba histolytica
IQPRNRQSSTGRRNQASL

SEQ ID NO: 2627770 - protein, 6 aa, Entamoeba histolytica
IQPRRR

SEQ ID NO: 2627771 - protein, 12 aa, Entamoeba histolytica
IQPSNTPNGSLQ

SEQ ID NO: 2627772 - protein, 7 aa, Entamoeba histolytica
IQPSPSW

SEQ ID NO: 2627773 - protein, 7 aa, Entamoeba histolytica
IQPTENI

SEQ ID NO: 2627774 - protein, 5 aa, Entamoeba histolytica
IQPTN

SEQ ID NO: 2627775 - protein, 6 aa, Entamoeba histolytica
IQPTST

SEQ ID NO: 2627776 - protein, 6 aa, Entamoeba histolytica
IQQEGR

SEQ ID NO: 2627777 - protein, 31 aa, Entamoeba histolytica
IQQEINEKEDEIKQKLERNNTEIENKSGELA

SEQ ID NO: 2627778 - protein, 19 aa, Entamoeba histolytica
IQQEKENEITKLNEDKTVI

SEQ ID NO: 2627779 - protein, 58 aa, Entamoeba histolytica
IQQEPEQQEDSEKQQEEEQYDQQDEQYDQQDEQYDQEEEGEYSDEEYDEDDDIAPEEI

SEQ ID NO: 2627780 - protein, 12 aa, Entamoeba histolytica
IQQHEPNNNEVS

SEQ ID NO: 2627781 - protein, 4 aa, Entamoeba histolytica
IQQI

SEQ ID NO: 2627782 - protein, 5 aa, Entamoeba histolytica
IQQKE

SEQ ID NO: 2627783 - protein, 13 aa, Entamoeba histolytica
IQQKKEKKEQKII

SEQ ID NO: 2627784 - protein, 4 aa, Entamoeba histolytica
IQQN

SEQ ID NO: 2627785 - protein, 6 aa, Entamoeba histolytica
IQQNSS

SEQ ID NO: 2627786 - protein, 9 aa, Entamoeba histolytica
IQQPGPVTN

SEQ ID NO: 2627787 - protein, 8 aa, Entamoeba histolytica
IQQPNAPI

SEQ ID NO: 2627788 - protein, 25 aa, Entamoeba histolytica
IQQPQNTQSYQQQPQNIQSYQQPVD

SEQ ID NO: 2627789 - protein, 8 aa, Entamoeba histolytica
IQQPTPRE

SEQ ID NO: 2627790 - protein, 8 aa, Entamoeba histolytica
IQQPTQEV

SEQ ID NO: 2627791 - protein, 4 aa, Entamoeba histolytica
IQQQ

SEQ ID NO: 2627792 - protein, 8 aa, Entamoeba histolytica
IQQQKDPK

SEQ ID NO: 2627793 - protein, 8 aa, Entamoeba histolytica
IQQQPQQQ

SEQ ID NO: 2627794 - protein, 7 aa, Entamoeba histolytica
IQQRQKE

SEQ ID NO: 2627795 - protein, 6 aa, Entamoeba histolytica
IQQRYD

SEQ ID NO: 2627796 - protein, 4 aa, Entamoeba histolytica
IQQS

SEQ ID NO: 2627797 - protein, 5 aa, Entamoeba histolytica
IQQTE

SEQ ID NO: 2627798 - protein, 10 aa, Entamoeba histolytica
IQQTGADENF

SEQ ID NO: 2627799 - protein, 8 aa, Entamoeba histolytica
IQRDGDSS

SEQ ID NO: 2627800 - protein, 7 aa, Entamoeba histolytica
IQRETDL

SEQ ID NO: 2627801 - protein, 35 aa, Entamoeba histolytica
IQRGKKLKKTTVNDRSKPMISKEQQSPTTPHYPTN

SEQ ID NO: 2627802 - protein, 11 aa, Entamoeba histolytica
IQRGKNPPEQR

SEQ ID NO: 2627803 - protein, 7 aa, Entamoeba histolytica
IQRGNNV

SEQ ID NO: 2627804 - protein, 42 aa, Entamoeba histolytica
IQRGTKLKKTTTVDKSAPAIGKSSNSSPSGMGGGMPMGGGNP

SEQ ID NO: 2627805 - protein, 4 aa, Entamoeba histolytica
IQRN

SEQ ID NO: 2627806 - protein, 22 aa, Entamoeba histolytica
IQRRQETEAKKDNNKEEENTIN

SEQ ID NO: 2627807 - protein, 7 aa, Entamoeba histolytica
IQRTQTA

SEQ ID NO: 2627808 - protein, 9 aa, Entamoeba histolytica
IQSAQRTKG

SEQ ID NO: 2627809 - protein, 6 aa, Entamoeba histolytica
IQSDRL

SEQ ID NO: 2627810 - protein, 7 aa, Entamoeba histolytica
IQSEPKE

SEQ ID NO: 2627811 - protein, 10 aa, Entamoeba histolytica
IQSERNSNEV

SEQ ID NO: 2627812 - protein, 4 aa, Entamoeba histolytica
IQSG

SEQ ID NO: 2627813 - protein, 11 aa, Entamoeba histolytica
IQSGDSEVVHS

SEQ ID NO: 2627814 - protein, 9 aa, Entamoeba histolytica
IQSIGKEVN

SEQ ID NO: 2627815 - protein, 6 aa, Entamoeba histolytica
IQSKEY

SEQ ID NO: 2627816 - protein, 9 aa, Entamoeba histolytica
IQSKSEEKY

SEQ ID NO: 2627817 - protein, 6 aa, Entamoeba histolytica
IQSKTI

SEQ ID NO: 2627818 - protein, 7 aa, Entamoeba histolytica
IQSNDQI

SEQ ID NO: 2627819 - protein, 13 aa, Entamoeba histolytica
IQSPITFSNEVNF

SEQ ID NO: 2627820 - protein, 8 aa, Entamoeba histolytica
IQSQETQY

SEQ ID NO: 2627821 - protein, 16 aa, Entamoeba histolytica
IQSQNTNKSIEEEKKL

SEQ ID NO: 2627822 - protein, 19 aa, Entamoeba histolytica
IQSQTDTSNFDDEITQEEV

SEQ ID NO: 2627823 - protein, 36 aa, Entamoeba histolytica
IQSQVSQSQKEKKLKAPRSSDEIKRKTKIPKLSEKT

SEQ ID NO: 2627824 - protein, 8 aa, Entamoeba histolytica
IQSREKEI

SEQ ID NO: 2627825 - protein, 6 aa, Entamoeba histolytica
IQSRQQ

SEQ ID NO: 2627826 - protein, 9 aa, Entamoeba histolytica
IQSSESTTH

SEQ ID NO: 2627827 - protein, 6 aa, Entamoeba histolytica
IQSSPE

SEQ ID NO: 2627828 - protein, 9 aa, Entamoeba histolytica
IQSSSEDVD

SEQ ID NO: 2627829 - protein, 6 aa, Entamoeba histolytica
IQSSYK

SEQ ID NO: 2627830 - protein, 4 aa, Entamoeba histolytica
IQST

SEQ ID NO: 2627831 - protein, 12 aa, Entamoeba histolytica
IQSTDPKKKKLN

SEQ ID NO: 2627832 - protein, 9 aa, Entamoeba histolytica
IQSTNKGLS

SEQ ID NO: 2627833 - protein, 7 aa, Entamoeba histolytica
IQSTNTD

SEQ ID NO: 2627834 - protein, 9 aa, Entamoeba histolytica
IQSTQEDEF

SEQ ID NO: 2627835 - protein, 8 aa, Entamoeba histolytica
IQSTSETF

SEQ ID NO: 2627836 - protein, 5 aa, Entamoeba histolytica
IQTEE

SEQ ID NO: 2627837 - protein, 6 aa, Entamoeba histolytica
IQTGVA

SEQ ID NO: 2627838 - protein, 6 aa, Entamoeba histolytica
IQTKAI

SEQ ID NO: 2627839 - protein, 15 aa, Entamoeba histolytica
IQTKGRVAAELSAGN

SEQ ID NO: 2627840 - protein, 10 aa, Entamoeba histolytica
IQTKSENEVI

SEQ ID NO: 2627841 - protein, 7 aa, Entamoeba histolytica
IQTNETI

SEQ ID NO: 2627842 - protein, 32 aa, Entamoeba histolytica
IQTNPSITQQPQGNNPPTQSYLSSNATTSSFQ

SEQ ID NO: 2627843 - protein, 5 aa, Entamoeba histolytica
IQTNQ

SEQ ID NO: 2627844 - protein, 5 aa, Entamoeba histolytica
IQTPK

SEQ ID NO: 2627845 - protein, 16 aa, Entamoeba histolytica
IQTPMASSPSSNNNDD

SEQ ID NO: 2627846 - protein, 10 aa, Entamoeba histolytica
IQTPTGEEAR

SEQ ID NO: 2627847 - protein, 10 aa, Entamoeba histolytica
IQYEEANEKA

SEQ ID NO: 2627848 - protein, 19 aa, Entamoeba histolytica
IQYKEKPKQESKESDSCVL

SEQ ID NO: 2627849 - protein, 8 aa, Entamoeba histolytica
IQYPPSDC

SEQ ID NO: 2627850 - protein, 11 aa, Entamoeba histolytica
IRAADKAKISQ

SEQ ID NO: 2627851 - protein, 4 aa, Entamoeba histolytica
IRAM

SEQ ID NO: 2627852 - protein, 4 aa, Entamoeba histolytica
IRAP

SEQ ID NO: 2627853 - protein, 9 aa, Entamoeba histolytica
IRASSKQKV

SEQ ID NO: 2627854 - protein, 6 aa, Entamoeba histolytica
IRDDKT

SEQ ID NO: 2627855 - protein, 10 aa, Entamoeba histolytica
IRDDPEQVKR

SEQ ID NO: 2627856 - protein, 31 aa, Entamoeba histolytica
IRDEQTQTNKTCDKKIEPITSEQGEAKCKDI

SEQ ID NO: 2627857 - protein, 8 aa, Entamoeba histolytica
IRDETANK

SEQ ID NO: 2627858 - protein, 25 aa, Entamoeba histolytica
IRDNEEAKAESTTLEESKDTEENNV

SEQ ID NO: 2627859 - protein, 32 aa, Entamoeba histolytica
IRDPKKANKSKPIGESEDDEIKEEEEDDEVGG

SEQ ID NO: 2627860 - protein, 9 aa, Entamoeba histolytica
IREDKPCSI

SEQ ID NO: 2627861 - protein, 23 aa, Entamoeba histolytica
IREDSHDRIERRTTEVQKEKGKQ

SEQ ID NO: 2627862 - protein, 12 aa, Entamoeba histolytica
IREDSSDDDASI

SEQ ID NO: 2627863 - protein, 22 aa, Entamoeba histolytica
IREENKKEINLKPTSKKNTFSL

SEQ ID NO: 2627864 - protein, 10 aa, Entamoeba histolytica
IREETQKELQ

SEQ ID NO: 2627865 - protein, 4 aa, Entamoeba histolytica
IREK

SEQ ID NO: 2627866 - protein, 14 aa, Entamoeba histolytica
IREKTHQKNSKCEA

SEQ ID NO: 2627867 - protein, 6 aa, Entamoeba histolytica
IRERED

SEQ ID NO: 2627868 - protein, 6 aa, Entamoeba histolytica
IRERNA

SEQ ID NO: 2627869 - protein, 10 aa, Entamoeba histolytica
IRETKETKGL

SEQ ID NO: 2627870 - protein, 7 aa, Entamoeba histolytica
IRETPLE

SEQ ID NO: 2627871 - protein, 7 aa, Entamoeba histolytica
IRETTPQ

SEQ ID NO: 2627872 - protein, 6 aa, Entamoeba histolytica
IRGDGE

SEQ ID NO: 2627873 - protein, 4 aa, Entamoeba histolytica
IRGN

SEQ ID NO: 2627874 - protein, 8 aa, Entamoeba histolytica
IRGSQQSI

SEQ ID NO: 2627875 - protein, 12 aa, Entamoeba histolytica
IRGTKYQRKQMT

SEQ ID NO: 2627876 - protein, 11 aa, Entamoeba histolytica
IRGTPGYCSPE

SEQ ID NO: 2627877 - protein, 9 aa, Entamoeba histolytica
IRGTPLSED

SEQ ID NO: 2627878 - protein, 8 aa, Entamoeba histolytica
IRGYSGEL

SEQ ID NO: 2627879 - protein, 37 aa, Entamoeba histolytica
IRIKEKKSNIKEGIKTEKEIIRESKNKIEKQEEEEIS

SEQ ID NO: 2627880 - protein, 9 aa, Entamoeba histolytica
IRKDASGKL

SEQ ID NO: 2627881 - protein, 6 aa, Entamoeba histolytica
IRKEGK

SEQ ID NO: 2627882 - protein, 9 aa, Entamoeba histolytica
IRKENIDNN

SEQ ID NO: 2627883 - protein, 45 aa, Entamoeba histolytica
IRKGNNPQKPKKKFQPPYKKDNIQENKEKQTKINKQKKGDETEDW

SEQ ID NO: 2627884 - protein, 8 aa, Entamoeba histolytica
IRKLPTEI

SEQ ID NO: 2627885 - protein, 14 aa, Entamoeba histolytica
IRKQQKKLKQESKI

SEQ ID NO: 2627886 - protein, 5 aa, Entamoeba histolytica
IRKSS

SEQ ID NO: 2627887 - protein, 4 aa, Entamoeba histolytica
IRKT

SEQ ID NO: 2627888 - protein, 5 aa, Entamoeba histolytica
IRKTI

SEQ ID NO: 2627889 - protein, 8 aa, Entamoeba histolytica
IRKYTNST

SEQ ID NO: 2627890 - protein, 8 aa, Entamoeba histolytica
IRNDTQQE

SEQ ID NO: 2627891 - protein, 4 aa, Entamoeba histolytica
IRNE

SEQ ID NO: 2627892 - protein, 18 aa, Entamoeba histolytica
IRNEKKKEGGEKSYVKTT

SEQ ID NO: 2627893 - protein, 12 aa, Entamoeba histolytica
IRNKKRSIVTQD

SEQ ID NO: 2627894 - protein, 20 aa, Entamoeba histolytica
IRNQAYKEGSKDNICVVVVD

SEQ ID NO: 2627895 - protein, 4 aa, Entamoeba histolytica
IRPD

SEQ ID NO: 2627896 - protein, 5 aa, Entamoeba histolytica
IRPDG

SEQ ID NO: 2627897 - protein, 9 aa, Entamoeba histolytica
IRPISPDPY

SEQ ID NO: 2627898 - protein, 15 aa, Entamoeba histolytica
IRPNRKTGRQAPTKN

SEQ ID NO: 2627899 - protein, 5 aa, Entamoeba histolytica
IRPRA

SEQ ID NO: 2627900 - protein, 4 aa, Entamoeba histolytica
IRPS

SEQ ID NO: 2627901 - protein, 6 aa, Entamoeba histolytica
IRPSGC

SEQ ID NO: 2627902 - protein, 5 aa, Entamoeba histolytica
IRPSL

SEQ ID NO: 2627903 - protein, 8 aa, Entamoeba histolytica
IRPSVSQD

SEQ ID NO: 2627904 - protein, 15 aa, Entamoeba histolytica
IRPTQGDDENKNGGR

SEQ ID NO: 2627905 - protein, 10 aa, Entamoeba histolytica
IRQAESTESK

SEQ ID NO: 2627906 - protein, 9 aa, Entamoeba histolytica
IRQDPTRAK

SEQ ID NO: 2627907 - protein, 4 aa, Entamoeba histolytica
IRQK

SEQ ID NO: 2627908 - protein, 8 aa, Entamoeba histolytica
IRQKDQRI

SEQ ID NO: 2627909 - protein, 9 aa, Entamoeba histolytica
IRQSEDPQG

SEQ ID NO: 2627910 - protein, 9 aa, Entamoeba histolytica
IRQTPNKKH

SEQ ID NO: 2627911 - protein, 11 aa, Entamoeba histolytica
IRQTRRHKDIN

SEQ ID NO: 2627912 - protein, 23 aa, Entamoeba histolytica
IRRKQREDEGISSSSEEEMERDT

SEQ ID NO: 2627913 - protein, 9 aa, Entamoeba histolytica
IRRSTQQKY

SEQ ID NO: 2627914 - protein, 6 aa, Entamoeba histolytica
IRRTKL

SEQ ID NO: 2627915 - protein, 16 aa, Entamoeba histolytica
IRSEKTTKHERFYFNY

SEQ ID NO: 2627916 - protein, 11 aa, Entamoeba histolytica
IRSENKETITE

SEQ ID NO: 2627917 - protein, 22 aa, Entamoeba histolytica
IRSESQNDNIPKLTDTKDNKEI

SEQ ID NO: 2627918 - protein, 7 aa, Entamoeba histolytica
IRSGTNE

SEQ ID NO: 2627919 - protein, 11 aa, Entamoeba histolytica
IRSKDQDTIKK

SEQ ID NO: 2627920 - protein, 6 aa, Entamoeba histolytica
IRSNEI

SEQ ID NO: 2627921 - protein, 12 aa, Entamoeba histolytica
IRSNNQSELNDD

SEQ ID NO: 2627922 - protein, 5 aa, Entamoeba histolytica
IRSNS

SEQ ID NO: 2627923 - protein, 32 aa, Entamoeba histolytica
IRSQSRKPDNHQEDEKAPKKTHSNQKKNELQH

SEQ ID NO: 2627924 - protein, 5 aa, Entamoeba histolytica
IRSSG

SEQ ID NO: 2627925 - protein, 6 aa, Entamoeba histolytica
IRSSKE

SEQ ID NO: 2627926 - protein, 8 aa, Entamoeba histolytica
IRSSSGHI

SEQ ID NO: 2627927 - protein, 16 aa, Entamoeba histolytica
IRSTEENIDSLKTNDE

SEQ ID NO: 2627928 - protein, 18 aa, Entamoeba histolytica
IRTDREDTKFEKDGCQNL

SEQ ID NO: 2627929 - protein, 5 aa, Entamoeba histolytica
IRTEQ

SEQ ID NO: 2627930 - protein, 8 aa, Entamoeba histolytica
IRTNEKEL

SEQ ID NO: 2627931 - protein, 6 aa, Entamoeba histolytica
IRTPDN

SEQ ID NO: 2627932 - protein, 7 aa, Entamoeba histolytica
IRTPKSS

SEQ ID NO: 2627933 - protein, 8 aa, Entamoeba histolytica
IRTQNNGL

SEQ ID NO: 2627934 - protein, 5 aa, Entamoeba histolytica
IRTRA

SEQ ID NO: 2627935 - protein, 70 aa, Entamoeba histolytica
IRTRDNEDNIQKNIQNDEINKENEETKKIKETKWHKSNEIQQKQMSTIDNDITKEGNGEQRKDISGREIK

SEQ ID NO: 2627936 - protein, 61 aa, Entamoeba histolytica
IRTRKGDIHKIGKKSDEHNKEEKENTGRSEDDTIEEDEGKKKTRINEKKKEKNKRTNKENM

SEQ ID NO: 2627937 - protein, 61 aa, Entamoeba histolytica
IRTRKGDIHKIGKKSDEHNKEEKENTGSGEDDTIEEDEGKKKTRINEKKKEKNKRTNKENM

SEQ ID NO: 2627938 - protein, 61 aa, Entamoeba histolytica
IRTRKGDIHKIGKKSEEHHKEEKENTGSGEDDTIEEDEGKKKTRINEKKKEKNKRTNKENM

SEQ ID NO: 2627939 - protein, 24 aa, Entamoeba histolytica
IRTSGGYGITKSYAEEQKRSVSEK

SEQ ID NO: 2627940 - protein, 8 aa, Entamoeba histolytica
IRYDGSVT

SEQ ID NO: 2627941 - protein, 5 aa, Entamoeba histolytica
ISADD

SEQ ID NO: 2627942 - protein, 9 aa, Entamoeba histolytica
ISADPDATP

SEQ ID NO: 2627943 - protein, 7 aa, Entamoeba histolytica
ISAEDQN

SEQ ID NO: 2627944 - protein, 8 aa, Entamoeba histolytica
ISAGAPEN

SEQ ID NO: 2627945 - protein, 13 aa, Entamoeba histolytica
ISAGSTSVGIKAK

SEQ ID NO: 2627946 - protein, 4 aa, Entamoeba histolytica
ISAK

SEQ ID NO: 2627947 - protein, 9 aa, Entamoeba histolytica
ISAKDSQLM

SEQ ID NO: 2627948 - protein, 15 aa, Entamoeba histolytica
ISAKHSTQIKEKQEL

SEQ ID NO: 2627949 - protein, 13 aa, Entamoeba histolytica
ISAQDLDGAIAGS

SEQ ID NO: 2627950 - protein, 14 aa, Entamoeba histolytica
ISASEENKEENATN

SEQ ID NO: 2627951 - protein, 9 aa, Entamoeba histolytica
ISASKKYPK

SEQ ID NO: 2627952 - protein, 5 aa, Entamoeba histolytica
ISASN

SEQ ID NO: 2627953 - protein, 8 aa, Entamoeba histolytica
ISASNGFS
